United States Patent 12,624,385 (RIBOREGULATORS AND METHODS OF USE THEREOF) - sequence listing, part 5

SEQ ID NO: 67522 - DNA, 103 bp, Artificial Sequence
  Synthetic Polynucleotide
taatacgactcactataggggatatttaaaacataaatcagacgacgactaacagaggagaagtcgtatgctgatttataacctggcggcagcgcaaaagatg

SEQ ID NO: 67523 - DNA, 103 bp, Artificial Sequence
  Synthetic Polynucleotide
taatacgactcactatagggcggttgatatttaaaacataaatcagacgaaacagaggagatcgtctatgttatgttttaacctggcggcagcgcaaaagatg

SEQ ID NO: 67524 - DNA, 103 bp, Artificial Sequence
  Synthetic Polynucleotide
taatacgactcactatagggatttgcggttgatatttaaaacataaatcaaacagaggagatgatttatgttttaaataaacctggcggcagcgcaaaagatg

SEQ ID NO: 67525 - DNA, 103 bp, Artificial Sequence
  Synthetic Polynucleotide
taatacgactcactatagggagttgatttgcggttgatatttaaaacataaacagaggagatatgttatgaatatcaacaacctggcggcagcgcaaaagatg

SEQ ID NO: 67526 - DNA, 103 bp, Artificial Sequence
  Synthetic Polynucleotide
taatacgactcactatagggccgatccttcagaaagagtgtttaaaaaaaaacagaggagattttttatgacactctttaacctggcggcagcgcaaaagatg

SEQ ID NO: 67527 - DNA, 103 bp, Artificial Sequence
  Synthetic Polynucleotide
taatacgactcactatagggttatgagttgatttgcggttgatatttaaaaacagaggagatttaaaatgcaaccgcaaaacctggcggcagcgcaaaagatg

SEQ ID NO: 67528 - DNA, 103 bp, Artificial Sequence
  Synthetic Polynucleotide
taatacgactcactataggggtattttatgagttgatttgcggttgatataacagaggagaatatcaatggcaaatcaaaacctggcggcagcgcaaaagatg

SEQ ID NO: 67529 - DNA, 103 bp, Artificial Sequence
  Synthetic Polynucleotide
taatacgactcactatagggctcttgtattttatgagttgatttgcggttaacagaggagaaaccgcatgtcaactcataacctggcggcagcgcaaaagatg

SEQ ID NO: 67530 - DNA, 103 bp, Artificial Sequence
  Synthetic Polynucleotide
taatacgactcactatagggtcattctcttgtattttatgagttgatttgaacagaggagacaaatcatgtcataaaataacctggcggcagcgcaaaagatg

SEQ ID NO: 67531 - DNA, 103 bp, Artificial Sequence
  Synthetic Polynucleotide
taatacgactcactatagggatatttcattctcttgtattttatgagttgaacagaggagacaactcatgaaatacaagaacctggcggcagcgcaaaagatg

SEQ ID NO: 67532 - DNA, 103 bp, Artificial Sequence
  Synthetic Polynucleotide
taatacgactcactatagggtgtatatatttcattctcttgtattttatgaacagaggagacataaaatgcaagagaataacctggcggcagcgcaaaagatg

SEQ ID NO: 67533 - DNA, 103 bp, Artificial Sequence
  Synthetic Polynucleotide
taatacgactcactatagggaaatatgtatatatttcattctcttgtattaacagaggagaaatacaatggaatgaaataacctggcggcagcgcaaaagatg

SEQ ID NO: 67534 - DNA, 103 bp, Artificial Sequence
  Synthetic Polynucleotide
taatacgactcactatagggaactaaaatatgtatatatttcattctcttaacagaggagaaagagaatgaaatatataaacctggcggcagcgcaaaagatg

SEQ ID NO: 67535 - DNA, 103 bp, Artificial Sequence
  Synthetic Polynucleotide
taatacgactcactataggggcaataactaaaatatgtatatatttcattaacagaggagaaatgaaatgtatacatataacctggcggcagcgcaaaagatg

SEQ ID NO: 67536 - DNA, 103 bp, Artificial Sequence
  Synthetic Polynucleotide
taatacgactcactatagggatattgcaataactaaaatatgtatatattaacagaggagaaatataatgatattttagaacctggcggcagcgcaaaagatg

SEQ ID NO: 67537 - DNA, 103 bp, Artificial Sequence
  Synthetic Polynucleotide
taatacgactcactataggggtctaccgatccttcagaaagagtgtttaaaacagaggagattaaacatgctttctgaaaacctggcggcagcgcaaaagatg

SEQ ID NO: 67538 - DNA, 103 bp, Artificial Sequence
  Synthetic Polynucleotide
taatacgactcactatagggggtctatattgcaataactaaaatatgtataacagaggagaatacatatgttagttattaacctggcggcagcgcaaaagatg

SEQ ID NO: 67539 - DNA, 103 bp, Artificial Sequence
  Synthetic Polynucleotide
taatacgactcactatagggagtatggtctatattgcaataactaaaataaacagaggagatattttatgtattgcaataacctggcggcagcgcaaaagatg

SEQ ID NO: 67540 - DNA, 103 bp, Artificial Sequence
  Synthetic Polynucleotide
taatacgactcactataggggtagaagtatggtctatattgcaataactaaacagaggagatagttaatgcaatatagaaacctggcggcagcgcaaaagatg

SEQ ID NO: 67541 - DNA, 103 bp, Artificial Sequence
  Synthetic Polynucleotide
taatacgactcactataggggttctgtagaagtatggtctatattgcaataacagaggagaattgcaatgtagaccataaacctggcggcagcgcaaaagatg

SEQ ID NO: 67542 - DNA, 103 bp, Artificial Sequence
  Synthetic Polynucleotide
taatacgactcactatagggatcaagttctgtagaagtatggtctatattaacagaggagaaatataatgcatacttctaacctggcggcagcgcaaaagatg

SEQ ID NO: 67543 - DNA, 103 bp, Artificial Sequence
  Synthetic Polynucleotide
taatacgactcactatagggacaaaatcaagttctgtagaagtatggtctaacagaggagaagaccaatgttctacagaaacctggcggcagcgcaaaagatg

SEQ ID NO: 67544 - DNA, 103 bp, Artificial Sequence
  Synthetic Polynucleotide
taatacgactcactatagggtaactacaaaatcaagttctgtagaagtataacagaggagaatacttatgcagaacttgaacctggcggcagcgcaaaagatg

SEQ ID NO: 67545 - DNA, 103 bp, Artificial Sequence
  Synthetic Polynucleotide
taatacgactcactataggggtttttaactacaaaatcaagttctgtagaaacagaggagatctacaatgcttgattttaacctggcggcagcgcaaaagatg

SEQ ID NO: 67546 - DNA, 103 bp, Artificial Sequence
  Synthetic Polynucleotide
taatacgactcactatagggtcatagtttttaactacaaaatcaagttctaacagaggagaagaactatgttttgtagtaacctggcggcagcgcaaaagatg

SEQ ID NO: 67547 - DNA, 103 bp, Artificial Sequence
  Synthetic Polynucleotide
taatacgactcactatagggttagatcatagtttttaactacaaaatcaaaacagaggagattgattatgtagttaaaaaacctggcggcagcgcaaaagatg

SEQ ID NO: 67548 - DNA, 103 bp, Artificial Sequence
  Synthetic Polynucleotide
taatacgactcactatagggttggcgtctaccgatccttcagaaagagtgaacagaggagacactctatgtgaaggatcaacctggcggcagcgcaaaagatg

SEQ ID NO: 67549 - DNA, 103 bp, Artificial Sequence
  Synthetic Polynucleotide
taatacgactcactatagggtctgtttagatcatagtttttaactacaaaaacagaggagatttgtaatgaaaaactataacctggcggcagcgcaaaagatg

SEQ ID NO: 67550 - DNA, 103 bp, Artificial Sequence
  Synthetic Polynucleotide
taatacgactcactatagggtgtcgtctgtttagatcatagtttttaactaacagaggagaagttaaatgctatgatctaacctggcggcagcgcaaaagatg

SEQ ID NO: 67551 - DNA, 103 bp, Artificial Sequence
  Synthetic Polynucleotide
taatacgactcactatagggcaggctgtcgtctgtttagatcatagttttaacagaggagaaaaactatgatctaaacaaacctggcggcagcgcaaaagatg

SEQ ID NO: 67552 - DNA, 103 bp, Artificial Sequence
  Synthetic Polynucleotide
taatacgactcactatagggagttacaggctgtcgtctgtttagatcataaacagaggagatatgatatgaacagacgaaacctggcggcagcgcaaaagatg

SEQ ID NO: 67553 - DNA, 103 bp, Artificial Sequence
  Synthetic Polynucleotide
taatacgactcactatagggtacccagttacaggctgtcgtctgtttagaaacagaggagatctaaaatgacgacagccaacctggcggcagcgcaaaagatg

SEQ ID NO: 67554 - DNA, 103 bp, Artificial Sequence
  Synthetic Polynucleotide
taatacgactcactatagggcggtatacccagttacaggctgtcgtctgtaacagaggagaacagacatgagcctgtaaaacctggcggcagcgcaaaagatg

SEQ ID NO: 67555 - DNA, 103 bp, Artificial Sequence
  Synthetic Polynucleotide
taatacgactcactatagggtagtgcggtatacccagttacaggctgtcgaacagaggagacgacagatggtaactgggaacctggcggcagcgcaaaagatg

SEQ ID NO: 67556 - DNA, 103 bp, Artificial Sequence
  Synthetic Polynucleotide
taatacgactcactatagggcagtgtagtgcggtatacccagttacaggcaacagaggagagcctgtatgtgggtatacaacctggcggcagcgcaaaagatg

SEQ ID NO: 67557 - DNA, 103 bp, Artificial Sequence
  Synthetic Polynucleotide
taatacgactcactatagggaatagcagtgtagtgcggtatacccagttaaacagaggagataactgatgataccgcacaacctggcggcagcgcaaaagatg

SEQ ID NO: 67558 - DNA, 103 bp, Artificial Sequence
  Synthetic Polynucleotide
taatacgactcactatagggatacaaatagcagtgtagtgcggtatacccaacagaggagagggtatatggcactacacaacctggcggcagcgcaaaagatg

SEQ ID NO: 67559 - DNA, 103 bp, Artificial Sequence
  Synthetic Polynucleotide
taatacgactcactatagggcgttgttggcgtctaccgatccttcagaaaaacagaggagatttctgatggatcggtagaacctggcggcagcgcaaaagatg

SEQ ID NO: 67560 - DNA, 103 bp, Artificial Sequence
  Synthetic Polynucleotide
taatacgactcactatagggttattatacaaatagcagtgtagtgcggtaaacagaggagataccgcatgacactgctaaacctggcggcagcgcaaaagatg

SEQ ID NO: 67561 - DNA, 103 bp, Artificial Sequence
  Synthetic Polynucleotide
taatacgactcactatagggagtaattattatacaaatagcagtgtagtgaacagaggagacactacatggctatttgtaacctggcggcagcgcaaaagatg

SEQ ID NO: 67562 - DNA, 103 bp, Artificial Sequence
  Synthetic Polynucleotide
taatacgactcactatagggtgtaaagtaattattatacaaatagcagtgaacagaggagacactgcatgttgtataataacctggcggcagcgcaaaagatg

SEQ ID NO: 67563 - DNA, 103 bp, Artificial Sequence
  Synthetic Polynucleotide
taatacgactcactatagggtcgtttgtaaagtaattattatacaaatagaacagaggagactatttatgtaataattaaacctggcggcagcgcaaaagatg

SEQ ID NO: 67564 - DNA, 103 bp, Artificial Sequence
  Synthetic Polynucleotide
taatacgactcactataggggtacatcgtttgtaaagtaattattatacaaacagaggagatgtataatgattactttaaacctggcggcagcgcaaaagatg

SEQ ID NO: 67565 - DNA, 103 bp, Artificial Sequence
  Synthetic Polynucleotide
taatacgactcactatagggcttcagtacatcgtttgtaaagtaattattaacagaggagaaataatatgtttacaaacaacctggcggcagcgcaaaagatg

SEQ ID NO: 67566 - DNA, 103 bp, Artificial Sequence
  Synthetic Polynucleotide
taatacgactcactatagggaataccttcagtacatcgtttgtaaagtaaaacagaggagattacttatgaaacgatgtaacctggcggcagcgcaaaagatg

SEQ ID NO: 67567 - DNA, 103 bp, Artificial Sequence
  Synthetic Polynucleotide
taatacgactcactatagggttaataataccttcagtacatcgtttgtaaaacagaggagattacaaatgatgtactgaaacctggcggcagcgcaaaagatg

SEQ ID NO: 67568 - DNA, 103 bp, Artificial Sequence
  Synthetic Polynucleotide
taatacgactcactatagggatgatttaataataccttcagtacatcgttaacagaggagaaacgatatgctgaaggtaaacctggcggcagcgcaaaagatg

SEQ ID NO: 67569 - DNA, 103 bp, Artificial Sequence
  Synthetic Polynucleotide
taatacgactcactatagggactccatgatttaataataccttcagtacaaacagaggagatgtactatgggtattattaacctggcggcagcgcaaaagatg

SEQ ID NO: 67570 - DNA, 103 bp, Artificial Sequence
  Synthetic Polynucleotide
taatacgactcactataggggctgtaatagataatactatagatttagaaaacagaggagattctaaatgtatagtattaacctggcggcagcgcaaaagatg

SEQ ID NO: 67571 - DNA, 103 bp, Artificial Sequence
  Synthetic Polynucleotide
taatacgactcactatagggtggtccgttgttggcgtctaccgatccttcaacagaggagagaaggaatggtagacgccaacctggcggcagcgcaaaagatg

SEQ ID NO: 67572 - DNA, 103 bp, Artificial Sequence
  Synthetic Polynucleotide
taatacgactcactatagggcatccactccatgatttaataataccttcaaacagaggagatgaaggatgtattaaatcaacctggcggcagcgcaaaagatg

SEQ ID NO: 67573 - DNA, 103 bp, Artificial Sequence
  Synthetic Polynucleotide
taatacgactcactatagggcgttacatccactccatgatttaataatacaacagaggagagtattaatgaatcatggaaacctggcggcagcgcaaaagatg

SEQ ID NO: 67574 - DNA, 103 bp, Artificial Sequence
  Synthetic Polynucleotide
taatacgactcactatagggtttatcgttacatccactccatgatttaataacagaggagaattaaaatgtggagtggaaacctggcggcagcgcaaaagatg

SEQ ID NO: 67575 - DNA, 103 bp, Artificial Sequence
  Synthetic Polynucleotide
taatacgactcactatagggtgggttttatcgttacatccactccatgataacagaggagaatcatgatgtggatgtaaaacctggcggcagcgcaaaagatg

SEQ ID NO: 67576 - DNA, 103 bp, Artificial Sequence
  Synthetic Polynucleotide
taatacgactcactataggggctactgggttttatcgttacatccactccaacagaggagaggagtgatggtaacgataaacctggcggcagcgcaaaagatg

SEQ ID NO: 67577 - DNA, 103 bp, Artificial Sequence
  Synthetic Polynucleotide
taatacgactcactatagggtgtccgctactgggttttatcgttacatccaacagaggagaggatgtatggataaaaccaacctggcggcagcgcaaaagatg

SEQ ID NO: 67578 - DNA, 103 bp, Artificial Sequence
  Synthetic Polynucleotide
taatacgactcactataggggcatatgtccgctactgggttttatcgttaaacagaggagataacgaatgaacccagtaaacctggcggcagcgcaaaagatg

SEQ ID NO: 67579 - DNA, 103 bp, Artificial Sequence
  Synthetic Polynucleotide
taatacgactcactatagggaataggcatatgtccgctactgggttttataacagaggagaataaaaatgagtagcggaaacctggcggcagcgcaaaagatg

SEQ ID NO: 67580 - DNA, 103 bp, Artificial Sequence
  Synthetic Polynucleotide
taatacgactcactatagggatataaataggcatatgtccgctactgggtaacagaggagaacccagatgcggacatataacctggcggcagcgcaaaagatg

SEQ ID NO: 67581 - DNA, 103 bp, Artificial Sequence
  Synthetic Polynucleotide
taatacgactcactataggggcaatatataaataggcatatgtccgctacaacagaggagagtagcgatgatatgcctaaacctggcggcagcgcaaaagatg

SEQ ID NO: 67582 - DNA, 103 bp, Artificial Sequence
  Synthetic Polynucleotide
taatacgactcactatagggggatgtggtccgttgttggcgtctaccgataacagaggagaatcggtatgcgccaacaaaacctggcggcagcgcaaaagatg

SEQ ID NO: 67583 - DNA, 103 bp, Artificial Sequence
  Synthetic Polynucleotide
taatacgactcactatagggagtaagcaatatataaataggcatatgtccaacagaggagaggacatatgcctatttataacctggcggcagcgcaaaagatg

SEQ ID NO: 67584 - DNA, 103 bp, Artificial Sequence
  Synthetic Polynucleotide
taatacgactcactatagggcatctagtaagcaatatataaataggcataaacagaggagatatgccatgttatatattaacctggcggcagcgcaaaagatg

SEQ ID NO: 67585 - DNA, 103 bp, Artificial Sequence
  Synthetic Polynucleotide
taatacgactcactatagggtgcaacatctagtaagcaatatataaatagaacagaggagactatttatgtattgcttaaacctggcggcagcgcaaaagatg

SEQ ID NO: 67586 - DNA, 103 bp, Artificial Sequence
  Synthetic Polynucleotide
taatacgactcactatagggaatattgcaacatctagtaagcaatatataaacagaggagatatataatgcttactagaaacctggcggcagcgcaaaagatg

SEQ ID NO: 67587 - DNA, 103 bp, Artificial Sequence
  Synthetic Polynucleotide
taatacgactcactatagggtgtgaaatattgcaacatctagtaagcaataacagaggagaattgctatgtagatgttgaacctggcggcagcgcaaaagatg

SEQ ID NO: 67588 - DNA, 103 bp, Artificial Sequence
  Synthetic Polynucleotide
taatacgactcactatagggcattgtgtgaaatattgcaacatctagtaaaacagaggagattactaatggttgcaataaacctggcggcagcgcaaaagatg

SEQ ID NO: 67589 - DNA, 103 bp, Artificial Sequence
  Synthetic Polynucleotide
taatacgactcactatagggcactacattgtgtgaaatattgcaacatctaacagaggagaagatgtatgaatatttcaaacctggcggcagcgcaaaagatg

SEQ ID NO: 67590 - DNA, 103 bp, Artificial Sequence
  Synthetic Polynucleotide
taatacgactcactatagggtctatcactacattgtgtgaaatattgcaaaacagaggagattgcaaatgttcacacaaaacctggcggcagcgcaaaagatg

SEQ ID NO: 67591 - DNA, 103 bp, Artificial Sequence
  Synthetic Polynucleotide
taatacgactcactatagggtcatatctatcactacattgtgtgaaatataacagaggagaatatttatgacaatgtagaacctggcggcagcgcaaaagatg

SEQ ID NO: 67592 - DNA, 103 bp, Artificial Sequence
  Synthetic Polynucleotide
taatacgactcactataggggtttatcatatctatcactacattgtgtgaaacagaggagatcacacatggtagtgataaacctggcggcagcgcaaaagatg

SEQ ID NO: 67593 - DNA, 103 bp, Artificial Sequence
  Synthetic Polynucleotide
taatacgactcactatagggaagaaggatgtggtccgttgttggcgtctaaacagaggagatagacgatgacaacggacaacctggcggcagcgcaaaagatg

SEQ ID NO: 67594 - DNA, 103 bp, Artificial Sequence
  Synthetic Polynucleotide
taatacgactcactatagggtctttgtttatcatatctatcactacattgaacagaggagacaatgtatggatagatataacctggcggcagcgcaaaagatg

SEQ ID NO: 67595 - DNA, 103 bp, Artificial Sequence
  Synthetic Polynucleotide
taatacgactcactatagggttttatctttgtttatcatatctatcactaaacagaggagatagtgaatgatatgataaaacctggcggcagcgcaaaagatg

SEQ ID NO: 67596 - DNA, 103 bp, Artificial Sequence
  Synthetic Polynucleotide
taatacgactcactataggggtgggttttatctttgtttatcatatctataacagaggagaatagatatgataaacaaaaacctggcggcagcgcaaaagatg

SEQ ID NO: 67597 - DNA, 103 bp, Artificial Sequence
  Synthetic Polynucleotide
taatacgactcactataggggataagtgggttttatctttgtttatcataaacagaggagatatgatatgcaaagataaaacctggcggcagcgcaaaagatg

SEQ ID NO: 67598 - DNA, 103 bp, Artificial Sequence
  Synthetic Polynucleotide
taatacgactcactatagggtatgcgataagtgggttttatctttgtttaaacagaggagataaacaatgataaaacccaacctggcggcagcgcaaaagatg

SEQ ID NO: 67599 - DNA, 103 bp, Artificial Sequence
  Synthetic Polynucleotide
taatacgactcactataggggtctttatgcgataagtgggttttatctttaacagaggagaaaagatatgacccacttaaacctggcggcagcgcaaaagatg

SEQ ID NO: 67600 - DNA, 103 bp, Artificial Sequence
  Synthetic Polynucleotide
taatacgactcactataggggaatagtctttatgcgataagtgggttttaaacagaggagataaaacatgcttatcgcaaacctggcggcagcgcaaaagatg

SEQ ID NO: 67601 - DNA, 103 bp, Artificial Sequence
  Synthetic Polynucleotide
taatacgactcactatagggggttggaatagtctttatgcgataagtgggaacagaggagacccactatgcgcataaagaacctggcggcagcgcaaaagatg

SEQ ID NO: 67602 - DNA, 103 bp, Artificial Sequence
  Synthetic Polynucleotide
taatacgactcactatagggtagtaggttggaatagtctttatgcgataaaacagaggagattatcgatgaaagactataacctggcggcagcgcaaaagatg

SEQ ID NO: 67603 - DNA, 103 bp, Artificial Sequence
  Synthetic Polynucleotide
taatacgactcactatagggtctagtagtaggttggaatagtctttatgcaacagaggagagcataaatgctattccaaaacctggcggcagcgcaaaagatg

SEQ ID NO: 67604 - DNA, 103 bp, Artificial Sequence
  Synthetic Polynucleotide
taatacgactcactatagggtgatgaagaaggatgtggtccgttgttggcaacagaggagagccaacatgggaccacataacctggcggcagcgcaaaagatg

SEQ ID NO: 67605 - DNA, 103 bp, Artificial Sequence
  Synthetic Polynucleotide
taatacgactcactatagggtatactctagtagtaggttggaatagtcttaacagaggagaaagactatgccaacctacaacctggcggcagcgcaaaagatg

SEQ ID NO: 67606 - DNA, 103 bp, Artificial Sequence
  Synthetic Polynucleotide
taatacgactcactatagggttttatatactctagtagtaggttggaataaacagaggagatattccatgctactactaaacctggcggcagcgcaaaagatg

SEQ ID NO: 67607 - DNA, 103 bp, Artificial Sequence
  Synthetic Polynucleotide
taatacgactcactatagggcgagattttatatactctagtagtaggttgaacagaggagacaacctatgactagagtaaacctggcggcagcgcaaaagatg

SEQ ID NO: 67608 - DNA, 103 bp, Artificial Sequence
  Synthetic Polynucleotide
taatacgactcactatagggtgtaacgagattttatatactctagtagtaaacagaggagatactacatgagtatataaaacctggcggcagcgcaaaagatg

SEQ ID NO: 67609 - DNA, 103 bp, Artificial Sequence
  Synthetic Polynucleotide
taatacgactcactatagggtagcatgtaacgagattttatatactctagaacagaggagactagagatgataaaatctaacctggcggcagcgcaaaagatg

SEQ ID NO: 67610 - DNA, 103 bp, Artificial Sequence
  Synthetic Polynucleotide
taatacgactcactatagggttcaatagcatgtaacgagattttatatacaacagaggagagtatatatgatctcgttaaacctggcggcagcgcaaaagatg

SEQ ID NO: 67611 - DNA, 103 bp, Artificial Sequence
  Synthetic Polynucleotide
taatacgactcactatagggcttccttcaatagcatgtaacgagattttaaacagaggagataaaatatggttacatgcaacctggcggcagcgcaaaagatg

SEQ ID NO: 67612 - DNA, 103 bp, Artificial Sequence
  Synthetic Polynucleotide
taatacgactcactatagggatcctcttccttcaatagcatgtaacgagaaacagaggagatctcgtatgatgctattgaacctggcggcagcgcaaaagatg

SEQ ID NO: 67613 - DNA, 103 bp, Artificial Sequence
  Synthetic Polynucleotide
taatacgactcactatagggtcgatatcctcttccttcaatagcatgtaaaacagaggagattacatatgattgaaggaaacctggcggcagcgcaaaagatg

SEQ ID NO: 67614 - DNA, 103 bp, Artificial Sequence
  Synthetic Polynucleotide
taatacgactcactatagggtctcatcgatatcctcttccttcaatagcaaacagaggagatgctatatgaggaagaggaacctggcggcagcgcaaaagatg

SEQ ID NO: 67615 - DNA, 103 bp, Artificial Sequence
  Synthetic Polynucleotide
taatacgactcactatagggtcggttgatgaagaaggatgtggtccgttgaacagaggagacaacggatgacatccttcaacctggcggcagcgcaaaagatg

SEQ ID NO: 67616 - DNA, 103 bp, Artificial Sequence
  Synthetic Polynucleotide
taatacgactcactatagggtatgttctcatcgatatcctcttccttcaaaacagaggagattgaagatggaggatatcaacctggcggcagcgcaaaagatg

SEQ ID NO: 67617 - DNA, 103 bp, Artificial Sequence
  Synthetic Polynucleotide
taatacgactcactataggggatactatgttctcatcgatatcctcttccaacagaggagaggaagaatgtatcgatgaaacctggcggcagcgcaaaagatg

SEQ ID NO: 67618 - DNA, 103 bp, Artificial Sequence
  Synthetic Polynucleotide
taatacgactcactatagggaagttgatactatgttctcatcgatatcctaacagaggagaaggataatgatgagaacaaacctggcggcagcgcaaaagatg

SEQ ID NO: 67619 - DNA, 103 bp, Artificial Sequence
  Synthetic Polynucleotide
taatacgactcactatagggtaataaagttgatactatgttctcatcgataacagaggagaatcgatatgaacatagtaaacctggcggcagcgcaaaagatg

SEQ ID NO: 67620 - DNA, 103 bp, Artificial Sequence
  Synthetic Polynucleotide
taatacgactcactatagggttatctaataaagttgatactatgttctcaaacagaggagatgagaaatgagtatcaacaacctggcggcagcgcaaaagatg

SEQ ID NO: 67621 - DNA, 103 bp, Artificial Sequence
  Synthetic Polynucleotide
taatacgactcactatagggttcccttatctaataaagttgatactatgtaacagaggagaacatagatgcaactttataacctggcggcagcgcaaaagatg

SEQ ID NO: 67622 - DNA, 103 bp, Artificial Sequence
  Synthetic Polynucleotide
taatacgactcactatagggatcgattcccttatctaataaagttgatacaacagaggagagtatcaatgttattagataacctggcggcagcgcaaaagatg

SEQ ID NO: 67623 - DNA, 103 bp, Artificial Sequence
  Synthetic Polynucleotide
taatacgactcactatagggttaggatcgattcccttatctaataaagttaacagaggagaaactttatgagataagggaacctggcggcagcgcaaaagatg

SEQ ID NO: 67624 - DNA, 103 bp, Artificial Sequence
  Synthetic Polynucleotide
taatacgactcactatagggtaaagttaggatcgattcccttatctaataaacagaggagatattagatgagggaatcgaacctggcggcagcgcaaaagatg

SEQ ID NO: 67625 - DNA, 103 bp, Artificial Sequence
  Synthetic Polynucleotide
taatacgactcactatagggttgtttaaagttaggatcgattcccttatcaacagaggagagataagatgatcgatcctaacctggcggcagcgcaaaagatg

SEQ ID NO: 67626 - DNA, 103 bp, Artificial Sequence
  Synthetic Polynucleotide
taatacgactcactatagggacaactcggttgatgaagaaggatgtggtcaacagaggagagaccacatgcttcttcataacctggcggcagcgcaaaagatg

SEQ ID NO: 67627 - DNA, 103 bp, Artificial Sequence
  Synthetic Polynucleotide
taatacgactcactatagggccgtcttgtttaaagttaggatcgattcccaacagaggagagggaatatgtcctaacttaacctggcggcagcgcaaaagatg

SEQ ID NO: 67628 - DNA, 103 bp, Artificial Sequence
  Synthetic Polynucleotide
taatacgactcactatagggtatatccgtcttgtttaaagttaggatcgaaacagaggagatcgatcatgactttaaacaacctggcggcagcgcaaaagatg

SEQ ID NO: 67629 - DNA, 103 bp, Artificial Sequence
  Synthetic Polynucleotide
taatacgactcactatagggtgctgtatatccgtcttgtttaaagttaggaacagaggagacctaacatgaaacaagacaacctggcggcagcgcaaaagatg

SEQ ID NO: 67630 - DNA, 103 bp, Artificial Sequence
  Synthetic Polynucleotide
taatacgactcactatagggtgtaatgctgtatatccgtcttgtttaaagaacagaggagactttaaatgagacggataaacctggcggcagcgcaaaagatg

SEQ ID NO: 67631 - DNA, 103 bp, Artificial Sequence
  Synthetic Polynucleotide
taatacgactcactatagggaataatgtaatgctgtatatccgtcttgttaacagaggagaaacaagatggatatacagaacctggcggcagcgcaaaagatg

SEQ ID NO: 67632 - DNA, 103 bp, Artificial Sequence
  Synthetic Polynucleotide
taatacgactcactatagggataataataatgtaatgctgtatatccgtcaacagaggagagacggaatgacagcattaaacctggcggcagcgcaaaagatg

SEQ ID NO: 67633 - DNA, 103 bp, Artificial Sequence
  Synthetic Polynucleotide
taatacgactcactatagggcacaaataataataatgtaatgctgtatataacagaggagaatatacatgattacattaaacctggcggcagcgcaaaagatg

SEQ ID NO: 67634 - DNA, 103 bp, Artificial Sequence
  Synthetic Polynucleotide
taatacgactcactatagggcaagacacaaataataataatgtaatgctgaacagaggagacagcatatgattattattaacctggcggcagcgcaaaagatg

SEQ ID NO: 67635 - DNA, 103 bp, Artificial Sequence
  Synthetic Polynucleotide
taatacgactcactataggggtgtgcaagacacaaataataataatgtaaaacagaggagattacatatgtattatttgaacctggcggcagcgcaaaagatg

SEQ ID NO: 67636 - DNA, 103 bp, Artificial Sequence
  Synthetic Polynucleotide
taatacgactcactatagggtaaacgtgtgcaagacacaaataataataaaacagaggagattattaatgtttgtgtctaacctggcggcagcgcaaaagatg

SEQ ID NO: 67637 - DNA, 103 bp, Artificial Sequence
  Synthetic Polynucleotide
taatacgactcactataggggattaacaactcggttgatgaagaaggatgaacagaggagacatcctatgtcatcaaccaacctggcggcagcgcaaaagatg

SEQ ID NO: 67638 - DNA, 103 bp, Artificial Sequence
  Synthetic Polynucleotide
taatacgactcactataggggtttataaacgtgtgcaagacacaaataataacagaggagaattattatggtcttgcacaacctggcggcagcgcaaaagatg

SEQ ID NO: 67639 - DNA, 103 bp, Artificial Sequence
  Synthetic Polynucleotide
taatacgactcactataggggcctggtttataaacgtgtgcaagacacaaaacagaggagattgtgtatggcacacgttaacctggcggcagcgcaaaagatg

SEQ ID NO: 67640 - DNA, 103 bp, Artificial Sequence
  Synthetic Polynucleotide
taatacgactcactatagggcactcgcctggtttataaacgtgtgcaagaaacagaggagatcttgcatgcgtttataaaacctggcggcagcgcaaaagatg

SEQ ID NO: 67641 - DNA, 103 bp, Artificial Sequence
  Synthetic Polynucleotide
taatacgactcactatagggttctacactcgcctggtttataaacgtgtgaacagaggagacacacgatgataaaccagaacctggcggcagcgcaaaagatg

SEQ ID NO: 67642 - DNA, 103 bp, Artificial Sequence
  Synthetic Polynucleotide
taatacgactcactatagggcggttttctacactcgcctggtttataaacaacagaggagagtttatatgccaggcgagaacctggcggcagcgcaaaagatg

SEQ ID NO: 67643 - DNA, 103 bp, Artificial Sequence
  Synthetic Polynucleotide
taatacgactcactataggggttatcggttttctacactcgcctggtttaaacagaggagataaaccatgcgagtgtagaacctggcggcagcgcaaaagatg

SEQ ID NO: 67644 - DNA, 103 bp, Artificial Sequence
  Synthetic Polynucleotide
taatacgactcactatagggttatcgttatcggttttctacactcgcctgaacagaggagacaggcgatggtagaaaacaacctggcggcagcgcaaaagatg

SEQ ID NO: 67645 - DNA, 103 bp, Artificial Sequence
  Synthetic Polynucleotide
taatacgactcactatagggcttttttatcgttatcggttttctacactcaacagaggagagagtgtatgaaaccgataaacctggcggcagcgcaaaagatg

SEQ ID NO: 67646 - DNA, 103 bp, Artificial Sequence
  Synthetic Polynucleotide
taatacgactcactatagggttggccttttttatcgttatcggttttctaaacagaggagatagaaaatggataacgataacctggcggcagcgcaaaagatg

SEQ ID NO: 67647 - DNA, 103 bp, Artificial Sequence
  Synthetic Polynucleotide
taatacgactcactatagggttcgcttggccttttttatcgttatcggttaacagaggagaaaccgaatgcgataaaaaaacctggcggcagcgcaaaagatg

SEQ ID NO: 67648 - DNA, 103 bp, Artificial Sequence
  Synthetic Polynucleotide
taatacgactcactataggggccaagattaacaactcggttgatgaagaaaacagaggagattcttcatgaaccgagttaacctggcggcagcgcaaaagatg

SEQ ID NO: 67649 - DNA, 103 bp, Artificial Sequence
  Synthetic Polynucleotide
taatacgactcactatagggaataattcgcttggccttttttatcgttataacagaggagaataacgatgaaaaaggccaacctggcggcagcgcaaaagatg

SEQ ID NO: 67650 - DNA, 103 bp, Artificial Sequence
  Synthetic Polynucleotide
taatacgactcactatagggaaagaaataattcgcttggccttttttatcaacagaggagagataaaatgggccaagcgaacctggcggcagcgcaaaagatg

SEQ ID NO: 67651 - DNA, 103 bp, Artificial Sequence
  Synthetic Polynucleotide
taatacgactcactatagggtaaacaaagaaataattcgcttggccttttaacagaggagaaaaaggatgagcgaattaaacctggcggcagcgcaaaagatg

SEQ ID NO: 67652 - DNA, 103 bp, Artificial Sequence
  Synthetic Polynucleotide
taatacgactcactatagggttgtataaacaaagaaataattcgcttggcaacagaggagagccaagatgattatttctaacctggcggcagcgcaaaagatg

SEQ ID NO: 67653 - DNA, 103 bp, Artificial Sequence
  Synthetic Polynucleotide
taatacgactcactatagggccatgttgtataaacaaagaaataattcgcaacagaggagagcgaatatgttctttgttaacctggcggcagcgcaaaagatg

SEQ ID NO: 67654 - DNA, 103 bp, Artificial Sequence
  Synthetic Polynucleotide
taatacgactcactatagggtagctccatgttgtataaacaaagaaataaaacagaggagattatttatgtgtttatacaacctggcggcagcgcaaaagatg

SEQ ID NO: 67655 - DNA, 103 bp, Artificial Sequence
  Synthetic Polynucleotide
taatacgactcactatagggtagattagctccatgttgtataaacaaagaaacagaggagatctttgatgatacaacataacctggcggcagcgcaaaagatg

SEQ ID NO: 67656 - DNA, 103 bp, Artificial Sequence
  Synthetic Polynucleotide
taatacgactcactataggggcgtttagattagctccatgttgtataaacaacagaggagagtttatatgacatggagcaacctggcggcagcgcaaaagatg

SEQ ID NO: 67657 - DNA, 103 bp, Artificial Sequence
  Synthetic Polynucleotide
taatacgactcactatagggctaacgcgtttagattagctccatgttgtaaacagaggagatacaacatggagctaatcaacctggcggcagcgcaaaagatg

SEQ ID NO: 67658 - DNA, 103 bp, Artificial Sequence
  Synthetic Polynucleotide
taatacgactcactatagggattatctaacgcgtttagattagctccatgaacagaggagacatggaatgaatctaaacaacctggcggcagcgcaaaagatg

SEQ ID NO: 67659 - DNA, 103 bp, Artificial Sequence
  Synthetic Polynucleotide
taatacgactcactatagggatggagccaagattaacaactcggttgatgaacagaggagacatcaaatgagttgttaaaacctggcggcagcgcaaaagatg

SEQ ID NO: 67660 - DNA, 103 bp, Artificial Sequence
  Synthetic Polynucleotide
taatacgactcactatagggccacaattatctaacgcgtttagattagctaacagaggagaagctaaatgaaacgcgttaacctggcggcagcgcaaaagatg

SEQ ID NO: 67661 - DNA, 103 bp, Artificial Sequence
  Synthetic Polynucleotide
taatacgactcactatagggtattaccacaattatctaacgcgtttagataacagaggagaatctaaatgcgttagataaacctggcggcagcgcaaaagatg

SEQ ID NO: 67662 - DNA, 103 bp, Artificial Sequence
  Synthetic Polynucleotide
taatacgactcactatagggtggtgtattaccacaattatctaacgcgttaacagaggagaaacgcgatggataattgtaacctggcggcagcgcaaaagatg

SEQ ID NO: 67663 - DNA, 103 bp, Artificial Sequence
  Synthetic Polynucleotide
taatacgactcactatagggtggaatggtgtattaccacaattatctaacaacagaggagagttagaatgttgtggtaaaacctggcggcagcgcaaaagatg

SEQ ID NO: 67664 - DNA, 103 bp, Artificial Sequence
  Synthetic Polynucleotide
taatacgactcactatagggacaaatggaatggtgtattaccacaattataacagaggagaataattatggtaatacacaacctggcggcagcgcaaaagatg

SEQ ID NO: 67665 - DNA, 103 bp, Artificial Sequence
  Synthetic Polynucleotide
taatacgactcactatagggaagatacaaatggaatggtgtattaccacaaacagaggagatgtggtatgacaccattcaacctggcggcagcgcaaaagatg

SEQ ID NO: 67666 - DNA, 103 bp, Artificial Sequence
  Synthetic Polynucleotide
taatacgactcactatagggatactaagatacaaatggaatggtgtattaaacagaggagataatacatgattccatttaacctggcggcagcgcaaaagatg

SEQ ID NO: 67667 - DNA, 103 bp, Artificial Sequence
  Synthetic Polynucleotide
taatacgactcactatagggtttcaatactaagatacaaatggaatggtgaacagaggagacaccatatgatttgtatcaacctggcggcagcgcaaaagatg

SEQ ID NO: 67668 - DNA, 103 bp, Artificial Sequence
  Synthetic Polynucleotide
taatacgactcactatagggacacatttcaatactaagatacaaatggaaaacagaggagattccatatgtatcttagtaacctggcggcagcgcaaaagatg

SEQ ID NO: 67669 - DNA, 103 bp, Artificial Sequence
  Synthetic Polynucleotide
taatacgactcactatagggttattacacatttcaatactaagatacaaaaacagaggagatttgtaatgtagtattgaaacctggcggcagcgcaaaagatg

SEQ ID NO: 67670 - DNA, 103 bp, Artificial Sequence
  Synthetic Polynucleotide
taatacgactcactatagggacagtatggagccaagattaacaactcggtaacagaggagaaccgagatgttaatcttgaacctggcggcagcgcaaaagatg

SEQ ID NO: 67671 - DNA, 103 bp, Artificial Sequence
  Synthetic Polynucleotide
taatacgactcactatagggggatattattacacatttcaatactaagataacagaggagaatcttaatgttgaaatgtaacctggcggcagcgcaaaagatg

SEQ ID NO: 67672 - DNA, 103 bp, Artificial Sequence
  Synthetic Polynucleotide
taatacgactcactatagggcatatggatattattacacatttcaatactaacagaggagaagtattatgatgtgtaataacctggcggcagcgcaaaagatg

SEQ ID NO: 67673 - DNA, 103 bp, Artificial Sequence
  Synthetic Polynucleotide
taatacgactcactatagggttagtcatatggatattattacacatttcaaacagaggagatgaaatatgtaataatataacctggcggcagcgcaaaagatg

SEQ ID NO: 67674 - DNA, 103 bp, Artificial Sequence
  Synthetic Polynucleotide
taatacgactcactataggggcattttagtcatatggatattattacacaaacagaggagatgtgtaatgatatccataaacctggcggcagcgcaaaagatg

SEQ ID NO: 67675 - DNA, 103 bp, Artificial Sequence
  Synthetic Polynucleotide
taatacgactcactatagggcaacagcattttagtcatatggatattattaacagaggagaaataatatgcatatgactaacctggcggcagcgcaaaagatg

SEQ ID NO: 67676 - DNA, 103 bp, Artificial Sequence
  Synthetic Polynucleotide
taatacgactcactatagggaaagtcaacagcattttagtcatatggataaacagaggagatatccaatggactaaaataacctggcggcagcgcaaaagatg

SEQ ID NO: 67677 - DNA, 103 bp, Artificial Sequence
  Synthetic Polynucleotide
taatacgactcactataggggattaaaagtcaacagcattttagtcatataacagaggagaatatgaatgaaatgctgtaacctggcggcagcgcaaaagatg

SEQ ID NO: 67678 - DNA, 103 bp, Artificial Sequence
  Synthetic Polynucleotide
taatacgactcactatagggattcggattaaaagtcaacagcattttagtaacagaggagaactaaaatgctgttgactaacctggcggcagcgcaaaagatg

SEQ ID NO: 67679 - DNA, 103 bp, Artificial Sequence
  Synthetic Polynucleotide
taatacgactcactatagggtcgaaattcggattaaaagtcaacagcattaacagaggagaaatgctatggacttttaaaacctggcggcagcgcaaaagatg

SEQ ID NO: 67680 - DNA, 103 bp, Artificial Sequence
  Synthetic Polynucleotide
taatacgactcactatagggatatttcgaaattcggattaaaagtcaacaaacagaggagatgttgaatgttaatccgaaacctggcggcagcgcaaaagatg

SEQ ID NO: 67681 - DNA, 103 bp, Artificial Sequence
  Synthetic Polynucleotide
taatacgactcactatagggtttacgctgtaatagataatactatagattaacagaggagaaatctaatgtattatctaaacctggcggcagcgcaaaagatg

SEQ ID NO: 67682 - DNA, 103 bp, Artificial Sequence
  Synthetic Polynucleotide
taatacgactcactatagggttggtacagtatggagccaagattaacaacaacagaggagagttgttatgcttggctccaacctggcggcagcgcaaaagatg

SEQ ID NO: 67683 - DNA, 103 bp, Artificial Sequence
  Synthetic Polynucleotide
taatacgactcactatagggattacatatttcgaaattcggattaaaagtaacagaggagaacttttatgccgaatttcaacctggcggcagcgcaaaagatg

SEQ ID NO: 67684 - DNA, 103 bp, Artificial Sequence
  Synthetic Polynucleotide
taatacgactcactatagggtgattattacatatttcgaaattcggattaaacagaggagataatccatgtttcgaaataacctggcggcagcgcaaaagatg

SEQ ID NO: 67685 - DNA, 103 bp, Artificial Sequence
  Synthetic Polynucleotide
taatacgactcactatagggatccatgattattacatatttcgaaattcgaacagaggagacgaattatgaaatatgtaaacctggcggcagcgcaaaagatg

SEQ ID NO: 67686 - DNA, 103 bp, Artificial Sequence
  Synthetic Polynucleotide
taatacgactcactatagggcgttaatccatgattattacatatttcgaaaacagaggagattcgaaatgtgtaataataacctggcggcagcgcaaaagatg

SEQ ID NO: 67687 - DNA, 103 bp, Artificial Sequence
  Synthetic Polynucleotide
taatacgactcactatagggataggcgttaatccatgattattacatattaacagaggagaaatatgatgtaatcatggaacctggcggcagcgcaaaagatg

SEQ ID NO: 67688 - DNA, 103 bp, Artificial Sequence
  Synthetic Polynucleotide
taatacgactcactatagggatagtataggcgttaatccatgattattacaacagaggagagtaataatgatggattaaaacctggcggcagcgcaaaagatg

SEQ ID NO: 67689 - DNA, 103 bp, Artificial Sequence
  Synthetic Polynucleotide
taatacgactcactatagggataacatagtataggcgttaatccatgattaacagaggagaaatcatatgttaacgcctaacctggcggcagcgcaaaagatg

SEQ ID NO: 67690 - DNA, 103 bp, Artificial Sequence
  Synthetic Polynucleotide
taatacgactcactataggggttatataacatagtataggcgttaatccaaacagaggagatggattatggcctatactaacctggcggcagcgcaaaagatg

SEQ ID NO: 67691 - DNA, 103 bp, Artificial Sequence
  Synthetic Polynucleotide
taatacgactcactatagggcggaagttatataacatagtataggcgttaaacagaggagataacgcatgtactatgttaacctggcggcagcgcaaaagatg

SEQ ID NO: 67692 - DNA, 103 bp, Artificial Sequence
  Synthetic Polynucleotide
taatacgactcactataggggtagtcggaagttatataacatagtataggaacagaggagacctataatgtgttatataaacctggcggcagcgcaaaagatg

SEQ ID NO: 67693 - DNA, 103 bp, Artificial Sequence
  Synthetic Polynucleotide
taatacgactcactatagggatttattggtacagtatggagccaagattaaacagaggagataatctatgctccatactaacctggcggcagcgcaaaagatg

SEQ ID NO: 67694 - DNA, 103 bp, Artificial Sequence
  Synthetic Polynucleotide
taatacgactcactatagggtgtatgtagtcggaagttatataacatagtaacagaggagaactatgatgtataacttcaacctggcggcagcgcaaaagatg

SEQ ID NO: 67695 - DNA, 103 bp, Artificial Sequence
  Synthetic Polynucleotide
taatacgactcactatagggcgtgttgtatgtagtcggaagttatataacaacagaggagagttataatgcttccgactaacctggcggcagcgcaaaagatg

SEQ ID NO: 67696 - DNA, 103 bp, Artificial Sequence
  Synthetic Polynucleotide
taatacgactcactatagggaatatcgtgttgtatgtagtcggaagttataacagaggagaataactatggactacataaacctggcggcagcgcaaaagatg

SEQ ID NO: 67697 - DNA, 103 bp, Artificial Sequence
  Synthetic Polynucleotide
taatacgactcactatagggacaagaatatcgtgttgtatgtagtcggaaaacagaggagattccgaatgcatacaacaaacctggcggcagcgcaaaagatg

SEQ ID NO: 67698 - DNA, 103 bp, Artificial Sequence
  Synthetic Polynucleotide
taatacgactcactatagggacatgacaagaatatcgtgttgtatgtagtaacagaggagaactacaatgaacacgataaacctggcggcagcgcaaaagatg

SEQ ID NO: 67699 - DNA, 103 bp, Artificial Sequence
  Synthetic Polynucleotide
taatacgactcactatagggtatcaacatgacaagaatatcgtgttgtataacagaggagaatacaaatggatattcttaacctggcggcagcgcaaaagatg

SEQ ID NO: 67700 - DNA, 103 bp, Artificial Sequence
  Synthetic Polynucleotide
taatacgactcactatagggtgatgtatcaacatgacaagaatatcgtgtaacagaggagaacacgaatgtcttgtcataacctggcggcagcgcaaaagatg

SEQ ID NO: 67701 - DNA, 103 bp, Artificial Sequence
  Synthetic Polynucleotide
taatacgactcactatagggcatagtgatgtatcaacatgacaagaatataacagaggagaatattcatgtcatgttgaaacctggcggcagcgcaaaagatg

SEQ ID NO: 67702 - DNA, 103 bp, Artificial Sequence
  Synthetic Polynucleotide
taatacgactcactatagggtgtttcatagtgatgtatcaacatgacaagaacagaggagacttgtcatgttgatacataacctggcggcagcgcaaaagatg

SEQ ID NO: 67703 - DNA, 103 bp, Artificial Sequence
  Synthetic Polynucleotide
taatacgactcactatagggacatttgtttcatagtgatgtatcaacatgaacagaggagacatgttatgacatcactaaacctggcggcagcgcaaaagatg

SEQ ID NO: 67704 - DNA, 103 bp, Artificial Sequence
  Synthetic Polynucleotide
taatacgactcactatagggaataaatttattggtacagtatggagccaaaacagaggagattggctatgtactgtaccaacctggcggcagcgcaaaagatg

SEQ ID NO: 67705 - DNA, 103 bp, Artificial Sequence
  Synthetic Polynucleotide
taatacgactcactatagggctccaacatttgtttcatagtgatgtatcaaacagaggagatgatacatgactatgaaaaacctggcggcagcgcaaaagatg

SEQ ID NO: 67706 - DNA, 103 bp, Artificial Sequence
  Synthetic Polynucleotide
taatacgactcactatagggcatttctccaacatttgtttcatagtgatgaacagaggagacatcacatggaaacaaataacctggcggcagcgcaaaagatg

SEQ ID NO: 67707 - DNA, 103 bp, Artificial Sequence
  Synthetic Polynucleotide
taatacgactcactatagggataggcatttctccaacatttgtttcatagaacagaggagactatgaatgaaatgttggaacctggcggcagcgcaaaagatg

SEQ ID NO: 67708 - DNA, 103 bp, Artificial Sequence
  Synthetic Polynucleotide
taatacgactcactatagggcatctataggcatttctccaacatttgtttaacagaggagaaaacaaatgttggagaaaaacctggcggcagcgcaaaagatg

SEQ ID NO: 67709 - DNA, 103 bp, Artificial Sequence
  Synthetic Polynucleotide
taatacgactcactatagggacgctcatctataggcatttctccaacattaacagaggagaaatgttatggaaatgcctaacctggcggcagcgcaaaagatg

SEQ ID NO: 67710 - DNA, 103 bp, Artificial Sequence
  Synthetic Polynucleotide
taatacgactcactatagggatacgacgctcatctataggcatttctccaaacagaggagatggagaatggcctatagaaacctggcggcagcgcaaaagatg

SEQ ID NO: 67711 - DNA, 103 bp, Artificial Sequence
  Synthetic Polynucleotide
taatacgactcactatagggcgatcatacgacgctcatctataggcatttaacagaggagaaaatgcatgtagatgagcaacctggcggcagcgcaaaagatg

SEQ ID NO: 67712 - DNA, 103 bp, Artificial Sequence
  Synthetic Polynucleotide
taatacgactcactataggggaatacgatcatacgacgctcatctataggaacagaggagacctataatggagcgtcgtaacctggcggcagcgcaaaagatg

SEQ ID NO: 67713 - DNA, 103 bp, Artificial Sequence
  Synthetic Polynucleotide
taatacgactcactatagggaactcgaatacgatcatacgacgctcatctaacagaggagaagatgaatgtcgtatgataacctggcggcagcgcaaaagatg

SEQ ID NO: 67714 - DNA, 103 bp, Artificial Sequence
  Synthetic Polynucleotide
taatacgactcactatagggtgataaactcgaatacgatcatacgacgctaacagaggagaagcgtcatgtgatcgtataacctggcggcagcgcaaaagatg

SEQ ID NO: 67715 - DNA, 103 bp, Artificial Sequence
  Synthetic Polynucleotide
taatacgactcactataggggagagaataaatttattggtacagtatggaaacagaggagatccataatgtaccaataaaacctggcggcagcgcaaaagatg

SEQ ID NO: 67716 - DNA, 103 bp, Artificial Sequence
  Synthetic Polynucleotide
taatacgactcactatagggtgttttgataaactcgaatacgatcatacgaacagaggagacgtatgatggtattcgagaacctggcggcagcgcaaaagatg

SEQ ID NO: 67717 - DNA, 103 bp, Artificial Sequence
  Synthetic Polynucleotide
taatacgactcactataggggaatatgttttgataaactcgaatacgatcaacagaggagagatcgtatgcgagtttataacctggcggcagcgcaaaagatg

SEQ ID NO: 67718 - DNA, 103 bp, Artificial Sequence
  Synthetic Polynucleotide
taatacgactcactataggggtgtagaatatgttttgataaactcgaataaacagaggagatattcgatgttatcaaaaaacctggcggcagcgcaaaagatg

SEQ ID NO: 67719 - DNA, 103 bp, Artificial Sequence
  Synthetic Polynucleotide
taatacgactcactatagggcggacgtgtagaatatgttttgataaactcaacagaggagagagtttatgaaaacatataacctggcggcagcgcaaaagatg

SEQ ID NO: 67720 - DNA, 103 bp, Artificial Sequence
  Synthetic Polynucleotide
taatacgactcactatagggtctaacggacgtgtagaatatgttttgataaacagaggagatatcaaatgatattctacaacctggcggcagcgcaaaagatg

SEQ ID NO: 67721 - DNA, 103 bp, Artificial Sequence
  Synthetic Polynucleotide
taatacgactcactatagggtcgaatctaacggacgtgtagaatatgtttaacagaggagaaaacatatgctacacgtcaacctggcggcagcgcaaaagatg

SEQ ID NO: 67722 - DNA, 103 bp, Artificial Sequence
  Synthetic Polynucleotide
taatacgactcactatagggagttatcgaatctaacggacgtgtagaataaacagaggagatattctatgcgtccgttaaacctggcggcagcgcaaaagatg

SEQ ID NO: 67723 - DNA, 103 bp, Artificial Sequence
  Synthetic Polynucleotide
taatacgactcactatagggaaataagttatcgaatctaacggacgtgtaaacagaggagatacacgatggttagattcaacctggcggcagcgcaaaagatg

SEQ ID NO: 67724 - DNA, 103 bp, Artificial Sequence
  Synthetic Polynucleotide
taatacgactcactatagggtcatcaaataagttatcgaatctaacggacaacagaggagagtccgtatgattcgataaaacctggcggcagcgcaaaagatg

SEQ ID NO: 67725 - DNA, 103 bp, Artificial Sequence
  Synthetic Polynucleotide
taatacgactcactatagggcctattcatcaaataagttatcgaatctaaaacagaggagattagatatgataacttataacctggcggcagcgcaaaagatg

SEQ ID NO: 67726 - DNA, 103 bp, Artificial Sequence
  Synthetic Polynucleotide
taatacgactcactatagggtcatagagagaataaatttattggtacagtaacagaggagaactgtaatgataaatttaaacctggcggcagcgcaaaagatg

SEQ ID NO: 67727 - DNA, 103 bp, Artificial Sequence
  Synthetic Polynucleotide
taatacgactcactatagggttaaacctattcatcaaataagttatcgaaaacagaggagattcgatatgttatttgataacctggcggcagcgcaaaagatg

SEQ ID NO: 67728 - DNA, 103 bp, Artificial Sequence
  Synthetic Polynucleotide
taatacgactcactatagggtatttttaaacctattcatcaaataagttaaacagaggagataacttatgtgatgaataaacctggcggcagcgcaaaagatg

SEQ ID NO: 67729 - DNA, 103 bp, Artificial Sequence
  Synthetic Polynucleotide
taatacgactcactatagggatctatatttttaaacctattcatcaaataaacagaggagatatttgatgaataggtttaacctggcggcagcgcaaaagatg

SEQ ID NO: 67730 - DNA, 103 bp, Artificial Sequence
  Synthetic Polynucleotide
taatacgactcactatagggtgaatatctatatttttaaacctattcatcaacagaggagagatgaaatggtttaaaaaaacctggcggcagcgcaaaagatg

SEQ ID NO: 67731 - DNA, 103 bp, Artificial Sequence
  Synthetic Polynucleotide
taatacgactcactataggggggtatgaatatctatatttttaaacctataacagaggagaataggtatgaaaatatagaacctggcggcagcgcaaaagatg

SEQ ID NO: 67732 - DNA, 103 bp, Artificial Sequence
  Synthetic Polynucleotide
taatacgactcactatagggatagcgggtatgaatatctatatttttaaaaacagaggagatttaaaatgatagatattaacctggcggcagcgcaaaagatg

SEQ ID NO: 67733 - DNA, 103 bp, Artificial Sequence
  Synthetic Polynucleotide
taatacgactcactatagggccttcatagcgggtatgaatatctatatttaacagaggagaaaatatatgtattcatacaacctggcggcagcgcaaaagatg

SEQ ID NO: 67734 - DNA, 103 bp, Artificial Sequence
  Synthetic Polynucleotide
taatacgactcactatagggtctttccttcatagcgggtatgaatatctaaacagaggagatagataatgatacccgctaacctggcggcagcgcaaaagatg

SEQ ID NO: 67735 - DNA, 103 bp, Artificial Sequence
  Synthetic Polynucleotide
taatacgactcactatagggtaatgtctttccttcatagcgggtatgaataacagaggagaattcatatgcgctatgaaaacctggcggcagcgcaaaagatg

SEQ ID NO: 67736 - DNA, 103 bp, Artificial Sequence
  Synthetic Polynucleotide
taatacgactcactatagggtgtaataatgtctttccttcatagcgggtaaacagaggagatacccgatgtgaaggaaaaacctggcggcagcgcaaaagatg

SEQ ID NO: 67737 - DNA, 103 bp, Artificial Sequence
  Synthetic Polynucleotide
taatacgactcactatagggtgaagtcatagagagaataaatttattggtaacagaggagaaccaatatgtttattctcaacctggcggcagcgcaaaagatg

SEQ ID NO: 67738 - DNA, 103 bp, Artificial Sequence
  Synthetic Polynucleotide
taatacgactcactatagggctatgtgtaataatgtctttccttcatagcaacagaggagagctatgatggaaagacataacctggcggcagcgcaaaagatg

SEQ ID NO: 67739 - DNA, 103 bp, Artificial Sequence
  Synthetic Polynucleotide
taatacgactcactatagggacatgctatgtgtaataatgtctttccttcaacagaggagagaaggaatgacattattaaacctggcggcagcgcaaaagatg

SEQ ID NO: 67740 - DNA, 103 bp, Artificial Sequence
  Synthetic Polynucleotide
taatacgactcactatagggtattcacatgctatgtgtaataatgtctttaacagaggagaaaagacatgattacacataacctggcggcagcgcaaaagatg

SEQ ID NO: 67741 - DNA, 103 bp, Artificial Sequence
  Synthetic Polynucleotide
taatacgactcactatagggtattatattcacatgctatgtgtaataatgaacagaggagacattatatgacatagcataacctggcggcagcgcaaaagatg

SEQ ID NO: 67742 - DNA, 103 bp, Artificial Sequence
  Synthetic Polynucleotide
taatacgactcactatagggtgtattattatattcacatgctatgtgtaaaacagaggagattacacatggcatgtgaaaacctggcggcagcgcaaaagatg

SEQ ID NO: 67743 - DNA, 103 bp, Artificial Sequence
  Synthetic Polynucleotide
taatacgactcactatagggacgtgtgtattattatattcacatgctatgaacagaggagacatagcatgtgaatataaaacctggcggcagcgcaaaagatg

SEQ ID NO: 67744 - DNA, 103 bp, Artificial Sequence
  Synthetic Polynucleotide
taatacgactcactatagggctattacgtgtgtattattatattcacatgaacagaggagacatgtgatgataataataaacctggcggcagcgcaaaagatg

SEQ ID NO: 67745 - DNA, 103 bp, Artificial Sequence
  Synthetic Polynucleotide
taatacgactcactatagggataatctattacgtgtgtattattatattcaacagaggagagaatatatgaatacacacaacctggcggcagcgcaaaagatg

SEQ ID NO: 67746 - DNA, 103 bp, Artificial Sequence
  Synthetic Polynucleotide
taatacgactcactatagggataagataatctattacgtgtgtattattaaacagaggagataataaatgacacgtaataacctggcggcagcgcaaaagatg

SEQ ID NO: 67747 - DNA, 103 bp, Artificial Sequence
  Synthetic Polynucleotide
taatacgactcactatagggtacgtataagataatctattacgtgtgtataacagaggagaatacacatgtaatagattaacctggcggcagcgcaaaagatg

SEQ ID NO: 67748 - DNA, 103 bp, Artificial Sequence
  Synthetic Polynucleotide
taatacgactcactataggggatgatgaagtcatagagagaataaatttaaacagaggagataaattatgtctctctataacctggcggcagcgcaaaagatg

SEQ ID NO: 67749 - DNA, 103 bp, Artificial Sequence
  Synthetic Polynucleotide
taatacgactcactataggggttaatacgtataagataatctattacgtgaacagaggagacacgtaatggattatcttaacctggcggcagcgcaaaagatg

SEQ ID NO: 67750 - DNA, 103 bp, Artificial Sequence
  Synthetic Polynucleotide
taatacgactcactatagggtctccgttaatacgtataagataatctattaacagaggagaaatagaatgtcttatacgaacctggcggcagcgcaaaagatg

SEQ ID NO: 67751 - DNA, 103 bp, Artificial Sequence
  Synthetic Polynucleotide
taatacgactcactatagggttatatctccgttaatacgtataagataataacagaggagaattatcatgtacgtattaaacctggcggcagcgcaaaagatg

SEQ ID NO: 67752 - DNA, 103 bp, Artificial Sequence
  Synthetic Polynucleotide
taatacgactcactatagggcgcatttatatctccgttaatacgtataagaacagaggagacttataatgattaacggaaacctggcggcagcgcaaaagatg

SEQ ID NO: 67753 - DNA, 103 bp, Artificial Sequence
  Synthetic Polynucleotide
taatacgactcactataggggttaacgcatttatatctccgttaatacgtaacagaggagaacgtatatgcggagatataacctggcggcagcgcaaaagatg

SEQ ID NO: 67754 - DNA, 103 bp, Artificial Sequence
  Synthetic Polynucleotide
taatacgactcactatagggtgtcggttaacgcatttatatctccgttaaaacagaggagattaacgatgatataaatgaacctggcggcagcgcaaaagatg

SEQ ID NO: 67755 - DNA, 103 bp, Artificial Sequence
  Synthetic Polynucleotide
taatacgactcactataggggttattgtcggttaacgcatttatatctccaacagaggagaggagatatgaatgcgttaaacctggcggcagcgcaaaagatg

SEQ ID NO: 67756 - DNA, 103 bp, Artificial Sequence
  Synthetic Polynucleotide
taatacgactcactatagggtgtttgttattgtcggttaacgcatttataaacagaggagatataaaatggttaaccgaaacctggcggcagcgcaaaagatg

SEQ ID NO: 67757 - DNA, 103 bp, Artificial Sequence
  Synthetic Polynucleotide
taatacgactcactatagggtagcgtgtttgttattgtcggttaacgcataacagaggagaatgcgtatgccgacaataaacctggcggcagcgcaaaagatg

SEQ ID NO: 67758 - DNA, 103 bp, Artificial Sequence
  Synthetic Polynucleotide
taatacgactcactatagggttggatagcgtgtttgttattgtcggttaaaacagaggagattaaccatgaataacaaaaacctggcggcagcgcaaaagatg

SEQ ID NO: 67759 - DNA, 103 bp, Artificial Sequence
  Synthetic Polynucleotide
taatacgactcactataggggaacagatgatgaagtcatagagagaataaaacagaggagattattcatgctatgacttaacctggcggcagcgcaaaagatg

SEQ ID NO: 67760 - DNA, 103 bp, Artificial Sequence
  Synthetic Polynucleotide
taatacgactcactatagggatgagttggatagcgtgtttgttattgtcgaacagaggagacgacaaatgcaaacacgcaacctggcggcagcgcaaaagatg

SEQ ID NO: 67761 - DNA, 103 bp, Artificial Sequence
  Synthetic Polynucleotide
taatacgactcactatagggctataatgagttggatagcgtgtttgttataacagaggagaataacaatgacgctatccaacctggcggcagcgcaaaagatg

SEQ ID NO: 67762 - DNA, 103 bp, Artificial Sequence
  Synthetic Polynucleotide
taatacgactcactataggggttatctataatgagttggatagcgtgtttaacagaggagaaaacacatgatccaactcaacctggcggcagcgcaaaagatg

SEQ ID NO: 67763 - DNA, 103 bp, Artificial Sequence
  Synthetic Polynucleotide
taatacgactcactatagggtctttgttatctataatgagttggatagcgaacagaggagacgctatatgactcattataacctggcggcagcgcaaaagatg

SEQ ID NO: 67764 - DNA, 103 bp, Artificial Sequence
  Synthetic Polynucleotide
taatacgactcactatagggaattttctttgttatctataatgagttggaaacagaggagatccaacatgttatagataaacctggcggcagcgcaaaagatg

SEQ ID NO: 67765 - DNA, 103 bp, Artificial Sequence
  Synthetic Polynucleotide
taatacgactcactatagggctgggaattttctttgttatctataatgagaacagaggagactcattatggataacaaaaacctggcggcagcgcaaaagatg

SEQ ID NO: 67766 - DNA, 103 bp, Artificial Sequence
  Synthetic Polynucleotide
taatacgactcactataggggtatactgggaattttctttgttatctataaacagaggagatatagaatgcaaagaaaaaacctggcggcagcgcaaaagatg

SEQ ID NO: 67767 - DNA, 103 bp, Artificial Sequence
  Synthetic Polynucleotide
taatacgactcactatagggcgatggtatactgggaattttctttgttataacagaggagaataacaatgaaaattcccaacctggcggcagcgcaaaagatg

SEQ ID NO: 67768 - DNA, 103 bp, Artificial Sequence
  Synthetic Polynucleotide
taatacgactcactatagggacaatcgatggtatactgggaattttctttaacagaggagaaaagaaatgtcccagtataacctggcggcagcgcaaaagatg

SEQ ID NO: 67769 - DNA, 103 bp, Artificial Sequence
  Synthetic Polynucleotide
taatacgactcactatagggaataaacaatcgatggtatactgggaatttaacagaggagaaaattcatggtataccataacctggcggcagcgcaaaagatg

SEQ ID NO: 67770 - DNA, 103 bp, Artificial Sequence
  Synthetic Polynucleotide
taatacgactcactatagggttcgggaacagatgatgaagtcatagagagaacagaggagactctctatgacttcatcaaacctggcggcagcgcaaaagatg

SEQ ID NO: 67771 - DNA, 103 bp, Artificial Sequence
  Synthetic Polynucleotide
taatacgactcactatagggtatacaataaacaatcgatggtatactgggaacagaggagacccagtatgccatcgattaacctggcggcagcgcaaaagatg

SEQ ID NO: 67772 - DNA, 103 bp, Artificial Sequence
  Synthetic Polynucleotide
taatacgactcactatagggaagtatatacaataaacaatcgatggtataaacagaggagatataccatggattgtttaaacctggcggcagcgcaaaagatg

SEQ ID NO: 67773 - DNA, 103 bp, Artificial Sequence
  Synthetic Polynucleotide
taatacgactcactatagggtatctaagtatatacaataaacaatcgatgaacagaggagacatcgaatgtttattgtaaacctggcggcagcgcaaaagatg

SEQ ID NO: 67774 - DNA, 103 bp, Artificial Sequence
  Synthetic Polynucleotide
taatacgactcactatagggcaatatatctaagtatatacaataaacaataacagaggagaattgttatgtgtatatacaacctggcggcagcgcaaaagatg

SEQ ID NO: 67775 - DNA, 103 bp, Artificial Sequence
  Synthetic Polynucleotide
taatacgactcactatagggatctacaatatatctaagtatatacaataaaacagaggagattattgatgatacttagaaacctggcggcagcgcaaaagatg

SEQ ID NO: 67776 - DNA, 103 bp, Artificial Sequence
  Synthetic Polynucleotide
taatacgactcactatagggttcttatctacaatatatctaagtatatacaacagaggagagtatatatgtagatatataacctggcggcagcgcaaaagatg

SEQ ID NO: 67777 - DNA, 103 bp, Artificial Sequence
  Synthetic Polynucleotide
taatacgactcactatagggtcacattcttatctacaatatatctaagtaaacagaggagatacttaatgatattgtagaacctggcggcagcgcaaaagatg

SEQ ID NO: 67778 - DNA, 103 bp, Artificial Sequence
  Synthetic Polynucleotide
taatacgactcactatagggtcttatcacattcttatctacaatatatctaacagaggagaagatatatggtagataagaacctggcggcagcgcaaaagatg

SEQ ID NO: 67779 - DNA, 103 bp, Artificial Sequence
  Synthetic Polynucleotide
taatacgactcactatagggaacgatcttatcacattcttatctacaataaacagaggagatattgtatgtaagaatgtaacctggcggcagcgcaaaagatg

SEQ ID NO: 67780 - DNA, 103 bp, Artificial Sequence
  Synthetic Polynucleotide
taatacgactcactatagggccaccaacgatcttatcacattcttatctaaacagaggagatagataatgatgtgataaaacctggcggcagcgcaaaagatg

SEQ ID NO: 67781 - DNA, 103 bp, Artificial Sequence
  Synthetic Polynucleotide
taatacgactcactatagggtatctttcgggaacagatgatgaagtcataaacagaggagatatgacatgatcatctgtaacctggcggcagcgcaaaagatg

SEQ ID NO: 67782 - DNA, 103 bp, Artificial Sequence
  Synthetic Polynucleotide
taatacgactcactatagggttgatccaccaacgatcttatcacattcttaacagaggagaaagaatatgataagatcgaacctggcggcagcgcaaaagatg

SEQ ID NO: 67783 - DNA, 103 bp, Artificial Sequence
  Synthetic Polynucleotide
taatacgactcactatagggggaagttgatccaccaacgatcttatcacaaacagaggagatgtgatatgatcgttggtaacctggcggcagcgcaaaagatg

SEQ ID NO: 67784 - DNA, 103 bp, Artificial Sequence
  Synthetic Polynucleotide
taatacgactcactataggggatatggaagttgatccaccaacgatcttaaacagaggagataagatatgtggtggatcaacctggcggcagcgcaaaagatg

SEQ ID NO: 67785 - DNA, 103 bp, Artificial Sequence
  Synthetic Polynucleotide
taatacgactcactatagggaggtagatatggaagttgatccaccaacgaaacagaggagatcgttgatggatcaacttaacctggcggcagcgcaaaagatg

SEQ ID NO: 67786 - DNA, 103 bp, Artificial Sequence
  Synthetic Polynucleotide
taatacgactcactatagggaagataggtagatatggaagttgatccaccaacagaggagaggtggaatgacttccataaacctggcggcagcgcaaaagatg

SEQ ID NO: 67787 - DNA, 103 bp, Artificial Sequence
  Synthetic Polynucleotide
taatacgactcactatagggtatcgaagataggtagatatggaagttgataacagaggagaatcaacatgcatatctacaacctggcggcagcgcaaaagatg

SEQ ID NO: 67788 - DNA, 103 bp, Artificial Sequence
  Synthetic Polynucleotide
taatacgactcactatagggttttatatcgaagataggtagatatggaagaacagaggagacttccaatgctacctatcaacctggcggcagcgcaaaagatg

SEQ ID NO: 67789 - DNA, 103 bp, Artificial Sequence
  Synthetic Polynucleotide
taatacgactcactatagggaatgattttatatcgaagataggtagatataacagaggagaatatctatgtatcttcgaaacctggcggcagcgcaaaagatg

SEQ ID NO: 67790 - DNA, 103 bp, Artificial Sequence
  Synthetic Polynucleotide
taatacgactcactatagggtctcaaatgattttatatcgaagataggtaaacagaggagatacctaatgtcgatataaaacctggcggcagcgcaaaagatg

SEQ ID NO: 67791 - DNA, 103 bp, Artificial Sequence
  Synthetic Polynucleotide
taatacgactcactataggggaatttctcaaatgattttatatcgaagataacagaggagaatcttcatgataaaatcaaacctggcggcagcgcaaaagatg

SEQ ID NO: 67792 - DNA, 103 bp, Artificial Sequence
  Synthetic Polynucleotide
taatacgactcactatagggtgtgttttacgctgtaatagataatactataacagaggagaatagtaatgtctattacaaacctggcggcagcgcaaaagatg

SEQ ID NO: 67793 - DNA, 103 bp, Artificial Sequence
  Synthetic Polynucleotide
taatacgactcactatagggtatattatctttcgggaacagatgatgaagaacagaggagacttcatatgctgttcccgaacctggcggcagcgcaaaagatg

SEQ ID NO: 67794 - DNA, 103 bp, Artificial Sequence
  Synthetic Polynucleotide
taatacgactcactataggggatatgaatttctcaaatgattttatatcgaacagaggagacgatatatgatcatttgaaacctggcggcagcgcaaaagatg

SEQ ID NO: 67795 - DNA, 103 bp, Artificial Sequence
  Synthetic Polynucleotide
taatacgactcactatagggagtatgatatgaatttctcaaatgattttaaacagaggagataaaatatgttgagaaataacctggcggcagcgcaaaagatg

SEQ ID NO: 67796 - DNA, 103 bp, Artificial Sequence
  Synthetic Polynucleotide
taatacgactcactatagggtatacagtatgatatgaatttctcaaatgaaacagaggagatcatttatgaaattcataaacctggcggcagcgcaaaagatg

SEQ ID NO: 67797 - DNA, 103 bp, Artificial Sequence
  Synthetic Polynucleotide
taatacgactcactatagggaaaagtatacagtatgatatgaatttctcaaacagaggagatgagaaatgcatatcataaacctggcggcagcgcaaaagatg

SEQ ID NO: 67798 - DNA, 103 bp, Artificial Sequence
  Synthetic Polynucleotide
taatacgactcactatagggcatctaaaagtatacagtatgatatgaattaacagaggagaaattcaatgcatactgtaaacctggcggcagcgcaaaagatg

SEQ ID NO: 67799 - DNA, 103 bp, Artificial Sequence
  Synthetic Polynucleotide
taatacgactcactatagggtgtgtcatctaaaagtatacagtatgatataacagaggagaatatcaatgtgtatacttaacctggcggcagcgcaaaagatg

SEQ ID NO: 67800 - DNA, 103 bp, Artificial Sequence
  Synthetic Polynucleotide
taatacgactcactatagggtaaaatgtgtcatctaaaagtatacagtataacagaggagaatactgatgacttttagaaacctggcggcagcgcaaaagatg

SEQ ID NO: 67801 - DNA, 103 bp, Artificial Sequence
  Synthetic Polynucleotide
taatacgactcactatagggtatcgtaaaatgtgtcatctaaaagtatacaacagaggagagtatacatgtagatgacaaacctggcggcagcgcaaaagatg

SEQ ID NO: 67802 - DNA, 103 bp, Artificial Sequence
  Synthetic Polynucleotide
taatacgactcactataggggtgtctatcgtaaaatgtgtcatctaaaagaacagaggagacttttaatggacacatttaacctggcggcagcgcaaaagatg

SEQ ID NO: 67803 - DNA, 103 bp, Artificial Sequence
  Synthetic Polynucleotide
taatacgactcactatagggtgaacgtgtctatcgtaaaatgtgtcatctaacagaggagaagatgaatgattttacgaaacctggcggcagcgcaaaagatg

SEQ ID NO: 67804 - DNA, 103 bp, Artificial Sequence
  Synthetic Polynucleotide
taatacgactcactataggggcctctatattatctttcgggaacagatgaaacagaggagatcatctatgcccgaaagaaacctggcggcagcgcaaaagatg

SEQ ID NO: 67805 - DNA, 103 bp, Artificial Sequence
  Synthetic Polynucleotide
taatacgactcactataggggattctgaacgtgtctatcgtaaaatgtgtaacagaggagaacacatatgacgatagacaacctggcggcagcgcaaaagatg

SEQ ID NO: 67806 - DNA, 103 bp, Artificial Sequence
  Synthetic Polynucleotide
taatacgactcactatagggatcgcgattctgaacgtgtctatcgtaaaaaacagaggagattttacatgagacacgttaacctggcggcagcgcaaaagatg

SEQ ID NO: 67807 - DNA, 103 bp, Artificial Sequence
  Synthetic Polynucleotide
taatacgactcactatagggttagaatcgcgattctgaacgtgtctatcgaacagaggagacgatagatgcgttcagaaaacctggcggcagcgcaaaagatg

SEQ ID NO: 67808 - DNA, 103 bp, Artificial Sequence
  Synthetic Polynucleotide
taatacgactcactatagggaagttttagaatcgcgattctgaacgtgtcaacagaggagagacacgatgagaatcgcgaacctggcggcagcgcaaaagatg

SEQ ID NO: 67809 - DNA, 103 bp, Artificial Sequence
  Synthetic Polynucleotide
taatacgactcactatagggtcgataagttttagaatcgcgattctgaacaacagaggagagttcagatgcgcgattctaacctggcggcagcgcaaaagatg

SEQ ID NO: 67810 - DNA, 103 bp, Artificial Sequence
  Synthetic Polynucleotide
taatacgactcactataggggtgtatcgataagttttagaatcgcgattcaacagaggagagaatcgatgttctaaaacaacctggcggcagcgcaaaagatg

SEQ ID NO: 67811 - DNA, 103 bp, Artificial Sequence
  Synthetic Polynucleotide
taatacgactcactatagggaaaacgtgtatcgataagttttagaatcgcaacagaggagagcgattatgaaacttatcaacctggcggcagcgcaaaagatg

SEQ ID NO: 67812 - DNA, 103 bp, Artificial Sequence
  Synthetic Polynucleotide
taatacgactcactatagggttttgaaaacgtgtatcgataagttttagaaacagaggagatctaaaatgtatcgatacaacctggcggcagcgcaaaagatg

SEQ ID NO: 67813 - DNA, 103 bp, Artificial Sequence
  Synthetic Polynucleotide
taatacgactcactatagggatgtattttgaaaacgtgtatcgataagttaacagaggagaaacttaatgatacacgttaacctggcggcagcgcaaaagatg

SEQ ID NO: 67814 - DNA, 103 bp, Artificial Sequence
  Synthetic Polynucleotide
taatacgactcactatagggatgatatgtattttgaaaacgtgtatcgataacagaggagaatcgatatgcgttttcaaaacctggcggcagcgcaaaagatg

SEQ ID NO: 67815 - DNA, 103 bp, Artificial Sequence
  Synthetic Polynucleotide
taatacgactcactatagggaaaacgcctctatattatctttcgggaacaaacagaggagatgttccatgaagataataaacctggcggcagcgcaaaagatg

SEQ ID NO: 67816 - DNA, 103 bp, Artificial Sequence
  Synthetic Polynucleotide
taatacgactcactatagggatcgaatgatatgtattttgaaaacgtgtaaacagaggagatacacgatgtcaaaatacaacctggcggcagcgcaaaagatg

SEQ ID NO: 67817 - DNA, 103 bp, Artificial Sequence
  Synthetic Polynucleotide
taatacgactcactatagggtatttatcgaatgatatgtattttgaaaacaacagaggagagttttcatgatacatatcaacctggcggcagcgcaaaagatg

SEQ ID NO: 67818 - DNA, 103 bp, Artificial Sequence
  Synthetic Polynucleotide
taatacgactcactatagggtatcgtatttatcgaatgatatgtattttgaacagaggagacaaaatatgtatcattcgaacctggcggcagcgcaaaagatg

SEQ ID NO: 67819 - DNA, 103 bp, Artificial Sequence
  Synthetic Polynucleotide
taatacgactcactatagggtatactatcgtatttatcgaatgatatgtaaacagaggagatacataatgttcgataaaaacctggcggcagcgcaaaagatg

SEQ ID NO: 67820 - DNA, 103 bp, Artificial Sequence
  Synthetic Polynucleotide
taatacgactcactataggggttattatactatcgtatttatcgaatgataacagaggagaatcattatgtaaatacgaaacctggcggcagcgcaaaagatg

SEQ ID NO: 67821 - DNA, 103 bp, Artificial Sequence
  Synthetic Polynucleotide
taatacgactcactatagggatttagttattatactatcgtatttatcgaaacagaggagatcgataatgacgatagtaaacctggcggcagcgcaaaagatg

SEQ ID NO: 67822 - DNA, 103 bp, Artificial Sequence
  Synthetic Polynucleotide
taatacgactcactatagggatagcatttagttattatactatcgtatttaacagaggagaaaatacatgagtataataaacctggcggcagcgcaaaagatg

SEQ ID NO: 67823 - DNA, 103 bp, Artificial Sequence
  Synthetic Polynucleotide
taatacgactcactatagggtcttcatagcatttagttattatactatcgaacagaggagacgatagatgaataactaaaacctggcggcagcgcaaaagatg

SEQ ID NO: 67824 - DNA, 103 bp, Artificial Sequence
  Synthetic Polynucleotide
taatacgactcactatagggttgtttcttcatagcatttagttattatacaacagaggagagtataaatgctaaatgctaacctggcggcagcgcaaaagatg

SEQ ID NO: 67825 - DNA, 103 bp, Artificial Sequence
  Synthetic Polynucleotide
taatacgactcactatagggcaatattgtttcttcatagcatttagttataacagaggagaataactatgtgctatgaaaacctggcggcagcgcaaaagatg

SEQ ID NO: 67826 - DNA, 103 bp, Artificial Sequence
  Synthetic Polynucleotide
taatacgactcactatagggagcataaaacgcctctatattatctttcggaacagaggagaccgaaaatgaatatagagaacctggcggcagcgcaaaagatg

SEQ ID NO: 67827 - DNA, 103 bp, Artificial Sequence
  Synthetic Polynucleotide
taatacgactcactatagggttgagcaatattgtttcttcatagcatttaaacagaggagataaatgatgtgaagaaacaacctggcggcagcgcaaaagatg

SEQ ID NO: 67828 - DNA, 103 bp, Artificial Sequence
  Synthetic Polynucleotide
taatacgactcactatagggatagtttgagcaatattgtttcttcatagcaacagaggagagctatgatgaaacaatataacctggcggcagcgcaaaagatg

SEQ ID NO: 67829 - DNA, 103 bp, Artificial Sequence
  Synthetic Polynucleotide
taatacgactcactatagggagtggatagtttgagcaatattgtttcttcaacagaggagagaagaaatgatattgctcaacctggcggcagcgcaaaagatg

SEQ ID NO: 67830 - DNA, 103 bp, Artificial Sequence
  Synthetic Polynucleotide
taatacgactcactatagggagaacagtggatagtttgagcaatattgttaacagaggagaaacaatatggctcaaactaacctggcggcagcgcaaaagatg

SEQ ID NO: 67831 - DNA, 103 bp, Artificial Sequence
  Synthetic Polynucleotide
taatacgactcactatagggtgtctagaacagtggatagtttgagcaataaacagaggagatattgcatgaactatccaaacctggcggcagcgcaaaagatg

SEQ ID NO: 67832 - DNA, 103 bp, Artificial Sequence
  Synthetic Polynucleotide
taatacgactcactatagggtgttgtgtctagaacagtggatagtttgagaacagaggagactcaaaatgtccactgttaacctggcggcagcgcaaaagatg

SEQ ID NO: 67833 - DNA, 103 bp, Artificial Sequence
  Synthetic Polynucleotide
taatacgactcactatagggtatagtgttgtgtctagaacagtggatagtaacagaggagaactatcatgtgttctagaaacctggcggcagcgcaaaagatg

SEQ ID NO: 67834 - DNA, 103 bp, Artificial Sequence
  Synthetic Polynucleotide
taatacgactcactatagggcagaatatagtgttgtgtctagaacagtggaacagaggagaccactgatgtagacacaaaacctggcggcagcgcaaaagatg

SEQ ID NO: 67835 - DNA, 103 bp, Artificial Sequence
  Synthetic Polynucleotide
taatacgactcactatagggtaaaacagaatatagtgttgtgtctagaacaacagaggagagttctaatgacaacactaaacctggcggcagcgcaaaagatg

SEQ ID NO: 67836 - DNA, 103 bp, Artificial Sequence
  Synthetic Polynucleotide
taatacgactcactatagggcatcttaaaacagaatatagtgttgtgtctaacagaggagaagacacatgactatattcaacctggcggcagcgcaaaagatg

SEQ ID NO: 67837 - DNA, 103 bp, Artificial Sequence
  Synthetic Polynucleotide
taatacgactcactatagggtaaacagcataaaacgcctctatattatctaacagaggagaagataaatgagaggcgttaacctggcggcagcgcaaaagatg

SEQ ID NO: 67838 - DNA, 103 bp, Artificial Sequence
  Synthetic Polynucleotide
taatacgactcactatagggtatgacatcttaaaacagaatatagtgttgaacagaggagacaacacatgattctgtttaacctggcggcagcgcaaaagatg

SEQ ID NO: 67839 - DNA, 103 bp, Artificial Sequence
  Synthetic Polynucleotide
taatacgactcactatagggcgaattatgacatcttaaaacagaatatagaacagaggagactatatatggttttaagaaacctggcggcagcgcaaaagatg

SEQ ID NO: 67840 - DNA, 103 bp, Artificial Sequence
  Synthetic Polynucleotide
taatacgactcactatagggtttctcgaattatgacatcttaaaacagaaaacagaggagattctgtatgaagatgtcaaacctggcggcagcgcaaaagatg

SEQ ID NO: 67841 - DNA, 103 bp, Artificial Sequence
  Synthetic Polynucleotide
taatacgactcactatagggttaactttctcgaattatgacatcttaaaaaacagaggagattttaaatggtcataattaacctggcggcagcgcaaaagatg

SEQ ID NO: 67842 - DNA, 103 bp, Artificial Sequence
  Synthetic Polynucleotide
taatacgactcactatagggtctttttaactttctcgaattatgacatctaacagaggagaagatgtatgaattcgagaaacctggcggcagcgcaaaagatg

SEQ ID NO: 67843 - DNA, 103 bp, Artificial Sequence
  Synthetic Polynucleotide
taatacgactcactatagggaggtatctttttaactttctcgaattatgaaacagaggagatcataaatggagaaagttaacctggcggcagcgcaaaagatg

SEQ ID NO: 67844 - DNA, 103 bp, Artificial Sequence
  Synthetic Polynucleotide
taatacgactcactatagggcgctgaggtatctttttaactttctcgaataacagaggagaattcgaatgagttaaaaaaacctggcggcagcgcaaaagatg

SEQ ID NO: 67845 - DNA, 103 bp, Artificial Sequence
  Synthetic Polynucleotide
taatacgactcactatagggtaacacgctgaggtatctttttaactttctaacagaggagaagaaagatgaaaagatacaacctggcggcagcgcaaaagatg

SEQ ID NO: 67846 - DNA, 103 bp, Artificial Sequence
  Synthetic Polynucleotide
taatacgactcactatagggttttttaacacgctgaggtatctttttaacaacagaggagagttaaaatgatacctcagaacctggcggcagcgcaaaagatg

SEQ ID NO: 67847 - DNA, 103 bp, Artificial Sequence
  Synthetic Polynucleotide
taatacgactcactatagggtatatttttttaacacgctgaggtatctttaacagaggagaaaagatatgtcagcgtgtaacctggcggcagcgcaaaagatg

SEQ ID NO: 67848 - DNA, 103 bp, Artificial Sequence
  Synthetic Polynucleotide
taatacgactcactatagggtgcgataaacagcataaaacgcctctatataacagaggagaatatagatgcgttttatgaacctggcggcagcgcaaaagatg

SEQ ID NO: 67849 - DNA, 103 bp, Artificial Sequence
  Synthetic Polynucleotide
taatacgactcactatagggattattatatttttttaacacgctgaggtaaacagaggagatacctcatggtgttaaaaaacctggcggcagcgcaaaagatg

SEQ ID NO: 67850 - DNA, 103 bp, Artificial Sequence
  Synthetic Polynucleotide
taatacgactcactatagggttatcattattatatttttttaacacgctgaacagaggagacagcgtatgaaaaaaataaacctggcggcagcgcaaaagatg

SEQ ID NO: 67851 - DNA, 103 bp, Artificial Sequence
  Synthetic Polynucleotide
taatacgactcactatagggaggacttatcattattatatttttttaacaaacagaggagatgttaaatgaatataataaacctggcggcagcgcaaaagatg

SEQ ID NO: 67852 - DNA, 103 bp, Artificial Sequence
  Synthetic Polynucleotide
taatacgactcactatagggtttgaaggacttatcattattatattttttaacagaggagaaaaaaaatgaataatgataacctggcggcagcgcaaaagatg

SEQ ID NO: 67853 - DNA, 103 bp, Artificial Sequence
  Synthetic Polynucleotide
taatacgactcactatagggtatattttgaaggacttatcattattatataacagaggagaatataaatgtgataagtcaacctggcggcagcgcaaaagatg

SEQ ID NO: 67854 - DNA, 103 bp, Artificial Sequence
  Synthetic Polynucleotide
taatacgactcactatagggtagaatatattttgaaggacttatcattataacagaggagaataatgatgagtccttcaaacctggcggcagcgcaaaagatg

SEQ ID NO: 67855 - DNA, 103 bp, Artificial Sequence
  Synthetic Polynucleotide
taatacgactcactatagggaatattagaatatattttgaaggacttatcaacagaggagagataagatgttcaaaataaacctggcggcagcgcaaaagatg

SEQ ID NO: 67856 - DNA, 103 bp, Artificial Sequence
  Synthetic Polynucleotide
taatacgactcactatagggttcataatattagaatatattttgaaggacaacagaggagagtccttatgaatatattcaacctggcggcagcgcaaaagatg

SEQ ID NO: 67857 - DNA, 103 bp, Artificial Sequence
  Synthetic Polynucleotide
taatacgactcactatagggtctcattcataatattagaatatattttgaaacagaggagatcaaaaatgattctaataaacctggcggcagcgcaaaagatg

SEQ ID NO: 67858 - DNA, 103 bp, Artificial Sequence
  Synthetic Polynucleotide
taatacgactcactataggggtatctctcattcataatattagaatatataacagaggagaatatatatgaatattatgaacctggcggcagcgcaaaagatg

SEQ ID NO: 67859 - DNA, 103 bp, Artificial Sequence
  Synthetic Polynucleotide
taatacgactcactatagggacgcgtgcgataaacagcataaaacgcctcaacagaggagagaggcgatgtatgctgttaacctggcggcagcgcaaaagatg

SEQ ID NO: 67860 - DNA, 103 bp, Artificial Sequence
  Synthetic Polynucleotide
taatacgactcactatagggttaaggtatctctcattcataatattagaaaacagaggagattctaaatgtatgaatgaaacctggcggcagcgcaaaagatg

SEQ ID NO: 67861 - DNA, 103 bp, Artificial Sequence
  Synthetic Polynucleotide
taatacgactcactatagggagacattaaggtatctctcattcataatataacagaggagaatattaatgatgagagataacctggcggcagcgcaaaagatg

SEQ ID NO: 67862 - DNA, 103 bp, Artificial Sequence
  Synthetic Polynucleotide
taatacgactcactatagggataatagacattaaggtatctctcattcataacagaggagaatgaatatgagataccttaacctggcggcagcgcaaaagatg

SEQ ID NO: 67863 - DNA, 103 bp, Artificial Sequence
  Synthetic Polynucleotide
taatacgactcactatagggtctttataatagacattaaggtatctctcaaacagaggagatgagagatgccttaatgtaacctggcggcagcgcaaaagatg

SEQ ID NO: 67864 - DNA, 103 bp, Artificial Sequence
  Synthetic Polynucleotide
taatacgactcactatagggacatatctttataatagacattaaggtatcaacagaggagagataccatgatgtctattaacctggcggcagcgcaaaagatg

SEQ ID NO: 67865 - DNA, 103 bp, Artificial Sequence
  Synthetic Polynucleotide
taatacgactcactatagggcacatacatatctttataatagacattaagaacagaggagacttaatatgtattataaaaacctggcggcagcgcaaaagatg

SEQ ID NO: 67866 - DNA, 103 bp, Artificial Sequence
  Synthetic Polynucleotide
taatacgactcactatagggtttgacacatacatatctttataatagacaaacagaggagatgtctaatgtaaagatataacctggcggcagcgcaaaagatg

SEQ ID NO: 67867 - DNA, 103 bp, Artificial Sequence
  Synthetic Polynucleotide
taatacgactcactatagggatacttttgacacatacatatctttataataacagaggagaattataatgatatgtatgaacctggcggcagcgcaaaagatg

SEQ ID NO: 67868 - DNA, 103 bp, Artificial Sequence
  Synthetic Polynucleotide
taatacgactcactatagggatcgtatacttttgacacatacatatctttaacagaggagaaaagatatgtatgtgtcaaacctggcggcagcgcaaaagatg

SEQ ID NO: 67869 - DNA, 103 bp, Artificial Sequence
  Synthetic Polynucleotide
taatacgactcactatagggagtttatcgtatacttttgacacatacataaacagaggagatatgtaatggtcaaaagtaacctggcggcagcgcaaaagatg

SEQ ID NO: 67870 - DNA, 103 bp, Artificial Sequence
  Synthetic Polynucleotide
taatacgactcactatagggtccaaacgcgtgcgataaacagcataaaacaacagaggagagttttaatgtgtttatcgaacctggcggcagcgcaaaagatg

SEQ ID NO: 67871 - DNA, 103 bp, Artificial Sequence
  Synthetic Polynucleotide
taatacgactcactataggggaaatagtttatcgtatacttttgacacataacagaggagaatgtgtatgaagtatacgaacctggcggcagcgcaaaagatg

SEQ ID NO: 67872 - DNA, 103 bp, Artificial Sequence
  Synthetic Polynucleotide
taatacgactcactatagggaacaggaaatagtttatcgtatacttttgaaacagaggagatcaaaaatgtacgataaaaacctggcggcagcgcaaaagatg

SEQ ID NO: 67873 - DNA, 103 bp, Artificial Sequence
  Synthetic Polynucleotide
taatacgactcactataggggtgaaaacaggaaatagtttatcgtatactaacagaggagaagtataatgtaaactattaacctggcggcagcgcaaaagatg

SEQ ID NO: 67874 - DNA, 103 bp, Artificial Sequence
  Synthetic Polynucleotide
taatacgactcactatagggtatctgtgaaaacaggaaatagtttatcgtaacagaggagaacgataatgtatttcctgaacctggcggcagcgcaaaagatg

SEQ ID NO: 67875 - DNA, 103 bp, Artificial Sequence
  Synthetic Polynucleotide
taatacgactcactatagggttttttatctgtgaaaacaggaaatagtttaacagaggagaaaactaatgcctgttttcaacctggcggcagcgcaaaagatg

SEQ ID NO: 67876 - DNA, 103 bp, Artificial Sequence
  Synthetic Polynucleotide
taatacgactcactatagggagacattttttatctgtgaaaacaggaaataacagaggagaatttccatgtttcacagaaacctggcggcagcgcaaaagatg

SEQ ID NO: 67877 - DNA, 103 bp, Artificial Sequence
  Synthetic Polynucleotide
taatacgactcactatagggttagtagacattttttatctgtgaaaacagaacagaggagactgtttatgcagataaaaaacctggcggcagcgcaaaagatg

SEQ ID NO: 67878 - DNA, 103 bp, Artificial Sequence
  Synthetic Polynucleotide
taatacgactcactatagggtaatgttagtagacattttttatctgtgaaaacagaggagattcacaatgaaaaaatgtaacctggcggcagcgcaaaagatg

SEQ ID NO: 67879 - DNA, 103 bp, Artificial Sequence
  Synthetic Polynucleotide
taatacgactcactatagggggtagtaatgttagtagacattttttatctaacagaggagaagataaatgatgtctactaacctggcggcagcgcaaaagatg

SEQ ID NO: 67880 - DNA, 103 bp, Artificial Sequence
  Synthetic Polynucleotide
taatacgactcactatagggctgaaggtagtaatgttagtagacatttttaacagaggagaaaaaatatgtactaacataacctggcggcagcgcaaaagatg

SEQ ID NO: 67881 - DNA, 103 bp, Artificial Sequence
  Synthetic Polynucleotide
taatacgactcactataggggcagatccaaacgcgtgcgataaacagcataacagaggagaatgctgatgatcgcacgcaacctggcggcagcgcaaaagatg

SEQ ID NO: 67882 - DNA, 103 bp, Artificial Sequence
  Synthetic Polynucleotide
taatacgactcactatagggaatttctgaaggtagtaatgttagtagacaaacagaggagatgtctaatgacattactaaacctggcggcagcgcaaaagatg

SEQ ID NO: 67883 - DNA, 103 bp, Artificial Sequence
  Synthetic Polynucleotide
taatacgactcactatagggtatataatttctgaaggtagtaatgttagtaacagaggagaactaacatgactaccttcaacctggcggcagcgcaaaagatg

SEQ ID NO: 67884 - DNA, 103 bp, Artificial Sequence
  Synthetic Polynucleotide
taatacgactcactatagggtttcatatataatttctgaaggtagtaatgaacagaggagacattacatgcttcagaaaaacctggcggcagcgcaaaagatg

SEQ ID NO: 67885 - DNA, 103 bp, Artificial Sequence
  Synthetic Polynucleotide
taatacgactcactatagggtaatatttcatatataatttctgaaggtagaacagaggagactacctatggaaattataaacctggcggcagcgcaaaagatg

SEQ ID NO: 67886 - DNA, 103 bp, Artificial Sequence
  Synthetic Polynucleotide
taatacgactcactatagggatgtataatatttcatatataatttctgaaaacagaggagattcagaatgtatatatgaaacctggcggcagcgcaaaagatg

SEQ ID NO: 67887 - DNA, 103 bp, Artificial Sequence
  Synthetic Polynucleotide
taatacgactcactatagggttaacatgtataatatttcatatataatttaacagaggagaaaattaatgatgaaatataacctggcggcagcgcaaaagatg

SEQ ID NO: 67888 - DNA, 103 bp, Artificial Sequence
  Synthetic Polynucleotide
taatacgactcactatagggaattgttaacatgtataatatttcatatataacagaggagaatatatatgatattatacaacctggcggcagcgcaaaagatg

SEQ ID NO: 67889 - DNA, 103 bp, Artificial Sequence
  Synthetic Polynucleotide
taatacgactcactatagggtcgtaaattgttaacatgtataatatttcaaacagaggagatgaaatatgatacatgttaacctggcggcagcgcaaaagatg

SEQ ID NO: 67890 - DNA, 103 bp, Artificial Sequence
  Synthetic Polynucleotide
taatacgactcactatagggaaagatcgtaaattgttaacatgtataataaacagaggagatattatatgtgttaacaaaacctggcggcagcgcaaaagatg

SEQ ID NO: 67891 - DNA, 103 bp, Artificial Sequence
  Synthetic Polynucleotide
taatacgactcactatagggattataaagatcgtaaattgttaacatgtaaacagaggagatacatgatgacaatttacaacctggcggcagcgcaaaagatg

SEQ ID NO: 67892 - DNA, 103 bp, Artificial Sequence
  Synthetic Polynucleotide
taatacgactcactatagggacggcgcagatccaaacgcgtgcgataaacaacagaggagagtttatatgacgcgtttgaacctggcggcagcgcaaaagatg

SEQ ID NO: 67893 - DNA, 103 bp, Artificial Sequence
  Synthetic Polynucleotide
taatacgactcactataggggatatattataaagatcgtaaattgttaacaacagaggagagttaacatgttacgatctaacctggcggcagcgcaaaagatg

SEQ ID NO: 67894 - DNA, 103 bp, Artificial Sequence
  Synthetic Polynucleotide
taatacgactcactataggggatacgatatattataaagatcgtaaattgaacagaggagacaatttatgatctttataaacctggcggcagcgcaaaagatg

SEQ ID NO: 67895 - DNA, 103 bp, Artificial Sequence
  Synthetic Polynucleotide
taatacgactcactatagggaggtggatacgatatattataaagatcgtaaacagaggagatacgatatgtataatataaacctggcggcagcgcaaaagatg

SEQ ID NO: 67896 - DNA, 103 bp, Artificial Sequence
  Synthetic Polynucleotide
taatacgactcactatagggttggtaggtggatacgatatattataaagaaacagaggagatctttaatgtatatcgtaaacctggcggcagcgcaaaagatg

SEQ ID NO: 67897 - DNA, 103 bp, Artificial Sequence
  Synthetic Polynucleotide
taatacgactcactatagggatactttggtaggtggatacgatatattataacagaggagaataataatgcgtatccacaacctggcggcagcgcaaaagatg

SEQ ID NO: 67898 - DNA, 103 bp, Artificial Sequence
  Synthetic Polynucleotide
taatacgactcactatagggcaactatactttggtaggtggatacgatataacagaggagaatatcgatgccacctaccaacctggcggcagcgcaaaagatg

SEQ ID NO: 67899 - DNA, 103 bp, Artificial Sequence
  Synthetic Polynucleotide
taatacgactcactatagggaaatacaactatactttggtaggtggatacaacagaggagagtatccatgtaccaaagtaacctggcggcagcgcaaaagatg

SEQ ID NO: 67900 - DNA, 103 bp, Artificial Sequence
  Synthetic Polynucleotide
taatacgactcactatagggattacaaatacaactatactttggtaggtgaacagaggagacacctaatgaagtatagtaacctggcggcagcgcaaaagatg

SEQ ID NO: 67901 - DNA, 103 bp, Artificial Sequence
  Synthetic Polynucleotide
taatacgactcactataggggaaaaattacaaatacaactatactttggtaacagaggagaaccaaaatgtagttgtataacctggcggcagcgcaaaagatg

SEQ ID NO: 67902 - DNA, 103 bp, Artificial Sequence
  Synthetic Polynucleotide
taatacgactcactatagggtatgagaaaaattacaaatacaactatactaacagaggagaagtataatggtatttgtaaacctggcggcagcgcaaaagatg

SEQ ID NO: 67903 - DNA, 103 bp, Artificial Sequence
  Synthetic Polynucleotide
taatacgactcactatagggttgaatgtgttttacgctgtaatagataataacagaggagaattatcatgtacagcgtaaacctggcggcagcgcaaaagatg

SEQ ID NO: 67904 - DNA, 103 bp, Artificial Sequence
  Synthetic Polynucleotide
taatacgactcactataggggacgcacggcgcagatccaaacgcgtgcgaaacagaggagatcgcacatgtttggatctaacctggcggcagcgcaaaagatg

SEQ ID NO: 67905 - DNA, 103 bp, Artificial Sequence
  Synthetic Polynucleotide
taatacgactcactatagggcatcgtatgagaaaaattacaaatacaactaacagaggagaagttgtatgtgtaattttaacctggcggcagcgcaaaagatg

SEQ ID NO: 67906 - DNA, 103 bp, Artificial Sequence
  Synthetic Polynucleotide
taatacgactcactatagggacacacatcgtatgagaaaaattacaaataaacagaggagatatttgatgtttttctcaaacctggcggcagcgcaaaagatg

SEQ ID NO: 67907 - DNA, 103 bp, Artificial Sequence
  Synthetic Polynucleotide
taatacgactcactatagggtttttacacacatcgtatgagaaaaattacaacagaggagagtaattatgctcatacgaaacctggcggcagcgcaaaagatg

SEQ ID NO: 67908 - DNA, 103 bp, Artificial Sequence
  Synthetic Polynucleotide
taatacgactcactatagggatcagtttttacacacatcgtatgagaaaaaacagaggagattttctatgacgatgtgtaacctggcggcagcgcaaaagatg

SEQ ID NO: 67909 - DNA, 103 bp, Artificial Sequence
  Synthetic Polynucleotide
taatacgactcactatagggataatatcagtttttacacacatcgtatgaaacagaggagatcatacatggtgtgtaaaaacctggcggcagcgcaaaagatg

SEQ ID NO: 67910 - DNA, 103 bp, Artificial Sequence
  Synthetic Polynucleotide
taatacgactcactatagggaatttataatatcagtttttacacacatcgaacagaggagacgatgtatgtaaaaactgaacctggcggcagcgcaaaagatg

SEQ ID NO: 67911 - DNA, 103 bp, Artificial Sequence
  Synthetic Polynucleotide
taatacgactcactatagggaagataatttataatatcagtttttacacaaacagaggagatgtgtaatgactgatattaacctggcggcagcgcaaaagatg

SEQ ID NO: 67912 - DNA, 103 bp, Artificial Sequence
  Synthetic Polynucleotide
taatacgactcactatagggacactaagataatttataatatcagtttttaacagaggagaaaaaacatgtattataaaaacctggcggcagcgcaaaagatg

SEQ ID NO: 67913 - DNA, 103 bp, Artificial Sequence
  Synthetic Polynucleotide
taatacgactcactatagggatacgacactaagataatttataatatcagaacagaggagactgataatgtaaattatcaacctggcggcagcgcaaaagatg

SEQ ID NO: 67914 - DNA, 103 bp, Artificial Sequence
  Synthetic Polynucleotide
taatacgactcactatagggtcatcatacgacactaagataatttataataacagaggagaattataatgtatcttagtaacctggcggcagcgcaaaagatg

SEQ ID NO: 67915 - DNA, 103 bp, Artificial Sequence
  Synthetic Polynucleotide
taatacgactcactatagggctattgacgcacggcgcagatccaaacgcgaacagaggagacgcgttatgatctgcgccaacctggcggcagcgcaaaagatg

SEQ ID NO: 67916 - DNA, 103 bp, Artificial Sequence
  Synthetic Polynucleotide
taatacgactcactatagggcatcttcatcatacgacactaagataatttaacagaggagaaaattaatgtagtgtcgtaacctggcggcagcgcaaaagatg

SEQ ID NO: 67917 - DNA, 103 bp, Artificial Sequence
  Synthetic Polynucleotide
taatacgactcactatagggatcgtcatcttcatcatacgacactaagataacagaggagaatcttaatgtcgtatgataacctggcggcagcgcaaaagatg

SEQ ID NO: 67918 - DNA, 103 bp, Artificial Sequence
  Synthetic Polynucleotide
taatacgactcactatagggttttcatcgtcatcttcatcatacgacactaacagaggagaagtgtcatgtgatgaagaaacctggcggcagcgcaaaagatg

SEQ ID NO: 67919 - DNA, 103 bp, Artificial Sequence
  Synthetic Polynucleotide
taatacgactcactatagggcatcattttcatcgtcatcttcatcatacgaacagaggagacgtatgatgaagatgacgaacctggcggcagcgcaaaagatg

SEQ ID NO: 67920 - DNA, 103 bp, Artificial Sequence
  Synthetic Polynucleotide
taatacgactcactatagggtgtaccatcattttcatcgtcatcttcatcaacagaggagagatgaaatggacgatgaaaacctggcggcagcgcaaaagatg

SEQ ID NO: 67921 - DNA, 103 bp, Artificial Sequence
  Synthetic Polynucleotide
taatacgactcactatagggatatatgtaccatcattttcatcgtcatctaacagaggagaagatgaatgtgaaaatgaaacctggcggcagcgcaaaagatg

SEQ ID NO: 67922 - DNA, 103 bp, Artificial Sequence
  Synthetic Polynucleotide
taatacgactcactatagggaaaatatatatgtaccatcattttcatcgtaacagaggagaacgatgatgatgatggtaaacctggcggcagcgcaaaagatg

SEQ ID NO: 67923 - DNA, 103 bp, Artificial Sequence
  Synthetic Polynucleotide
taatacgactcactataggggatacaaaatatatatgtaccatcattttcaacagaggagagaaaatatgggtacatataacctggcggcagcgcaaaagatg

SEQ ID NO: 67924 - DNA, 103 bp, Artificial Sequence
  Synthetic Polynucleotide
taatacgactcactatagggataatgatacaaaatatatatgtaccatcaaacagaggagatgatggatgatatatattaacctggcggcagcgcaaaagatg

SEQ ID NO: 67925 - DNA, 103 bp, Artificial Sequence
  Synthetic Polynucleotide
taatacgactcactatagggtaacaataatgatacaaaatatatatgtacaacagaggagagtacatatgtattttgtaaacctggcggcagcgcaaaagatg

SEQ ID NO: 67926 - DNA, 103 bp, Artificial Sequence
  Synthetic Polynucleotide
taatacgactcactatagggcgatgctattgacgcacggcgcagatccaaaacagaggagattggatatgcgccgtgcgaacctggcggcagcgcaaaagatg

SEQ ID NO: 67927 - DNA, 103 bp, Artificial Sequence
  Synthetic Polynucleotide
taatacgactcactatagggagcaataacaataatgatacaaaatatataaacagaggagatatataatgtgtatcattaacctggcggcagcgcaaaagatg

SEQ ID NO: 67928 - DNA, 103 bp, Artificial Sequence
  Synthetic Polynucleotide
taatacgactcactatagggggaatagcaataacaataatgatacaaaataacagaggagaattttgatgcattattgtaacctggcggcagcgcaaaagatg

SEQ ID NO: 67929 - DNA, 103 bp, Artificial Sequence
  Synthetic Polynucleotide
taatacgactcactatagggactgtggaatagcaataacaataatgatacaacagaggagagtatcaatgttgttattgaacctggcggcagcgcaaaagatg

SEQ ID NO: 67930 - DNA, 103 bp, Artificial Sequence
  Synthetic Polynucleotide
taatacgactcactataggggcgtaactgtggaatagcaataacaataataacagaggagaattattatgattgctattaacctggcggcagcgcaaaagatg

SEQ ID NO: 67931 - DNA, 103 bp, Artificial Sequence
  Synthetic Polynucleotide
taatacgactcactatagggctatggcgtaactgtggaatagcaataacaaacagaggagatgttatatgtattccacaaacctggcggcagcgcaaaagatg

SEQ ID NO: 67932 - DNA, 103 bp, Artificial Sequence
  Synthetic Polynucleotide
taatacgactcactatagggaatgtctatggcgtaactgtggaatagcaaaacagaggagattgctaatgcacagttacaacctggcggcagcgcaaaagatg

SEQ ID NO: 67933 - DNA, 103 bp, Artificial Sequence
  Synthetic Polynucleotide
taatacgactcactatagggttttcaatgtctatggcgtaactgtggaataacagaggagaattccaatgttacgccataacctggcggcagcgcaaaagatg

SEQ ID NO: 67934 - DNA, 103 bp, Artificial Sequence
  Synthetic Polynucleotide
taatacgactcactatagggtttcattttcaatgtctatggcgtaactgtaacagaggagaacagttatgccatagacaaacctggcggcagcgcaaaagatg

SEQ ID NO: 67935 - DNA, 103 bp, Artificial Sequence
  Synthetic Polynucleotide
taatacgactcactatagggtgtgatttcattttcaatgtctatggcgtaaacagaggagatacgccatggacattgaaaacctggcggcagcgcaaaagatg

SEQ ID NO: 67936 - DNA, 103 bp, Artificial Sequence
  Synthetic Polynucleotide
taatacgactcactatagggaaatctgtgatttcattttcaatgtctatgaacagaggagacatagaatgtgaaaatgaaacctggcggcagcgcaaaagatg

SEQ ID NO: 67937 - DNA, 103 bp, Artificial Sequence
  Synthetic Polynucleotide
taatacgactcactatagggagttgcgatgctattgacgcacggcgcagaaacagaggagatctgcgatgtgcgtcaataacctggcggcagcgcaaaagatg

SEQ ID NO: 67938 - DNA, 103 bp, Artificial Sequence
  Synthetic Polynucleotide
taatacgactcactatagggtgaagaaatctgtgatttcattttcaatgtaacagaggagaacattgatgatgaaatcaaacctggcggcagcgcaaaagatg

SEQ ID NO: 67939 - DNA, 103 bp, Artificial Sequence
  Synthetic Polynucleotide
taatacgactcactatagggtttattgaagaaatctgtgatttcattttcaacagaggagagaaaatatgatcacagataacctggcggcagcgcaaaagatg

SEQ ID NO: 67940 - DNA, 103 bp, Artificial Sequence
  Synthetic Polynucleotide
taatacgactcactatagggttcattttattgaagaaatctgtgatttcaaacagaggagatgaaatatgagatttcttaacctggcggcagcgcaaaagatg

SEQ ID NO: 67941 - DNA, 103 bp, Artificial Sequence
  Synthetic Polynucleotide
taatacgactcactatagggtatctttcattttattgaagaaatctgtgaaacagaggagatcacagatgtcttcaataaacctggcggcagcgcaaaagatg

SEQ ID NO: 67942 - DNA, 103 bp, Artificial Sequence
  Synthetic Polynucleotide
taatacgactcactatagggtagagtatctttcattttattgaagaaatcaacagaggagagatttcatgaataaaatgaacctggcggcagcgcaaaagatg

SEQ ID NO: 67943 - DNA, 103 bp, Artificial Sequence
  Synthetic Polynucleotide
taatacgactcactataggggctggtagagtatctttcattttattgaagaacagaggagacttcaaatgaatgaaagaaacctggcggcagcgcaaaagatg

SEQ ID NO: 67944 - DNA, 103 bp, Artificial Sequence
  Synthetic Polynucleotide
taatacgactcactatagggctttagctggtagagtatctttcattttataacagaggagaataaaaatgaagatactcaacctggcggcagcgcaaaagatg

SEQ ID NO: 67945 - DNA, 103 bp, Artificial Sequence
  Synthetic Polynucleotide
taatacgactcactatagggagagtctttagctggtagagtatctttcataacagaggagaatgaaaatgactctaccaaacctggcggcagcgcaaaagatg

SEQ ID NO: 67946 - DNA, 103 bp, Artificial Sequence
  Synthetic Polynucleotide
taatacgactcactatagggcatttagagtctttagctggtagagtatctaacagaggagaagatacatgaccagctaaaacctggcggcagcgcaaaagatg

SEQ ID NO: 67947 - DNA, 103 bp, Artificial Sequence
  Synthetic Polynucleotide
taatacgactcactatagggtcaaccatttagagtctttagctggtagagaacagaggagactctacatgctaaagactaacctggcggcagcgcaaaagatg

SEQ ID NO: 67948 - DNA, 103 bp, Artificial Sequence
  Synthetic Polynucleotide
taatacgactcactatagggagaatagttgcgatgctattgacgcacggcaacagaggagagccgtgatgcaatagcataacctggcggcagcgcaaaagatg

SEQ ID NO: 67949 - DNA, 103 bp, Artificial Sequence
  Synthetic Polynucleotide
taatacgactcactatagggtggattcaaccatttagagtctttagctggaacagaggagaccagctatggactctaaaaacctggcggcagcgcaaaagatg

SEQ ID NO: 67950 - DNA, 103 bp, Artificial Sequence
  Synthetic Polynucleotide
taatacgactcactatagggcatgttggattcaaccatttagagtctttaaacagaggagataaagaatgtaaatggttaacctggcggcagcgcaaaagatg

SEQ ID NO: 67951 - DNA, 103 bp, Artificial Sequence
  Synthetic Polynucleotide
taatacgactcactatagggatatacatgttggattcaaccatttagagtaacagaggagaactctaatgggttgaatcaacctggcggcagcgcaaaagatg

SEQ ID NO: 67952 - DNA, 103 bp, Artificial Sequence
  Synthetic Polynucleotide
taatacgactcactatagggtccaaatatacatgttggattcaaccatttaacagaggagaaaatggatgaatccaacaaacctggcggcagcgcaaaagatg

SEQ ID NO: 67953 - DNA, 103 bp, Artificial Sequence
  Synthetic Polynucleotide
taatacgactcactataggggtgcctccaaatatacatgttggattcaacaacagaggagagttgaaatgaacatgtataacctggcggcagcgcaaaagatg

SEQ ID NO: 67954 - DNA, 103 bp, Artificial Sequence
  Synthetic Polynucleotide
taatacgactcactatagggtcattgtgcctccaaatatacatgttggataacagaggagaatccaaatggtatatttgaacctggcggcagcgcaaaagatg

SEQ ID NO: 67955 - DNA, 103 bp, Artificial Sequence
  Synthetic Polynucleotide
taatacgactcactatagggattattcattgtgcctccaaatatacatgtaacagaggagaacatgtatgtttggaggcaacctggcggcagcgcaaaagatg

SEQ ID NO: 67956 - DNA, 103 bp, Artificial Sequence
  Synthetic Polynucleotide
taatacgactcactataggggccatattattcattgtgcctccaaatataaacagaggagatatattatgaggcacaataacctggcggcagcgcaaaagatg

SEQ ID NO: 67957 - DNA, 103 bp, Artificial Sequence
  Synthetic Polynucleotide
taatacgactcactatagggtagcagccatattattcattgtgcctccaaaacagaggagattggagatgcaatgaataaacctggcggcagcgcaaaagatg

SEQ ID NO: 67958 - DNA, 103 bp, Artificial Sequence
  Synthetic Polynucleotide
taatacgactcactatagggtcctatagcagccatattattcattgtgccaacagaggagaggcacaatgaataatatgaacctggcggcagcgcaaaagatg

SEQ ID NO: 67959 - DNA, 103 bp, Artificial Sequence
  Synthetic Polynucleotide
taatacgactcactatagggataatagaatagttgcgatgctattgacgcaacagaggagagcgtcaatggcatcgcaaaacctggcggcagcgcaaaagatg

SEQ ID NO: 67960 - DNA, 103 bp, Artificial Sequence
  Synthetic Polynucleotide
taatacgactcactatagggggctctcctatagcagccatattattcattaacagaggagaaatgaaatgtatggctgcaacctggcggcagcgcaaaagatg

SEQ ID NO: 67961 - DNA, 103 bp, Artificial Sequence
  Synthetic Polynucleotide
taatacgactcactatagggtgaatggctctcctatagcagccatattataacagaggagaataataatgctgctatagaacctggcggcagcgcaaaagatg

SEQ ID NO: 67962 - DNA, 103 bp, Artificial Sequence
  Synthetic Polynucleotide
taatacgactcactatagggtgcactgaatggctctcctatagcagccataacagaggagaatggctatgataggagagaacctggcggcagcgcaaaagatg

SEQ ID NO: 67963 - DNA, 103 bp, Artificial Sequence
  Synthetic Polynucleotide
taatacgactcactatagggcactttgcactgaatggctctcctatagcaaacagaggagatgctatatgagagccattaacctggcggcagcgcaaaagatg

SEQ ID NO: 67964 - DNA, 103 bp, Artificial Sequence
  Synthetic Polynucleotide
taatacgactcactataggggaggacactttgcactgaatggctctcctaaacagaggagataggagatgcattcagtgaacctggcggcagcgcaaaagatg

SEQ ID NO: 67965 - DNA, 103 bp, Artificial Sequence
  Synthetic Polynucleotide
taatacgactcactatagggaataggaggacactttgcactgaatggctcaacagaggagagagccaatgagtgcaaagaacctggcggcagcgcaaaagatg

SEQ ID NO: 67966 - DNA, 103 bp, Artificial Sequence
  Synthetic Polynucleotide
taatacgactcactatagggtcttcaataggaggacactttgcactgaataacagaggagaattcagatgaaagtgtccaacctggcggcagcgcaaaagatg

SEQ ID NO: 67967 - DNA, 103 bp, Artificial Sequence
  Synthetic Polynucleotide
taatacgactcactataggggactgtcttcaataggaggacactttgcacaacagaggagagtgcaaatggtcctcctaaacctggcggcagcgcaaaagatg

SEQ ID NO: 67968 - DNA, 103 bp, Artificial Sequence
  Synthetic Polynucleotide
taatacgactcactatagggtaaaagactgtcttcaataggaggacacttaacagaggagaaagtgtatgcctattgaaaacctggcggcagcgcaaaagatg

SEQ ID NO: 67969 - DNA, 103 bp, Artificial Sequence
  Synthetic Polynucleotide
taatacgactcactatagggcgcgataaaagactgtcttcaataggaggaaacagaggagatcctccatgtgaagacagaacctggcggcagcgcaaaagatg

SEQ ID NO: 67970 - DNA, 103 bp, Artificial Sequence
  Synthetic Polynucleotide
taatacgactcactatagggtaataataatagaatagttgcgatgctattaacagaggagaaatagcatggcaactattaacctggcggcagcgcaaaagatg

SEQ ID NO: 67971 - DNA, 103 bp, Artificial Sequence
  Synthetic Polynucleotide
taatacgactcactatagggatctacgcgataaaagactgtcttcaatagaacagaggagactattgatgacagtctttaacctggcggcagcgcaaaagatg

SEQ ID NO: 67972 - DNA, 103 bp, Artificial Sequence
  Synthetic Polynucleotide
taatacgactcactatagggtatatatctacgcgataaaagactgtcttcaacagaggagagaagacatgcttttatcgaacctggcggcagcgcaaaagatg

SEQ ID NO: 67973 - DNA, 103 bp, Artificial Sequence
  Synthetic Polynucleotide
taatacgactcactatagggttatttatatatctacgcgataaaagactgaacagaggagacagtctatgatcgcgtagaacctggcggcagcgcaaaagatg

SEQ ID NO: 67974 - DNA, 103 bp, Artificial Sequence
  Synthetic Polynucleotide
taatacgactcactatagggtgtctttatttatatatctacgcgataaaaaacagaggagattttatatggtagatataaacctggcggcagcgcaaaagatg

SEQ ID NO: 67975 - DNA, 103 bp, Artificial Sequence
  Synthetic Polynucleotide
taatacgactcactatagggtacgttgtctttatttatatatctacgcgaaacagaggagatcgcgtatgtatataaataacctggcggcagcgcaaaagatg

SEQ ID NO: 67976 - DNA, 103 bp, Artificial Sequence
  Synthetic Polynucleotide
taatacgactcactatagggttaactacgttgtctttatttatatatctaaacagaggagatagataatgaaataaagaaacctggcggcagcgcaaaagatg

SEQ ID NO: 67977 - DNA, 103 bp, Artificial Sequence
  Synthetic Polynucleotide
taatacgactcactatagggcccagttaactacgttgtctttatttatataacagaggagaatataaatgaagacaacgaacctggcggcagcgcaaaagatg

SEQ ID NO: 67978 - DNA, 103 bp, Artificial Sequence
  Synthetic Polynucleotide
taatacgactcactatagggtttctcccagttaactacgttgtctttattaacagaggagaaataaaatgaacgtagttaacctggcggcagcgcaaaagatg

SEQ ID NO: 67979 - DNA, 103 bp, Artificial Sequence
  Synthetic Polynucleotide
taatacgactcactatagggcctattttctcccagttaactacgttgtctaacagaggagaagacaaatgagttaactgaacctggcggcagcgcaaaagatg

SEQ ID NO: 67980 - DNA, 103 bp, Artificial Sequence
  Synthetic Polynucleotide
taatacgactcactatagggtttttcctattttctcccagttaactacgtaacagaggagaacgtagatgactgggagaaacctggcggcagcgcaaaagatg

SEQ ID NO: 67981 - DNA, 103 bp, Artificial Sequence
  Synthetic Polynucleotide
taatacgactcactatagggaaaattaataataatagaatagttgcgatgaacagaggagacatcgcatgtattctattaacctggcggcagcgcaaaagatg

SEQ ID NO: 67982 - DNA, 103 bp, Artificial Sequence
  Synthetic Polynucleotide
taatacgactcactatagggtctagtttttcctattttctcccagttaacaacagaggagagttaacatggagaaaataaacctggcggcagcgcaaaagatg

SEQ ID NO: 67983 - DNA, 103 bp, Artificial Sequence
  Synthetic Polynucleotide
taatacgactcactatagggggtcgtctagtttttcctattttctcccagaacagaggagactgggaatgaataggaaaaacctggcggcagcgcaaaagatg

SEQ ID NO: 67984 - DNA, 103 bp, Artificial Sequence
  Synthetic Polynucleotide
taatacgactcactatagggtaagaggtcgtctagtttttcctattttctaacagaggagaagaaaaatggaaaaactaaacctggcggcagcgcaaaagatg

SEQ ID NO: 67985 - DNA, 103 bp, Artificial Sequence
  Synthetic Polynucleotide
taatacgactcactatagggtctattaagaggtcgtctagtttttcctataacagaggagaataggaatgactagacgaaacctggcggcagcgcaaaagatg

SEQ ID NO: 67986 - DNA, 103 bp, Artificial Sequence
  Synthetic Polynucleotide
taatacgactcactatagggacacgtctattaagaggtcgtctagtttttaacagaggagaaaaaacatgacgacctctaacctggcggcagcgcaaaagatg

SEQ ID NO: 67987 - DNA, 103 bp, Artificial Sequence
  Synthetic Polynucleotide
taatacgactcactatagggttttaacacgtctattaagaggtcgtctagaacagaggagactagacatgctcttaataaacctggcggcagcgcaaaagatg

SEQ ID NO: 67988 - DNA, 103 bp, Artificial Sequence
  Synthetic Polynucleotide
taatacgactcactatagggaccgtttttaacacgtctattaagaggtcgaacagaggagacgacctatgaatagacgtaacctggcggcagcgcaaaagatg

SEQ ID NO: 67989 - DNA, 103 bp, Artificial Sequence
  Synthetic Polynucleotide
taatacgactcactatagggaagtcaccgtttttaacacgtctattaagaaacagaggagatcttaaatgacgtgttaaaacctggcggcagcgcaaaagatg

SEQ ID NO: 67990 - DNA, 103 bp, Artificial Sequence
  Synthetic Polynucleotide
taatacgactcactatagggtccataagtcaccgtttttaacacgtctataacagaggagaatagacatgttaaaaacgaacctggcggcagcgcaaaagatg

SEQ ID NO: 67991 - DNA, 103 bp, Artificial Sequence
  Synthetic Polynucleotide
taatacgactcactatagggggctatccataagtcaccgtttttaacacgaacagaggagacgtgttatgaacggtgacaacctggcggcagcgcaaaagatg

SEQ ID NO: 67992 - DNA, 103 bp, Artificial Sequence
  Synthetic Polynucleotide
taatacgactcactatagggcttctaaaattaataataatagaatagttgaacagaggagacaactaatgtattattataacctggcggcagcgcaaaagatg

SEQ ID NO: 67993 - DNA, 103 bp, Artificial Sequence
  Synthetic Polynucleotide
taatacgactcactatagggtagttggctatccataagtcaccgtttttaaacagaggagataaaaaatgtgacttatgaacctggcggcagcgcaaaagatg

SEQ ID NO: 67994 - DNA, 103 bp, Artificial Sequence
  Synthetic Polynucleotide
taatacgactcactatagggatgtatagttggctatccataagtcaccgtaacagaggagaacggtgatgtatggatagaacctggcggcagcgcaaaagatg

SEQ ID NO: 67995 - DNA, 103 bp, Artificial Sequence
  Synthetic Polynucleotide
taatacgactcactataggggttagatgtatagttggctatccataagtcaacagaggagagacttaatgatagccaacaacctggcggcagcgcaaaagatg

SEQ ID NO: 67996 - DNA, 103 bp, Artificial Sequence
  Synthetic Polynucleotide
taatacgactcactatagggctgtcgttagatgtatagttggctatccataacagaggagaatggatatgcaactatacaacctggcggcagcgcaaaagatg

SEQ ID NO: 67997 - DNA, 103 bp, Artificial Sequence
  Synthetic Polynucleotide
taatacgactcactataggggatgactgtcgttagatgtatagttggctaaacagaggagatagccaatgatacatctaaacctggcggcagcgcaaaagatg

SEQ ID NO: 67998 - DNA, 103 bp, Artificial Sequence
  Synthetic Polynucleotide
taatacgactcactatagggcatacgatgactgtcgttagatgtatagttaacagaggagaaactatatgtctaacgacaacctggcggcagcgcaaaagatg

SEQ ID NO: 67999 - DNA, 103 bp, Artificial Sequence
  Synthetic Polynucleotide
taatacgactcactatagggaaatacatacgatgactgtcgttagatgtaaacagaggagatacatcatgcgacagtcaaacctggcggcagcgcaaaagatg

SEQ ID NO: 68000 - DNA, 103 bp, Artificial Sequence
  Synthetic Polynucleotide
taatacgactcactatagggtacacaaatacatacgatgactgtcgttagaacagaggagactaacgatggtcatcgtaaacctggcggcagcgcaaaagatg

SEQ ID NO: 68001 - DNA, 103 bp, Artificial Sequence
  Synthetic Polynucleotide
taatacgactcactatagggcactgtacacaaatacatacgatgactgtcaacagaggagagacagtatgcgtatgtataacctggcggcagcgcaaaagatg

SEQ ID NO: 68002 - DNA, 103 bp, Artificial Sequence
  Synthetic Polynucleotide
taatacgactcactataggggtaatcactgtacacaaatacatacgatgaaacagaggagatcatcgatggtatttgtgaacctggcggcagcgcaaaagatg

SEQ ID NO: 68003 - DNA, 103 bp, Artificial Sequence
  Synthetic Polynucleotide
taatacgactcactatagggtatagcttctaaaattaataataatagaataacagaggagaattctaatgttattaattaacctggcggcagcgcaaaagatg

SEQ ID NO: 68004 - DNA, 103 bp, Artificial Sequence
  Synthetic Polynucleotide
taatacgactcactatagggtctttgtaatcactgtacacaaatacatacaacagaggagagtatgtatgtgtgtacagaacctggcggcagcgcaaaagatg

SEQ ID NO: 68005 - DNA, 103 bp, Artificial Sequence
  Synthetic Polynucleotide
taatacgactcactataggggccattctttgtaatcactgtacacaaataaacagaggagatatttgatgacagtgattaacctggcggcagcgcaaaagatg

SEQ ID NO: 68006 - DNA, 103 bp, Artificial Sequence
  Synthetic Polynucleotide
taatacgactcactatagggcagtcgccattctttgtaatcactgtacacaacagaggagagtgtacatggattacaaaaacctggcggcagcgcaaaagatg

SEQ ID NO: 68007 - DNA, 103 bp, Artificial Sequence
  Synthetic Polynucleotide
taatacgactcactataggggaatacagtcgccattctttgtaatcactgaacagaggagacagtgaatgcaaagaatgaacctggcggcagcgcaaaagatg

SEQ ID NO: 68008 - DNA, 103 bp, Artificial Sequence
  Synthetic Polynucleotide
taatacgactcactatagggaccttgaatacagtcgccattctttgtaataacagaggagaattacaatgaatggcgacaacctggcggcagcgcaaaagatg

SEQ ID NO: 68009 - DNA, 103 bp, Artificial Sequence
  Synthetic Polynucleotide
taatacgactcactatagggactataccttgaatacagtcgccattctttaacagaggagaaaagaaatgcgactgtataacctggcggcagcgcaaaagatg

SEQ ID NO: 68010 - DNA, 103 bp, Artificial Sequence
  Synthetic Polynucleotide
taatacgactcactatagggatctaactataccttgaatacagtcgccataacagaggagaatggcgatggtattcaagaacctggcggcagcgcaaaagatg

SEQ ID NO: 68011 - DNA, 103 bp, Artificial Sequence
  Synthetic Polynucleotide
taatacgactcactatagggatgggatctaactataccttgaatacagtcaacagaggagagactgtatgcaaggtataaacctggcggcagcgcaaaagatg

SEQ ID NO: 68012 - DNA, 103 bp, Artificial Sequence
  Synthetic Polynucleotide
taatacgactcactatagggcgtacatgggatctaactataccttgaataaacagaggagatattcaatgtatagttagaacctggcggcagcgcaaaagatg

SEQ ID NO: 68013 - DNA, 103 bp, Artificial Sequence
  Synthetic Polynucleotide
taatacgactcactataggggtttccgtacatgggatctaactataccttaacagaggagaaaggtaatgttagatcccaacctggcggcagcgcaaaagatg

SEQ ID NO: 68014 - DNA, 103 bp, Artificial Sequence
  Synthetic Polynucleotide
taatacgactcactatagggcaatattgaatgtgttttacgctgtaatagaacagaggagactattaatgcgtaaaacaaacctggcggcagcgcaaaagatg

SEQ ID NO: 68015 - DNA, 103 bp, Artificial Sequence
  Synthetic Polynucleotide
taatacgactcactatagggttacatatagcttctaaaattaataataataacagaggagaattattatgaattttagaaacctggcggcagcgcaaaagatg

SEQ ID NO: 68016 - DNA, 103 bp, Artificial Sequence
  Synthetic Polynucleotide
taatacgactcactatagggagaaggtttccgtacatgggatctaactataacagaggagaatagttatgtcccatgtaaacctggcggcagcgcaaaagatg

SEQ ID NO: 68017 - DNA, 103 bp, Artificial Sequence
  Synthetic Polynucleotide
taatacgactcactatagggcatgaagaaggtttccgtacatgggatctaaacagaggagatagatcatgtgtacggaaaacctggcggcagcgcaaaagatg

SEQ ID NO: 68018 - DNA, 103 bp, Artificial Sequence
  Synthetic Polynucleotide
taatacgactcactataggggaatgcatgaagaaggtttccgtacatgggaacagaggagacccatgatgggaaaccttaacctggcggcagcgcaaaagatg

SEQ ID NO: 68019 - DNA, 103 bp, Artificial Sequence
  Synthetic Polynucleotide
taatacgactcactatagggttctggaatgcatgaagaaggtttccgtacaacagaggagagtacggatgccttcttcaaacctggcggcagcgcaaaagatg

SEQ ID NO: 68020 - DNA, 103 bp, Artificial Sequence
  Synthetic Polynucleotide
taatacgactcactatagggtagatttctggaatgcatgaagaaggtttcaacagaggagagaaaccatgttcatgcataacctggcggcagcgcaaaagatg

SEQ ID NO: 68021 - DNA, 103 bp, Artificial Sequence
  Synthetic Polynucleotide
taatacgactcactataggggttcatagatttctggaatgcatgaagaagaacagaggagacttcttatggcattccagaacctggcggcagcgcaaaagatg

SEQ ID NO: 68022 - DNA, 103 bp, Artificial Sequence
  Synthetic Polynucleotide
taatacgactcactatagggacctagttcatagatttctggaatgcatgaaacagaggagatcatgcatgccagaaatcaacctggcggcagcgcaaaagatg

SEQ ID NO: 68023 - DNA, 103 bp, Artificial Sequence
  Synthetic Polynucleotide
taatacgactcactatagggtgagtacctagttcatagatttctggaatgaacagaggagacattccatgaatctatgaaacctggcggcagcgcaaaagatg

SEQ ID NO: 68024 - DNA, 103 bp, Artificial Sequence
  Synthetic Polynucleotide
taatacgactcactatagggtatcatgagtacctagttcatagatttctgaacagaggagacagaaaatgatgaactagaacctggcggcagcgcaaaagatg

SEQ ID NO: 68025 - DNA, 103 bp, Artificial Sequence
  Synthetic Polynucleotide
taatacgactcactatagggatacttatcatgagtacctagttcatagataacagaggagaatctatatgctaggtactaacctggcggcagcgcaaaagatg

SEQ ID NO: 68026 - DNA, 103 bp, Artificial Sequence
  Synthetic Polynucleotide
taatacgactcactatagggatccattacatatagcttctaaaattaataaacagaggagatattaaatgtagaagctaaacctggcggcagcgcaaaagatg

SEQ ID NO: 68027 - DNA, 103 bp, Artificial Sequence
  Synthetic Polynucleotide
taatacgactcactatagggattccatacttatcatgagtacctagttcaaacagaggagatgaactatgtactcatgaaacctggcggcagcgcaaaagatg

SEQ ID NO: 68028 - DNA, 103 bp, Artificial Sequence
  Synthetic Polynucleotide
taatacgactcactatagggagtctattccatacttatcatgagtacctaaacagaggagataggtaatgatgataagtaacctggcggcagcgcaaaagatg

SEQ ID NO: 68029 - DNA, 103 bp, Artificial Sequence
  Synthetic Polynucleotide
taatacgactcactataggggtataagtctattccatacttatcatgagtaacagaggagaactcatatgaagtatggaaacctggcggcagcgcaaaagatg

SEQ ID NO: 68030 - DNA, 103 bp, Artificial Sequence
  Synthetic Polynucleotide
taatacgactcactatagggccacagtataagtctattccatacttatcaaacagaggagatgataaatgtggaatagaaacctggcggcagcgcaaaagatg

SEQ ID NO: 68031 - DNA, 103 bp, Artificial Sequence
  Synthetic Polynucleotide
taatacgactcactatagggtaattccacagtataagtctattccatactaacagaggagaagtatgatgtagacttataacctggcggcagcgcaaaagatg

SEQ ID NO: 68032 - DNA, 103 bp, Artificial Sequence
  Synthetic Polynucleotide
taatacgactcactataggggtaaataattccacagtataagtctattccaacagaggagaggaataatgttatactgtaacctggcggcagcgcaaaagatg

SEQ ID NO: 68033 - DNA, 103 bp, Artificial Sequence
  Synthetic Polynucleotide
taatacgactcactatagggtttgcgtaaataattccacagtataagtctaacagaggagaagacttatgctgtggaataacctggcggcagcgcaaaagatg

SEQ ID NO: 68034 - DNA, 103 bp, Artificial Sequence
  Synthetic Polynucleotide
taatacgactcactatagggaatgttttgcgtaaataattccacagtataaacagaggagatatactatggaattatttaacctggcggcagcgcaaaagatg

SEQ ID NO: 68035 - DNA, 103 bp, Artificial Sequence
  Synthetic Polynucleotide
taatacgactcactatagggattataatgttttgcgtaaataattccacaaacagaggagatgtggaatgatttacgcaaacctggcggcagcgcaaaagatg

SEQ ID NO: 68036 - DNA, 103 bp, Artificial Sequence
  Synthetic Polynucleotide
taatacgactcactatagggatattattataatgttttgcgtaaataattaacagaggagaaattatatgcgcaaaacaaacctggcggcagcgcaaaagatg

SEQ ID NO: 68037 - DNA, 103 bp, Artificial Sequence
  Synthetic Polynucleotide
taatacgactcactatagggaaattatccattacatatagcttctaaaataacagaggagaattttaatggctatatgtaacctggcggcagcgcaaaagatg

SEQ ID NO: 68038 - DNA, 103 bp, Artificial Sequence
  Synthetic Polynucleotide
taatacgactcactatagggaagttatattattataatgttttgcgtaaaaacagaggagatttacgatgaacattataaacctggcggcagcgcaaaagatg

SEQ ID NO: 68039 - DNA, 103 bp, Artificial Sequence
  Synthetic Polynucleotide
taatacgactcactatagggataccaagttatattattataatgttttgcaacagaggagagcaaaaatgtataataataacctggcggcagcgcaaaagatg

SEQ ID NO: 68040 - DNA, 103 bp, Artificial Sequence
  Synthetic Polynucleotide
taatacgactcactatagggtctttataccaagttatattattataatgtaacagaggagaacattaatgtaatataacaacctggcggcagcgcaaaagatg

SEQ ID NO: 68041 - DNA, 103 bp, Artificial Sequence
  Synthetic Polynucleotide
taatacgactcactatagggtattatctttataccaagttatattattataacagaggagaataataatgtaacttggtaacctggcggcagcgcaaaagatg

SEQ ID NO: 68042 - DNA, 103 bp, Artificial Sequence
  Synthetic Polynucleotide
taatacgactcactatagggttccttattatctttataccaagttatattaacagaggagaaatataatgtggtataaaaacctggcggcagcgcaaaagatg

SEQ ID NO: 68043 - DNA, 103 bp, Artificial Sequence
  Synthetic Polynucleotide
taatacgactcactatagggttaatttccttattatctttataccaagttaacagaggagaaacttgatgtaaagataaaacctggcggcagcgcaaaagatg

SEQ ID NO: 68044 - DNA, 103 bp, Artificial Sequence
  Synthetic Polynucleotide
taatacgactcactatagggcgatattaatttccttattatctttataccaacagaggagaggtataatgataataaggaacctggcggcagcgcaaaagatg

SEQ ID NO: 68045 - DNA, 103 bp, Artificial Sequence
  Synthetic Polynucleotide
taatacgactcactatagggatcatcgatattaatttccttattatctttaacagaggagaaaagatatgaaggaaattaacctggcggcagcgcaaaagatg

SEQ ID NO: 68046 - DNA, 103 bp, Artificial Sequence
  Synthetic Polynucleotide
taatacgactcactatagggttaatatcatcgatattaatttccttattaaacagaggagataataaatgaattaatataacctggcggcagcgcaaaagatg

SEQ ID NO: 68047 - DNA, 103 bp, Artificial Sequence
  Synthetic Polynucleotide
taatacgactcactatagggaatacttaatatcatcgatattaatttcctaacagaggagaaggaaaatgatatcgatgaacctggcggcagcgcaaaagatg

SEQ ID NO: 68048 - DNA, 103 bp, Artificial Sequence
  Synthetic Polynucleotide
taatacgactcactataggggatggaaattatccattacatatagcttctaacagaggagaagaagcatgatgtaatggaacctggcggcagcgcaaaagatg

SEQ ID NO: 68049 - DNA, 103 bp, Artificial Sequence
  Synthetic Polynucleotide
taatacgactcactatagggttgtgaatacttaatatcatcgatattaataacagaggagaattaatatggatgatattaacctggcggcagcgcaaaagatg

SEQ ID NO: 68050 - DNA, 103 bp, Artificial Sequence
  Synthetic Polynucleotide
taatacgactcactatagggcccgtttgtgaatacttaatatcatcgataaacagaggagatatcgaatgtattaagtaaacctggcggcagcgcaaaagatg

SEQ ID NO: 68051 - DNA, 103 bp, Artificial Sequence
  Synthetic Polynucleotide
taatacgactcactatagggcctttcccgtttgtgaatacttaatatcataacagaggagaatgataatgagtattcacaacctggcggcagcgcaaaagatg

SEQ ID NO: 68052 - DNA, 103 bp, Artificial Sequence
  Synthetic Polynucleotide
taatacgactcactatagggtaattcctttcccgtttgtgaatacttaataacagaggagaattaagatgtcacaaacgaacctggcggcagcgcaaaagatg

SEQ ID NO: 68053 - DNA, 103 bp, Artificial Sequence
  Synthetic Polynucleotide
taatacgactcactatagggataattaattcctttcccgtttgtgaatacaacagaggagagtattcatgaacgggaaaaacctggcggcagcgcaaaagatg

SEQ ID NO: 68054 - DNA, 103 bp, Artificial Sequence
  Synthetic Polynucleotide
taatacgactcactatagggtatgaataattaattcctttcccgtttgtgaacagaggagacacaaaatggaaaggaataacctggcggcagcgcaaaagatg

SEQ ID NO: 68055 - DNA, 103 bp, Artificial Sequence
  Synthetic Polynucleotide
taatacgactcactatagggtggattatgaataattaattcctttcccgtaacagaggagaacgggaatggaattaattaacctggcggcagcgcaaaagatg

SEQ ID NO: 68056 - DNA, 103 bp, Artificial Sequence
  Synthetic Polynucleotide
taatacgactcactatagggaatgctggattatgaataattaattcctttaacagaggagaaaaggaatgaattattcaaacctggcggcagcgcaaaagatg

SEQ ID NO: 68057 - DNA, 103 bp, Artificial Sequence
  Synthetic Polynucleotide
taatacgactcactatagggcttctaatgctggattatgaataattaattaacagaggagaaattaaatgttcataatcaacctggcggcagcgcaaaagatg

SEQ ID NO: 68058 - DNA, 103 bp, Artificial Sequence
  Synthetic Polynucleotide
taatacgactcactataggggctatcttctaatgctggattatgaataataacagaggagaattattatgaatccagcaaacctggcggcagcgcaaaagatg

SEQ ID NO: 68059 - DNA, 103 bp, Artificial Sequence
  Synthetic Polynucleotide
taatacgactcactatagggatgatgatggaaattatccattacatatagaacagaggagactatatatgatggataataacctggcggcagcgcaaaagatg

SEQ ID NO: 68060 - DNA, 103 bp, Artificial Sequence
  Synthetic Polynucleotide
taatacgactcactatagggcttccgctatcttctaatgctggattatgaaacagaggagatcataaatgagcattagaaacctggcggcagcgcaaaagatg

SEQ ID NO: 68061 - DNA, 103 bp, Artificial Sequence
  Synthetic Polynucleotide
taatacgactcactatagggcatatcttccgctatcttctaatgctggataacagaggagaatccagatgtagaagataaacctggcggcagcgcaaaagatg

SEQ ID NO: 68062 - DNA, 103 bp, Artificial Sequence
  Synthetic Polynucleotide
taatacgactcactatagggacagtcatatcttccgctatcttctaatgcaacagaggagagcattaatggatagcggaaacctggcggcagcgcaaaagatg

SEQ ID NO: 68063 - DNA, 103 bp, Artificial Sequence
  Synthetic Polynucleotide
taatacgactcactatagggacataacagtcatatcttccgctatcttctaacagaggagaagaagaatgcggaagataaacctggcggcagcgcaaaagatg

SEQ ID NO: 68064 - DNA, 103 bp, Artificial Sequence
  Synthetic Polynucleotide
taatacgactcactatagggaatgaacataacagtcatatcttccgctataacagaggagaatagcgatggatatgactaacctggcggcagcgcaaaagatg

SEQ ID NO: 68065 - DNA, 103 bp, Artificial Sequence
  Synthetic Polynucleotide
taatacgactcactataggggtcgtaatgaacataacagtcatatcttccaacagaggagaggaagaatggactgttataacctggcggcagcgcaaaagatg

SEQ ID NO: 68066 - DNA, 103 bp, Artificial Sequence
  Synthetic Polynucleotide
taatacgactcactatagggacgtcgtcgtaatgaacataacagtcatataacagaggagaatatgaatgttatgttcaaacctggcggcagcgcaaaagatg

SEQ ID NO: 68067 - DNA, 103 bp, Artificial Sequence
  Synthetic Polynucleotide
taatacgactcactatagggttctaacgtcgtcgtaatgaacataacagtaacagaggagaactgttatgttcattacgaacctggcggcagcgcaaaagatg

SEQ ID NO: 68068 - DNA, 103 bp, Artificial Sequence
  Synthetic Polynucleotide
taatacgactcactatagggcttgattctaacgtcgtcgtaatgaacataaacagaggagatatgttatgtacgacgacaacctggcggcagcgcaaaagatg

SEQ ID NO: 68069 - DNA, 103 bp, Artificial Sequence
  Synthetic Polynucleotide
taatacgactcactatagggtcattcttgattctaacgtcgtcgtaatgaaacagaggagatcattaatgcgacgttagaacctggcggcagcgcaaaagatg

SEQ ID NO: 68070 - DNA, 103 bp, Artificial Sequence
  Synthetic Polynucleotide
taatacgactcactataggggacggatgatgatggaaattatccattacaaacagaggagatgtaatatgtaatttccaaacctggcggcagcgcaaaagatg

SEQ ID NO: 68071 - DNA, 103 bp, Artificial Sequence
  Synthetic Polynucleotide
taatacgactcactatagggcgatatcattcttgattctaacgtcgtcgtaacagaggagaacgacgatgttagaatcaaacctggcggcagcgcaaaagatg

SEQ ID NO: 68072 - DNA, 103 bp, Artificial Sequence
  Synthetic Polynucleotide
taatacgactcactatagggtactacgatatcattcttgattctaacgtcaacagaggagagacgttatgatcaagaataacctggcggcagcgcaaaagatg

SEQ ID NO: 68073 - DNA, 103 bp, Artificial Sequence
  Synthetic Polynucleotide
taatacgactcactatagggcttgatactacgatatcattcttgattctaaacagaggagatagaatatggaatgatataacctggcggcagcgcaaaagatg

SEQ ID NO: 68074 - DNA, 103 bp, Artificial Sequence
  Synthetic Polynucleotide
taatacgactcactatagggtacatcttgatactacgatatcattcttgaaacagaggagatcaagaatgatatcgtagaacctggcggcagcgcaaaagatg

SEQ ID NO: 68075 - DNA, 103 bp, Artificial Sequence
  Synthetic Polynucleotide
taatacgactcactatagggtattttacatcttgatactacgatatcattaacagaggagaaatgatatggtagtatcaaacctggcggcagcgcaaaagatg

SEQ ID NO: 68076 - DNA, 103 bp, Artificial Sequence
  Synthetic Polynucleotide
taatacgactcactataggggtaagtattttacatcttgatactacgataaacagaggagatatcgtatgatcaagatgaacctggcggcagcgcaaaagatg

SEQ ID NO: 68077 - DNA, 103 bp, Artificial Sequence
  Synthetic Polynucleotide
taatacgactcactatagggtaaccgtaagtattttacatcttgatactaaacagaggagatagtatatggatgtaaaaaacctggcggcagcgcaaaagatg

SEQ ID NO: 68078 - DNA, 103 bp, Artificial Sequence
  Synthetic Polynucleotide
taatacgactcactatagggcggtataaccgtaagtattttacatcttgaaacagaggagatcaagaatgaaaatacttaacctggcggcagcgcaaaagatg

SEQ ID NO: 68079 - DNA, 103 bp, Artificial Sequence
  Synthetic Polynucleotide
taatacgactcactatagggtgtgacggtataaccgtaagtattttacataacagaggagaatgtaaatgacttacggtaacctggcggcagcgcaaaagatg

SEQ ID NO: 68080 - DNA, 103 bp, Artificial Sequence
  Synthetic Polynucleotide
taatacgactcactatagggggtcttgtgacggtataaccgtaagtatttaacagaggagaaaatacatgcggttatacaacctggcggcagcgcaaaagatg

SEQ ID NO: 68081 - DNA, 103 bp, Artificial Sequence
  Synthetic Polynucleotide
taatacgactcactatagggaatgagacggatgatgatggaaattatccaaacagaggagatggataatgtccatcatcaacctggcggcagcgcaaaagatg

SEQ ID NO: 68082 - DNA, 103 bp, Artificial Sequence
  Synthetic Polynucleotide
taatacgactcactatagggcctgtggtcttgtgacggtataaccgtaagaacagaggagacttacgatgataccgtcaaacctggcggcagcgcaaaagatg

SEQ ID NO: 68083 - DNA, 103 bp, Artificial Sequence
  Synthetic Polynucleotide
taatacgactcactatagggttaaacctgtggtcttgtgacggtataaccaacagaggagaggttatatggtcacaagaaacctggcggcagcgcaaaagatg

SEQ ID NO: 68084 - DNA, 103 bp, Artificial Sequence
  Synthetic Polynucleotide
taatacgactcactatagggttagtttaaacctgtggtcttgtgacggtaaacagaggagataccgtatgaagaccacaaacctggcggcagcgcaaaagatg

SEQ ID NO: 68085 - DNA, 103 bp, Artificial Sequence
  Synthetic Polynucleotide
taatacgactcactatagggtagtattagtttaaacctgtggtcttgtgaaacagaggagatcacaaatgcacaggtttaacctggcggcagcgcaaaagatg

SEQ ID NO: 68086 - DNA, 103 bp, Artificial Sequence
  Synthetic Polynucleotide
taatacgactcactataggggaatctagtattagtttaaacctgtggtctaacagaggagaagaccaatggtttaaactaacctggcggcagcgcaaaagatg

SEQ ID NO: 68087 - DNA, 103 bp, Artificial Sequence
  Synthetic Polynucleotide
taatacgactcactatagggttttcgaatctagtattagtttaaacctgtaacagaggagaacaggtatgaactaatacaacctggcggcagcgcaaaagatg

SEQ ID NO: 68088 - DNA, 103 bp, Artificial Sequence
  Synthetic Polynucleotide
taatacgactcactataggggttgattttcgaatctagtattagtttaaaaacagaggagatttaaaatgatactagataacctggcggcagcgcaaaagatg

SEQ ID NO: 68089 - DNA, 103 bp, Artificial Sequence
  Synthetic Polynucleotide
taatacgactcactatagggattacgttgattttcgaatctagtattagtaacagaggagaactaatatgagattcgaaaacctggcggcagcgcaaaagatg

SEQ ID NO: 68090 - DNA, 103 bp, Artificial Sequence
  Synthetic Polynucleotide
taatacgactcactatagggctataattacgttgattttcgaatctagtaaacagaggagatactagatgcgaaaatcaaacctggcggcagcgcaaaagatg

SEQ ID NO: 68091 - DNA, 103 bp, Artificial Sequence
  Synthetic Polynucleotide
taatacgactcactatagggttctcctataattacgttgattttcgaatcaacagaggagagattcgatgatcaacgtaaacctggcggcagcgcaaaagatg

SEQ ID NO: 68092 - DNA, 103 bp, Artificial Sequence
  Synthetic Polynucleotide
taatacgactcactatagggctccaaatgagacggatgatgatggaaattaacagaggagaaatttcatgcatcatccgaacctggcggcagcgcaaaagatg

SEQ ID NO: 68093 - DNA, 103 bp, Artificial Sequence
  Synthetic Polynucleotide
taatacgactcactataggggcaggttctcctataattacgttgattttcaacagaggagagaaaatatgcgtaattataacctggcggcagcgcaaaagatg

SEQ ID NO: 68094 - DNA, 103 bp, Artificial Sequence
  Synthetic Polynucleotide
taatacgactcactatagggtattggcaggttctcctataattacgttgaaacagaggagatcaacgatgttataggagaacctggcggcagcgcaaaagatg

SEQ ID NO: 68095 - DNA, 103 bp, Artificial Sequence
  Synthetic Polynucleotide
taatacgactcactatagggtgttatattggcaggttctcctataattacaacagaggagagtaattatgggagaacctaacctggcggcagcgcaaaagatg

SEQ ID NO: 68096 - DNA, 103 bp, Artificial Sequence
  Synthetic Polynucleotide
taatacgactcactataggggtgcatgttatattggcaggttctcctataaacagaggagatataggatgacctgccaaaacctggcggcagcgcaaaagatg

SEQ ID NO: 68097 - DNA, 103 bp, Artificial Sequence
  Synthetic Polynucleotide
taatacgactcactatagggcagcagtgcatgttatattggcaggttctcaacagaggagagagaacatgccaatataaaacctggcggcagcgcaaaagatg

SEQ ID NO: 68098 - DNA, 103 bp, Artificial Sequence
  Synthetic Polynucleotide
taatacgactcactatagggtgatacagcagtgcatgttatattggcaggaacagaggagacctgccatgataacatgcaacctggcggcagcgcaaaagatg

SEQ ID NO: 68099 - DNA, 103 bp, Artificial Sequence
  Synthetic Polynucleotide
taatacgactcactataggggacgttgatacagcagtgcatgttatattgaacagaggagacaatatatgatgcactgcaacctggcggcagcgcaaaagatg

SEQ ID NO: 68100 - DNA, 103 bp, Artificial Sequence
  Synthetic Polynucleotide
taatacgactcactatagggataatgacgttgatacagcagtgcatgttaaacagaggagataacatatgctgctgtataacctggcggcagcgcaaaagatg

SEQ ID NO: 68101 - DNA, 103 bp, Artificial Sequence
  Synthetic Polynucleotide
taatacgactcactataggggaacaataatgacgttgatacagcagtgcaaacagaggagatgcactatggtatcaacgaacctggcggcagcgcaaaagatg

SEQ ID NO: 68102 - DNA, 103 bp, Artificial Sequence
  Synthetic Polynucleotide
taatacgactcactatagggtcatcgaacaataatgacgttgatacagcaaacagaggagatgctgtatgaacgtcattaacctggcggcagcgcaaaagatg

SEQ ID NO: 68103 - DNA, 103 bp, Artificial Sequence
  Synthetic Polynucleotide
taatacgactcactatagggatactctccaaatgagacggatgatgatggaacagaggagaccatcaatgtccgtctcaaacctggcggcagcgcaaaagatg

SEQ ID NO: 68104 - DNA, 103 bp, Artificial Sequence
  Synthetic Polynucleotide
taatacgactcactataggggtacatcatcgaacaataatgacgttgataaacagaggagatatcaaatgcattattgtaacctggcggcagcgcaaaagatg

SEQ ID NO: 68105 - DNA, 103 bp, Artificial Sequence
  Synthetic Polynucleotide
taatacgactcactatagggaatcagtacatcatcgaacaataatgacgtaacagaggagaacgtcaatgttgttcgataacctggcggcagcgcaaaagatg

SEQ ID NO: 68106 - DNA, 103 bp, Artificial Sequence
  Synthetic Polynucleotide
taatacgactcactatagggcattcaatcagtacatcatcgaacaataataacagaggagaattattatgcgatgatgtaacctggcggcagcgcaaaagatg

SEQ ID NO: 68107 - DNA, 103 bp, Artificial Sequence
  Synthetic Polynucleotide
taatacgactcactatagggtttcccattcaatcagtacatcatcgaacaaacagaggagatgttcgatgatgtactgaaacctggcggcagcgcaaaagatg

SEQ ID NO: 68108 - DNA, 103 bp, Artificial Sequence
  Synthetic Polynucleotide
taatacgactcactatagggtggattttcccattcaatcagtacatcatcaacagaggagagatgatatgctgattgaaaacctggcggcagcgcaaaagatg

SEQ ID NO: 68109 - DNA, 103 bp, Artificial Sequence
  Synthetic Polynucleotide
taatacgactcactatagggccggatggattttcccattcaatcagtacaaacagaggagatgtactatgtgaatgggaaacctggcggcagcgcaaaagatg

SEQ ID NO: 68110 - DNA, 103 bp, Artificial Sequence
  Synthetic Polynucleotide
taatacgactcactataggggccatccggatggattttcccattcaatcaaacagaggagatgattgatggggaaaatcaacctggcggcagcgcaaaagatg

SEQ ID NO: 68111 - DNA, 103 bp, Artificial Sequence
  Synthetic Polynucleotide
taatacgactcactatagggtataagccatccggatggattttcccattcaacagaggagagaatggatgaatccatccaacctggcggcagcgcaaaagatg

SEQ ID NO: 68112 - DNA, 103 bp, Artificial Sequence
  Synthetic Polynucleotide
taatacgactcactatagggaatcctataagccatccggatggattttccaacagaggagaggaaaaatgatccggatgaacctggcggcagcgcaaaagatg

SEQ ID NO: 68113 - DNA, 103 bp, Artificial Sequence
  Synthetic Polynucleotide
taatacgactcactatagggaatcgaatcctataagccatccggatggataacagaggagaatccatatggatggcttaaacctggcggcagcgcaaaagatg

SEQ ID NO: 68114 - DNA, 103 bp, Artificial Sequence
  Synthetic Polynucleotide
taatacgactcactatagggagaggatactctccaaatgagacggatgataacagaggagaatcatcatgctcatttggaacctggcggcagcgcaaaagatg

SEQ ID NO: 68115 - DNA, 103 bp, Artificial Sequence
  Synthetic Polynucleotide
taatacgactcactatagggatcaaaatcgaatcctataagccatccggaaacagaggagatccggaatgcttataggaaacctggcggcagcgcaaaagatg

SEQ ID NO: 68116 - DNA, 103 bp, Artificial Sequence
  Synthetic Polynucleotide
taatacgactcactatagggtatacatcaaaatcgaatcctataagccataacagaggagaatggctatgaggattcgaaacctggcggcagcgcaaaagatg

SEQ ID NO: 68117 - DNA, 103 bp, Artificial Sequence
  Synthetic Polynucleotide
taatacgactcactatagggcagagtatacatcaaaatcgaatcctataaaacagaggagattatagatgtcgattttgaacctggcggcagcgcaaaagatg

SEQ ID NO: 68118 - DNA, 103 bp, Artificial Sequence
  Synthetic Polynucleotide
taatacgactcactatagggtaaaacagagtatacatcaaaatcgaatccaacagaggagaggattcatgtttgatgtaaacctggcggcagcgcaaaagatg

SEQ ID NO: 68119 - DNA, 103 bp, Artificial Sequence
  Synthetic Polynucleotide
taatacgactcactatagggctagttaaaacagagtatacatcaaaatcgaacagaggagacgatttatgtgtatactcaacctggcggcagcgcaaaagatg

SEQ ID NO: 68120 - DNA, 103 bp, Artificial Sequence
  Synthetic Polynucleotide
taatacgactcactatagggctctactagttaaaacagagtatacatcaaaacagaggagattgatgatgactctgtttaacctggcggcagcgcaaaagatg

SEQ ID NO: 68121 - DNA, 103 bp, Artificial Sequence
  Synthetic Polynucleotide
taatacgactcactatagggaccgcctctactagttaaaacagagtatacaacagaggagagtatacatggttttaactaacctggcggcagcgcaaaagatg

SEQ ID NO: 68122 - DNA, 103 bp, Artificial Sequence
  Synthetic Polynucleotide
taatacgactcactataggggtaataccgcctctactagttaaaacagagaacagaggagactctgtatgaactagtagaacctggcggcagcgcaaaagatg

SEQ ID NO: 68123 - DNA, 103 bp, Artificial Sequence
  Synthetic Polynucleotide
taatacgactcactatagggcctcagtaataccgcctctactagttaaaaaacagaggagattttaaatggtagaggcgaacctggcggcagcgcaaaagatg

SEQ ID NO: 68124 - DNA, 103 bp, Artificial Sequence
  Synthetic Polynucleotide
taatacgactcactatagggggtcgcctcagtaataccgcctctactagtaacagaggagaactagtatgggcggtattaacctggcggcagcgcaaaagatg

SEQ ID NO: 68125 - DNA, 103 bp, Artificial Sequence
  Synthetic Polynucleotide
taatacgactcactatagggcaatacaatattgaatgtgttttacgctgtaacagaggagaacagcgatgaacacattcaacctggcggcagcgcaaaagatg

SEQ ID NO: 68126 - DNA, 103 bp, Artificial Sequence
  Synthetic Polynucleotide
taatacgactcactatagggttcatagaggatactctccaaatgagacggaacagaggagaccgtctatgttggagagtaacctggcggcagcgcaaaagatg

SEQ ID NO: 68127 - DNA, 103 bp, Artificial Sequence
  Synthetic Polynucleotide
taatacgactcactatagggtacaaggtcgcctcagtaataccgcctctaaacagaggagatagaggatgtattactgaaacctggcggcagcgcaaaagatg

SEQ ID NO: 68128 - DNA, 103 bp, Artificial Sequence
  Synthetic Polynucleotide
taatacgactcactatagggtaaaatacaaggtcgcctcagtaataccgcaacagaggagagcggtaatgctgaggcgaaacctggcggcagcgcaaaagatg

SEQ ID NO: 68129 - DNA, 103 bp, Artificial Sequence
  Synthetic Polynucleotide
taatacgactcactatagggatttttaaaatacaaggtcgcctcagtaataacagaggagaattactatggcgaccttgaacctggcggcagcgcaaaagatg

SEQ ID NO: 68130 - DNA, 103 bp, Artificial Sequence
  Synthetic Polynucleotide
taatacgactcactataggggtaacatttttaaaatacaaggtcgcctcaaacagaggagatgaggcatgcttgtatttaacctggcggcagcgcaaaagatg

SEQ ID NO: 68131 - DNA, 103 bp, Artificial Sequence
  Synthetic Polynucleotide
taatacgactcactatagggcttcagtaacatttttaaaatacaaggtcgaacagaggagacgacctatgattttaaaaaacctggcggcagcgcaaaagatg

SEQ ID NO: 68132 - DNA, 103 bp, Artificial Sequence
  Synthetic Polynucleotide
taatacgactcactatagggatattcttcagtaacatttttaaaatacaaaacagaggagattgtatatgaaaaatgttaacctggcggcagcgcaaaagatg

SEQ ID NO: 68133 - DNA, 103 bp, Artificial Sequence
  Synthetic Polynucleotide
taatacgactcactatagggcctatatattcttcagtaacatttttaaaaaacagaggagattttaaatgtgttactgaaacctggcggcagcgcaaaagatg

SEQ ID NO: 68134 - DNA, 103 bp, Artificial Sequence
  Synthetic Polynucleotide
taatacgactcactatagggtattacctatatattcttcagtaacattttaacagaggagaaaaatgatgctgaagaataacctggcggcagcgcaaaagatg

SEQ ID NO: 68135 - DNA, 103 bp, Artificial Sequence
  Synthetic Polynucleotide
taatacgactcactatagggatatgtattacctatatattcttcagtaacaacagaggagagttactatggaatatataaacctggcggcagcgcaaaagatg

SEQ ID NO: 68136 - DNA, 103 bp, Artificial Sequence
  Synthetic Polynucleotide
taatacgactcactatagggcatttatatgtattacctatatattcttcaaacagaggagatgaagaatgtataggtaaaacctggcggcagcgcaaaagatg

SEQ ID NO: 68137 - DNA, 103 bp, Artificial Sequence
  Synthetic Polynucleotide
taatacgactcactatagggacttcttcatagaggatactctccaaatgaaacagaggagatcatttatggagtatcctaacctggcggcagcgcaaaagatg

SEQ ID NO: 68138 - DNA, 103 bp, Artificial Sequence
  Synthetic Polynucleotide
taatacgactcactatagggcacgacatttatatgtattacctatatattaacagaggagaaatataatggtaatacataacctggcggcagcgcaaaagatg

SEQ ID NO: 68139 - DNA, 103 bp, Artificial Sequence
  Synthetic Polynucleotide
taatacgactcactataggggtgtccacgacatttatatgtattacctataacagaggagaataggtatgacatataaaaacctggcggcagcgcaaaagatg

SEQ ID NO: 68140 - DNA, 103 bp, Artificial Sequence
  Synthetic Polynucleotide
taatacgactcactatagggtagttgtgtccacgacatttatatgtattaaacagaggagataatacatgtaaatgtcgaacctggcggcagcgcaaaagatg

SEQ ID NO: 68141 - DNA, 103 bp, Artificial Sequence
  Synthetic Polynucleotide
taatacgactcactatagggaataatagttgtgtccacgacatttatatgaacagaggagacatataatggtcgtggacaacctggcggcagcgcaaaagatg

SEQ ID NO: 68142 - DNA, 103 bp, Artificial Sequence
  Synthetic Polynucleotide
taatacgactcactatagggttcaaaataatagttgtgtccacgacatttaacagaggagaaaatgtatgggacacaacaacctggcggcagcgcaaaagatg

SEQ ID NO: 68143 - DNA, 103 bp, Artificial Sequence
  Synthetic Polynucleotide
taatacgactcactataggggttttttcaaaataatagttgtgtccacgaaacagaggagatcgtggatgcaactattaaacctggcggcagcgcaaaagatg

SEQ ID NO: 68144 - DNA, 103 bp, Artificial Sequence
  Synthetic Polynucleotide
taatacgactcactatagggtaagggttttttcaaaataatagttgtgtcaacagaggagagacacaatgattattttgaacctggcggcagcgcaaaagatg

SEQ ID NO: 68145 - DNA, 103 bp, Artificial Sequence
  Synthetic Polynucleotide
taatacgactcactatagggagttgtaagggttttttcaaaataatagttaacagaggagaaactatatgtttgaaaaaaacctggcggcagcgcaaaagatg

SEQ ID NO: 68146 - DNA, 103 bp, Artificial Sequence
  Synthetic Polynucleotide
taatacgactcactatagggactgtagttgtaagggttttttcaaaataaaacagaggagattatttatgaaaaaccctaacctggcggcagcgcaaaagatg

SEQ ID NO: 68147 - DNA, 103 bp, Artificial Sequence
  Synthetic Polynucleotide
taatacgactcactatagggatactactgtagttgtaagggttttttcaaaacagaggagattgaaaatgcccttacaaaacctggcggcagcgcaaaagatg

SEQ ID NO: 68148 - DNA, 103 bp, Artificial Sequence
  Synthetic Polynucleotide
taatacgactcactataggggaagaacttcttcatagaggatactctccaaacagaggagatggagaatgtcctctatgaacctggcggcagcgcaaaagatg

SEQ ID NO: 68149 - DNA, 103 bp, Artificial Sequence
  Synthetic Polynucleotide
taatacgactcactatagggctccaatactactgtagttgtaagggttttaacagaggagaaaaaccatgacaactacaaacctggcggcagcgcaaaagatg

SEQ ID NO: 68150 - DNA, 103 bp, Artificial Sequence
  Synthetic Polynucleotide
taatacgactcactatagggatttactccaatactactgtagttgtaaggaacagaggagaccttacatgtacagtagtaacctggcggcagcgcaaaagatg

SEQ ID NO: 68151 - DNA, 103 bp, Artificial Sequence
  Synthetic Polynucleotide
taatacgactcactatagggtgtgtatttactccaatactactgtagttgaacagaggagacaactaatgtagtattggaacctggcggcagcgcaaaagatg

SEQ ID NO: 68152 - DNA, 103 bp, Artificial Sequence
  Synthetic Polynucleotide
taatacgactcactatagggtgcattgtgtatttactccaatactactgtaacagaggagaacagtaatgttggagtaaaacctggcggcagcgcaaaagatg

SEQ ID NO: 68153 - DNA, 103 bp, Artificial Sequence
  Synthetic Polynucleotide
taatacgactcactatagggaaaaatgcattgtgtatttactccaatactaacagaggagaagtattatggtaaatacaaacctggcggcagcgcaaaagatg

SEQ ID NO: 68154 - DNA, 103 bp, Artificial Sequence
  Synthetic Polynucleotide
taatacgactcactatagggtatataaaaatgcattgtgtatttactccaaacagaggagatggagtatgtacacaatgaacctggcggcagcgcaaaagatg

SEQ ID NO: 68155 - DNA, 103 bp, Artificial Sequence
  Synthetic Polynucleotide
taatacgactcactatagggtaatgtatataaaaatgcattgtgtatttaaacagaggagataaataatgaatgcatttaacctggcggcagcgcaaaagatg

SEQ ID NO: 68156 - DNA, 103 bp, Artificial Sequence
  Synthetic Polynucleotide
taatacgactcactatagggttcagtaatgtatataaaaatgcattgtgtaacagaggagaacacaaatgatttttataaacctggcggcagcgcaaaagatg

SEQ ID NO: 68157 - DNA, 103 bp, Artificial Sequence
  Synthetic Polynucleotide
taatacgactcactatagggaataattcagtaatgtatataaaaatgcataacagaggagaatgcatatgtatatacataacctggcggcagcgcaaaagatg

SEQ ID NO: 68158 - DNA, 103 bp, Artificial Sequence
  Synthetic Polynucleotide
taatacgactcactatagggataataataattcagtaatgtatataaaaaaacagaggagatttttaatgacattactgaacctggcggcagcgcaaaagatg

SEQ ID NO: 68159 - DNA, 103 bp, Artificial Sequence
  Synthetic Polynucleotide
taatacgactcactatagggttgtcgaagaacttcttcatagaggatactaacagaggagaagtatcatgtatgaagaaaacctggcggcagcgcaaaagatg

SEQ ID NO: 68160 - DNA, 103 bp, Artificial Sequence
  Synthetic Polynucleotide
taatacgactcactatagggaattaataataataattcagtaatgtatataacagaggagaatatacatgactgaattaaacctggcggcagcgcaaaagatg

SEQ ID NO: 68161 - DNA, 103 bp, Artificial Sequence
  Synthetic Polynucleotide
taatacgactcactataggggatataattaataataataattcagtaatgaacagaggagacattacatgattattattaacctggcggcagcgcaaaagatg

SEQ ID NO: 68162 - DNA, 103 bp, Artificial Sequence
  Synthetic Polynucleotide
taatacgactcactatagggaatacgatataattaataataataattcagaacagaggagactgaatatgtattattaaaacctggcggcagcgcaaaagatg

SEQ ID NO: 68163 - DNA, 103 bp, Artificial Sequence
  Synthetic Polynucleotide
taatacgactcactataggggcacaaatacgatataattaataataataaaacagaggagattattaatgttaattataaacctggcggcagcgcaaaagatg

SEQ ID NO: 68164 - DNA, 103 bp, Artificial Sequence
  Synthetic Polynucleotide
taatacgactcactatagggctatagcacaaatacgatataattaataataacagaggagaattattatgtatatcgtaaacctggcggcagcgcaaaagatg

SEQ ID NO: 68165 - DNA, 103 bp, Artificial Sequence
  Synthetic Polynucleotide
taatacgactcactatagggccattctatagcacaaatacgatataattaaacagaggagataattaatgcgtatttgtaacctggcggcagcgcaaaagatg

SEQ ID NO: 68166 - DNA, 103 bp, Artificial Sequence
  Synthetic Polynucleotide
taatacgactcactatagggttcatccattctatagcacaaatacgatataacagaggagaatatcgatgttgtgctataacctggcggcagcgcaaaagatg

SEQ ID NO: 68167 - DNA, 103 bp, Artificial Sequence
  Synthetic Polynucleotide
taatacgactcactataggggtatcttcatccattctatagcacaaatacaacagaggagagtatttatgctatagaataacctggcggcagcgcaaaagatg

SEQ ID NO: 68168 - DNA, 103 bp, Artificial Sequence
  Synthetic Polynucleotide
taatacgactcactataggggtttcgtatcttcatccattctatagcacaaacagaggagatgtgctatggaatggatgaacctggcggcagcgcaaaagatg

SEQ ID NO: 68169 - DNA, 103 bp, Artificial Sequence
  Synthetic Polynucleotide
taatacgactcactatagggagatagtttcgtatcttcatccattctataaacagaggagatatagaatggatgaagataacctggcggcagcgcaaaagatg

SEQ ID NO: 68170 - DNA, 103 bp, Artificial Sequence
  Synthetic Polynucleotide
taatacgactcactatagggacgatttgtcgaagaacttcttcatagaggaacagaggagacctctaatgagaagttctaacctggcggcagcgcaaaagatg

SEQ ID NO: 68171 - DNA, 103 bp, Artificial Sequence
  Synthetic Polynucleotide
taatacgactcactatagggtacctagatagtttcgtatcttcatccattaacagaggagaaatggaatgagatacgaaaacctggcggcagcgcaaaagatg

SEQ ID NO: 68172 - DNA, 103 bp, Artificial Sequence
  Synthetic Polynucleotide
taatacgactcactatagggacaaatacctagatagtttcgtatcttcataacagaggagaatgaagatgcgaaactataacctggcggcagcgcaaaagatg

SEQ ID NO: 68173 - DNA, 103 bp, Artificial Sequence
  Synthetic Polynucleotide
taatacgactcactataggggagatacaaatacctagatagtttcgtatcaacagaggagagatacgatgctatctaggaacctggcggcagcgcaaaagatg

SEQ ID NO: 68174 - DNA, 103 bp, Artificial Sequence
  Synthetic Polynucleotide
taatacgactcactatagggtcggtgagatacaaatacctagatagtttcaacagaggagagaaactatgtaggtatttaacctggcggcagcgcaaaagatg

SEQ ID NO: 68175 - DNA, 103 bp, Artificial Sequence
  Synthetic Polynucleotide
taatacgactcactatagggctctatcggtgagatacaaatacctagataaacagaggagatatctaatgatttgtatcaacctggcggcagcgcaaaagatg

SEQ ID NO: 68176 - DNA, 103 bp, Artificial Sequence
  Synthetic Polynucleotide
taatacgactcactatagggatgttctctatcggtgagatacaaatacctaacagaggagaaggtatatgtatctcaccaacctggcggcagcgcaaaagatg

SEQ ID NO: 68177 - DNA, 103 bp, Artificial Sequence
  Synthetic Polynucleotide
taatacgactcactatagggtttatatgttctctatcggtgagatacaaaaacagaggagatttgtaatgcaccgatagaacctggcggcagcgcaaaagatg

SEQ ID NO: 68178 - DNA, 103 bp, Artificial Sequence
  Synthetic Polynucleotide
taatacgactcactatagggctacatttatatgttctctatcggtgagataacagaggagaatctcaatgatagagaacaacctggcggcagcgcaaaagatg

SEQ ID NO: 68179 - DNA, 103 bp, Artificial Sequence
  Synthetic Polynucleotide
taatacgactcactatagggagagtctacatttatatgttctctatcggtaacagaggagaaccgatatggaacatataaacctggcggcagcgcaaaagatg

SEQ ID NO: 68180 - DNA, 103 bp, Artificial Sequence
  Synthetic Polynucleotide
taatacgactcactatagggttaatagagtctacatttatatgttctctaaacagaggagatagagaatgtataaatgtaacctggcggcagcgcaaaagatg

SEQ ID NO: 68181 - DNA, 103 bp, Artificial Sequence
  Synthetic Polynucleotide
taatacgactcactataggggatgaacgatttgtcgaagaacttcttcataacagaggagaatgaagatgttcttcgacaacctggcggcagcgcaaaagatg

SEQ ID NO: 68182 - DNA, 103 bp, Artificial Sequence
  Synthetic Polynucleotide
taatacgactcactatagggactgtttaatagagtctacatttatatgttaacagaggagaaacataatgatgtagactaacctggcggcagcgcaaaagatg

SEQ ID NO: 68183 - DNA, 103 bp, Artificial Sequence
  Synthetic Polynucleotide
taatacgactcactatagggacacaactgtttaatagagtctacatttataacagaggagaataaatatggactctattaacctggcggcagcgcaaaagatg

SEQ ID NO: 68184 - DNA, 103 bp, Artificial Sequence
  Synthetic Polynucleotide
taatacgactcactatagggattttacacaactgtttaatagagtctacaaacagaggagatgtagaatgtattaaacaaacctggcggcagcgcaaaagatg

SEQ ID NO: 68185 - DNA, 103 bp, Artificial Sequence
  Synthetic Polynucleotide
taatacgactcactatagggttgatattttacacaactgtttaatagagtaacagaggagaactctaatgaacagttgtaacctggcggcagcgcaaaagatg

SEQ ID NO: 68186 - DNA, 103 bp, Artificial Sequence
  Synthetic Polynucleotide
taatacgactcactatagggaggatttgatattttacacaactgtttaataacagaggagaattaaaatgttgtgtaaaaacctggcggcagcgcaaaagatg

SEQ ID NO: 68187 - DNA, 103 bp, Artificial Sequence
  Synthetic Polynucleotide
taatacgactcactataggggaattaggatttgatattttacacaactgtaacagaggagaacagttatgtaaaatatcaacctggcggcagcgcaaaagatg

SEQ ID NO: 68188 - DNA, 103 bp, Artificial Sequence
  Synthetic Polynucleotide
taatacgactcactatagggaacatgaattaggatttgatattttacacaaacagaggagatgtgtaatgtatcaaatcaacctggcggcagcgcaaaagatg

SEQ ID NO: 68189 - DNA, 103 bp, Artificial Sequence
  Synthetic Polynucleotide
taatacgactcactatagggtctataacatgaattaggatttgatattttaacagaggagaaaaataatgaatcctaataacctggcggcagcgcaaaagatg

SEQ ID NO: 68190 - DNA, 103 bp, Artificial Sequence
  Synthetic Polynucleotide
taatacgactcactatagggccacatctataacatgaattaggatttgataacagaggagaatcaaaatgtaattcatgaacctggcggcagcgcaaaagatg

SEQ ID NO: 68191 - DNA, 103 bp, Artificial Sequence
  Synthetic Polynucleotide
taatacgactcactatagggtacatccacatctataacatgaattaggataacagaggagaatcctaatgcatgttataaacctggcggcagcgcaaaagatg

SEQ ID NO: 68192 - DNA, 103 bp, Artificial Sequence
  Synthetic Polynucleotide
taatacgactcactataggggactagatgaacgatttgtcgaagaacttcaacagaggagagaagttatgcgacaaatcaacctggcggcagcgcaaaagatg

SEQ ID NO: 68193 - DNA, 103 bp, Artificial Sequence
  Synthetic Polynucleotide
taatacgactcactatagggagccgtacatccacatctataacatgaattaacagaggagaaattcaatgtatagatgtaacctggcggcagcgcaaaagatg

SEQ ID NO: 68194 - DNA, 103 bp, Artificial Sequence
  Synthetic Polynucleotide
taatacgactcactatagggtgtaaagccgtacatccacatctataacataacagaggagaatgttaatgatgtggatgaacctggcggcagcgcaaaagatg

SEQ ID NO: 68195 - DNA, 103 bp, Artificial Sequence
  Synthetic Polynucleotide
taatacgactcactatagggactcatgtaaagccgtacatccacatctataacagaggagaatagatatggatgtacggaacctggcggcagcgcaaaagatg

SEQ ID NO: 68196 - DNA, 103 bp, Artificial Sequence
  Synthetic Polynucleotide
taatacgactcactatagggaaagtactcatgtaaagccgtacatccacaaacagaggagatgtggaatgacggctttaaacctggcggcagcgcaaaagatg

SEQ ID NO: 68197 - DNA, 103 bp, Artificial Sequence
  Synthetic Polynucleotide
taatacgactcactatagggttataaaagtactcatgtaaagccgtacataacagaggagaatgtacatgtttacatgaaacctggcggcagcgcaaaagatg

SEQ ID NO: 68198 - DNA, 103 bp, Artificial Sequence
  Synthetic Polynucleotide
taatacgactcactatagggtataattataaaagtactcatgtaaagccgaacagaggagacggcttatgatgagtactaacctggcggcagcgcaaaagatg

SEQ ID NO: 68199 - DNA, 103 bp, Artificial Sequence
  Synthetic Polynucleotide
taatacgactcactatagggtgatctataattataaaagtactcatgtaaaacagaggagattacatatgtacttttataacctggcggcagcgcaaaagatg

SEQ ID NO: 68200 - DNA, 103 bp, Artificial Sequence
  Synthetic Polynucleotide
taatacgactcactatagggttgactgatctataattataaaagtactcaaacagaggagatgagtaatgttataattaaacctggcggcagcgcaaaagatg

SEQ ID NO: 68201 - DNA, 103 bp, Artificial Sequence
  Synthetic Polynucleotide
taatacgactcactatagggttccgttgactgatctataattataaaagtaacagaggagaacttttatgattatagataacctggcggcagcgcaaaagatg

SEQ ID NO: 68202 - DNA, 103 bp, Artificial Sequence
  Synthetic Polynucleotide
taatacgactcactataggggtattttccgttgactgatctataattataaacagaggagatataatatgagatcagtcaacctggcggcagcgcaaaagatg

SEQ ID NO: 68203 - DNA, 103 bp, Artificial Sequence
  Synthetic Polynucleotide
taatacgactcactatagggtaaaggactagatgaacgatttgtcgaagaaacagaggagatcttcgatgaatcgttcaaacctggcggcagcgcaaaagatg

SEQ ID NO: 68204 - DNA, 103 bp, Artificial Sequence
  Synthetic Polynucleotide
taatacgactcactatagggtacttgtattttccgttgactgatctataaaacagaggagattatagatgagtcaacggaacctggcggcagcgcaaaagatg

SEQ ID NO: 68205 - DNA, 103 bp, Artificial Sequence
  Synthetic Polynucleotide
taatacgactcactatagggatctatacttgtattttccgttgactgatcaacagaggagagatcagatgacggaaaataacctggcggcagcgcaaaagatg

SEQ ID NO: 68206 - DNA, 103 bp, Artificial Sequence
  Synthetic Polynucleotide
taatacgactcactataggggttgtatctatacttgtattttccgttgacaacagaggagagtcaacatgaaatacaagaacctggcggcagcgcaaaagatg

SEQ ID NO: 68207 - DNA, 103 bp, Artificial Sequence
  Synthetic Polynucleotide
taatacgactcactatagggtaaccgttgtatctatacttgtattttccgaacagaggagacggaaaatgcaagtatagaacctggcggcagcgcaaaagatg

SEQ ID NO: 68208 - DNA, 103 bp, Artificial Sequence
  Synthetic Polynucleotide
taatacgactcactataggggatagtaaccgttgtatctatacttgtattaacagaggagaaatacaatgatagatacaaacctggcggcagcgcaaaagatg

SEQ ID NO: 68209 - DNA, 103 bp, Artificial Sequence
  Synthetic Polynucleotide
taatacgactcactatagggatattgatagtaaccgttgtatctatacttaacagaggagaaagtatatgtacaacggtaacctggcggcagcgcaaaagatg

SEQ ID NO: 68210 - DNA, 103 bp, Artificial Sequence
  Synthetic Polynucleotide
taatacgactcactataggggaataatattgatagtaaccgttgtatctaaacagaggagatagataatgcggttactaaacctggcggcagcgcaaaagatg

SEQ ID NO: 68211 - DNA, 103 bp, Artificial Sequence
  Synthetic Polynucleotide
taatacgactcactatagggtaaatgaataatattgatagtaaccgttgtaacagaggagaacaacgatgactatcaataacctggcggcagcgcaaaagatg

SEQ ID NO: 68212 - DNA, 103 bp, Artificial Sequence
  Synthetic Polynucleotide
taatacgactcactatagggatcgctaaatgaataatattgatagtaaccaacagaggagaggttacatgcaatattataacctggcggcagcgcaaaagatg

SEQ ID NO: 68213 - DNA, 103 bp, Artificial Sequence
  Synthetic Polynucleotide
taatacgactcactatagggtcataatcgctaaatgaataatattgatagaacagaggagactatcaatgttattcattaacctggcggcagcgcaaaagatg

SEQ ID NO: 68214 - DNA, 103 bp, Artificial Sequence
  Synthetic Polynucleotide
taatacgactcactatagggggaattaaaggactagatgaacgatttgtcaacagaggagagacaaaatgttcatctagaacctggcggcagcgcaaaagatg

SEQ ID NO: 68215 - DNA, 103 bp, Artificial Sequence
  Synthetic Polynucleotide
taatacgactcactatagggaattttcataatcgctaaatgaataatattaacagaggagaaatattatgcatttagcgaacctggcggcagcgcaaaagatg

SEQ ID NO: 68216 - DNA, 103 bp, Artificial Sequence
  Synthetic Polynucleotide
taatacgactcactatagggattataattttcataatcgctaaatgaataaacagaggagatattcaatgagcgattataacctggcggcagcgcaaaagatg

SEQ ID NO: 68217 - DNA, 103 bp, Artificial Sequence
  Synthetic Polynucleotide
taatacgactcactatagggtattcattataattttcataatcgctaaataacagaggagaatttagatgttatgaaaaaacctggcggcagcgcaaaagatg

SEQ ID NO: 68218 - DNA, 103 bp, Artificial Sequence
  Synthetic Polynucleotide
taatacgactcactatagggaataatattcattataattttcataatcgcaacagaggagagcgattatgaaaattataaacctggcggcagcgcaaaagatg

SEQ ID NO: 68219 - DNA, 103 bp, Artificial Sequence
  Synthetic Polynucleotide
taatacgactcactatagggatcataataatattcattataattttcataaacagaggagatatgaaatgtataatgaaaacctggcggcagcgcaaaagatg

SEQ ID NO: 68220 - DNA, 103 bp, Artificial Sequence
  Synthetic Polynucleotide
taatacgactcactatagggtaatcatcataataatattcattataatttaacagaggagaaaattaatgtgaatattaaacctggcggcagcgcaaaagatg

SEQ ID NO: 68221 - DNA, 103 bp, Artificial Sequence
  Synthetic Polynucleotide
taatacgactcactatagggtatcataatcatcataataatattcattataacagaggagaataatgatgattattatgaacctggcggcagcgcaaaagatg

SEQ ID NO: 68222 - DNA, 103 bp, Artificial Sequence
  Synthetic Polynucleotide
taatacgactcactatagggagttctatcataatcatcataataatattcaacagaggagagaatatatgtatgatgataacctggcggcagcgcaaaagatg

SEQ ID NO: 68223 - DNA, 103 bp, Artificial Sequence
  Synthetic Polynucleotide
taatacgactcactatagggataccagttctatcataatcatcataataaaacagaggagattattaatgtgattatgaaacctggcggcagcgcaaaagatg

SEQ ID NO: 68224 - DNA, 103 bp, Artificial Sequence
  Synthetic Polynucleotide
taatacgactcactatagggtattcataccagttctatcataatcatcataacagaggagaatgatgatgatgatagaaaacctggcggcagcgcaaaagatg

SEQ ID NO: 68225 - DNA, 103 bp, Artificial Sequence
  Synthetic Polynucleotide
taatacgactcactatagggattgtggaattaaaggactagatgaacgataacagaggagaatcgttatgctagtccttaacctggcggcagcgcaaaagatg

SEQ ID NO: 68226 - DNA, 103 bp, Artificial Sequence
  Synthetic Polynucleotide
taatacgactcactatagggctcgctattcataccagttctatcataatcaacagaggagagattatatgagaactggtaacctggcggcagcgcaaaagatg

SEQ ID NO: 68227 - DNA, 103 bp, Artificial Sequence
  Synthetic Polynucleotide
taatacgactcactatagggtcactctcgctattcataccagttctatcaaacagaggagatgatagatgtggtatgaaaacctggcggcagcgcaaaagatg

SEQ ID NO: 68228 - DNA, 103 bp, Artificial Sequence
  Synthetic Polynucleotide
taatacgactcactatagggcactctcactctcgctattcataccagttcaacagaggagagaactgatgtgaatagcgaacctggcggcagcgcaaaagatg

SEQ ID NO: 68229 - DNA, 103 bp, Artificial Sequence
  Synthetic Polynucleotide
taatacgactcactatagggattatcactctcactctcgctattcataccaacagaggagaggtatgatgagcgagagtaacctggcggcagcgcaaaagatg

SEQ ID NO: 68230 - DNA, 103 bp, Artificial Sequence
  Synthetic Polynucleotide
taatacgactcactataggggatatattatcactctcactctcgctattcaacagaggagagaatagatggagtgagagaacctggcggcagcgcaaaagatg

SEQ ID NO: 68231 - DNA, 103 bp, Artificial Sequence
  Synthetic Polynucleotide
taatacgactcactatagggtgattgatatattatcactctcactctcgcaacagaggagagcgagaatgagagtgataaacctggcggcagcgcaaaagatg

SEQ ID NO: 68232 - DNA, 103 bp, Artificial Sequence
  Synthetic Polynucleotide
taatacgactcactatagggtgttttgattgatatattatcactctcactaacagaggagaagtgagatggataatataaacctggcggcagcgcaaaagatg

SEQ ID NO: 68233 - DNA, 103 bp, Artificial Sequence
  Synthetic Polynucleotide
taatacgactcactatagggtattctgttttgattgatatattatcactcaacagaggagagagtgaatgtatatcaataacctggcggcagcgcaaaagatg

SEQ ID NO: 68234 - DNA, 103 bp, Artificial Sequence
  Synthetic Polynucleotide
taatacgactcactatagggtctcatattctgttttgattgatatattataacagaggagaataataatgcaatcaaaaaacctggcggcagcgcaaaagatg

SEQ ID NO: 68235 - DNA, 103 bp, Artificial Sequence
  Synthetic Polynucleotide
taatacgactcactatagggttcattctcatattctgttttgattgatataacagaggagaatatcaatgaaaacagaaaacctggcggcagcgcaaaagatg

SEQ ID NO: 68236 - DNA, 103 bp, Artificial Sequence
  Synthetic Polynucleotide
taatacgactcactatagggtataacaatacaatattgaatgtgttttacaacagaggagagtaaaaatgattcaatataacctggcggcagcgcaaaagatg

SEQ ID NO: 68237 - DNA, 103 bp, Artificial Sequence
  Synthetic Polynucleotide
taatacgactcactatagggtgcgtattgtggaattaaaggactagatgaaacagaggagatcatctatgcctttaattaacctggcggcagcgcaaaagatg

SEQ ID NO: 68238 - DNA, 103 bp, Artificial Sequence
  Synthetic Polynucleotide
taatacgactcactatagggtcgtattcattctcatattctgttttgattaacagaggagaaatcaaatgagaatatgaaacctggcggcagcgcaaaagatg

SEQ ID NO: 68239 - DNA, 103 bp, Artificial Sequence
  Synthetic Polynucleotide
taatacgactcactatagggagaattcgtattcattctcatattctgtttaacagaggagaaaacagatgatgagaatgaacctggcggcagcgcaaaagatg

SEQ ID NO: 68240 - DNA, 103 bp, Artificial Sequence
  Synthetic Polynucleotide
taatacgactcactatagggatcatagaattcgtattcattctcatattcaacagaggagagaatatatgaatgaatacaacctggcggcagcgcaaaagatg

SEQ ID NO: 68241 - DNA, 103 bp, Artificial Sequence
  Synthetic Polynucleotide
taatacgactcactataggggtttcatcatagaattcgtattcattctcaaacagaggagatgagaaatgatacgaattaacctggcggcagcgcaaaagatg

SEQ ID NO: 68242 - DNA, 103 bp, Artificial Sequence
  Synthetic Polynucleotide
taatacgactcactatagggcttgtgtttcatcatagaattcgtattcataacagaggagaatgaatatgaattctatgaacctggcggcagcgcaaaagatg

SEQ ID NO: 68243 - DNA, 103 bp, Artificial Sequence
  Synthetic Polynucleotide
taatacgactcactatagggttgatcttgtgtttcatcatagaattcgtaaacagaggagatacgaaatgtatgatgaaaacctggcggcagcgcaaaagatg

SEQ ID NO: 68244 - DNA, 103 bp, Artificial Sequence
  Synthetic Polynucleotide
taatacgactcactataggggtactttgatcttgtgtttcatcatagaataacagaggagaattctaatgtgaaacacaaacctggcggcagcgcaaaagatg

SEQ ID NO: 68245 - DNA, 103 bp, Artificial Sequence
  Synthetic Polynucleotide
taatacgactcactataggggttgtgtactttgatcttgtgtttcatcataacagaggagaatgatgatgcacaagatcaacctggcggcagcgcaaaagatg

SEQ ID NO: 68246 - DNA, 103 bp, Artificial Sequence
  Synthetic Polynucleotide
taatacgactcactatagggtactagttgtgtactttgatcttgtgtttcaacagaggagagaaacaatggatcaaagtaacctggcggcagcgcaaaagatg

SEQ ID NO: 68247 - DNA, 103 bp, Artificial Sequence
  Synthetic Polynucleotide
taatacgactcactatagggtaacctactagttgtgtactttgatcttgtaacagaggagaacaagaatgaagtacacaaacctggcggcagcgcaaaagatg

SEQ ID NO: 68248 - DNA, 103 bp, Artificial Sequence
  Synthetic Polynucleotide
taatacgactcactatagggctacatgcgtattgtggaattaaaggactaaacagaggagatagtccatgaattccacaaacctggcggcagcgcaaaagatg

SEQ ID NO: 68249 - DNA, 103 bp, Artificial Sequence
  Synthetic Polynucleotide
taatacgactcactatagggtgtcgtaacctactagttgtgtactttgataacagaggagaatcaaaatgcacaactagaacctggcggcagcgcaaaagatg

SEQ ID NO: 68250 - DNA, 103 bp, Artificial Sequence
  Synthetic Polynucleotide
taatacgactcactatagggtttaatgtcgtaacctactagttgtgtactaacagaggagaagtacaatgctagtaggtaacctggcggcagcgcaaaagatg

SEQ ID NO: 68251 - DNA, 103 bp, Artificial Sequence
  Synthetic Polynucleotide
taatacgactcactatagggttgagtttaatgtcgtaacctactagttgtaacagaggagaacaactatgaggttacgaaacctggcggcagcgcaaaagatg

SEQ ID NO: 68252 - DNA, 103 bp, Artificial Sequence
  Synthetic Polynucleotide
taatacgactcactatagggtggttttgagtttaatgtcgtaacctactaaacagaggagatagtagatgacgacattaaacctggcggcagcgcaaaagatg

SEQ ID NO: 68253 - DNA, 103 bp, Artificial Sequence
  Synthetic Polynucleotide
taatacgactcactatagggctcattggttttgagtttaatgtcgtaaccaacagaggagaggttacatgattaaactcaacctggcggcagcgcaaaagatg

SEQ ID NO: 68254 - DNA, 103 bp, Artificial Sequence
  Synthetic Polynucleotide
taatacgactcactatagggtcatcctcattggttttgagtttaatgtcgaacagaggagacgacatatgactcaaaacaacctggcggcagcgcaaaagatg

SEQ ID NO: 68255 - DNA, 103 bp, Artificial Sequence
  Synthetic Polynucleotide
taatacgactcactatagggcaaaatcatcctcattggttttgagtttaaaacagaggagattaaacatgaaaccaatgaacctggcggcagcgcaaaagatg

SEQ ID NO: 68256 - DNA, 103 bp, Artificial Sequence
  Synthetic Polynucleotide
taatacgactcactatagggatccacaaaatcatcctcattggttttgagaacagaggagactcaaaatgaatgaggataacctggcggcagcgcaaaagatg

SEQ ID NO: 68257 - DNA, 103 bp, Artificial Sequence
  Synthetic Polynucleotide
taatacgactcactatagggaattcatccacaaaatcatcctcattggttaacagaggagaaaccaaatgggatgatttaacctggcggcagcgcaaaagatg

SEQ ID NO: 68258 - DNA, 103 bp, Artificial Sequence
  Synthetic Polynucleotide
taatacgactcactatagggcatagaattcatccacaaaatcatcctcataacagaggagaatgaggatgattttgtggaacctggcggcagcgcaaaagatg

SEQ ID NO: 68259 - DNA, 103 bp, Artificial Sequence
  Synthetic Polynucleotide
taatacgactcactatagggacattctacatgcgtattgtggaattaaagaacagaggagactttaaatgcacaatacgaacctggcggcagcgcaaaagatg

SEQ ID NO: 68260 - DNA, 103 bp, Artificial Sequence
  Synthetic Polynucleotide
taatacgactcactatagggatagccatagaattcatccacaaaatcatcaacagaggagagatgatatggtggatgaaaacctggcggcagcgcaaaagatg

SEQ ID NO: 68261 - DNA, 103 bp, Artificial Sequence
  Synthetic Polynucleotide
taatacgactcactatagggctatcatagccatagaattcatccacaaaaaacagaggagattttgtatgtgaattctaaacctggcggcagcgcaaaagatg

SEQ ID NO: 68262 - DNA, 103 bp, Artificial Sequence
  Synthetic Polynucleotide
taatacgactcactatagggctgatctatcatagccatagaattcatccaaacagaggagatggatgatgtctatggctaacctggcggcagcgcaaaagatg

SEQ ID NO: 68263 - DNA, 103 bp, Artificial Sequence
  Synthetic Polynucleotide
taatacgactcactatagggacccactgatctatcatagccatagaattcaacagaggagagaattcatgggctatgataacctggcggcagcgcaaaagatg

SEQ ID NO: 68264 - DNA, 103 bp, Artificial Sequence
  Synthetic Polynucleotide
taatacgactcactatagggtggacacccactgatctatcatagccatagaacagaggagactatggatgtgatagatcaacctggcggcagcgcaaaagatg

SEQ ID NO: 68265 - DNA, 103 bp, Artificial Sequence
  Synthetic Polynucleotide
taatacgactcactatagggaatcatggacacccactgatctatcatagcaacagaggagagctatgatggatcagtggaacctggcggcagcgcaaaagatg

SEQ ID NO: 68266 - DNA, 103 bp, Artificial Sequence
  Synthetic Polynucleotide
taatacgactcactatagggtatataatcatggacacccactgatctatcaacagaggagagatagaatggtgggtgtcaacctggcggcagcgcaaaagatg

SEQ ID NO: 68267 - DNA, 103 bp, Artificial Sequence
  Synthetic Polynucleotide
taatacgactcactatagggttatctatataatcatggacacccactgataacagaggagaatcagtatgtgtccatgaaacctggcggcagcgcaaaagatg

SEQ ID NO: 68268 - DNA, 103 bp, Artificial Sequence
  Synthetic Polynucleotide
taatacgactcactatagggttgatttatctatataatcatggacacccaaacagaggagatgggtgatgatgattataaacctggcggcagcgcaaaagatg

SEQ ID NO: 68269 - DNA, 103 bp, Artificial Sequence
  Synthetic Polynucleotide
taatacgactcactatagggattaattgatttatctatataatcatggacaacagaggagagtccatatgtatatagataacctggcggcagcgcaaaagatg

SEQ ID NO: 68270 - DNA, 103 bp, Artificial Sequence
  Synthetic Polynucleotide
taatacgactcactatagggttatcacattctacatgcgtattgtggaataacagaggagaattccaatgtacgcatgtaacctggcggcagcgcaaaagatg

SEQ ID NO: 68271 - DNA, 103 bp, Artificial Sequence
  Synthetic Polynucleotide
taatacgactcactatagggactttattaattgatttatctatataatcaaacagaggagatgattaatgagataaatcaacctggcggcagcgcaaaagatg

SEQ ID NO: 68272 - DNA, 103 bp, Artificial Sequence
  Synthetic Polynucleotide
taatacgactcactatagggatactactttattaattgatttatctatataacagaggagaatatagatgaatcaattaaacctggcggcagcgcaaaagatg

SEQ ID NO: 68273 - DNA, 103 bp, Artificial Sequence
  Synthetic Polynucleotide
taatacgactcactatagggtccatatactactttattaattgatttatcaacagaggagagataaaatgattaataaaaacctggcggcagcgcaaaagatg

SEQ ID NO: 68274 - DNA, 103 bp, Artificial Sequence
  Synthetic Polynucleotide
taatacgactcactatagggtctcttccatatactactttattaattgataacagaggagaatcaatatgtaaagtagtaacctggcggcagcgcaaaagatg

SEQ ID NO: 68275 - DNA, 103 bp, Artificial Sequence
  Synthetic Polynucleotide
taatacgactcactatagggaagactctcttccatatactactttattaaaacagaggagattaataatgtagtatatgaacctggcggcagcgcaaaagatg

SEQ ID NO: 68276 - DNA, 103 bp, Artificial Sequence
  Synthetic Polynucleotide
taatacgactcactatagggtacgtaagactctcttccatatactactttaacagaggagaaaagtaatgtatggaagaaacctggcggcagcgcaaaagatg

SEQ ID NO: 68277 - DNA, 103 bp, Artificial Sequence
  Synthetic Polynucleotide
taatacgactcactatagggcatcttacgtaagactctcttccatatactaacagaggagaagtataatgaagagagtcaacctggcggcagcgcaaaagatg

SEQ ID NO: 68278 - DNA, 103 bp, Artificial Sequence
  Synthetic Polynucleotide
taatacgactcactatagggcccgccatcttacgtaagactctcttccataacagaggagaatggaaatgagtcttacgaacctggcggcagcgcaaaagatg

SEQ ID NO: 68279 - DNA, 103 bp, Artificial Sequence
  Synthetic Polynucleotide
taatacgactcactatagggtatatcccgccatcttacgtaagactctctaacagaggagaagagagatgtacgtaagaaacctggcggcagcgcaaaagatg

SEQ ID NO: 68280 - DNA, 103 bp, Artificial Sequence
  Synthetic Polynucleotide
taatacgactcactatagggtgccatatatcccgccatcttacgtaagacaacagaggagagtcttaatgaagatggcgaacctggcggcagcgcaaaagatg

SEQ ID NO: 68281 - DNA, 103 bp, Artificial Sequence
  Synthetic Polynucleotide
taatacgactcactatagggggaaattatcacattctacatgcgtattgtaacagaggagaacaataatgatgtagaataacctggcggcagcgcaaaagatg

SEQ ID NO: 68282 - DNA, 103 bp, Artificial Sequence
  Synthetic Polynucleotide
taatacgactcactataggggttcttgccatatatcccgccatcttacgtaacagaggagaacgtaaatgggcgggataaacctggcggcagcgcaaaagatg

SEQ ID NO: 68283 - DNA, 103 bp, Artificial Sequence
  Synthetic Polynucleotide
taatacgactcactatagggattatgttcttgccatatatcccgccatctaacagaggagaagatggatggatatatggaacctggcggcagcgcaaaagatg

SEQ ID NO: 68284 - DNA, 103 bp, Artificial Sequence
  Synthetic Polynucleotide
taatacgactcactatagggccatcattatgttcttgccatatatcccgcaacagaggagagcgggaatgatggcaagaaacctggcggcagcgcaaaagatg

SEQ ID NO: 68285 - DNA, 103 bp, Artificial Sequence
  Synthetic Polynucleotide
taatacgactcactatagggatacaccatcattatgttcttgccatatataacagaggagaatatatatgaagaacataaacctggcggcagcgcaaaagatg

SEQ ID NO: 68286 - DNA, 103 bp, Artificial Sequence
  Synthetic Polynucleotide
taatacgactcactatagggactgtatacaccatcattatgttcttgccaaacagaggagatggcaaatgcataatgataacctggcggcagcgcaaaagatg

SEQ ID NO: 68287 - DNA, 103 bp, Artificial Sequence
  Synthetic Polynucleotide
taatacgactcactatagggcctatactgtatacaccatcattatgttctaacagaggagaagaacaatgtgatggtgtaacctggcggcagcgcaaaagatg

SEQ ID NO: 68288 - DNA, 103 bp, Artificial Sequence
  Synthetic Polynucleotide
taatacgactcactatagggcctttcctatactgtatacaccatcattataacagaggagaataatgatggtgtatacaaacctggcggcagcgcaaaagatg

SEQ ID NO: 68289 - DNA, 103 bp, Artificial Sequence
  Synthetic Polynucleotide
taatacgactcactataggggcactcctttcctatactgtatacaccatcaacagaggagagatggtatgtacagtataaacctggcggcagcgcaaaagatg

SEQ ID NO: 68290 - DNA, 103 bp, Artificial Sequence
  Synthetic Polynucleotide
taatacgactcactatagggtctatgcactcctttcctatactgtatacaaacagaggagatgtataatgtataggaaaaacctggcggcagcgcaaaagatg

SEQ ID NO: 68291 - DNA, 103 bp, Artificial Sequence
  Synthetic Polynucleotide
taatacgactcactatagggtattatctatgcactcctttcctatactgtaacagaggagaacagtaatggaaaggagtaacctggcggcagcgcaaaagatg

SEQ ID NO: 68292 - DNA, 103 bp, Artificial Sequence
  Synthetic Polynucleotide
taatacgactcactatagggcttctggaaattatcacattctacatgcgtaacagaggagaacgcatatggaatgtgataacctggcggcagcgcaaaagatg

SEQ ID NO: 68293 - DNA, 103 bp, Artificial Sequence
  Synthetic Polynucleotide
taatacgactcactataggggtatatattatctatgcactcctttcctataacagaggagaataggaatggagtgcataaacctggcggcagcgcaaaagatg

SEQ ID NO: 68294 - DNA, 103 bp, Artificial Sequence
  Synthetic Polynucleotide
taatacgactcactatagggtcttcgtatatattatctatgcactcctttaacagaggagaaaaggaatgcatagataaaacctggcggcagcgcaaaagatg

SEQ ID NO: 68295 - DNA, 103 bp, Artificial Sequence
  Synthetic Polynucleotide
taatacgactcactataggggtctgtcttcgtatatattatctatgcactaacagaggagaagtgcaatgataatatataacctggcggcagcgcaaaagatg

SEQ ID NO: 68296 - DNA, 103 bp, Artificial Sequence
  Synthetic Polynucleotide
taatacgactcactatagggtgtatgtctgtcttcgtatatattatctataacagaggagaatagatatgatatacgaaaacctggcggcagcgcaaaagatg

SEQ ID NO: 68297 - DNA, 103 bp, Artificial Sequence
  Synthetic Polynucleotide
taatacgactcactatagggtctactgtatgtctgtcttcgtatatattaaacagaggagataatatatgcgaagacagaacctggcggcagcgcaaaagatg

SEQ ID NO: 68298 - DNA, 103 bp, Artificial Sequence
  Synthetic Polynucleotide
taatacgactcactatagggattcgtctactgtatgtctgtcttcgtataaacagaggagatatacgatgacagacataaacctggcggcagcgcaaaagatg

SEQ ID NO: 68299 - DNA, 103 bp, Artificial Sequence
  Synthetic Polynucleotide
taatacgactcactataggggtagaattcgtctactgtatgtctgtcttcaacagaggagagaagacatgcatacagtaaacctggcggcagcgcaaaagatg

SEQ ID NO: 68300 - DNA, 103 bp, Artificial Sequence
  Synthetic Polynucleotide
taatacgactcactatagggatcttgtagaattcgtctactgtatgtctgaacagaggagacagacaatgagtagacgaaacctggcggcagcgcaaaagatg

SEQ ID NO: 68301 - DNA, 103 bp, Artificial Sequence
  Synthetic Polynucleotide
taatacgactcactatagggtgtctatcttgtagaattcgtctactgtataacagaggagaatacagatgacgaattctaacctggcggcagcgcaaaagatg

SEQ ID NO: 68302 - DNA, 103 bp, Artificial Sequence
  Synthetic Polynucleotide
taatacgactcactatagggtacgctgtctatcttgtagaattcgtctacaacagaggagagtagacatgttctacaagaacctggcggcagcgcaaaagatg

SEQ ID NO: 68303 - DNA, 103 bp, Artificial Sequence
  Synthetic Polynucleotide
taatacgactcactatagggtgaaccttctggaaattatcacattctacaaacagaggagatgtagaatgtgataatttaacctggcggcagcgcaaaagatg

SEQ ID NO: 68304 - DNA, 103 bp, Artificial Sequence
  Synthetic Polynucleotide
taatacgactcactatagggtttgatacgctgtctatcttgtagaattcgaacagaggagacgaattatgcaagatagaaacctggcggcagcgcaaaagatg

SEQ ID NO: 68305 - DNA, 103 bp, Artificial Sequence
  Synthetic Polynucleotide
taatacgactcactatagggttacatttgatacgctgtctatcttgtagaaacagaggagatctacaatgtagacagcgaacctggcggcagcgcaaaagatg

SEQ ID NO: 68306 - DNA, 103 bp, Artificial Sequence
  Synthetic Polynucleotide
taatacgactcactataggggtcatttacatttgatacgctgtctatcttaacagaggagaaagataatgagcgtatcaaacctggcggcagcgcaaaagatg

SEQ ID NO: 68307 - DNA, 103 bp, Artificial Sequence
  Synthetic Polynucleotide
taatacgactcactatagggtccgcgtcatttacatttgatacgctgtctaacagaggagaagacagatgatcaaatgtaacctggcggcagcgcaaaagatg

SEQ ID NO: 68308 - DNA, 103 bp, Artificial Sequence
  Synthetic Polynucleotide
taatacgactcactatagggtgtgttccgcgtcatttacatttgatacgcaacagaggagagcgtatatgatgtaaatgaacctggcggcagcgcaaaagatg

SEQ ID NO: 68309 - DNA, 103 bp, Artificial Sequence
  Synthetic Polynucleotide
taatacgactcactatagggagatatgtgttccgcgtcatttacatttgaaacagaggagatcaaatatgaatgacgcgaacctggcggcagcgcaaaagatg

SEQ ID NO: 68310 - DNA, 103 bp, Artificial Sequence
  Synthetic Polynucleotide
taatacgactcactatagggatctgagatatgtgttccgcgtcatttacaaacagaggagatgtaaaatgcgcggaacaaacctggcggcagcgcaaaagatg

SEQ ID NO: 68311 - DNA, 103 bp, Artificial Sequence
  Synthetic Polynucleotide
taatacgactcactatagggtagttatctgagatatgtgttccgcgtcataacagaggagaatgacgatgaacacatataacctggcggcagcgcaaaagatg

SEQ ID NO: 68312 - DNA, 103 bp, Artificial Sequence
  Synthetic Polynucleotide
taatacgactcactatagggatcattagttatctgagatatgtgttccgcaacagaggagagcggaaatgatatctcagaacctggcggcagcgcaaaagatg

SEQ ID NO: 68313 - DNA, 103 bp, Artificial Sequence
  Synthetic Polynucleotide
taatacgactcactataggggatacatcattagttatctgagatatgtgtaacagaggagaacacatatgtcagataacaacctggcggcagcgcaaaagatg

SEQ ID NO: 68314 - DNA, 103 bp, Artificial Sequence
  Synthetic Polynucleotide
taatacgactcactataggggctattgaaccttctggaaattatcacattaacagaggagaaatgtgatgatttccagaaacctggcggcagcgcaaaagatg

SEQ ID NO: 68315 - DNA, 103 bp, Artificial Sequence
  Synthetic Polynucleotide
taatacgactcactataggggtgtagatacatcattagttatctgagataaacagaggagatatctcatgtaactaatgaacctggcggcagcgcaaaagatg

SEQ ID NO: 68316 - DNA, 103 bp, Artificial Sequence
  Synthetic Polynucleotide
taatacgactcactatagggtgtttgtgtagatacatcattagttatctgaacagaggagacagataatgaatgatgtaaacctggcggcagcgcaaaagatg

SEQ ID NO: 68317 - DNA, 103 bp, Artificial Sequence
  Synthetic Polynucleotide
taatacgactcactatagggtcccatgtttgtgtagatacatcattagttaacagaggagaaactaaatgtgtatctacaacctggcggcagcgcaaaagatg

SEQ ID NO: 68318 - DNA, 103 bp, Artificial Sequence
  Synthetic Polynucleotide
taatacgactcactatagggtcttttcccatgtttgtgtagatacatcataacagaggagaatgatgatgctacacaaaaacctggcggcagcgcaaaagatg

SEQ ID NO: 68319 - DNA, 103 bp, Artificial Sequence
  Synthetic Polynucleotide
taatacgactcactatagggtgatttcttttcccatgtttgtgtagatacaacagaggagagtatctatgcaaacatggaacctggcggcagcgcaaaagatg

SEQ ID NO: 68320 - DNA, 103 bp, Artificial Sequence
  Synthetic Polynucleotide
taatacgactcactatagggaactctgatttcttttcccatgtttgtgtaaacagaggagatacacaatgatgggaaaaaacctggcggcagcgcaaaagatg

SEQ ID NO: 68321 - DNA, 103 bp, Artificial Sequence
  Synthetic Polynucleotide
taatacgactcactatagggtatctaactctgatttcttttcccatgtttaacagaggagaaaacatatgaaaagaaataacctggcggcagcgcaaaagatg

SEQ ID NO: 68322 - DNA, 103 bp, Artificial Sequence
  Synthetic Polynucleotide
taatacgactcactataggggtatctatctaactctgatttcttttcccaaacagaggagatgggaaatgaaatcagagaacctggcggcagcgcaaaagatg

SEQ ID NO: 68323 - DNA, 103 bp, Artificial Sequence
  Synthetic Polynucleotide
taatacgactcactatagggtccatgtatctatctaactctgatttctttaacagaggagaaaagaaatgagagttagaaacctggcggcagcgcaaaagatg

SEQ ID NO: 68324 - DNA, 103 bp, Artificial Sequence
  Synthetic Polynucleotide
taatacgactcactatagggacatttccatgtatctatctaactctgattaacagaggagaaatcagatgtagatagataacctggcggcagcgcaaaagatg

SEQ ID NO: 68325 - DNA, 103 bp, Artificial Sequence
  Synthetic Polynucleotide
taatacgactcactatagggtacaagctattgaaccttctggaaattatcaacagaggagagataatatgcagaaggttaacctggcggcagcgcaaaagatg

SEQ ID NO: 68326 - DNA, 103 bp, Artificial Sequence
  Synthetic Polynucleotide
taatacgactcactatagggaggatacatttccatgtatctatctaactcaacagaggagagagttaatgagatacatgaacctggcggcagcgcaaaagatg

SEQ ID NO: 68327 - DNA, 103 bp, Artificial Sequence
  Synthetic Polynucleotide
taatacgactcactatagggtgacgaggatacatttccatgtatctatctaacagaggagaagatagatgcatggaaataacctggcggcagcgcaaaagatg

SEQ ID NO: 68328 - DNA, 103 bp, Artificial Sequence
  Synthetic Polynucleotide
taatacgactcactatagggatctatgacgaggatacatttccatgtatcaacagaggagagatacaatgaaatgtatcaacctggcggcagcgcaaaagatg

SEQ ID NO: 68329 - DNA, 103 bp, Artificial Sequence
  Synthetic Polynucleotide
taatacgactcactatagggactatatctatgacgaggatacatttccataacagaggagaatggaaatgtatcctcgtaacctggcggcagcgcaaaagatg

SEQ ID NO: 68330 - DNA, 103 bp, Artificial Sequence
  Synthetic Polynucleotide
taatacgactcactatagggtgcttactatatctatgacgaggatacattaacagaggagaaatgtaatgtcgtcatagaacctggcggcagcgcaaaagatg

SEQ ID NO: 68331 - DNA, 103 bp, Artificial Sequence
  Synthetic Polynucleotide
taatacgactcactatagggtagaatgcttactatatctatgacgaggataacagaggagaatcctcatgatagatataaacctggcggcagcgcaaaagatg

SEQ ID NO: 68332 - DNA, 103 bp, Artificial Sequence
  Synthetic Polynucleotide
taatacgactcactatagggaaagatagaatgcttactatatctatgacgaacagaggagacgtcatatgtatagtaagaacctggcggcagcgcaaaagatg

SEQ ID NO: 68333 - DNA, 103 bp, Artificial Sequence
  Synthetic Polynucleotide
taatacgactcactatagggcccttaaagatagaatgcttactatatctaaacagaggagatagataatgtaagcattcaacctggcggcagcgcaaaagatg

SEQ ID NO: 68334 - DNA, 103 bp, Artificial Sequence
  Synthetic Polynucleotide
taatacgactcactatagggaaaatcccttaaagatagaatgcttactataacagaggagaatagtaatgattctatctaacctggcggcagcgcaaaagatg

SEQ ID NO: 68335 - DNA, 103 bp, Artificial Sequence
  Synthetic Polynucleotide
taatacgactcactataggggtcagaaaatcccttaaagatagaatgcttaacagaggagaaagcatatgatctttaagaacctggcggcagcgcaaaagatg

SEQ ID NO: 68336 - DNA, 103 bp, Artificial Sequence
  Synthetic Polynucleotide
taatacgactcactatagggtatgctacaagctattgaaccttctggaaaaacagaggagatttccaatgggttcaataaacctggcggcagcgcaaaagatg

SEQ ID NO: 68337 - DNA, 103 bp, Artificial Sequence
  Synthetic Polynucleotide
taatacgactcactatagggactttgtcagaaaatcccttaaagatagaaaacagaggagattctatatgtaagggattaacctggcggcagcgcaaaagatg

SEQ ID NO: 68338 - DNA, 103 bp, Artificial Sequence
  Synthetic Polynucleotide
taatacgactcactatagggttctaactttgtcagaaaatcccttaaagaaacagaggagatctttaatggattttctgaacctggcggcagcgcaaaagatg

SEQ ID NO: 68339 - DNA, 103 bp, Artificial Sequence
  Synthetic Polynucleotide
taatacgactcactatagggattttttctaactttgtcagaaaatcccttaacagaggagaaagggaatgtctgacaaaaacctggcggcagcgcaaaagatg

SEQ ID NO: 68340 - DNA, 103 bp, Artificial Sequence
  Synthetic Polynucleotide
taatacgactcactatagggaaatcattttttctaactttgtcagaaaataacagaggagaattttcatgcaaagttagaacctggcggcagcgcaaaagatg

SEQ ID NO: 68341 - DNA, 103 bp, Artificial Sequence
  Synthetic Polynucleotide
taatacgactcactatagggtgtctaaatcattttttctaactttgtcagaacagaggagactgacaatgttagaaaaaaacctggcggcagcgcaaaagatg

SEQ ID NO: 68342 - DNA, 103 bp, Artificial Sequence
  Synthetic Polynucleotide
taatacgactcactatagggattcatgtctaaatcattttttctaactttaacagaggagaaaagttatgaaaaatgataacctggcggcagcgcaaaagatg

SEQ ID NO: 68343 - DNA, 103 bp, Artificial Sequence
  Synthetic Polynucleotide
taatacgactcactatagggaccacattcatgtctaaatcattttttctaaacagaggagatagaaaatgtgatttagaaacctggcggcagcgcaaaagatg

SEQ ID NO: 68344 - DNA, 103 bp, Artificial Sequence
  Synthetic Polynucleotide
taatacgactcactatagggcttttaccacattcatgtctaaatcattttaacagaggagaaaaatgatgtagacatgaaacctggcggcagcgcaaaagatg

SEQ ID NO: 68345 - DNA, 103 bp, Artificial Sequence
  Synthetic Polynucleotide
taatacgactcactatagggtaattcttttaccacattcatgtctaaatcaacagaggagagatttaatgatgaatgtgaacctggcggcagcgcaaaagatg

SEQ ID NO: 68346 - DNA, 103 bp, Artificial Sequence
  Synthetic Polynucleotide
taatacgactcactataggggaaagtaattcttttaccacattcatgtctaacagaggagaagacatatgtgtggtaaaaacctggcggcagcgcaaaagatg

SEQ ID NO: 68347 - DNA, 103 bp, Artificial Sequence
  Synthetic Polynucleotide
taatacgactcactatagggaataatataacaatacaatattgaatgtgtaacagaggagaacacatatgatattgtataacctggcggcagcgcaaaagatg

SEQ ID NO: 68348 - DNA, 103 bp, Artificial Sequence
  Synthetic Polynucleotide
taatacgactcactatagggaggaatatgctacaagctattgaaccttctaacagaggagaagaaggatgaatagcttgaacctggcggcagcgcaaaagatg

SEQ ID NO: 68349 - DNA, 103 bp, Artificial Sequence
  Synthetic Polynucleotide
taatacgactcactatagggcgttagaaagtaattcttttaccacattcaaacagaggagatgaatgatgtaaaagaataacctggcggcagcgcaaaagatg

SEQ ID NO: 68350 - DNA, 103 bp, Artificial Sequence
  Synthetic Polynucleotide
taatacgactcactatagggtgcgccgttagaaagtaattcttttaccacaacagaggagagtggtaatggaattacttaacctggcggcagcgcaaaagatg

SEQ ID NO: 68351 - DNA, 103 bp, Artificial Sequence
  Synthetic Polynucleotide
taatacgactcactatagggagagatgcgccgttagaaagtaattcttttaacagaggagaaaaagaatgactttctaaaacctggcggcagcgcaaaagatg

SEQ ID NO: 68352 - DNA, 103 bp, Artificial Sequence
  Synthetic Polynucleotide
taatacgactcactatagggttgttagagatgcgccgttagaaagtaattaacagaggagaaattacatgctaacggcgaacctggcggcagcgcaaaagatg

SEQ ID NO: 68353 - DNA, 103 bp, Artificial Sequence
  Synthetic Polynucleotide
taatacgactcactatagggcttgattgttagagatgcgccgttagaaagaacagaggagactttctatgggcgcatctaacctggcggcagcgcaaaagatg

SEQ ID NO: 68354 - DNA, 103 bp, Artificial Sequence
  Synthetic Polynucleotide
taatacgactcactatagggctatccttgattgttagagatgcgccgttaaacagaggagataacggatgatctctaacaacctggcggcagcgcaaaagatg

SEQ ID NO: 68355 - DNA, 103 bp, Artificial Sequence
  Synthetic Polynucleotide
taatacgactcactatagggtactgctatccttgattgttagagatgcgcaacagaggagagcgcatatgtaacaatcaaacctggcggcagcgcaaaagatg

SEQ ID NO: 68356 - DNA, 103 bp, Artificial Sequence
  Synthetic Polynucleotide
taatacgactcactatagggcttattactgctatccttgattgttagagaaacagaggagatctctaatgatcaaggataacctggcggcagcgcaaaagatg

SEQ ID NO: 68357 - DNA, 103 bp, Artificial Sequence
  Synthetic Polynucleotide
taatacgactcactatagggggatccttattactgctatccttgattgttaacagaggagaaacaatatgggatagcagaacctggcggcagcgcaaaagatg

SEQ ID NO: 68358 - DNA, 103 bp, Artificial Sequence
  Synthetic Polynucleotide
taatacgactcactatagggcaattggatccttattactgctatccttgaaacagaggagatcaaggatggcagtaataaacctggcggcagcgcaaaagatg

SEQ ID NO: 68359 - DNA, 103 bp, Artificial Sequence
  Synthetic Polynucleotide
taatacgactcactatagggtatttaggaatatgctacaagctattgaacaacagaggagagttcaaatgcttgtagcaaacctggcggcagcgcaaaagatg

SEQ ID NO: 68360 - DNA, 103 bp, Artificial Sequence
  Synthetic Polynucleotide
taatacgactcactatagggaacagcaattggatccttattactgctatcaacagaggagagatagcatgaataaggataacctggcggcagcgcaaaagatg

SEQ ID NO: 68361 - DNA, 103 bp, Artificial Sequence
  Synthetic Polynucleotide
taatacgactcactatagggaaataaacagcaattggatccttattactgaacagaggagacagtaaatgggatccaataacctggcggcagcgcaaaagatg

SEQ ID NO: 68362 - DNA, 103 bp, Artificial Sequence
  Synthetic Polynucleotide
taatacgactcactatagggttctaaaataaacagcaattggatccttataacagaggagaataaggatgcaattgctgaacctggcggcagcgcaaaagatg

SEQ ID NO: 68363 - DNA, 103 bp, Artificial Sequence
  Synthetic Polynucleotide
taatacgactcactatagggcgttcttctaaaataaacagcaattggatcaacagaggagagatccaatggctgtttataacctggcggcagcgcaaaagatg

SEQ ID NO: 68364 - DNA, 103 bp, Artificial Sequence
  Synthetic Polynucleotide
taatacgactcactatagggattatcgttcttctaaaataaacagcaattaacagaggagaaattgcatgttattttagaacctggcggcagcgcaaaagatg

SEQ ID NO: 68365 - DNA, 103 bp, Artificial Sequence
  Synthetic Polynucleotide
taatacgactcactatagggaattcattatcgttcttctaaaataaacagaacagaggagactgtttatgttagaagaaaacctggcggcagcgcaaaagatg

SEQ ID NO: 68366 - DNA, 103 bp, Artificial Sequence
  Synthetic Polynucleotide
taatacgactcactatagggttctaaattcattatcgttcttctaaaataaacagaggagatattttatgagaacgataaacctggcggcagcgcaaaagatg

SEQ ID NO: 68367 - DNA, 103 bp, Artificial Sequence
  Synthetic Polynucleotide
taatacgactcactatagggatcatttctaaattcattatcgttcttctaaacagaggagatagaagatggataatgaaaacctggcggcagcgcaaaagatg

SEQ ID NO: 68368 - DNA, 103 bp, Artificial Sequence
  Synthetic Polynucleotide
taatacgactcactatagggtatcaatcatttctaaattcattatcgttcaacagaggagagaacgaatgtgaatttagaacctggcggcagcgcaaaagatg

SEQ ID NO: 68369 - DNA, 103 bp, Artificial Sequence
  Synthetic Polynucleotide
taatacgactcactatagggaatgatatcaatcatttctaaattcattataacagaggagaataatgatgttagaaatgaacctggcggcagcgcaaaagatg

SEQ ID NO: 68370 - DNA, 103 bp, Artificial Sequence
  Synthetic Polynucleotide
taatacgactcactatagggagatgtatttaggaatatgctacaagctataacagaggagaatagctatgagcatattcaacctggcggcagcgcaaaagatg

SEQ ID NO: 68371 - DNA, 103 bp, Artificial Sequence
  Synthetic Polynucleotide
taatacgactcactatagggttgttaatgatatcaatcatttctaaattcaacagaggagagaatttatgaatgattgaaacctggcggcagcgcaaaagatg

SEQ ID NO: 68372 - DNA, 103 bp, Artificial Sequence
  Synthetic Polynucleotide
taatacgactcactatagggtatgtttgttaatgatatcaatcatttctaaacagaggagatagaaaatgttgatatcaaacctggcggcagcgcaaaagatg

SEQ ID NO: 68373 - DNA, 103 bp, Artificial Sequence
  Synthetic Polynucleotide
taatacgactcactatagggagttgtatgtttgttaatgatatcaatcataacagaggagaatgattatgatcattaacaacctggcggcagcgcaaaagatg

SEQ ID NO: 68374 - DNA, 103 bp, Artificial Sequence
  Synthetic Polynucleotide
taatacgactcactatagggtagatagttgtatgtttgttaatgatatcaaacagaggagatgatatatgtaacaaacaaacctggcggcagcgcaaaagatg

SEQ ID NO: 68375 - DNA, 103 bp, Artificial Sequence
  Synthetic Polynucleotide
taatacgactcactataggggttcatagatagttgtatgtttgttaatgaaacagaggagatcattaatgaacatacaaaacctggcggcagcgcaaaagatg

SEQ ID NO: 68376 - DNA, 103 bp, Artificial Sequence
  Synthetic Polynucleotide
taatacgactcactatagggccggcgttcatagatagttgtatgtttgttaacagaggagaaacaaaatgacaactatcaacctggcggcagcgcaaaagatg

SEQ ID NO: 68377 - DNA, 103 bp, Artificial Sequence
  Synthetic Polynucleotide
taatacgactcactatagggatataccggcgttcatagatagttgtatgtaacagaggagaacatacatgtatctatgaaacctggcggcagcgcaaaagatg

SEQ ID NO: 68378 - DNA, 103 bp, Artificial Sequence
  Synthetic Polynucleotide
taatacgactcactataggggtactatataccggcgttcatagatagttgaacagaggagacaactaatgatgaacgccaacctggcggcagcgcaaaagatg

SEQ ID NO: 68379 - DNA, 103 bp, Artificial Sequence
  Synthetic Polynucleotide
taatacgactcactatagggggagtgtactatataccggcgttcatagataacagaggagaatctatatgcgccggtataacctggcggcagcgcaaaagatg

SEQ ID NO: 68380 - DNA, 103 bp, Artificial Sequence
  Synthetic Polynucleotide
taatacgactcactatagggagataggagtgtactatataccggcgttcaaacagaggagatgaacgatggtatatagtaacctggcggcagcgcaaaagatg

SEQ ID NO: 68381 - DNA, 103 bp, Artificial Sequence
  Synthetic Polynucleotide
taatacgactcactatagggaatttagatgtatttaggaatatgctacaaaacagaggagattgtagatgattcctaaaaacctggcggcagcgcaaaagatg

SEQ ID NO: 68382 - DNA, 103 bp, Artificial Sequence
  Synthetic Polynucleotide
taatacgactcactatagggtttttagataggagtgtactatataccggcaacagaggagagccggtatgtagtacactaacctggcggcagcgcaaaagatg

SEQ ID NO: 68383 - DNA, 103 bp, Artificial Sequence
  Synthetic Polynucleotide
taatacgactcactatagggataattttttagataggagtgtactatataaacagaggagatatataatgcactcctataacctggcggcagcgcaaaagatg

SEQ ID NO: 68384 - DNA, 103 bp, Artificial Sequence
  Synthetic Polynucleotide
taatacgactcactatagggtttctataattttttagataggagtgtactaacagaggagaagtacaatgctatctaaaaacctggcggcagcgcaaaagatg

SEQ ID NO: 68385 - DNA, 103 bp, Artificial Sequence
  Synthetic Polynucleotide
taatacgactcactatagggcaaaatttctataattttttagataggagtaacagaggagaactcctatgtaaaaaattaacctggcggcagcgcaaaagatg

SEQ ID NO: 68386 - DNA, 103 bp, Artificial Sequence
  Synthetic Polynucleotide
taatacgactcactatagggataatcaaaatttctataattttttagataaacagaggagatatctaatgaattatagaaacctggcggcagcgcaaaagatg

SEQ ID NO: 68387 - DNA, 103 bp, Artificial Sequence
  Synthetic Polynucleotide
taatacgactcactatagggaatggataatcaaaatttctataattttttaacagaggagaaaaaaaatgtagaaatttaacctggcggcagcgcaaaagatg

SEQ ID NO: 68388 - DNA, 103 bp, Artificial Sequence
  Synthetic Polynucleotide
taatacgactcactatagggtgaaaaatggataatcaaaatttctataataacagaggagaattataatgattttgattaacctggcggcagcgcaaaagatg

SEQ ID NO: 68389 - DNA, 103 bp, Artificial Sequence
  Synthetic Polynucleotide
taatacgactcactatagggcttcctgaaaaatggataatcaaaatttctaacagaggagaagaaatatggattatccaaacctggcggcagcgcaaaagatg

SEQ ID NO: 68390 - DNA, 103 bp, Artificial Sequence
  Synthetic Polynucleotide
taatacgactcactatagggactaacttcctgaaaaatggataatcaaaaaacagaggagattttgaatgtccatttttaacctggcggcagcgcaaaagatg

SEQ ID NO: 68391 - DNA, 103 bp, Artificial Sequence
  Synthetic Polynucleotide
taatacgactcactatagggtcaaaactaacttcctgaaaaatggataataacagaggagaattatcatgttttcaggaaacctggcggcagcgcaaaagatg

SEQ ID NO: 68392 - DNA, 103 bp, Artificial Sequence
  Synthetic Polynucleotide
taatacgactcactataggggtaaaaatttagatgtatttaggaatatgcaacagaggagagcatatatgtaaatacataacctggcggcagcgcaaaagatg

SEQ ID NO: 68393 - DNA, 103 bp, Artificial Sequence
  Synthetic Polynucleotide
taatacgactcactatagggattagtcaaaactaacttcctgaaaaatggaacagaggagaccatttatgaggaagttaaacctggcggcagcgcaaaagatg

SEQ ID NO: 68394 - DNA, 103 bp, Artificial Sequence
  Synthetic Polynucleotide
taatacgactcactatagggtgtttattagtcaaaactaacttcctgaaaaacagaggagatttcagatggttagttttaacctggcggcagcgcaaaagatg

SEQ ID NO: 68395 - DNA, 103 bp, Artificial Sequence
  Synthetic Polynucleotide
taatacgactcactataggggacaatgtttattagtcaaaactaacttccaacagaggagaggaagtatgttttgactaaacctggcggcagcgcaaaagatg

SEQ ID NO: 68396 - DNA, 103 bp, Artificial Sequence
  Synthetic Polynucleotide
taatacgactcactatagggatcgagacaatgtttattagtcaaaactaaaacagaggagattagttatgactaataaaaacctggcggcagcgcaaaagatg

SEQ ID NO: 68397 - DNA, 103 bp, Artificial Sequence
  Synthetic Polynucleotide
taatacgactcactatagggtaattatcgagacaatgtttattagtcaaaaacagaggagatttgacatgtaaacattgaacctggcggcagcgcaaaagatg

SEQ ID NO: 68398 - DNA, 103 bp, Artificial Sequence
  Synthetic Polynucleotide
taatacgactcactatagggtataataattatcgagacaatgtttattagaacagaggagactaataatgattgtctcgaacctggcggcagcgcaaaagatg

SEQ ID NO: 68399 - DNA, 103 bp, Artificial Sequence
  Synthetic Polynucleotide
taatacgactcactatagggtgtattataataattatcgagacaatgtttaacagaggagaaaacatatgctcgataataacctggcggcagcgcaaaagatg

SEQ ID NO: 68400 - DNA, 103 bp, Artificial Sequence
  Synthetic Polynucleotide
taatacgactcactatagggtcacctgtattataataattatcgagacaaaacagaggagattgtctatgtaattattaaacctggcggcagcgcaaaagatg

SEQ ID NO: 68401 - DNA, 103 bp, Artificial Sequence
  Synthetic Polynucleotide
taatacgactcactatagggtgcggtcacctgtattataataattatcgaaacagaggagatcgataatgattataataaacctggcggcagcgcaaaagatg

SEQ ID NO: 68402 - DNA, 103 bp, Artificial Sequence
  Synthetic Polynucleotide
taatacgactcactatagggatgtctgcggtcacctgtattataataattaacagaggagaaattatatgaatacaggtaacctggcggcagcgcaaaagatg

SEQ ID NO: 68403 - DNA, 103 bp, Artificial Sequence
  Synthetic Polynucleotide
taatacgactcactatagggtaatagtaaaaatttagatgtatttaggaaaacagaggagattcctaatgacatctaaaaacctggcggcagcgcaaaagatg

SEQ ID NO: 68404 - DNA, 103 bp, Artificial Sequence
  Synthetic Polynucleotide
taatacgactcactataggggttccatgtctgcggtcacctgtattataaaacagaggagattataaatgaggtgaccgaacctggcggcagcgcaaaagatg

SEQ ID NO: 68405 - DNA, 103 bp, Artificial Sequence
  Synthetic Polynucleotide
taatacgactcactataggggcggcgttccatgtctgcggtcacctgtataacagaggagaatacagatgaccgcagacaacctggcggcagcgcaaaagatg

SEQ ID NO: 68406 - DNA, 103 bp, Artificial Sequence
  Synthetic Polynucleotide
taatacgactcactatagggatgtagcggcgttccatgtctgcggtcaccaacagaggagaggtgacatgagacatggaaacctggcggcagcgcaaaagatg

SEQ ID NO: 68407 - DNA, 103 bp, Artificial Sequence
  Synthetic Polynucleotide
taatacgactcactatagggaatatatgtagcggcgttccatgtctgcggaacagaggagaccgcagatgtggaacgccaacctggcggcagcgcaaaagatg

SEQ ID NO: 68408 - DNA, 103 bp, Artificial Sequence
  Synthetic Polynucleotide
taatacgactcactatagggtcgccaatatatgtagcggcgttccatgtcaacagaggagagacatgatgcgccgctacaacctggcggcagcgcaaaagatg

SEQ ID NO: 68409 - DNA, 103 bp, Artificial Sequence
  Synthetic Polynucleotide
taatacgactcactatagggattagtcgccaatatatgtagcggcgttccaacagaggagaggaacgatgctacatataaacctggcggcagcgcaaaagatg

SEQ ID NO: 68410 - DNA, 103 bp, Artificial Sequence
  Synthetic Polynucleotide
taatacgactcactatagggtttttattagtcgccaatatatgtagcggcaacagaggagagccgctatgtatattggcaacctggcggcagcgcaaaagatg

SEQ ID NO: 68411 - DNA, 103 bp, Artificial Sequence
  Synthetic Polynucleotide
taatacgactcactatagggttaattttttattagtcgccaatatatgtaaacagaggagatacataatgtggcgactaaacctggcggcagcgcaaaagatg

SEQ ID NO: 68412 - DNA, 103 bp, Artificial Sequence
  Synthetic Polynucleotide
taatacgactcactatagggtgttattaattttttattagtcgccaatataacagaggagaatattgatgactaataaaaacctggcggcagcgcaaaagatg

SEQ ID NO: 68413 - DNA, 103 bp, Artificial Sequence
  Synthetic Polynucleotide
taatacgactcactatagggttaggtgttattaattttttattagtcgccaacagaggagaggcgacatgtaaaaaattaacctggcggcagcgcaaaagatg

SEQ ID NO: 68414 - DNA, 103 bp, Artificial Sequence
  Synthetic Polynucleotide
taatacgactcactatagggaaatataatagtaaaaatttagatgtatttaacagaggagaaaatacatgtaaatttttaacctggcggcagcgcaaaagatg

SEQ ID NO: 68415 - DNA, 103 bp, Artificial Sequence
  Synthetic Polynucleotide
taatacgactcactatagggtgtaattaggtgttattaattttttattagaacagaggagactaataatgaattaataaaacctggcggcagcgcaaaagatg

SEQ ID NO: 68416 - DNA, 103 bp, Artificial Sequence
  Synthetic Polynucleotide
taatacgactcactatagggcttcatgtaattaggtgttattaattttttaacagaggagaaaaaaaatgataacacctaacctggcggcagcgcaaaagatg

SEQ ID NO: 68417 - DNA, 103 bp, Artificial Sequence
  Synthetic Polynucleotide
taatacgactcactatagggaataacttcatgtaattaggtgttattaataacagaggagaattaatatgacctaattaaacctggcggcagcgcaaaagatg

SEQ ID NO: 68418 - DNA, 103 bp, Artificial Sequence
  Synthetic Polynucleotide
taatacgactcactatagggacactaataacttcatgtaattaggtgttaaacagaggagataacacatgattacatgaaacctggcggcagcgcaaaagatg

SEQ ID NO: 68419 - DNA, 103 bp, Artificial Sequence
  Synthetic Polynucleotide
taatacgactcactataggggttatacactaataacttcatgtaattaggaacagaggagacctaatatgatgaagttaaacctggcggcagcgcaaaagatg

SEQ ID NO: 68420 - DNA, 103 bp, Artificial Sequence
  Synthetic Polynucleotide
taatacgactcactatagggtttccgttatacactaataacttcatgtaaaacagaggagattacatatggttattagtaacctggcggcagcgcaaaagatg

SEQ ID NO: 68421 - DNA, 103 bp, Artificial Sequence
  Synthetic Polynucleotide
taatacgactcactatagggtatcatttccgttatacactaataacttcaaacagaggagatgaagtatgtagtgtataaacctggcggcagcgcaaaagatg

SEQ ID NO: 68422 - DNA, 103 bp, Artificial Sequence
  Synthetic Polynucleotide
taatacgactcactataggggtttatatcatttccgttatacactaataaaacagaggagattattaatgtataacggaaacctggcggcagcgcaaaagatg

SEQ ID NO: 68423 - DNA, 103 bp, Artificial Sequence
  Synthetic Polynucleotide
taatacgactcactatagggcgtgcgtttatatcatttccgttatacactaacagaggagaagtgtaatgcggaaatgaaacctggcggcagcgcaaaagatg

SEQ ID NO: 68424 - DNA, 103 bp, Artificial Sequence
  Synthetic Polynucleotide
taatacgactcactatagggcgccgcgtgcgtttatatcatttccgttataacagaggagaataacgatgatgatataaaacctggcggcagcgcaaaagatg

SEQ ID NO: 68425 - DNA, 103 bp, Artificial Sequence
  Synthetic Polynucleotide
taatacgactcactatagggataccaaatataatagtaaaaatttagatgaacagaggagacatctaatgttttactataacctggcggcagcgcaaaagatg

SEQ ID NO: 68426 - DNA, 103 bp, Artificial Sequence
  Synthetic Polynucleotide
taatacgactcactatagggattttcgccgcgtgcgtttatatcatttccaacagaggagaggaaatatgataaacgcaaacctggcggcagcgcaaaagatg

SEQ ID NO: 68427 - DNA, 103 bp, Artificial Sequence
  Synthetic Polynucleotide
taatacgactcactatagggtgtgtattttcgccgcgtgcgtttatatcaaacagaggagatgatatatgcgcacgcggaacctggcggcagcgcaaaagatg

SEQ ID NO: 68428 - DNA, 103 bp, Artificial Sequence
  Synthetic Polynucleotide
taatacgactcactataggggcatttgtgtattttcgccgcgtgcgtttaaacagaggagataaacgatggcggcgaaaaacctggcggcagcgcaaaagatg

SEQ ID NO: 68429 - DNA, 103 bp, Artificial Sequence
  Synthetic Polynucleotide
taatacgactcactatagggagtttgcatttgtgtattttcgccgcgtgcaacagaggagagcacgcatggaaaatacaaacctggcggcagcgcaaaagatg

SEQ ID NO: 68430 - DNA, 103 bp, Artificial Sequence
  Synthetic Polynucleotide
taatacgactcactatagggaatggagtttgcatttgtgtattttcgccgaacagaggagacggcgaatgtacacaaataacctggcggcagcgcaaaagatg

SEQ ID NO: 68431 - DNA, 103 bp, Artificial Sequence
  Synthetic Polynucleotide
taatacgactcactatagggtgtgtaatggagtttgcatttgtgtattttaacagaggagaaaaataatgaaatgcaaaaacctggcggcagcgcaaaagatg

SEQ ID NO: 68432 - DNA, 103 bp, Artificial Sequence
  Synthetic Polynucleotide
taatacgactcactatagggatatttgtgtaatggagtttgcatttgtgtaacagaggagaacacaaatgcaaactccaaacctggcggcagcgcaaaagatg

SEQ ID NO: 68433 - DNA, 103 bp, Artificial Sequence
  Synthetic Polynucleotide
taatacgactcactatagggcacaaatatttgtgtaatggagtttgcattaacagaggagaaatgcaatgtccattacaaacctggcggcagcgcaaaagatg

SEQ ID NO: 68434 - DNA, 103 bp, Artificial Sequence
  Synthetic Polynucleotide
taatacgactcactatagggatttacacaaatatttgtgtaatggagtttaacagaggagaaaactcatgtacacaaataacctggcggcagcgcaaaagatg

SEQ ID NO: 68435 - DNA, 103 bp, Artificial Sequence
  Synthetic Polynucleotide
taatacgactcactatagggtacaaatttacacaaatatttgtgtaatggaacagaggagaccattaatgaaatatttgaacctggcggcagcgcaaaagatg

SEQ ID NO: 68436 - DNA, 103 bp, Artificial Sequence
  Synthetic Polynucleotide
taatacgactcactatagggtctttataccaaatataatagtaaaaatttaacagaggagaaaatttatgctattatataacctggcggcagcgcaaaagatg

SEQ ID NO: 68437 - DNA, 103 bp, Artificial Sequence
  Synthetic Polynucleotide
taatacgactcactatagggtgatatacaaatttacacaaatatttgtgtaacagaggagaacacaaatgtttgtgtaaaacctggcggcagcgcaaaagatg

SEQ ID NO: 68438 - DNA, 103 bp, Artificial Sequence
  Synthetic Polynucleotide
taatacgactcactatagggtattatgatatacaaatttacacaaatattaacagaggagaaatattatggtaaatttgaacctggcggcagcgcaaaagatg

SEQ ID NO: 68439 - DNA, 103 bp, Artificial Sequence
  Synthetic Polynucleotide
taatacgactcactatagggttcaatattatgatatacaaatttacacaaaacagaggagattgtgtatgtttgtatataacctggcggcagcgcaaaagatg

SEQ ID NO: 68440 - DNA, 103 bp, Artificial Sequence
  Synthetic Polynucleotide
taatacgactcactatagggccatattcaatattatgatatacaaatttaaacagaggagataaattatgatatcataaaacctggcggcagcgcaaaagatg

SEQ ID NO: 68441 - DNA, 103 bp, Artificial Sequence
  Synthetic Polynucleotide
taatacgactcactatagggggataccatattcaatattatgatatacaaaacagaggagattgtatatgataatattgaacctggcggcagcgcaaaagatg

SEQ ID NO: 68442 - DNA, 103 bp, Artificial Sequence
  Synthetic Polynucleotide
taatacgactcactataggggtatcggataccatattcaatattatgataaacagaggagatatcatatgattgaatataacctggcggcagcgcaaaagatg

SEQ ID NO: 68443 - DNA, 103 bp, Artificial Sequence
  Synthetic Polynucleotide
taatacgactcactatagggttatagtatcggataccatattcaatattaaacagaggagataatatatgatatggtataacctggcggcagcgcaaaagatg

SEQ ID NO: 68444 - DNA, 103 bp, Artificial Sequence
  Synthetic Polynucleotide
taatacgactcactatagggtttcattatagtatcggataccatattcaaaacagaggagattgaatatggtatccgataacctggcggcagcgcaaaagatg

SEQ ID NO: 68445 - DNA, 103 bp, Artificial Sequence
  Synthetic Polynucleotide
taatacgactcactatagggaatcttttcattatagtatcggataccataaacagaggagatatggtatgcgatactataacctggcggcagcgcaaaagatg

SEQ ID NO: 68446 - DNA, 103 bp, Artificial Sequence
  Synthetic Polynucleotide
taatacgactcactatagggtctataatcttttcattatagtatcggataaacagaggagatatccgatgctataatgaaacctggcggcagcgcaaaagatg

SEQ ID NO: 68447 - DNA, 103 bp, Artificial Sequence
  Synthetic Polynucleotide
taatacgactcactatagggctatctctttataccaaatataatagtaaaaacagaggagatttactatgatatttggtaacctggcggcagcgcaaaagatg

SEQ ID NO: 68448 - DNA, 103 bp, Artificial Sequence
  Synthetic Polynucleotide
taatacgactcactatagggatgcgtctataatcttttcattatagtatcaacagaggagagatactatgatgaaaagaaacctggcggcagcgcaaaagatg

SEQ ID NO: 68449 - DNA, 103 bp, Artificial Sequence
  Synthetic Polynucleotide
taatacgactcactatagggtataaatgcgtctataatcttttcattataaacagaggagatataatatgaagattataaacctggcggcagcgcaaaagatg

SEQ ID NO: 68450 - DNA, 103 bp, Artificial Sequence
  Synthetic Polynucleotide
taatacgactcactatagggaactctataaatgcgtctataatcttttcaaacagaggagatgaaaaatgtatagacgcaacctggcggcagcgcaaaagatg

SEQ ID NO: 68451 - DNA, 103 bp, Artificial Sequence
  Synthetic Polynucleotide
taatacgactcactatagggctcctaactctataaatgcgtctataatctaacagaggagaagattaatgacgcatttaaacctggcggcagcgcaaaagatg

SEQ ID NO: 68452 - DNA, 103 bp, Artificial Sequence
  Synthetic Polynucleotide
taatacgactcactatagggatcggctcctaactctataaatgcgtctataacagaggagaatagacatgtttatagagaacctggcggcagcgcaaaagatg

SEQ ID NO: 68453 - DNA, 103 bp, Artificial Sequence
  Synthetic Polynucleotide
taatacgactcactataggggttagatcggctcctaactctataaatgcgaacagaggagacgcattatgagagttaggaacctggcggcagcgcaaaagatg

SEQ ID NO: 68454 - DNA, 103 bp, Artificial Sequence
  Synthetic Polynucleotide
taatacgactcactataggggaatagttagatcggctcctaactctataaaacagaggagattatagatgtaggagccgaacctggcggcagcgcaaaagatg

SEQ ID NO: 68455 - DNA, 103 bp, Artificial Sequence
  Synthetic Polynucleotide
taatacgactcactatagggatttggaatagttagatcggctcctaactcaacagaggagagagttaatggccgatctaaacctggcggcagcgcaaaagatg

SEQ ID NO: 68456 - DNA, 103 bp, Artificial Sequence
  Synthetic Polynucleotide
taatacgactcactatagggtcatcatttggaatagttagatcggctcctaacagaggagaaggagcatgtctaactataacctggcggcagcgcaaaagatg

SEQ ID NO: 68457 - DNA, 103 bp, Artificial Sequence
  Synthetic Polynucleotide
taatacgactcactatagggtttcatcatcatttggaatagttagatcggaacagaggagaccgatcatgctattccaaaacctggcggcagcgcaaaagatg

SEQ ID NO: 68458 - DNA, 103 bp, Artificial Sequence
  Synthetic Polynucleotide
taatacgactcactatagggtctatgtcgtctactggatgaagatgtgacaacagaggagagtcacaatgtcatccagtaacctggcggcagcgcaaaagatg

SEQ ID NO: 68459 - DNA, 103 bp, Artificial Sequence
  Synthetic Polynucleotide
taatacgactcactatagggaaactaataatataacaatacaatattgaaaacagaggagattcaatatggtattgttaaacctggcggcagcgcaaaagatg

SEQ ID NO: 68460 - DNA, 103 bp, Artificial Sequence
  Synthetic Polynucleotide
taatacgactcactatagggattatctatctctttataccaaatataataaacagaggagatattatatgtggtataaaaacctggcggcagcgcaaaagatg

SEQ ID NO: 68461 - DNA, 103 bp, Artificial Sequence
  Synthetic Polynucleotide
taatacgactcactatagggtatcatttcatcatcatttggaatagttagaacagaggagactaactatgccaaatgataacctggcggcagcgcaaaagatg

SEQ ID NO: 68462 - DNA, 103 bp, Artificial Sequence
  Synthetic Polynucleotide
taatacgactcactatagggactggtatcatttcatcatcatttggaataaacagaggagatattccatgtgatgatgaaacctggcggcagcgcaaaagatg

SEQ ID NO: 68463 - DNA, 103 bp, Artificial Sequence
  Synthetic Polynucleotide
taatacgactcactatagggaaattactggtatcatttcatcatcatttgaacagaggagacaaatgatgatgaaatgaaacctggcggcagcgcaaaagatg

SEQ ID NO: 68464 - DNA, 103 bp, Artificial Sequence
  Synthetic Polynucleotide
taatacgactcactataggggcagtaaattactggtatcatttcatcatcaacagaggagagatgatatgatgataccaaacctggcggcagcgcaaaagatg

SEQ ID NO: 68465 - DNA, 103 bp, Artificial Sequence
  Synthetic Polynucleotide
taatacgactcactatagggtgtatgcagtaaattactggtatcatttcaaacagaggagatgaaatatgaccagtaataacctggcggcagcgcaaaagatg

SEQ ID NO: 68466 - DNA, 103 bp, Artificial Sequence
  Synthetic Polynucleotide
taatacgactcactatagggttacgtgtatgcagtaaattactggtatcaaacagaggagatgatacatgtaatttactaacctggcggcagcgcaaaagatg

SEQ ID NO: 68467 - DNA, 103 bp, Artificial Sequence
  Synthetic Polynucleotide
taatacgactcactatagggagcatttacgtgtatgcagtaaattactggaacagaggagaccagtaatgtactgcataaacctggcggcagcgcaaaagatg

SEQ ID NO: 68468 - DNA, 103 bp, Artificial Sequence
  Synthetic Polynucleotide
taatacgactcactatagggtattcagcatttacgtgtatgcagtaaattaacagaggagaaatttaatgcatacacgtaacctggcggcagcgcaaaagatg

SEQ ID NO: 68469 - DNA, 103 bp, Artificial Sequence
  Synthetic Polynucleotide
taatacgactcactatagggaaccatattcagcatttacgtgtatgcagtaacagaggagaactgcaatgacgtaaatgaacctggcggcagcgcaaaagatg

SEQ ID NO: 68470 - DNA, 103 bp, Artificial Sequence
  Synthetic Polynucleotide
taatacgactcactataggggttataaccatattcagcatttacgtgtataacagaggagaatacacatgaatgctgaaaacctggcggcagcgcaaaagatg

SEQ ID NO: 68471 - DNA, 103 bp, Artificial Sequence
  Synthetic Polynucleotide
taatacgactcactatagggcgagtattatctatctctttataccaaataaacagaggagatatttgatgtaaagagataacctggcggcagcgcaaaagatg

SEQ ID NO: 68472 - DNA, 103 bp, Artificial Sequence
  Synthetic Polynucleotide
taatacgactcactatagggatattgttataaccatattcagcatttacgaacagaggagacgtaaaatgtgaatatggaacctggcggcagcgcaaaagatg

SEQ ID NO: 68473 - DNA, 103 bp, Artificial Sequence
  Synthetic Polynucleotide
taatacgactcactatagggtagtaatattgttataaccatattcagcataacagaggagaatgctgatgatggttataaacctggcggcagcgcaaaagatg

SEQ ID NO: 68474 - DNA, 103 bp, Artificial Sequence
  Synthetic Polynucleotide
taatacgactcactatagggtatgttagtaatattgttataaccatattcaacagaggagagaatatatgtataacaataacctggcggcagcgcaaaagatg

SEQ ID NO: 68475 - DNA, 103 bp, Artificial Sequence
  Synthetic Polynucleotide
taatacgactcactatagggatccttatgttagtaatattgttataaccaaacagaggagatggttaatgcaatattacaacctggcggcagcgcaaaagatg

SEQ ID NO: 68476 - DNA, 103 bp, Artificial Sequence
  Synthetic Polynucleotide
taatacgactcactataggggtattatccttatgttagtaatattgttataacagaggagaataacaatgttactaacaaacctggcggcagcgcaaaagatg

SEQ ID NO: 68477 - DNA, 103 bp, Artificial Sequence
  Synthetic Polynucleotide
taatacgactcactatagggtttacgtattatccttatgttagtaatattaacagaggagaaatattatgaacataaggaacctggcggcagcgcaaaagatg

SEQ ID NO: 68478 - DNA, 103 bp, Artificial Sequence
  Synthetic Polynucleotide
taatacgactcactatagggagtagtttacgtattatccttatgttagtaaacagaggagatactaaatgaaggataataacctggcggcagcgcaaaagatg

SEQ ID NO: 68479 - DNA, 103 bp, Artificial Sequence
  Synthetic Polynucleotide
taatacgactcactataggggattaagtagtttacgtattatccttatgtaacagaggagaacataaatgtaatacgtaaacctggcggcagcgcaaaagatg

SEQ ID NO: 68480 - DNA, 103 bp, Artificial Sequence
  Synthetic Polynucleotide
taatacgactcactataggggctaagattaagtagtttacgtattatcctaacagaggagaaggataatgcgtaaactaaacctggcggcagcgcaaaagatg

SEQ ID NO: 68481 - DNA, 103 bp, Artificial Sequence
  Synthetic Polynucleotide
taatacgactcactatagggtgtctgctaagattaagtagtttacgtattaacagaggagaaatacgatgactacttaaaacctggcggcagcgcaaaagatg

SEQ ID NO: 68482 - DNA, 103 bp, Artificial Sequence
  Synthetic Polynucleotide
taatacgactcactatagggtcggccgagtattatctatctctttataccaacagaggagaggtataatgagatagataaacctggcggcagcgcaaaagatg

SEQ ID NO: 68483 - DNA, 103 bp, Artificial Sequence
  Synthetic Polynucleotide
taatacgactcactataggggagcatgtctgctaagattaagtagtttacaacagaggagagtaaacatgttaatcttaaacctggcggcagcgcaaaagatg

SEQ ID NO: 68484 - DNA, 103 bp, Artificial Sequence
  Synthetic Polynucleotide
taatacgactcactatagggatgtggagcatgtctgctaagattaagtagaacagaggagactacttatgcttagcagaaacctggcggcagcgcaaaagatg

SEQ ID NO: 68485 - DNA, 103 bp, Artificial Sequence
  Synthetic Polynucleotide
taatacgactcactatagggagattatgtggagcatgtctgctaagattaaacagaggagataatctatgcagacatgcaacctggcggcagcgcaaaagatg

SEQ ID NO: 68486 - DNA, 103 bp, Artificial Sequence
  Synthetic Polynucleotide
taatacgactcactatagggtaaatagattatgtggagcatgtctgctaaaacagaggagattagcaatgatgctccacaacctggcggcagcgcaaaagatg

SEQ ID NO: 68487 - DNA, 103 bp, Artificial Sequence
  Synthetic Polynucleotide
taatacgactcactatagggatctctaaatagattatgtggagcatgtctaacagaggagaagacatatgccacataataacctggcggcagcgcaaaagatg

SEQ ID NO: 68488 - DNA, 103 bp, Artificial Sequence
  Synthetic Polynucleotide
taatacgactcactatagggactcgatctctaaatagattatgtggagcaaacagaggagatgctccatgtaatctattaacctggcggcagcgcaaaagatg

SEQ ID NO: 68489 - DNA, 103 bp, Artificial Sequence
  Synthetic Polynucleotide
taatacgactcactataggggcatgactcgatctctaaatagattatgtgaacagaggagacacataatgtatttagagaacctggcggcagcgcaaaagatg

SEQ ID NO: 68490 - DNA, 103 bp, Artificial Sequence
  Synthetic Polynucleotide
taatacgactcactatagggatcgtgcatgactcgatctctaaatagattaacagaggagaaatctaatgagagatcgaaacctggcggcagcgcaaaagatg

SEQ ID NO: 68491 - DNA, 103 bp, Artificial Sequence
  Synthetic Polynucleotide
taatacgactcactatagggatataatcgtgcatgactcgatctctaaataacagaggagaatttagatgtcgagtcataacctggcggcagcgcaaaagatg

SEQ ID NO: 68492 - DNA, 103 bp, Artificial Sequence
  Synthetic Polynucleotide
taatacgactcactatagggtacttatataatcgtgcatgactcgatctcaacagaggagagagatcatgtcatgcacgaacctggcggcagcgcaaaagatg

SEQ ID NO: 68493 - DNA, 103 bp, Artificial Sequence
  Synthetic Polynucleotide
taatacgactcactatagggttatgtcggccgagtattatctatctctttaacagaggagaaaagagatggataatactaacctggcggcagcgcaaaagatg

SEQ ID NO: 68494 - DNA, 103 bp, Artificial Sequence
  Synthetic Polynucleotide
taatacgactcactatagggtgtattacttatataatcgtgcatgactcgaacagaggagacgagtcatgcacgattataacctggcggcagcgcaaaagatg

SEQ ID NO: 68495 - DNA, 103 bp, Artificial Sequence
  Synthetic Polynucleotide
taatacgactcactatagggatatatgtattacttatataatcgtgcatgaacagaggagacatgcaatgttatataagaacctggcggcagcgcaaaagatg

SEQ ID NO: 68496 - DNA, 103 bp, Artificial Sequence
  Synthetic Polynucleotide
taatacgactcactatagggtatcaatatatgtattacttatataatcgtaacagaggagaacgattatgtaagtaataaacctggcggcagcgcaaaagatg

SEQ ID NO: 68497 - DNA, 103 bp, Artificial Sequence
  Synthetic Polynucleotide
taatacgactcactatagggctctatatcaatatatgtattacttatataaacagaggagatatataatgaatacatataacctggcggcagcgcaaaagatg

SEQ ID NO: 68498 - DNA, 103 bp, Artificial Sequence
  Synthetic Polynucleotide
taatacgactcactatagggaaacactctatatcaatatatgtattacttaacagaggagaaagtaaatgatatattgaaacctggcggcagcgcaaaagatg

SEQ ID NO: 68499 - DNA, 103 bp, Artificial Sequence
  Synthetic Polynucleotide
taatacgactcactatagggtatctaaacactctatatcaatatatgtataacagaggagaatacatatgttgatatagaacctggcggcagcgcaaaagatg

SEQ ID NO: 68500 - DNA, 103 bp, Artificial Sequence
  Synthetic Polynucleotide
taatacgactcactatagggaataatatctaaacactctatatcaatataaacagaggagatatattatgatagagtgtaacctggcggcagcgcaaaagatg

SEQ ID NO: 68501 - DNA, 103 bp, Artificial Sequence
  Synthetic Polynucleotide
taatacgactcactataggggatctaataatatctaaacactctatatcaaacagaggagatgatatatggtgtttagaaacctggcggcagcgcaaaagatg

SEQ ID NO: 68502 - DNA, 103 bp, Artificial Sequence
  Synthetic Polynucleotide
taatacgactcactatagggccagtgatctaataatatctaaacactctaaacagaggagatagagtatgtagatattaaacctggcggcagcgcaaaagatg

SEQ ID NO: 68503 - DNA, 103 bp, Artificial Sequence
  Synthetic Polynucleotide
taatacgactcactatagggcccatccagtgatctaataatatctaaacaaacagaggagatgtttaatgattattagaaacctggcggcagcgcaaaagatg

SEQ ID NO: 68504 - DNA, 103 bp, Artificial Sequence
  Synthetic Polynucleotide
taatacgactcactatagggcaacattatgtcggccgagtattatctatcaacagaggagagatagaatgtactcggccaacctggcggcagcgcaaaagatg

SEQ ID NO: 68505 - DNA, 103 bp, Artificial Sequence
  Synthetic Polynucleotide
taatacgactcactatagggtcgaacccatccagtgatctaataatatctaacagaggagaagatatatgtagatcactaacctggcggcagcgcaaaagatg

SEQ ID NO: 68506 - DNA, 103 bp, Artificial Sequence
  Synthetic Polynucleotide
taatacgactcactatagggtaatatcgaacccatccagtgatctaataaaacagaggagattattaatgcactggatgaacctggcggcagcgcaaaagatg

SEQ ID NO: 68507 - DNA, 103 bp, Artificial Sequence
  Synthetic Polynucleotide
taatacgactcactatagggacaattaatatcgaacccatccagtgatctaacagaggagaagatcaatggatgggttcaacctggcggcagcgcaaaagatg

SEQ ID NO: 68508 - DNA, 103 bp, Artificial Sequence
  Synthetic Polynucleotide
taatacgactcactatagggaagtaacaattaatatcgaacccatccagtaacagaggagaactggaatggttcgatataacctggcggcagcgcaaaagatg

SEQ ID NO: 68509 - DNA, 103 bp, Artificial Sequence
  Synthetic Polynucleotide
taatacgactcactatagggcttcaaagtaacaattaatatcgaacccataacagaggagaatgggtatgatattaattaacctggcggcagcgcaaaagatg

SEQ ID NO: 68510 - DNA, 103 bp, Artificial Sequence
  Synthetic Polynucleotide
taatacgactcactatagggacgtccttcaaagtaacaattaatatcgaaaacagaggagattcgatatgaattgttacaacctggcggcagcgcaaaagatg

SEQ ID NO: 68511 - DNA, 103 bp, Artificial Sequence
  Synthetic Polynucleotide
taatacgactcactatagggggtgtacgtccttcaaagtaacaattaataaacagaggagatattaaatgttactttgaaacctggcggcagcgcaaaagatg

SEQ ID NO: 68512 - DNA, 103 bp, Artificial Sequence
  Synthetic Polynucleotide
taatacgactcactataggggaagaggtgtacgtccttcaaagtaacaataacagaggagaattgttatgttgaaggacaacctggcggcagcgcaaaagatg

SEQ ID NO: 68513 - DNA, 103 bp, Artificial Sequence
  Synthetic Polynucleotide
taatacgactcactataggggcaatgaagaggtgtacgtccttcaaagtaaacagaggagatactttatgggacgtacaaacctggcggcagcgcaaaagatg

SEQ ID NO: 68514 - DNA, 103 bp, Artificial Sequence
  Synthetic Polynucleotide
taatacgactcactatagggatagcgcaatgaagaggtgtacgtccttcaaacagaggagatgaaggatgtacacctctaacctggcggcagcgcaaaagatg

SEQ ID NO: 68515 - DNA, 103 bp, Artificial Sequence
  Synthetic Polynucleotide
taatacgactcactatagggatggacaacattatgtcggccgagtattataacagaggagaataataatgggccgacataacctggcggcagcgcaaaagatg

SEQ ID NO: 68516 - DNA, 103 bp, Artificial Sequence
  Synthetic Polynucleotide
taatacgactcactatagggactgtatagcgcaatgaagaggtgtacgtcaacagaggagagacgtaatgctcttcattaacctggcggcagcgcaaaagatg

SEQ ID NO: 68517 - DNA, 103 bp, Artificial Sequence
  Synthetic Polynucleotide
taatacgactcactataggggttatactgtatagcgcaatgaagaggtgtaacagaggagaacacctatgcattgcgctaacctggcggcagcgcaaaagatg

SEQ ID NO: 68518 - DNA, 103 bp, Artificial Sequence
  Synthetic Polynucleotide
taatacgactcactataggggtgaagttatactgtatagcgcaatgaagaaacagaggagatcttcaatgcgctatacaaacctggcggcagcgcaaaagatg

SEQ ID NO: 68519 - DNA, 103 bp, Artificial Sequence
  Synthetic Polynucleotide
taatacgactcactatagggtatgagtgaagttatactgtatagcgcaataacagaggagaattgcgatgtacagtataaacctggcggcagcgcaaaagatg

SEQ ID NO: 68520 - DNA, 103 bp, Artificial Sequence
  Synthetic Polynucleotide
taatacgactcactatagggcgcaatatgagtgaagttatactgtatagcaacagaggagagctataatgtataacttcaacctggcggcagcgcaaaagatg

SEQ ID NO: 68521 - DNA, 103 bp, Artificial Sequence
  Synthetic Polynucleotide
taatacgactcactatagggtattccgcaatatgagtgaagttatactgtaacagaggagaacagtaatgcttcactcaaacctggcggcagcgcaaaagatg

SEQ ID NO: 68522 - DNA, 103 bp, Artificial Sequence
  Synthetic Polynucleotide
taatacgactcactatagggataagtattccgcaatatgagtgaagttataacagaggagaataactatgctcatattgaacctggcggcagcgcaaaagatg

SEQ ID NO: 68523 - DNA, 103 bp, Artificial Sequence
  Synthetic Polynucleotide
taatacgactcactatagggatctaataagtattccgcaatatgagtgaaaacagaggagattcactatgattgcggaaaacctggcggcagcgcaaaagatg

SEQ ID NO: 68524 - DNA, 103 bp, Artificial Sequence
  Synthetic Polynucleotide
taatacgactcactatagggcctcgatctaataagtattccgcaatatgaaacagaggagatcatatatgggaatacttaacctggcggcagcgcaaaagatg

SEQ ID NO: 68525 - DNA, 103 bp, Artificial Sequence
  Synthetic Polynucleotide
taatacgactcactatagggcagctcctcgatctaataagtattccgcaaaacagaggagattgcggatgacttattagaacctggcggcagcgcaaaagatg

SEQ ID NO: 68526 - DNA, 103 bp, Artificial Sequence
  Synthetic Polynucleotide
taatacgactcactatagggctacaatggacaacattatgtcggccgagtaacagaggagaactcggatgacataatgtaacctggcggcagcgcaaaagatg

SEQ ID NO: 68527 - DNA, 103 bp, Artificial Sequence
  Synthetic Polynucleotide
taatacgactcactatagggtatatcagctcctcgatctaataagtattcaacagaggagagaatacatgttagatcgaaacctggcggcagcgcaaaagatg

SEQ ID NO: 68528 - DNA, 103 bp, Artificial Sequence
  Synthetic Polynucleotide
taatacgactcactatagggaatgatatatcagctcctcgatctaataagaacagaggagacttattatgtcgaggagcaacctggcggcagcgcaaaagatg

SEQ ID NO: 68529 - DNA, 103 bp, Artificial Sequence
  Synthetic Polynucleotide
taatacgactcactatagggtctttaatgatatatcagctcctcgatctaaacagaggagatagatcatggagctgataaacctggcggcagcgcaaaagatg

SEQ ID NO: 68530 - DNA, 103 bp, Artificial Sequence
  Synthetic Polynucleotide
taatacgactcactataggggcctgtctttaatgatatatcagctcctcgaacagaggagacgaggaatggatatatcaaacctggcggcagcgcaaaagatg

SEQ ID NO: 68531 - DNA, 103 bp, Artificial Sequence
  Synthetic Polynucleotide
taatacgactcactatagggccatcgcctgtctttaatgatatatcagctaacagaggagaagctgaatgatcattaaaaacctggcggcagcgcaaaagatg

SEQ ID NO: 68532 - DNA, 103 bp, Artificial Sequence
  Synthetic Polynucleotide
taatacgactcactatagggattttccatcgcctgtctttaatgatatataacagaggagaatatatatgtaaagacagaacctggcggcagcgcaaaagatg

SEQ ID NO: 68533 - DNA, 103 bp, Artificial Sequence
  Synthetic Polynucleotide
taatacgactcactatagggtacagattttccatcgcctgtctttaatgaaacagaggagatcattaatgacaggcgataacctggcggcagcgcaaaagatg

SEQ ID NO: 68534 - DNA, 103 bp, Artificial Sequence
  Synthetic Polynucleotide
taatacgactcactatagggtcgaatacagattttccatcgcctgtctttaacagaggagaaaagacatgcgatggaaaaacctggcggcagcgcaaaagatg

SEQ ID NO: 68535 - DNA, 103 bp, Artificial Sequence
  Synthetic Polynucleotide
taatacgactcactatagggataaatcgaatacagattttccatcgcctgaacagaggagacaggcgatggaaaatctgaacctggcggcagcgcaaaagatg

SEQ ID NO: 68536 - DNA, 103 bp, Artificial Sequence
  Synthetic Polynucleotide
taatacgactcactatagggtaacgataaatcgaatacagattttccatcaacagaggagagatggaatgtctgtattcaacctggcggcagcgcaaaagatg

SEQ ID NO: 68537 - DNA, 103 bp, Artificial Sequence
  Synthetic Polynucleotide
taatacgactcactatagggttatactacaatggacaacattatgtcggcaacagaggagagccgacatgatgttgtccaacctggcggcagcgcaaaagatg

SEQ ID NO: 68538 - DNA, 103 bp, Artificial Sequence
  Synthetic Polynucleotide
taatacgactcactatagggctacataacgataaatcgaatacagattttaacagaggagaaaaatcatgattcgatttaacctggcggcagcgcaaaagatg

SEQ ID NO: 68539 - DNA, 103 bp, Artificial Sequence
  Synthetic Polynucleotide
taatacgactcactatagggtgtagctacataacgataaatcgaatacagaacagaggagactgtatatgatttatcgtaacctggcggcagcgcaaaagatg

SEQ ID NO: 68540 - DNA, 103 bp, Artificial Sequence
  Synthetic Polynucleotide
taatacgactcactatagggaggtatgtagctacataacgataaatcgaaaacagaggagattcgatatgtcgttatgtaacctggcggcagcgcaaaagatg

SEQ ID NO: 68541 - DNA, 103 bp, Artificial Sequence
  Synthetic Polynucleotide
taatacgactcactatagggttaagaggtatgtagctacataacgataaaaacagaggagatttatcatgatgtagctaaacctggcggcagcgcaaaagatg

SEQ ID NO: 68542 - DNA, 103 bp, Artificial Sequence
  Synthetic Polynucleotide
taatacgactcactatagggtccatttaagaggtatgtagctacataacgaacagaggagacgttatatggctacatacaacctggcggcagcgcaaaagatg

SEQ ID NO: 68543 - DNA, 103 bp, Artificial Sequence
  Synthetic Polynucleotide
taatacgactcactatagggactagtccatttaagaggtatgtagctacaaacagaggagatgtagcatgatacctcttaacctggcggcagcgcaaaagatg

SEQ ID NO: 68544 - DNA, 103 bp, Artificial Sequence
  Synthetic Polynucleotide
taatacgactcactatagggaaaaaactagtccatttaagaggtatgtagaacagaggagactacatatgtcttaaatgaacctggcggcagcgcaaaagatg

SEQ ID NO: 68545 - DNA, 103 bp, Artificial Sequence
  Synthetic Polynucleotide
taatacgactcactatagggtaatcaaaaaactagtccatttaagaggtaaacagaggagatacctcatgaatggactaaacctggcggcagcgcaaaagatg

SEQ ID NO: 68546 - DNA, 103 bp, Artificial Sequence
  Synthetic Polynucleotide
taatacgactcactatagggacgactaatcaaaaaactagtccatttaagaacagaggagacttaaaatgactagttttaacctggcggcagcgcaaaagatg

SEQ ID NO: 68547 - DNA, 103 bp, Artificial Sequence
  Synthetic Polynucleotide
taatacgactcactatagggggtagacgactaatcaaaaaactagtccataacagaggagaatggacatgttttttgataacctggcggcagcgcaaaagatg

SEQ ID NO: 68548 - DNA, 103 bp, Artificial Sequence
  Synthetic Polynucleotide
taatacgactcactatagggaatttttatactacaatggacaacattatgaacagaggagacataatatggtccattgtaacctggcggcagcgcaaaagatg

SEQ ID NO: 68549 - DNA, 103 bp, Artificial Sequence
  Synthetic Polynucleotide
taatacgactcactatagggtaggcggtagacgactaatcaaaaaactagaacagaggagactagttatgtgattagtcaacctggcggcagcgcaaaagatg

SEQ ID NO: 68550 - DNA, 103 bp, Artificial Sequence
  Synthetic Polynucleotide
taatacgactcactatagggacttttaggcggtagacgactaatcaaaaaaacagaggagatttttgatgagtcgtctaaacctggcggcagcgcaaaagatg

SEQ ID NO: 68551 - DNA, 103 bp, Artificial Sequence
  Synthetic Polynucleotide
taatacgactcactatagggatgacacttttaggcggtagacgactaatcaacagaggagagattagatgtctaccgccaacctggcggcagcgcaaaagatg

SEQ ID NO: 68552 - DNA, 103 bp, Artificial Sequence
  Synthetic Polynucleotide
taatacgactcactatagggagctcatgacacttttaggcggtagacgacaacagaggagagtcgtcatgcgcctaaaaaacctggcggcagcgcaaaagatg

SEQ ID NO: 68553 - DNA, 103 bp, Artificial Sequence
  Synthetic Polynucleotide
taatacgactcactatagggcagtgagctcatgacacttttaggcggtagaacagaggagactaccgatgaaaagtgtcaacctggcggcagcgcaaaagatg

SEQ ID NO: 68554 - DNA, 103 bp, Artificial Sequence
  Synthetic Polynucleotide
taatacgactcactatagggttagtcagtgagctcatgacacttttaggcaacagaggagagcctaaatgtgtcatgagaacctggcggcagcgcaaaagatg

SEQ ID NO: 68555 - DNA, 103 bp, Artificial Sequence
  Synthetic Polynucleotide
taatacgactcactatagggtatggttagtcagtgagctcatgacactttaacagaggagaaaagtgatgtgagctcacaacctggcggcagcgcaaaagatg

SEQ ID NO: 68556 - DNA, 103 bp, Artificial Sequence
  Synthetic Polynucleotide
taatacgactcactatagggtattatatggttagtcagtgagctcatgacaacagaggagagtcatgatgtcactgactaacctggcggcagcgcaaaagatg

SEQ ID NO: 68557 - DNA, 103 bp, Artificial Sequence
  Synthetic Polynucleotide
taatacgactcactatagggtaatctattatatggttagtcagtgagctcaacagaggagagagctcatggactaaccaaacctggcggcagcgcaaaagatg

SEQ ID NO: 68558 - DNA, 103 bp, Artificial Sequence
  Synthetic Polynucleotide
taatacgactcactataggggaacataatctattatatggttagtcagtgaacagaggagacactgaatgaccatataaaacctggcggcagcgcaaaagatg

SEQ ID NO: 68559 - DNA, 103 bp, Artificial Sequence
  Synthetic Polynucleotide
taatacgactcactatagggatattaatttttatactacaatggacaacaaacagaggagatgttgtatgttgtagtataacctggcggcagcgcaaaagatg

SEQ ID NO: 68560 - DNA, 103 bp, Artificial Sequence
  Synthetic Polynucleotide
taatacgactcactatagggtgtaagaacataatctattatatggttagtaacagaggagaactaacatgataatagataacctggcggcagcgcaaaagatg

SEQ ID NO: 68561 - DNA, 103 bp, Artificial Sequence
  Synthetic Polynucleotide
taatacgactcactatagggttgtctgtaagaacataatctattatatggaacagaggagaccatatatgagattatgtaacctggcggcagcgcaaaagatg

SEQ ID NO: 68562 - DNA, 103 bp, Artificial Sequence
  Synthetic Polynucleotide
taatacgactcactatagggttttattgtctgtaagaacataatctattaaacagaggagataatagatgatgttcttaaacctggcggcagcgcaaaagatg

SEQ ID NO: 68563 - DNA, 103 bp, Artificial Sequence
  Synthetic Polynucleotide
taatacgactcactatagggaatatttttattgtctgtaagaacataatcaacagaggagagattatatgcttacagacaacctggcggcagcgcaaaagatg

SEQ ID NO: 68564 - DNA, 103 bp, Artificial Sequence
  Synthetic Polynucleotide
taatacgactcactatagggcaaataatatttttattgtctgtaagaacaaacagaggagatgttctatgagacaataaaacctggcggcagcgcaaaagatg

SEQ ID NO: 68565 - DNA, 103 bp, Artificial Sequence
  Synthetic Polynucleotide
taatacgactcactatagggtttgccaaataatatttttattgtctgtaaaacagaggagattacagatgataaaaataaacctggcggcagcgcaaaagatg

SEQ ID NO: 68566 - DNA, 103 bp, Artificial Sequence
  Synthetic Polynucleotide
taatacgactcactatagggttgactttgccaaataatatttttattgtcaacagaggagagacaatatgaatattattaacctggcggcagcgcaaaagatg

SEQ ID NO: 68567 - DNA, 103 bp, Artificial Sequence
  Synthetic Polynucleotide
taatacgactcactatagggatcatttgactttgccaaataatatttttaaacagaggagataaaaaatgtatttggcaaacctggcggcagcgcaaaagatg

SEQ ID NO: 68568 - DNA, 103 bp, Artificial Sequence
  Synthetic Polynucleotide
taatacgactcactatagggtattaatcatttgactttgccaaataatataacagaggagaatattaatgggcaaagtcaacctggcggcagcgcaaaagatg

SEQ ID NO: 68569 - DNA, 103 bp, Artificial Sequence
  Synthetic Polynucleotide
taatacgactcactatagggatacttattaatcatttgactttgccaaataacagaggagaatttggatgagtcaaatgaacctggcggcagcgcaaaagatg

SEQ ID NO: 68570 - DNA, 103 bp, Artificial Sequence
  Synthetic Polynucleotide
taatacgactcactatagggaatataaactaataatataacaatacaataaacagaggagatattgtatggttatattaaacctggcggcagcgcaaaagatg

SEQ ID NO: 68571 - DNA, 103 bp, Artificial Sequence
  Synthetic Polynucleotide
taatacgactcactatagggtagaaatattaatttttatactacaatggaaacagaggagatccattatggtataaaaaaacctggcggcagcgcaaaagatg

SEQ ID NO: 68572 - DNA, 103 bp, Artificial Sequence
  Synthetic Polynucleotide
taatacgactcactatagggaacacatacttattaatcatttgactttgcaacagaggagagcaaagatgaatgattaaaacctggcggcagcgcaaaagatg

SEQ ID NO: 68573 - DNA, 103 bp, Artificial Sequence
  Synthetic Polynucleotide
taatacgactcactataggggtaacaacacatacttattaatcatttgacaacagaggagagtcaaaatgttaataagtaacctggcggcagcgcaaaagatg

SEQ ID NO: 68574 - DNA, 103 bp, Artificial Sequence
  Synthetic Polynucleotide
taatacgactcactatagggatcaagtaacaacacatacttattaatcataacagaggagaatgattatgaagtatgtgaacctggcggcagcgcaaaagatg

SEQ ID NO: 68575 - DNA, 103 bp, Artificial Sequence
  Synthetic Polynucleotide
taatacgactcactataggggatggatcaagtaacaacacatacttattaaacagaggagataataaatgtgtgttgttaacctggcggcagcgcaaaagatg

SEQ ID NO: 68576 - DNA, 103 bp, Artificial Sequence
  Synthetic Polynucleotide
taatacgactcactatagggaaaaggatggatcaagtaacaacacatactaacagaggagaagtatgatgtgttacttgaacctggcggcagcgcaaaagatg

SEQ ID NO: 68577 - DNA, 103 bp, Artificial Sequence
  Synthetic Polynucleotide
taatacgactcactatagggagaataaaaggatggatcaagtaacaacacaacagaggagagtgttgatgcttgatccaaacctggcggcagcgcaaaagatg

SEQ ID NO: 68578 - DNA, 103 bp, Artificial Sequence
  Synthetic Polynucleotide
taatacgactcactatagggaatctagaataaaaggatggatcaagtaacaacagaggagagttactatgtccatccttaacctggcggcagcgcaaaagatg

SEQ ID NO: 68579 - DNA, 103 bp, Artificial Sequence
  Synthetic Polynucleotide
taatacgactcactatagggttctgaatctagaataaaaggatggatcaaaacagaggagattgatcatgccttttattaacctggcggcagcgcaaaagatg

SEQ ID NO: 68580 - DNA, 103 bp, Artificial Sequence
  Synthetic Polynucleotide
taatacgactcactatagggagcatttctgaatctagaataaaaggatggaacagaggagaccatccatgtattctagaaacctggcggcagcgcaaaagatg

SEQ ID NO: 68581 - DNA, 103 bp, Artificial Sequence
  Synthetic Polynucleotide
taatacgactcactatagggttaatagcatttctgaatctagaataaaagaacagaggagacttttaatgtagattcagaacctggcggcagcgcaaaagatg

SEQ ID NO: 68582 - DNA, 103 bp, Artificial Sequence
  Synthetic Polynucleotide
taatacgactcactatagggagaaatagaaatattaatttttatactacaaacagaggagatgtagtatgaaaattaataacctggcggcagcgcaaaagatg

SEQ ID NO: 68583 - DNA, 103 bp, Artificial Sequence
  Synthetic Polynucleotide
taatacgactcactatagggtgcttttaatagcatttctgaatctagaataacagaggagaattctaatgtcagaaatgaacctggcggcagcgcaaaagatg

SEQ ID NO: 68584 - DNA, 103 bp, Artificial Sequence
  Synthetic Polynucleotide
taatacgactcactatagggtaatttgcttttaatagcatttctgaatctaacagaggagaagattcatgaatgctattaacctggcggcagcgcaaaagatg

SEQ ID NO: 68585 - DNA, 103 bp, Artificial Sequence
  Synthetic Polynucleotide
taatacgactcactatagggtgatttaatttgcttttaatagcatttctgaacagaggagacagaaaatgtattaaaagaacctggcggcagcgcaaaagatg

SEQ ID NO: 68586 - DNA, 103 bp, Artificial Sequence
  Synthetic Polynucleotide
taatacgactcactatagggcgtattgatttaatttgcttttaatagcataacagaggagaatgctaatgaaagcaaataacctggcggcagcgcaaaagatg

SEQ ID NO: 68587 - DNA, 103 bp, Artificial Sequence
  Synthetic Polynucleotide
taatacgactcactatagggataatcgtattgatttaatttgcttttaataacagaggagaattaaaatgaaattaaataacctggcggcagcgcaaaagatg

SEQ ID NO: 68588 - DNA, 103 bp, Artificial Sequence
  Synthetic Polynucleotide
taatacgactcactatagggcaacgataatcgtattgatttaatttgcttaacagaggagaaagcaaatgaaatcaataaacctggcggcagcgcaaaagatg

SEQ ID NO: 68589 - DNA, 103 bp, Artificial Sequence
  Synthetic Polynucleotide
taatacgactcactatagggtgaagcaacgataatcgtattgatttaattaacagaggagaaattaaatgaatacgattaacctggcggcagcgcaaaagatg

SEQ ID NO: 68590 - DNA, 103 bp, Artificial Sequence
  Synthetic Polynucleotide
taatacgactcactataggggtaattgaagcaacgataatcgtattgattaacagaggagaaatcaaatggattatcgtaacctggcggcagcgcaaaagatg

SEQ ID NO: 68591 - DNA, 103 bp, Artificial Sequence
  Synthetic Polynucleotide
taatacgactcactatagggctattgtaattgaagcaacgataatcgtataacagaggagaatacgaatgtcgttgcttaacctggcggcagcgcaaaagatg

SEQ ID NO: 68592 - DNA, 103 bp, Artificial Sequence
  Synthetic Polynucleotide
taatacgactcactataggggatatctattgtaattgaagcaacgataataacagaggagaattatcatggcttcaattaacctggcggcagcgcaaaagatg

SEQ ID NO: 68593 - DNA, 103 bp, Artificial Sequence
  Synthetic Polynucleotide
taatacgactcactataggggaaatagaaatagaaatattaatttttataaacagaggagatataaaatgtaatatttcaacctggcggcagcgcaaaagatg

SEQ ID NO: 68594 - DNA, 103 bp, Artificial Sequence
  Synthetic Polynucleotide
taatacgactcactatagggaacacgatatctattgtaattgaagcaacgaacagaggagacgttgcatgaattacaataacctggcggcagcgcaaaagatg

SEQ ID NO: 68595 - DNA, 103 bp, Artificial Sequence
  Synthetic Polynucleotide
taatacgactcactatagggttattaacacgatatctattgtaattgaagaacagaggagacttcaaatgcaatagataaacctggcggcagcgcaaaagatg

SEQ ID NO: 68596 - DNA, 103 bp, Artificial Sequence
  Synthetic Polynucleotide
taatacgactcactatagggactttttattaacacgatatctattgtaataacagaggagaattacaatggatatcgtgaacctggcggcagcgcaaaagatg

SEQ ID NO: 68597 - DNA, 103 bp, Artificial Sequence
  Synthetic Polynucleotide
taatacgactcactataggggcgatactttttattaacacgatatctattaacagaggagaaatagaatgcgtgttaataacctggcggcagcgcaaaagatg

SEQ ID NO: 68598 - DNA, 103 bp, Artificial Sequence
  Synthetic Polynucleotide
taatacgactcactatagggactttgcgatactttttattaacacgatataacagaggagaatatcgatgtaataaaaaaacctggcggcagcgcaaaagatg

SEQ ID NO: 68599 - DNA, 103 bp, Artificial Sequence
  Synthetic Polynucleotide
taatacgactcactataggggtaaaactttgcgatactttttattaacacaacagaggagagtgttaatgaaaagtatcaacctggcggcagcgcaaaagatg

SEQ ID NO: 68600 - DNA, 103 bp, Artificial Sequence
  Synthetic Polynucleotide
taatacgactcactataggggtcatgtaaaactttgcgatactttttattaacagaggagaaataaaatgtatcgcaaaaacctggcggcagcgcaaaagatg

SEQ ID NO: 68601 - DNA, 103 bp, Artificial Sequence
  Synthetic Polynucleotide
taatacgactcactatagggtcaatgtcatgtaaaactttgcgatactttaacagaggagaaaagtaatgcaaagttttaacctggcggcagcgcaaaagatg

SEQ ID NO: 68602 - DNA, 103 bp, Artificial Sequence
  Synthetic Polynucleotide
taatacgactcactatagggatatatcaatgtcatgtaaaactttgcgataacagaggagaatcgcaatgttttacatgaacctggcggcagcgcaaaagatg

SEQ ID NO: 68603 - DNA, 103 bp, Artificial Sequence
  Synthetic Polynucleotide
taatacgactcactatagggaatatatatatcaatgtcatgtaaaactttaacagaggagaaaagttatgcatgacattaacctggcggcagcgcaaaagatg

SEQ ID NO: 68604 - DNA, 103 bp, Artificial Sequence
  Synthetic Polynucleotide
taatacgactcactatagggtagtagaaatagaaatagaaatattaatttaacagaggagaaaattaatgtttctatttaacctggcggcagcgcaaaagatg

SEQ ID NO: 68605 - DNA, 103 bp, Artificial Sequence
  Synthetic Polynucleotide
taatacgactcactatagggtccttaatatatatatcaatgtcatgtaaaaacagaggagatttacaatgcattgatataacctggcggcagcgcaaaagatg

SEQ ID NO: 68606 - DNA, 103 bp, Artificial Sequence
  Synthetic Polynucleotide
taatacgactcactataggggtacatccttaatatatatatcaatgtcataacagaggagaatgacaatgatatatataaacctggcggcagcgcaaaagatg

SEQ ID NO: 68607 - DNA, 103 bp, Artificial Sequence
  Synthetic Polynucleotide
taatacgactcactatagggtacttgtacatccttaatatatatatcaataacagaggagaattgatatgtatattaagaacctggcggcagcgcaaaagatg

SEQ ID NO: 68608 - DNA, 103 bp, Artificial Sequence
  Synthetic Polynucleotide
taatacgactcactatagggtttaatacttgtacatccttaatatatataaacagaggagatatataatgtaaggatgtaacctggcggcagcgcaaaagatg

SEQ ID NO: 68609 - DNA, 103 bp, Artificial Sequence
  Synthetic Polynucleotide
taatacgactcactatagggtagattttaatacttgtacatccttaatataacagaggagaatattaatgatgtacaagaacctggcggcagcgcaaaagatg

SEQ ID NO: 68610 - DNA, 103 bp, Artificial Sequence
  Synthetic Polynucleotide
taatacgactcactataggggagaatagattttaatacttgtacatccttaacagaggagaaaggatatgcaagtattaaacctggcggcagcgcaaaagatg

SEQ ID NO: 68611 - DNA, 103 bp, Artificial Sequence
  Synthetic Polynucleotide
taatacgactcactataggggcgatgagaatagattttaatacttgtacaaacagaggagatgtacaatgattaaaatcaacctggcggcagcgcaaaagatg

SEQ ID NO: 68612 - DNA, 103 bp, Artificial Sequence
  Synthetic Polynucleotide
taatacgactcactatagggtattggcgatgagaatagattttaatacttaacagaggagaaagtatatgaatctattcaacctggcggcagcgcaaaagatg

SEQ ID NO: 68613 - DNA, 103 bp, Artificial Sequence
  Synthetic Polynucleotide
taatacgactcactatagggtacattattggcgatgagaatagattttaaaacagaggagattaaaaatgattctcatcaacctggcggcagcgcaaaagatg

SEQ ID NO: 68614 - DNA, 103 bp, Artificial Sequence
  Synthetic Polynucleotide
taatacgactcactatagggagtgttacattattggcgatgagaatagataacagaggagaatctatatgcatcgccaaaacctggcggcagcgcaaaagatg

SEQ ID NO: 68615 - DNA, 103 bp, Artificial Sequence
  Synthetic Polynucleotide
taatacgactcactatagggaattatagtagaaatagaaatagaaatattaacagaggagaaatattatgatttctattaacctggcggcagcgcaaaagatg

SEQ ID NO: 68616 - DNA, 103 bp, Artificial Sequence
  Synthetic Polynucleotide
taatacgactcactatagggcgtatagtgttacattattggcgatgagaaaacagaggagattctcaatgccaataatgaacctggcggcagcgcaaaagatg

SEQ ID NO: 68617 - DNA, 103 bp, Artificial Sequence
  Synthetic Polynucleotide
taatacgactcactatagggagtgtcgtatagtgttacattattggcgataacagaggagaatcgccatgaatgtaacaaacctggcggcagcgcaaaagatg

SEQ ID NO: 68618 - DNA, 103 bp, Artificial Sequence
  Synthetic Polynucleotide
taatacgactcactatagggacaatagtgtcgtatagtgttacattattgaacagaggagacaataaatgaacactataaacctggcggcagcgcaaaagatg

SEQ ID NO: 68619 - DNA, 103 bp, Artificial Sequence
  Synthetic Polynucleotide
taatacgactcactatagggtatttacaatagtgtcgtatagtgttacataacagaggagaatgtaaatgtatacgacaaacctggcggcagcgcaaaagatg

SEQ ID NO: 68620 - DNA, 103 bp, Artificial Sequence
  Synthetic Polynucleotide
taatacgactcactatagggtgtattatttacaatagtgtcgtatagtgtaacagaggagaacactaatggacactattaacctggcggcagcgcaaaagatg

SEQ ID NO: 68621 - DNA, 103 bp, Artificial Sequence
  Synthetic Polynucleotide
taatacgactcactatagggtctgatgtattatttacaatagtgtcgtataacagaggagaatacgaatgtattgtaaaaacctggcggcagcgcaaaagatg

SEQ ID NO: 68622 - DNA, 103 bp, Artificial Sequence
  Synthetic Polynucleotide
taatacgactcactataggggaaactctgatgtattatttacaatagtgtaacagaggagaacactaatgtaaataataaacctggcggcagcgcaaaagatg

SEQ ID NO: 68623 - DNA, 103 bp, Artificial Sequence
  Synthetic Polynucleotide
taatacgactcactatagggtacaggaaactctgatgtattatttacaataacagaggagaattgtaatgaatacatcaaacctggcggcagcgcaaaagatg

SEQ ID NO: 68624 - DNA, 103 bp, Artificial Sequence
  Synthetic Polynucleotide
taatacgactcactatagggcgatgtacaggaaactctgatgtattatttaacagaggagaaaataaatgatcagagttaacctggcggcagcgcaaaagatg

SEQ ID NO: 68625 - DNA, 103 bp, Artificial Sequence
  Synthetic Polynucleotide
taatacgactcactatagggttagacgatgtacaggaaactctgatgtataacagaggagaatacatatgagtttcctgaacctggcggcagcgcaaaagatg

SEQ ID NO: 68626 - DNA, 103 bp, Artificial Sequence
  Synthetic Polynucleotide
taatacgactcactataggggagtaaattatagtagaaatagaaatagaaaacagaggagattctatatgtatttctacaacctggcggcagcgcaaaagatg

SEQ ID NO: 68627 - DNA, 103 bp, Artificial Sequence
  Synthetic Polynucleotide
taatacgactcactataggggttgtttagacgatgtacaggaaactctgaaacagaggagatcagagatgcctgtacataacctggcggcagcgcaaaagatg

SEQ ID NO: 68628 - DNA, 103 bp, Artificial Sequence
  Synthetic Polynucleotide
taatacgactcactatagggtgtttgttgtttagacgatgtacaggaaacaacagaggagagtttccatgacatcgtctaacctggcggcagcgcaaaagatg

SEQ ID NO: 68629 - DNA, 103 bp, Artificial Sequence
  Synthetic Polynucleotide
taatacgactcactatagggttaattgtttgttgtttagacgatgtacagaacagaggagactgtacatggtctaaacaaacctggcggcagcgcaaaagatg

SEQ ID NO: 68630 - DNA, 103 bp, Artificial Sequence
  Synthetic Polynucleotide
taatacgactcactatagggattaattaattgtttgttgtttagacgatgaacagaggagacatcgtatgaacaacaaaaacctggcggcagcgcaaaagatg

SEQ ID NO: 68631 - DNA, 103 bp, Artificial Sequence
  Synthetic Polynucleotide
taatacgactcactatagggactgtattaattaattgtttgttgtttagaaacagaggagatctaaaatgcaaacaattaacctggcggcagcgcaaaagatg

SEQ ID NO: 68632 - DNA, 103 bp, Artificial Sequence
  Synthetic Polynucleotide
taatacgactcactatagggaatttactgtattaattaattgtttgttgtaacagaggagaacaacaatgaattaattaaacctggcggcagcgcaaaagatg

SEQ ID NO: 68633 - DNA, 103 bp, Artificial Sequence
  Synthetic Polynucleotide
taatacgactcactatagggattggaatttactgtattaattaattgtttaacagaggagaaaacaaatgattaatacaaacctggcggcagcgcaaaagatg

SEQ ID NO: 68634 - DNA, 103 bp, Artificial Sequence
  Synthetic Polynucleotide
taatacgactcactatagggtatatattggaatttactgtattaattaataacagaggagaattaatatgtacagtaaaaacctggcggcagcgcaaaagatg

SEQ ID NO: 68635 - DNA, 103 bp, Artificial Sequence
  Synthetic Polynucleotide
taatacgactcactatagggcatgatatatattggaatttactgtattaaaacagaggagattaataatgtaaattccaaacctggcggcagcgcaaaagatg

SEQ ID NO: 68636 - DNA, 103 bp, Artificial Sequence
  Synthetic Polynucleotide
taatacgactcactatagggaagatcatgatatatattggaatttactgtaacagaggagaacagtaatgtccaatataaacctggcggcagcgcaaaagatg

SEQ ID NO: 68637 - DNA, 103 bp, Artificial Sequence
  Synthetic Polynucleotide
taatacgactcactatagggatagagagtaaattatagtagaaatagaaaaacagaggagatttctaatgctactataaaacctggcggcagcgcaaaagatg

SEQ ID NO: 68638 - DNA, 103 bp, Artificial Sequence
  Synthetic Polynucleotide
taatacgactcactatagggtcgataagatcatgatatatattggaatttaacagaggagaaaattcatgtatatatcaaacctggcggcagcgcaaaagatg

SEQ ID NO: 68639 - DNA, 103 bp, Artificial Sequence
  Synthetic Polynucleotide
taatacgactcactatagggctttttcgataagatcatgatatatattggaacagaggagaccaataatgatcatgatcaacctggcggcagcgcaaaagatg

SEQ ID NO: 68640 - DNA, 103 bp, Artificial Sequence
  Synthetic Polynucleotide
taatacgactcactatagggaataactttttcgataagatcatgatatataacagaggagaatatatatggatcttatcaacctggcggcagcgcaaaagatg

SEQ ID NO: 68641 - DNA, 103 bp, Artificial Sequence
  Synthetic Polynucleotide
taatacgactcactatagggtttttaataactttttcgataagatcatgaaacagaggagatcatgaatgtatcgaaaaaacctggcggcagcgcaaaagatg

SEQ ID NO: 68642 - DNA, 103 bp, Artificial Sequence
  Synthetic Polynucleotide
taatacgactcactatagggatgattttttaataactttttcgataagataacagaggagaatcttaatgaaaaagttaaacctggcggcagcgcaaaagatg

SEQ ID NO: 68643 - DNA, 103 bp, Artificial Sequence
  Synthetic Polynucleotide
taatacgactcactatagggctctaatgattttttaataactttttcgataacagaggagaatcgaaatggttattaaaaacctggcggcagcgcaaaagatg

SEQ ID NO: 68644 - DNA, 103 bp, Artificial Sequence
  Synthetic Polynucleotide
taatacgactcactatagggcatttctctaatgattttttaataacttttaacagaggagaaaaagtatgtaaaaaatcaacctggcggcagcgcaaaagatg

SEQ ID NO: 68645 - DNA, 103 bp, Artificial Sequence
  Synthetic Polynucleotide
taatacgactcactataggggagtacatttctctaatgattttttaataaaacagaggagattattaatgaatcattagaacctggcggcagcgcaaaagatg

SEQ ID NO: 68646 - DNA, 103 bp, Artificial Sequence
  Synthetic Polynucleotide
taatacgactcactatagggagttagagtacatttctctaatgattttttaacagaggagaaaaaaaatgttagagaaaaacctggcggcagcgcaaaagatg

SEQ ID NO: 68647 - DNA, 103 bp, Artificial Sequence
  Synthetic Polynucleotide
taatacgactcactataggggcattagttagagtacatttctctaatgataacagaggagaatcattatggaaatgtacaacctggcggcagcgcaaaagatg

SEQ ID NO: 68648 - DNA, 103 bp, Artificial Sequence
  Synthetic Polynucleotide
taatacgactcactatagggttgttatagagagtaaattatagtagaaataacagaggagaatttctatgataatttacaacctggcggcagcgcaaaagatg

SEQ ID NO: 68649 - DNA, 103 bp, Artificial Sequence
  Synthetic Polynucleotide
taatacgactcactatagggggacggcattagttagagtacatttctctaaacagaggagatagagaatggtactctaaaacctggcggcagcgcaaaagatg

SEQ ID NO: 68650 - DNA, 103 bp, Artificial Sequence
  Synthetic Polynucleotide
taatacgactcactatagggctcgaggacggcattagttagagtacatttaacagaggagaaaatgtatgctaactaataacctggcggcagcgcaaaagatg

SEQ ID NO: 68651 - DNA, 103 bp, Artificial Sequence
  Synthetic Polynucleotide
taatacgactcactatagggatatactcgaggacggcattagttagagtaaacagaggagatactctatgtaatgccgtaacctggcggcagcgcaaaagatg

SEQ ID NO: 68652 - DNA, 103 bp, Artificial Sequence
  Synthetic Polynucleotide
taatacgactcactatagggcgatcatatactcgaggacggcattagttaaacagaggagataactaatgccgtcctcgaacctggcggcagcgcaaaagatg

SEQ ID NO: 68653 - DNA, 103 bp, Artificial Sequence
  Synthetic Polynucleotide
taatacgactcactatagggagatgcgatcatatactcgaggacggcattaacagaggagaaatgccatgctcgagtataacctggcggcagcgcaaaagatg

SEQ ID NO: 68654 - DNA, 103 bp, Artificial Sequence
  Synthetic Polynucleotide
taatacgactcactataggggatcgagatgcgatcatatactcgaggacgaacagaggagacgtcctatggtatatgataacctggcggcagcgcaaaagatg

SEQ ID NO: 68655 - DNA, 103 bp, Artificial Sequence
  Synthetic Polynucleotide
taatacgactcactatagggattgagatcgagatgcgatcatatactcgaaacagaggagatcgagtatgtgatcgcataacctggcggcagcgcaaaagatg

SEQ ID NO: 68656 - DNA, 103 bp, Artificial Sequence
  Synthetic Polynucleotide
taatacgactcactatagggagatgattgagatcgagatgcgatcatataaacagaggagatatatgatggcatctcgaaacctggcggcagcgcaaaagatg

SEQ ID NO: 68657 - DNA, 103 bp, Artificial Sequence
  Synthetic Polynucleotide
taatacgactcactatagggaaataagatgattgagatcgagatgcgatcaacagaggagagatcgcatgtcgatctcaaacctggcggcagcgcaaaagatg

SEQ ID NO: 68658 - DNA, 103 bp, Artificial Sequence
  Synthetic Polynucleotide
taatacgactcactataggggacttaaataagatgattgagatcgagatgaacagaggagacatctcatgctcaatcataacctggcggcagcgcaaaagatg

SEQ ID NO: 68659 - DNA, 103 bp, Artificial Sequence
  Synthetic Polynucleotide
taatacgactcactataggggacatttgttatagagagtaaattatagtaaacagaggagatactatatgttactctctaacctggcggcagcgcaaaagatg

SEQ ID NO: 68660 - DNA, 103 bp, Artificial Sequence
  Synthetic Polynucleotide
taatacgactcactatagggaatacgacttaaataagatgattgagatcgaacagaggagacgatctatgtcatcttataacctggcggcagcgcaaaagatg

SEQ ID NO: 68661 - DNA, 103 bp, Artificial Sequence
  Synthetic Polynucleotide
taatacgactcactatagggttaggaatacgacttaaataagatgattgaaacagaggagatcaatcatgttatttaagaacctggcggcagcgcaaaagatg

SEQ ID NO: 68662 - DNA, 103 bp, Artificial Sequence
  Synthetic Polynucleotide
taatacgactcactatagggtctcattaggaatacgacttaaataagatgaacagaggagacatcttatgtaagtcgtaaacctggcggcagcgcaaaagatg

SEQ ID NO: 68663 - DNA, 103 bp, Artificial Sequence
  Synthetic Polynucleotide
taatacgactcactatagggtaatatctcattaggaatacgacttaaataaacagaggagatatttaatgcgtattcctaacctggcggcagcgcaaaagatg

SEQ ID NO: 68664 - DNA, 103 bp, Artificial Sequence
  Synthetic Polynucleotide
taatacgactcactatagggttgagtaatatctcattaggaatacgacttaacagaggagaaagtcgatgtcctaatgaaacctggcggcagcgcaaaagatg

SEQ ID NO: 68665 - DNA, 103 bp, Artificial Sequence
  Synthetic Polynucleotide
taatacgactcactataggggtattttgagtaatatctcattaggaatacaacagaggagagtattcatgatgagatataacctggcggcagcgcaaaagatg

SEQ ID NO: 68666 - DNA, 103 bp, Artificial Sequence
  Synthetic Polynucleotide
taatacgactcactatagggatatagtattttgagtaatatctcattaggaacagaggagacctaatatgatattactcaacctggcggcagcgcaaaagatg

SEQ ID NO: 68667 - DNA, 103 bp, Artificial Sequence
  Synthetic Polynucleotide
taatacgactcactatagggaggttatatagtattttgagtaatatctcaaacagaggagatgagatatgactcaaaataacctggcggcagcgcaaaagatg

SEQ ID NO: 68668 - DNA, 103 bp, Artificial Sequence
  Synthetic Polynucleotide
taatacgactcactatagggcgctgaggttatatagtattttgagtaataaacagaggagatattacatgaaatactataacctggcggcagcgcaaaagatg

SEQ ID NO: 68669 - DNA, 103 bp, Artificial Sequence
  Synthetic Polynucleotide
taatacgactcactataggggtagacgctgaggttatatagtattttgagaacagaggagactcaaaatgctatataacaacctggcggcagcgcaaaagatg

SEQ ID NO: 68670 - DNA, 103 bp, Artificial Sequence
  Synthetic Polynucleotide
taatacgactcactataggggttatgacatttgttatagagagtaaattaaacagaggagataatttatgctctataacaacctggcggcagcgcaaaagatg

SEQ ID NO: 68671 - DNA, 103 bp, Artificial Sequence
  Synthetic Polynucleotide
taatacgactcactatagggaaatcgtagacgctgaggttatatagtattaacagaggagaaatactatgtaacctcagaacctggcggcagcgcaaaagatg

SEQ ID NO: 68672 - DNA, 103 bp, Artificial Sequence
  Synthetic Polynucleotide
taatacgactcactatagggtgcgtaaatcgtagacgctgaggttatataaacagaggagatatataatgtcagcgtctaacctggcggcagcgcaaaagatg

SEQ ID NO: 68673 - DNA, 103 bp, Artificial Sequence
  Synthetic Polynucleotide
taatacgactcactatagggtagtttgcgtaaatcgtagacgctgaggttaacagaggagaaacctcatggtctacgataacctggcggcagcgcaaaagatg

SEQ ID NO: 68674 - DNA, 103 bp, Artificial Sequence
  Synthetic Polynucleotide
taatacgactcactataggggcatatagtttgcgtaaatcgtagacgctgaacagaggagacagcgtatgcgatttacgaacctggcggcagcgcaaaagatg

SEQ ID NO: 68675 - DNA, 103 bp, Artificial Sequence
  Synthetic Polynucleotide
taatacgactcactatagggatcttgcatatagtttgcgtaaatcgtagaaacagaggagatctacgatgtacgcaaacaacctggcggcagcgcaaaagatg

SEQ ID NO: 68676 - DNA, 103 bp, Artificial Sequence
  Synthetic Polynucleotide
taatacgactcactatagggcatgtatcttgcatatagtttgcgtaaatcaacagaggagagatttaatgaaactatataacctggcggcagcgcaaaagatg

SEQ ID NO: 68677 - DNA, 103 bp, Artificial Sequence
  Synthetic Polynucleotide
taatacgactcactatagggtctagcatgtatcttgcatatagtttgcgtaacagaggagaacgcaaatgatatgcaagaacctggcggcagcgcaaaagatg

SEQ ID NO: 68678 - DNA, 103 bp, Artificial Sequence
  Synthetic Polynucleotide
taatacgactcactatagggcattctctagcatgtatcttgcatatagttaacagaggagaaactatatgcaagatacaaacctggcggcagcgcaaaagatg

SEQ ID NO: 68679 - DNA, 103 bp, Artificial Sequence
  Synthetic Polynucleotide
taatacgactcactatagggtgtctcattctctagcatgtatcttgcataaacagaggagatatgcaatgtacatgctaaacctggcggcagcgcaaaagatg

SEQ ID NO: 68680 - DNA, 103 bp, Artificial Sequence
  Synthetic Polynucleotide
taatacgactcactatagggtaatctgtctcattctctagcatgtatcttaacagaggagaaagataatggctagagaaaacctggcggcagcgcaaaagatg

SEQ ID NO: 68681 - DNA, 103 bp, Artificial Sequence
  Synthetic Polynucleotide
taatacgactcactatagggtcagtaatataaactaataatataacaataaacagaggagatattgtatgattattagtaacctggcggcagcgcaaaagatg

SEQ ID NO: 68682 - DNA, 103 bp, Artificial Sequence
  Synthetic Polynucleotide
taatacgactcactatagggactaagttatgacatttgttatagagagtaaacagaggagatactctatgtaacaaatgaacctggcggcagcgcaaaagatg

SEQ ID NO: 68683 - DNA, 103 bp, Artificial Sequence
  Synthetic Polynucleotide
taatacgactcactatagggtatgataatctgtctcattctctagcatgtaacagaggagaacatgcatgagaatgagaaacctggcggcagcgcaaaagatg

SEQ ID NO: 68684 - DNA, 103 bp, Artificial Sequence
  Synthetic Polynucleotide
taatacgactcactatagggctctatatgataatctgtctcattctctagaacagaggagactagagatggagacagataacctggcggcagcgcaaaagatg

SEQ ID NO: 68685 - DNA, 103 bp, Artificial Sequence
  Synthetic Polynucleotide
taatacgactcactatagggcttgactctatatgataatctgtctcattcaacagaggagagaatgaatgagattatcaaacctggcggcagcgcaaaagatg

SEQ ID NO: 68686 - DNA, 103 bp, Artificial Sequence
  Synthetic Polynucleotide
taatacgactcactatagggttgaccttgactctatatgataatctgtctaacagaggagaagacagatgatcatatagaacctggcggcagcgcaaaagatg

SEQ ID NO: 68687 - DNA, 103 bp, Artificial Sequence
  Synthetic Polynucleotide
taatacgactcactatagggagaaattgaccttgactctatatgataatcaacagaggagagattatatgatagagtcaaacctggcggcagcgcaaaagatg

SEQ ID NO: 68688 - DNA, 103 bp, Artificial Sequence
  Synthetic Polynucleotide
taatacgactcactatagggtgcgtagaaattgaccttgactctatatgaaacagaggagatcatatatggtcaaggtcaacctggcggcagcgcaaaagatg

SEQ ID NO: 68689 - DNA, 103 bp, Artificial Sequence
  Synthetic Polynucleotide
taatacgactcactatagggcagtctgcgtagaaattgaccttgactctaaacagaggagatagagtatgggtcaatttaacctggcggcagcgcaaaagatg

SEQ ID NO: 68690 - DNA, 103 bp, Artificial Sequence
  Synthetic Polynucleotide
taatacgactcactatagggttattcagtctgcgtagaaattgaccttgaaacagaggagatcaaggatgatttctacgaacctggcggcagcgcaaaagatg

SEQ ID NO: 68691 - DNA, 103 bp, Artificial Sequence
  Synthetic Polynucleotide
taatacgactcactatagggtaacattattcagtctgcgtagaaattgacaacagaggagagtcaatatgtacgcagacaacctggcggcagcgcaaaagatg

SEQ ID NO: 68692 - DNA, 103 bp, Artificial Sequence
  Synthetic Polynucleotide
taatacgactcactataggggtatataacattattcagtctgcgtagaaaaacagaggagatttctaatgagactgaataacctggcggcagcgcaaaagatg

SEQ ID NO: 68693 - DNA, 103 bp, Artificial Sequence
  Synthetic Polynucleotide
taatacgactcactatagggaaagaactaagttatgacatttgttatagaaacagaggagatctataatgaatgtcataaacctggcggcagcgcaaaagatg

SEQ ID NO: 68694 - DNA, 103 bp, Artificial Sequence
  Synthetic Polynucleotide
taatacgactcactataggggtagtgtatataacattattcagtctgcgtaacagaggagaacgcagatggaataatgtaacctggcggcagcgcaaaagatg

SEQ ID NO: 68695 - DNA, 103 bp, Artificial Sequence
  Synthetic Polynucleotide
taatacgactcactatagggaatatgtagtgtatataacattattcagtcaacagaggagagactgaatgatgttatataacctggcggcagcgcaaaagatg

SEQ ID NO: 68696 - DNA, 103 bp, Artificial Sequence
  Synthetic Polynucleotide
taatacgactcactatagggataaaaatatgtagtgtatataacattattaacagaggagaaataatatgatatacactaacctggcggcagcgcaaaagatg

SEQ ID NO: 68697 - DNA, 103 bp, Artificial Sequence
  Synthetic Polynucleotide
taatacgactcactatagggatgacataaaaatatgtagtgtatataacaaacagaggagatgttatatgcactacataaacctggcggcagcgcaaaagatg

SEQ ID NO: 68698 - DNA, 103 bp, Artificial Sequence
  Synthetic Polynucleotide
taatacgactcactatagggttataatgacataaaaatatgtagtgtataaacagaggagatatacaatgcatatttttaacctggcggcagcgcaaaagatg

SEQ ID NO: 68699 - DNA, 103 bp, Artificial Sequence
  Synthetic Polynucleotide
taatacgactcactatagggagtagttataatgacataaaaatatgtagtaacagaggagaactacaatgttttatgtcaacctggcggcagcgcaaaagatg

SEQ ID NO: 68700 - DNA, 103 bp, Artificial Sequence
  Synthetic Polynucleotide
taatacgactcactatagggttacaagtagttataatgacataaaaatataacagaggagaatatttatgtgtcattataacctggcggcagcgcaaaagatg

SEQ ID NO: 68701 - DNA, 103 bp, Artificial Sequence
  Synthetic Polynucleotide
taatacgactcactatagggcaatattacaagtagttataatgacataaaaacagaggagatttatgatgttataactaaacctggcggcagcgcaaaagatg

SEQ ID NO: 68702 - DNA, 103 bp, Artificial Sequence
  Synthetic Polynucleotide
taatacgactcactataggggatttcaatattacaagtagttataatgacaacagaggagagtcattatgactacttgtaacctggcggcagcgcaaaagatg

SEQ ID NO: 68703 - DNA, 103 bp, Artificial Sequence
  Synthetic Polynucleotide
taatacgactcactatagggattacgatttcaatattacaagtagttataaacagaggagatataacatgttgtaatataacctggcggcagcgcaaaagatg

SEQ ID NO: 68704 - DNA, 103 bp, Artificial Sequence
  Synthetic Polynucleotide
taatacgactcactatagggacataaaagaactaagttatgacatttgttaacagaggagaaacaaaatgcataacttaaacctggcggcagcgcaaaagatg

SEQ ID NO: 68705 - DNA, 103 bp, Artificial Sequence
  Synthetic Polynucleotide
taatacgactcactatagggatcaaattacgatttcaatattacaagtagaacagaggagactacttatgatattgaaaaacctggcggcagcgcaaaagatg

SEQ ID NO: 68706 - DNA, 103 bp, Artificial Sequence
  Synthetic Polynucleotide
taatacgactcactatagggtatatatcaaattacgatttcaatattacaaacagaggagatgtaatatggaaatcgtaaacctggcggcagcgcaaaagatg

SEQ ID NO: 68707 - DNA, 103 bp, Artificial Sequence
  Synthetic Polynucleotide
taatacgactcactatagggttcactatatatcaaattacgatttcaataaacagaggagatattgaatgcgtaatttgaacctggcggcagcgcaaaagatg

SEQ ID NO: 68708 - DNA, 103 bp, Artificial Sequence
  Synthetic Polynucleotide
taatacgactcactatagggcatttttcactatatatcaaattacgatttaacagaggagaaaatcgatgtttgatataaacctggcggcagcgcaaaagatg

SEQ ID NO: 68709 - DNA, 103 bp, Artificial Sequence
  Synthetic Polynucleotide
taatacgactcactatagggaaatccatttttcactatatatcaaattacaacagaggagagtaattatgtatatagtgaacctggcggcagcgcaaaagatg

SEQ ID NO: 68710 - DNA, 103 bp, Artificial Sequence
  Synthetic Polynucleotide
taatacgactcactatagggcatcaaaatccatttttcactatatatcaaaacagaggagattgataatgagtgaaaaaaacctggcggcagcgcaaaagatg

SEQ ID NO: 68711 - DNA, 103 bp, Artificial Sequence
  Synthetic Polynucleotide
taatacgactcactatagggaatatcatcaaaatccatttttcactatataacagaggagaatatagatgaaaatggataacctggcggcagcgcaaaagatg

SEQ ID NO: 68712 - DNA, 103 bp, Artificial Sequence
  Synthetic Polynucleotide
taatacgactcactatagggtgtttaatatcatcaaaatccatttttcacaacagaggagagtgaaaatgggattttgaaacctggcggcagcgcaaaagatg

SEQ ID NO: 68713 - DNA, 103 bp, Artificial Sequence
  Synthetic Polynucleotide
taatacgactcactatagggtattatgtttaatatcatcaaaatccatttaacagaggagaaaatggatgttgatgataaacctggcggcagcgcaaaagatg

SEQ ID NO: 68714 - DNA, 103 bp, Artificial Sequence
  Synthetic Polynucleotide
taatacgactcactatagggtcgtctattatgtttaatatcatcaaaatcaacagaggagagattttatggatattaaaaacctggcggcagcgcaaaagatg

SEQ ID NO: 68715 - DNA, 103 bp, Artificial Sequence
  Synthetic Polynucleotide
taatacgactcactatagggtcttgacataaaagaactaagttatgacataacagaggagaatgtcaatgcttagttctaacctggcggcagcgcaaaagatg

SEQ ID NO: 68716 - DNA, 103 bp, Artificial Sequence
  Synthetic Polynucleotide
taatacgactcactatagggactactcgtctattatgtttaatatcatcaaacagaggagatgatgaatgtaaacataaaacctggcggcagcgcaaaagatg

SEQ ID NO: 68717 - DNA, 103 bp, Artificial Sequence
  Synthetic Polynucleotide
taatacgactcactatagggtacttactactcgtctattatgtttaatataacagaggagaatattaatgataatagacaacctggcggcagcgcaaaagatg

SEQ ID NO: 68718 - DNA, 103 bp, Artificial Sequence
  Synthetic Polynucleotide
taatacgactcactatagggaatgttacttactactcgtctattatgtttaacagaggagaaaacatatgagacgagtaaacctggcggcagcgcaaaagatg

SEQ ID NO: 68719 - DNA, 103 bp, Artificial Sequence
  Synthetic Polynucleotide
taatacgactcactatagggttgctaatgttacttactactcgtctattaaacagaggagataatagatgagtagtaagaacctggcggcagcgcaaaagatg

SEQ ID NO: 68720 - DNA, 103 bp, Artificial Sequence
  Synthetic Polynucleotide
taatacgactcactatagggaaagattgctaatgttacttactactcgtcaacagaggagagacgagatgtaagtaacaaacctggcggcagcgcaaaagatg

SEQ ID NO: 68721 - DNA, 103 bp, Artificial Sequence
  Synthetic Polynucleotide
taatacgactcactatagggatctaaaagattgctaatgttacttactacaacagaggagagtagtaatgaacattagcaacctggcggcagcgcaaaagatg

SEQ ID NO: 68722 - DNA, 103 bp, Artificial Sequence
  Synthetic Polynucleotide
taatacgactcactatagggtcatcatctaaaagattgctaatgttacttaacagaggagaaagtaaatgtagcaatctaacctggcggcagcgcaaaagatg

SEQ ID NO: 68723 - DNA, 103 bp, Artificial Sequence
  Synthetic Polynucleotide
taatacgactcactatagggatatatcatcatctaaaagattgctaatgtaacagaggagaacattaatgatcttttagaacctggcggcagcgcaaaagatg

SEQ ID NO: 68724 - DNA, 103 bp, Artificial Sequence
  Synthetic Polynucleotide
taatacgactcactatagggataatatatatcatcatctaaaagattgctaacagaggagaagcaatatgttagatgataacctggcggcagcgcaaaagatg

SEQ ID NO: 68725 - DNA, 103 bp, Artificial Sequence
  Synthetic Polynucleotide
taatacgactcactatagggatcgcataatatatatcatcatctaaaagaaacagaggagatcttttatgtgatgatataacctggcggcagcgcaaaagatg

SEQ ID NO: 68726 - DNA, 103 bp, Artificial Sequence
  Synthetic Polynucleotide
taatacgactcactatagggtgccttcttgacataaaagaactaagttataacagaggagaataactatgttcttttataacctggcggcagcgcaaaagatg

SEQ ID NO: 68727 - DNA, 103 bp, Artificial Sequence
  Synthetic Polynucleotide
taatacgactcactatagggattacatcgcataatatatatcatcatctaaacagaggagatagatgatgatatatattaacctggcggcagcgcaaaagatg

SEQ ID NO: 68728 - DNA, 103 bp, Artificial Sequence
  Synthetic Polynucleotide
taatacgactcactatagggttatgattacatcgcataatatatatcatcaacagaggagagatgatatgtattatgcgaacctggcggcagcgcaaaagatg

SEQ ID NO: 68729 - DNA, 103 bp, Artificial Sequence
  Synthetic Polynucleotide
taatacgactcactatagggaatagttatgattacatcgcataatatataaacagaggagatatataatgtgcgatgtaaacctggcggcagcgcaaaagatg

SEQ ID NO: 68730 - DNA, 103 bp, Artificial Sequence
  Synthetic Polynucleotide
taatacgactcactatagggtcaccaatagttatgattacatcgcataataacagaggagaattatgatgtgtaatcataacctggcggcagcgcaaaagatg

SEQ ID NO: 68731 - DNA, 103 bp, Artificial Sequence
  Synthetic Polynucleotide
taatacgactcactatagggctccatcaccaatagttatgattacatcgcaacagaggagagcgatgatgtcataactaaacctggcggcagcgcaaaagatg

SEQ ID NO: 68732 - DNA, 103 bp, Artificial Sequence
  Synthetic Polynucleotide
taatacgactcactatagggttcttctccatcaccaatagttatgattacaacagaggagagtaatcatgactattggtaacctggcggcagcgcaaaagatg

SEQ ID NO: 68733 - DNA, 103 bp, Artificial Sequence
  Synthetic Polynucleotide
taatacgactcactatagggttaatttcttctccatcaccaatagttatgaacagaggagacataacatgtggtgatggaacctggcggcagcgcaaaagatg

SEQ ID NO: 68734 - DNA, 103 bp, Artificial Sequence
  Synthetic Polynucleotide
taatacgactcactataggggtgctttaatttcttctccatcaccaatagaacagaggagactattgatgatggagaagaacctggcggcagcgcaaaagatg

SEQ ID NO: 68735 - DNA, 103 bp, Artificial Sequence
  Synthetic Polynucleotide
taatacgactcactatagggtttatgtgctttaatttcttctccatcaccaacagaggagaggtgatatggaagaaattaacctggcggcagcgcaaaagatg

SEQ ID NO: 68736 - DNA, 103 bp, Artificial Sequence
  Synthetic Polynucleotide
taatacgactcactatagggatagttttatgtgctttaatttcttctccaaacagaggagatggagaatgaattaaagcaacctggcggcagcgcaaaagatg

SEQ ID NO: 68737 - DNA, 103 bp, Artificial Sequence
  Synthetic Polynucleotide
taatacgactcactatagggaccagtgccttcttgacataaaagaactaaaacagaggagattagttatgttatgtcaaaacctggcggcagcgcaaaagatg

SEQ ID NO: 68738 - DNA, 103 bp, Artificial Sequence
  Synthetic Polynucleotide
taatacgactcactatagggccaagatagttttatgtgctttaatttcttaacagaggagaaagaaaatgaagcacataaacctggcggcagcgcaaaagatg

SEQ ID NO: 68739 - DNA, 103 bp, Artificial Sequence
  Synthetic Polynucleotide
taatacgactcactatagggagcagccaagatagttttatgtgctttaataacagaggagaattaaaatgcataaaactaacctggcggcagcgcaaaagatg

SEQ ID NO: 68740 - DNA, 103 bp, Artificial Sequence
  Synthetic Polynucleotide
taatacgactcactataggggatccagcagccaagatagttttatgtgctaacagaggagaagcacaatgaactatcttaacctggcggcagcgcaaaagatg

SEQ ID NO: 68741 - DNA, 103 bp, Artificial Sequence
  Synthetic Polynucleotide
taatacgactcactatagggatttagatccagcagccaagatagttttataacagaggagaataaaaatgtcttggctgaacctggcggcagcgcaaaagatg

SEQ ID NO: 68742 - DNA, 103 bp, Artificial Sequence
  Synthetic Polynucleotide
taatacgactcactatagggaaaatatttagatccagcagccaagatagtaacagaggagaactatcatggctgctggaaacctggcggcagcgcaaaagatg

SEQ ID NO: 68743 - DNA, 103 bp, Artificial Sequence
  Synthetic Polynucleotide
taatacgactcactataggggttctaaaatatttagatccagcagccaagaacagaggagacttggcatgtggatctaaaacctggcggcagcgcaaaagatg

SEQ ID NO: 68744 - DNA, 103 bp, Artificial Sequence
  Synthetic Polynucleotide
taatacgactcactatagggacagtgttctaaaatatttagatccagcagaacagaggagactgctgatgctaaatattaacctggcggcagcgcaaaagatg

SEQ ID NO: 68745 - DNA, 103 bp, Artificial Sequence
  Synthetic Polynucleotide
taatacgactcactatagggtgtaaacagtgttctaaaatatttagatccaacagaggagaggatctatgtattttagaaacctggcggcagcgcaaaagatg

SEQ ID NO: 68746 - DNA, 103 bp, Artificial Sequence
  Synthetic Polynucleotide
taatacgactcactatagggggtgttgtaaacagtgttctaaaatatttaaacagaggagataaataatgtagaacactaacctggcggcagcgcaaaagatg

SEQ ID NO: 68747 - DNA, 103 bp, Artificial Sequence
  Synthetic Polynucleotide
taatacgactcactatagggtcataggtgttgtaaacagtgttctaaaataacagaggagaattttaatgcactgtttaaacctggcggcagcgcaaaagatg

SEQ ID NO: 68748 - DNA, 103 bp, Artificial Sequence
  Synthetic Polynucleotide
taatacgactcactatagggactaaaccagtgccttcttgacataaaagaaacagaggagatcttttatgtcaagaaggaacctggcggcagcgcaaaagatg

SEQ ID NO: 68749 - DNA, 103 bp, Artificial Sequence
  Synthetic Polynucleotide
taatacgactcactatagggtattatcataggtgttgtaaacagtgttctaacagaggagaagaacaatgtttacaacaaacctggcggcagcgcaaaagatg

SEQ ID NO: 68750 - DNA, 103 bp, Artificial Sequence
  Synthetic Polynucleotide
taatacgactcactatagggtctcttattatcataggtgttgtaaacagtaacagaggagaactgttatgaacacctataacctggcggcagcgcaaaagatg

SEQ ID NO: 68751 - DNA, 103 bp, Artificial Sequence
  Synthetic Polynucleotide
taatacgactcactatagggctagatctcttattatcataggtgttgtaaaacagaggagattacaaatgctatgataaaacctggcggcagcgcaaaagatg

SEQ ID NO: 68752 - DNA, 103 bp, Artificial Sequence
  Synthetic Polynucleotide
taatacgactcactatagggagttactagatctcttattatcataggtgtaacagaggagaacacctatgataataagaaacctggcggcagcgcaaaagatg

SEQ ID NO: 68753 - DNA, 103 bp, Artificial Sequence
  Synthetic Polynucleotide
taatacgactcactatagggactctagttactagatctcttattatcataaacagaggagatatgatatgaagagatctaacctggcggcagcgcaaaagatg

SEQ ID NO: 68754 - DNA, 103 bp, Artificial Sequence
  Synthetic Polynucleotide
taatacgactcactatagggtttttactctagttactagatctcttattaaacagaggagataataaatgatctagtaaaacctggcggcagcgcaaaagatg

SEQ ID NO: 68755 - DNA, 103 bp, Artificial Sequence
  Synthetic Polynucleotide
taatacgactcactataggggtagatttttactctagttactagatctctaacagaggagaagagatatggtaactagaaacctggcggcagcgcaaaagatg

SEQ ID NO: 68756 - DNA, 103 bp, Artificial Sequence
  Synthetic Polynucleotide
taatacgactcactatagggcatctgtagatttttactctagttactagaaacagaggagatctagtatgtagagtaaaaacctggcggcagcgcaaaagatg

SEQ ID NO: 68757 - DNA, 103 bp, Artificial Sequence
  Synthetic Polynucleotide
taatacgactcactatagggttgatcatctgtagatttttactctagttaaacagaggagataactaatgtaaaaatctaacctggcggcagcgcaaaagatg

SEQ ID NO: 68758 - DNA, 103 bp, Artificial Sequence
  Synthetic Polynucleotide
taatacgactcactatagggctttattgatcatctgtagatttttactctaacagaggagaagagtaatgatctacagaaacctggcggcagcgcaaaagatg

SEQ ID NO: 68759 - DNA, 103 bp, Artificial Sequence
  Synthetic Polynucleotide
taatacgactcactataggggatgaactaaaccagtgccttcttgacataaacagaggagatatgtcatgaaggcactgaacctggcggcagcgcaaaagatg

SEQ ID NO: 68760 - DNA, 103 bp, Artificial Sequence
  Synthetic Polynucleotide
taatacgactcactatagggggaatctttattgatcatctgtagatttttaacagaggagaaaaaatatgcagatgatcaacctggcggcagcgcaaaagatg

SEQ ID NO: 68761 - DNA, 103 bp, Artificial Sequence
  Synthetic Polynucleotide
taatacgactcactatagggttgacggaatctttattgatcatctgtagaaacagaggagatctacaatggatcaataaaacctggcggcagcgcaaaagatg

SEQ ID NO: 68762 - DNA, 103 bp, Artificial Sequence
  Synthetic Polynucleotide
taatacgactcactatagggtatttttgacggaatctttattgatcatctaacagaggagaagatgaatgataaagattaacctggcggcagcgcaaaagatg

SEQ ID NO: 68763 - DNA, 103 bp, Artificial Sequence
  Synthetic Polynucleotide
taatacgactcactatagggtacaatatttttgacggaatctttattgataacagaggagaatcaatatggattccgtcaacctggcggcagcgcaaaagatg

SEQ ID NO: 68764 - DNA, 103 bp, Artificial Sequence
  Synthetic Polynucleotide
taatacgactcactatagggtactgtacaatatttttgacggaatctttaaacagaggagataaagaatgcgtcaaaaaaacctggcggcagcgcaaaagatg

SEQ ID NO: 68765 - DNA, 103 bp, Artificial Sequence
  Synthetic Polynucleotide
taatacgactcactatagggataagtactgtacaatatttttgacggaataacagaggagaattccgatgaaaatattgaacctggcggcagcgcaaaagatg

SEQ ID NO: 68766 - DNA, 103 bp, Artificial Sequence
  Synthetic Polynucleotide
taatacgactcactatagggattgtataagtactgtacaatatttttgacaacagaggagagtcaaaatgattgtacagaacctggcggcagcgcaaaagatg

SEQ ID NO: 68767 - DNA, 103 bp, Artificial Sequence
  Synthetic Polynucleotide
taatacgactcactatagggtacctattgtataagtactgtacaatatttaacagaggagaaaatatatgacagtacttaacctggcggcagcgcaaaagatg

SEQ ID NO: 68768 - DNA, 103 bp, Artificial Sequence
  Synthetic Polynucleotide
taatacgactcactatagggttatatacctattgtataagtactgtacaaaacagaggagattgtacatgacttatacaaacctggcggcagcgcaaaagatg

SEQ ID NO: 68769 - DNA, 103 bp, Artificial Sequence
  Synthetic Polynucleotide
taatacgactcactatagggagaacttatatacctattgtataagtactgaacagaggagacagtacatgtacaataggaacctggcggcagcgcaaaagatg

SEQ ID NO: 68770 - DNA, 103 bp, Artificial Sequence
  Synthetic Polynucleotide
taatacgactcactatagggtcatagatgaactaaaccagtgccttcttgaacagaggagacaagaaatgactggtttaaacctggcggcagcgcaaaagatg

SEQ ID NO: 68771 - DNA, 103 bp, Artificial Sequence
  Synthetic Polynucleotide
taatacgactcactatagggttcatagaacttatatacctattgtataagaacagaggagacttataatgtaggtatataacctggcggcagcgcaaaagatg

SEQ ID NO: 68772 - DNA, 103 bp, Artificial Sequence
  Synthetic Polynucleotide
taatacgactcactatagggttatattcatagaacttatatacctattgtaacagaggagaacaataatgatataagttaacctggcggcagcgcaaaagatg

SEQ ID NO: 68773 - DNA, 103 bp, Artificial Sequence
  Synthetic Polynucleotide
taatacgactcactatagggatctattatattcatagaacttatatacctaacagaggagaaggtatatgagttctatgaacctggcggcagcgcaaaagatg

SEQ ID NO: 68774 - DNA, 103 bp, Artificial Sequence
  Synthetic Polynucleotide
taatacgactcactatagggaatacatctattatattcatagaacttataaacagaggagatataagatgtatgaatataacctggcggcagcgcaaaagatg

SEQ ID NO: 68775 - DNA, 103 bp, Artificial Sequence
  Synthetic Polynucleotide
taatacgactcactatagggattttaatacatctattatattcatagaacaacagaggagagttctaatgatataatagaacctggcggcagcgcaaaagatg

SEQ ID NO: 68776 - DNA, 103 bp, Artificial Sequence
  Synthetic Polynucleotide
taatacgactcactatagggggcgcattttaatacatctattatattcataacagaggagaatgaatatgatagatgtaaacctggcggcagcgcaaaagatg

SEQ ID NO: 68777 - DNA, 103 bp, Artificial Sequence
  Synthetic Polynucleotide
taatacgactcactatagggtagttggcgcattttaatacatctattataaacagaggagatataatatgtgtattaaaaacctggcggcagcgcaaaagatg

SEQ ID NO: 68778 - DNA, 103 bp, Artificial Sequence
  Synthetic Polynucleotide
taatacgactcactataggggaagatagttggcgcattttaatacatctaaacagaggagatagatgatgtaaaatgcgaacctggcggcagcgcaaaagatg

SEQ ID NO: 68779 - DNA, 103 bp, Artificial Sequence
  Synthetic Polynucleotide
taatacgactcactataggggattagaagatagttggcgcattttaatacaacagaggagagtattaatgtgcgccaacaacctggcggcagcgcaaaagatg

SEQ ID NO: 68780 - DNA, 103 bp, Artificial Sequence
  Synthetic Polynucleotide
taatacgactcactatagggtaatcgattagaagatagttggcgcattttaacagaggagaaaaatgatgcaactatctaacctggcggcagcgcaaaagatg

SEQ ID NO: 68781 - DNA, 103 bp, Artificial Sequence
  Synthetic Polynucleotide
taatacgactcactataggggacattcatagatgaactaaaccagtgcctaacagaggagaaggcacatgtttagttcaaacctggcggcagcgcaaaagatg

SEQ ID NO: 68782 - DNA, 103 bp, Artificial Sequence
  Synthetic Polynucleotide
taatacgactcactatagggctagataatcgattagaagatagttggcgcaacagaggagagcgccaatgatcttctaaaacctggcggcagcgcaaaagatg

SEQ ID NO: 68783 - DNA, 103 bp, Artificial Sequence
  Synthetic Polynucleotide
taatacgactcactatagggagtgactagataatcgattagaagatagttaacagaggagaaactatatgctaatcgataacctggcggcagcgcaaaagatg

SEQ ID NO: 68784 - DNA, 103 bp, Artificial Sequence
  Synthetic Polynucleotide
taatacgactcactatagggcagtcagtgactagataatcgattagaagaaacagaggagatcttctatgcgattatctaacctggcggcagcgcaaaagatg

SEQ ID NO: 68785 - DNA, 103 bp, Artificial Sequence
  Synthetic Polynucleotide
taatacgactcactatagggattcgcagtcagtgactagataatcgattaaacagaggagataatcgatgatctagtcaaacctggcggcagcgcaaaagatg

SEQ ID NO: 68786 - DNA, 103 bp, Artificial Sequence
  Synthetic Polynucleotide
taatacgactcactatagggataggattcgcagtcagtgactagataatcaacagaggagagattatatggtcactgacaacctggcggcagcgcaaaagatg

SEQ ID NO: 68787 - DNA, 103 bp, Artificial Sequence
  Synthetic Polynucleotide
taatacgactcactatagggttaatataggattcgcagtcagtgactagaaacagaggagatctagtatgtgactgcgaaacctggcggcagcgcaaaagatg

SEQ ID NO: 68788 - DNA, 103 bp, Artificial Sequence
  Synthetic Polynucleotide
taatacgactcactatagggaatctttaatataggattcgcagtcagtgaaacagaggagatcactgatggcgaatcctaacctggcggcagcgcaaaagatg

SEQ ID NO: 68789 - DNA, 103 bp, Artificial Sequence
  Synthetic Polynucleotide
taatacgactcactatagggagtataatctttaatataggattcgcagtcaacagaggagagactgcatgtcctatattaacctggcggcagcgcaaaagatg

SEQ ID NO: 68790 - DNA, 103 bp, Artificial Sequence
  Synthetic Polynucleotide
taatacgactcactatagggtgattagtataatctttaatataggattcgaacagaggagacgaatcatgtattaaagaaacctggcggcagcgcaaaagatg

SEQ ID NO: 68791 - DNA, 103 bp, Artificial Sequence
  Synthetic Polynucleotide
taatacgactcactatagggtatcatgattagtataatctttaatataggaacagaggagacctataatgaagattataaacctggcggcagcgcaaaagatg

SEQ ID NO: 68792 - DNA, 103 bp, Artificial Sequence
  Synthetic Polynucleotide
taatacgactcactatagggttaattcagtaatataaactaataatataaaacagaggagattatatatgtagtttataaacctggcggcagcgcaaaagatg

SEQ ID NO: 68793 - DNA, 103 bp, Artificial Sequence
  Synthetic Polynucleotide
taatacgactcactatagggggtgtgacattcatagatgaactaaaccagaacagaggagactggttatgttcatctataacctggcggcagcgcaaaagatg

SEQ ID NO: 68794 - DNA, 103 bp, Artificial Sequence
  Synthetic Polynucleotide
taatacgactcactataggggcaggtatcatgattagtataatctttaataacagaggagaattaaaatgtatactaataacctggcggcagcgcaaaagatg

SEQ ID NO: 68795 - DNA, 103 bp, Artificial Sequence
  Synthetic Polynucleotide
taatacgactcactatagggcatatgcaggtatcatgattagtataatctaacagaggagaagattaatgtaatcatgaaacctggcggcagcgcaaaagatg

SEQ ID NO: 68796 - DNA, 103 bp, Artificial Sequence
  Synthetic Polynucleotide
taatacgactcactatagggacatacatatgcaggtatcatgattagtataacagaggagaatactaatgatgatacctaacctggcggcagcgcaaaagatg

SEQ ID NO: 68797 - DNA, 103 bp, Artificial Sequence
  Synthetic Polynucleotide
taatacgactcactatagggatggtacatacatatgcaggtatcatgattaacagaggagaaatcatatgacctgcataaacctggcggcagcgcaaaagatg

SEQ ID NO: 68798 - DNA, 103 bp, Artificial Sequence
  Synthetic Polynucleotide
taatacgactcactatagggaacctatggtacatacatatgcaggtatcaaacagaggagatgatacatgcatatgtataacctggcggcagcgcaaaagatg

SEQ ID NO: 68799 - DNA, 103 bp, Artificial Sequence
  Synthetic Polynucleotide
taatacgactcactatagggtcattaacctatggtacatacatatgcaggaacagaggagacctgcaatggtatgtaccaacctggcggcagcgcaaaagatg

SEQ ID NO: 68800 - DNA, 103 bp, Artificial Sequence
  Synthetic Polynucleotide
taatacgactcactatagggccatctcattaacctatggtacatacatataacagaggagaatatgtatgtaccataggaacctggcggcagcgcaaaagatg

SEQ ID NO: 68801 - DNA, 103 bp, Artificial Sequence
  Synthetic Polynucleotide
taatacgactcactatagggatgaaccatctcattaacctatggtacataaacagaggagatatgtaatgtaggttaataacctggcggcagcgcaaaagatg

SEQ ID NO: 68802 - DNA, 103 bp, Artificial Sequence
  Synthetic Polynucleotide
taatacgactcactatagggggaatatgaaccatctcattaacctatggtaacagaggagaaccataatgtaatgagataacctggcggcagcgcaaaagatg

SEQ ID NO: 68803 - DNA, 103 bp, Artificial Sequence
  Synthetic Polynucleotide
taatacgactcactatagggctattggaatatgaaccatctcattaacctaacagaggagaaggttaatgagatggttcaacctggcggcagcgcaaaagatg

SEQ ID NO: 68804 - DNA, 103 bp, Artificial Sequence
  Synthetic Polynucleotide
taatacgactcactataggggttatggtgtgacattcatagatgaactaaaacagaggagattagttatgctatgaatgaacctggcggcagcgcaaaagatg

SEQ ID NO: 68805 - DNA, 103 bp, Artificial Sequence
  Synthetic Polynucleotide
taatacgactcactatagggtttgactattggaatatgaaccatctcattaacagaggagaaatgagatggttcatattaacctggcggcagcgcaaaagatg

SEQ ID NO: 68806 - DNA, 103 bp, Artificial Sequence
  Synthetic Polynucleotide
taatacgactcactatagggatatatttgactattggaatatgaaccatcaacagaggagagatggtatgtattccaataacctggcggcagcgcaaaagatg

SEQ ID NO: 68807 - DNA, 103 bp, Artificial Sequence
  Synthetic Polynucleotide
taatacgactcactataggggtttaatatatttgactattggaatatgaaaacagaggagattcataatgcaatagtcaaacctggcggcagcgcaaaagatg

SEQ ID NO: 68808 - DNA, 103 bp, Artificial Sequence
  Synthetic Polynucleotide
taatacgactcactatagggcatacgtttaatatatttgactattggaataacagaggagaattccaatggtcaaatataacctggcggcagcgcaaaagatg

SEQ ID NO: 68809 - DNA, 103 bp, Artificial Sequence
  Synthetic Polynucleotide
taatacgactcactatagggatcagcatacgtttaatatatttgactattaacagaggagaaatagtatgatatattaaaacctggcggcagcgcaaaagatg

SEQ ID NO: 68810 - DNA, 103 bp, Artificial Sequence
  Synthetic Polynucleotide
taatacgactcactatagggtactcatcagcatacgtttaatatatttgaaacagaggagatcaaatatgttaaacgtaaacctggcggcagcgcaaaagatg

SEQ ID NO: 68811 - DNA, 103 bp, Artificial Sequence
  Synthetic Polynucleotide
taatacgactcactatagggtatattactcatcagcatacgtttaatataaacagaggagatatattatgcgtatgctgaacctggcggcagcgcaaaagatg

SEQ ID NO: 68812 - DNA, 103 bp, Artificial Sequence
  Synthetic Polynucleotide
taatacgactcactataggggttgatatattactcatcagcatacgtttaaacagaggagataaacgatggctgatgagaacctggcggcagcgcaaaagatg

SEQ ID NO: 68813 - DNA, 103 bp, Artificial Sequence
  Synthetic Polynucleotide
taatacgactcactatagggtcaatgttgatatattactcatcagcatacaacagaggagagtatgcatgtgagtaataaacctggcggcagcgcaaaagatg

SEQ ID NO: 68814 - DNA, 103 bp, Artificial Sequence
  Synthetic Polynucleotide
taatacgactcactatagggagttatcaatgttgatatattactcatcagaacagaggagactgatgatgaatatatcaaacctggcggcagcgcaaaagatg

SEQ ID NO: 68815 - DNA, 103 bp, Artificial Sequence
  Synthetic Polynucleotide
taatacgactcactatagggtggtagttatggtgtgacattcatagatgaaacagaggagatcatctatgaatgtcacaaacctggcggcagcgcaaaagatg

SEQ ID NO: 68816 - DNA, 103 bp, Artificial Sequence
  Synthetic Polynucleotide
taatacgactcactatagggtccgtagttatcaatgttgatatattactcaacagaggagagagtaaatgatcaacattaacctggcggcagcgcaaaagatg

SEQ ID NO: 68817 - DNA, 103 bp, Artificial Sequence
  Synthetic Polynucleotide
taatacgactcactatagggatgcgtccgtagttatcaatgttgatatataacagaggagaatatatatgcattgataaaacctggcggcagcgcaaaagatg

SEQ ID NO: 68818 - DNA, 103 bp, Artificial Sequence
  Synthetic Polynucleotide
taatacgactcactatagggtttaaatgcgtccgtagttatcaatgttgaaacagaggagatcaacaatgataactacgaacctggcggcagcgcaaaagatg

SEQ ID NO: 68819 - DNA, 103 bp, Artificial Sequence
  Synthetic Polynucleotide
taatacgactcactataggggtttttttaaatgcgtccgtagttatcaataacagaggagaattgatatgtacggacgcaacctggcggcagcgcaaaagatg

SEQ ID NO: 68820 - DNA, 103 bp, Artificial Sequence
  Synthetic Polynucleotide
taatacgactcactatagggatactgtttttttaaatgcgtccgtagttaaacagaggagataactaatgacgcatttaaacctggcggcagcgcaaaagatg

SEQ ID NO: 68821 - DNA, 103 bp, Artificial Sequence
  Synthetic Polynucleotide
taatacgactcactatagggttcaaatactgtttttttaaatgcgtccgtaacagaggagaacggacatgtttaaaaaaaacctggcggcagcgcaaaagatg

SEQ ID NO: 68822 - DNA, 103 bp, Artificial Sequence
  Synthetic Polynucleotide
taatacgactcactatagggaatatttcaaatactgtttttttaaatgcgaacagaggagacgcattatgaaaaacagtaacctggcggcagcgcaaaagatg

SEQ ID NO: 68823 - DNA, 103 bp, Artificial Sequence
  Synthetic Polynucleotide
taatacgactcactatagggcaaataatatttcaaatactgtttttttaaaacagaggagattaaaaatgcagtatttgaacctggcggcagcgcaaaagatg

SEQ ID NO: 68824 - DNA, 103 bp, Artificial Sequence
  Synthetic Polynucleotide
taatacgactcactatagggaatatcaaataatatttcaaatactgttttaacagaggagaaaaacaatgtttgaaataaacctggcggcagcgcaaaagatg

SEQ ID NO: 68825 - DNA, 103 bp, Artificial Sequence
  Synthetic Polynucleotide
taatacgactcactataggggaaagaatatcaaataatatttcaaatactaacagaggagaagtattatgaatattattaacctggcggcagcgcaaaagatg

SEQ ID NO: 68826 - DNA, 103 bp, Artificial Sequence
  Synthetic Polynucleotide
taatacgactcactatagggatgcgtggtagttatggtgtgacattcataaacagaggagatatgaaatgcacaccataaacctggcggcagcgcaaaagatg

SEQ ID NO: 68827 - DNA, 103 bp, Artificial Sequence
  Synthetic Polynucleotide
taatacgactcactatagggtagtagaaagaatatcaaataatatttcaaaacagaggagattgaaaatgtatttgataaacctggcggcagcgcaaaagatg

SEQ ID NO: 68828 - DNA, 103 bp, Artificial Sequence
  Synthetic Polynucleotide
taatacgactcactataggggtcgttagtagaaagaatatcaaataatataacagaggagaatattaatggatattcttaacctggcggcagcgcaaaagatg

SEQ ID NO: 68829 - DNA, 103 bp, Artificial Sequence
  Synthetic Polynucleotide
taatacgactcactatagggacattgtcgttagtagaaagaatatcaaataacagaggagaatttgaatgtctttctacaacctggcggcagcgcaaaagatg

SEQ ID NO: 68830 - DNA, 103 bp, Artificial Sequence
  Synthetic Polynucleotide
taatacgactcactatagggaatatacattgtcgttagtagaaagaatataacagaggagaatattcatgctactaacgaacctggcggcagcgcaaaagatg

SEQ ID NO: 68831 - DNA, 103 bp, Artificial Sequence
  Synthetic Polynucleotide
taatacgactcactataggggtataaatatacattgtcgttagtagaaagaacagaggagactttctatgaacgacaataacctggcggcagcgcaaaagatg

SEQ ID NO: 68832 - DNA, 103 bp, Artificial Sequence
  Synthetic Polynucleotide
taatacgactcactatagggtctctgtataaatatacattgtcgttagtaaacagaggagatactaaatgcaatgtataaacctggcggcagcgcaaaagatg

SEQ ID NO: 68833 - DNA, 103 bp, Artificial Sequence
  Synthetic Polynucleotide
taatacgactcactatagggagccttctctgtataaatatacattgtcgtaacagaggagaacgacaatgtatatttataacctggcggcagcgcaaaagatg

SEQ ID NO: 68834 - DNA, 103 bp, Artificial Sequence
  Synthetic Polynucleotide
taatacgactcactatagggtttatagccttctctgtataaatatacattaacagaggagaaatgtaatgttatacagaaacctggcggcagcgcaaaagatg

SEQ ID NO: 68835 - DNA, 103 bp, Artificial Sequence
  Synthetic Polynucleotide
taatacgactcactataggggttactttatagccttctctgtataaatataacagaggagaatatttatgcagagaaggaacctggcggcagcgcaaaagatg

SEQ ID NO: 68836 - DNA, 103 bp, Artificial Sequence
  Synthetic Polynucleotide
taatacgactcactataggggtatcgttactttatagccttctctgtataaacagaggagatatacaatgaaggctataaacctggcggcagcgcaaaagatg

SEQ ID NO: 68837 - DNA, 103 bp, Artificial Sequence
  Synthetic Polynucleotide
taatacgactcactatagggatggtatgcgtggtagttatggtgtgacataacagaggagaatgtcaatgcataactacaacctggcggcagcgcaaaagatg

SEQ ID NO: 68838 - DNA, 103 bp, Artificial Sequence
  Synthetic Polynucleotide
taatacgactcactatagggcaatagtatcgttactttatagccttctctaacagaggagaagagaaatgtataaagtaaacctggcggcagcgcaaaagatg

SEQ ID NO: 68839 - DNA, 103 bp, Artificial Sequence
  Synthetic Polynucleotide
taatacgactcactatagggcacttcaatagtatcgttactttatagcctaacagaggagaaggctaatgagtaacgataacctggcggcagcgcaaaagatg

SEQ ID NO: 68840 - DNA, 103 bp, Artificial Sequence
  Synthetic Polynucleotide
taatacgactcactatagggctagccacttcaatagtatcgttactttataacagaggagaataaagatgcgatactataacctggcggcagcgcaaaagatg

SEQ ID NO: 68841 - DNA, 103 bp, Artificial Sequence
  Synthetic Polynucleotide
taatacgactcactataggggtattctagccacttcaatagtatcgttacaacagaggagagtaacgatgctattgaagaacctggcggcagcgcaaaagatg

SEQ ID NO: 68842 - DNA, 103 bp, Artificial Sequence
  Synthetic Polynucleotide
taatacgactcactatagggtagttgtattctagccacttcaatagtatcaacagaggagagatactatggaagtggctaacctggcggcagcgcaaaagatg

SEQ ID NO: 68843 - DNA, 103 bp, Artificial Sequence
  Synthetic Polynucleotide
taatacgactcactatagggtgatgtagttgtattctagccacttcaataaacagaggagatattgaatgggctagaataacctggcggcagcgcaaaagatg

SEQ ID NO: 68844 - DNA, 103 bp, Artificial Sequence
  Synthetic Polynucleotide
taatacgactcactatagggttttgtgatgtagttgtattctagccacttaacagaggagaaagtggatggaatacaacaacctggcggcagcgcaaaagatg

SEQ ID NO: 68845 - DNA, 103 bp, Artificial Sequence
  Synthetic Polynucleotide
taatacgactcactatagggtgttcttttgtgatgtagttgtattctagcaacagaggagagctagaatgcaactacataacctggcggcagcgcaaaagatg

SEQ ID NO: 68846 - DNA, 103 bp, Artificial Sequence
  Synthetic Polynucleotide
taatacgactcactatagggaaagctgttcttttgtgatgtagttgtattaacagaggagaaatacaatgacatcacaaaacctggcggcagcgcaaaagatg

SEQ ID NO: 68847 - DNA, 103 bp, Artificial Sequence
  Synthetic Polynucleotide
taatacgactcactatagggatacaaaagctgttcttttgtgatgtagttaacagaggagaaactacatgacaaaagaaaacctggcggcagcgcaaaagatg

SEQ ID NO: 68848 - DNA, 103 bp, Artificial Sequence
  Synthetic Polynucleotide
taatacgactcactatagggtaagtatggtatgcgtggtagttatggtgtaacagaggagaacaccaatgctaccacgcaacctggcggcagcgcaaaagatg

SEQ ID NO: 68849 - DNA, 103 bp, Artificial Sequence
  Synthetic Polynucleotide
taatacgactcactatagggagtatatacaaaagctgttcttttgtgatgaacagaggagacatcacatgagaacagctaacctggcggcagcgcaaaagatg

SEQ ID NO: 68850 - DNA, 103 bp, Artificial Sequence
  Synthetic Polynucleotide
taatacgactcactatagggaggacagtatatacaaaagctgttcttttgaacagaggagacaaaagatgagcttttgtaacctggcggcagcgcaaaagatg

SEQ ID NO: 68851 - DNA, 103 bp, Artificial Sequence
  Synthetic Polynucleotide
taatacgactcactatagggtatacaggacagtatatacaaaagctgttcaacagaggagagaacagatgttgtatataaacctggcggcagcgcaaaagatg

SEQ ID NO: 68852 - DNA, 103 bp, Artificial Sequence
  Synthetic Polynucleotide
taatacgactcactatagggatatctatacaggacagtatatacaaaagcaacagaggagagcttttatgtatactgtcaacctggcggcagcgcaaaagatg

SEQ ID NO: 68853 - DNA, 103 bp, Artificial Sequence
  Synthetic Polynucleotide
taatacgactcactatagggattgtatatctatacaggacagtatatacaaacagaggagatgtataatgtgtcctgtaaacctggcggcagcgcaaaagatg

SEQ ID NO: 68854 - DNA, 103 bp, Artificial Sequence
  Synthetic Polynucleotide
taatacgactcactatagggtctagattgtatatctatacaggacagtataacagaggagaatactgatgtgtatagataacctggcggcagcgcaaaagatg

SEQ ID NO: 68855 - DNA, 103 bp, Artificial Sequence
  Synthetic Polynucleotide
taatacgactcactatagggttctatctagattgtatatctatacaggacaacagaggagagtcctgatgagatatacaaacctggcggcagcgcaaaagatg

SEQ ID NO: 68856 - DNA, 103 bp, Artificial Sequence
  Synthetic Polynucleotide
taatacgactcactatagggtatacttctatctagattgtatatctatacaacagaggagagtatagatgtacaatctaaacctggcggcagcgcaaaagatg

SEQ ID NO: 68857 - DNA, 103 bp, Artificial Sequence
  Synthetic Polynucleotide
taatacgactcactatagggtagtctatacttctatctagattgtatatcaacagaggagagatataatgtctagatagaacctggcggcagcgcaaaagatg

SEQ ID NO: 68858 - DNA, 103 bp, Artificial Sequence
  Synthetic Polynucleotide
taatacgactcactatagggagtagtagtctatacttctatctagattgtaacagaggagaacaatcatgatagaagtaaacctggcggcagcgcaaaagatg

SEQ ID NO: 68859 - DNA, 103 bp, Artificial Sequence
  Synthetic Polynucleotide
taatacgactcactatagggaactctaagtatggtatgcgtggtagttataacagaggagaataactatgacgcataccaacctggcggcagcgcaaaagatg

SEQ ID NO: 68860 - DNA, 103 bp, Artificial Sequence
  Synthetic Polynucleotide
taatacgactcactatagggaatagagtagtagtctatacttctatctagaacagaggagactagatatgagtatagacaacctggcggcagcgcaaaagatg

SEQ ID NO: 68861 - DNA, 103 bp, Artificial Sequence
  Synthetic Polynucleotide
taatacgactcactatagggatttgaatagagtagtagtctatacttctaaacagaggagatagaagatgagactactaaacctggcggcagcgcaaaagatg

SEQ ID NO: 68862 - DNA, 103 bp, Artificial Sequence
  Synthetic Polynucleotide
taatacgactcactataggggttttatttgaatagagtagtagtctatacaacagaggagagtatagatgactactctaaacctggcggcagcgcaaaagatg

SEQ ID NO: 68863 - DNA, 103 bp, Artificial Sequence
  Synthetic Polynucleotide
taatacgactcactatagggttatagttttatttgaatagagtagtagtcaacagaggagagactacatgtctattcaaaacctggcggcagcgcaaaagatg

SEQ ID NO: 68864 - DNA, 103 bp, Artificial Sequence
  Synthetic Polynucleotide
taatacgactcactatagggcatatttatagttttatttgaatagagtagaacagaggagactactcatgtcaaataaaaacctggcggcagcgcaaaagatg

SEQ ID NO: 68865 - DNA, 103 bp, Artificial Sequence
  Synthetic Polynucleotide
taatacgactcactatagggggatgcatatttatagttttatttgaatagaacagaggagactattcatgtaaaactataacctggcggcagcgcaaaagatg

SEQ ID NO: 68866 - DNA, 103 bp, Artificial Sequence
  Synthetic Polynucleotide
taatacgactcactatagggatgagggatgcatatttatagttttatttgaacagaggagacaaataatgctataaataaacctggcggcagcgcaaaagatg

SEQ ID NO: 68867 - DNA, 103 bp, Artificial Sequence
  Synthetic Polynucleotide
taatacgactcactatagggtatacatgagggatgcatatttatagttttaacagaggagaaaaactatgaatatgcataacctggcggcagcgcaaaagatg

SEQ ID NO: 68868 - DNA, 103 bp, Artificial Sequence
  Synthetic Polynucleotide
taatacgactcactatagggaattgtatacatgagggatgcatatttataaacagaggagatataaaatggcatccctcaacctggcggcagcgcaaaagatg

SEQ ID NO: 68869 - DNA, 103 bp, Artificial Sequence
  Synthetic Polynucleotide
taatacgactcactatagggatagaaattgtatacatgagggatgcatataacagaggagaatatgcatgcctcatgtaaacctggcggcagcgcaaaagatg

SEQ ID NO: 68870 - DNA, 103 bp, Artificial Sequence
  Synthetic Polynucleotide
taatacgactcactatagggatcataactctaagtatggtatgcgtggtaaacagaggagataccacatgtaccatactaacctggcggcagcgcaaaagatg

SEQ ID NO: 68871 - DNA, 103 bp, Artificial Sequence
  Synthetic Polynucleotide
taatacgactcactatagggatctaatagaaattgtatacatgagggatgaacagaggagacatcccatgtgtatacaaaacctggcggcagcgcaaaagatg

SEQ ID NO: 68872 - DNA, 103 bp, Artificial Sequence
  Synthetic Polynucleotide
taatacgactcactatagggttattatctaatagaaattgtatacatgagaacagaggagactcatgatgacaatttctaacctggcggcagcgcaaaagatg

SEQ ID NO: 68873 - DNA, 103 bp, Artificial Sequence
  Synthetic Polynucleotide
taatacgactcactatagggtctgtttattatctaatagaaattgtatacaacagaggagagtatacatgttctattagaacctggcggcagcgcaaaagatg

SEQ ID NO: 68874 - DNA, 103 bp, Artificial Sequence
  Synthetic Polynucleotide
taatacgactcactatagggtctattctgtttattatctaatagaaattgaacagaggagacaatttatgttagataataacctggcggcagcgcaaaagatg

SEQ ID NO: 68875 - DNA, 103 bp, Artificial Sequence
  Synthetic Polynucleotide
taatacgactcactatagggatgtttctattctgtttattatctaatagaaacagaggagatctattatgtaataaacaaacctggcggcagcgcaaaagatg

SEQ ID NO: 68876 - DNA, 103 bp, Artificial Sequence
  Synthetic Polynucleotide
taatacgactcactataggggtataatgtttctattctgtttattatctaaacagaggagatagataatgaacagaataaacctggcggcagcgcaaaagatg

SEQ ID NO: 68877 - DNA, 103 bp, Artificial Sequence
  Synthetic Polynucleotide
taatacgactcactatagggttggggtataatgtttctattctgtttattaacagaggagaaataaaatgaatagaaacaacctggcggcagcgcaaaagatg

SEQ ID NO: 68878 - DNA, 103 bp, Artificial Sequence
  Synthetic Polynucleotide
taatacgactcactatagggactggttggggtataatgtttctattctgtaacagaggagaacagaaatgaaacattataacctggcggcagcgcaaaagatg

SEQ ID NO: 68879 - DNA, 103 bp, Artificial Sequence
  Synthetic Polynucleotide
taatacgactcactatagggacataactggttggggtataatgtttctataacagaggagaatagaaatgttataccccaacctggcggcagcgcaaaagatg

SEQ ID NO: 68880 - DNA, 103 bp, Artificial Sequence
  Synthetic Polynucleotide
taatacgactcactataggggctaaacataactggttggggtataatgttaacagaggagaaacattatgccccaaccaaacctggcggcagcgcaaaagatg

SEQ ID NO: 68881 - DNA, 103 bp, Artificial Sequence
  Synthetic Polynucleotide
taatacgactcactatagggtctttatcataactctaagtatggtatgcgaacagaggagacgcataatgtacttagagaacctggcggcagcgcaaaagatg

SEQ ID NO: 68882 - DNA, 103 bp, Artificial Sequence
  Synthetic Polynucleotide
taatacgactcactataggggacacgctaaacataactggttggggtataaacagaggagatataccatgaccagttataacctggcggcagcgcaaaagatg

SEQ ID NO: 68883 - DNA, 103 bp, Artificial Sequence
  Synthetic Polynucleotide
taatacgactcactatagggatcatgacacgctaaacataactggttgggaacagaggagacccaacatgttatgtttaaacctggcggcagcgcaaaagatg

SEQ ID NO: 68884 - DNA, 103 bp, Artificial Sequence
  Synthetic Polynucleotide
taatacgactcactatagggttagtatcatgacacgctaaacataactggaacagaggagaccagttatgtttagcgtgaacctggcggcagcgcaaaagatg

SEQ ID NO: 68885 - DNA, 103 bp, Artificial Sequence
  Synthetic Polynucleotide
taatacgactcactatagggtatacttagtatcatgacacgctaaacataaacagaggagatatgttatgcgtgtcatgaacctggcggcagcgcaaaagatg

SEQ ID NO: 68886 - DNA, 103 bp, Artificial Sequence
  Synthetic Polynucleotide
taatacgactcactatagggtacattatacttagtatcatgacacgctaaaacagaggagattagcgatgcatgatactaacctggcggcagcgcaaaagatg

SEQ ID NO: 68887 - DNA, 103 bp, Artificial Sequence
  Synthetic Polynucleotide
taatacgactcactatagggttacatacattatacttagtatcatgacacaacagaggagagtgtcaatgtactaagtaaacctggcggcagcgcaaaagatg

SEQ ID NO: 68888 - DNA, 103 bp, Artificial Sequence
  Synthetic Polynucleotide
taatacgactcactatagggacgggttacatacattatacttagtatcataacagaggagaatgataatgagtataatgaacctggcggcagcgcaaaagatg

SEQ ID NO: 68889 - DNA, 103 bp, Artificial Sequence
  Synthetic Polynucleotide
taatacgactcactatagggtatgcacgggttacatacattatacttagtaacagaggagaactaagatgaatgtatgtaacctggcggcagcgcaaaagatg

SEQ ID NO: 68890 - DNA, 103 bp, Artificial Sequence
  Synthetic Polynucleotide
taatacgactcactatagggactaatatgcacgggttacatacattatacaacagaggagagtataaatgatgtaacccaacctggcggcagcgcaaaagatg

SEQ ID NO: 68891 - DNA, 103 bp, Artificial Sequence
  Synthetic Polynucleotide
taatacgactcactatagggtatatactaatatgcacgggttacatacataacagaggagaatgtatatgacccgtgcaaacctggcggcagcgcaaaagatg

SEQ ID NO: 68892 - DNA, 103 bp, Artificial Sequence
  Synthetic Polynucleotide
taatacgactcactatagggaaatatctttatcataactctaagtatggtaacagaggagaaccataatgagagttatgaacctggcggcagcgcaaaagatg

SEQ ID NO: 68893 - DNA, 103 bp, Artificial Sequence
  Synthetic Polynucleotide
taatacgactcactatagggaatgttatatactaatatgcacgggttacaaacagaggagatgtaacatgtgcatattaaacctggcggcagcgcaaaagatg

SEQ ID NO: 68894 - DNA, 103 bp, Artificial Sequence
  Synthetic Polynucleotide
taatacgactcactataggggtattaatgttatatactaatatgcacgggaacagaggagacccgtgatgattagtataaacctggcggcagcgcaaaagatg

SEQ ID NO: 68895 - DNA, 103 bp, Artificial Sequence
  Synthetic Polynucleotide
taatacgactcactatagggccatagtattaatgttatatactaatatgcaacagaggagagcatatatgtatataacaaacctggcggcagcgcaaaagatg

SEQ ID NO: 68896 - DNA, 103 bp, Artificial Sequence
  Synthetic Polynucleotide
taatacgactcactatagggatattccatagtattaatgttatatactaaaacagaggagattagtaatgaacattaataacctggcggcagcgcaaaagatg

SEQ ID NO: 68897 - DNA, 103 bp, Artificial Sequence
  Synthetic Polynucleotide
taatacgactcactatagggacactatattccatagtattaatgttatataacagaggagaatataaatgtaatactataacctggcggcagcgcaaaagatg

SEQ ID NO: 68898 - DNA, 103 bp, Artificial Sequence
  Synthetic Polynucleotide
taatacgactcactatagggaaataacactatattccatagtattaatgtaacagaggagaacattaatgctatggaataacctggcggcagcgcaaaagatg

SEQ ID NO: 68899 - DNA, 103 bp, Artificial Sequence
  Synthetic Polynucleotide
taatacgactcactatagggggtggaaataacactatattccatagtattaacagaggagaaatactatggaatatagtaacctggcggcagcgcaaaagatg

SEQ ID NO: 68900 - DNA, 103 bp, Artificial Sequence
  Synthetic Polynucleotide
taatacgactcactatagggggaatggtggaaataacactatattccataaacagaggagatatggaatgtagtgttataacctggcggcagcgcaaaagatg

SEQ ID NO: 68901 - DNA, 103 bp, Artificial Sequence
  Synthetic Polynucleotide
taatacgactcactataggggattaggaatggtggaaataacactatattaacagaggagaaatataatgttatttccaaacctggcggcagcgcaaaagatg

SEQ ID NO: 68902 - DNA, 103 bp, Artificial Sequence
  Synthetic Polynucleotide
taatacgactcactatagggtatgtgattaggaatggtggaaataacactaacagaggagaagtgttatgtccaccattaacctggcggcagcgcaaaagatg

SEQ ID NO: 68903 - DNA, 103 bp, Artificial Sequence
  Synthetic Polynucleotide
taatacgactcactatagggtattattaattcagtaatataaactaataaaacagaggagattattaatgtatattactaacctggcggcagcgcaaaagatg

SEQ ID NO: 68904 - DNA, 103 bp, Artificial Sequence
  Synthetic Polynucleotide
taatacgactcactatagggaggataaatatctttatcataactctaagtaacagaggagaacttagatgtatgataaaaacctggcggcagcgcaaaagatg

SEQ ID NO: 68905 - DNA, 103 bp, Artificial Sequence
  Synthetic Polynucleotide
taatacgactcactatagggttaattatgtgattaggaatggtggaaataaacagaggagatatttcatgcattcctaaaacctggcggcagcgcaaaagatg

SEQ ID NO: 68906 - DNA, 103 bp, Artificial Sequence
  Synthetic Polynucleotide
taatacgactcactatagggtgtaattaattatgtgattaggaatggtggaacagaggagaccaccaatgctaatcacaaacctggcggcagcgcaaaagatg

SEQ ID NO: 68907 - DNA, 103 bp, Artificial Sequence
  Synthetic Polynucleotide
taatacgactcactatagggggatgtgtaattaattatgtgattaggaataacagaggagaattcctatgcacataattaacctggcggcagcgcaaaagatg

SEQ ID NO: 68908 - DNA, 103 bp, Artificial Sequence
  Synthetic Polynucleotide
taatacgactcactatagggatcgcggatgtgtaattaattatgtgattaaacagaggagataatcaatgaattaattaaacctggcggcagcgcaaaagatg

SEQ ID NO: 68909 - DNA, 103 bp, Artificial Sequence
  Synthetic Polynucleotide
taatacgactcactatagggctacaatcgcggatgtgtaattaattatgtaacagaggagaacataaatgattacacataacctggcggcagcgcaaaagatg

SEQ ID NO: 68910 - DNA, 103 bp, Artificial Sequence
  Synthetic Polynucleotide
taatacgactcactatagggattatctacaatcgcggatgtgtaattaataacagaggagaattaatatgacatccgcgaacctggcggcagcgcaaaagatg

SEQ ID NO: 68911 - DNA, 103 bp, Artificial Sequence
  Synthetic Polynucleotide
taatacgactcactatagggatttcattatctacaatcgcggatgtgtaaaacagaggagattacacatgcgcgattgtaacctggcggcagcgcaaaagatg

SEQ ID NO: 68912 - DNA, 103 bp, Artificial Sequence
  Synthetic Polynucleotide
taatacgactcactatagggttattatttcattatctacaatcgcggatgaacagaggagacatccgatgttgtagataaacctggcggcagcgcaaaagatg

SEQ ID NO: 68913 - DNA, 103 bp, Artificial Sequence
  Synthetic Polynucleotide
taatacgactcactatagggagctattattatttcattatctacaatcgcaacagaggagagcgattatggataatgaaaacctggcggcagcgcaaaagatg

SEQ ID NO: 68914 - DNA, 103 bp, Artificial Sequence
  Synthetic Polynucleotide
taatacgactcactatagggcctccagctattattatttcattatctacaaacagaggagatgtagaatgtgaaataataacctggcggcagcgcaaaagatg

SEQ ID NO: 68915 - DNA, 103 bp, Artificial Sequence
  Synthetic Polynucleotide
taatacgactcactatagggccctaaggataaatatctttatcataactcaacagaggagagagttaatgtaaagatataacctggcggcagcgcaaaagatg

SEQ ID NO: 68916 - DNA, 103 bp, Artificial Sequence
  Synthetic Polynucleotide
taatacgactcactatagggtatatcctccagctattattatttcattataacagaggagaataatgatgtaataatagaacctggcggcagcgcaaaagatg

SEQ ID NO: 68917 - DNA, 103 bp, Artificial Sequence
  Synthetic Polynucleotide
taatacgactcactatagggaaagttatatcctccagctattattatttcaacagaggagagaaataatgatagctggaaacctggcggcagcgcaaaagatg

SEQ ID NO: 68918 - DNA, 103 bp, Artificial Sequence
  Synthetic Polynucleotide
taatacgactcactatagggttattaaagttatatcctccagctattattaacagaggagaaataatatgtggaggataaacctggcggcagcgcaaaagatg

SEQ ID NO: 68919 - DNA, 103 bp, Artificial Sequence
  Synthetic Polynucleotide
taatacgactcactatagggatggattattaaagttatatcctccagctaaacagaggagatagctgatggatataactaacctggcggcagcgcaaaagatg

SEQ ID NO: 68920 - DNA, 103 bp, Artificial Sequence
  Synthetic Polynucleotide
taatacgactcactatagggtaacgatggattattaaagttatatcctccaacagaggagaggaggaatgaactttaataacctggcggcagcgcaaaagatg

SEQ ID NO: 68921 - DNA, 103 bp, Artificial Sequence
  Synthetic Polynucleotide
taatacgactcactatagggttgtttaacgatggattattaaagttatataacagaggagaatataaatgtaataatccaacctggcggcagcgcaaaagatg

SEQ ID NO: 68922 - DNA, 103 bp, Artificial Sequence
  Synthetic Polynucleotide
taatacgactcactatagggataccttgtttaacgatggattattaaagtaacagaggagaactttaatgatccatcgtaacctggcggcagcgcaaaagatg

SEQ ID NO: 68923 - DNA, 103 bp, Artificial Sequence
  Synthetic Polynucleotide
taatacgactcactatagggtttatataccttgtttaacgatggattattaacagaggagaaataatatgtcgttaaacaacctggcggcagcgcaaaagatg

SEQ ID NO: 68924 - DNA, 103 bp, Artificial Sequence
  Synthetic Polynucleotide
taatacgactcactatagggtttattttatataccttgtttaacgatggaaacagaggagatccatcatgaaacaaggtaacctggcggcagcgcaaaagatg

SEQ ID NO: 68925 - DNA, 103 bp, Artificial Sequence
  Synthetic Polynucleotide
taatacgactcactatagggcaatgtttattttatataccttgtttaacgaacagaggagacgttaaatgaggtatataaacctggcggcagcgcaaaagatg

SEQ ID NO: 68926 - DNA, 103 bp, Artificial Sequence
  Synthetic Polynucleotide
taatacgactcactatagggctgcaccctaaggataaatatctttatcataacagaggagaatgataatgatatttatcaacctggcggcagcgcaaaagatg

SEQ ID NO: 68927 - DNA, 103 bp, Artificial Sequence
  Synthetic Polynucleotide
taatacgactcactataggggttctcaatgtttattttatataccttgttaacagaggagaaacaagatgtataaaataaacctggcggcagcgcaaaagatg

SEQ ID NO: 68928 - DNA, 103 bp, Artificial Sequence
  Synthetic Polynucleotide
taatacgactcactatagggattttgttctcaatgtttattttatataccaacagaggagaggtataatgaataaacataacctggcggcagcgcaaaagatg

SEQ ID NO: 68929 - DNA, 103 bp, Artificial Sequence
  Synthetic Polynucleotide
taatacgactcactatagggcatgtattttgttctcaatgtttattttataacagaggagaataaaaatgacattgagaaacctggcggcagcgcaaaagatg

SEQ ID NO: 68930 - DNA, 103 bp, Artificial Sequence
  Synthetic Polynucleotide
taatacgactcactatagggttcgacatgtattttgttctcaatgtttataacagaggagaataaacatggagaacaaaaacctggcggcagcgcaaaagatg

SEQ ID NO: 68931 - DNA, 103 bp, Artificial Sequence
  Synthetic Polynucleotide
taatacgactcactataggggggagttcgacatgtattttgttctcaatgaacagaggagacattgaatgcaaaatacaaacctggcggcagcgcaaaagatg

SEQ ID NO: 68932 - DNA, 103 bp, Artificial Sequence
  Synthetic Polynucleotide
taatacgactcactatagggtgggtgggagttcgacatgtattttgttctaacagaggagaagaacaatgtacatgtcgaacctggcggcagcgcaaaagatg

SEQ ID NO: 68933 - DNA, 103 bp, Artificial Sequence
  Synthetic Polynucleotide
taatacgactcactatagggtatcatgggtgggagttcgacatgtattttaacagaggagaaaaataatggtcgaactcaacctggcggcagcgcaaaagatg

SEQ ID NO: 68934 - DNA, 103 bp, Artificial Sequence
  Synthetic Polynucleotide
taatacgactcactatagggttcattatcatgggtgggagttcgacatgtaacagaggagaacatgtatgactcccaccaacctggcggcagcgcaaaagatg

SEQ ID NO: 68935 - DNA, 103 bp, Artificial Sequence
  Synthetic Polynucleotide
taatacgactcactatagggatctattcattatcatgggtgggagttcgaaacagaggagatcgaacatgcacccatgaaacctggcggcagcgcaaaagatg

SEQ ID NO: 68936 - DNA, 103 bp, Artificial Sequence
  Synthetic Polynucleotide
taatacgactcactatagggacgacatctattcattatcatgggtgggagaacagaggagactcccaatgatgataatgaacctggcggcagcgcaaaagatg

SEQ ID NO: 68937 - DNA, 103 bp, Artificial Sequence
  Synthetic Polynucleotide
taatacgactcactatagggattacctgcaccctaaggataaatatctttaacagaggagaaaagatatgtatccttagaacctggcggcagcgcaaaagatg

SEQ ID NO: 68938 - DNA, 103 bp, Artificial Sequence
  Synthetic Polynucleotide
taatacgactcactataggggaaaaacgacatctattcattatcatgggtaacagaggagaacccatatgaatgaatagaacctggcggcagcgcaaaagatg

SEQ ID NO: 68939 - DNA, 103 bp, Artificial Sequence
  Synthetic Polynucleotide
taatacgactcactatagggccaaagaaaaacgacatctattcattatcaaacagaggagatgataaatgatagatgtcaacctggcggcagcgcaaaagatg

SEQ ID NO: 68940 - DNA, 103 bp, Artificial Sequence
  Synthetic Polynucleotide
taatacgactcactatagggtacagccaaagaaaaacgacatctattcataacagaggagaatgaatatgtgtcgttttaacctggcggcagcgcaaaagatg

SEQ ID NO: 68941 - DNA, 103 bp, Artificial Sequence
  Synthetic Polynucleotide
taatacgactcactatagggtcgattacagccaaagaaaaacgacatctaaacagaggagatagatgatgtttttctttaacctggcggcagcgcaaaagatg

SEQ ID NO: 68942 - DNA, 103 bp, Artificial Sequence
  Synthetic Polynucleotide
taatacgactcactatagggtgttatcgattacagccaaagaaaaacgacaacagaggagagtcgttatgctttggctgaacctggcggcagcgcaaaagatg

SEQ ID NO: 68943 - DNA, 103 bp, Artificial Sequence
  Synthetic Polynucleotide
taatacgactcactatagggaattgtgttatcgattacagccaaagaaaaaacagaggagattttctatggctgtaatcaacctggcggcagcgcaaaagatg

SEQ ID NO: 68944 - DNA, 103 bp, Artificial Sequence
  Synthetic Polynucleotide
taatacgactcactataggggcataaattgtgttatcgattacagccaaaaacagaggagatttggcatgaatcgataaaacctggcggcagcgcaaaagatg

SEQ ID NO: 68945 - DNA, 103 bp, Artificial Sequence
  Synthetic Polynucleotide
taatacgactcactatagggctatagcataaattgtgttatcgattacagaacagaggagactgtaaatgataacacaaaacctggcggcagcgcaaaagatg

SEQ ID NO: 68946 - DNA, 103 bp, Artificial Sequence
  Synthetic Polynucleotide
taatacgactcactatagggaccacctatagcataaattgtgttatcgataacagaggagaatcgatatgacaatttataacctggcggcagcgcaaaagatg

SEQ ID NO: 68947 - DNA, 103 bp, Artificial Sequence
  Synthetic Polynucleotide
taatacgactcactatagggttttgaccacctatagcataaattgtgttaaacagaggagataacacatgttatgctataacctggcggcagcgcaaaagatg

SEQ ID NO: 68948 - DNA, 103 bp, Artificial Sequence
  Synthetic Polynucleotide
taatacgactcactatagggtccccattacctgcaccctaaggataaataaacagaggagatatttaatgttagggtgcaacctggcggcagcgcaaaagatg

SEQ ID NO: 68949 - DNA, 103 bp, Artificial Sequence
  Synthetic Polynucleotide
taatacgactcactatagggtcagtttttgaccacctatagcataaattgaacagaggagacaatttatgctataggtgaacctggcggcagcgcaaaagatg

SEQ ID NO: 68950 - DNA, 103 bp, Artificial Sequence
  Synthetic Polynucleotide
taatacgactcactatagggaaacttcagtttttgaccacctatagcataaacagaggagatatgctatgggtggtcaaaacctggcggcagcgcaaaagatg

SEQ ID NO: 68951 - DNA, 103 bp, Artificial Sequence
  Synthetic Polynucleotide
taatacgactcactatagggatgttaaacttcagtttttgaccacctataaacagaggagatataggatgtcaaaaactaacctggcggcagcgcaaaagatg

SEQ ID NO: 68952 - DNA, 103 bp, Artificial Sequence
  Synthetic Polynucleotide
taatacgactcactatagggaaataatgttaaacttcagtttttgaccacaacagaggagagtggtcatgaactgaagtaacctggcggcagcgcaaaagatg

SEQ ID NO: 68953 - DNA, 103 bp, Artificial Sequence
  Synthetic Polynucleotide
taatacgactcactatagggtaaataaataatgttaaacttcagtttttgaacagaggagacaaaaaatgaagtttaacaacctggcggcagcgcaaaagatg

SEQ ID NO: 68954 - DNA, 103 bp, Artificial Sequence
  Synthetic Polynucleotide
taatacgactcactatagggtatcataaataaataatgttaaacttcagtaacagaggagaactgaaatgtaacattataacctggcggcagcgcaaaagatg

SEQ ID NO: 68955 - DNA, 103 bp, Artificial Sequence
  Synthetic Polynucleotide
taatacgactcactatagggatatatatcataaataaataatgttaaactaacagaggagaagtttaatgttatttattaacctggcggcagcgcaaaagatg

SEQ ID NO: 68956 - DNA, 103 bp, Artificial Sequence
  Synthetic Polynucleotide
taatacgactcactatagggatataatatatatcataaataaataatgttaacagaggagaaacattatgtatttatgaaacctggcggcagcgcaaaagatg

SEQ ID NO: 68957 - DNA, 103 bp, Artificial Sequence
  Synthetic Polynucleotide
taatacgactcactatagggccgatatataatatatatcataaataaataaacagaggagatatttaatgatgatatataacctggcggcagcgcaaaagatg

SEQ ID NO: 68958 - DNA, 103 bp, Artificial Sequence
  Synthetic Polynucleotide
taatacgactcactatagggcgataccgatatataatatatatcataaataacagaggagaatttatatgatatattataacctggcggcagcgcaaaagatg

SEQ ID NO: 68959 - DNA, 103 bp, Artificial Sequence
  Synthetic Polynucleotide
taatacgactcactatagggattaatccccattacctgcaccctaaggataacagaggagaatccttatggtgcaggtaaacctggcggcagcgcaaaagatg

SEQ ID NO: 68960 - DNA, 103 bp, Artificial Sequence
  Synthetic Polynucleotide
taatacgactcactatagggaataacgataccgatatataatatatatcaaacagaggagatgatatatgttatatatcaacctggcggcagcgcaaaagatg

SEQ ID NO: 68961 - DNA, 103 bp, Artificial Sequence
  Synthetic Polynucleotide
taatacgactcactatagggcaaacaataacgataccgatatataatataaacagaggagatatattatgtatcggtataacctggcggcagcgcaaaagatg

SEQ ID NO: 68962 - DNA, 103 bp, Artificial Sequence
  Synthetic Polynucleotide
taatacgactcactatagggtagaccaaacaataacgataccgatatataaacagaggagatatataatggtatcgttaaacctggcggcagcgcaaaagatg

SEQ ID NO: 68963 - DNA, 103 bp, Artificial Sequence
  Synthetic Polynucleotide
taatacgactcactatagggtggtatagaccaaacaataacgataccgataacagaggagaatcggtatggttattgttaacctggcggcagcgcaaaagatg

SEQ ID NO: 68964 - DNA, 103 bp, Artificial Sequence
  Synthetic Polynucleotide
taatacgactcactatagggatccatggtatagaccaaacaataacgataaacagaggagatatcgtatgtgtttggtcaacctggcggcagcgcaaaagatg

SEQ ID NO: 68965 - DNA, 103 bp, Artificial Sequence
  Synthetic Polynucleotide
taatacgactcactatagggaagatatccatggtatagaccaaacaataaaacagaggagattattgatgggtctatacaacctggcggcagcgcaaaagatg

SEQ ID NO: 68966 - DNA, 103 bp, Artificial Sequence
  Synthetic Polynucleotide
taatacgactcactatagggctttaaagatatccatggtatagaccaaacaacagaggagagtttggatgataccatggaacctggcggcagcgcaaaagatg

SEQ ID NO: 68967 - DNA, 103 bp, Artificial Sequence
  Synthetic Polynucleotide
taatacgactcactatagggtagttctttaaagatatccatggtatagacaacagaggagagtctatatgatggatatcaacctggcggcagcgcaaaagatg

SEQ ID NO: 68968 - DNA, 103 bp, Artificial Sequence
  Synthetic Polynucleotide
taatacgactcactatagggaagattagttctttaaagatatccatggtaaacagaggagataccatatgtatctttaaaacctggcggcagcgcaaaagatg

SEQ ID NO: 68969 - DNA, 103 bp, Artificial Sequence
  Synthetic Polynucleotide
taatacgactcactatagggattttaagattagttctttaaagatatccaaacagaggagatggataatgttaaagaacaacctggcggcagcgcaaaagatg

SEQ ID NO: 68970 - DNA, 103 bp, Artificial Sequence
  Synthetic Polynucleotide
taatacgactcactatagggcaaagattaatccccattacctgcaccctaaacagaggagatagggtatgggtaatgggaacctggcggcagcgcaaaagatg

SEQ ID NO: 68971 - DNA, 103 bp, Artificial Sequence
  Synthetic Polynucleotide
taatacgactcactatagggagggtattttaagattagttctttaaagataacagaggagaatctttatggaactaatcaacctggcggcagcgcaaaagatg

SEQ ID NO: 68972 - DNA, 103 bp, Artificial Sequence
  Synthetic Polynucleotide
taatacgactcactatagggtcatcagggtattttaagattagttctttaaacagaggagataaagaatgaatcttaaaaacctggcggcagcgcaaaagatg

SEQ ID NO: 68973 - DNA, 103 bp, Artificial Sequence
  Synthetic Polynucleotide
taatacgactcactatagggcattttcatcagggtattttaagattagttaacagaggagaaactaaatgtaaaataccaacctggcggcagcgcaaaagatg

SEQ ID NO: 68974 - DNA, 103 bp, Artificial Sequence
  Synthetic Polynucleotide
taatacgactcactatagggcaaaacattttcatcagggtattttaagataacagaggagaatcttaatgtaccctgataacctggcggcagcgcaaaagatg

SEQ ID NO: 68975 - DNA, 103 bp, Artificial Sequence
  Synthetic Polynucleotide
taatacgactcactataggggaaatcaaaacattttcatcagggtattttaacagaggagaaaaataatgtgatgaaaaaacctggcggcagcgcaaaagatg

SEQ ID NO: 68976 - DNA, 103 bp, Artificial Sequence
  Synthetic Polynucleotide
taatacgactcactatagggctggagaaatcaaaacattttcatcagggtaacagaggagaaccctgatgaaaatgtttaacctggcggcagcgcaaaagatg

SEQ ID NO: 68977 - DNA, 103 bp, Artificial Sequence
  Synthetic Polynucleotide
taatacgactcactatagggggaaactggagaaatcaaaacattttcatcaacagaggagagatgaaatggttttgattaacctggcggcagcgcaaaagatg

SEQ ID NO: 68978 - DNA, 103 bp, Artificial Sequence
  Synthetic Polynucleotide
taatacgactcactatagggaaaatggaaactggagaaatcaaaacatttaacagaggagaaaatgtatggatttctccaacctggcggcagcgcaaaagatg

SEQ ID NO: 68979 - DNA, 103 bp, Artificial Sequence
  Synthetic Polynucleotide
taatacgactcactatagggtagataaaatggaaactggagaaatcaaaaaacagaggagattttgaatgctccagtttaacctggcggcagcgcaaaagatg

SEQ ID NO: 68980 - DNA, 103 bp, Artificial Sequence
  Synthetic Polynucleotide
taatacgactcactatagggtaaagtagataaaatggaaactggagaaataacagaggagaatttctatggtttccattaacctggcggcagcgcaaaagatg

SEQ ID NO: 68981 - DNA, 103 bp, Artificial Sequence
  Synthetic Polynucleotide
taatacgactcactatagggtccaacaaagattaatccccattacctgcaaacagaggagatgcaggatgtggggattaaacctggcggcagcgcaaaagatg

SEQ ID NO: 68982 - DNA, 103 bp, Artificial Sequence
  Synthetic Polynucleotide
taatacgactcactatagggatagataaagtagataaaatggaaactggaaacagaggagatccagtatgcattttatcaacctggcggcagcgcaaaagatg

SEQ ID NO: 68983 - DNA, 103 bp, Artificial Sequence
  Synthetic Polynucleotide
taatacgactcactatagggtcagaatagataaagtagataaaatggaaaaacagaggagatttccaatgtatctacttaacctggcggcagcgcaaaagatg

SEQ ID NO: 68984 - DNA, 103 bp, Artificial Sequence
  Synthetic Polynucleotide
taatacgactcactatagggatgattcagaatagataaagtagataaaataacagaggagaattttaatgactttatctaacctggcggcagcgcaaaagatg

SEQ ID NO: 68985 - DNA, 103 bp, Artificial Sequence
  Synthetic Polynucleotide
taatacgactcactataggggctccatgattcagaatagataaagtagataacagaggagaatctacatgatctattctaacctggcggcagcgcaaaagatg

SEQ ID NO: 68986 - DNA, 103 bp, Artificial Sequence
  Synthetic Polynucleotide
taatacgactcactatagggcagctgctccatgattcagaatagataaagaacagaggagactttatatgttctgaatcaacctggcggcagcgcaaaagatg

SEQ ID NO: 68987 - DNA, 103 bp, Artificial Sequence
  Synthetic Polynucleotide
taatacgactcactatagggagaaccagctgctccatgattcagaatagaaacagaggagatctattatgaatcatggaaacctggcggcagcgcaaaagatg

SEQ ID NO: 68988 - DNA, 103 bp, Artificial Sequence
  Synthetic Polynucleotide
taatacgactcactataggggctgtagaaccagctgctccatgattcagaaacagaggagatctgaaatgtggagcagcaacctggcggcagcgcaaaagatg

SEQ ID NO: 68989 - DNA, 103 bp, Artificial Sequence
  Synthetic Polynucleotide
taatacgactcactataggggttcagctgtagaaccagctgctccatgataacagaggagaatcatgatgcagctggttaacctggcggcagcgcaaaagatg

SEQ ID NO: 68990 - DNA, 103 bp, Artificial Sequence
  Synthetic Polynucleotide
taatacgactcactatagggtagttgttcagctgtagaaccagctgctccaacagaggagaggagcaatgggttctacaaacctggcggcagcgcaaaagatg

SEQ ID NO: 68991 - DNA, 103 bp, Artificial Sequence
  Synthetic Polynucleotide
taatacgactcactatagggtttgatagttgttcagctgtagaaccagctaacagaggagaagctggatgtacagctgaaacctggcggcagcgcaaaagatg

SEQ ID NO: 68992 - DNA, 103 bp, Artificial Sequence
  Synthetic Polynucleotide
taatacgactcactatagggactgatccaacaaagattaatccccattacaacagaggagagtaatgatgattaatcttaacctggcggcagcgcaaaagatg

SEQ ID NO: 68993 - DNA, 103 bp, Artificial Sequence
  Synthetic Polynucleotide
taatacgactcactatagggtatattttgatagttgttcagctgtagaacaacagaggagagttctaatgctgaacaacaacctggcggcagcgcaaaagatg

SEQ ID NO: 68994 - DNA, 103 bp, Artificial Sequence
  Synthetic Polynucleotide
taatacgactcactatagggctctatatattttgatagttgttcagctgtaacagaggagaacagctatgcaactatcaaacctggcggcagcgcaaaagatg

SEQ ID NO: 68995 - DNA, 103 bp, Artificial Sequence
  Synthetic Polynucleotide
taatacgactcactatagggacattctctatatattttgatagttgttcaaacagaggagatgaacaatgatcaaaataaacctggcggcagcgcaaaagatg

SEQ ID NO: 68996 - DNA, 103 bp, Artificial Sequence
  Synthetic Polynucleotide
taatacgactcactatagggcattcacattctctatatattttgatagttaacagaggagaaactatatgaatatatagaacctggcggcagcgcaaaagatg

SEQ ID NO: 68997 - DNA, 103 bp, Artificial Sequence
  Synthetic Polynucleotide
taatacgactcactatagggattttcattcacattctctatatattttgaaacagaggagatcaaaaatgatagagaataacctggcggcagcgcaaaagatg

SEQ ID NO: 68998 - DNA, 103 bp, Artificial Sequence
  Synthetic Polynucleotide
taatacgactcactatagggggtgtattttcattcacattctctatatataacagaggagaatatatatggaatgtgaaaacctggcggcagcgcaaaagatg

SEQ ID NO: 68999 - DNA, 103 bp, Artificial Sequence
  Synthetic Polynucleotide
taatacgactcactatagggcatcgggtgtattttcattcacattctctaaacagaggagatagagaatgtgaatgaaaaacctggcggcagcgcaaaagatg

SEQ ID NO: 69000 - DNA, 103 bp, Artificial Sequence
  Synthetic Polynucleotide
taatacgactcactatagggcttatcatcgggtgtattttcattcacattaacagaggagaaatgtgatggaaaatacaaacctggcggcagcgcaaaagatg

SEQ ID NO: 69001 - DNA, 103 bp, Artificial Sequence
  Synthetic Polynucleotide
taatacgactcactatagggtccttcttatcatcgggtgtattttcattcaacagaggagagaatgaatgtacacccgaaacctggcggcagcgcaaaagatg

SEQ ID NO: 69002 - DNA, 103 bp, Artificial Sequence
  Synthetic Polynucleotide
taatacgactcactatagggtgtcatccttcttatcatcgggtgtattttaacagaggagaaaaataatgccgatgataaacctggcggcagcgcaaaagatg

SEQ ID NO: 69003 - DNA, 103 bp, Artificial Sequence
  Synthetic Polynucleotide
taatacgactcactatagggtagagactgatccaacaaagattaatccccaacagaggagaggggatatgtctttgttgaacctggcggcagcgcaaaagatg

SEQ ID NO: 69004 - DNA, 103 bp, Artificial Sequence
  Synthetic Polynucleotide
taatacgactcactatagggattattgtcatccttcttatcatcgggtgtaacagaggagaacacccatggataagaagaacctggcggcagcgcaaaagatg

SEQ ID NO: 69005 - DNA, 103 bp, Artificial Sequence
  Synthetic Polynucleotide
taatacgactcactatagggatgtcattattgtcatccttcttatcatcgaacagaggagacgatgaatggaaggatgaaacctggcggcagcgcaaaagatg

SEQ ID NO: 69006 - DNA, 103 bp, Artificial Sequence
  Synthetic Polynucleotide
taatacgactcactatagggcgtccatgtcattattgtcatccttcttataacagaggagaataagaatgatgacaataaacctggcggcagcgcaaaagatg

SEQ ID NO: 69007 - DNA, 103 bp, Artificial Sequence
  Synthetic Polynucleotide
taatacgactcactatagggatctacgtccatgtcattattgtcatccttaacagaggagaaaggatatgaataatgacaacctggcggcagcgcaaaagatg

SEQ ID NO: 69008 - DNA, 103 bp, Artificial Sequence
  Synthetic Polynucleotide
taatacgactcactatagggggaacatctacgtccatgtcattattgtcaaacagaggagatgacaaatgtgacatggaaacctggcggcagcgcaaaagatg

SEQ ID NO: 69009 - DNA, 103 bp, Artificial Sequence
  Synthetic Polynucleotide
taatacgactcactatagggaatacggaacatctacgtccatgtcattataacagaggagaataatgatgtggacgtagaacctggcggcagcgcaaaagatg

SEQ ID NO: 69010 - DNA, 103 bp, Artificial Sequence
  Synthetic Polynucleotide
taatacgactcactatagggcgcacaatacggaacatctacgtccatgtcaacagaggagagacatgatggtagatgttaacctggcggcagcgcaaaagatg

SEQ ID NO: 69011 - DNA, 103 bp, Artificial Sequence
  Synthetic Polynucleotide
taatacgactcactatagggagtgtcgcacaatacggaacatctacgtccaacagaggagaggacgtatgtgttccgtaaacctggcggcagcgcaaaagatg

SEQ ID NO: 69012 - DNA, 103 bp, Artificial Sequence
  Synthetic Polynucleotide
taatacgactcactatagggtagctagtgtcgcacaatacggaacatctaaacagaggagatagatgatgcgtattgtgaacctggcggcagcgcaaaagatg

SEQ ID NO: 69013 - DNA, 103 bp, Artificial Sequence
  Synthetic Polynucleotide
taatacgactcactatagggtgcaatagctagtgtcgcacaatacggaacaacagaggagagttccgatgtgtgcgacaaacctggcggcagcgcaaaagatg

SEQ ID NO: 69014 - DNA, 103 bp, Artificial Sequence
  Synthetic Polynucleotide
taatacgactcactatagggttttatattattaattcagtaatataaactaacagaggagaagtttaatgtactgaattaacctggcggcagcgcaaaagatg

SEQ ID NO: 69015 - DNA, 103 bp, Artificial Sequence
  Synthetic Polynucleotide
taatacgactcactatagggtaacttagagactgatccaacaaagattaaaacagaggagattaatcatggttggatcaaacctggcggcagcgcaaaagatg

SEQ ID NO: 69016 - DNA, 103 bp, Artificial Sequence
  Synthetic Polynucleotide
taatacgactcactatagggttatttgcaatagctagtgtcgcacaatacaacagaggagagtattgatggacactagcaacctggcggcagcgcaaaagatg

SEQ ID NO: 69017 - DNA, 103 bp, Artificial Sequence
  Synthetic Polynucleotide
taatacgactcactatagggatattttatttgcaatagctagtgtcgcacaacagaggagagtgcgaatgtagctattgaacctggcggcagcgcaaaagatg

SEQ ID NO: 69018 - DNA, 103 bp, Artificial Sequence
  Synthetic Polynucleotide
taatacgactcactatagggacagtatattttatttgcaatagctagtgtaacagaggagaacactaatgattgcaaataacctggcggcagcgcaaaagatg

SEQ ID NO: 69019 - DNA, 103 bp, Artificial Sequence
  Synthetic Polynucleotide
taatacgactcactatagggtcgctacagtatattttatttgcaatagctaacagaggagaagctatatgaaataaaataacctggcggcagcgcaaaagatg

SEQ ID NO: 69020 - DNA, 103 bp, Artificial Sequence
  Synthetic Polynucleotide
taatacgactcactatagggtactatcgctacagtatattttatttgcaaaacagaggagattgcaaatgaaatatactaacctggcggcagcgcaaaagatg

SEQ ID NO: 69021 - DNA, 103 bp, Artificial Sequence
  Synthetic Polynucleotide
taatacgactcactatagggctcgatactatcgctacagtatattttattaacagaggagaaataaaatgtactgtagcaacctggcggcagcgcaaaagatg

SEQ ID NO: 69022 - DNA, 103 bp, Artificial Sequence
  Synthetic Polynucleotide
taatacgactcactatagggtggaactcgatactatcgctacagtatattaacagaggagaaatataatgtagcgatagaacctggcggcagcgcaaaagatg

SEQ ID NO: 69023 - DNA, 103 bp, Artificial Sequence
  Synthetic Polynucleotide
taatacgactcactatagggaggcgtggaactcgatactatcgctacagtaacagaggagaactgtaatgatagtatcgaacctggcggcagcgcaaaagatg

SEQ ID NO: 69024 - DNA, 103 bp, Artificial Sequence
  Synthetic Polynucleotide
taatacgactcactataggggaaggaggcgtggaactcgatactatcgctaacagaggagaagcgatatgatcgagttcaacctggcggcagcgcaaaagatg

SEQ ID NO: 69025 - DNA, 103 bp, Artificial Sequence
  Synthetic Polynucleotide
taatacgactcactatagggtgtaggaaggaggcgtggaactcgatactaaacagaggagatagtatatggttccacgcaacctggcggcagcgcaaaagatg

SEQ ID NO: 69026 - DNA, 103 bp, Artificial Sequence
  Synthetic Polynucleotide
taatacgactcactatagggtgtgttaacttagagactgatccaacaaagaacagaggagactttgtatgatcagtctcaacctggcggcagcgcaaaagatg

SEQ ID NO: 69027 - DNA, 103 bp, Artificial Sequence
  Synthetic Polynucleotide
taatacgactcactatagggttttttgtaggaaggaggcgtggaactcgaaacagaggagatcgagtatgacgcctcctaacctggcggcagcgcaaaagatg

SEQ ID NO: 69028 - DNA, 103 bp, Artificial Sequence
  Synthetic Polynucleotide
taatacgactcactatagggttttattttttgtaggaaggaggcgtggaaaacagaggagattccacatgtccttcctaaacctggcggcagcgcaaaagatg

SEQ ID NO: 69029 - DNA, 103 bp, Artificial Sequence
  Synthetic Polynucleotide
taatacgactcactatagggtcatcttttattttttgtaggaaggaggcgaacagaggagacgcctcatgcctacaaaaaacctggcggcagcgcaaaagatg

SEQ ID NO: 69030 - DNA, 103 bp, Artificial Sequence
  Synthetic Polynucleotide
taatacgactcactataggggaaaatcatcttttattttttgtaggaaggaacagaggagaccttccatgaaaaaataaaacctggcggcagcgcaaaagatg

SEQ ID NO: 69031 - DNA, 103 bp, Artificial Sequence
  Synthetic Polynucleotide
taatacgactcactatagggagtttgaaaatcatcttttattttttgtagaacagaggagactacaaatgataaaagataacctggcggcagcgcaaaagatg

SEQ ID NO: 69032 - DNA, 103 bp, Artificial Sequence
  Synthetic Polynucleotide
taatacgactcactatagggtttacagtttgaaaatcatcttttatttttaacagaggagaaaaaatatgagatgatttaacctggcggcagcgcaaaagatg

SEQ ID NO: 69033 - DNA, 103 bp, Artificial Sequence
  Synthetic Polynucleotide
taatacgactcactatagggtaaagtttacagtttgaaaatcatcttttaaacagaggagataaaagatgattttcaaaaacctggcggcagcgcaaaagatg

SEQ ID NO: 69034 - DNA, 103 bp, Artificial Sequence
  Synthetic Polynucleotide
taatacgactcactatagggattattaaagtttacagtttgaaaatcatcaacagaggagagatgatatgcaaactgtaaacctggcggcagcgcaaaagatg

SEQ ID NO: 69035 - DNA, 103 bp, Artificial Sequence
  Synthetic Polynucleotide
taatacgactcactatagggttagcattattaaagtttacagtttgaaaaaacagaggagattttcaatgtgtaaacttaacctggcggcagcgcaaaagatg

SEQ ID NO: 69036 - DNA, 103 bp, Artificial Sequence
  Synthetic Polynucleotide
taatacgactcactatagggtttggttagcattattaaagtttacagtttaacagaggagaaaactgatgactttaataaacctggcggcagcgcaaaagatg

SEQ ID NO: 69037 - DNA, 103 bp, Artificial Sequence
  Synthetic Polynucleotide
taatacgactcactatagggtgacatgtgttaacttagagactgatccaaaacagaggagattggatatgtctctaagtaacctggcggcagcgcaaaagatg

SEQ ID NO: 69038 - DNA, 103 bp, Artificial Sequence
  Synthetic Polynucleotide
taatacgactcactatagggctttgtttggttagcattattaaagtttacaacagaggagagtaaacatgaataatgctaacctggcggcagcgcaaaagatg

SEQ ID NO: 69039 - DNA, 103 bp, Artificial Sequence
  Synthetic Polynucleotide
taatacgactcactatagggagttcctttgtttggttagcattattaaagaacagaggagactttaaatgtgctaaccaaacctggcggcagcgcaaaagatg

SEQ ID NO: 69040 - DNA, 103 bp, Artificial Sequence
  Synthetic Polynucleotide
taatacgactcactatagggtgattagttcctttgtttggttagcattataacagaggagaataatgatgaccaaacaaaacctggcggcagcgcaaaagatg

SEQ ID NO: 69041 - DNA, 103 bp, Artificial Sequence
  Synthetic Polynucleotide
taatacgactcactatagggttcattgattagttcctttgtttggttagcaacagaggagagctaacatgacaaaggaaaacctggcggcagcgcaaaagatg

SEQ ID NO: 69042 - DNA, 103 bp, Artificial Sequence
  Synthetic Polynucleotide
taatacgactcactatagggacccattcattgattagttcctttgtttggaacagaggagaccaaacatgggaactaataacctggcggcagcgcaaaagatg

SEQ ID NO: 69043 - DNA, 103 bp, Artificial Sequence
  Synthetic Polynucleotide
taatacgactcactatagggtcttaacccattcattgattagttcctttgaacagaggagacaaaggatgtaatcaatgaacctggcggcagcgcaaaagatg

SEQ ID NO: 69044 - DNA, 103 bp, Artificial Sequence
  Synthetic Polynucleotide
taatacgactcactatagggcatcgtcttaacccattcattgattagttcaacagaggagagaactaatgaatgaatggaacctggcggcagcgcaaaagatg

SEQ ID NO: 69045 - DNA, 103 bp, Artificial Sequence
  Synthetic Polynucleotide
taatacgactcactatagggtttgtcatcgtcttaacccattcattgattaacagaggagaaatcaaatgatgggttaaaacctggcggcagcgcaaaagatg

SEQ ID NO: 69046 - DNA, 103 bp, Artificial Sequence
  Synthetic Polynucleotide
taatacgactcactatagggtaccatttgtcatcgtcttaacccattcataacagaggagaatgaatatgttaagacgaaacctggcggcagcgcaaaagatg

SEQ ID NO: 69047 - DNA, 103 bp, Artificial Sequence
  Synthetic Polynucleotide
taatacgactcactatagggaattttaccatttgtcatcgtcttaacccaaacagaggagatgggttatgacgatgacaaacctggcggcagcgcaaaagatg

SEQ ID NO: 69048 - DNA, 103 bp, Artificial Sequence
  Synthetic Polynucleotide
taatacgactcactatagggctgtgtgacatgtgttaacttagagactgaaacagaggagatcagtcatgaagttaacaaacctggcggcagcgcaaaagatg

SEQ ID NO: 69049 - DNA, 103 bp, Artificial Sequence
  Synthetic Polynucleotide
taatacgactcactataggggaattaattttaccatttgtcatcgtcttaaacagaggagataagacatggacaaatggaacctggcggcagcgcaaaagatg

SEQ ID NO: 69050 - DNA, 103 bp, Artificial Sequence
  Synthetic Polynucleotide
taatacgactcactatagggataaggaattaattttaccatttgtcatcgaacagaggagacgatgaatgatggtaaaaaacctggcggcagcgcaaaagatg

SEQ ID NO: 69051 - DNA, 103 bp, Artificial Sequence
  Synthetic Polynucleotide
taatacgactcactatagggagtcaataaggaattaattttaccatttgtaacagaggagaacaaatatgaaaattaataacctggcggcagcgcaaaagatg

SEQ ID NO: 69052 - DNA, 103 bp, Artificial Sequence
  Synthetic Polynucleotide
taatacgactcactatagggggactagtcaataaggaattaattttaccaaacagaggagatggtaaatgtaattccttaacctggcggcagcgcaaaagatg

SEQ ID NO: 69053 - DNA, 103 bp, Artificial Sequence
  Synthetic Polynucleotide
taatacgactcactataggggcagtggactagtcaataaggaattaatttaacagaggagaaaattaatgccttattgaaacctggcggcagcgcaaaagatg

SEQ ID NO: 69054 - DNA, 103 bp, Artificial Sequence
  Synthetic Polynucleotide
taatacgactcactatagggaatgggcagtggactagtcaataaggaattaacagaggagaaattccatgttgactagtaacctggcggcagcgcaaaagatg

SEQ ID NO: 69055 - DNA, 103 bp, Artificial Sequence
  Synthetic Polynucleotide
taatacgactcactataggggtattaatgggcagtggactagtcaataagaacagaggagacttattatgtagtccactaacctggcggcagcgcaaaagatg

SEQ ID NO: 69056 - DNA, 103 bp, Artificial Sequence
  Synthetic Polynucleotide
taatacgactcactatagggtgcgagtattaatgggcagtggactagtcaaacagaggagatgactaatgcactgcccaaacctggcggcagcgcaaaagatg

SEQ ID NO: 69057 - DNA, 103 bp, Artificial Sequence
  Synthetic Polynucleotide
taatacgactcactatagggtgtcatgcgagtattaatgggcagtggactaacagaggagaagtccaatgcccattaataacctggcggcagcgcaaaagatg

SEQ ID NO: 69058 - DNA, 103 bp, Artificial Sequence
  Synthetic Polynucleotide
taatacgactcactatagggacaactgtcatgcgagtattaatgggcagtaacagaggagaactgccatgtaatactcgaacctggcggcagcgcaaaagatg

SEQ ID NO: 69059 - DNA, 103 bp, Artificial Sequence
  Synthetic Polynucleotide
taatacgactcactatagggggatcctgtgtgacatgtgttaacttagagaacagaggagactctaaatgaacacatgtaacctggcggcagcgcaaaagatg

SEQ ID NO: 69060 - DNA, 103 bp, Artificial Sequence
  Synthetic Polynucleotide
taatacgactcactatagggcgctaacaactgtcatgcgagtattaatggaacagaggagaccattaatgctcgcatgaaacctggcggcagcgcaaaagatg

SEQ ID NO: 69061 - DNA, 103 bp, Artificial Sequence
  Synthetic Polynucleotide
taatacgactcactataggggacggcgctaacaactgtcatgcgagtattaacagaggagaaatactatgatgacagttaacctggcggcagcgcaaaagatg

SEQ ID NO: 69062 - DNA, 103 bp, Artificial Sequence
  Synthetic Polynucleotide
taatacgactcactatagggaaatggacggcgctaacaactgtcatgcgaaacagaggagatcgcatatgagttgttagaacctggcggcagcgcaaaagatg

SEQ ID NO: 69063 - DNA, 103 bp, Artificial Sequence
  Synthetic Polynucleotide
taatacgactcactatagggctttaaaatggacggcgctaacaactgtcaaacagaggagatgacagatgttagcgccgaacctggcggcagcgcaaaagatg

SEQ ID NO: 69064 - DNA, 103 bp, Artificial Sequence
  Synthetic Polynucleotide
taatacgactcactatagggcattgctttaaaatggacggcgctaacaacaacagaggagagttgttatggccgtccataacctggcggcagcgcaaaagatg

SEQ ID NO: 69065 - DNA, 103 bp, Artificial Sequence
  Synthetic Polynucleotide
taatacgactcactatagggttccacattgctttaaaatggacggcgctaaacagaggagatagcgcatgccattttaaaacctggcggcagcgcaaaagatg

SEQ ID NO: 69066 - DNA, 103 bp, Artificial Sequence
  Synthetic Polynucleotide
taatacgactcactataggggatatttccacattgctttaaaatggacggaacagaggagaccgtccatgttaaagcaaaacctggcggcagcgcaaaagatg

SEQ ID NO: 69067 - DNA, 103 bp, Artificial Sequence
  Synthetic Polynucleotide
taatacgactcactatagggaaatggatatttccacattgctttaaaatgaacagaggagacattttatggcaatgtggaacctggcggcagcgcaaaagatg

SEQ ID NO: 69068 - DNA, 103 bp, Artificial Sequence
  Synthetic Polynucleotide
taatacgactcactatagggttagaaaatggatatttccacattgctttaaacagaggagataaagcatggtggaaataaacctggcggcagcgcaaaagatg

SEQ ID NO: 69069 - DNA, 103 bp, Artificial Sequence
  Synthetic Polynucleotide
taatacgactcactataggggatgtttagaaaatggatatttccacattgaacagaggagacaatgtatgaatatccataacctggcggcagcgcaaaagatg

SEQ ID NO: 69070 - DNA, 103 bp, Artificial Sequence
  Synthetic Polynucleotide
taatacgactcactatagggtaaatggatcctgtgtgacatgtgttaactaacagaggagaagttaaatgatgtcacacaacctggcggcagcgcaaaagatg

SEQ ID NO: 69071 - DNA, 103 bp, Artificial Sequence
  Synthetic Polynucleotide
taatacgactcactatagggtgtaagatgtttagaaaatggatatttccaaacagaggagatggaaaatgccattttctaacctggcggcagcgcaaaagatg

SEQ ID NO: 69072 - DNA, 103 bp, Artificial Sequence
  Synthetic Polynucleotide
taatacgactcactataggggtatatgtaagatgtttagaaaatggatataacagaggagaatatccatgttctaaacaaacctggcggcagcgcaaaagatg

SEQ ID NO: 69073 - DNA, 103 bp, Artificial Sequence
  Synthetic Polynucleotide
taatacgactcactatagggtgtctgtatatgtaagatgtttagaaaatgaacagaggagacattttatgaacatcttaaacctggcggcagcgcaaaagatg

SEQ ID NO: 69074 - DNA, 103 bp, Artificial Sequence
  Synthetic Polynucleotide
taatacgactcactatagggaaacttgtctgtatatgtaagatgtttagaaacagaggagatctaaaatgcttacatataacctggcggcagcgcaaaagatg

SEQ ID NO: 69075 - DNA, 103 bp, Artificial Sequence
  Synthetic Polynucleotide
taatacgactcactatagggatataaaacttgtctgtatatgtaagatgtaacagaggagaacatctatgatatacagaaacctggcggcagcgcaaaagatg

SEQ ID NO: 69076 - DNA, 103 bp, Artificial Sequence
  Synthetic Polynucleotide
taatacgactcactatagggtagaaatataaaacttgtctgtatatgtaaaacagaggagattacatatgcagacaagtaacctggcggcagcgcaaaagatg

SEQ ID NO: 69077 - DNA, 103 bp, Artificial Sequence
  Synthetic Polynucleotide
taatacgactcactatagggatttttagaaatataaaacttgtctgtataaacagaggagatatacaatgaagttttataacctggcggcagcgcaaaagatg

SEQ ID NO: 69078 - DNA, 103 bp, Artificial Sequence
  Synthetic Polynucleotide
taatacgactcactatagggactatatttttagaaatataaaacttgtctaacagaggagaagacaaatgttatatttcaacctggcggcagcgcaaaagatg

SEQ ID NO: 69079 - DNA, 103 bp, Artificial Sequence
  Synthetic Polynucleotide
taatacgactcactatagggtggtaactatatttttagaaatataaaactaacagaggagaagttttatgtttctaaaaaacctggcggcagcgcaaaagatg

SEQ ID NO: 69080 - DNA, 103 bp, Artificial Sequence
  Synthetic Polynucleotide
taatacgactcactatagggaacgctggtaactatatttttagaaatataaacagaggagatatattatgaaaaatataaacctggcggcagcgcaaaagatg

SEQ ID NO: 69081 - DNA, 103 bp, Artificial Sequence
  Synthetic Polynucleotide
taatacgactcactatagggaactataaatggatcctgtgtgacatgtgtaacagaggagaacacatatgacacaggataacctggcggcagcgcaaaagatg

SEQ ID NO: 69082 - DNA, 103 bp, Artificial Sequence
  Synthetic Polynucleotide
taatacgactcactatagggatatcaacgctggtaactatatttttagaaaacagaggagattctaaatgtatagttacaacctggcggcagcgcaaaagatg

SEQ ID NO: 69083 - DNA, 103 bp, Artificial Sequence
  Synthetic Polynucleotide
taatacgactcactatagggccatcatatcaacgctggtaactatattttaacagaggagaaaaataatgttaccagcgaacctggcggcagcgcaaaagatg

SEQ ID NO: 69084 - DNA, 103 bp, Artificial Sequence
  Synthetic Polynucleotide
taatacgactcactataggggctcaccatcatatcaacgctggtaactataacagaggagaatagttatgagcgttgataacctggcggcagcgcaaaagatg

SEQ ID NO: 69085 - DNA, 103 bp, Artificial Sequence
  Synthetic Polynucleotide
taatacgactcactatagggtcagtgctcaccatcatatcaacgctggtaaacagaggagataccagatgtgatatgataacctggcggcagcgcaaaagatg

SEQ ID NO: 69086 - DNA, 103 bp, Artificial Sequence
  Synthetic Polynucleotide
taatacgactcactatagggcgttttcagtgctcaccatcatatcaacgcaacagaggagagcgttgatgtgatggtgaaacctggcggcagcgcaaaagatg

SEQ ID NO: 69087 - DNA, 103 bp, Artificial Sequence
  Synthetic Polynucleotide
taatacgactcactatagggtaagtcgttttcagtgctcaccatcatatcaacagaggagagatatgatggtgagcactaacctggcggcagcgcaaaagatg

SEQ ID NO: 69088 - DNA, 103 bp, Artificial Sequence
  Synthetic Polynucleotide
taatacgactcactatagggtattgtaagtcgttttcagtgctcaccatcaacagaggagagatggtatgcactgaaaaaacctggcggcagcgcaaaagatg

SEQ ID NO: 69089 - DNA, 103 bp, Artificial Sequence
  Synthetic Polynucleotide
taatacgactcactataggggtacatattgtaagtcgttttcagtgctcaaacagaggagatgagcaatgaaaacgactaacctggcggcagcgcaaaagatg

SEQ ID NO: 69090 - DNA, 103 bp, Artificial Sequence
  Synthetic Polynucleotide
taatacgactcactatagggaatatgtacatattgtaagtcgttttcagtaacagaggagaactgaaatggacttacaaaacctggcggcagcgcaaaagatg

SEQ ID NO: 69091 - DNA, 103 bp, Artificial Sequence
  Synthetic Polynucleotide
taatacgactcactatagggtcattaatatgtacatattgtaagtcgtttaacagaggagaaaacgaatgacaatatgtaacctggcggcagcgcaaaagatg

SEQ ID NO: 69092 - DNA, 103 bp, Artificial Sequence
  Synthetic Polynucleotide
taatacgactcactataggggatataactataaatggatcctgtgtgacaaacagaggagatgtcacatgggatccattaacctggcggcagcgcaaaagatg

SEQ ID NO: 69093 - DNA, 103 bp, Artificial Sequence
  Synthetic Polynucleotide
taatacgactcactatagggataattcattaatatgtacatattgtaagtaacagaggagaacttacatgatgtacataaacctggcggcagcgcaaaagatg

SEQ ID NO: 69094 - DNA, 103 bp, Artificial Sequence
  Synthetic Polynucleotide
taatacgactcactatagggtccaaataattcattaatatgtacatattgaacagaggagacaatatatgcatattaataacctggcggcagcgcaaaagatg

SEQ ID NO: 69095 - DNA, 103 bp, Artificial Sequence
  Synthetic Polynucleotide
taatacgactcactatagggaatcctccaaataattcattaatatgtacaaacagaggagatgtacaatgtaatgaattaacctggcggcagcgcaaaagatg

SEQ ID NO: 69096 - DNA, 103 bp, Artificial Sequence
  Synthetic Polynucleotide
taatacgactcactatagggtagagaatcctccaaataattcattaatataacagaggagaatattaatgaattatttgaacctggcggcagcgcaaaagatg

SEQ ID NO: 69097 - DNA, 103 bp, Artificial Sequence
  Synthetic Polynucleotide
taatacgactcactataggggataatagagaatcctccaaataattcattaacagaggagaaatgaaatgtttggaggaaacctggcggcagcgcaaaagatg

SEQ ID NO: 69098 - DNA, 103 bp, Artificial Sequence
  Synthetic Polynucleotide
taatacgactcactatagggatatcgataatagagaatcctccaaataataacagaggagaattattatgaggattctcaacctggcggcagcgcaaaagatg

SEQ ID NO: 69099 - DNA, 103 bp, Artificial Sequence
  Synthetic Polynucleotide
taatacgactcactatagggatggaatatcgataatagagaatcctccaaaacagaggagattggagatgtctctattaaacctggcggcagcgcaaaagatg

SEQ ID NO: 69100 - DNA, 103 bp, Artificial Sequence
  Synthetic Polynucleotide
taatacgactcactatagggctcgtatggaatatcgataatagagaatccaacagaggagaggattcatgattatcgataacctggcggcagcgcaaaagatg

SEQ ID NO: 69101 - DNA, 103 bp, Artificial Sequence
  Synthetic Polynucleotide
taatacgactcactatagggtttccctcgtatggaatatcgataatagagaacagaggagactctatatgcgatattccaacctggcggcagcgcaaaagatg

SEQ ID NO: 69102 - DNA, 103 bp, Artificial Sequence
  Synthetic Polynucleotide
taatacgactcactatagggtagagtttccctcgtatggaatatcgataaaacagaggagattatcgatgttccatacgaacctggcggcagcgcaaaagatg

SEQ ID NO: 69103 - DNA, 103 bp, Artificial Sequence
  Synthetic Polynucleotide
taatacgactcactatagggcatgtgatataactataaatggatcctgtgaacagaggagacacaggatgcatttatagaacctggcggcagcgcaaaagatg

SEQ ID NO: 69104 - DNA, 103 bp, Artificial Sequence
  Synthetic Polynucleotide
taatacgactcactatagggcatactagagtttccctcgtatggaatatcaacagaggagagatattatgtacgagggaaacctggcggcagcgcaaaagatg

SEQ ID NO: 69105 - DNA, 103 bp, Artificial Sequence
  Synthetic Polynucleotide
taatacgactcactatagggattaccatactagagtttccctcgtatggaaacagaggagatccataatggggaaactcaacctggcggcagcgcaaaagatg

SEQ ID NO: 69106 - DNA, 103 bp, Artificial Sequence
  Synthetic Polynucleotide
taatacgactcactataggggtataattaccatactagagtttccctcgtaacagaggagaacgaggatgactctagtaaacctggcggcagcgcaaaagatg

SEQ ID NO: 69107 - DNA, 103 bp, Artificial Sequence
  Synthetic Polynucleotide
taatacgactcactatagggtggtagtataattaccatactagagtttccaacagaggagaggaaacatgagtatggtaaacctggcggcagcgcaaaagatg

SEQ ID NO: 69108 - DNA, 103 bp, Artificial Sequence
  Synthetic Polynucleotide
taatacgactcactatagggtcgtctggtagtataattaccatactagagaacagaggagactctagatgggtaattataacctggcggcagcgcaaaagatg

SEQ ID NO: 69109 - DNA, 103 bp, Artificial Sequence
  Synthetic Polynucleotide
taatacgactcactatagggctatgtcgtctggtagtataattaccatacaacagaggagagtatggatgttatactacaacctggcggcagcgcaaaagatg

SEQ ID NO: 69110 - DNA, 103 bp, Artificial Sequence
  Synthetic Polynucleotide
taatacgactcactatagggaccttctatgtcgtctggtagtataattacaacagaggagagtaattatgctaccagacaacctggcggcagcgcaaaagatg

SEQ ID NO: 69111 - DNA, 103 bp, Artificial Sequence
  Synthetic Polynucleotide
taatacgactcactatagggtataaaccttctatgtcgtctggtagtataaacagaggagatatactatgagacgacataacctggcggcagcgcaaaagatg

SEQ ID NO: 69112 - DNA, 103 bp, Artificial Sequence
  Synthetic Polynucleotide
taatacgactcactatagggtgttatataaaccttctatgtcgtctggtaaacagaggagataccagatgacatagaagaacctggcggcagcgcaaaagatg

SEQ ID NO: 69113 - DNA, 103 bp, Artificial Sequence
  Synthetic Polynucleotide
taatacgactcactatagggttctatgttatataaaccttctatgtcgtcaacagaggagagacgacatggaaggtttaaacctggcggcagcgcaaaagatg

SEQ ID NO: 69114 - DNA, 103 bp, Artificial Sequence
  Synthetic Polynucleotide
taatacgactcactatagggatcatcatgtgatataactataaatggatcaacagaggagagatccaatgatagttataaacctggcggcagcgcaaaagatg

SEQ ID NO: 69115 - DNA, 103 bp, Artificial Sequence
  Synthetic Polynucleotide
taatacgactcactatagggtgtttttctatgttatataaaccttctatgaacagaggagacatagaatgtttatataaaacctggcggcagcgcaaaagatg

SEQ ID NO: 69116 - DNA, 103 bp, Artificial Sequence
  Synthetic Polynucleotide
taatacgactcactatagggttatgtgtttttctatgttatataaaccttaacagaggagaaaggttatgataacatagaacctggcggcagcgcaaaagatg

SEQ ID NO: 69117 - DNA, 103 bp, Artificial Sequence
  Synthetic Polynucleotide
taatacgactcactatagggttcagttatgtgtttttctatgttatataaaacagaggagattatatatgatagaaaaaaacctggcggcagcgcaaaagatg

SEQ ID NO: 69118 - DNA, 103 bp, Artificial Sequence
  Synthetic Polynucleotide
taatacgactcactatagggttttcttcagttatgtgtttttctatgttaaacagaggagataacatatgaaaacacataacctggcggcagcgcaaaagatg

SEQ ID NO: 69119 - DNA, 103 bp, Artificial Sequence
  Synthetic Polynucleotide
taatacgactcactatagggtaaaattttcttcagttatgtgtttttctaaacagaggagatagaaaatgacataactgaacctggcggcagcgcaaaagatg

SEQ ID NO: 69120 - DNA, 103 bp, Artificial Sequence
  Synthetic Polynucleotide
taatacgactcactatagggttttttaaaattttcttcagttatgtgtttaacagaggagaaaacacatgactgaagaaaacctggcggcagcgcaaaagatg

SEQ ID NO: 69121 - DNA, 103 bp, Artificial Sequence
  Synthetic Polynucleotide
taatacgactcactatagggcaccattttttaaaattttcttcagttatgaacagaggagacataacatgagaaaatttaacctggcggcagcgcaaaagatg

SEQ ID NO: 69122 - DNA, 103 bp, Artificial Sequence
  Synthetic Polynucleotide
taatacgactcactatagggtaccacaccattttttaaaattttcttcagaacagaggagactgaagatgattttaaaaaacctggcggcagcgcaaaagatg

SEQ ID NO: 69123 - DNA, 103 bp, Artificial Sequence
  Synthetic Polynucleotide
taatacgactcactatagggtaacttaccacaccattttttaaaattttcaacagaggagagaaaatatgaaaaaatggaacctggcggcagcgcaaaagatg

SEQ ID NO: 69124 - DNA, 103 bp, Artificial Sequence
  Synthetic Polynucleotide
taatacgactcactataggggtgtataacttaccacaccattttttaaaaaacagaggagattttaaatgatggtgtggaacctggcggcagcgcaaaagatg

SEQ ID NO: 69125 - DNA, 103 bp, Artificial Sequence
  Synthetic Polynucleotide
taatacgactcactataggggggaattttatattattaattcagtaatataacagaggagaatattaatgaattaataaaacctggcggcagcgcaaaagatg

SEQ ID NO: 69126 - DNA, 103 bp, Artificial Sequence
  Synthetic Polynucleotide
taatacgactcactatagggcataaatcatcatgtgatataactataaataacagaggagaatttatatgtatatcacaaacctggcggcagcgcaaaagatg

SEQ ID NO: 69127 - DNA, 103 bp, Artificial Sequence
  Synthetic Polynucleotide
taatacgactcactatagggttttagtgtataacttaccacaccatttttaacagaggagaaaaaatatggtggtaagtaacctggcggcagcgcaaaagatg

SEQ ID NO: 69128 - DNA, 103 bp, Artificial Sequence
  Synthetic Polynucleotide
taatacgactcactatagggtatacttttagtgtataacttaccacaccaaacagaggagatggtgtatgaagttatacaacctggcggcagcgcaaaagatg

SEQ ID NO: 69129 - DNA, 103 bp, Artificial Sequence
  Synthetic Polynucleotide
taatacgactcactatagggaagtctatacttttagtgtataacttaccaaacagaggagatggtaaatgatacactaaaacctggcggcagcgcaaaagatg

SEQ ID NO: 69130 - DNA, 103 bp, Artificial Sequence
  Synthetic Polynucleotide
taatacgactcactatagggtatacaagtctatacttttagtgtataactaacagaggagaagttatatgctaaaagtaaacctggcggcagcgcaaaagatg

SEQ ID NO: 69131 - DNA, 103 bp, Artificial Sequence
  Synthetic Polynucleotide
taatacgactcactatagggtggcatatacaagtctatacttttagtgtaaacagaggagatacactatgagtatagacaacctggcggcagcgcaaaagatg

SEQ ID NO: 69132 - DNA, 103 bp, Artificial Sequence
  Synthetic Polynucleotide
taatacgactcactatagggaactttggcatatacaagtctatacttttaaacagaggagataaaagatgagacttgtaaacctggcggcagcgcaaaagatg

SEQ ID NO: 69133 - DNA, 103 bp, Artificial Sequence
  Synthetic Polynucleotide
taatacgactcactataggggtttaaactttggcatatacaagtctatacaacagaggagagtatagatgtgtatatgcaacctggcggcagcgcaaaagatg

SEQ ID NO: 69134 - DNA, 103 bp, Artificial Sequence
  Synthetic Polynucleotide
taatacgactcactatagggtttcagtttaaactttggcatatacaagtcaacagaggagagacttgatgatgccaaagaacctggcggcagcgcaaaagatg

SEQ ID NO: 69135 - DNA, 103 bp, Artificial Sequence
  Synthetic Polynucleotide
taatacgactcactataggggtcattttcagtttaaactttggcatatacaacagaggagagtatatatgaaagtttaaaacctggcggcagcgcaaaagatg

SEQ ID NO: 69136 - DNA, 103 bp, Artificial Sequence
  Synthetic Polynucleotide
taatacgactcactatagggattctgtcattttcagtttaaactttggcaaacagaggagatgccaaatgttaaactgaaacctggcggcagcgcaaaagatg

SEQ ID NO: 69137 - DNA, 103 bp, Artificial Sequence
  Synthetic Polynucleotide
taatacgactcactatagggttcaccataaatcatcatgtgatataactaaacagaggagatagttaatgcacatgatgaacctggcggcagcgcaaaagatg

SEQ ID NO: 69138 - DNA, 103 bp, Artificial Sequence
  Synthetic Polynucleotide
taatacgactcactatagggatacgattctgtcattttcagtttaaacttaacagaggagaaagtttatgctgaaaatgaacctggcggcagcgcaaaagatg

SEQ ID NO: 69139 - DNA, 103 bp, Artificial Sequence
  Synthetic Polynucleotide
taatacgactcactatagggagattatacgattctgtcattttcagtttaaacagaggagataaactatgaatgacagaaacctggcggcagcgcaaaagatg

SEQ ID NO: 69140 - DNA, 103 bp, Artificial Sequence
  Synthetic Polynucleotide
taatacgactcactataggggtaccagattatacgattctgtcattttcaaacagaggagatgaaaaatgcagaatcgtaacctggcggcagcgcaaaagatg

SEQ ID NO: 69141 - DNA, 103 bp, Artificial Sequence
  Synthetic Polynucleotide
taatacgactcactatagggaataggtaccagattatacgattctgtcataacagaggagaatgacaatgtcgtataataacctggcggcagcgcaaaagatg

SEQ ID NO: 69142 - DNA, 103 bp, Artificial Sequence
  Synthetic Polynucleotide
taatacgactcactatagggtctagaataggtaccagattatacgattctaacagaggagaagaatcatgtaatctggtaacctggcggcagcgcaaaagatg

SEQ ID NO: 69143 - DNA, 103 bp, Artificial Sequence
  Synthetic Polynucleotide
taatacgactcactatagggaattttctagaataggtaccagattatacgaacagaggagacgtataatgtggtacctaaacctggcggcagcgcaaaagatg

SEQ ID NO: 69144 - DNA, 103 bp, Artificial Sequence
  Synthetic Polynucleotide
taatacgactcactatagggtcctaaattttctagaataggtaccagattaacagaggagaaatctgatgcctattctaaacctggcggcagcgcaaaagatg

SEQ ID NO: 69145 - DNA, 103 bp, Artificial Sequence
  Synthetic Polynucleotide
taatacgactcactataggggtaagtcctaaattttctagaataggtaccaacagaggagaggtaccatgtctagaaaaaacctggcggcagcgcaaaagatg

SEQ ID NO: 69146 - DNA, 103 bp, Artificial Sequence
  Synthetic Polynucleotide
taatacgactcactatagggtattagtaagtcctaaattttctagaatagaacagaggagactattcatgaaaatttagaacctggcggcagcgcaaaagatg

SEQ ID NO: 69147 - DNA, 103 bp, Artificial Sequence
  Synthetic Polynucleotide
taatacgactcactataggggaatatattagtaagtcctaaattttctagaacagaggagactagaaatgttaggacttaacctggcggcagcgcaaaagatg

SEQ ID NO: 69148 - DNA, 103 bp, Artificial Sequence
  Synthetic Polynucleotide
taatacgactcactatagggatcaattcaccataaatcatcatgtgatataacagaggagaatatcaatggatgatttaaacctggcggcagcgcaaaagatg

SEQ ID NO: 69149 - DNA, 103 bp, Artificial Sequence
  Synthetic Polynucleotide
taatacgactcactatagggtatccgaatatattagtaagtcctaaatttaacagaggagaaaatttatgacttactaaaacctggcggcagcgcaaaagatg

SEQ ID NO: 69150 - DNA, 103 bp, Artificial Sequence
  Synthetic Polynucleotide
taatacgactcactatagggcataatatccgaatatattagtaagtcctaaacagaggagataggacatgctaatatataacctggcggcagcgcaaaagatg

SEQ ID NO: 69151 - DNA, 103 bp, Artificial Sequence
  Synthetic Polynucleotide
taatacgactcactatagggatctgcataatatccgaatatattagtaagaacagaggagacttactatgatattcggaaacctggcggcagcgcaaaagatg

SEQ ID NO: 69152 - DNA, 103 bp, Artificial Sequence
  Synthetic Polynucleotide
taatacgactcactatagggctaaaatctgcataatatccgaatatattaaacagaggagataatatatgcggatattaaacctggcggcagcgcaaaagatg

SEQ ID NO: 69153 - DNA, 103 bp, Artificial Sequence
  Synthetic Polynucleotide
taatacgactcactatagggtcttgctaaaatctgcataatatccgaataaacagaggagatattcgatgattatgcagaacctggcggcagcgcaaaagatg

SEQ ID NO: 69154 - DNA, 103 bp, Artificial Sequence
  Synthetic Polynucleotide
taatacgactcactatagggacacatcttgctaaaatctgcataatatccaacagaggagaggatatatggcagattttaacctggcggcagcgcaaaagatg

SEQ ID NO: 69155 - DNA, 103 bp, Artificial Sequence
  Synthetic Polynucleotide
taatacgactcactatagggtcattacacatcttgctaaaatctgcataaaacagaggagattatgcatgttttagcaaaacctggcggcagcgcaaaagatg

SEQ ID NO: 69156 - DNA, 103 bp, Artificial Sequence
  Synthetic Polynucleotide
taatacgactcactatagggtagtttcattacacatcttgctaaaatctgaacagaggagacagattatggcaagatgtaacctggcggcagcgcaaaagatg

SEQ ID NO: 69157 - DNA, 103 bp, Artificial Sequence
  Synthetic Polynucleotide
taatacgactcactatagggagtgatagtttcattacacatcttgctaaaaacagaggagatttagcatgatgtgtaataacctggcggcagcgcaaaagatg

SEQ ID NO: 69158 - DNA, 103 bp, Artificial Sequence
  Synthetic Polynucleotide
taatacgactcactatagggtctacagtgatagtttcattacacatcttgaacagaggagacaagatatgtaatgaaacaacctggcggcagcgcaaaagatg

SEQ ID NO: 69159 - DNA, 103 bp, Artificial Sequence
  Synthetic Polynucleotide
taatacgactcactatagggccggaatcaattcaccataaatcatcatgtaacagaggagaacatgaatgtttatggtgaacctggcggcagcgcaaaagatg

SEQ ID NO: 69160 - DNA, 103 bp, Artificial Sequence
  Synthetic Polynucleotide
taatacgactcactatagggatttttctacagtgatagtttcattacacaaacagaggagatgtgtaatgaaactatcaaacctggcggcagcgcaaaagatg

SEQ ID NO: 69161 - DNA, 103 bp, Artificial Sequence
  Synthetic Polynucleotide
taatacgactcactatagggtagaaatttttctacagtgatagtttcattaacagaggagaaatgaaatgatcactgtaaacctggcggcagcgcaaaagatg

SEQ ID NO: 69162 - DNA, 103 bp, Artificial Sequence
  Synthetic Polynucleotide
taatacgactcactatagggttgtgtagaaatttttctacagtgatagttaacagaggagaaactatatgtgtagaaaaaacctggcggcagcgcaaaagatg

SEQ ID NO: 69163 - DNA, 103 bp, Artificial Sequence
  Synthetic Polynucleotide
taatacgactcactatagggacgtcttgtgtagaaatttttctacagtgaaacagaggagatcactgatgaaaaatttcaacctggcggcagcgcaaaagatg

SEQ ID NO: 69164 - DNA, 103 bp, Artificial Sequence
  Synthetic Polynucleotide
taatacgactcactatagggtataaacgtcttgtgtagaaatttttctacaacagaggagagtagaaatgtttctacacaacctggcggcagcgcaaaagatg

SEQ ID NO: 69165 - DNA, 103 bp, Artificial Sequence
  Synthetic Polynucleotide
taatacgactcactatagggacatctataaacgtcttgtgtagaaattttaacagaggagaaaaattatgacacaagacaacctggcggcagcgcaaaagatg

SEQ ID NO: 69166 - DNA, 103 bp, Artificial Sequence
  Synthetic Polynucleotide
taatacgactcactatagggcattaacatctataaacgtcttgtgtagaaaacagaggagattctacatgagacgtttaaacctggcggcagcgcaaaagatg

SEQ ID NO: 69167 - DNA, 103 bp, Artificial Sequence
  Synthetic Polynucleotide
taatacgactcactatagggctcctcattaacatctataaacgtcttgtgaacagaggagacacaagatgtttatagataacctggcggcagcgcaaaagatg

SEQ ID NO: 69168 - DNA, 103 bp, Artificial Sequence
  Synthetic Polynucleotide
taatacgactcactataggggtatactcctcattaacatctataaacgtcaacagaggagagacgttatgagatgttaaaacctggcggcagcgcaaaagatg

SEQ ID NO: 69169 - DNA, 103 bp, Artificial Sequence
  Synthetic Polynucleotide
taatacgactcactatagggcttctgtatactcctcattaacatctataaaacagaggagattatagatgttaatgaggaacctggcggcagcgcaaaagatg

SEQ ID NO: 69170 - DNA, 103 bp, Artificial Sequence
  Synthetic Polynucleotide
taatacgactcactatagggatcttccggaatcaattcaccataaatcataacagaggagaatgattatgggtgaattgaacctggcggcagcgcaaaagatg

SEQ ID NO: 69171 - DNA, 103 bp, Artificial Sequence
  Synthetic Polynucleotide
taatacgactcactatagggcgatgcttctgtatactcctcattaacatcaacagaggagagatgttatggaggagtataacctggcggcagcgcaaaagatg

SEQ ID NO: 69172 - DNA, 103 bp, Artificial Sequence
  Synthetic Polynucleotide
taatacgactcactatagggatagccgatgcttctgtatactcctcattaaacagaggagataatgaatggtatacagaaacctggcggcagcgcaaaagatg

SEQ ID NO: 69173 - DNA, 103 bp, Artificial Sequence
  Synthetic Polynucleotide
taatacgactcactatagggctgtaatagccgatgcttctgtatactcctaacagaggagaaggagtatgcagaagcataacctggcggcagcgcaaaagatg

SEQ ID NO: 69174 - DNA, 103 bp, Artificial Sequence
  Synthetic Polynucleotide
taatacgactcactatagggtactcctgtaatagccgatgcttctgtataaacagaggagatatacaatggcatcggctaacctggcggcagcgcaaaagatg

SEQ ID NO: 69175 - DNA, 103 bp, Artificial Sequence
  Synthetic Polynucleotide
taatacgactcactatagggataaatactcctgtaatagccgatgcttctaacagaggagaagaagcatgggctattacaacctggcggcagcgcaaaagatg

SEQ ID NO: 69176 - DNA, 103 bp, Artificial Sequence
  Synthetic Polynucleotide
taatacgactcactatagggtagtcataaatactcctgtaatagccgatgaacagaggagacatcggatgttacaggagaacctggcggcagcgcaaaagatg

SEQ ID NO: 69177 - DNA, 103 bp, Artificial Sequence
  Synthetic Polynucleotide
taatacgactcactatagggaaagttagtcataaatactcctgtaatagcaacagaggagagctattatgggagtatttaacctggcggcagcgcaaaagatg

SEQ ID NO: 69178 - DNA, 103 bp, Artificial Sequence
  Synthetic Polynucleotide
taatacgactcactatagggatcgaaaagttagtcataaatactcctgtaaacagaggagatacaggatgatttatgacaacctggcggcagcgcaaaagatg

SEQ ID NO: 69179 - DNA, 103 bp, Artificial Sequence
  Synthetic Polynucleotide
taatacgactcactatagggataccatcgaaaagttagtcataaatactcaacagaggagagagtatatgtgactaactaacctggcggcagcgcaaaagatg

SEQ ID NO: 69180 - DNA, 103 bp, Artificial Sequence
  Synthetic Polynucleotide
taatacgactcactatagggacgatataccatcgaaaagttagtcataaaaacagaggagatttatgatgaacttttcgaacctggcggcagcgcaaaagatg

SEQ ID NO: 69181 - DNA, 103 bp, Artificial Sequence
  Synthetic Polynucleotide
taatacgactcactatagggtagcgatcttccggaatcaattcaccataaaacagaggagattatggatgattgattccaacctggcggcagcgcaaaagatg

SEQ ID NO: 69182 - DNA, 103 bp, Artificial Sequence
  Synthetic Polynucleotide
taatacgactcactatagggttcgtacgatataccatcgaaaagttagtcaacagaggagagactaaatgttcgatggtaacctggcggcagcgcaaaagatg

SEQ ID NO: 69183 - DNA, 103 bp, Artificial Sequence
  Synthetic Polynucleotide
taatacgactcactatagggagaccttcgtacgatataccatcgaaaagtaacagaggagaacttttatgtggtatatcaacctggcggcagcgcaaaagatg

SEQ ID NO: 69184 - DNA, 103 bp, Artificial Sequence
  Synthetic Polynucleotide
taatacgactcactatagggtatgtagaccttcgtacgatataccatcgaaacagaggagatcgatgatgtatcgtacgaacctggcggcagcgcaaaagatg

SEQ ID NO: 69185 - DNA, 103 bp, Artificial Sequence
  Synthetic Polynucleotide
taatacgactcactatagggtggtttatgtagaccttcgtacgatataccaacagaggagaggtataatgtacgaaggtaacctggcggcagcgcaaaagatg

SEQ ID NO: 69186 - DNA, 103 bp, Artificial Sequence
  Synthetic Polynucleotide
taatacgactcactatagggatggatggtttatgtagaccttcgtacgataacagaggagaatcgtaatgaggtctacaaacctggcggcagcgcaaaagatg

SEQ ID NO: 69187 - DNA, 103 bp, Artificial Sequence
  Synthetic Polynucleotide
taatacgactcactatagggtatgaatggatggtttatgtagaccttcgtaacagaggagaacgaagatgtacataaacaacctggcggcagcgcaaaagatg

SEQ ID NO: 69188 - DNA, 103 bp, Artificial Sequence
  Synthetic Polynucleotide
taatacgactcactatagggatgtatatgaatggatggtttatgtagaccaacagaggagaggtctaatgaaaccatccaacctggcggcagcgcaaaagatg

SEQ ID NO: 69189 - DNA, 103 bp, Artificial Sequence
  Synthetic Polynucleotide
taatacgactcactatagggtaatcatgtatatgaatggatggtttatgtaacagaggagaacataaatgatccattcaaacctggcggcagcgcaaaagatg

SEQ ID NO: 69190 - DNA, 103 bp, Artificial Sequence
  Synthetic Polynucleotide
taatacgactcactataggggtctttaatcatgtatatgaatggatggttaacagaggagaaaccatatgttcatatacaacctggcggcagcgcaaaagatg

SEQ ID NO: 69191 - DNA, 103 bp, Artificial Sequence
  Synthetic Polynucleotide
taatacgactcactataggggtgttgtctttaatcatgtatatgaatggaaacagaggagatccattatgatacatgataacctggcggcagcgcaaaagatg

SEQ ID NO: 69192 - DNA, 103 bp, Artificial Sequence
  Synthetic Polynucleotide
taatacgactcactatagggtacaatagcgatcttccggaatcaattcacaacagaggagagtgaatatgttccggaagaacctggcggcagcgcaaaagatg

SEQ ID NO: 69193 - DNA, 103 bp, Artificial Sequence
  Synthetic Polynucleotide
taatacgactcactataggggtcctgtgttgtctttaatcatgtatatgaaacagaggagatcatatatgtgattaaagaacctggcggcagcgcaaaagatg

SEQ ID NO: 69194 - DNA, 103 bp, Artificial Sequence
  Synthetic Polynucleotide
taatacgactcactatagggtatacgtcctgtgttgtctttaatcatgtaaacagaggagatacatgatgaaagacaacaacctggcggcagcgcaaaagatg

SEQ ID NO: 69195 - DNA, 103 bp, Artificial Sequence
  Synthetic Polynucleotide
taatacgactcactatagggaagagtatacgtcctgtgttgtctttaatcaacagaggagagattaaatgcaacacaggaacctggcggcagcgcaaaagatg

SEQ ID NO: 69196 - DNA, 103 bp, Artificial Sequence
  Synthetic Polynucleotide
taatacgactcactatagggctataaagagtatacgtcctgtgttgtcttaacagaggagaaagacaatgcaggacgtaaacctggcggcagcgcaaaagatg

SEQ ID NO: 69197 - DNA, 103 bp, Artificial Sequence
  Synthetic Polynucleotide
taatacgactcactatagggtttccctataaagagtatacgtcctgtgttaacagaggagaaacacaatgcgtatactcaacctggcggcagcgcaaaagatg

SEQ ID NO: 69198 - DNA, 103 bp, Artificial Sequence
  Synthetic Polynucleotide
taatacgactcactatagggcagtatttccctataaagagtatacgtcctaacagaggagaaggacgatgactctttataacctggcggcagcgcaaaagatg

SEQ ID NO: 69199 - DNA, 103 bp, Artificial Sequence
  Synthetic Polynucleotide
taatacgactcactataggggataacagtatttccctataaagagtatacaacagaggagagtatacatgttatagggaaacctggcggcagcgcaaaagatg

SEQ ID NO: 69200 - DNA, 103 bp, Artificial Sequence
  Synthetic Polynucleotide
taatacgactcactatagggttgtggataacagtatttccctataaagagaacagaggagactctttatggggaaatacaacctggcggcagcgcaaaagatg

SEQ ID NO: 69201 - DNA, 103 bp, Artificial Sequence
  Synthetic Polynucleotide
taatacgactcactatagggatttattgtggataacagtatttccctataaacagaggagatataggatgatactgttaaacctggcggcagcgcaaaagatg

SEQ ID NO: 69202 - DNA, 103 bp, Artificial Sequence
  Synthetic Polynucleotide
taatacgactcactatagggtttatatttattgtggataacagtatttccaacagaggagaggaaatatggttatccacaacctggcggcagcgcaaaagatg

SEQ ID NO: 69203 - DNA, 103 bp, Artificial Sequence
  Synthetic Polynucleotide
taatacgactcactatagggcaaaatacaatagcgatcttccggaatcaaaacagaggagattgattatggaagatcgcaacctggcggcagcgcaaaagatg

SEQ ID NO: 69204 - DNA, 103 bp, Artificial Sequence
  Synthetic Polynucleotide
taatacgactcactatagggatttgtttatatttattgtggataacagtaaacagaggagatactgtatgccacaataaaacctggcggcagcgcaaaagatg

SEQ ID NO: 69205 - DNA, 103 bp, Artificial Sequence
  Synthetic Polynucleotide
taatacgactcactatagggagtctatttgtttatatttattgtggataaaacagaggagattatccatgataaatataaacctggcggcagcgcaaaagatg

SEQ ID NO: 69206 - DNA, 103 bp, Artificial Sequence
  Synthetic Polynucleotide
taatacgactcactatagggtaaaaagtctatttgtttatatttattgtgaacagaggagacacaatatgtataaacaaaacctggcggcagcgcaaaagatg

SEQ ID NO: 69207 - DNA, 103 bp, Artificial Sequence
  Synthetic Polynucleotide
taatacgactcactatagggtgagataaaaagtctatttgtttatatttaaacagaggagataaataatgacaaatagaaacctggcggcagcgcaaaagatg

SEQ ID NO: 69208 - DNA, 103 bp, Artificial Sequence
  Synthetic Polynucleotide
taatacgactcactatagggagacatgagataaaaagtctatttgtttataacagaggagaataaacatgtagacttttaacctggcggcagcgcaaaagatg

SEQ ID NO: 69209 - DNA, 103 bp, Artificial Sequence
  Synthetic Polynucleotide
taatacgactcactatagggttcttagacatgagataaaaagtctatttgaacagaggagacaaataatgtttttatctaacctggcggcagcgcaaaagatg

SEQ ID NO: 69210 - DNA, 103 bp, Artificial Sequence
  Synthetic Polynucleotide
taatacgactcactatagggtgtaattcttagacatgagataaaaagtctaacagaggagaagacttatgatctcatgtaacctggcggcagcgcaaaagatg

SEQ ID NO: 69211 - DNA, 103 bp, Artificial Sequence
  Synthetic Polynucleotide
taatacgactcactatagggtactttgtaattcttagacatgagataaaaaacagaggagattttatatgatgtctaagaacctggcggcagcgcaaaagatg

SEQ ID NO: 69212 - DNA, 103 bp, Artificial Sequence
  Synthetic Polynucleotide
taatacgactcactatagggtatattactttgtaattcttagacatgagaaacagaggagatctcatatgtaagaattaaacctggcggcagcgcaaaagatg

SEQ ID NO: 69213 - DNA, 103 bp, Artificial Sequence
  Synthetic Polynucleotide
taatacgactcactatagggctaactatattactttgtaattcttagacaaacagaggagatgtctaatgattacaaagaacctggcggcagcgcaaaagatg

SEQ ID NO: 69214 - DNA, 103 bp, Artificial Sequence
  Synthetic Polynucleotide
taatacgactcactatagggaaccacaaaatacaatagcgatcttccggaaacagaggagatccggaatgtcgctattgaacctggcggcagcgcaaaagatg

SEQ ID NO: 69215 - DNA, 103 bp, Artificial Sequence
  Synthetic Polynucleotide
taatacgactcactatagggttatactaactatattactttgtaattcttaacagaggagaaagaatatgaaagtaataaacctggcggcagcgcaaaagatg

SEQ ID NO: 69216 - DNA, 103 bp, Artificial Sequence
  Synthetic Polynucleotide
taatacgactcactatagggtttagttatactaactatattactttgtaaaacagaggagattacaaatgaatatagttaacctggcggcagcgcaaaagatg

SEQ ID NO: 69217 - DNA, 103 bp, Artificial Sequence
  Synthetic Polynucleotide
taatacgactcactatagggttaactttagttatactaactatattacttaacagaggagaaagtaaatgagttagtataacctggcggcagcgcaaaagatg

SEQ ID NO: 69218 - DNA, 103 bp, Artificial Sequence
  Synthetic Polynucleotide
taatacgactcactatagggtagtattaactttagttatactaactatataacagaggagaatatagatggtataactaaacctggcggcagcgcaaaagatg

SEQ ID NO: 69219 - DNA, 103 bp, Artificial Sequence
  Synthetic Polynucleotide
taatacgactcactatagggtaatgtagtattaactttagttatactaacaacagaggagagttagtatgactaaagttaacctggcggcagcgcaaaagatg

SEQ ID NO: 69220 - DNA, 103 bp, Artificial Sequence
  Synthetic Polynucleotide
taatacgactcactatagggagttttaatgtagtattaactttagttataaacagaggagatataacatgagttaatacaacctggcggcagcgcaaaagatg

SEQ ID NO: 69221 - DNA, 103 bp, Artificial Sequence
  Synthetic Polynucleotide
taatacgactcactatagggttttaagttttaatgtagtattaactttagaacagaggagactaaagatgatactacataacctggcggcagcgcaaaagatg

SEQ ID NO: 69222 - DNA, 103 bp, Artificial Sequence
  Synthetic Polynucleotide
taatacgactcactatagggattttttttaagttttaatgtagtattaacaacagaggagagttaatatgacattaaaaaacctggcggcagcgcaaaagatg

SEQ ID NO: 69223 - DNA, 103 bp, Artificial Sequence
  Synthetic Polynucleotide
taatacgactcactatagggttattattttttttaagttttaatgtagtaaacagaggagatactacatgaaaacttaaaacctggcggcagcgcaaaagatg

SEQ ID NO: 69224 - DNA, 103 bp, Artificial Sequence
  Synthetic Polynucleotide
taatacgactcactatagggtgatattattattttttttaagttttaatgaacagaggagacattaaatgttaaaaaaaaacctggcggcagcgcaaaagatg

SEQ ID NO: 69225 - DNA, 103 bp, Artificial Sequence
  Synthetic Polynucleotide
taatacgactcactatagggtgtggaaccacaaaatacaatagcgatcttaacagaggagaaagatcatgattgtatttaacctggcggcagcgcaaaagatg

SEQ ID NO: 69226 - DNA, 103 bp, Artificial Sequence
  Synthetic Polynucleotide
taatacgactcactatagggaatagtgatattattattttttttaagtttaacagaggagaaaacttatgaaaaataataacctggcggcagcgcaaaagatg

SEQ ID NO: 69227 - DNA, 103 bp, Artificial Sequence
  Synthetic Polynucleotide
taatacgactcactatagggattgtaatagtgatattattattttttttaaacagaggagataaaaaatgtaataatataacctggcggcagcgcaaaagatg

SEQ ID NO: 69228 - DNA, 103 bp, Artificial Sequence
  Synthetic Polynucleotide
taatacgactcactatagggtattaattgtaatagtgatattattattttaacagaggagaaaaataatgatatcactaaacctggcggcagcgcaaaagatg

SEQ ID NO: 69229 - DNA, 103 bp, Artificial Sequence
  Synthetic Polynucleotide
taatacgactcactatagggatacttattaattgtaatagtgatattattaacagaggagaaataatatgactattacaaacctggcggcagcgcaaaagatg

SEQ ID NO: 69230 - DNA, 103 bp, Artificial Sequence
  Synthetic Polynucleotide
taatacgactcactatagggagtttatacttattaattgtaatagtgataaacagaggagatatcacatgtacaattaaaacctggcggcagcgcaaaagatg

SEQ ID NO: 69231 - DNA, 103 bp, Artificial Sequence
  Synthetic Polynucleotide
taatacgactcactatagggtttatagtttatacttattaattgtaatagaacagaggagactattaatgttaataagtaacctggcggcagcgcaaaagatg

SEQ ID NO: 69232 - DNA, 103 bp, Artificial Sequence
  Synthetic Polynucleotide
taatacgactcactatagggtttagtttatagtttatacttattaattgtaacagaggagaacaattatgaagtataaaaacctggcggcagcgcaaaagatg

SEQ ID NO: 69233 - DNA, 103 bp, Artificial Sequence
  Synthetic Polynucleotide
taatacgactcactatagggtaatttttagtttatagtttatacttattaaacagaggagataataaatgtaaactataaacctggcggcagcgcaaaagatg

SEQ ID NO: 69234 - DNA, 103 bp, Artificial Sequence
  Synthetic Polynucleotide
taatacgactcactatagggttgtttaatttttagtttatagtttatactaacagaggagaagtataatgtataaactaaacctggcggcagcgcaaaagatg

SEQ ID NO: 69235 - DNA, 103 bp, Artificial Sequence
  Synthetic Polynucleotide
taatacgactcactatagggcgatattgtttaatttttagtttatagtttaacagaggagaaaactaatgactaaaaataacctggcggcagcgcaaaagatg

SEQ ID NO: 69236 - DNA, 103 bp, Artificial Sequence
  Synthetic Polynucleotide
taatacgactcactatagggagattgggaattttatattattaattcagtaacagaggagaactgaaatgataatataaaacctggcggcagcgcaaaagatg

SEQ ID NO: 69237 - DNA, 103 bp, Artificial Sequence
  Synthetic Polynucleotide
taatacgactcactatagggtgaattgtggaaccacaaaatacaatagcgaacagaggagacgctatatgattttgtggaacctggcggcagcgcaaaagatg

SEQ ID NO: 69238 - DNA, 103 bp, Artificial Sequence
  Synthetic Polynucleotide
taatacgactcactatagggaataacgatattgtttaatttttagtttataacagaggagaataaacatgaaattaaacaacctggcggcagcgcaaaagatg

SEQ ID NO: 69239 - DNA, 103 bp, Artificial Sequence
  Synthetic Polynucleotide
taatacgactcactatagggtatataataacgatattgtttaatttttagaacagaggagactaaaaatgaaacaatataacctggcggcagcgcaaaagatg

SEQ ID NO: 69240 - DNA, 103 bp, Artificial Sequence
  Synthetic Polynucleotide
taatacgactcactatagggttacttatataataacgatattgtttaattaacagaggagaaattaaatgatatcgttaaacctggcggcagcgcaaaagatg

SEQ ID NO: 69241 - DNA, 103 bp, Artificial Sequence
  Synthetic Polynucleotide
taatacgactcactatagggtggtattacttatataataacgatattgttaacagaggagaaacaatatggttattataaacctggcggcagcgcaaaagatg

SEQ ID NO: 69242 - DNA, 103 bp, Artificial Sequence
  Synthetic Polynucleotide
taatacgactcactatagggcattttggtattacttatataataacgataaacagaggagatatcgtatgtatataagtaacctggcggcagcgcaaaagatg

SEQ ID NO: 69243 - DNA, 103 bp, Artificial Sequence
  Synthetic Polynucleotide
taatacgactcactatagggatcatcattttggtattacttatataataaaacagaggagattattaatgaagtaatacaacctggcggcagcgcaaaagatg

SEQ ID NO: 69244 - DNA, 103 bp, Artificial Sequence
  Synthetic Polynucleotide
taatacgactcactatagggcgtatatcatcattttggtattacttatataacagaggagaatataaatgataccaaaaaacctggcggcagcgcaaaagatg

SEQ ID NO: 69245 - DNA, 103 bp, Artificial Sequence
  Synthetic Polynucleotide
taatacgactcactatagggttaatcgtatatcatcattttggtattactaacagaggagaagtaatatgaaaatgatgaacctggcggcagcgcaaaagatg

SEQ ID NO: 69246 - DNA, 103 bp, Artificial Sequence
  Synthetic Polynucleotide
taatacgactcactatagggggctattaatcgtatatcatcattttggtaaacagaggagataccaaatggatgatataaacctggcggcagcgcaaaagatg

SEQ ID NO: 69247 - DNA, 103 bp, Artificial Sequence
  Synthetic Polynucleotide
taatacgactcactatagggagacaggctattaatcgtatatcatcatttaacagaggagaaaatgaatgtatacgattaacctggcggcagcgcaaaagatg

SEQ ID NO: 69248 - DNA, 103 bp, Artificial Sequence
  Synthetic Polynucleotide
taatacgactcactatagggggaaatgaattgtggaaccacaaaatacaaaacagaggagattgtatatggtggttccaaacctggcggcagcgcaaaagatg

SEQ ID NO: 69249 - DNA, 103 bp, Artificial Sequence
  Synthetic Polynucleotide
taatacgactcactatagggatataagacaggctattaatcgtatatcataacagaggagaatgataatggattaatagaacctggcggcagcgcaaaagatg

SEQ ID NO: 69250 - DNA, 103 bp, Artificial Sequence
  Synthetic Polynucleotide
taatacgactcactatagggcacgaatataagacaggctattaatcgtataacagaggagaatacgaatgatagcctgtaacctggcggcagcgcaaaagatg

SEQ ID NO: 69251 - DNA, 103 bp, Artificial Sequence
  Synthetic Polynucleotide
taatacgactcactatagggaaagtcacgaatataagacaggctattaataacagaggagaattaatatgctgtcttataacctggcggcagcgcaaaagatg

SEQ ID NO: 69252 - DNA, 103 bp, Artificial Sequence
  Synthetic Polynucleotide
taatacgactcactatagggtggataaagtcacgaatataagacaggctaaacagaggagatagcctatgttatattcgaacctggcggcagcgcaaaagatg

SEQ ID NO: 69253 - DNA, 103 bp, Artificial Sequence
  Synthetic Polynucleotide
taatacgactcactatagggagcaatggataaagtcacgaatataagacaaacagaggagatgtcttatgttcgtgactaacctggcggcagcgcaaaagatg

SEQ ID NO: 69254 - DNA, 103 bp, Artificial Sequence
  Synthetic Polynucleotide
taatacgactcactatagggtgactagcaatggataaagtcacgaatataaacagaggagatatattatggactttatcaacctggcggcagcgcaaaagatg

SEQ ID NO: 69255 - DNA, 103 bp, Artificial Sequence
  Synthetic Polynucleotide
taatacgactcactatagggtaaagtgactagcaatggataaagtcacgaaacagaggagatcgtgaatgtatccattgaacctggcggcagcgcaaaagatg

SEQ ID NO: 69256 - DNA, 103 bp, Artificial Sequence
  Synthetic Polynucleotide
taatacgactcactataggggaatgtaaagtgactagcaatggataaagtaacagaggagaactttaatgattgctagtaacctggcggcagcgcaaaagatg

SEQ ID NO: 69257 - DNA, 103 bp, Artificial Sequence
  Synthetic Polynucleotide
taatacgactcactatagggaacgggaatgtaaagtgactagcaatggataacagaggagaatccatatgtagtcacttaacctggcggcagcgcaaaagatg

SEQ ID NO: 69258 - DNA, 103 bp, Artificial Sequence
  Synthetic Polynucleotide
taatacgactcactatagggggaataacgggaatgtaaagtgactagcaaaacagaggagattgctaatgactttacataacctggcggcagcgcaaaagatg

SEQ ID NO: 69259 - DNA, 103 bp, Artificial Sequence
  Synthetic Polynucleotide
taatacgactcactatagggtgtatggaaatgaattgtggaaccacaaaaaacagaggagattttgtatgtccacaattaacctggcggcagcgcaaaagatg

SEQ ID NO: 69260 - DNA, 103 bp, Artificial Sequence
  Synthetic Polynucleotide
taatacgactcactatagggtgggaggaataacgggaatgtaaagtgactaacagaggagaagtcacatgacattcccgaacctggcggcagcgcaaaagatg

SEQ ID NO: 69261 - DNA, 103 bp, Artificial Sequence
  Synthetic Polynucleotide
taatacgactcactatagggcgtaatgggaggaataacgggaatgtaaagaacagaggagactttacatgcccgttattaacctggcggcagcgcaaaagatg

SEQ ID NO: 69262 - DNA, 103 bp, Artificial Sequence
  Synthetic Polynucleotide
taatacgactcactatagggtcttccgtaatgggaggaataacgggaatgaacagaggagacattccatgtattcctccaacctggcggcagcgcaaaagatg

SEQ ID NO: 69263 - DNA, 103 bp, Artificial Sequence
  Synthetic Polynucleotide
taatacgactcactatagggatttatcttccgtaatgggaggaataacggaacagaggagaccgttaatgctcccattaaacctggcggcagcgcaaaagatg

SEQ ID NO: 69264 - DNA, 103 bp, Artificial Sequence
  Synthetic Polynucleotide
taatacgactcactatagggaaacgatttatcttccgtaatgggaggaataacagaggagaattcctatgattacggaaaacctggcggcagcgcaaaagatg

SEQ ID NO: 69265 - DNA, 103 bp, Artificial Sequence
  Synthetic Polynucleotide
taatacgactcactatagggctattaaacgatttatcttccgtaatgggaaacagaggagatcccatatgggaagataaaacctggcggcagcgcaaaagatg

SEQ ID NO: 69266 - DNA, 103 bp, Artificial Sequence
  Synthetic Polynucleotide
taatacgactcactatagggctacactattaaacgatttatcttccgtaaaacagaggagattacggatgataaatcgtaacctggcggcagcgcaaaagatg

SEQ ID NO: 69267 - DNA, 103 bp, Artificial Sequence
  Synthetic Polynucleotide
taatacgactcactatagggtacctctacactattaaacgatttatcttcaacagaggagagaagatatgtcgtttaataacctggcggcagcgcaaaagatg

SEQ ID NO: 69268 - DNA, 103 bp, Artificial Sequence
  Synthetic Polynucleotide
taatacgactcactatagggactaatacctctacactattaaacgatttaaacagaggagataaatcatgtaatagtgtaacctggcggcagcgcaaaagatg

SEQ ID NO: 69269 - DNA, 103 bp, Artificial Sequence
  Synthetic Polynucleotide
taatacgactcactatagggaggaaactaatacctctacactattaaacgaacagaggagacgtttaatggtgtagaggaacctggcggcagcgcaaaagatg

SEQ ID NO: 69270 - DNA, 103 bp, Artificial Sequence
  Synthetic Polynucleotide
taatacgactcactatagggtaacatgtatggaaatgaattgtggaaccaaacagaggagatggttcatgaattcatttaacctggcggcagcgcaaaagatg

SEQ ID NO: 69271 - DNA, 103 bp, Artificial Sequence
  Synthetic Polynucleotide
taatacgactcactatagggaaacaaggaaactaatacctctacactattaacagaggagaaatagtatggaggtattaaacctggcggcagcgcaaaagatg

SEQ ID NO: 69272 - DNA, 103 bp, Artificial Sequence
  Synthetic Polynucleotide
taatacgactcactatagggtctctaaacaaggaaactaatacctctacaaacagaggagatgtagaatgattagtttcaacctggcggcagcgcaaaagatg

SEQ ID NO: 69273 - DNA, 103 bp, Artificial Sequence
  Synthetic Polynucleotide
taatacgactcactataggggatcatctctaaacaaggaaactaatacctaacagaggagaaggtatatgtttccttgtaacctggcggcagcgcaaaagatg

SEQ ID NO: 69274 - DNA, 103 bp, Artificial Sequence
  Synthetic Polynucleotide
taatacgactcactatagggtttttgatcatctctaaacaaggaaactaaaacagaggagattagttatgttgtttagaaacctggcggcagcgcaaaagatg

SEQ ID NO: 69275 - DNA, 103 bp, Artificial Sequence
  Synthetic Polynucleotide
taatacgactcactatagggtagtctttttgatcatctctaaacaaggaaaacagaggagattccttatgtagagatgaaacctggcggcagcgcaaaagatg

SEQ ID NO: 69276 - DNA, 103 bp, Artificial Sequence
  Synthetic Polynucleotide
taatacgactcactatagggccgtatagtctttttgatcatctctaaacaaacagaggagatgtttaatgatgatcaaaaacctggcggcagcgcaaaagatg

SEQ ID NO: 69277 - DNA, 103 bp, Artificial Sequence
  Synthetic Polynucleotide
taatacgactcactatagggagttaccgtatagtctttttgatcatctctaacagaggagaagagatatgcaaaaagacaacctggcggcagcgcaaaagatg

SEQ ID NO: 69278 - DNA, 103 bp, Artificial Sequence
  Synthetic Polynucleotide
taatacgactcactatagggtgagaagttaccgtatagtctttttgatcaaacagaggagatgatcaatgagactatacaacctggcggcagcgcaaaagatg

SEQ ID NO: 69279 - DNA, 103 bp, Artificial Sequence
  Synthetic Polynucleotide
taatacgactcactatagggtgaactgagaagttaccgtatagtctttttaacagaggagaaaaaagatgatacggtaaaacctggcggcagcgcaaaagatg

SEQ ID NO: 69280 - DNA, 103 bp, Artificial Sequence
  Synthetic Polynucleotide
taatacgactcactataggggttattgaactgagaagttaccgtatagtcaacagaggagagactatatggtaacttctaacctggcggcagcgcaaaagatg

SEQ ID NO: 69281 - DNA, 103 bp, Artificial Sequence
  Synthetic Polynucleotide
taatacgactcactataggggataataacatgtatggaaatgaattgtggaacagaggagaccacaaatgatttccataaacctggcggcagcgcaaaagatg

SEQ ID NO: 69282 - DNA, 103 bp, Artificial Sequence
  Synthetic Polynucleotide
taatacgactcactataggggtgtagttattgaactgagaagttaccgtaaacagaggagatacggtatgttctcagttaacctggcggcagcgcaaaagatg

SEQ ID NO: 69283 - DNA, 103 bp, Artificial Sequence
  Synthetic Polynucleotide
taatacgactcactatagggtcgatgtgtagttattgaactgagaagttaaacagaggagataacttatgagttcaataaacctggcggcagcgcaaaagatg

SEQ ID NO: 69284 - DNA, 103 bp, Artificial Sequence
  Synthetic Polynucleotide
taatacgactcactatagggtggtgtcgatgtgtagttattgaactgagaaacagaggagatctcagatgaataactacaacctggcggcagcgcaaaagatg

SEQ ID NO: 69285 - DNA, 103 bp, Artificial Sequence
  Synthetic Polynucleotide
taatacgactcactataggggtcgttggtgtcgatgtgtagttattgaacaacagaggagagttcaaatgctacacatcaacctggcggcagcgcaaaagatg

SEQ ID NO: 69286 - DNA, 103 bp, Artificial Sequence
  Synthetic Polynucleotide
taatacgactcactataggggtccagtcgttggtgtcgatgtgtagttataacagaggagaataactatgcatcgacacaacctggcggcagcgcaaaagatg

SEQ ID NO: 69287 - DNA, 103 bp, Artificial Sequence
  Synthetic Polynucleotide
taatacgactcactatagggttatagtccagtcgttggtgtcgatgtgtaaacagaggagatacacaatgacaccaacgaacctggcggcagcgcaaaagatg

SEQ ID NO: 69288 - DNA, 103 bp, Artificial Sequence
  Synthetic Polynucleotide
taatacgactcactatagggtacatttatagtccagtcgttggtgtcgataacagaggagaatcgacatgaacgactggaacctggcggcagcgcaaaagatg

SEQ ID NO: 69289 - DNA, 103 bp, Artificial Sequence
  Synthetic Polynucleotide
taatacgactcactataggggatagtacatttatagtccagtcgttggtgaacagaggagacaccaaatgctggactataacctggcggcagcgcaaaagatg

SEQ ID NO: 69290 - DNA, 103 bp, Artificial Sequence
  Synthetic Polynucleotide
taatacgactcactatagggcatcggatagtacatttatagtccagtcgtaacagaggagaacgactatgctataaatgaacctggcggcagcgcaaaagatg

SEQ ID NO: 69291 - DNA, 103 bp, Artificial Sequence
  Synthetic Polynucleotide
taatacgactcactatagggcagaccatcggatagtacatttatagtccaaacagaggagatggactatgaatgtactaaacctggcggcagcgcaaaagatg

SEQ ID NO: 69292 - DNA, 103 bp, Artificial Sequence
  Synthetic Polynucleotide
taatacgactcactatagggagtgtgataataacatgtatggaaatgaataacagaggagaattcatatgcatacatgtaacctggcggcagcgcaaaagatg

SEQ ID NO: 69293 - DNA, 103 bp, Artificial Sequence
  Synthetic Polynucleotide
taatacgactcactatagggatatccagaccatcggatagtacatttataaacagaggagatataaaatgactatccgaaacctggcggcagcgcaaaagatg

SEQ ID NO: 69294 - DNA, 103 bp, Artificial Sequence
  Synthetic Polynucleotide
taatacgactcactatagggatggtatatccagaccatcggatagtacataacagaggagaatgtacatgccgatggtcaacctggcggcagcgcaaaagatg

SEQ ID NO: 69295 - DNA, 103 bp, Artificial Sequence
  Synthetic Polynucleotide
taatacgactcactatagggagtcaatggtatatccagaccatcggatagaacagaggagactatccatgggtctggataacctggcggcagcgcaaaagatg

SEQ ID NO: 69296 - DNA, 103 bp, Artificial Sequence
  Synthetic Polynucleotide
taatacgactcactatagggatattagtcaatggtatatccagaccatcgaacagaggagacgatggatgggatataccaacctggcggcagcgcaaaagatg

SEQ ID NO: 69297 - DNA, 103 bp, Artificial Sequence
  Synthetic Polynucleotide
taatacgactcactatagggaagttatattagtcaatggtatatccagacaacagaggagagtctggatgtaccattgaaacctggcggcagcgcaaaagatg

SEQ ID NO: 69298 - DNA, 103 bp, Artificial Sequence
  Synthetic Polynucleotide
taatacgactcactatagggccaataagttatattagtcaatggtatatcaacagaggagagatataatgttgactaataacctggcggcagcgcaaaagatg

SEQ ID NO: 69299 - DNA, 103 bp, Artificial Sequence
  Synthetic Polynucleotide
taatacgactcactatagggcgtgaccaataagttatattagtcaatggtaacagaggagaaccattatgtaatataacaacctggcggcagcgcaaaagatg

SEQ ID NO: 69300 - DNA, 103 bp, Artificial Sequence
  Synthetic Polynucleotide
taatacgactcactatagggtaaaccgtgaccaataagttatattagtcaaacagaggagatgactaatgtaacttattaacctggcggcagcgcaaaagatg

SEQ ID NO: 69301 - DNA, 103 bp, Artificial Sequence
  Synthetic Polynucleotide
taatacgactcactatagggtatagtaaaccgtgaccaataagttatattaacagaggagaaatataatgtattggtcaaacctggcggcagcgcaaaagatg

SEQ ID NO: 69302 - DNA, 103 bp, Artificial Sequence
  Synthetic Polynucleotide
taatacgactcactatagggcgacctatagtaaaccgtgaccaataagttaacagaggagaaacttaatggtcacggttaacctggcggcagcgcaaaagatg

SEQ ID NO: 69303 - DNA, 103 bp, Artificial Sequence
  Synthetic Polynucleotide
taatacgactcactatagggatatcagtgtgataataacatgtatggaaaaacagaggagatttccaatgatgttattaaacctggcggcagcgcaaaagatg

SEQ ID NO: 69304 - DNA, 103 bp, Artificial Sequence
  Synthetic Polynucleotide
taatacgactcactatagggatacacgacctatagtaaaccgtgaccaataacagaggagaattggtatgggtttactaaacctggcggcagcgcaaaagatg

SEQ ID NO: 69305 - DNA, 103 bp, Artificial Sequence
  Synthetic Polynucleotide
taatacgactcactataggggaacaatacacgacctatagtaaaccgtgaaacagaggagatcacggatgactataggtaacctggcggcagcgcaaaagatg

SEQ ID NO: 69306 - DNA, 103 bp, Artificial Sequence
  Synthetic Polynucleotide
taatacgactcactataggggatttgaacaatacacgacctatagtaaacaacagaggagagtttacatgaggtcgtgtaacctggcggcagcgcaaaagatg

SEQ ID NO: 69307 - DNA, 103 bp, Artificial Sequence
  Synthetic Polynucleotide
taatacgactcactatagggactctgatttgaacaatacacgacctatagaacagaggagactatagatggtgtattgtaacctggcggcagcgcaaaagatg

SEQ ID NO: 69308 - DNA, 103 bp, Artificial Sequence
  Synthetic Polynucleotide
taatacgactcactatagggctcagactctgatttgaacaatacacgaccaacagaggagaggtcgtatgttgttcaaaaacctggcggcagcgcaaaagatg

SEQ ID NO: 69309 - DNA, 103 bp, Artificial Sequence
  Synthetic Polynucleotide
taatacgactcactatagggatatcctcagactctgatttgaacaatacaaacagaggagatgtattatgcaaatcagaaacctggcggcagcgcaaaagatg

SEQ ID NO: 69310 - DNA, 103 bp, Artificial Sequence
  Synthetic Polynucleotide
taatacgactcactatagggggaaaatatcctcagactctgatttgaacaaacagaggagatgttcaatgcagagtctgaacctggcggcagcgcaaaagatg

SEQ ID NO: 69311 - DNA, 103 bp, Artificial Sequence
  Synthetic Polynucleotide
taatacgactcactatagggcttttggaaaatatcctcagactctgatttaacagaggagaaaatcaatgtctgaggataacctggcggcagcgcaaaagatg

SEQ ID NO: 69312 - DNA, 103 bp, Artificial Sequence
  Synthetic Polynucleotide
taatacgactcactatagggatgttcttttggaaaatatcctcagactctaacagaggagaagagtcatgggatattttaacctggcggcagcgcaaaagatg

SEQ ID NO: 69313 - DNA, 103 bp, Artificial Sequence
  Synthetic Polynucleotide
taatacgactcactatagggtactcatgttcttttggaaaatatcctcagaacagaggagactgaggatgttttccaaaaacctggcggcagcgcaaaagatg

SEQ ID NO: 69314 - DNA, 103 bp, Artificial Sequence
  Synthetic Polynucleotide
taatacgactcactatagggtcataatatcagtgtgataataacatgtataacagaggagaatacatatgattatcacaaacctggcggcagcgcaaaagatg

SEQ ID NO: 69315 - DNA, 103 bp, Artificial Sequence
  Synthetic Polynucleotide
taatacgactcactatagggtagaatactcatgttcttttggaaaatatcaacagaggagagatattatgcaaaagaacaacctggcggcagcgcaaaagatg

SEQ ID NO: 69316 - DNA, 103 bp, Artificial Sequence
  Synthetic Polynucleotide
taatacgactcactatagggacacctagaatactcatgttcttttggaaaaacagaggagatttccaatggaacatgagaacctggcggcagcgcaaaagatg

SEQ ID NO: 69317 - DNA, 103 bp, Artificial Sequence
  Synthetic Polynucleotide
taatacgactcactatagggtagagacacctagaatactcatgttcttttaacagaggagaaaaagaatgtgagtattcaacctggcggcagcgcaaaagatg

SEQ ID NO: 69318 - DNA, 103 bp, Artificial Sequence
  Synthetic Polynucleotide
taatacgactcactatagggttcaatagagacacctagaatactcatgttaacagaggagaaacatgatgattctaggtaacctggcggcagcgcaaaagatg

SEQ ID NO: 69319 - DNA, 103 bp, Artificial Sequence
  Synthetic Polynucleotide
taatacgactcactatagggttacattcaatagagacacctagaatactcaacagaggagagagtatatgaggtgtctcaacctggcggcagcgcaaaagatg

SEQ ID NO: 69320 - DNA, 103 bp, Artificial Sequence
  Synthetic Polynucleotide
taatacgactcactataggggcttcttacattcaatagagacacctagaaaacagaggagattctagatgtctctattgaacctggcggcagcgcaaaagatg

SEQ ID NO: 69321 - DNA, 103 bp, Artificial Sequence
  Synthetic Polynucleotide
taatacgactcactatagggcgacggcttcttacattcaatagagacaccaacagaggagaggtgtcatgattgaatgtaacctggcggcagcgcaaaagatg

SEQ ID NO: 69322 - DNA, 103 bp, Artificial Sequence
  Synthetic Polynucleotide
taatacgactcactatagggaataccgacggcttcttacattcaatagagaacagaggagactctatatgatgtaagaaaacctggcggcagcgcaaaagatg

SEQ ID NO: 69323 - DNA, 103 bp, Artificial Sequence
  Synthetic Polynucleotide
taatacgactcactatagggtaagtaataccgacggcttcttacattcaaaacagaggagattgaatatgagaagccgtaacctggcggcagcgcaaaagatg

SEQ ID NO: 69324 - DNA, 103 bp, Artificial Sequence
  Synthetic Polynucleotide
taatacgactcactatagggaaaagtaagtaataccgacggcttcttacaaacagaggagatgtaagatgccgtcggtaaacctggcggcagcgcaaaagatg

SEQ ID NO: 69325 - DNA, 103 bp, Artificial Sequence
  Synthetic Polynucleotide
taatacgactcactataggggttcatcataatatcagtgtgataataacaaacagaggagatgttatatgcacactgataacctggcggcagcgcaaaagatg

SEQ ID NO: 69326 - DNA, 103 bp, Artificial Sequence
  Synthetic Polynucleotide
taatacgactcactatagggggtcaaaaagtaagtaataccgacggcttcaacagaggagagaagccatgggtattactaacctggcggcagcgcaaaagatg

SEQ ID NO: 69327 - DNA, 103 bp, Artificial Sequence
  Synthetic Polynucleotide
taatacgactcactatagggcacacggtcaaaaagtaagtaataccgacgaacagaggagacgtcggatgtacttacttaacctggcggcagcgcaaaagatg

SEQ ID NO: 69328 - DNA, 103 bp, Artificial Sequence
  Synthetic Polynucleotide
taatacgactcactatagggttttacacacggtcaaaaagtaagtaatacaacagaggagagtattaatgactttttgaaacctggcggcagcgcaaaagatg

SEQ ID NO: 69329 - DNA, 103 bp, Artificial Sequence
  Synthetic Polynucleotide
taatacgactcactatagggagtcattttacacacggtcaaaaagtaagtaacagaggagaacttacatgttgaccgtgaacctggcggcagcgcaaaagatg

SEQ ID NO: 69330 - DNA, 103 bp, Artificial Sequence
  Synthetic Polynucleotide
taatacgactcactatagggactcgagtcattttacacacggtcaaaaagaacagaggagactttttatgcgtgtgtaaaacctggcggcagcgcaaaagatg

SEQ ID NO: 69331 - DNA, 103 bp, Artificial Sequence
  Synthetic Polynucleotide
taatacgactcactatagggcaaatactcgagtcattttacacacggtcaaacagaggagatgaccgatggtaaaatgaaacctggcggcagcgcaaaagatg

SEQ ID NO: 69332 - DNA, 103 bp, Artificial Sequence
  Synthetic Polynucleotide
taatacgactcactataggggaagtcaaatactcgagtcattttacacacaacagaggagagtgtgtatgatgactcgaaacctggcggcagcgcaaaagatg

SEQ ID NO: 69333 - DNA, 103 bp, Artificial Sequence
  Synthetic Polynucleotide
taatacgactcactatagggatctggaagtcaaatactcgagtcattttaaacagaggagataaaatatgtcgagtattaacctggcggcagcgcaaaagatg

SEQ ID NO: 69334 - DNA, 103 bp, Artificial Sequence
  Synthetic Polynucleotide
taatacgactcactatagggtccatatctggaagtcaaatactcgagtcaaacagaggagatgactcatgtatttgactaacctggcggcagcgcaaaagatg

SEQ ID NO: 69335 - DNA, 103 bp, Artificial Sequence
  Synthetic Polynucleotide
taatacgactcactatagggaataatccatatctggaagtcaaatactcgaacagaggagacgagtaatggacttccagaacctggcggcagcgcaaaagatg

SEQ ID NO: 69336 - DNA, 103 bp, Artificial Sequence
  Synthetic Polynucleotide
taatacgactcactatagggataaagttcatcataatatcagtgtgataaaacagaggagattatcaatgtgatattataacctggcggcagcgcaaaagatg

SEQ ID NO: 69337 - DNA, 103 bp, Artificial Sequence
  Synthetic Polynucleotide
taatacgactcactatagggtcgataataatccatatctggaagtcaaataacagaggagaatttgaatgccagatatgaacctggcggcagcgcaaaagatg

SEQ ID NO: 69338 - DNA, 103 bp, Artificial Sequence
  Synthetic Polynucleotide
taatacgactcactatagggtctcctcgataataatccatatctggaagtaacagaggagaacttccatgtatggattaaacctggcggcagcgcaaaagatg

SEQ ID NO: 69339 - DNA, 103 bp, Artificial Sequence
  Synthetic Polynucleotide
taatacgactcactataggggacagtctcctcgataataatccatatctgaacagaggagacagataatgattattatcaacctggcggcagcgcaaaagatg

SEQ ID NO: 69340 - DNA, 103 bp, Artificial Sequence
  Synthetic Polynucleotide
taatacgactcactatagggttctagacagtctcctcgataataatccataacagaggagaatggatatgtatcgaggaaacctggcggcagcgcaaaagatg

SEQ ID NO: 69341 - DNA, 103 bp, Artificial Sequence
  Synthetic Polynucleotide
taatacgactcactatagggacgacttctagacagtctcctcgataataaaacagaggagattattaatgaggagactgaacctggcggcagcgcaaaagatg

SEQ ID NO: 69342 - DNA, 103 bp, Artificial Sequence
  Synthetic Polynucleotide
taatacgactcactatagggtataaacgacttctagacagtctcctcgataacagaggagaatcgagatgactgtctagaacctggcggcagcgcaaaagatg

SEQ ID NO: 69343 - DNA, 103 bp, Artificial Sequence
  Synthetic Polynucleotide
taatacgactcactatagggtgttatataaacgacttctagacagtctccaacagaggagaggagacatgctagaagtcaacctggcggcagcgcaaaagatg

SEQ ID NO: 69344 - DNA, 103 bp, Artificial Sequence
  Synthetic Polynucleotide
taatacgactcactataggggtcattgttatataaacgacttctagacagaacagaggagactgtctatgagtcgtttaaacctggcggcagcgcaaaagatg

SEQ ID NO: 69345 - DNA, 103 bp, Artificial Sequence
  Synthetic Polynucleotide
taatacgactcactatagggtataagtcattgttatataaacgacttctaaacagaggagatagaagatgtttatataaaacctggcggcagcgcaaaagatg

SEQ ID NO: 69346 - DNA, 103 bp, Artificial Sequence
  Synthetic Polynucleotide
taatacgactcactatagggatttttataagtcattgttatataaacgacaacagaggagagtcgttatgataacaatgaacctggcggcagcgcaaaagatg

SEQ ID NO: 69347 - DNA, 103 bp, Artificial Sequence
  Synthetic Polynucleotide
taatacgactcactatagggtaacaagattgggaattttatattattaataacagaggagaattaatatgataaaattcaacctggcggcagcgcaaaagatg

SEQ ID NO: 69348 - DNA, 103 bp, Artificial Sequence
  Synthetic Polynucleotide
taatacgactcactataggggctggataaagttcatcataatatcagtgtaacagaggagaacactgatgttatgatgaaacctggcggcagcgcaaaagatg

SEQ ID NO: 69349 - DNA, 103 bp, Artificial Sequence
  Synthetic Polynucleotide
taatacgactcactatagggttagtatttttataagtcattgttatataaaacagaggagattatatatgaatgacttaaacctggcggcagcgcaaaagatg

SEQ ID NO: 69350 - DNA, 103 bp, Artificial Sequence
  Synthetic Polynucleotide
taatacgactcactatagggcagttttagtatttttataagtcattgttaaacagaggagataacaaatgcttataaaaaacctggcggcagcgcaaaagatg

SEQ ID NO: 69351 - DNA, 103 bp, Artificial Sequence
  Synthetic Polynucleotide
taatacgactcactatagggctcttcagttttagtatttttataagtcataacagaggagaatgactatgaaaaatactaacctggcggcagcgcaaaagatg

SEQ ID NO: 69352 - DNA, 103 bp, Artificial Sequence
  Synthetic Polynucleotide
taatacgactcactatagggtcagtctcttcagttttagtatttttataaaacagaggagattataaatgtactaaaacaacctggcggcagcgcaaaagatg

SEQ ID NO: 69353 - DNA, 103 bp, Artificial Sequence
  Synthetic Polynucleotide
taatacgactcactatagggcgtaatcagtctcttcagttttagtattttaacagaggagaaaaataatgaaactgaagaacctggcggcagcgcaaaagatg

SEQ ID NO: 69354 - DNA, 103 bp, Artificial Sequence
  Synthetic Polynucleotide
taatacgactcactataggggtatgcgtaatcagtctcttcagttttagtaacagaggagaactaaaatggaagagactaacctggcggcagcgcaaaagatg

SEQ ID NO: 69355 - DNA, 103 bp, Artificial Sequence
  Synthetic Polynucleotide
taatacgactcactataggggagaggtatgcgtaatcagtctcttcagttaacagaggagaaactgaatggactgattaaacctggcggcagcgcaaaagatg

SEQ ID NO: 69356 - DNA, 103 bp, Artificial Sequence
  Synthetic Polynucleotide
taatacgactcactatagggcattagagaggtatgcgtaatcagtctcttaacagaggagaaagagaatgattacgcataacctggcggcagcgcaaaagatg

SEQ ID NO: 69357 - DNA, 103 bp, Artificial Sequence
  Synthetic Polynucleotide
taatacgactcactatagggccgcacattagagaggtatgcgtaatcagtaacagaggagaactgatatggcatacctcaacctggcggcagcgcaaaagatg

SEQ ID NO: 69358 - DNA, 103 bp, Artificial Sequence
  Synthetic Polynucleotide
taatacgactcactatagggggaatccgcacattagagaggtatgcgtaaaacagaggagattacgcatgcctctctaaaacctggcggcagcgcaaaagatg

SEQ ID NO: 69359 - DNA, 103 bp, Artificial Sequence
  Synthetic Polynucleotide
taatacgactcactatagggcagcggctggataaagttcatcataatatcaacagaggagagatattatgatgaactttaacctggcggcagcgcaaaagatg

SEQ ID NO: 69360 - DNA, 103 bp, Artificial Sequence
  Synthetic Polynucleotide
taatacgactcactatagggattcaggaatccgcacattagagaggtatgaacagaggagacataccatgctaatgtgcaacctggcggcagcgcaaaagatg

SEQ ID NO: 69361 - DNA, 103 bp, Artificial Sequence
  Synthetic Polynucleotide
taatacgactcactatagggatagtattcaggaatccgcacattagagagaacagaggagactctctatggtgcggattaacctggcggcagcgcaaaagatg

SEQ ID NO: 69362 - DNA, 103 bp, Artificial Sequence
  Synthetic Polynucleotide
taatacgactcactatagggaatcgatagtattcaggaatccgcacattaaacagaggagataatgtatggattcctgaaacctggcggcagcgcaaaagatg

SEQ ID NO: 69363 - DNA, 103 bp, Artificial Sequence
  Synthetic Polynucleotide
taatacgactcactatagggtcatcaatcgatagtattcaggaatccgcaaacagaggagatgcggaatgctgaatactaacctggcggcagcgcaaaagatg

SEQ ID NO: 69364 - DNA, 103 bp, Artificial Sequence
  Synthetic Polynucleotide
taatacgactcactatagggattactcatcaatcgatagtattcaggaataacagaggagaattcctatgtactatcgaaacctggcggcagcgcaaaagatg

SEQ ID NO: 69365 - DNA, 103 bp, Artificial Sequence
  Synthetic Polynucleotide
taatacgactcactatagggaccccattactcatcaatcgatagtattcaaacagaggagatgaataatgtcgattgataacctggcggcagcgcaaaagatg

SEQ ID NO: 69366 - DNA, 103 bp, Artificial Sequence
  Synthetic Polynucleotide
taatacgactcactatagggcatcaaccccattactcatcaatcgatagtaacagaggagaactatcatgtgatgagtaaacctggcggcagcgcaaaagatg

SEQ ID NO: 69367 - DNA, 103 bp, Artificial Sequence
  Synthetic Polynucleotide
taatacgactcactatagggtcaaccatcaaccccattactcatcaatcgaacagaggagacgattgatgagtaatgggaacctggcggcagcgcaaaagatg

SEQ ID NO: 69368 - DNA, 103 bp, Artificial Sequence
  Synthetic Polynucleotide
taatacgactcactatagggaataatcaaccatcaaccccattactcatcaacagaggagagatgagatgtggggttgaaacctggcggcagcgcaaaagatg

SEQ ID NO: 69369 - DNA, 103 bp, Artificial Sequence
  Synthetic Polynucleotide
taatacgactcactatagggtaatcaataatcaaccatcaaccccattacaacagaggagagtaatgatgttgatggttaacctggcggcagcgcaaaagatg

SEQ ID NO: 69370 - DNA, 103 bp, Artificial Sequence
  Synthetic Polynucleotide
taatacgactcactatagggcaacccagcggctggataaagttcatcataaacagaggagatatgatatgctttatccaaacctggcggcagcgcaaaagatg

SEQ ID NO: 69371 - DNA, 103 bp, Artificial Sequence
  Synthetic Polynucleotide
taatacgactcactatagggaaaactaatcaataatcaaccatcaaccccaacagaggagaggggttatgggttgattaaacctggcggcagcgcaaaagatg

SEQ ID NO: 69372 - DNA, 103 bp, Artificial Sequence
  Synthetic Polynucleotide
taatacgactcactatagggtaaggaaaactaatcaataatcaaccatcaaacagaggagatgatggatgattattgataacctggcggcagcgcaaaagatg

SEQ ID NO: 69373 - DNA, 103 bp, Artificial Sequence
  Synthetic Polynucleotide
taatacgactcactatagggaagaataaggaaaactaatcaataatcaacaacagaggagagttgatatgtgattagttaacctggcggcagcgcaaaagatg

SEQ ID NO: 69374 - DNA, 103 bp, Artificial Sequence
  Synthetic Polynucleotide
taatacgactcactatagggataaaaagaataaggaaaactaatcaataaaacagaggagattattgatgagttttcctaacctggcggcagcgcaaaagatg

SEQ ID NO: 69375 - DNA, 103 bp, Artificial Sequence
  Synthetic Polynucleotide
taatacgactcactatagggtgtgaataaaaagaataaggaaaactaatcaacagaggagagattagatgtccttattcaacctggcggcagcgcaaaagatg

SEQ ID NO: 69376 - DNA, 103 bp, Artificial Sequence
  Synthetic Polynucleotide
taatacgactcactatagggttttatgtgaataaaaagaataaggaaaacaacagaggagagttttcatgattctttttaacctggcggcagcgcaaaagatg

SEQ ID NO: 69377 - DNA, 103 bp, Artificial Sequence
  Synthetic Polynucleotide
taatacgactcactatagggtattcttttatgtgaataaaaagaataaggaacagaggagaccttatatgttttattcaaacctggcggcagcgcaaaagatg

SEQ ID NO: 69378 - DNA, 103 bp, Artificial Sequence
  Synthetic Polynucleotide
taatacgactcactatagggaaaaatattcttttatgtgaataaaaagaaaacagaggagattctttatgttcacataaaacctggcggcagcgcaaaagatg

SEQ ID NO: 69379 - DNA, 103 bp, Artificial Sequence
  Synthetic Polynucleotide
taatacgactcactatagggttataaaaaatattcttttatgtgaataaaaacagaggagatttattatgataaaagaaaacctggcggcagcgcaaaagatg

SEQ ID NO: 69380 - DNA, 103 bp, Artificial Sequence
  Synthetic Polynucleotide
taatacgactcactatagggcatgtttataaaaaatattcttttatgtgaaacagaggagatcacatatgagaatatttaacctggcggcagcgcaaaagatg

SEQ ID NO: 69381 - DNA, 103 bp, Artificial Sequence
  Synthetic Polynucleotide
taatacgactcactataggggtttacaacccagcggctggataaagttcaaacagaggagatgaactatgtccagccgcaacctggcggcagcgcaaaagatg

SEQ ID NO: 69382 - DNA, 103 bp, Artificial Sequence
  Synthetic Polynucleotide
taatacgactcactatagggggtttcatgtttataaaaaatattcttttaaacagaggagataaaagatgattttttataacctggcggcagcgcaaaagatg

SEQ ID NO: 69383 - DNA, 103 bp, Artificial Sequence
  Synthetic Polynucleotide
taatacgactcactatagggacagtggtttcatgtttataaaaaatattcaacagaggagagaatatatgttataaacaaacctggcggcagcgcaaaagatg

SEQ ID NO: 69384 - DNA, 103 bp, Artificial Sequence
  Synthetic Polynucleotide
taatacgactcactatagggtttagacagtggtttcatgtttataaaaaaaacagaggagattttttatgaacatgaaaaacctggcggcagcgcaaaagatg

SEQ ID NO: 69385 - DNA, 103 bp, Artificial Sequence
  Synthetic Polynucleotide
taatacgactcactatagggttacatttagacagtggtttcatgtttataaacagaggagatataaaatggaaaccactaacctggcggcagcgcaaaagatg

SEQ ID NO: 69386 - DNA, 103 bp, Artificial Sequence
  Synthetic Polynucleotide
taatacgactcactatagggcataattacatttagacagtggtttcatgtaacagaggagaacatgaatgcactgtctaaacctggcggcagcgcaaaagatg

SEQ ID NO: 69387 - DNA, 103 bp, Artificial Sequence
  Synthetic Polynucleotide
taatacgactcactatagggaagatcataattacatttagacagtggtttaacagaggagaaaaccaatgtctaaatgtaacctggcggcagcgcaaaagatg

SEQ ID NO: 69388 - DNA, 103 bp, Artificial Sequence
  Synthetic Polynucleotide
taatacgactcactatagggaaatcaagatcataattacatttagacagtaacagaggagaactgtcatgatgtaattaaacctggcggcagcgcaaaagatg

SEQ ID NO: 69389 - DNA, 103 bp, Artificial Sequence
  Synthetic Polynucleotide
taatacgactcactatagggtctataaatcaagatcataattacatttagaacagaggagactaaatatgattatgatcaacctggcggcagcgcaaaagatg

SEQ ID NO: 69390 - DNA, 103 bp, Artificial Sequence
  Synthetic Polynucleotide
taatacgactcactatagggtttcatctataaatcaagatcataattacaaacagaggagatgtaatatggatcttgataacctggcggcagcgcaaaagatg

SEQ ID NO: 69391 - DNA, 103 bp, Artificial Sequence
  Synthetic Polynucleotide
taatacgactcactatagggctgattttcatctataaatcaagatcataaaacagaggagattatgaatgtgatttataaacctggcggcagcgcaaaagatg

SEQ ID NO: 69392 - DNA, 103 bp, Artificial Sequence
  Synthetic Polynucleotide
taatacgactcactatagggatgttgtttacaacccagcggctggataaaaacagaggagatttatcatgccgctgggtaacctggcggcagcgcaaaagatg

SEQ ID NO: 69393 - DNA, 103 bp, Artificial Sequence
  Synthetic Polynucleotide
taatacgactcactatagggagcagctgattttcatctataaatcaagataacagaggagaatcttgatgtatagatgaaacctggcggcagcgcaaaagatg

SEQ ID NO: 69394 - DNA, 103 bp, Artificial Sequence
  Synthetic Polynucleotide
taatacgactcactatagggtctaaagcagctgattttcatctataaatcaacagaggagagatttaatgatgaaaatcaacctggcggcagcgcaaaagatg

SEQ ID NO: 69395 - DNA, 103 bp, Artificial Sequence
  Synthetic Polynucleotide
taatacgactcactatagggaatcatctaaagcagctgattttcatctataacagaggagaatagatatgaatcagctgaacctggcggcagcgcaaaagatg

SEQ ID NO: 69396 - DNA, 103 bp, Artificial Sequence
  Synthetic Polynucleotide
taatacgactcactatagggaccaaaatcatctaaagcagctgattttcaaacagaggagatgaaaaatggctgctttaaacctggcggcagcgcaaaagatg

SEQ ID NO: 69397 - DNA, 103 bp, Artificial Sequence
  Synthetic Polynucleotide
taatacgactcactatagggtactaaccaaaatcatctaaagcagctgataacagaggagaatcagcatgtttagatgaaacctggcggcagcgcaaaagatg

SEQ ID NO: 69398 - DNA, 103 bp, Artificial Sequence
  Synthetic Polynucleotide
taatacgactcactatagggatacatactaaccaaaatcatctaaagcagaacagaggagactgcttatgatgattttgaacctggcggcagcgcaaaagatg

SEQ ID NO: 69399 - DNA, 103 bp, Artificial Sequence
  Synthetic Polynucleotide
taatacgactcactatagggatattatacatactaaccaaaatcatctaaaacagaggagattagatatgtttggttagaacctggcggcagcgcaaaagatg

SEQ ID NO: 69400 - DNA, 103 bp, Artificial Sequence
  Synthetic Polynucleotide
taatacgactcactatagggtttttatattatacatactaaccaaaatcaaacagaggagatgatttatgttagtatgtaacctggcggcagcgcaaaagatg

SEQ ID NO: 69401 - DNA, 103 bp, Artificial Sequence
  Synthetic Polynucleotide
taatacgactcactatagggttatttttttatattatacatactaaccaaaacagaggagattggttatgatgtataataacctggcggcagcgcaaaagatg

SEQ ID NO: 69402 - DNA, 103 bp, Artificial Sequence
  Synthetic Polynucleotide
taatacgactcactatagggtatatttatttttttatattatacatactaaacagaggagatagtatatgtaatataaaaacctggcggcagcgcaaaagatg

SEQ ID NO: 69403 - DNA, 103 bp, Artificial Sequence
  Synthetic Polynucleotide
taatacgactcactatagggctgttatgttgtttacaacccagcggctggaacagaggagaccagccatggggttgtaaaacctggcggcagcgcaaaagatg

SEQ ID NO: 69404 - DNA, 103 bp, Artificial Sequence
  Synthetic Polynucleotide
taatacgactcactatagggtaagttatatttatttttttatattatacaaacagaggagatgtataatgtaaaaaaataacctggcggcagcgcaaaagatg

SEQ ID NO: 69405 - DNA, 103 bp, Artificial Sequence
  Synthetic Polynucleotide
taatacgactcactatagggtaaaataagttatatttatttttttatattaacagaggagaaatataatgaaataaataaacctggcggcagcgcaaaagatg

SEQ ID NO: 69406 - DNA, 103 bp, Artificial Sequence
  Synthetic Polynucleotide
taatacgactcactatagggaatcttaaaataagttatatttatttttttaacagaggagaaaaaaaatgaatataactaacctggcggcagcgcaaaagatg

SEQ ID NO: 69407 - DNA, 103 bp, Artificial Sequence
  Synthetic Polynucleotide
taatacgactcactatagggcacttaatcttaaaataagttatatttattaacagaggagaaataaaatgaacttatttaacctggcggcagcgcaaaagatg

SEQ ID NO: 69408 - DNA, 103 bp, Artificial Sequence
  Synthetic Polynucleotide
taatacgactcactatagggaatagcacttaatcttaaaataagttatataacagaggagaatataaatgattttaagaaacctggcggcagcgcaaaagatg

SEQ ID NO: 69409 - DNA, 103 bp, Artificial Sequence
  Synthetic Polynucleotide
taatacgactcactatagggagtacaatagcacttaatcttaaaataagtaacagaggagaacttatatgaagattaagaacctggcggcagcgcaaaagatg

SEQ ID NO: 69410 - DNA, 103 bp, Artificial Sequence
  Synthetic Polynucleotide
taatacgactcactatagggaattaagtacaatagcacttaatcttaaaaaacagaggagattttaaatgtaagtgctaaacctggcggcagcgcaaaagatg

SEQ ID NO: 69411 - DNA, 103 bp, Artificial Sequence
  Synthetic Polynucleotide
taatacgactcactatagggcaaaaaattaagtacaatagcacttaatctaacagaggagaagattaatggctattgtaaacctggcggcagcgcaaaagatg

SEQ ID NO: 69412 - DNA, 103 bp, Artificial Sequence
  Synthetic Polynucleotide
taatacgactcactatagggtagaacaaaaaattaagtacaatagcacttaacagaggagaaagtgcatgtgtacttaaaacctggcggcagcgcaaaagatg

SEQ ID NO: 69413 - DNA, 103 bp, Artificial Sequence
  Synthetic Polynucleotide
taatacgactcactataggggtttatagaacaaaaaattaagtacaatagaacagaggagactattgatgttaatttttaacctggcggcagcgcaaaagatg

SEQ ID NO: 69414 - DNA, 103 bp, Artificial Sequence
  Synthetic Polynucleotide
taatacgactcactatagggactatctgttatgttgtttacaacccagcgaacagaggagacgctggatggtaaacaacaacctggcggcagcgcaaaagatg

SEQ ID NO: 69415 - DNA, 103 bp, Artificial Sequence
  Synthetic Polynucleotide
taatacgactcactatagggattcagtttatagaacaaaaaattaagtacaacagaggagagtacttatgtttttgttcaacctggcggcagcgcaaaagatg

SEQ ID NO: 69416 - DNA, 103 bp, Artificial Sequence
  Synthetic Polynucleotide
taatacgactcactatagggtatatattcagtttatagaacaaaaaattaaacagaggagataatttatggttctataaaacctggcggcagcgcaaaagatg

SEQ ID NO: 69417 - DNA, 103 bp, Artificial Sequence
  Synthetic Polynucleotide
taatacgactcactataggggtagctatatattcagtttatagaacaaaaaacagaggagattttgtatgataaactgaaacctggcggcagcgcaaaagatg

SEQ ID NO: 69418 - DNA, 103 bp, Artificial Sequence
  Synthetic Polynucleotide
taatacgactcactatagggtaattgtagctatatattcagtttatagaaaacagaggagattctatatgctgaatataaacctggcggcagcgcaaaagatg

SEQ ID NO: 69419 - DNA, 103 bp, Artificial Sequence
  Synthetic Polynucleotide
taatacgactcactataggggtcaataattgtagctatatattcagtttaaacagaggagataaactatgtatatagctaacctggcggcagcgcaaaagatg

SEQ ID NO: 69420 - DNA, 103 bp, Artificial Sequence
  Synthetic Polynucleotide
taatacgactcactatagggaacccgtcaataattgtagctatatattcaaacagaggagatgaataatgagctacaataacctggcggcagcgcaaaagatg

SEQ ID NO: 69421 - DNA, 103 bp, Artificial Sequence
  Synthetic Polynucleotide
taatacgactcactatagggaaataaacccgtcaataattgtagctatataacagaggagaatatagatgcaattattgaacctggcggcagcgcaaaagatg

SEQ ID NO: 69422 - DNA, 103 bp, Artificial Sequence
  Synthetic Polynucleotide
taatacgactcactataggggtcataaataaacccgtcaataattgtagcaacagaggagagctacaatgattgacgggaacctggcggcagcgcaaaagatg

SEQ ID NO: 69423 - DNA, 103 bp, Artificial Sequence
  Synthetic Polynucleotide
taatacgactcactatagggtgccggtcataaataaacccgtcaataattaacagaggagaaattatatgcgggtttataacctggcggcagcgcaaaagatg

SEQ ID NO: 69424 - DNA, 103 bp, Artificial Sequence
  Synthetic Polynucleotide
taatacgactcactatagggatggttgccggtcataaataaacccgtcaaaacagaggagattgacgatgttatttatgaacctggcggcagcgcaaaagatg

SEQ ID NO: 69425 - DNA, 103 bp, Artificial Sequence
  Synthetic Polynucleotide
taatacgactcactatagggaataaactatctgttatgttgtttacaaccaacagaggagaggttgtatgcaacataacaacctggcggcagcgcaaaagatg

SEQ ID NO: 69426 - DNA, 103 bp, Artificial Sequence
  Synthetic Polynucleotide
taatacgactcactatagggaattcatggttgccggtcataaataaacccaacagaggagagggtttatgtatgaccggaacctggcggcagcgcaaaagatg

SEQ ID NO: 69427 - DNA, 103 bp, Artificial Sequence
  Synthetic Polynucleotide
taatacgactcactatagggctgtaaattcatggttgccggtcataaataaacagaggagatatttaatgccggcaaccaacctggcggcagcgcaaaagatg

SEQ ID NO: 69428 - DNA, 103 bp, Artificial Sequence
  Synthetic Polynucleotide
taatacgactcactatagggaatctctgtaaattcatggttgccggtcataacagaggagaatgaccatgaaccatgaaaacctggcggcagcgcaaaagatg

SEQ ID NO: 69429 - DNA, 103 bp, Artificial Sequence
  Synthetic Polynucleotide
taatacgactcactataggggagataatctctgtaaattcatggttgccgaacagaggagacggcaaatgtgaatttacaacctggcggcagcgcaaaagatg

SEQ ID NO: 69430 - DNA, 103 bp, Artificial Sequence
  Synthetic Polynucleotide
taatacgactcactatagggagccagagataatctctgtaaattcatggtaacagaggagaaccatgatgttacagagaaacctggcggcagcgcaaaagatg

SEQ ID NO: 69431 - DNA, 103 bp, Artificial Sequence
  Synthetic Polynucleotide
taatacgactcactatagggtatatagccagagataatctctgtaaattcaacagaggagagaatttatggagattatcaacctggcggcagcgcaaaagatg

SEQ ID NO: 69432 - DNA, 103 bp, Artificial Sequence
  Synthetic Polynucleotide
taatacgactcactatagggtaagatatatagccagagataatctctgtaaacagaggagatacagaatgtatctctggaacctggcggcagcgcaaaagatg

SEQ ID NO: 69433 - DNA, 103 bp, Artificial Sequence
  Synthetic Polynucleotide
taatacgactcactatagggcacagtaagatatatagccagagataatctaacagaggagaagattaatgctggctataaacctggcggcagcgcaaaagatg

SEQ ID NO: 69434 - DNA, 103 bp, Artificial Sequence
  Synthetic Polynucleotide
taatacgactcactatagggcatgtcacagtaagatatatagccagagataacagaggagaatctctatgtatatatctaacctggcggcagcgcaaaagatg

SEQ ID NO: 69435 - DNA, 103 bp, Artificial Sequence
  Synthetic Polynucleotide
taatacgactcactatagggacgaacatgtcacagtaagatatatagccaaacagaggagatggctaatgatcttactgaacctggcggcagcgcaaaagatg

SEQ ID NO: 69436 - DNA, 103 bp, Artificial Sequence
  Synthetic Polynucleotide
taatacgactcactatagggaagataataaactatctgttatgttgtttaaacagaggagataaacaatgtaacagataaacctggcggcagcgcaaaagatg

SEQ ID NO: 69437 - DNA, 103 bp, Artificial Sequence
  Synthetic Polynucleotide
taatacgactcactatagggacaccacgaacatgtcacagtaagatatataacagaggagaatatatatgactgtgacaaacctggcggcagcgcaaaagatg

SEQ ID NO: 69438 - DNA, 103 bp, Artificial Sequence
  Synthetic Polynucleotide
taatacgactcactatagggtcataacaccacgaacatgtcacagtaagaaacagaggagatcttacatggacatgttcaacctggcggcagcgcaaaagatg

SEQ ID NO: 69439 - DNA, 103 bp, Artificial Sequence
  Synthetic Polynucleotide
taatacgactcactatagggatgtttcataacaccacgaacatgtcacagaacagaggagactgtgaatggttcgtggtaacctggcggcagcgcaaaagatg

SEQ ID NO: 69440 - DNA, 103 bp, Artificial Sequence
  Synthetic Polynucleotide
taatacgactcactatagggcatacatgtttcataacaccacgaacatgtaacagaggagaacatgtatgtggtgttataacctggcggcagcgcaaaagatg

SEQ ID NO: 69441 - DNA, 103 bp, Artificial Sequence
  Synthetic Polynucleotide
taatacgactcactatagggtttctcatacatgtttcataacaccacgaaaacagaggagattcgtgatgttatgaaacaacctggcggcagcgcaaaagatg

SEQ ID NO: 69442 - DNA, 103 bp, Artificial Sequence
  Synthetic Polynucleotide
taatacgactcactatagggcagtttttctcatacatgtttcataacaccaacagaggagaggtgttatgaaacatgtaaacctggcggcagcgcaaaagatg

SEQ ID NO: 69443 - DNA, 103 bp, Artificial Sequence
  Synthetic Polynucleotide
taatacgactcactatagggcaacgcagtttttctcatacatgtttcataaacagaggagatatgaaatgtgtatgagaaacctggcggcagcgcaaaagatg

SEQ ID NO: 69444 - DNA, 103 bp, Artificial Sequence
  Synthetic Polynucleotide
taatacgactcactatagggtgaaacaacgcagtttttctcatacatgttaacagaggagaaacatgatggagaaaaacaacctggcggcagcgcaaaagatg

SEQ ID NO: 69445 - DNA, 103 bp, Artificial Sequence
  Synthetic Polynucleotide
taatacgactcactatagggtgtcatgaaacaacgcagtttttctcatacaacagaggagagtatgaatgaaactgcgtaacctggcggcagcgcaaaagatg

SEQ ID NO: 69446 - DNA, 103 bp, Artificial Sequence
  Synthetic Polynucleotide
taatacgactcactatagggttgattgtcatgaaacaacgcagtttttctaacagaggagaagaaaaatggcgttgtttaacctggcggcagcgcaaaagatg

SEQ ID NO: 69447 - DNA, 103 bp, Artificial Sequence
  Synthetic Polynucleotide
taatacgactcactatagggtggtaaagataataaactatctgttatgttaacagaggagaaacataatggatagtttaaacctggcggcagcgcaaaagatg

SEQ ID NO: 69448 - DNA, 103 bp, Artificial Sequence
  Synthetic Polynucleotide
taatacgactcactatagggcccaattgattgtcatgaaacaacgcagttaacagaggagaaactgcatggtttcatgaaacctggcggcagcgcaaaagatg

SEQ ID NO: 69449 - DNA, 103 bp, Artificial Sequence
  Synthetic Polynucleotide
taatacgactcactatagggcatgccccaattgattgtcatgaaacaacgaacagaggagacgttgtatgatgacaatcaacctggcggcagcgcaaaagatg

SEQ ID NO: 69450 - DNA, 103 bp, Artificial Sequence
  Synthetic Polynucleotide
taatacgactcactatagggttccgcatgccccaattgattgtcatgaaaaacagaggagatttcatatgaatcaattgaacctggcggcagcgcaaaagatg

SEQ ID NO: 69451 - DNA, 103 bp, Artificial Sequence
  Synthetic Polynucleotide
taatacgactcactatagggttgtcttccgcatgccccaattgattgtcaaacagaggagatgacaaatgattggggcaaacctggcggcagcgcaaaagatg

SEQ ID NO: 69452 - DNA, 103 bp, Artificial Sequence
  Synthetic Polynucleotide
taatacgactcactatagggcttgattgtcttccgcatgccccaattgataacagaggagaatcaatatgggcatgcggaacctggcggcagcgcaaaagatg

SEQ ID NO: 69453 - DNA, 103 bp, Artificial Sequence
  Synthetic Polynucleotide
taatacgactcactatagggactatcttgattgtcttccgcatgccccaaaacagaggagattggggatggcggaagacaacctggcggcagcgcaaaagatg

SEQ ID NO: 69454 - DNA, 103 bp, Artificial Sequence
  Synthetic Polynucleotide
taatacgactcactataggggctacactatcttgattgtcttccgcatgcaacagaggagagcatgcatgagacaatcaaacctggcggcagcgcaaaagatg

SEQ ID NO: 69455 - DNA, 103 bp, Artificial Sequence
  Synthetic Polynucleotide
taatacgactcactataggggcgacgctacactatcttgattgtcttccgaacagaggagacggaagatgatcaagataaacctggcggcagcgcaaaagatg

SEQ ID NO: 69456 - DNA, 103 bp, Artificial Sequence
  Synthetic Polynucleotide
taatacgactcactatagggcggtagcgacgctacactatcttgattgtcaacagaggagagacaatatggatagtgtaaacctggcggcagcgcaaaagatg

SEQ ID NO: 69457 - DNA, 103 bp, Artificial Sequence
  Synthetic Polynucleotide
taatacgactcactatagggttgtacggtagcgacgctacactatcttgaaacagaggagatcaagaatgtgtagcgtcaacctggcggcagcgcaaaagatg

SEQ ID NO: 69458 - DNA, 103 bp, Artificial Sequence
  Synthetic Polynucleotide
taatacgactcactataggggtttataacaagattgggaattttatattaaacagaggagataatatatgattcccaataacctggcggcagcgcaaaagatg

SEQ ID NO: 69459 - DNA, 103 bp, Artificial Sequence
  Synthetic Polynucleotide
taatacgactcactatagggggagttggtaaagataataaactatctgttaacagaggagaaacagaatgtttattatcaacctggcggcagcgcaaaagatg

SEQ ID NO: 69460 - DNA, 103 bp, Artificial Sequence
  Synthetic Polynucleotide
taatacgactcactataggggatacttgtacggtagcgacgctacactataacagaggagaatagtgatgcgtcgctacaacctggcggcagcgcaaaagatg

SEQ ID NO: 69461 - DNA, 103 bp, Artificial Sequence
  Synthetic Polynucleotide
taatacgactcactatagggttgtagatacttgtacggtagcgacgctacaacagaggagagtagcgatgctaccgtacaacctggcggcagcgcaaaagatg

SEQ ID NO: 69462 - DNA, 103 bp, Artificial Sequence
  Synthetic Polynucleotide
taatacgactcactatagggactacttgtagatacttgtacggtagcgacaacagaggagagtcgctatggtacaagtaaacctggcggcagcgcaaaagatg

SEQ ID NO: 69463 - DNA, 103 bp, Artificial Sequence
  Synthetic Polynucleotide
taatacgactcactatagggtattgactacttgtagatacttgtacggtaaacagaggagataccgtatgagtatctacaacctggcggcagcgcaaaagatg

SEQ ID NO: 69464 - DNA, 103 bp, Artificial Sequence
  Synthetic Polynucleotide
taatacgactcactatagggtcttttattgactacttgtagatacttgtaaacagaggagatacaagatgctacaagtaaacctggcggcagcgcaaaagatg

SEQ ID NO: 69465 - DNA, 103 bp, Artificial Sequence
  Synthetic Polynucleotide
taatacgactcactatagggcgttctcttttattgactacttgtagatacaacagaggagagtatctatgagtagtcaaaacctggcggcagcgcaaaagatg

SEQ ID NO: 69466 - DNA, 103 bp, Artificial Sequence
  Synthetic Polynucleotide
taatacgactcactatagggtactacgttctcttttattgactacttgtaaacagaggagatacaagatgtcaataaaaaacctggcggcagcgcaaaagatg

SEQ ID NO: 69467 - DNA, 103 bp, Artificial Sequence
  Synthetic Polynucleotide
taatacgactcactatagggcaatctactacgttctcttttattgactacaacagaggagagtagtcatgaaaagagaaaacctggcggcagcgcaaaagatg

SEQ ID NO: 69468 - DNA, 103 bp, Artificial Sequence
  Synthetic Polynucleotide
taatacgactcactataggggccagcaatctactacgttctcttttattgaacagaggagacaataaatgagaacgtagaacctggcggcagcgcaaaagatg

SEQ ID NO: 69469 - DNA, 103 bp, Artificial Sequence
  Synthetic Polynucleotide
taatacgactcactatagggacgtagccagcaatctactacgttctctttaacagaggagaaaagagatggtagtagataacctggcggcagcgcaaaagatg

SEQ ID NO: 69470 - DNA, 103 bp, Artificial Sequence
  Synthetic Polynucleotide
taatacgactcactatagggcagagggagttggtaaagataataaactataacagaggagaatagttatgtatctttacaacctggcggcagcgcaaaagatg

SEQ ID NO: 69471 - DNA, 103 bp, Artificial Sequence
  Synthetic Polynucleotide
taatacgactcactatagggattaaacgtagccagcaatctactacgttcaacagaggagagaacgtatgagattgctgaacctggcggcagcgcaaaagatg

SEQ ID NO: 69472 - DNA, 103 bp, Artificial Sequence
  Synthetic Polynucleotide
taatacgactcactataggggtccaattaaacgtagccagcaatctactaaacagaggagatagtagatggctggctacaacctggcggcagcgcaaaagatg

SEQ ID NO: 69473 - DNA, 103 bp, Artificial Sequence
  Synthetic Polynucleotide
taatacgactcactatagggtacttgtccaattaaacgtagccagcaatcaacagaggagagattgcatgctacgtttaaacctggcggcagcgcaaaagatg

SEQ ID NO: 69474 - DNA, 103 bp, Artificial Sequence
  Synthetic Polynucleotide
taatacgactcactatagggagctatacttgtccaattaaacgtagccagaacagaggagactggctatgtttaattggaacctggcggcagcgcaaaagatg

SEQ ID NO: 69475 - DNA, 103 bp, Artificial Sequence
  Synthetic Polynucleotide
taatacgactcactatagggccctcagctatacttgtccaattaaacgtaaacagaggagatacgttatgttggacaagaacctggcggcagcgcaaaagatg

SEQ ID NO: 69476 - DNA, 103 bp, Artificial Sequence
  Synthetic Polynucleotide
taatacgactcactatagggtaacaccctcagctatacttgtccaattaaaacagaggagattaattatgcaagtatagaacctggcggcagcgcaaaagatg

SEQ ID NO: 69477 - DNA, 103 bp, Artificial Sequence
  Synthetic Polynucleotide
taatacgactcactatagggatttttaacaccctcagctatacttgtccaaacagaggagatggacaatgatagctgagaacctggcggcagcgcaaaagatg

SEQ ID NO: 69478 - DNA, 103 bp, Artificial Sequence
  Synthetic Polynucleotide
taatacgactcactatagggaaatcatttttaacaccctcagctatacttaacagaggagaaagtatatgtgagggtgtaacctggcggcagcgcaaaagatg

SEQ ID NO: 69479 - DNA, 103 bp, Artificial Sequence
  Synthetic Polynucleotide
taatacgactcactatagggtaatgaaatcatttttaacaccctcagctaaacagaggagatagctgatggtgttaaaaaacctggcggcagcgcaaaagatg

SEQ ID NO: 69480 - DNA, 103 bp, Artificial Sequence
  Synthetic Polynucleotide
taatacgactcactatagggtattctaatgaaatcatttttaacaccctcaacagaggagagagggtatgaaaaatgataacctggcggcagcgcaaaagatg

SEQ ID NO: 69481 - DNA, 103 bp, Artificial Sequence
  Synthetic Polynucleotide
taatacgactcactatagggggcggcagagggagttggtaaagataataaaacagaggagattattaatgttaccaactaacctggcggcagcgcaaaagatg

SEQ ID NO: 69482 - DNA, 103 bp, Artificial Sequence
  Synthetic Polynucleotide
taatacgactcactatagggtcacatattctaatgaaatcatttttaacaaacagaggagatgttaaatgtgatttcataacctggcggcagcgcaaaagatg

SEQ ID NO: 69483 - DNA, 103 bp, Artificial Sequence
  Synthetic Polynucleotide
taatacgactcactatagggtgatatcacatattctaatgaaatcattttaacagaggagaaaaatgatgtcattagaaaacctggcggcagcgcaaaagatg

SEQ ID NO: 69484 - DNA, 103 bp, Artificial Sequence
  Synthetic Polynucleotide
taatacgactcactatagggtccgttgatatcacatattctaatgaaatcaacagaggagagatttcatgagaatatgtaacctggcggcagcgcaaaagatg

SEQ ID NO: 69485 - DNA, 103 bp, Artificial Sequence
  Synthetic Polynucleotide
taatacgactcactatagggtatgttccgttgatatcacatattctaatgaacagaggagacattagatgatgtgatataacctggcggcagcgcaaaagatg

SEQ ID NO: 69486 - DNA, 103 bp, Artificial Sequence
  Synthetic Polynucleotide
taatacgactcactatagggatagatatgttccgttgatatcacatattcaacagaggagagaatatatgatatcaacgaacctggcggcagcgcaaaagatg

SEQ ID NO: 69487 - DNA, 103 bp, Artificial Sequence
  Synthetic Polynucleotide
taatacgactcactatagggattatatagatatgttccgttgatatcacaaacagaggagatgtgatatgaacggaacaaacctggcggcagcgcaaaagatg

SEQ ID NO: 69488 - DNA, 103 bp, Artificial Sequence
  Synthetic Polynucleotide
taatacgactcactataggggtataattatatagatatgttccgttgataaacagaggagatatcaaatgaacatatctaacctggcggcagcgcaaaagatg

SEQ ID NO: 69489 - DNA, 103 bp, Artificial Sequence
  Synthetic Polynucleotide
taatacgactcactatagggcaatagtataattatatagatatgttccgtaacagaggagaacggaaatgatctatataaacctggcggcagcgcaaaagatg

SEQ ID NO: 69490 - DNA, 103 bp, Artificial Sequence
  Synthetic Polynucleotide
taatacgactcactatagggagcagcaatagtataattatatagatatgtaacagaggagaacatatatgtataattataacctggcggcagcgcaaaagatg

SEQ ID NO: 69491 - DNA, 103 bp, Artificial Sequence
  Synthetic Polynucleotide
taatacgactcactatagggatactagcagcaatagtataattatatagaaacagaggagatctataatgttatactataacctggcggcagcgcaaaagatg

SEQ ID NO: 69492 - DNA, 103 bp, Artificial Sequence
  Synthetic Polynucleotide
taatacgactcactataggggttgcggcggcagagggagttggtaaagataacagaggagaatctttatgaactccctcaacctggcggcagcgcaaaagatg

SEQ ID NO: 69493 - DNA, 103 bp, Artificial Sequence
  Synthetic Polynucleotide
taatacgactcactatagggtaatcatactagcagcaatagtataattataacagaggagaataattatgctattgctgaacctggcggcagcgcaaaagatg

SEQ ID NO: 69494 - DNA, 103 bp, Artificial Sequence
  Synthetic Polynucleotide
taatacgactcactatagggatcaataatcatactagcagcaatagtataaacagaggagatatactatggctgctagtaacctggcggcagcgcaaaagatg

SEQ ID NO: 69495 - DNA, 103 bp, Artificial Sequence
  Synthetic Polynucleotide
taatacgactcactatagggatggaatcaataatcatactagcagcaataaacagaggagatattgcatgtagtatgataacctggcggcagcgcaaaagatg

SEQ ID NO: 69496 - DNA, 103 bp, Artificial Sequence
  Synthetic Polynucleotide
taatacgactcactatagggcttccatggaatcaataatcatactagcagaacagaggagactgctaatgtgattattgaacctggcggcagcgcaaaagatg

SEQ ID NO: 69497 - DNA, 103 bp, Artificial Sequence
  Synthetic Polynucleotide
taatacgactcactatagggtagttcttccatggaatcaataatcatactaacagaggagaagtatgatgattgattccaacctggcggcagcgcaaaagatg

SEQ ID NO: 69498 - DNA, 103 bp, Artificial Sequence
  Synthetic Polynucleotide
taatacgactcactataggggttggtagttcttccatggaatcaataatcaacagaggagagattatatgttccatggaaacctggcggcagcgcaaaagatg

SEQ ID NO: 69499 - DNA, 103 bp, Artificial Sequence
  Synthetic Polynucleotide
taatacgactcactatagggtaattgttggtagttcttccatggaatcaaaacagaggagattgattatgtggaagaacaacctggcggcagcgcaaaagatg

SEQ ID NO: 69500 - DNA, 103 bp, Artificial Sequence
  Synthetic Polynucleotide
taatacgactcactatagggtgttgtaattgttggtagttcttccatggaaacagaggagatccatgatggaactaccaaacctggcggcagcgcaaaagatg

SEQ ID NO: 69501 - DNA, 103 bp, Artificial Sequence
  Synthetic Polynucleotide
taatacgactcactatagggtcatatgttgtaattgttggtagttcttccaacagaggagaggaagaatgaccaacaataacctggcggcagcgcaaaagatg

SEQ ID NO: 69502 - DNA, 103 bp, Artificial Sequence
  Synthetic Polynucleotide
taatacgactcactatagggacggttcatatgttgtaattgttggtagttaacagaggagaaactacatgcaattacaaaacctggcggcagcgcaaaagatg

SEQ ID NO: 69503 - DNA, 103 bp, Artificial Sequence
  Synthetic Polynucleotide
taatacgactcactataggggattcgttgcggcggcagagggagttggtaaacagaggagataccaaatgcctctgccgaacctggcggcagcgcaaaagatg

SEQ ID NO: 69504 - DNA, 103 bp, Artificial Sequence
  Synthetic Polynucleotide
taatacgactcactatagggggtagacggttcatatgttgtaattgttggaacagaggagaccaacaatgacaacatataacctggcggcagcgcaaaagatg

SEQ ID NO: 69505 - DNA, 103 bp, Artificial Sequence
  Synthetic Polynucleotide
taatacgactcactatagggttataggtagacggttcatatgttgtaattaacagaggagaaattacatgatatgaaccaacctggcggcagcgcaaaagatg

SEQ ID NO: 69506 - DNA, 103 bp, Artificial Sequence
  Synthetic Polynucleotide
taatacgactcactatagggtataattataggtagacggttcatatgttgaacagaggagacaacatatgaaccgtctaaacctggcggcagcgcaaaagatg

SEQ ID NO: 69507 - DNA, 103 bp, Artificial Sequence
  Synthetic Polynucleotide
taatacgactcactataggggaaagtataattataggtagacggttcataaacagaggagatatgaaatgtctacctataacctggcggcagcgcaaaagatg

SEQ ID NO: 69508 - DNA, 103 bp, Artificial Sequence
  Synthetic Polynucleotide
taatacgactcactatagggttatcgaaagtataattataggtagacggtaacagaggagaaccgtcatgctataattaaacctggcggcagcgcaaaagatg

SEQ ID NO: 69509 - DNA, 103 bp, Artificial Sequence
  Synthetic Polynucleotide
taatacgactcactatagggtgctattatcgaaagtataattataggtagaacagaggagactacctatgattatacttaacctggcggcagcgcaaaagatg

SEQ ID NO: 69510 - DNA, 103 bp, Artificial Sequence
  Synthetic Polynucleotide
taatacgactcactatagggaacagtgctattatcgaaagtataattataaacagaggagatataatatgactttcgataacctggcggcagcgcaaaagatg

SEQ ID NO: 69511 - DNA, 103 bp, Artificial Sequence
  Synthetic Polynucleotide
taatacgactcactataggggtactaacagtgctattatcgaaagtataaaacagaggagattatacatgcgataatagaacctggcggcagcgcaaaagatg

SEQ ID NO: 69512 - DNA, 103 bp, Artificial Sequence
  Synthetic Polynucleotide
taatacgactcactatagggcagtagtactaacagtgctattatcgaaagaacagaggagactttcgatgatagcactgaacctggcggcagcgcaaaagatg

SEQ ID NO: 69513 - DNA, 103 bp, Artificial Sequence
  Synthetic Polynucleotide
taatacgactcactatagggttcttcagtagtactaacagtgctattatcaacagaggagagataatatgactgttagtaacctggcggcagcgcaaaagatg

SEQ ID NO: 69514 - DNA, 103 bp, Artificial Sequence
  Synthetic Polynucleotide
taatacgactcactatagggtcagagattcgttgcggcggcagagggagtaacagaggagaactcccatggccgccgcaaacctggcggcagcgcaaaagatg

SEQ ID NO: 69515 - DNA, 103 bp, Artificial Sequence
  Synthetic Polynucleotide
taatacgactcactatagggtttagttcttcagtagtactaacagtgctaaacagaggagatagcacatgtagtactacaacctggcggcagcgcaaaagatg

SEQ ID NO: 69516 - DNA, 103 bp, Artificial Sequence
  Synthetic Polynucleotide
taatacgactcactatagggtcacttttagttcttcagtagtactaacagaacagaggagactgttaatgctactgaagaacctggcggcagcgcaaaagatg

SEQ ID NO: 69517 - DNA, 103 bp, Artificial Sequence
  Synthetic Polynucleotide
taatacgactcactatagggtggagtcacttttagttcttcagtagtactaacagaggagaagtactatggaagaactaaacctggcggcagcgcaaaagatg

SEQ ID NO: 69518 - DNA, 103 bp, Artificial Sequence
  Synthetic Polynucleotide
taatacgactcactatagggggtgatggagtcacttttagttcttcagtaaacagaggagatactgaatgactaaaagtaacctggcggcagcgcaaaagatg

SEQ ID NO: 69519 - DNA, 103 bp, Artificial Sequence
  Synthetic Polynucleotide
taatacgactcactatagggtagttggtgatggagtcacttttagttcttaacagaggagaaagaacatgaagtgactcaacctggcggcagcgcaaaagatg

SEQ ID NO: 69520 - DNA, 103 bp, Artificial Sequence
  Synthetic Polynucleotide
taatacgactcactataggggtatgtagttggtgatggagtcacttttagaacagaggagactaaaaatgactccatcaaacctggcggcagcgcaaaagatg

SEQ ID NO: 69521 - DNA, 103 bp, Artificial Sequence
  Synthetic Polynucleotide
taatacgactcactataggggtcgcgtatgtagttggtgatggagtcactaacagaggagaagtgacatgatcaccaacaacctggcggcagcgcaaaagatg

SEQ ID NO: 69522 - DNA, 103 bp, Artificial Sequence
  Synthetic Polynucleotide
taatacgactcactatagggttacagtcgcgtatgtagttggtgatggagaacagaggagactccatatgcaactacataacctggcggcagcgcaaaagatg

SEQ ID NO: 69523 - DNA, 103 bp, Artificial Sequence
  Synthetic Polynucleotide
taatacgactcactatagggagttgttacagtcgcgtatgtagttggtgaaacagaggagatcaccaatgacatacgcgaacctggcggcagcgcaaaagatg

SEQ ID NO: 69524 - DNA, 103 bp, Artificial Sequence
  Synthetic Polynucleotide
taatacgactcactatagggagaggagttgttacagtcgcgtatgtagttaacagaggagaaactacatgcgcgactgtaacctggcggcagcgcaaaagatg

SEQ ID NO: 69525 - DNA, 103 bp, Artificial Sequence
  Synthetic Polynucleotide
taatacgactcactatagggacggatcagagattcgttgcggcggcagagaacagaggagactctgcatgcgcaacgaaaacctggcggcagcgcaaaagatg

SEQ ID NO: 69526 - DNA, 103 bp, Artificial Sequence
  Synthetic Polynucleotide
taatacgactcactatagggttggaagaggagttgttacagtcgcgtatgaacagaggagacatacgatgctgtaacaaaacctggcggcagcgcaaaagatg

SEQ ID NO: 69527 - DNA, 103 bp, Artificial Sequence
  Synthetic Polynucleotide
taatacgactcactatagggtgatgttggaagaggagttgttacagtcgcaacagaggagagcgactatgacaactcctaacctggcggcagcgcaaaagatg

SEQ ID NO: 69528 - DNA, 103 bp, Artificial Sequence
  Synthetic Polynucleotide
taatacgactcactatagggactgatgatgttggaagaggagttgttacaaacagaggagatgtaacatgtcctcttccaacctggcggcagcgcaaaagatg

SEQ ID NO: 69529 - DNA, 103 bp, Artificial Sequence
  Synthetic Polynucleotide
taatacgactcactatagggatggaactgatgatgttggaagaggagttgaacagaggagacaactcatgttccaacataacctggcggcagcgcaaaagatg

SEQ ID NO: 69530 - DNA, 103 bp, Artificial Sequence
  Synthetic Polynucleotide
taatacgactcactatagggatcatatggaactgatgatgttggaagaggaacagaggagacctcttatgacatcatcaaacctggcggcagcgcaaaagatg

SEQ ID NO: 69531 - DNA, 103 bp, Artificial Sequence
  Synthetic Polynucleotide
taatacgactcactatagggcgttgatcatatggaactgatgatgttggaaacagaggagatccaacatgatcagttccaacctggcggcagcgcaaaagatg

SEQ ID NO: 69532 - DNA, 103 bp, Artificial Sequence
  Synthetic Polynucleotide
taatacgactcactatagggtagatcgttgatcatatggaactgatgatgaacagaggagacatcatatgttccatatgaacctggcggcagcgcaaaagatg

SEQ ID NO: 69533 - DNA, 103 bp, Artificial Sequence
  Synthetic Polynucleotide
taatacgactcactataggggttattagatcgttgatcatatggaactgaaacagaggagatcagttatgtatgatcaaaacctggcggcagcgcaaaagatg

SEQ ID NO: 69534 - DNA, 103 bp, Artificial Sequence
  Synthetic Polynucleotide
taatacgactcactatagggacattgttattagatcgttgatcatatggaaacagaggagatccataatgtcaacgatcaacctggcggcagcgcaaaagatg

SEQ ID NO: 69535 - DNA, 103 bp, Artificial Sequence
  Synthetic Polynucleotide
taatacgactcactatagggtacctacattgttattagatcgttgatcataacagaggagaatgatcatggatctaataaacctggcggcagcgcaaaagatg

SEQ ID NO: 69536 - DNA, 103 bp, Artificial Sequence
  Synthetic Polynucleotide
taatacgactcactatagggtggatacggatcagagattcgttgcggcggaacagaggagaccgccgatgcgaatctctaacctggcggcagcgcaaaagatg

SEQ ID NO: 69537 - DNA, 103 bp, Artificial Sequence
  Synthetic Polynucleotide
taatacgactcactatagggtatagtacctacattgttattagatcgttgaacagaggagacaacgaatgaataacaataacctggcggcagcgcaaaagatg

SEQ ID NO: 69538 - DNA, 103 bp, Artificial Sequence
  Synthetic Polynucleotide
taatacgactcactatagggatagatatagtacctacattgttattagataacagaggagaatctaaatgcaatgtaggaacctggcggcagcgcaaaagatg

SEQ ID NO: 69539 - DNA, 103 bp, Artificial Sequence
  Synthetic Polynucleotide
taatacgactcactatagggtctgaatagatatagtacctacattgttataacagaggagaataacaatgtaggtactaaacctggcggcagcgcaaaagatg

SEQ ID NO: 69540 - DNA, 103 bp, Artificial Sequence
  Synthetic Polynucleotide
taatacgactcactatagggcagtatctgaatagatatagtacctacattaacagaggagaaatgtaatgactatatctaacctggcggcagcgcaaaagatg

SEQ ID NO: 69541 - DNA, 103 bp, Artificial Sequence
  Synthetic Polynucleotide
taatacgactcactatagggttactcagtatctgaatagatatagtacctaacagaggagaaggtacatgatctattcaaacctggcggcagcgcaaaagatg

SEQ ID NO: 69542 - DNA, 103 bp, Artificial Sequence
  Synthetic Polynucleotide
taatacgactcactatagggatattttactcagtatctgaatagatatagaacagaggagactatatatgttcagatacaacctggcggcagcgcaaaagatg

SEQ ID NO: 69543 - DNA, 103 bp, Artificial Sequence
  Synthetic Polynucleotide
taatacgactcactatagggtcccaatattttactcagtatctgaatagaaacagaggagatctattatgatactgagtaacctggcggcagcgcaaaagatg

SEQ ID NO: 69544 - DNA, 103 bp, Artificial Sequence
  Synthetic Polynucleotide
taatacgactcactatagggttgactcccaatattttactcagtatctgaaacagaggagatcagatatggagtaaaataacctggcggcagcgcaaaagatg

SEQ ID NO: 69545 - DNA, 103 bp, Artificial Sequence
  Synthetic Polynucleotide
taatacgactcactatagggtttcattgactcccaatattttactcagtaaacagaggagatactgaatgaaatattggaacctggcggcagcgcaaaagatg

SEQ ID NO: 69546 - DNA, 103 bp, Artificial Sequence
  Synthetic Polynucleotide
taatacgactcactatagggttctgtttcattgactcccaatattttactaacagaggagaagtaaaatgttgggagtcaacctggcggcagcgcaaaagatg

SEQ ID NO: 69547 - DNA, 103 bp, Artificial Sequence
  Synthetic Polynucleotide
taatacgactcactatagggcatcatggatacggatcagagattcgttgcaacagaggagagcaacgatgctctgatccaacctggcggcagcgcaaaagatg

SEQ ID NO: 69548 - DNA, 103 bp, Artificial Sequence
  Synthetic Polynucleotide
taatacgactcactataggggttaattctgtttcattgactcccaatattaacagaggagaaatattatgagtcaatgaaacctggcggcagcgcaaaagatg

SEQ ID NO: 69549 - DNA, 103 bp, Artificial Sequence
  Synthetic Polynucleotide
taatacgactcactatagggaattagttaattctgtttcattgactcccaaacagaggagatgggagatgatgaaacagaacctggcggcagcgcaaaagatg

SEQ ID NO: 69550 - DNA, 103 bp, Artificial Sequence
  Synthetic Polynucleotide
taatacgactcactatagggaagataattagttaattctgtttcattgacaacagaggagagtcaatatgacagaattaaacctggcggcagcgcaaaagatg

SEQ ID NO: 69551 - DNA, 103 bp, Artificial Sequence
  Synthetic Polynucleotide
taatacgactcactataggggtaataagataattagttaattctgtttcaaacagaggagatgaaacatgattaactaaaacctggcggcagcgcaaaagatg

SEQ ID NO: 69552 - DNA, 103 bp, Artificial Sequence
  Synthetic Polynucleotide
taatacgactcactatagggtatgcgtaataagataattagttaattctgaacagaggagacagaatatgctaattatcaacctggcggcagcgcaaaagatg

SEQ ID NO: 69553 - DNA, 103 bp, Artificial Sequence
  Synthetic Polynucleotide
taatacgactcactatagggatttttatgcgtaataagataattagttaaaacagaggagattaactatgtatcttattaacctggcggcagcgcaaaagatg

SEQ ID NO: 69554 - DNA, 103 bp, Artificial Sequence
  Synthetic Polynucleotide
taatacgactcactataggggtggcatttttatgcgtaataagataattaaacagaggagataattaatgtattacgcaaacctggcggcagcgcaaaagatg

SEQ ID NO: 69555 - DNA, 103 bp, Artificial Sequence
  Synthetic Polynucleotide
taatacgactcactatagggcaaccgtggcatttttatgcgtaataagataacagaggagaatcttaatgcgcataaaaaacctggcggcagcgcaaaagatg

SEQ ID NO: 69556 - DNA, 103 bp, Artificial Sequence
  Synthetic Polynucleotide
taatacgactcactatagggattgtcaaccgtggcatttttatgcgtaataacagaggagaattacgatgaaaaatgccaacctggcggcagcgcaaaagatg

SEQ ID NO: 69557 - DNA, 103 bp, Artificial Sequence
  Synthetic Polynucleotide
taatacgactcactataggggtgttattgtcaaccgtggcatttttatgcaacagaggagagcataaatgtgccacggtaacctggcggcagcgcaaaagatg

SEQ ID NO: 69558 - DNA, 103 bp, Artificial Sequence
  Synthetic Polynucleotide
taatacgactcactatagggatgaccatcatggatacggatcagagattcaacagaggagagaatctatgatccgtatcaacctggcggcagcgcaaaagatg

SEQ ID NO: 69559 - DNA, 103 bp, Artificial Sequence
  Synthetic Polynucleotide
taatacgactcactatagggacaatgtgttattgtcaaccgtggcattttaacagaggagaaaaatgatgcggttgacaaacctggcggcagcgcaaaagatg

SEQ ID NO: 69560 - DNA, 103 bp, Artificial Sequence
  Synthetic Polynucleotide
taatacgactcactatagggaccatacaatgtgttattgtcaaccgtggcaacagaggagagccacgatggacaataacaacctggcggcagcgcaaaagatg

SEQ ID NO: 69561 - DNA, 103 bp, Artificial Sequence
  Synthetic Polynucleotide
taatacgactcactatagggatattaccatacaatgtgttattgtcaaccaacagaggagaggttgaatgtaacacattaacctggcggcagcgcaaaagatg

SEQ ID NO: 69562 - DNA, 103 bp, Artificial Sequence
  Synthetic Polynucleotide
taatacgactcactatagggatcctatattaccatacaatgtgttattgtaacagaggagaacaataatgcattgtatgaacctggcggcagcgcaaaagatg

SEQ ID NO: 69563 - DNA, 103 bp, Artificial Sequence
  Synthetic Polynucleotide
taatacgactcactatagggcaaaaatcctatattaccatacaatgtgttaacagaggagaaacacaatgtatggtaataacctggcggcagcgcaaaagatg

SEQ ID NO: 69564 - DNA, 103 bp, Artificial Sequence
  Synthetic Polynucleotide
taatacgactcactatagggatttccaaaaatcctatattaccatacaataacagaggagaattgtaatgtaatataggaacctggcggcagcgcaaaagatg

SEQ ID NO: 69565 - DNA, 103 bp, Artificial Sequence
  Synthetic Polynucleotide
taatacgactcactatagggtatttatttccaaaaatcctatattaccataacagaggagaatggtaatgtaggattttaacctggcggcagcgcaaaagatg

SEQ ID NO: 69566 - DNA, 103 bp, Artificial Sequence
  Synthetic Polynucleotide
taatacgactcactataggggcaattatttatttccaaaaatcctatattaacagaggagaaatataatgtttttggaaaacctggcggcagcgcaaaagatg

SEQ ID NO: 69567 - DNA, 103 bp, Artificial Sequence
  Synthetic Polynucleotide
taatacgactcactatagggttgtagcaattatttatttccaaaaatcctaacagaggagaaggattatgggaaataaaaacctggcggcagcgcaaaagatg

SEQ ID NO: 69568 - DNA, 103 bp, Artificial Sequence
  Synthetic Polynucleotide
taatacgactcactatagggaaatattgtagcaattatttatttccaaaaaacagaggagattttggatgtaaataattaacctggcggcagcgcaaaagatg

SEQ ID NO: 69569 - DNA, 103 bp, Artificial Sequence
  Synthetic Polynucleotide
taatacgactcactatagggtgtattctatgtcgtctactggatgaagataacagaggagaatcttcatgcagtagacgaacctggcggcagcgcaaaagatg

SEQ ID NO: 69570 - DNA, 103 bp, Artificial Sequence
  Synthetic Polynucleotide
taatacgactcactatagggtgtgtgtttataacaagattgggaattttaaacagaggagataaaatatgcaatcttgtaacctggcggcagcgcaaaagatg

SEQ ID NO: 69571 - DNA, 103 bp, Artificial Sequence
  Synthetic Polynucleotide
taatacgactcactatagggtaaacatgaccatcatggatacggatcagaaacagaggagatctgatatgtatccatgaaacctggcggcagcgcaaaagatg

SEQ ID NO: 69572 - DNA, 103 bp, Artificial Sequence
  Synthetic Polynucleotide
taatacgactcactatagggtacagaaatattgtagcaattatttatttcaacagaggagagaaataatgaattgctacaacctggcggcagcgcaaaagatg

SEQ ID NO: 69573 - DNA, 103 bp, Artificial Sequence
  Synthetic Polynucleotide
taatacgactcactatagggtttgatacagaaatattgtagcaattatttaacagaggagaaaataaatgctacaatataacctggcggcagcgcaaaagatg

SEQ ID NO: 69574 - DNA, 103 bp, Artificial Sequence
  Synthetic Polynucleotide
taatacgactcactatagggtagcatttgatacagaaatattgtagcaataacagaggagaattgctatgatatttctgaacctggcggcagcgcaaaagatg

SEQ ID NO: 69575 - DNA, 103 bp, Artificial Sequence
  Synthetic Polynucleotide
taatacgactcactatagggaaaactagcatttgatacagaaatattgtaaacagaggagatacaatatgtctgtatcaaacctggcggcagcgcaaaagatg

SEQ ID NO: 69576 - DNA, 103 bp, Artificial Sequence
  Synthetic Polynucleotide
taatacgactcactatagggattctaaaactagcatttgatacagaaataaacagaggagatatttcatgatcaaatgcaacctggcggcagcgcaaaagatg

SEQ ID NO: 69577 - DNA, 103 bp, Artificial Sequence
  Synthetic Polynucleotide
taatacgactcactatagggatgttattctaaaactagcatttgatacagaacagaggagactgtatatgatgctagttaacctggcggcagcgcaaaagatg

SEQ ID NO: 69578 - DNA, 103 bp, Artificial Sequence
  Synthetic Polynucleotide
taatacgactcactatagggtactaatgttattctaaaactagcatttgaaacagaggagatcaaatatgagttttagaaacctggcggcagcgcaaaagatg

SEQ ID NO: 69579 - DNA, 103 bp, Artificial Sequence
  Synthetic Polynucleotide
taatacgactcactatagggttgtttactaatgttattctaaaactagcaaacagaggagatgctagatgtagaataacaacctggcggcagcgcaaaagatg

SEQ ID NO: 69580 - DNA, 103 bp, Artificial Sequence
  Synthetic Polynucleotide
taatacgactcactatagggaagtattgtttactaatgttattctaaaacaacagaggagagttttaatgtaacattagaacctggcggcagcgcaaaagatg

SEQ ID NO: 69581 - DNA, 103 bp, Artificial Sequence
  Synthetic Polynucleotide
taatacgactcactatagggttcagaagtattgtttactaatgttattctaacagaggagaagaataatgttagtaaacaacctggcggcagcgcaaaagatg

SEQ ID NO: 69582 - DNA, 103 bp, Artificial Sequence
  Synthetic Polynucleotide
taatacgactcactatagggagaaataaacatgaccatcatggatacggaaacagaggagatccgtaatgatgatggtcaacctggcggcagcgcaaaagatg

SEQ ID NO: 69583 - DNA, 103 bp, Artificial Sequence
  Synthetic Polynucleotide
taatacgactcactatagggatttcttcagaagtattgtttactaatgttaacagaggagaaacattatgaaacaatacaacctggcggcagcgcaaaagatg

SEQ ID NO: 69584 - DNA, 103 bp, Artificial Sequence
  Synthetic Polynucleotide
taatacgactcactatagggtaacaatttcttcagaagtattgtttactaaacagaggagatagtaaatgatacttctgaacctggcggcagcgcaaaagatg

SEQ ID NO: 69585 - DNA, 103 bp, Artificial Sequence
  Synthetic Polynucleotide
taatacgactcactatagggcattataacaatttcttcagaagtattgttaacagaggagaaacaatatgtctgaagaaaacctggcggcagcgcaaaagatg

SEQ ID NO: 69586 - DNA, 103 bp, Artificial Sequence
  Synthetic Polynucleotide
taatacgactcactataggggttagcattataacaatttcttcagaagtaaacagaggagatacttcatgagaaattgtaacctggcggcagcgcaaaagatg

SEQ ID NO: 69587 - DNA, 103 bp, Artificial Sequence
  Synthetic Polynucleotide
taatacgactcactatagggtccctgttagcattataacaatttcttcagaacagaggagactgaagatgttgttataaaacctggcggcagcgcaaaagatg

SEQ ID NO: 69588 - DNA, 103 bp, Artificial Sequence
  Synthetic Polynucleotide
taatacgactcactatagggactagtccctgttagcattataacaatttcaacagaggagagaaattatgataatgctaaacctggcggcagcgcaaaagatg

SEQ ID NO: 69589 - DNA, 103 bp, Artificial Sequence
  Synthetic Polynucleotide
taatacgactcactataggggatgaactagtccctgttagcattataacaaacagaggagatgttatatggctaacaggaacctggcggcagcgcaaaagatg

SEQ ID NO: 69590 - DNA, 103 bp, Artificial Sequence
  Synthetic Polynucleotide
taatacgactcactatagggtgtcggatgaactagtccctgttagcattaaacagaggagataatgcatgcagggactaaacctggcggcagcgcaaaagatg

SEQ ID NO: 69591 - DNA, 103 bp, Artificial Sequence
  Synthetic Polynucleotide
taatacgactcactataggggaaggtgtcggatgaactagtccctgttagaacagaggagactaacaatgactagttcaaacctggcggcagcgcaaaagatg

SEQ ID NO: 69592 - DNA, 103 bp, Artificial Sequence
  Synthetic Polynucleotide
taatacgactcactataggggatatgaaggtgtcggatgaactagtccctaacagaggagaagggacatgttcatccgaaacctggcggcagcgcaaaagatg

SEQ ID NO: 69593 - DNA, 103 bp, Artificial Sequence
  Synthetic Polynucleotide
taatacgactcactataggggggctagaaataaacatgaccatcatggataacagaggagaatccatatgggtcatgttaacctggcggcagcgcaaaagatg

SEQ ID NO: 69594 - DNA, 103 bp, Artificial Sequence
  Synthetic Polynucleotide
taatacgactcactatagggtggaagatatgaaggtgtcggatgaactagaacagaggagactagttatgccgacacctaacctggcggcagcgcaaaagatg

SEQ ID NO: 69595 - DNA, 103 bp, Artificial Sequence
  Synthetic Polynucleotide
taatacgactcactatagggattggtggaagatatgaaggtgtcggatgaaacagaggagatcatccatgaccttcataaacctggcggcagcgcaaaagatg

SEQ ID NO: 69596 - DNA, 103 bp, Artificial Sequence
  Synthetic Polynucleotide
taatacgactcactataggggtggtattggtggaagatatgaaggtgtcgaacagaggagacgacacatgcatatcttcaacctggcggcagcgcaaaagatg

SEQ ID NO: 69597 - DNA, 103 bp, Artificial Sequence
  Synthetic Polynucleotide
taatacgactcactatagggattcagtggtattggtggaagatatgaaggaacagaggagaccttcaatgcttccaccaaacctggcggcagcgcaaaagatg

SEQ ID NO: 69598 - DNA, 103 bp, Artificial Sequence
  Synthetic Polynucleotide
taatacgactcactatagggcaaacattcagtggtattggtggaagatataacagaggagaatatctatgaccaataccaacctggcggcagcgcaaaagatg

SEQ ID NO: 69599 - DNA, 103 bp, Artificial Sequence
  Synthetic Polynucleotide
taatacgactcactataggggttttcaaacattcagtggtattggtggaaaacagaggagattccacatgtaccactgaaacctggcggcagcgcaaaagatg

SEQ ID NO: 69600 - DNA, 103 bp, Artificial Sequence
  Synthetic Polynucleotide
taatacgactcactatagggttaatgttttcaaacattcagtggtattggaacagaggagaccaataatgctgaatgttaacctggcggcagcgcaaaagatg

SEQ ID NO: 69601 - DNA, 103 bp, Artificial Sequence
  Synthetic Polynucleotide
taatacgactcactatagggattgattaatgttttcaaacattcagtggtaacagaggagaaccactatgtgtttgaaaaacctggcggcagcgcaaaagatg

SEQ ID NO: 69602 - DNA, 103 bp, Artificial Sequence
  Synthetic Polynucleotide
taatacgactcactataggggtattattgattaatgttttcaaacattcaaacagaggagatgaatgatggaaaacattaacctggcggcagcgcaaaagatg

SEQ ID NO: 69603 - DNA, 103 bp, Artificial Sequence
  Synthetic Polynucleotide
taatacgactcactatagggtcgacgtattattgattaatgttttcaaacaacagaggagagtttgaatgcattaatcaaacctggcggcagcgcaaaagatg

SEQ ID NO: 69604 - DNA, 103 bp, Artificial Sequence
  Synthetic Polynucleotide
taatacgactcactataggggatacgggctagaaataaacatgaccatcaaacagaggagatgatggatgtgtttatttaacctggcggcagcgcaaaagatg

SEQ ID NO: 69605 - DNA, 103 bp, Artificial Sequence
  Synthetic Polynucleotide
taatacgactcactatagggaatattcgacgtattattgattaatgttttaacagaggagaaaaacaatgatcaataataacctggcggcagcgcaaaagatg

SEQ ID NO: 69606 - DNA, 103 bp, Artificial Sequence
  Synthetic Polynucleotide
taatacgactcactatagggtcactaatattcgacgtattattgattaataacagaggagaattaatatgtaatacgtcaacctggcggcagcgcaaaagatg

SEQ ID NO: 69607 - DNA, 103 bp, Artificial Sequence
  Synthetic Polynucleotide
taatacgactcactatagggttacatcactaatattcgacgtattattgaaacagaggagatcaataatgcgtcgaataaacctggcggcagcgcaaaagatg

SEQ ID NO: 69608 - DNA, 103 bp, Artificial Sequence
  Synthetic Polynucleotide
taatacgactcactatagggtatacttacatcactaatattcgacgtattaacagaggagaaatacgatgaatattagtaacctggcggcagcgcaaaagatg

SEQ ID NO: 69609 - DNA, 103 bp, Artificial Sequence
  Synthetic Polynucleotide
taatacgactcactatagggtgtgttatacttacatcactaatattcgacaacagaggagagtcgaaatgtagtgatgtaacctggcggcagcgcaaaagatg

SEQ ID NO: 69610 - DNA, 103 bp, Artificial Sequence
  Synthetic Polynucleotide
taatacgactcactatagggtattttgtgttatacttacatcactaatataacagaggagaatattaatgatgtaagtaaacctggcggcagcgcaaaagatg

SEQ ID NO: 69611 - DNA, 103 bp, Artificial Sequence
  Synthetic Polynucleotide
taatacgactcactatagggattcatattttgtgttatacttacatcactaacagaggagaagtgatatgagtataacaaacctggcggcagcgcaaaagatg

SEQ ID NO: 69612 - DNA, 103 bp, Artificial Sequence
  Synthetic Polynucleotide
taatacgactcactataggggttacattcatattttgtgttatacttacaaacagaggagatgtaagatgaacacaaaaaacctggcggcagcgcaaaagatg

SEQ ID NO: 69613 - DNA, 103 bp, Artificial Sequence
  Synthetic Polynucleotide
taatacgactcactatagggtagatgttacattcatattttgtgttatacaacagaggagagtataaatgaaaatatgaaacctggcggcagcgcaaaagatg

SEQ ID NO: 69614 - DNA, 103 bp, Artificial Sequence
  Synthetic Polynucleotide
taatacgactcactatagggacaattagatgttacattcatattttgtgtaacagaggagaacacaaatgatgaatgtaaacctggcggcagcgcaaaagatg

SEQ ID NO: 69615 - DNA, 103 bp, Artificial Sequence
  Synthetic Polynucleotide
taatacgactcactataggggactggatacgggctagaaataaacatgacaacagaggagagtcatgatgatttctagcaacctggcggcagcgcaaaagatg

SEQ ID NO: 69616 - DNA, 103 bp, Artificial Sequence
  Synthetic Polynucleotide
taatacgactcactatagggttatcacaattagatgttacattcatatttaacagaggagaaaatatatgtgtaacatcaacctggcggcagcgcaaaagatg

SEQ ID NO: 69617 - DNA, 103 bp, Artificial Sequence
  Synthetic Polynucleotide
taatacgactcactatagggaacatttatcacaattagatgttacattcaaacagaggagatgaatgatgcatctaattaacctggcggcagcgcaaaagatg

SEQ ID NO: 69618 - DNA, 103 bp, Artificial Sequence
  Synthetic Polynucleotide
taatacgactcactatagggcattgaacatttatcacaattagatgttacaacagaggagagtaacaatgaattgtgataacctggcggcagcgcaaaagatg

SEQ ID NO: 69619 - DNA, 103 bp, Artificial Sequence
  Synthetic Polynucleotide
taatacgactcactatagggaaattcattgaacatttatcacaattagataacagaggagaatctaaatgtgataaatgaacctggcggcagcgcaaaagatg

SEQ ID NO: 69620 - DNA, 103 bp, Artificial Sequence
  Synthetic Polynucleotide
taatacgactcactatagggtcatcaaattcattgaacatttatcacaataacagaggagaattgtgatgaatgttcaaaacctggcggcagcgcaaaagatg

SEQ ID NO: 69621 - DNA, 103 bp, Artificial Sequence
  Synthetic Polynucleotide
taatacgactcactatagggggatgtcatcaaattcattgaacatttatcaacagaggagagataaaatgtcaatgaataacctggcggcagcgcaaaagatg

SEQ ID NO: 69622 - DNA, 103 bp, Artificial Sequence
  Synthetic Polynucleotide
taatacgactcactatagggataacggatgtcatcaaattcattgaacataacagaggagaatgttcatggaatttgataacctggcggcagcgcaaaagatg

SEQ ID NO: 69623 - DNA, 103 bp, Artificial Sequence
  Synthetic Polynucleotide
taatacgactcactatagggcagggataacggatgtcatcaaattcattgaacagaggagacaatgaatgtgatgacataacctggcggcagcgcaaaagatg

SEQ ID NO: 69624 - DNA, 103 bp, Artificial Sequence
  Synthetic Polynucleotide
taatacgactcactatagggaacggcagggataacggatgtcatcaaattaacagaggagaaatttgatgacatccgttaacctggcggcagcgcaaaagatg

SEQ ID NO: 69625 - DNA, 103 bp, Artificial Sequence
  Synthetic Polynucleotide
taatacgactcactatagggtctttaacggcagggataacggatgtcatcaacagaggagagatgacatgcgttatcccaacctggcggcagcgcaaaagatg

SEQ ID NO: 69626 - DNA, 103 bp, Artificial Sequence
  Synthetic Polynucleotide
taatacgactcactataggggtgttgactggatacgggctagaaataaacaacagaggagagtttatatgtagcccgtaaacctggcggcagcgcaaaagatg

SEQ ID NO: 69627 - DNA, 103 bp, Artificial Sequence
  Synthetic Polynucleotide
taatacgactcactatagggtaaattctttaacggcagggataacggatgaacagaggagacatccgatgtccctgccgaacctggcggcagcgcaaaagatg

SEQ ID NO: 69628 - DNA, 103 bp, Artificial Sequence
  Synthetic Polynucleotide
taatacgactcactatagggattgttaaattctttaacggcagggataacaacagaggagagttatcatggccgttaaaaacctggcggcagcgcaaaagatg

SEQ ID NO: 69629 - DNA, 103 bp, Artificial Sequence
  Synthetic Polynucleotide
taatacgactcactatagggaacgtattgttaaattctttaacggcagggaacagaggagaccctgcatgtaaagaattaacctggcggcagcgcaaaagatg

SEQ ID NO: 69630 - DNA, 103 bp, Artificial Sequence
  Synthetic Polynucleotide
taatacgactcactatagggttttcaacgtattgttaaattctttaacggaacagaggagaccgttaatgaatttaacaaacctggcggcagcgcaaaagatg

SEQ ID NO: 69631 - DNA, 103 bp, Artificial Sequence
  Synthetic Polynucleotide
taatacgactcactatagggaatttttttcaacgtattgttaaattctttaacagaggagaaaagaaatgaacaatacgaacctggcggcagcgcaaaagatg

SEQ ID NO: 69632 - DNA, 103 bp, Artificial Sequence
  Synthetic Polynucleotide
taatacgactcactatagggacaccaatttttttcaacgtattgttaaataacagaggagaatttaaatgtacgttgaaaacctggcggcagcgcaaaagatg

SEQ ID NO: 69633 - DNA, 103 bp, Artificial Sequence
  Synthetic Polynucleotide
taatacgactcactatagggcttttacaccaatttttttcaacgtattgtaacagaggagaacaataatgtgaaaaaaaaacctggcggcagcgcaaaagatg

SEQ ID NO: 69634 - DNA, 103 bp, Artificial Sequence
  Synthetic Polynucleotide
taatacgactcactatagggatcatcttttacaccaatttttttcaacgtaacagaggagaacgttgatgaaaattggtaacctggcggcagcgcaaaagatg

SEQ ID NO: 69635 - DNA, 103 bp, Artificial Sequence
  Synthetic Polynucleotide
taatacgactcactatagggtttttatcatcttttacaccaatttttttcaacagaggagagaaaaaatgtggtgtaaaaacctggcggcagcgcaaaagatg

SEQ ID NO: 69636 - DNA, 103 bp, Artificial Sequence
  Synthetic Polynucleotide
taatacgactcactatagggtattgtttttatcatcttttacaccaatttaacagaggagaaaattgatgtaaaagatgaacctggcggcagcgcaaaagatg

SEQ ID NO: 69637 - DNA, 103 bp, Artificial Sequence
  Synthetic Polynucleotide
taatacgactcactatagggacatagtgttgactggatacgggctagaaaaacagaggagatttctaatgcgtatccagaacctggcggcagcgcaaaagatg

SEQ ID NO: 69638 - DNA, 103 bp, Artificial Sequence
  Synthetic Polynucleotide
taatacgactcactatagggtactgtattgtttttatcatcttttacaccaacagaggagaggtgtaatggatgataaaaacctggcggcagcgcaaaagatg

SEQ ID NO: 69639 - DNA, 103 bp, Artificial Sequence
  Synthetic Polynucleotide
taatacgactcactatagggttatatactgtattgtttttatcatcttttaacagaggagaaaaagaatgtaaaaacaaaacctggcggcagcgcaaaagatg

SEQ ID NO: 69640 - DNA, 103 bp, Artificial Sequence
  Synthetic Polynucleotide
taatacgactcactatagggaatagttatatactgtattgtttttatcataacagaggagaatgataatgacaatacagaacctggcggcagcgcaaaagatg

SEQ ID NO: 69641 - DNA, 103 bp, Artificial Sequence
  Synthetic Polynucleotide
taatacgactcactatagggattataatagttatatactgtattgtttttaacagaggagaaaaaacatgacagtatataacctggcggcagcgcaaaagatg

SEQ ID NO: 69642 - DNA, 103 bp, Artificial Sequence
  Synthetic Polynucleotide
taatacgactcactatagggttacaattataatagttatatactgtattgaacagaggagacaatacatgatataactaaacctggcggcagcgcaaaagatg

SEQ ID NO: 69643 - DNA, 103 bp, Artificial Sequence
  Synthetic Polynucleotide
taatacgactcactatagggttagtttacaattataatagttatatactgaacagaggagacagtatatgactattataaacctggcggcagcgcaaaagatg

SEQ ID NO: 69644 - DNA, 103 bp, Artificial Sequence
  Synthetic Polynucleotide
taatacgactcactatagggtgtagttagtttacaattataatagttataaacagaggagatataacatgtataattgtaacctggcggcagcgcaaaagatg

SEQ ID NO: 69645 - DNA, 103 bp, Artificial Sequence
  Synthetic Polynucleotide
taatacgactcactataggggaatttgtagttagtttacaattataatagaacagaggagactattaatgttgtaaactaacctggcggcagcgcaaaagatg

SEQ ID NO: 69646 - DNA, 103 bp, Artificial Sequence
  Synthetic Polynucleotide
taatacgactcactatagggatgtagaatttgtagttagtttacaattataacagaggagaataattatgaactaactaaacctggcggcagcgcaaaagatg

SEQ ID NO: 69647 - DNA, 103 bp, Artificial Sequence
  Synthetic Polynucleotide
taatacgactcactataggggtcacatgtagaatttgtagttagtttacaaacagaggagatgtaaaatgactacaaataacctggcggcagcgcaaaagatg

SEQ ID NO: 69648 - DNA, 103 bp, Artificial Sequence
  Synthetic Polynucleotide
taatacgactcactatagggtgctaacatagtgttgactggatacgggctaacagaggagaagcccgatgccagtcaacaacctggcggcagcgcaaaagatg

SEQ ID NO: 69649 - DNA, 103 bp, Artificial Sequence
  Synthetic Polynucleotide
taatacgactcactatagggaactcgtcacatgtagaatttgtagttagtaacagaggagaactaacatgaaattctacaacctggcggcagcgcaaaagatg

SEQ ID NO: 69650 - DNA, 103 bp, Artificial Sequence
  Synthetic Polynucleotide
taatacgactcactatagggtgattaactcgtcacatgtagaatttgtagaacagaggagactacaaatgctacatgtgaacctggcggcagcgcaaaagatg

SEQ ID NO: 69651 - DNA, 103 bp, Artificial Sequence
  Synthetic Polynucleotide
taatacgactcactatagggtaaattgattaactcgtcacatgtagaattaacagaggagaaattctatgtgtgacgagaacctggcggcagcgcaaaagatg

SEQ ID NO: 69652 - DNA, 103 bp, Artificial Sequence
  Synthetic Polynucleotide
taatacgactcactatagggtcatctaaattgattaactcgtcacatgtaaacagaggagatacatgatgcgagttaataacctggcggcagcgcaaaagatg

SEQ ID NO: 69653 - DNA, 103 bp, Artificial Sequence
  Synthetic Polynucleotide
taatacgactcactatagggtgacttcatctaaattgattaactcgtcacaacagaggagagtgacgatgtaatcaattaacctggcggcagcgcaaaagatg

SEQ ID NO: 69654 - DNA, 103 bp, Artificial Sequence
  Synthetic Polynucleotide
taatacgactcactataggggttaatgacttcatctaaattgattaactcaacagaggagagagttaatgaatttagataacctggcggcagcgcaaaagatg

SEQ ID NO: 69655 - DNA, 103 bp, Artificial Sequence
  Synthetic Polynucleotide
taatacgactcactatagggatattgttaatgacttcatctaaattgattaacagaggagaaatcaaatgagatgaagtaacctggcggcagcgcaaaagatg

SEQ ID NO: 69656 - DNA, 103 bp, Artificial Sequence
  Synthetic Polynucleotide
taatacgactcactatagggaagttatattgttaatgacttcatctaaataacagaggagaatttagatgaagtcattaaacctggcggcagcgcaaaagatg

SEQ ID NO: 69657 - DNA, 103 bp, Artificial Sequence
  Synthetic Polynucleotide
taatacgactcactatagggtgtcaaagttatattgttaatgacttcatcaacagaggagagatgaaatgattaacaataacctggcggcagcgcaaaagatg

SEQ ID NO: 69658 - DNA, 103 bp, Artificial Sequence
  Synthetic Polynucleotide
taatacgactcactatagggatatttgtcaaagttatattgttaatgactaacagaggagaagtcatatgcaatataacaacctggcggcagcgcaaaagatg

SEQ ID NO: 69659 - DNA, 103 bp, Artificial Sequence
  Synthetic Polynucleotide
taatacgactcactatagggagaaatgctaacatagtgttgactggatacaacagaggagagtatccatgcaacactataacctggcggcagcgcaaaagatg

SEQ ID NO: 69660 - DNA, 103 bp, Artificial Sequence
  Synthetic Polynucleotide
taatacgactcactatagggttataatatttgtcaaagttatattgttaaaacagaggagattaacaatgtaactttgaaacctggcggcagcgcaaaagatg

SEQ ID NO: 69661 - DNA, 103 bp, Artificial Sequence
  Synthetic Polynucleotide
taatacgactcactatagggactacttataatatttgtcaaagttatattaacagaggagaaatataatgttgacaaataacctggcggcagcgcaaaagatg

SEQ ID NO: 69662 - DNA, 103 bp, Artificial Sequence
  Synthetic Polynucleotide
taatacgactcactatagggacactactacttataatatttgtcaaagttaacagaggagaaactttatgaaatattataacctggcggcagcgcaaaagatg

SEQ ID NO: 69663 - DNA, 103 bp, Artificial Sequence
  Synthetic Polynucleotide
taatacgactcactatagggtagaaacactactacttataatatttgtcaaacagaggagatgacaaatgttataagtaaacctggcggcagcgcaaaagatg

SEQ ID NO: 69664 - DNA, 103 bp, Artificial Sequence
  Synthetic Polynucleotide
taatacgactcactatagggggttgtagaaacactactacttataatattaacagaggagaaatattatgagtagtagtaacctggcggcagcgcaaaagatg

SEQ ID NO: 69665 - DNA, 103 bp, Artificial Sequence
  Synthetic Polynucleotide
taatacgactcactatagggctgttggttgtagaaacactactacttataaacagaggagatataagatgtagtgtttcaacctggcggcagcgcaaaagatg

SEQ ID NO: 69666 - DNA, 103 bp, Artificial Sequence
  Synthetic Polynucleotide
taatacgactcactatagggttctgctgttggttgtagaaacactactacaacagaggagagtagtaatgtttctacaaaacctggcggcagcgcaaaagatg

SEQ ID NO: 69667 - DNA, 103 bp, Artificial Sequence
  Synthetic Polynucleotide
taatacgactcactatagggtctttttctgctgttggttgtagaaacactaacagaggagaagtgttatgacaaccaacaacctggcggcagcgcaaaagatg

SEQ ID NO: 69668 - DNA, 103 bp, Artificial Sequence
  Synthetic Polynucleotide
taatacgactcactatagggtctcgtctttttctgctgttggttgtagaaaacagaggagattctacatgcaacagcagaacctggcggcagcgcaaaagatg

SEQ ID NO: 69669 - DNA, 103 bp, Artificial Sequence
  Synthetic Polynucleotide
taatacgactcactatagggtcagatctcgtctttttctgctgttggttgaacagaggagacaaccaatggcagaaaaaaacctggcggcagcgcaaaagatg

SEQ ID NO: 69670 - DNA, 103 bp, Artificial Sequence
  Synthetic Polynucleotide
taatacgactcactatagggtcgatagaaatgctaacatagtgttgactgaacagaggagacagtcaatgctatgttagaacctggcggcagcgcaaaagatg

SEQ ID NO: 69671 - DNA, 103 bp, Artificial Sequence
  Synthetic Polynucleotide
taatacgactcactatagggaccattcagatctcgtctttttctgctgttaacagaggagaaacagcatgaaaagacgaaacctggcggcagcgcaaaagatg

SEQ ID NO: 69672 - DNA, 103 bp, Artificial Sequence
  Synthetic Polynucleotide
taatacgactcactatagggaactcaccattcagatctcgtctttttctgaacagaggagacagaaaatgacgagatctaacctggcggcagcgcaaaagatg

SEQ ID NO: 69673 - DNA, 103 bp, Artificial Sequence
  Synthetic Polynucleotide
taatacgactcactatagggattcaaactcaccattcagatctcgtctttaacagaggagaaaagacatgatctgaatgaacctggcggcagcgcaaaagatg

SEQ ID NO: 69674 - DNA, 103 bp, Artificial Sequence
  Synthetic Polynucleotide
taatacgactcactatagggagaaaattcaaactcaccattcagatctcgaacagaggagacgagatatgaatggtgagaacctggcggcagcgcaaaagatg

SEQ ID NO: 69675 - DNA, 103 bp, Artificial Sequence
  Synthetic Polynucleotide
taatacgactcactataggggatgtagaaaattcaaactcaccattcagaaacagaggagatctgaaatgtgagtttgaaacctggcggcagcgcaaaagatg

SEQ ID NO: 69676 - DNA, 103 bp, Artificial Sequence
  Synthetic Polynucleotide
taatacgactcactatagggcctcggatgtagaaaattcaaactcaccataacagaggagaatggtgatgttgaattttaacctggcggcagcgcaaaagatg

SEQ ID NO: 69677 - DNA, 103 bp, Artificial Sequence
  Synthetic Polynucleotide
taatacgactcactatagggtaattcctcggatgtagaaaattcaaactcaacagaggagagagtttatgttttctacaaacctggcggcagcgcaaaagatg

SEQ ID NO: 69678 - DNA, 103 bp, Artificial Sequence
  Synthetic Polynucleotide
taatacgactcactatagggcaatctaattcctcggatgtagaaaattcaaacagaggagatgaattatgtacatccgaaacctggcggcagcgcaaaagatg

SEQ ID NO: 69679 - DNA, 103 bp, Artificial Sequence
  Synthetic Polynucleotide
taatacgactcactatagggaaagacaatctaattcctcggatgtagaaaaacagaggagatttctaatgccgaggaataacctggcggcagcgcaaaagatg

SEQ ID NO: 69680 - DNA, 103 bp, Artificial Sequence
  Synthetic Polynucleotide
taatacgactcactatagggtttgtaaagacaatctaattcctcggatgtaacagaggagaacatccatggaattagataacctggcggcagcgcaaaagatg

SEQ ID NO: 69681 - DNA, 103 bp, Artificial Sequence
  Synthetic Polynucleotide
taatacgactcactatagggctcagtgtgtgtttataacaagattgggaaaacagaggagattcccaatgttgttataaaacctggcggcagcgcaaaagatg

SEQ ID NO: 69682 - DNA, 103 bp, Artificial Sequence
  Synthetic Polynucleotide
taatacgactcactatagggctatatcgatagaaatgctaacatagtgttaacagaggagaaacactatgttagcatttaacctggcggcagcgcaaaagatg

SEQ ID NO: 69683 - DNA, 103 bp, Artificial Sequence
  Synthetic Polynucleotide
taatacgactcactatagggtatgatttgtaaagacaatctaattcctcgaacagaggagacgaggaatgagattgtctaacctggcggcagcgcaaaagatg

SEQ ID NO: 69684 - DNA, 103 bp, Artificial Sequence
  Synthetic Polynucleotide
taatacgactcactatagggcaccatatgatttgtaaagacaatctaattaacagaggagaaattagatggtctttacaaacctggcggcagcgcaaaagatg

SEQ ID NO: 69685 - DNA, 103 bp, Artificial Sequence
  Synthetic Polynucleotide
taatacgactcactatagggacttacaccatatgatttgtaaagacaatcaacagaggagagattgtatgtacaaatcaaacctggcggcagcgcaaaagatg

SEQ ID NO: 69686 - DNA, 103 bp, Artificial Sequence
  Synthetic Polynucleotide
taatacgactcactatagggtcatcacttacaccatatgatttgtaaagaaacagaggagatctttaatgatcatatggaacctggcggcagcgcaaaagatg

SEQ ID NO: 69687 - DNA, 103 bp, Artificial Sequence
  Synthetic Polynucleotide
taatacgactcactatagggttacatcatcacttacaccatatgatttgtaacagaggagaacaaatatgatggtgtaaaacctggcggcagcgcaaaagatg

SEQ ID NO: 69688 - DNA, 103 bp, Artificial Sequence
  Synthetic Polynucleotide
taatacgactcactatagggatgacttacatcatcacttacaccatatgaaacagaggagatcatatatggtaagtgataacctggcggcagcgcaaaagatg

SEQ ID NO: 69689 - DNA, 103 bp, Artificial Sequence
  Synthetic Polynucleotide
taatacgactcactatagggaaacaatgacttacatcatcacttacaccaaacagaggagatggtgtatgtgatgatgtaacctggcggcagcgcaaaagatg

SEQ ID NO: 69690 - DNA, 103 bp, Artificial Sequence
  Synthetic Polynucleotide
taatacgactcactatagggatgaaaaacaatgacttacatcatcacttaaacagaggagataagtgatgatgtaagtcaacctggcggcagcgcaaaagatg

SEQ ID NO: 69691 - DNA, 103 bp, Artificial Sequence
  Synthetic Polynucleotide
taatacgactcactatagggaggtgatgaaaaacaatgacttacatcatcaacagaggagagatgatatgagtcattgtaacctggcggcagcgcaaaagatg

SEQ ID NO: 69692 - DNA, 103 bp, Artificial Sequence
  Synthetic Polynucleotide
taatacgactcactatagggcgtctaggtgatgaaaaacaatgacttacaaacagaggagatgtaagatgttgtttttcaacctggcggcagcgcaaaagatg

SEQ ID NO: 69693 - DNA, 103 bp, Artificial Sequence
  Synthetic Polynucleotide
taatacgactcactataggggaaagctatatcgatagaaatgctaacataaacagaggagatatgttatgatttctatcaacctggcggcagcgcaaaagatg

SEQ ID NO: 69694 - DNA, 103 bp, Artificial Sequence
  Synthetic Polynucleotide
taatacgactcactataggggtctacgtctaggtgatgaaaaacaatgacaacagaggagagtcattatgtttcatcacaacctggcggcagcgcaaaagatg

SEQ ID NO: 69695 - DNA, 103 bp, Artificial Sequence
  Synthetic Polynucleotide
taatacgactcactatagggagatcgtctacgtctaggtgatgaaaaacaaacagaggagatgttttatgtcacctagaaacctggcggcagcgcaaaagatg

SEQ ID NO: 69696 - DNA, 103 bp, Artificial Sequence
  Synthetic Polynucleotide
taatacgactcactatagggtcgtcagatcgtctacgtctaggtgatgaaaacagaggagattcatcatgtagacgtagaacctggcggcagcgcaaaagatg

SEQ ID NO: 69697 - DNA, 103 bp, Artificial Sequence
  Synthetic Polynucleotide
taatacgactcactataggggtttgtcgtcagatcgtctacgtctaggtgaacagaggagacacctaatggtagacgataacctggcggcagcgcaaaagatg

SEQ ID NO: 69698 - DNA, 103 bp, Artificial Sequence
  Synthetic Polynucleotide
taatacgactcactatagggctcctgtttgtcgtcagatcgtctacgtctaacagaggagaagacgtatgcgatctgacaacctggcggcagcgcaaaagatg

SEQ ID NO: 69699 - DNA, 103 bp, Artificial Sequence
  Synthetic Polynucleotide
taatacgactcactataggggtgtactcctgtttgtcgtcagatcgtctaaacagaggagatagacgatgtgacgacaaaacctggcggcagcgcaaaagatg

SEQ ID NO: 69700 - DNA, 103 bp, Artificial Sequence
  Synthetic Polynucleotide
taatacgactcactatagggtttctgtgtactcctgtttgtcgtcagatcaacagaggagagatctgatgacaaacaggaacctggcggcagcgcaaaagatg

SEQ ID NO: 69701 - DNA, 103 bp, Artificial Sequence
  Synthetic Polynucleotide
taatacgactcactatagggtttcatttctgtgtactcctgtttgtcgtcaacagaggagagacgacatgcaggagtacaacctggcggcagcgcaaaagatg

SEQ ID NO: 69702 - DNA, 103 bp, Artificial Sequence
  Synthetic Polynucleotide
taatacgactcactatagggagtaatttcatttctgtgtactcctgtttgaacagaggagacaaacaatggtacacagaaacctggcggcagcgcaaaagatg

SEQ ID NO: 69703 - DNA, 103 bp, Artificial Sequence
  Synthetic Polynucleotide
taatacgactcactatagggggtcgagtaatttcatttctgtgtactcctaacagaggagaaggagtatgcagaaatgaaacctggcggcagcgcaaaagatg

SEQ ID NO: 69704 - DNA, 103 bp, Artificial Sequence
  Synthetic Polynucleotide
taatacgactcactatagggtgagtgaaagctatatcgatagaaatgctaaacagaggagatagcatatgtatcgatataacctggcggcagcgcaaaagatg

SEQ ID NO: 69705 - DNA, 103 bp, Artificial Sequence
  Synthetic Polynucleotide
taatacgactcactatagggcgcgtggtcgagtaatttcatttctgtgtaaacagaggagatacacaatgatgaaattaaacctggcggcagcgcaaaagatg

SEQ ID NO: 69706 - DNA, 103 bp, Artificial Sequence
  Synthetic Polynucleotide
taatacgactcactatagggtttttcgcgtggtcgagtaatttcatttctaacagaggagaagaaatatgattactcgaaacctggcggcagcgcaaaagatg

SEQ ID NO: 69707 - DNA, 103 bp, Artificial Sequence
  Synthetic Polynucleotide
taatacgactcactatagggaatcttttttcgcgtggtcgagtaatttcaaacagaggagatgaaatatgtcgaccacgaacctggcggcagcgcaaaagatg

SEQ ID NO: 69708 - DNA, 103 bp, Artificial Sequence
  Synthetic Polynucleotide
taatacgactcactatagggtcttaaatcttttttcgcgtggtcgagtaaaacagaggagattactcatgcacgcgaaaaacctggcggcagcgcaaaagatg

SEQ ID NO: 69709 - DNA, 103 bp, Artificial Sequence
  Synthetic Polynucleotide
taatacgactcactatagggtctattcttaaatcttttttcgcgtggtcgaacagaggagacgaccaatggaaaaaagaaacctggcggcagcgcaaaagatg

SEQ ID NO: 69710 - DNA, 103 bp, Artificial Sequence
  Synthetic Polynucleotide
taatacgactcactatagggcactgtctattcttaaatcttttttcgcgtaacagaggagaacgcgaatgaagatttaaaacctggcggcagcgcaaaagatg

SEQ ID NO: 69711 - DNA, 103 bp, Artificial Sequence
  Synthetic Polynucleotide
taatacgactcactatagggaataacactgtctattcttaaatcttttttaacagaggagaaaaaaaatgttaagaataaacctggcggcagcgcaaaagatg

SEQ ID NO: 69712 - DNA, 103 bp, Artificial Sequence
  Synthetic Polynucleotide
taatacgactcactatagggctaggaataacactgtctattcttaaatctaacagaggagaagatttatgaatagacagaacctggcggcagcgcaaaagatg

SEQ ID NO: 69713 - DNA, 103 bp, Artificial Sequence
  Synthetic Polynucleotide
taatacgactcactatagggtacctctaggaataacactgtctattcttaaacagaggagataagaaatgacagtgttaaacctggcggcagcgcaaaagatg

SEQ ID NO: 69714 - DNA, 103 bp, Artificial Sequence
  Synthetic Polynucleotide
taatacgactcactatagggagttgtacctctaggaataacactgtctataacagaggagaatagacatggttattcctaacctggcggcagcgcaaaagatg

SEQ ID NO: 69715 - DNA, 103 bp, Artificial Sequence
  Synthetic Polynucleotide
taatacgactcactatagggttatatgagtgaaagctatatcgatagaaaaacagaggagatttctaatgatatagcttaacctggcggcagcgcaaaagatg

SEQ ID NO: 69716 - DNA, 103 bp, Artificial Sequence
  Synthetic Polynucleotide
taatacgactcactatagggaaatgagttgtacctctaggaataacactgaacagaggagacagtgtatgtcctagaggaacctggcggcagcgcaaaagatg

SEQ ID NO: 69717 - DNA, 103 bp, Artificial Sequence
  Synthetic Polynucleotide
taatacgactcactatagggcttggaaatgagttgtacctctaggaataaaacagaggagattattcatggaggtacaaaacctggcggcagcgcaaaagatg

SEQ ID NO: 69718 - DNA, 103 bp, Artificial Sequence
  Synthetic Polynucleotide
taatacgactcactatagggacctacttggaaatgagttgtacctctaggaacagaggagacctagaatgacaactcataacctggcggcagcgcaaaagatg

SEQ ID NO: 69719 - DNA, 103 bp, Artificial Sequence
  Synthetic Polynucleotide
taatacgactcactataggggatgcacctacttggaaatgagttgtacctaacagaggagaaggtacatgtcatttccaaacctggcggcagcgcaaaagatg

SEQ ID NO: 69720 - DNA, 103 bp, Artificial Sequence
  Synthetic Polynucleotide
taatacgactcactatagggctccagatgcacctacttggaaatgagttgaacagaggagacaactcatgtccaagtagaacctggcggcagcgcaaaagatg

SEQ ID NO: 69721 - DNA, 103 bp, Artificial Sequence
  Synthetic Polynucleotide
taatacgactcactatagggacttgctccagatgcacctacttggaaatgaacagaggagacatttcatggtaggtgcaaacctggcggcagcgcaaaagatg

SEQ ID NO: 69722 - DNA, 103 bp, Artificial Sequence
  Synthetic Polynucleotide
taatacgactcactatagggccaccacttgctccagatgcacctacttggaacagaggagaccaagtatgtgcatctggaacctggcggcagcgcaaaagatg

SEQ ID NO: 69723 - DNA, 103 bp, Artificial Sequence
  Synthetic Polynucleotide
taatacgactcactatagggcaacaccaccacttgctccagatgcacctaaacagaggagataggtgatgctggagcaaaacctggcggcagcgcaaaagatg

SEQ ID NO: 69724 - DNA, 103 bp, Artificial Sequence
  Synthetic Polynucleotide
taatacgactcactatagggacctacaacaccaccacttgctccagatgcaacagaggagagcatctatggcaagtggtaacctggcggcagcgcaaaagatg

SEQ ID NO: 69725 - DNA, 103 bp, Artificial Sequence
  Synthetic Polynucleotide
taatacgactcactatagggctatcacctacaacaccaccacttgctccaaacagaggagatggagcatgtggtggtgtaacctggcggcagcgcaaaagatg

SEQ ID NO: 69726 - DNA, 103 bp, Artificial Sequence
  Synthetic Polynucleotide
taatacgactcactataggggagtgttatatgagtgaaagctatatcgataacagaggagaatcgatatggctttcactaacctggcggcagcgcaaaagatg

SEQ ID NO: 69727 - DNA, 103 bp, Artificial Sequence
  Synthetic Polynucleotide
taatacgactcactataggggggaactatcacctacaacaccaccacttgaacagaggagacaagtgatggtgttgtagaacctggcggcagcgcaaaagatg

SEQ ID NO: 69728 - DNA, 103 bp, Artificial Sequence
  Synthetic Polynucleotide
taatacgactcactatagggaaatggggaactatcacctacaacaccaccaacagaggagaggtggtatggtaggtgataacctggcggcagcgcaaaagatg

SEQ ID NO: 69729 - DNA, 103 bp, Artificial Sequence
  Synthetic Polynucleotide
taatacgactcactatagggttttgaaatggggaactatcacctacaacaaacagaggagatgttgtatgtgatagttcaacctggcggcagcgcaaaagatg

SEQ ID NO: 69730 - DNA, 103 bp, Artificial Sequence
  Synthetic Polynucleotide
taatacgactcactatagggtaacattttgaaatggggaactatcacctaaacagaggagataggtgatggttccccataacctggcggcagcgcaaaagatg

SEQ ID NO: 69731 - DNA, 103 bp, Artificial Sequence
  Synthetic Polynucleotide
taatacgactcactatagggtgatttaacattttgaaatggggaactatcaacagaggagagatagtatgccatttcaaaacctggcggcagcgcaaaagatg

SEQ ID NO: 69732 - DNA, 103 bp, Artificial Sequence
  Synthetic Polynucleotide
taatacgactcactataggggcccgtgatttaacattttgaaatggggaaaacagaggagattccccatgtcaaaatgtaacctggcggcagcgcaaaagatg

SEQ ID NO: 69733 - DNA, 103 bp, Artificial Sequence
  Synthetic Polynucleotide
taatacgactcactataggggactggcccgtgatttaacattttgaaatgaacagaggagacatttcatgatgttaaataacctggcggcagcgcaaaagatg

SEQ ID NO: 69734 - DNA, 103 bp, Artificial Sequence
  Synthetic Polynucleotide
taatacgactcactatagggcaatagactggcccgtgatttaacattttgaacagaggagacaaaatatgaaatcacggaacctggcggcagcgcaaaagatg

SEQ ID NO: 69735 - DNA, 103 bp, Artificial Sequence
  Synthetic Polynucleotide
taatacgactcactatagggtctgccaatagactggcccgtgatttaacaaacagaggagatgttaaatgacgggccagaacctggcggcagcgcaaaagatg

SEQ ID NO: 69736 - DNA, 103 bp, Artificial Sequence
  Synthetic Polynucleotide
taatacgactcactatagggttttttctgccaatagactggcccgtgattaacagaggagaaatcacatgccagtctataacctggcggcagcgcaaaagatg

SEQ ID NO: 69737 - DNA, 103 bp, Artificial Sequence
  Synthetic Polynucleotide
taatacgactcactatagggttggtgagtgttatatgagtgaaagctataaacagaggagatatagcatgcactcatataacctggcggcagcgcaaaagatg

SEQ ID NO: 69738 - DNA, 103 bp, Artificial Sequence
  Synthetic Polynucleotide
taatacgactcactatagggcattattttttctgccaatagactggcccgaacagaggagacgggccatgctattggcaaacctggcggcagcgcaaaagatg

SEQ ID NO: 69739 - DNA, 103 bp, Artificial Sequence
  Synthetic Polynucleotide
taatacgactcactatagggctaggcattattttttctgccaatagactgaacagaggagacagtctatgggcagaaaaaacctggcggcagcgcaaaagatg

SEQ ID NO: 69740 - DNA, 103 bp, Artificial Sequence
  Synthetic Polynucleotide
taatacgactcactataggggtactctaggcattattttttctgccaataaacagaggagatattggatgaaaaaataaaacctggcggcagcgcaaaagatg

SEQ ID NO: 69741 - DNA, 103 bp, Artificial Sequence
  Synthetic Polynucleotide
taatacgactcactatagggagtgggtactctaggcattattttttctgcaacagaggagagcagaaatgataatgcctaacctggcggcagcgcaaaagatg

SEQ ID NO: 69742 - DNA, 103 bp, Artificial Sequence
  Synthetic Polynucleotide
taatacgactcactataggggcagtagtgggtactctaggcattatttttaacagaggagaaaaaatatggcctagagtaacctggcggcagcgcaaaagatg

SEQ ID NO: 69743 - DNA, 103 bp, Artificial Sequence
  Synthetic Polynucleotide
taatacgactcactatagggcggtagcagtagtgggtactctaggcattaaacagaggagataatgcatggagtacccaaacctggcggcagcgcaaaagatg

SEQ ID NO: 69744 - DNA, 103 bp, Artificial Sequence
  Synthetic Polynucleotide
taatacgactcactatagggctcttcggtagcagtagtgggtactctaggaacagaggagacctagaatgcccactactaacctggcggcagcgcaaaagatg

SEQ ID NO: 69745 - DNA, 103 bp, Artificial Sequence
  Synthetic Polynucleotide
taatacgactcactatagggagctgctcttcggtagcagtagtgggtactaacagaggagaagtaccatgtactgctacaacctggcggcagcgcaaaagatg

SEQ ID NO: 69746 - DNA, 103 bp, Artificial Sequence
  Synthetic Polynucleotide
taatacgactcactatagggcatatagctgctcttcggtagcagtagtggaacagaggagaccactaatgctaccgaagaacctggcggcagcgcaaaagatg

SEQ ID NO: 69747 - DNA, 103 bp, Artificial Sequence
  Synthetic Polynucleotide
taatacgactcactatagggagttgcatatagctgctcttcggtagcagtaacagaggagaactgctatggaagagcagaacctggcggcagcgcaaaagatg

SEQ ID NO: 69748 - DNA, 103 bp, Artificial Sequence
  Synthetic Polynucleotide
taatacgactcactatagggtattattggtgagtgttatatgagtgaaagaacagaggagactttcaatgatataacacaacctggcggcagcgcaaaagatg

SEQ ID NO: 69749 - DNA, 103 bp, Artificial Sequence
  Synthetic Polynucleotide
taatacgactcactatagggtttatagttgcatatagctgctcttcggtaaacagaggagataccgaatggcagctataaacctggcggcagcgcaaaagatg

SEQ ID NO: 69750 - DNA, 103 bp, Artificial Sequence
  Synthetic Polynucleotide
taatacgactcactataggggtctatttatagttgcatatagctgctcttaacagaggagaaagagcatgtatatgcaaaacctggcggcagcgcaaaagatg

SEQ ID NO: 69751 - DNA, 103 bp, Artificial Sequence
  Synthetic Polynucleotide
taatacgactcactatagggtgtttgtctatttatagttgcatatagctgaacagaggagacagctaatggcaactataaacctggcggcagcgcaaaagatg

SEQ ID NO: 69752 - DNA, 103 bp, Artificial Sequence
  Synthetic Polynucleotide
taatacgactcactatagggaactttgtttgtctatttatagttgcatataacagaggagaatatgcatgtataaatagaacctggcggcagcgcaaaagatg

SEQ ID NO: 69753 - DNA, 103 bp, Artificial Sequence
  Synthetic Polynucleotide
taatacgactcactatagggcaggcaactttgtttgtctatttatagttgaacagaggagacaactaatgatagacaaaaacctggcggcagcgcaaaagatg

SEQ ID NO: 69754 - DNA, 103 bp, Artificial Sequence
  Synthetic Polynucleotide
taatacgactcactatagggacctgcaggcaactttgtttgtctatttataacagaggagaataaatatgcaaacaaagaacctggcggcagcgcaaaagatg

SEQ ID NO: 69755 - DNA, 103 bp, Artificial Sequence
  Synthetic Polynucleotide
taatacgactcactatagggttaacacctgcaggcaactttgtttgtctaaacagaggagatagacaatgaaagttgccaacctggcggcagcgcaaaagatg

SEQ ID NO: 69756 - DNA, 103 bp, Artificial Sequence
  Synthetic Polynucleotide
taatacgactcactatagggtacttttaacacctgcaggcaactttgtttaacagaggagaaaacaaatgtgcctgcagaacctggcggcagcgcaaaagatg

SEQ ID NO: 69757 - DNA, 103 bp, Artificial Sequence
  Synthetic Polynucleotide
taatacgactcactatagggcggagtacttttaacacctgcaggcaacttaacagaggagaaagttgatggcaggtgttaacctggcggcagcgcaaaagatg

SEQ ID NO: 69758 - DNA, 103 bp, Artificial Sequence
  Synthetic Polynucleotide
taatacgactcactataggggtaaacggagtacttttaacacctgcaggcaacagaggagagcctgcatgtgttaaaagaacctggcggcagcgcaaaagatg

SEQ ID NO: 69759 - DNA, 103 bp, Artificial Sequence
  Synthetic Polynucleotide
taatacgactcactatagggtctactattattggtgagtgttatatgagtaacagaggagaactcatatgacactcaccaacctggcggcagcgcaaaagatg

SEQ ID NO: 69760 - DNA, 103 bp, Artificial Sequence
  Synthetic Polynucleotide
taatacgactcactatagggcctctgtaaacggagtacttttaacacctgaacagaggagacaggtgatgaaagtactcaacctggcggcagcgcaaaagatg

SEQ ID NO: 69761 - DNA, 103 bp, Artificial Sequence
  Synthetic Polynucleotide
taatacgactcactatagggaagcgcctctgtaaacggagtacttttaacaacagaggagagttaaaatgactccgtttaacctggcggcagcgcaaaagatg

SEQ ID NO: 69762 - DNA, 103 bp, Artificial Sequence
  Synthetic Polynucleotide
taatacgactcactataggggacacaagcgcctctgtaaacggagtacttaacagaggagaaagtacatggtttacagaaacctggcggcagcgcaaaagatg

SEQ ID NO: 69763 - DNA, 103 bp, Artificial Sequence
  Synthetic Polynucleotide
taatacgactcactatagggtcgtagacacaagcgcctctgtaaacggagaacagaggagactccgtatgcagaggcgcaacctggcggcagcgcaaaagatg

SEQ ID NO: 69764 - DNA, 103 bp, Artificial Sequence
  Synthetic Polynucleotide
taatacgactcactataggggtttatcgtagacacaagcgcctctgtaaaaacagaggagatttacaatggcgcttgtgaacctggcggcagcgcaaaagatg

SEQ ID NO: 69765 - DNA, 103 bp, Artificial Sequence
  Synthetic Polynucleotide
taatacgactcactatagggttttggtttatcgtagacacaagcgcctctaacagaggagaagaggcatgtgtgtctacaacctggcggcagcgcaaaagatg

SEQ ID NO: 69766 - DNA, 103 bp, Artificial Sequence
  Synthetic Polynucleotide
taatacgactcactatagggaaagcttttggtttatcgtagacacaagcgaacagaggagacgcttgatgctacgataaaacctggcggcagcgcaaaagatg

SEQ ID NO: 69767 - DNA, 103 bp, Artificial Sequence
  Synthetic Polynucleotide
taatacgactcactatagggactagaaagcttttggtttatcgtagacacaacagaggagagtgtctatgataaaccaaaacctggcggcagcgcaaaagatg

SEQ ID NO: 69768 - DNA, 103 bp, Artificial Sequence
  Synthetic Polynucleotide
taatacgactcactatagggttaacactagaaagcttttggtttatcgtaaacagaggagatacgatatgccaaaagctaacctggcggcagcgcaaaagatg

SEQ ID NO: 69769 - DNA, 103 bp, Artificial Sequence
  Synthetic Polynucleotide
taatacgactcactatagggcctctttaacactagaaagcttttggtttaaacagaggagataaaccatgagctttctaaacctggcggcagcgcaaaagatg

SEQ ID NO: 69770 - DNA, 103 bp, Artificial Sequence
  Synthetic Polynucleotide
taatacgactcactatagggttaattctactattattggtgagtgttataaacagaggagatataacatgcaccaataaaacctggcggcagcgcaaaagatg

SEQ ID NO: 69771 - DNA, 103 bp, Artificial Sequence
  Synthetic Polynucleotide
taatacgactcactatagggagttacctctttaacactagaaagcttttgaacagaggagacaaaagatgtctagtgttaacctggcggcagcgcaaaagatg

SEQ ID NO: 69772 - DNA, 103 bp, Artificial Sequence
  Synthetic Polynucleotide
taatacgactcactataggggcataagttacctctttaacactagaaagcaacagaggagagctttcatgtgttaaagaaacctggcggcagcgcaaaagatg

SEQ ID NO: 69773 - DNA, 103 bp, Artificial Sequence
  Synthetic Polynucleotide
taatacgactcactatagggacgaagcataagttacctctttaacactagaacagaggagactagtgatgaagaggtaaaacctggcggcagcgcaaaagatg

SEQ ID NO: 69774 - DNA, 103 bp, Artificial Sequence
  Synthetic Polynucleotide
taatacgactcactatagggattggacgaagcataagttacctctttaacaacagaggagagttaaaatggtaacttataacctggcggcagcgcaaaagatg

SEQ ID NO: 69775 - DNA, 103 bp, Artificial Sequence
  Synthetic Polynucleotide
taatacgactcactatagggggcagattggacgaagcataagttacctctaacagaggagaagaggtatgttatgcttcaacctggcggcagcgcaaaagatg

SEQ ID NO: 69776 - DNA, 103 bp, Artificial Sequence
  Synthetic Polynucleotide
taatacgactcactatagggatcctggcagattggacgaagcataagttaaacagaggagataacttatgcttcgtccaaacctggcggcagcgcaaaagatg

SEQ ID NO: 69777 - DNA, 103 bp, Artificial Sequence
  Synthetic Polynucleotide
taatacgactcactatagggacttgatcctggcagattggacgaagcataaacagaggagatatgctatgtccaatctgaacctggcggcagcgcaaaagatg

SEQ ID NO: 69778 - DNA, 103 bp, Artificial Sequence
  Synthetic Polynucleotide
taatacgactcactatagggtaaccacttgatcctggcagattggacgaaaacagaggagattcgtcatgtctgccaggaacctggcggcagcgcaaaagatg

SEQ ID NO: 69779 - DNA, 103 bp, Artificial Sequence
  Synthetic Polynucleotide
taatacgactcactataggggaacataaccacttgatcctggcagattggaacagaggagaccaatcatgcaggatcaaaacctggcggcagcgcaaaagatg

SEQ ID NO: 69780 - DNA, 103 bp, Artificial Sequence
  Synthetic Polynucleotide
taatacgactcactatagggtctatgaacataaccacttgatcctggcagaacagaggagactgccaatgtcaagtggtaacctggcggcagcgcaaaagatg

SEQ ID NO: 69781 - DNA, 103 bp, Artificial Sequence
  Synthetic Polynucleotide
taatacgactcactatagggcgacattaattctactattattggtgagtgaacagaggagacactcaatgataatagtaaacctggcggcagcgcaaaagatg

SEQ ID NO: 69782 - DNA, 103 bp, Artificial Sequence
  Synthetic Polynucleotide
taatacgactcactataggggatggtctatgaacataaccacttgatcctaacagaggagaaggatcatgtggttatgtaacctggcggcagcgcaaaagatg

SEQ ID NO: 69783 - DNA, 103 bp, Artificial Sequence
  Synthetic Polynucleotide
taatacgactcactatagggaatcagatggtctatgaacataaccacttgaacagaggagacaagtgatgatgttcataaacctggcggcagcgcaaaagatg

SEQ ID NO: 69784 - DNA, 103 bp, Artificial Sequence
  Synthetic Polynucleotide
taatacgactcactatagggaacagaatcagatggtctatgaacataaccaacagaggagaggttatatgcatagaccaaacctggcggcagcgcaaaagatg

SEQ ID NO: 69785 - DNA, 103 bp, Artificial Sequence
  Synthetic Polynucleotide
taatacgactcactatagggtaaataacagaatcagatggtctatgaacaaacagaggagatgttcaatgaccatctgaaacctggcggcagcgcaaaagatg

SEQ ID NO: 69786 - DNA, 103 bp, Artificial Sequence
  Synthetic Polynucleotide
taatacgactcactatagggtgctgtaaataacagaatcagatggtctataacagaggagaatagacatgctgattctgaacctggcggcagcgcaaaagatg

SEQ ID NO: 69787 - DNA, 103 bp, Artificial Sequence
  Synthetic Polynucleotide
taatacgactcactatagggtatagtgctgtaaataacagaatcagatggaacagaggagaccatctatgtctgttattaacctggcggcagcgcaaaagatg

SEQ ID NO: 69788 - DNA, 103 bp, Artificial Sequence
  Synthetic Polynucleotide
taatacgactcactatagggcgtcttatagtgctgtaaataacagaatcaaacagaggagatgattcatgtatttacagaacctggcggcagcgcaaaagatg

SEQ ID NO: 69789 - DNA, 103 bp, Artificial Sequence
  Synthetic Polynucleotide
taatacgactcactataggggtgtccgtcttatagtgctgtaaataacagaacagaggagactgttaatgacagcactaaacctggcggcagcgcaaaagatg

SEQ ID NO: 69790 - DNA, 103 bp, Artificial Sequence
  Synthetic Polynucleotide
taatacgactcactatagggtaaacgtgtccgtcttatagtgctgtaaataacagaggagaatttacatgactataagaaacctggcggcagcgcaaaagatg

SEQ ID NO: 69791 - DNA, 103 bp, Artificial Sequence
  Synthetic Polynucleotide
taatacgactcactatagggctaggtaaacgtgtccgtcttatagtgctgaacagaggagacagcacatgaagacggacaacctggcggcagcgcaaaagatg

SEQ ID NO: 69792 - DNA, 103 bp, Artificial Sequence
  Synthetic Polynucleotide
taatacgactcactatagggtgtttctcagtgtgtgtttataacaagattaacagaggagaaatcttatgataaacacaaacctggcggcagcgcaaaagatg

SEQ ID NO: 69793 - DNA, 103 bp, Artificial Sequence
  Synthetic Polynucleotide
taatacgactcactatagggaattacgacattaattctactattattggtaacagaggagaaccaatatgagtagaattaacctggcggcagcgcaaaagatg

SEQ ID NO: 69794 - DNA, 103 bp, Artificial Sequence
  Synthetic Polynucleotide
taatacgactcactatagggtatcactaggtaaacgtgtccgtcttatagaacagaggagactataaatgggacacgttaacctggcggcagcgcaaaagatg

SEQ ID NO: 69795 - DNA, 103 bp, Artificial Sequence
  Synthetic Polynucleotide
taatacgactcactatagggatcggtatcactaggtaaacgtgtccgtctaacagaggagaagacggatgcgtttacctaacctggcggcagcgcaaaagatg

SEQ ID NO: 69796 - DNA, 103 bp, Artificial Sequence
  Synthetic Polynucleotide
taatacgactcactatagggtcactatcggtatcactaggtaaacgtgtcaacagaggagagacacgatgacctagtgaaacctggcggcagcgcaaaagatg

SEQ ID NO: 69797 - DNA, 103 bp, Artificial Sequence
  Synthetic Polynucleotide
taatacgactcactatagggcaaaatcactatcggtatcactaggtaaacaacagaggagagtttacatggtgataccgaacctggcggcagcgcaaaagatg

SEQ ID NO: 69798 - DNA, 103 bp, Artificial Sequence
  Synthetic Polynucleotide
taatacgactcactatagggatcctcaaaatcactatcggtatcactaggaacagaggagacctagtatgaccgatagtaacctggcggcagcgcaaaagatg

SEQ ID NO: 69799 - DNA, 103 bp, Artificial Sequence
  Synthetic Polynucleotide
taatacgactcactatagggtgtatatcctcaaaatcactatcggtatcaaacagaggagatgatacatgtagtgatttaacctggcggcagcgcaaaagatg

SEQ ID NO: 69800 - DNA, 103 bp, Artificial Sequence
  Synthetic Polynucleotide
taatacgactcactatagggcagtttgtatatcctcaaaatcactatcggaacagaggagaccgataatgattttgaggaacctggcggcagcgcaaaagatg

SEQ ID NO: 69801 - DNA, 103 bp, Artificial Sequence
  Synthetic Polynucleotide
taatacgactcactatagggaacaacagtttgtatatcctcaaaatcactaacagaggagaagtgatatggaggatataaacctggcggcagcgcaaaagatg

SEQ ID NO: 69802 - DNA, 103 bp, Artificial Sequence
  Synthetic Polynucleotide
taatacgactcactatagggtccttaacaacagtttgtatatcctcaaaaaacagaggagattttgaatgtatacaaacaacctggcggcagcgcaaaagatg

SEQ ID NO: 69803 - DNA, 103 bp, Artificial Sequence
  Synthetic Polynucleotide
taatacgactcactatagggtatattccttaacaacagtttgtatatcctaacagaggagaaggataatgaaactgttgaacctggcggcagcgcaaaagatg

SEQ ID NO: 69804 - DNA, 103 bp, Artificial Sequence
  Synthetic Polynucleotide
taatacgactcactataggggtgtaaattacgacattaattctactattaaacagaggagataatagatgaattaatgtaacctggcggcagcgcaaaagatg

SEQ ID NO: 69805 - DNA, 103 bp, Artificial Sequence
  Synthetic Polynucleotide
taatacgactcactatagggttcattatattccttaacaacagtttgtataacagaggagaatacaaatggttgttaagaacctggcggcagcgcaaaagatg

SEQ ID NO: 69806 - DNA, 103 bp, Artificial Sequence
  Synthetic Polynucleotide
taatacgactcactatagggtatctttcattatattccttaacaacagttaacagaggagaaactgtatgtaaggaataaacctggcggcagcgcaaaagatg

SEQ ID NO: 69807 - DNA, 103 bp, Artificial Sequence
  Synthetic Polynucleotide
taatacgactcactatagggtaccatatctttcattatattccttaacaaaacagaggagattgttaatgaatataatgaacctggcggcagcgcaaaagatg

SEQ ID NO: 69808 - DNA, 103 bp, Artificial Sequence
  Synthetic Polynucleotide
taatacgactcactatagggtcgtctaccatatctttcattatattccttaacagaggagaaaggaaatgaatgaaagaaacctggcggcagcgcaaaagatg

SEQ ID NO: 69809 - DNA, 103 bp, Artificial Sequence
  Synthetic Polynucleotide
taatacgactcactatagggctaactcgtctaccatatctttcattatataacagaggagaatataaatgaagatatggaacctggcggcagcgcaaaagatg

SEQ ID NO: 69810 - DNA, 103 bp, Artificial Sequence
  Synthetic Polynucleotide
taatacgactcactatagggttctactaactcgtctaccatatctttcataacagaggagaatgaaaatgatggtagacaacctggcggcagcgcaaaagatg

SEQ ID NO: 69811 - DNA, 103 bp, Artificial Sequence
  Synthetic Polynucleotide
taatacgactcactatagggctgtgttctactaactcgtctaccatatctaacagaggagaagatatatgagacgagttaacctggcggcagcgcaaaagatg

SEQ ID NO: 69812 - DNA, 103 bp, Artificial Sequence
  Synthetic Polynucleotide
taatacgactcactataggggatgactgtgttctactaactcgtctaccaaacagaggagatggtagatgagttagtagaacctggcggcagcgcaaaagatg

SEQ ID NO: 69813 - DNA, 103 bp, Artificial Sequence
  Synthetic Polynucleotide
taatacgactcactatagggtacttgatgactgtgttctactaactcgtcaacagaggagagacgagatggtagaacacaacctggcggcagcgcaaaagatg

SEQ ID NO: 69814 - DNA, 103 bp, Artificial Sequence
  Synthetic Polynucleotide
taatacgactcactatagggatcactacttgatgactgtgttctactaacaacagaggagagttagtatgacacagtcaaacctggcggcagcgcaaaagatg

SEQ ID NO: 69815 - DNA, 103 bp, Artificial Sequence
  Synthetic Polynucleotide
taatacgactcactatagggtattggtgtaaattacgacattaattctacaacagaggagagtagaaatgatgtcgtaaaacctggcggcagcgcaaaagatg

SEQ ID NO: 69816 - DNA, 103 bp, Artificial Sequence
  Synthetic Polynucleotide
taatacgactcactatagggtcaaaatcactacttgatgactgtgttctaaacagaggagatagaacatggtcatcaagaacctggcggcagcgcaaaagatg

SEQ ID NO: 69817 - DNA, 103 bp, Artificial Sequence
  Synthetic Polynucleotide
taatacgactcactatagggtatcttcaaaatcactacttgatgactgtgaacagaggagacacagtatgcaagtagtgaacctggcggcagcgcaaaagatg

SEQ ID NO: 69818 - DNA, 103 bp, Artificial Sequence
  Synthetic Polynucleotide
taatacgactcactatagggatctatatcttcaaaatcactacttgatgaaacagaggagatcatcaatgagtgattttaacctggcggcagcgcaaaagatg

SEQ ID NO: 69819 - DNA, 103 bp, Artificial Sequence
  Synthetic Polynucleotide
taatacgactcactatagggacctcatctatatcttcaaaatcactacttaacagaggagaaagtagatgttttgaagaaacctggcggcagcgcaaaagatg

SEQ ID NO: 69820 - DNA, 103 bp, Artificial Sequence
  Synthetic Polynucleotide
taatacgactcactatagggcaaccacctcatctatatcttcaaaatcacaacagaggagagtgattatgaagatatagaacctggcggcagcgcaaaagatg

SEQ ID NO: 69821 - DNA, 103 bp, Artificial Sequence
  Synthetic Polynucleotide
taatacgactcactatagggttctgcaaccacctcatctatatcttcaaaaacagaggagatttgaaatgatagatgagaacctggcggcagcgcaaaagatg

SEQ ID NO: 69822 - DNA, 103 bp, Artificial Sequence
  Synthetic Polynucleotide
taatacgactcactatagggctatattctgcaaccacctcatctatatctaacagaggagaagatatatgtgaggtggtaacctggcggcagcgcaaaagatg

SEQ ID NO: 69823 - DNA, 103 bp, Artificial Sequence
  Synthetic Polynucleotide
taatacgactcactatagggtttgtctatattctgcaaccacctcatctaaacagaggagatagatgatgtggttgcagaacctggcggcagcgcaaaagatg

SEQ ID NO: 69824 - DNA, 103 bp, Artificial Sequence
  Synthetic Polynucleotide
taatacgactcactatagggatatttttgtctatattctgcaaccacctcaacagaggagagaggtgatggcagaatataacctggcggcagcgcaaaagatg

SEQ ID NO: 69825 - DNA, 103 bp, Artificial Sequence
  Synthetic Polynucleotide
taatacgactcactatagggccaccatatttttgtctatattctgcaaccaacagaggagaggttgcatgatatagacaaacctggcggcagcgcaaaagatg

SEQ ID NO: 69826 - DNA, 103 bp, Artificial Sequence
  Synthetic Polynucleotide
taatacgactcactatagggcttactattggtgtaaattacgacattaataacagaggagaattaatatggtaatttacaacctggcggcagcgcaaaagatg

SEQ ID NO: 69827 - DNA, 103 bp, Artificial Sequence
  Synthetic Polynucleotide
taatacgactcactatagggtagctccaccatatttttgtctatattctgaacagaggagacagaatatggacaaaaataacctggcggcagcgcaaaagatg

SEQ ID NO: 69828 - DNA, 103 bp, Artificial Sequence
  Synthetic Polynucleotide
taatacgactcactatagggacggctagctccaccatatttttgtctataaacagaggagatatagaatgaaatatggtaacctggcggcagcgcaaaagatg

SEQ ID NO: 69829 - DNA, 103 bp, Artificial Sequence
  Synthetic Polynucleotide
taatacgactcactatagggctaccacggctagctccaccatatttttgtaacagaggagaacaaaaatgtggtggagcaacctggcggcagcgcaaaagatg

SEQ ID NO: 69830 - DNA, 103 bp, Artificial Sequence
  Synthetic Polynucleotide
taatacgactcactatagggatgttctaccacggctagctccaccatattaacagaggagaaatatgatggagctagccaacctggcggcagcgcaaaagatg

SEQ ID NO: 69831 - DNA, 103 bp, Artificial Sequence
  Synthetic Polynucleotide
taatacgactcactatagggtgacgatgttctaccacggctagctccaccaacagaggagaggtggaatgagccgtggtaacctggcggcagcgcaaaagatg

SEQ ID NO: 69832 - DNA, 103 bp, Artificial Sequence
  Synthetic Polynucleotide
taatacgactcactatagggcttgatgacgatgttctaccacggctagctaacagaggagaagctagatgtggtagaacaacctggcggcagcgcaaaagatg

SEQ ID NO: 69833 - DNA, 103 bp, Artificial Sequence
  Synthetic Polynucleotide
taatacgactcactatagggtactacttgatgacgatgttctaccacggcaacagaggagagccgtgatggaacatcgtaacctggcggcagcgcaaaagatg

SEQ ID NO: 69834 - DNA, 103 bp, Artificial Sequence
  Synthetic Polynucleotide
taatacgactcactatagggatcactactacttgatgacgatgttctaccaacagaggagaggtagaatgtcgtcatcaaacctggcggcagcgcaaaagatg

SEQ ID NO: 69835 - DNA, 103 bp, Artificial Sequence
  Synthetic Polynucleotide
taatacgactcactatagggtcaaaatcactactacttgatgacgatgttaacagaggagaaacatcatgatcaagtagaacctggcggcagcgcaaaagatg

SEQ ID NO: 69836 - DNA, 103 bp, Artificial Sequence
  Synthetic Polynucleotide
taatacgactcactatagggtatcttcaaaatcactactacttgatgacgaacagaggagacgtcatatggtagtagtgaacctggcggcagcgcaaaagatg

SEQ ID NO: 69837 - DNA, 103 bp, Artificial Sequence
  Synthetic Polynucleotide
taatacgactcactatagggccgaacttactattggtgtaaattacgacaaacagaggagatgtcgtatgttacaccaaaacctggcggcagcgcaaaagatg

SEQ ID NO: 69838 - DNA, 103 bp, Artificial Sequence
  Synthetic Polynucleotide
taatacgactcactatagggatctatatcttcaaaatcactactacttgaaacagaggagatcaagtatgagtgattttaacctggcggcagcgcaaaagatg

SEQ ID NO: 69839 - DNA, 103 bp, Artificial Sequence
  Synthetic Polynucleotide
taatacgactcactatagggacctcatctatatcttcaaaatcactactaaacagaggagatagtagatgttttgaagaaacctggcggcagcgcaaaagatg

SEQ ID NO: 69840 - DNA, 103 bp, Artificial Sequence; identical to SEQ ID NO: 69820
  Synthetic Polynucleotide

SEQ ID NO: 69841 - DNA, 103 bp, Artificial Sequence; identical to SEQ ID NO: 69821
  Synthetic Polynucleotide

SEQ ID NO: 69842 - DNA, 103 bp, Artificial Sequence; identical to SEQ ID NO: 69822
  Synthetic Polynucleotide

SEQ ID NO: 69843 - DNA, 103 bp, Artificial Sequence; identical to SEQ ID NO: 69823
  Synthetic Polynucleotide

SEQ ID NO: 69844 - DNA, 103 bp, Artificial Sequence; identical to SEQ ID NO: 69824
  Synthetic Polynucleotide

SEQ ID NO: 69845 - DNA, 103 bp, Artificial Sequence
  Synthetic Polynucleotide
taatacgactcactatagggttgccatatttttgtctatattctgcaaccaacagaggagaggttgcatgatatagacaaacctggcggcagcgcaaaagatg

SEQ ID NO: 69846 - DNA, 103 bp, Artificial Sequence
  Synthetic Polynucleotide
taatacgactcactatagggtagcgttgccatatttttgtctatattctgaacagaggagacagaatatggacaaaaataacctggcggcagcgcaaaagatg

SEQ ID NO: 69847 - DNA, 103 bp, Artificial Sequence
  Synthetic Polynucleotide
taatacgactcactatagggtgtcatagcgttgccatatttttgtctataaacagaggagatatagaatgaaatatggcaacctggcggcagcgcaaaagatg

SEQ ID NO: 69848 - DNA, 103 bp, Artificial Sequence
  Synthetic Polynucleotide
taatacgactcactatagggtgccgccgaacttactattggtgtaaattaaacagaggagataatttatgccaatagtaaacctggcggcagcgcaaaagatg

SEQ ID NO: 69849 - DNA, 103 bp, Artificial Sequence
  Synthetic Polynucleotide
taatacgactcactatagggccttttgtcatagcgttgccatatttttgtaacagaggagaacaaaaatgtggcaacgcaacctggcggcagcgcaaaagatg

SEQ ID NO: 69850 - DNA, 103 bp, Artificial Sequence
  Synthetic Polynucleotide
taatacgactcactatagggcacgtccttttgtcatagcgttgccatattaacagaggagaaatatgatgacgctatgaaacctggcggcagcgcaaaagatg

SEQ ID NO: 69851 - DNA, 103 bp, Artificial Sequence
  Synthetic Polynucleotide
taatacgactcactatagggagaaccacgtccttttgtcatagcgttgccaacagaggagaggcaacatgatgacaaaaaacctggcggcagcgcaaaagatg

SEQ ID NO: 69852 - DNA, 103 bp, Artificial Sequence
  Synthetic Polynucleotide
taatacgactcactatagggttagaagaaccacgtccttttgtcatagcgaacagaggagacgctatatgaaaaggacgaacctggcggcagcgcaaaagatg

SEQ ID NO: 69853 - DNA, 103 bp, Artificial Sequence
  Synthetic Polynucleotide
taatacgactcactatagggccggtttagaagaaccacgtccttttgtcaaacagaggagatgacaaatggacgtggttaacctggcggcagcgcaaaagatg

SEQ ID NO: 69854 - DNA, 103 bp, Artificial Sequence
  Synthetic Polynucleotide
taatacgactcactatagggcggatccggtttagaagaaccacgtcctttaacagaggagaaaaggaatgggttcttctaacctggcggcagcgcaaaagatg

SEQ ID NO: 69855 - DNA, 103 bp, Artificial Sequence
  Synthetic Polynucleotide
taatacgactcactatagggtataacggatccggtttagaagaaccacgtaacagaggagaacgtggatgttctaaaccaacctggcggcagcgcaaaagatg

SEQ ID NO: 69856 - DNA, 103 bp, Artificial Sequence
  Synthetic Polynucleotide
taatacgactcactatagggtactatataacggatccggtttagaagaacaacagaggagagttcttatgaaccggatcaacctggcggcagcgcaaaagatg

SEQ ID NO: 69857 - DNA, 103 bp, Artificial Sequence
  Synthetic Polynucleotide
taatacgactcactatagggaacagtactatataacggatccggtttagaaacagaggagatctaaaatggatccgttaaacctggcggcagcgcaaaagatg

SEQ ID NO: 69858 - DNA, 103 bp, Artificial Sequence
  Synthetic Polynucleotide
taatacgactcactatagggttcttaacagtactatataacggatccggtaacagaggagaaccggaatggttatatagaacctggcggcagcgcaaaagatg

SEQ ID NO: 69859 - DNA, 103 bp, Artificial Sequence
  Synthetic Polynucleotide
taatacgactcactatagggtactttgccgccgaacttactattggtgtaaacagaggagatacaccatgagtaagttcaacctggcggcagcgcaaaagatg

SEQ ID NO: 69860 - DNA, 103 bp, Artificial Sequence
  Synthetic Polynucleotide
taatacgactcactataggggtgttttcttaacagtactatataacggataacagaggagaatccgtatgatagtactgaacctggcggcagcgcaaaagatg

SEQ ID NO: 69861 - DNA, 103 bp, Artificial Sequence
  Synthetic Polynucleotide
taatacgactcactatagggtttaggtgttttcttaacagtactatataaaacagaggagattatatatgactgttaagaacctggcggcagcgcaaaagatg

SEQ ID NO: 69862 - DNA, 103 bp, Artificial Sequence
  Synthetic Polynucleotide
taatacgactcactatagggatacttttaggtgttttcttaacagtactaaacagaggagatagtacatgtaagaaaacaacctggcggcagcgcaaaagatg

SEQ ID NO: 69863 - DNA, 103 bp, Artificial Sequence
  Synthetic Polynucleotide
taatacgactcactatagggatgctatacttttaggtgttttcttaacagaacagaggagactgttaatgaaacacctaaacctggcggcagcgcaaaagatg

SEQ ID NO: 69864 - DNA, 103 bp, Artificial Sequence
  Synthetic Polynucleotide
taatacgactcactatagggtccagatgctatacttttaggtgttttcttaacagaggagaaagaaaatgcctaaaagtaacctggcggcagcgcaaaagatg

SEQ ID NO: 69865 - DNA, 103 bp, Artificial Sequence
  Synthetic Polynucleotide
taatacgactcactatagggtctactccagatgctatacttttaggtgttaacagaggagaaacaccatgaagtatagcaacctggcggcagcgcaaaagatg

SEQ ID NO: 69866 - DNA, 103 bp, Artificial Sequence
  Synthetic Polynucleotide
taatacgactcactatagggctatgtctactccagatgctatacttttagaacagaggagactaaaaatgtagcatctgaacctggcggcagcgcaaaagatg

SEQ ID NO: 69867 - DNA, 103 bp, Artificial Sequence
  Synthetic Polynucleotide
taatacgactcactatagggtgaaactatgtctactccagatgctatactaacagaggagaagtataatgtctggagtaaacctggcggcagcgcaaaagatg

SEQ ID NO: 69868 - DNA, 103 bp, Artificial Sequence
  Synthetic Polynucleotide
taatacgactcactatagggtgttttgaaactatgtctactccagatgctaacagaggagaagcatcatgagtagacataacctggcggcagcgcaaaagatg

SEQ ID NO: 69869 - DNA, 103 bp, Artificial Sequence
  Synthetic Polynucleotide
taatacgactcactatagggctgtttgttttgaaactatgtctactccagaacagaggagactggagatgacatagtttaacctggcggcagcgcaaaagatg

SEQ ID NO: 69870 - DNA, 103 bp, Artificial Sequence
  Synthetic Polynucleotide
taatacgactcactatagggattggtactttgccgccgaacttactattgaacagaggagacaatagatggttcggcggaacctggcggcagcgcaaaagatg

SEQ ID NO: 69871 - DNA, 103 bp, Artificial Sequence
  Synthetic Polynucleotide
taatacgactcactatagggatagtctgtttgttttgaaactatgtctacaacagaggagagtagacatggtttcaaaaaacctggcggcagcgcaaaagatg

SEQ ID NO: 69872 - DNA, 103 bp, Artificial Sequence
  Synthetic Polynucleotide
taatacgactcactatagggaaagaatagtctgtttgttttgaaactatgaacagaggagacatagtatgaaaacaaacaacctggcggcagcgcaaaagatg

SEQ ID NO: 69873 - DNA, 103 bp, Artificial Sequence
  Synthetic Polynucleotide
taatacgactcactataggggtaataaagaatagtctgtttgttttgaaaaacagaggagatttcaaatgaaacagactaacctggcggcagcgcaaaagatg

SEQ ID NO: 69874 - DNA, 103 bp, Artificial Sequence
  Synthetic Polynucleotide
taatacgactcactataggggccgggtaataaagaatagtctgtttgtttaacagaggagaaaacaaatggactattctaacctggcggcagcgcaaaagatg

SEQ ID NO: 69875 - DNA, 103 bp, Artificial Sequence
  Synthetic Polynucleotide
taatacgactcactatagggttaacgccgggtaataaagaatagtctgttaacagaggagaaacagaatgttctttattaacctggcggcagcgcaaaagatg

SEQ ID NO: 69876 - DNA, 103 bp, Artificial Sequence
  Synthetic Polynucleotide
taatacgactcactatagggcagtattaacgccgggtaataaagaatagtaacagaggagaactattatgtattacccgaacctggcggcagcgcaaaagatg

SEQ ID NO: 69877 - DNA, 103 bp, Artificial Sequence
  Synthetic Polynucleotide
taatacgactcactatagggactgccagtattaacgccgggtaataaagaaacagaggagatctttaatgcccggcgttaacctggcggcagcgcaaaagatg

SEQ ID NO: 69878 - DNA, 103 bp, Artificial Sequence
  Synthetic Polynucleotide
taatacgactcactatagggatagaactgccagtattaacgccgggtaataacagaggagaattaccatgcgttaatacaacctggcggcagcgcaaaagatg

SEQ ID NO: 69879 - DNA, 103 bp, Artificial Sequence
  Synthetic Polynucleotide
taatacgactcactatagggttacgatagaactgccagtattaacgccggaacagaggagaccggcgatgatactggcaaacctggcggcagcgcaaaagatg

SEQ ID NO: 69880 - DNA, 103 bp, Artificial Sequence
  Synthetic Polynucleotide
taatacgactcactatagggaggtgttacgatagaactgccagtattaacaacagaggagagttaatatgggcagttctaacctggcggcagcgcaaaagatg

SEQ ID NO: 69881 - DNA, 103 bp, Artificial Sequence
  Synthetic Polynucleotide
taatacgactcactatagggcaggtattggtactttgccgccgaacttacaacagaggagagtaagtatggcggcaaagaacctggcggcagcgcaaaagatg

SEQ ID NO: 69882 - DNA, 103 bp, Artificial Sequence
  Synthetic Polynucleotide
taatacgactcactataggggtgagaggtgttacgatagaactgccagtaaacagaggagatactggatgttctatcgtaacctggcggcagcgcaaaagatg

SEQ ID NO: 69883 - DNA, 103 bp, Artificial Sequence
  Synthetic Polynucleotide
taatacgactcactatagggttctggtgagaggtgttacgatagaactgcaacagaggagagcagttatgtcgtaacacaacctggcggcagcgcaaaagatg

SEQ ID NO: 69884 - DNA, 103 bp, Artificial Sequence
  Synthetic Polynucleotide
taatacgactcactatagggtcctcttctggtgagaggtgttacgatagaaacagaggagatctatcatgacacctctcaacctggcggcagcgcaaaagatg

SEQ ID NO: 69885 - DNA, 103 bp, Artificial Sequence
  Synthetic Polynucleotide
taatacgactcactataggggtagctcctcttctggtgagaggtgttacgaacagaggagacgtaacatgtctcaccagaacctggcggcagcgcaaaagatg

SEQ ID NO: 69886 - DNA, 103 bp, Artificial Sequence
  Synthetic Polynucleotide
taatacgactcactataggggtctagtagctcctcttctggtgagaggtgaacagaggagacacctcatgccagaagagaacctggcggcagcgcaaaagatg

SEQ ID NO: 69887 - DNA, 103 bp, Artificial Sequence
  Synthetic Polynucleotide
taatacgactcactatagggaggtcgtctagtagctcctcttctggtgagaacagaggagactcaccatgagaggagctaacctggcggcagcgcaaaagatg

SEQ ID NO: 69888 - DNA, 103 bp, Artificial Sequence
  Synthetic Polynucleotide
taatacgactcactatagggcgtttaggtcgtctagtagctcctcttctgaacagaggagacagaagatgagctactagaacctggcggcagcgcaaaagatg

SEQ ID NO: 69889 - DNA, 103 bp, Artificial Sequence
  Synthetic Polynucleotide
taatacgactcactatagggatgggcgtttaggtcgtctagtagctcctcaacagaggagagaggagatgctagacgacaacctggcggcagcgcaaaagatg

SEQ ID NO: 69890 - DNA, 103 bp, Artificial Sequence
  Synthetic Polynucleotide
taatacgactcactatagggtgtagatgggcgtttaggtcgtctagtagcaacagaggagagctactatgcgacctaaaaacctggcggcagcgcaaaagatg

SEQ ID NO: 69891 - DNA, 103 bp, Artificial Sequence
  Synthetic Polynucleotide
taatacgactcactatagggggaggtgtagatgggcgtttaggtcgtctaaacagaggagatagacgatgtaaacgcccaacctggcggcagcgcaaaagatg

SEQ ID NO: 69892 - DNA, 103 bp, Artificial Sequence
  Synthetic Polynucleotide
taatacgactcactataggggattacaggtattggtactttgccgccgaaaacagaggagattcggcatgaaagtaccaaacctggcggcagcgcaaaagatg

SEQ ID NO: 69893 - DNA, 103 bp, Artificial Sequence
  Synthetic Polynucleotide
taatacgactcactatagggcgcgtggaggtgtagatgggcgtttaggtcaacagaggagagacctaatggcccatctaaacctggcggcagcgcaaaagatg

SEQ ID NO: 69894 - DNA, 103 bp, Artificial Sequence
  Synthetic Polynucleotide
taatacgactcactatagggatcttcgcgtggaggtgtagatgggcgtttaacagaggagaaaacgcatgtctacacctaacctggcggcagcgcaaaagatg

SEQ ID NO: 69895 - DNA, 103 bp, Artificial Sequence
  Synthetic Polynucleotide
taatacgactcactatagggggtagatcttcgcgtggaggtgtagatgggaacagaggagacccatcatgacctccacgaacctggcggcagcgcaaaagatg

SEQ ID NO: 69896 - DNA, 103 bp, Artificial Sequence
  Synthetic Polynucleotide
taatacgactcactataggggcggtggtagatcttcgcgtggaggtgtagaacagaggagactacacatgcacgcgaagaacctggcggcagcgcaaaagatg

SEQ ID NO: 69897 - DNA, 103 bp, Artificial Sequence
  Synthetic Polynucleotide
taatacgactcactatagggaggaagcggtggtagatcttcgcgtggaggaacagaggagacctccaatggaagatctaaacctggcggcagcgcaaaagatg

SEQ ID NO: 69898 - DNA, 103 bp, Artificial Sequence
  Synthetic Polynucleotide
taatacgactcactatagggtttagaggaagcggtggtagatcttcgcgtaacagaggagaacgcgaatgtctaccaccaacctggcggcagcgcaaaagatg

SEQ ID NO: 69899 - DNA, 103 bp, Artificial Sequence
  Synthetic Polynucleotide
taatacgactcactataggggaggatttagaggaagcggtggtagatcttaacagaggagaaagatcatgcaccgcttcaacctggcggcagcgcaaaagatg

SEQ ID NO: 69900 - DNA, 103 bp, Artificial Sequence
  Synthetic Polynucleotide
taatacgactcactatagggataaggaggatttagaggaagcggtggtagaacagaggagactaccaatgcttcctctaaacctggcggcagcgcaaaagatg

SEQ ID NO: 69901 - DNA, 103 bp, Artificial Sequence
  Synthetic Polynucleotide
taatacgactcactatagggtgtcgataaggaggatttagaggaagcggtaacagaggagaaccgctatgtctaaatccaacctggcggcagcgcaaaagatg

SEQ ID NO: 69902 - DNA, 103 bp, Artificial Sequence
  Synthetic Polynucleotide
taatacgactcactatagggaaagttgtcgataaggaggatttagaggaaaacagaggagattcctcatgatcctccttaacctggcggcagcgcaaaagatg

SEQ ID NO: 69903 - DNA, 103 bp, Artificial Sequence
  Synthetic Polynucleotide
taatacgactcactatagggtatgctgtttctcagtgtgtgtttataacaaacagaggagatgttatatgcacacactgaacctggcggcagcgcaaaagatg

SEQ ID NO: 69904 - DNA, 103 bp, Artificial Sequence
  Synthetic Polynucleotide
taatacgactcactataggggacaagattacaggtattggtactttgccgaacagaggagacggcaaatgaccaataccaacctggcggcagcgcaaaagatg

SEQ ID NO: 69905 - DNA, 103 bp, Artificial Sequence
  Synthetic Polynucleotide
taatacgactcactatagggacgagaaagttgtcgataaggaggatttagaacagaggagactaaatatgccttatcgaaacctggcggcagcgcaaaagatg

SEQ ID NO: 69906 - DNA, 103 bp, Artificial Sequence
  Synthetic Polynucleotide
taatacgactcactatagggccaccacgagaaagttgtcgataaggaggaaacagaggagatcctccatgtcgacaactaacctggcggcagcgcaaaagatg

SEQ ID NO: 69907 - DNA, 103 bp, Artificial Sequence
  Synthetic Polynucleotide
taatacgactcactataggggatcaccaccacgagaaagttgtcgataagaacagaggagacttatcatgaactttctcaacctggcggcagcgcaaaagatg

SEQ ID NO: 69908 - DNA, 103 bp, Artificial Sequence
  Synthetic Polynucleotide
taatacgactcactatagggagaatgatcaccaccacgagaaagttgtcgaacagaggagacgacaaatgtctcgtggtaacctggcggcagcgcaaaagatg

SEQ ID NO: 69909 - DNA, 103 bp, Artificial Sequence
  Synthetic Polynucleotide
taatacgactcactatagggtgtagagaatgatcaccaccacgagaaagtaacagaggagaactttcatgtggtggtgaaacctggcggcagcgcaaaagatg

SEQ ID NO: 69910 - DNA, 103 bp, Artificial Sequence
  Synthetic Polynucleotide
taatacgactcactatagggcttgttgtagagaatgatcaccaccacgagaacagaggagactcgtgatggtgatcattaacctggcggcagcgcaaaagatg

SEQ ID NO: 69911 - DNA, 103 bp, Artificial Sequence
  Synthetic Polynucleotide
taatacgactcactatagggaggaacttgttgtagagaatgatcaccaccaacagaggagaggtggtatgcattctctaaacctggcggcagcgcaaaagatg

SEQ ID NO: 69912 - DNA, 103 bp, Artificial Sequence
  Synthetic Polynucleotide
taatacgactcactatagggcgttgaggaacttgttgtagagaatgatcaaacagaggagatgatcaatgtctacaacaaacctggcggcagcgcaaaagatg

SEQ ID NO: 69913 - DNA, 103 bp, Artificial Sequence
  Synthetic Polynucleotide
taatacgactcactatagggaatcacgttgaggaacttgttgtagagaataacagaggagaattctcatgaacaagttcaacctggcggcagcgcaaaagatg

SEQ ID NO: 69914 - DNA, 103 bp, Artificial Sequence
  Synthetic Polynucleotide
taatacgactcactatagggagaataatcacgttgaggaacttgttgtagaacagaggagactacaaatggttcctcaaaacctggcggcagcgcaaaagatg

SEQ ID NO: 69915 - DNA, 103 bp, Artificial Sequence
  Synthetic Polynucleotide
taatacgactcactatagggtcctcgacaagattacaggtattggtacttaacagaggagaaagtacatgtacctgtaaaacctggcggcagcgcaaaagatg

SEQ ID NO: 69916 - DNA, 103 bp, Artificial Sequence
  Synthetic Polynucleotide
taatacgactcactatagggggtggagaataatcacgttgaggaacttgtaacagaggagaacaagtatgtcaacgtgaaacctggcggcagcgcaaaagatg

SEQ ID NO: 69917 - DNA, 103 bp, Artificial Sequence
  Synthetic Polynucleotide
taatacgactcactatagggtatgtggtggagaataatcacgttgaggaaaacagaggagattcctcatggtgattattaacctggcggcagcgcaaaagatg

SEQ ID NO: 69918 - DNA, 103 bp, Artificial Sequence
  Synthetic Polynucleotide
taatacgactcactatagggaggtctatgtggtggagaataatcacgttgaacagaggagacaacgtatgtattctccaaacctggcggcagcgcaaaagatg

SEQ ID NO: 69919 - DNA, 103 bp, Artificial Sequence
  Synthetic Polynucleotide
taatacgactcactatagggggaggaggtctatgtggtggagaataatcaaacagaggagatgattaatgtccaccacaaacctggcggcagcgcaaaagatg

SEQ ID NO: 69920 - DNA, 103 bp, Artificial Sequence
  Synthetic Polynucleotide
taatacgactcactataggggtggtggaggaggtctatgtggtggagaataacagaggagaattctcatgcacatagacaacctggcggcagcgcaaaagatg

SEQ ID NO: 69921 - DNA, 103 bp, Artificial Sequence
  Synthetic Polynucleotide
taatacgactcactatagggaggaagtggtggaggaggtctatgtggtggaacagaggagaccaccaatgagacctcctaacctggcggcagcgcaaaagatg

SEQ ID NO: 69922 - DNA, 103 bp, Artificial Sequence
  Synthetic Polynucleotide
taatacgactcactatagggttaggaggaagtggtggaggaggtctatgtaacagaggagaacatagatgtcctccaccaacctggcggcagcgcaaaagatg

SEQ ID NO: 69923 - DNA, 103 bp, Artificial Sequence
  Synthetic Polynucleotide
taatacgactcactatagggctggtttaggaggaagtggtggaggaggtcaacagaggagagacctcatgcaccacttcaacctggcggcagcgcaaaagatg

SEQ ID NO: 69924 - DNA, 103 bp, Artificial Sequence
  Synthetic Polynucleotide
taatacgactcactatagggtggaactggtttaggaggaagtggtggaggaacagaggagacctccaatgcttcctcctaacctggcggcagcgcaaaagatg

SEQ ID NO: 69925 - DNA, 103 bp, Artificial Sequence
  Synthetic Polynucleotide
taatacgactcactatagggatagctggaactggtttaggaggaagtggtaacagaggagaaccactatgtcctaaaccaacctggcggcagcgcaaaagatg

SEQ ID NO: 69926 - DNA, 103 bp, Artificial Sequence
  Synthetic Polynucleotide
taatacgactcactatagggtgtcctcctcgacaagattacaggtattggaacagaggagaccaataatggtaatcttgaacctggcggcagcgcaaaagatg

SEQ ID NO: 69927 - DNA, 103 bp, Artificial Sequence
  Synthetic Polynucleotide
taatacgactcactataggggtggaatagctggaactggtttaggaggaaaacagaggagattcctcatgaaccagttcaacctggcggcagcgcaaaagatg

SEQ ID NO: 69928 - DNA, 103 bp, Artificial Sequence
  Synthetic Polynucleotide
taatacgactcactatagggtctaggtggaatagctggaactggtttaggaacagaggagacctaaaatggttccagctaacctggcggcagcgcaaaagatg

SEQ ID NO: 69929 - DNA, 103 bp, Artificial Sequence
  Synthetic Polynucleotide
taatacgactcactatagggctatctctaggtggaatagctggaactggtaacagaggagaaccagtatgagctattccaacctggcggcagcgcaaaagatg

SEQ ID NO: 69930 - DNA, 103 bp, Artificial Sequence
  Synthetic Polynucleotide
taatacgactcactataggggttgactatctctaggtggaatagctggaaaacagaggagattccagatgttccacctaaacctggcggcagcgcaaaagatg

SEQ ID NO: 69931 - DNA, 103 bp, Artificial Sequence
  Synthetic Polynucleotide
taatacgactcactatagggatttggttgactatctctaggtggaatagcaacagaggagagctattatgcctagagataacctggcggcagcgcaaaagatg

SEQ ID NO: 69932 - DNA, 103 bp, Artificial Sequence
  Synthetic Polynucleotide
taatacgactcactatagggttattatttggttgactatctctaggtggaaacagaggagatccaccatgagatagtcaaacctggcggcagcgcaaaagatg

SEQ ID NO: 69933 - DNA, 103 bp, Artificial Sequence
  Synthetic Polynucleotide
taatacgactcactatagggatcctttattatttggttgactatctctagaacagaggagactagagatggtcaaccaaaacctggcggcagcgcaaaagatg

SEQ ID NO: 69934 - DNA, 103 bp, Artificial Sequence
  Synthetic Polynucleotide
taatacgactcactatagggactaaatcctttattatttggttgactatcaacagaggagagatagtatgccaaataataacctggcggcagcgcaaaagatg

SEQ ID NO: 69935 - DNA, 103 bp, Artificial Sequence
  Synthetic Polynucleotide
taatacgactcactatagggaacttactaaatcctttattatttggttgaaacagaggagatcaaccatgtaataaaggaacctggcggcagcgcaaaagatg

SEQ ID NO: 69936 - DNA, 103 bp, Artificial Sequence
  Synthetic Polynucleotide
taatacgactcactatagggatacaaacttactaaatcctttattatttgaacagaggagacaaataatgaaggatttaaacctggcggcagcgcaaaagatg

SEQ ID NO: 69937 - DNA, 103 bp, Artificial Sequence
  Synthetic Polynucleotide
taatacgactcactatagggctatatgtcctcctcgacaagattacaggtaacagaggagaacctgtatgcttgtcgagaacctggcggcagcgcaaaagatg

SEQ ID NO: 69938 - DNA, 103 bp, Artificial Sequence
  Synthetic Polynucleotide
taatacgactcactatagggaggagatacaaacttactaaatcctttattaacagaggagaaataaaatgtttagtaagaacctggcggcagcgcaaaagatg

SEQ ID NO: 69939 - DNA, 103 bp, Artificial Sequence
  Synthetic Polynucleotide
taatacgactcactatagggcgtctaggagatacaaacttactaaatcctaacagaggagaaggattatgtaagtttgtaacctggcggcagcgcaaaagatg

SEQ ID NO: 69940 - DNA, 103 bp, Artificial Sequence
  Synthetic Polynucleotide
taatacgactcactatagggtacaccgtctaggagatacaaacttactaaaacagaggagattagtaatgttgtatctcaacctggcggcagcgcaaaagatg

SEQ ID NO: 69941 - DNA, 103 bp, Artificial Sequence
  Synthetic Polynucleotide
taatacgactcactatagggtcttctacaccgtctaggagatacaaacttaacagaggagaaagtttatgtctcctagaaacctggcggcagcgcaaaagatg

SEQ ID NO: 69942 - DNA, 103 bp, Artificial Sequence
  Synthetic Polynucleotide
taatacgactcactataggggttgatcttctacaccgtctaggagatacaaacagaggagatgtatcatgtagacggtgaacctggcggcagcgcaaaagatg

SEQ ID NO: 69943 - DNA, 103 bp, Artificial Sequence
  Synthetic Polynucleotide
taatacgactcactatagggcagaggttgatcttctacaccgtctaggagaacagaggagactcctaatgggtgtagaaaacctggcggcagcgcaaaagatg

SEQ ID NO: 69944 - DNA, 103 bp, Artificial Sequence
  Synthetic Polynucleotide
taatacgactcactataggggactccagaggttgatcttctacaccgtctaacagaggagaagacggatgagaagatcaaacctggcggcagcgcaaaagatg

SEQ ID NO: 69945 - DNA, 103 bp, Artificial Sequence
  Synthetic Polynucleotide
taatacgactcactatagggcatacgactccagaggttgatcttctacacaacagaggagagtgtagatgatcaacctcaacctggcggcagcgcaaaagatg

SEQ ID NO: 69946 - DNA, 103 bp, Artificial Sequence
  Synthetic Polynucleotide
taatacgactcactatagggtaccacatacgactccagaggttgatcttcaacagaggagagaagatatgcctctggagaacctggcggcagcgcaaaagatg

SEQ ID NO: 69947 - DNA, 103 bp, Artificial Sequence
  Synthetic Polynucleotide
taatacgactcactatagggtatcataccacatacgactccagaggttgaaacagaggagatcaaccatgggagtcgtaaacctggcggcagcgcaaaagatg

SEQ ID NO: 69948 - DNA, 103 bp, Artificial Sequence
  Synthetic Polynucleotide
taatacgactcactataggggaatactatatgtcctcctcgacaagattaaacagaggagataatctatgcgaggaggaaacctggcggcagcgcaaaagatg

SEQ ID NO: 69949 - DNA, 103 bp, Artificial Sequence
  Synthetic Polynucleotide
taatacgactcactataggggattgtatcataccacatacgactccagagaacagaggagactctggatgcgtatgtggaacctggcggcagcgcaaaagatg

SEQ ID NO: 69950 - DNA, 103 bp, Artificial Sequence
  Synthetic Polynucleotide
taatacgactcactataggggtcttgattgtatcataccacatacgactcaacagaggagagagtcgatggtggtatgaaacctggcggcagcgcaaaagatg

SEQ ID NO: 69951 - DNA, 103 bp, Artificial Sequence
  Synthetic Polynucleotide
taatacgactcactataggggtttggtcttgattgtatcataccacatacaacagaggagagtatgtatgatgatacaaaacctggcggcagcgcaaaagatg

SEQ ID NO: 69952 - DNA, 103 bp, Artificial Sequence
  Synthetic Polynucleotide
taatacgactcactatagggtcatcgtttggtcttgattgtatcataccaaacagaggagatggtatatgacaatcaagaacctggcggcagcgcaaaagatg

SEQ ID NO: 69953 - DNA, 103 bp, Artificial Sequence
  Synthetic Polynucleotide
taatacgactcactatagggatgtatcatcgtttggtcttgattgtatcaaacagaggagatgatacatgcaagaccaaaacctggcggcagcgcaaaagatg

SEQ ID NO: 69954 - DNA, 103 bp, Artificial Sequence
  Synthetic Polynucleotide
taatacgactcactatagggtgaatatgtatcatcgtttggtcttgattgaacagaggagacaatcaatgccaaacgataacctggcggcagcgcaaaagatg

SEQ ID NO: 69955 - DNA, 103 bp, Artificial Sequence
  Synthetic Polynucleotide
taatacgactcactatagggagaagtgaatatgtatcatcgtttggtcttaacagaggagaaagaccatgcgatgatacaacctggcggcagcgcaaaagatg

SEQ ID NO: 69956 - DNA, 103 bp, Artificial Sequence
  Synthetic Polynucleotide
taatacgactcactataggggttgaagaagtgaatatgtatcatcgtttgaacagaggagacaaacgatgatacatattaacctggcggcagcgcaaaagatg

SEQ ID NO: 69957 - DNA, 103 bp, Artificial Sequence
  Synthetic Polynucleotide
taatacgactcactatagggtggtagttgaagaagtgaatatgtatcatcaacagaggagagatgatatgtattcacttaacctggcggcagcgcaaaagatg

SEQ ID NO: 69958 - DNA, 103 bp, Artificial Sequence
  Synthetic Polynucleotide
taatacgactcactatagggatttttggtagttgaagaagtgaatatgtaaacagaggagatacataatgacttcttcaaacctggcggcagcgcaaaagatg

SEQ ID NO: 69959 - DNA, 103 bp, Artificial Sequence
  Synthetic Polynucleotide
taatacgactcactatagggtacaagaatactatatgtcctcctcgacaaaacagaggagattgtcgatgaggacatataacctggcggcagcgcaaaagatg

SEQ ID NO: 69960 - DNA, 103 bp, Artificial Sequence
  Synthetic Polynucleotide
taatacgactcactataggggttcaatttttggtagttgaagaagtgaataacagaggagaattcacatgttcaactacaacctggcggcagcgcaaaagatg

SEQ ID NO: 69961 - DNA, 103 bp, Artificial Sequence
  Synthetic Polynucleotide
taatacgactcactatagggttctggttcaatttttggtagttgaagaagaacagaggagacttcttatgctaccaaaaaacctggcggcagcgcaaaagatg

SEQ ID NO: 69962 - DNA, 103 bp, Artificial Sequence
  Synthetic Polynucleotide
taatacgactcactataggggcatattctggttcaatttttggtagttgaaacagaggagatcaactatgaaaaattgaaacctggcggcagcgcaaaagatg

SEQ ID NO: 69963 - DNA, 103 bp, Artificial Sequence
  Synthetic Polynucleotide
taatacgactcactatagggcctccgcatattctggttcaatttttggtaaacagaggagataccaaatgttgaaccagaacctggcggcagcgcaaaagatg

SEQ ID NO: 69964 - DNA, 103 bp, Artificial Sequence
  Synthetic Polynucleotide
taatacgactcactatagggacctacctccgcatattctggttcaattttaacagaggagaaaaattatgccagaatataacctggcggcagcgcaaaagatg

SEQ ID NO: 69965 - DNA, 103 bp, Artificial Sequence
  Synthetic Polynucleotide
taatacgactcactatagggccattacctacctccgcatattctggttcaaacagaggagatgaaccatgatatgcggaaacctggcggcagcgcaaaagatg

SEQ ID NO: 69966 - DNA, 103 bp, Artificial Sequence
  Synthetic Polynucleotide
taatacgactcactataggggtaagccattacctacctccgcatattctgaacagaggagacagaatatgcggaggtagaacctggcggcagcgcaaaagatg

SEQ ID NO: 69967 - DNA, 103 bp, Artificial Sequence
  Synthetic Polynucleotide
taatacgactcactatagggcttgggtaagccattacctacctccgcataaacagaggagatatgcgatggtaggtaataacctggcggcagcgcaaaagatg

SEQ ID NO: 69968 - DNA, 103 bp, Artificial Sequence
  Synthetic Polynucleotide
taatacgactcactatagggttgttcttgggtaagccattacctacctccaacagaggagaggaggtatgtaatggcttaacctggcggcagcgcaaaagatg

SEQ ID NO: 69969 - DNA, 103 bp, Artificial Sequence
  Synthetic Polynucleotide
taatacgactcactataggggaacattgttcttgggtaagccattacctaaacagaggagataggtaatggcttacccaaacctggcggcagcgcaaaagatg

SEQ ID NO: 69970 - DNA, 103 bp, Artificial Sequence
  Synthetic Polynucleotide
taatacgactcactatagggtagaatacaagaatactatatgtcctcctcaacagaggagagaggagatgatatagtataacctggcggcagcgcaaaagatg

SEQ ID NO: 69971 - DNA, 103 bp, Artificial Sequence
  Synthetic Polynucleotide
taatacgactcactatagggcacaggaacattgttcttgggtaagccattaacagaggagaaatggcatgcccaagaacaacctggcggcagcgcaaaagatg

SEQ ID NO: 69972 - DNA, 103 bp, Artificial Sequence
  Synthetic Polynucleotide
taatacgactcactatagggcctatcacaggaacattgttcttgggtaagaacagaggagacttaccatggaacaatgtaacctggcggcagcgcaaaagatg

SEQ ID NO: 69973 - DNA, 103 bp, Artificial Sequence
  Synthetic Polynucleotide
taatacgactcactatagggtattgcctatcacaggaacattgttcttggaacagaggagaccaagaatgatgttcctgaacctggcggcagcgcaaaagatg

SEQ ID NO: 69974 - DNA, 103 bp, Artificial Sequence
  Synthetic Polynucleotide
taatacgactcactatagggatgtttattgcctatcacaggaacattgttaacagaggagaaacaatatgcctgtgataaacctggcggcagcgcaaaagatg

SEQ ID NO: 69975 - DNA, 103 bp, Artificial Sequence
  Synthetic Polynucleotide
taatacgactcactatagggttactatgtttattgcctatcacaggaacaaacagaggagatgttccatggataggcaaaacctggcggcagcgcaaaagatg

SEQ ID NO: 69976 - DNA, 103 bp, Artificial Sequence
  Synthetic Polynucleotide
taatacgactcactatagggattttttactatgtttattgcctatcacagaacagaggagactgtgaatggcaataaacaacctggcggcagcgcaaaagatg

SEQ ID NO: 69977 - DNA, 103 bp, Artificial Sequence
  Synthetic Polynucleotide
taatacgactcactatagggtgtatattttttactatgtttattgcctataacagaggagaataggcatgaaacatagtaacctggcggcagcgcaaaagatg

SEQ ID NO: 69978 - DNA, 103 bp, Artificial Sequence
  Synthetic Polynucleotide
taatacgactcactataggggacgatgtatattttttactatgtttattgaacagaggagacaataaatgtagtaaaaaaacctggcggcagcgcaaaagatg

SEQ ID NO: 69979 - DNA, 103 bp, Artificial Sequence
  Synthetic Polynucleotide
taatacgactcactatagggacatcgacgatgtatattttttactatgttaacagaggagaaacataatgaaaaatataaacctggcggcagcgcaaaagatg

SEQ ID NO: 69980 - DNA, 103 bp, Artificial Sequence
  Synthetic Polynucleotide
taatacgactcactatagggttttgacatcgacgatgtatattttttactaacagaggagaagtaaaatgtatacatcgaacctggcggcagcgcaaaagatg

SEQ ID NO: 69981 - DNA, 103 bp, Artificial Sequence
  Synthetic Polynucleotide
taatacgactcactatagggttcggtagaatacaagaatactatatgtccaacagaggagaggacatatggtattcttgaacctggcggcagcgcaaaagatg

SEQ ID NO: 69982 - DNA, 103 bp, Artificial Sequence
  Synthetic Polynucleotide
taatacgactcactataggggatatttttgacatcgacgatgtatattttaacagaggagaaaaataatgatcgtcgataacctggcggcagcgcaaaagatg

SEQ ID NO: 69983 - DNA, 103 bp, Artificial Sequence
  Synthetic Polynucleotide
taatacgactcactatagggttgttgatatttttgacatcgacgatgtataacagaggagaatacatatgcgatgtcaaaacctggcggcagcgcaaaagatg

SEQ ID NO: 69984 - DNA, 103 bp, Artificial Sequence
  Synthetic Polynucleotide
taatacgactcactatagggaaattttgttgatatttttgacatcgacgaaacagaggagatcgtcgatgtcaaaaataaacctggcggcagcgcaaaagatg

SEQ ID NO: 69985 - DNA, 103 bp, Artificial Sequence
  Synthetic Polynucleotide
taatacgactcactatagggttatcaaattttgttgatatttttgacatcaacagaggagagatgtcatgaatatcaacaacctggcggcagcgcaaaagatg

SEQ ID NO: 69986 - DNA, 103 bp, Artificial Sequence
  Synthetic Polynucleotide
taatacgactcactatagggtagatttatcaaattttgttgatatttttgaacagaggagacaaaaaatgcaacaaaataacctggcggcagcgcaaaagatg

SEQ ID NO: 69987 - DNA, 103 bp, Artificial Sequence
  Synthetic Polynucleotide
taatacgactcactatagggtgccatagatttatcaaattttgttgatataacagaggagaatatcaatgaaatttgataacctggcggcagcgcaaaagatg

SEQ ID NO: 69988 - DNA, 103 bp, Artificial Sequence
  Synthetic Polynucleotide
taatacgactcactatagggccaaatgccatagatttatcaaattttgttaacagaggagaaacaaaatgtgataaatcaacctggcggcagcgcaaaagatg

SEQ ID NO: 69989 - DNA, 103 bp, Artificial Sequence
  Synthetic Polynucleotide
taatacgactcactatagggctgttccaaatgccatagatttatcaaattaacagaggagaaatttgatgaatctatggaacctggcggcagcgcaaaagatg

SEQ ID NO: 69990 - DNA, 103 bp, Artificial Sequence
  Synthetic Polynucleotide
taatacgactcactatagggcattgctgttccaaatgccatagatttatcaacagaggagagataaaatgatggcatttaacctggcggcagcgcaaaagatg

SEQ ID NO: 69991 - DNA, 103 bp, Artificial Sequence
  Synthetic Polynucleotide
taatacgactcactatagggagtaacattgctgttccaaatgccatagataacagaggagaatctatatgatttggaacaacctggcggcagcgcaaaagatg

SEQ ID NO: 69992 - DNA, 103 bp, Artificial Sequence
  Synthetic Polynucleotide
taatacgactcactataggggggtattcggtagaatacaagaatactataaacagaggagatatagtatgcttgtattcaacctggcggcagcgcaaaagatg

SEQ ID NO: 69993 - DNA, 103 bp, Artificial Sequence
  Synthetic Polynucleotide
taatacgactcactatagggcagttagtaacattgctgttccaaatgccaaacagaggagatggcatatggaacagcaaaacctggcggcagcgcaaaagatg

SEQ ID NO: 69994 - DNA, 103 bp, Artificial Sequence
  Synthetic Polynucleotide
taatacgactcactatagggttgaccagttagtaacattgctgttccaaaaacagaggagatttggaatggcaatgttaaacctggcggcagcgcaaaagatg

SEQ ID NO: 69995 - DNA, 103 bp, Artificial Sequence
  Synthetic Polynucleotide
taatacgactcactataggggcctgttgaccagttagtaacattgctgttaacagaggagaaacagcatggttactaacaacctggcggcagcgcaaaagatg

SEQ ID NO: 69996 - DNA, 103 bp, Artificial Sequence
  Synthetic Polynucleotide
taatacgactcactatagggtaatagcctgttgaccagttagtaacattgaacagaggagacaatgtatgtaactggtcaacctggcggcagcgcaaaagatg

SEQ ID NO: 69997 - DNA, 103 bp, Artificial Sequence
  Synthetic Polynucleotide
taatacgactcactatagggttggttaatagcctgttgaccagttagtaaaacagaggagattactaatgggtcaacagaacctggcggcagcgcaaaagatg

SEQ ID NO: 69998 - DNA, 103 bp, Artificial Sequence
  Synthetic Polynucleotide
taatacgactcactatagggtcctgttggttaatagcctgttgaccagttaacagaggagaaactggatgacaggctataacctggcggcagcgcaaaagatg

SEQ ID NO: 69999 - DNA, 103 bp, Artificial Sequence
  Synthetic Polynucleotide
taatacgactcactatagggatctatcctgttggttaatagcctgttgacaacagaggagagtcaacatgctattaaccaacctggcggcagcgcaaaagatg

SEQ ID NO: 70000 - DNA, 103 bp, Artificial Sequence
  Synthetic Polynucleotide
taatacgactcactatagggagttgatctatcctgttggttaatagcctgaacagaggagacaggctatgaaccaacagaacctggcggcagcgcaaaagatg

SEQ ID NO: 70001 - DNA, 103 bp, Artificial Sequence
  Synthetic Polynucleotide
taatacgactcactatagggaacgcagttgatctatcctgttggttaataaacagaggagatattaaatgacaggatagaacctggcggcagcgcaaaagatg

SEQ ID NO: 70002 - DNA, 103 bp, Artificial Sequence
  Synthetic Polynucleotide
taatacgactcactatagggtaatcaacgcagttgatctatcctgttggtaacagaggagaaccaacatgatagatcaaaacctggcggcagcgcaaaagatg

SEQ ID NO: 70003 - DNA, 103 bp, Artificial Sequence
  Synthetic Polynucleotide
taatacgactcactatagggctcttgggtattcggtagaatacaagaataaacagaggagatattctatgattctaccgaacctggcggcagcgcaaaagatg

SEQ ID NO: 70004 - DNA, 103 bp, Artificial Sequence
  Synthetic Polynucleotide
taatacgactcactatagggttttttaatcaacgcagttgatctatcctgaacagaggagacaggatatgtcaactgcgaacctggcggcagcgcaaaagatg

SEQ ID NO: 70005 - DNA, 103 bp, Artificial Sequence
  Synthetic Polynucleotide
taatacgactcactatagggtgatcttttttaatcaacgcagttgatctaaacagaggagatagatcatgtgcgttgataacctggcggcagcgcaaaagatg

SEQ ID NO: 70006 - DNA, 103 bp, Artificial Sequence
  Synthetic Polynucleotide
taatacgactcactatagggtcatttgatcttttttaatcaacgcagttgaacagaggagacaactgatgtgattaaaaaacctggcggcagcgcaaaagatg

SEQ ID NO: 70007 - DNA, 103 bp, Artificial Sequence
  Synthetic Polynucleotide
taatacgactcactatagggcttgctcatttgatcttttttaatcaacgcaacagaggagagcgttgatgaaaaaagataacctggcggcagcgcaaaagatg

SEQ ID NO: 70008 - DNA, 103 bp, Artificial Sequence
  Synthetic Polynucleotide
taatacgactcactatagggtcgtccttgctcatttgatcttttttaatcaacagaggagagattaaatgagatcaaataacctggcggcagcgcaaaagatg

SEQ ID NO: 70009 - DNA, 103 bp, Artificial Sequence
  Synthetic Polynucleotide
taatacgactcactatagggttttttcgtccttgctcatttgatctttttaacagaggagaaaaaagatgaaatgagcaaacctggcggcagcgcaaaagatg

SEQ ID NO: 70010 - DNA, 103 bp, Artificial Sequence
  Synthetic Polynucleotide
taatacgactcactataggggaatattttttcgtccttgctcatttgatcaacagaggagagatcaaatgagcaaggacaacctggcggcagcgcaaaagatg

SEQ ID NO: 70011 - DNA, 103 bp, Artificial Sequence
  Synthetic Polynucleotide
taatacgactcactataggggcttcgaatattttttcgtccttgctcattaacagaggagaaatgagatgggacgaaaaaacctggcggcagcgcaaaagatg

SEQ ID NO: 70012 - DNA, 103 bp, Artificial Sequence
  Synthetic Polynucleotide
taatacgactcactatagggtaactgcttcgaatattttttcgtccttgcaacagaggagagcaaggatgaaaaaatataacctggcggcagcgcaaaagatg

SEQ ID NO: 70013 - DNA, 103 bp, Artificial Sequence
  Synthetic Polynucleotide
taatacgactcactatagggcattgtaactgcttcgaatattttttcgtcaacagaggagagacgaaatgatattcgaaaacctggcggcagcgcaaaagatg

SEQ ID NO: 70014 - DNA, 103 bp, Artificial Sequence
  Synthetic Polynucleotide
taatacgactcactataggggtgtttatgctgtttctcagtgtgtgtttaaacagaggagataaacaatgactgagaaaaacctggcggcagcgcaaaagatg

SEQ ID NO: 70015 - DNA, 103 bp, Artificial Sequence
  Synthetic Polynucleotide
taatacgactcactatagggtgcatctcttgggtattcggtagaatacaaaacagaggagattgtatatgaccgaatacaacctggcggcagcgcaaaagatg

SEQ ID NO: 70016 - DNA, 103 bp, Artificial Sequence
  Synthetic Polynucleotide
taatacgactcactatagggagagtcattgtaactgcttcgaatatttttaacagaggagaaaaaatatgcgaagcagtaacctggcggcagcgcaaaagatg

SEQ ID NO: 70017 - DNA, 103 bp, Artificial Sequence
  Synthetic Polynucleotide
taatacgactcactatagggttgatagagtcattgtaactgcttcgaataaacagaggagatattcgatgcagttacaaaacctggcggcagcgcaaaagatg

SEQ ID NO: 70018 - DNA, 103 bp, Artificial Sequence
  Synthetic Polynucleotide
taatacgactcactatagggtatagttgatagagtcattgtaactgcttcaacagaggagagaagcaatgacaatgactaacctggcggcagcgcaaaagatg

SEQ ID NO: 70019 - DNA, 103 bp, Artificial Sequence
  Synthetic Polynucleotide
taatacgactcactataggggaacctatagttgatagagtcattgtaactaacagaggagaagttacatggactctatcaacctggcggcagcgcaaaagatg

SEQ ID NO: 70020 - DNA, 103 bp, Artificial Sequence
  Synthetic Polynucleotide
taatacgactcactatagggacgttgaacctatagttgatagagtcattgaacagaggagacaatgaatgtatcaactaaacctggcggcagcgcaaaagatg

SEQ ID NO: 70021 - DNA, 103 bp, Artificial Sequence
  Synthetic Polynucleotide
taatacgactcactatagggtgtcaacgttgaacctatagttgatagagtaacagaggagaactctaatgactataggtaacctggcggcagcgcaaaagatg

SEQ ID NO: 70022 - DNA, 103 bp, Artificial Sequence
  Synthetic Polynucleotide
taatacgactcactataggggcagttgtcaacgttgaacctatagttgataacagaggagaatcaacatgaggttcaacaacctggcggcagcgcaaaagatg

SEQ ID NO: 70023 - DNA, 103 bp, Artificial Sequence
  Synthetic Polynucleotide
taatacgactcactatagggtacctgcagttgtcaacgttgaacctatagaacagaggagactatagatgcaacgttgaaacctggcggcagcgcaaaagatg

SEQ ID NO: 70024 - DNA, 103 bp, Artificial Sequence
  Synthetic Polynucleotide
taatacgactcactatagggtatcatacctgcagttgtcaacgttgaaccaacagaggagaggttcaatgttgacaactaacctggcggcagcgcaaaagatg

SEQ ID NO: 70025 - DNA, 103 bp, Artificial Sequence
  Synthetic Polynucleotide
taatacgactcactatagggggagctatcatacctgcagttgtcaacgttaacagaggagaaacgttatgaactgcaggaacctggcggcagcgcaaaagatg

SEQ ID NO: 70026 - DNA, 103 bp, Artificial Sequence
  Synthetic Polynucleotide
taatacgactcactatagggtgtattgcatctcttgggtattcggtagaaaacagaggagattctacatgatacccaagaacctggcggcagcgcaaaagatg

SEQ ID NO: 70027 - DNA, 103 bp, Artificial Sequence
  Synthetic Polynucleotide
taatacgactcactataggggtggtggagctatcatacctgcagttgtcaaacagaggagatgacaaatgcaggtatgaaacctggcggcagcgcaaaagatg

SEQ ID NO: 70028 - DNA, 103 bp, Artificial Sequence
  Synthetic Polynucleotide
taatacgactcactatagggcattagtggtggagctatcatacctgcagtaacagaggagaactgcaatgatgatagctaacctggcggcagcgcaaaagatg

SEQ ID NO: 70029 - DNA, 103 bp, Artificial Sequence
  Synthetic Polynucleotide
taatacgactcactataggggcaatcattagtggtggagctatcatacctaacagaggagaaggtatatgagctccaccaacctggcggcagcgcaaaagatg

SEQ ID NO: 70030 - DNA, 103 bp, Artificial Sequence
  Synthetic Polynucleotide
taatacgactcactatagggttccagcaatcattagtggtggagctatcaaacagaggagatgatagatgcaccactaaaacctggcggcagcgcaaaagatg

SEQ ID NO: 70031 - DNA, 103 bp, Artificial Sequence
  Synthetic Polynucleotide
taatacgactcactatagggacctattccagcaatcattagtggtggagcaacagaggagagctccaatgctaatgattaacctggcggcagcgcaaaagatg

SEQ ID NO: 70032 - DNA, 103 bp, Artificial Sequence
  Synthetic Polynucleotide
taatacgactcactataggggatatacctattccagcaatcattagtggtaacagaggagaaccactatggattgctggaacctggcggcagcgcaaaagatg

SEQ ID NO: 70033 - DNA, 103 bp, Artificial Sequence
  Synthetic Polynucleotide
taatacgactcactatagggtaagcgatatacctattccagcaatcattaaacagaggagataatgaatgctggaatagaacctggcggcagcgcaaaagatg

SEQ ID NO: 70034 - DNA, 103 bp, Artificial Sequence
  Synthetic Polynucleotide
taatacgactcactatagggtgatataagcgatatacctattccagcaataacagaggagaattgctatgataggtataaacctggcggcagcgcaaaagatg

SEQ ID NO: 70035 - DNA, 103 bp, Artificial Sequence
  Synthetic Polynucleotide
taatacgactcactatagggatacctgatataagcgatatacctattccaaacagaggagatggaatatgtatatcgctaacctggcggcagcgcaaaagatg

SEQ ID NO: 70036 - DNA, 103 bp, Artificial Sequence
  Synthetic Polynucleotide
taatacgactcactatagggctattatacctgatataagcgatatacctaaacagaggagataggtaatgcgcttatataacctggcggcagcgcaaaagatg

SEQ ID NO: 70037 - DNA, 103 bp, Artificial Sequence
  Synthetic Polynucleotide
taatacgactcactatagggtcttttgtattgcatctcttgggtattcggaacagaggagaccgaatatgcaagagatgaacctggcggcagcgcaaaagatg

SEQ ID NO: 70038 - DNA, 103 bp, Artificial Sequence
  Synthetic Polynucleotide
taatacgactcactatagggcgtatctattatacctgatataagcgatataacagaggagaatatcgatgatatcaggtaacctggcggcagcgcaaaagatg

SEQ ID NO: 70039 - DNA, 103 bp, Artificial Sequence
  Synthetic Polynucleotide
taatacgactcactatagggtttgccgtatctattatacctgatataagcaacagaggagagcttatatgaggtataataacctggcggcagcgcaaaagatg

SEQ ID NO: 70040 - DNA, 103 bp, Artificial Sequence
  Synthetic Polynucleotide
taatacgactcactatagggtatcttttgccgtatctattatacctgataaacagaggagatatcagatgtaatagataaacctggcggcagcgcaaaagatg

SEQ ID NO: 70041 - DNA, 103 bp, Artificial Sequence
  Synthetic Polynucleotide
taatacgactcactatagggatatatatcttttgccgtatctattataccaacagaggagaggtataatggatacggcaaacctggcggcagcgcaaaagatg

SEQ ID NO: 70042 - DNA, 103 bp, Artificial Sequence
  Synthetic Polynucleotide
taatacgactcactatagggaggtaatatatatcttttgccgtatctattaacagaggagaaatagaatgggcaaaagaaacctggcggcagcgcaaaagatg

SEQ ID NO: 70043 - DNA, 103 bp, Artificial Sequence
  Synthetic Polynucleotide
taatacgactcactatagggaaaataggtaatatatatcttttgccgtataacagaggagaatacggatgaagatatataacctggcggcagcgcaaaagatg

SEQ ID NO: 70044 - DNA, 103 bp, Artificial Sequence
  Synthetic Polynucleotide
taatacgactcactatagggtcctgaaaataggtaatatatatcttttgcaacagaggagagcaaaaatgatatattacaacctggcggcagcgcaaaagatg

SEQ ID NO: 70045 - DNA, 103 bp, Artificial Sequence
  Synthetic Polynucleotide
taatacgactcactatagggtcctgtcctgaaaataggtaatatatatctaacagaggagaagatatatgttacctattaacctggcggcagcgcaaaagatg

SEQ ID NO: 70046 - DNA, 103 bp, Artificial Sequence
  Synthetic Polynucleotide
taatacgactcactataggggcttctcctgtcctgaaaataggtaatataaacagaggagatatattatgtattttcagaacctggcggcagcgcaaaagatg

SEQ ID NO: 70047 - DNA, 103 bp, Artificial Sequence
  Synthetic Polynucleotide
taatacgactcactatagggtactggcttctcctgtcctgaaaataggtaaacagaggagatacctaatgtcaggacagaacctggcggcagcgcaaaagatg

SEQ ID NO: 70048 - DNA, 103 bp, Artificial Sequence
  Synthetic Polynucleotide
taatacgactcactatagggcttactcttttgtattgcatctcttgggtaaacagaggagatacccaatggatgcaataaacctggcggcagcgcaaaagatg

SEQ ID NO: 70049 - DNA, 103 bp, Artificial Sequence
  Synthetic Polynucleotide
taatacgactcactatagggggatctactggcttctcctgtcctgaaaataacagaggagaattttcatgacaggagaaaacctggcggcagcgcaaaagatg

SEQ ID NO: 70050 - DNA, 103 bp, Artificial Sequence
  Synthetic Polynucleotide
taatacgactcactatagggtaactggatctactggcttctcctgtcctgaacagaggagacaggacatgagaagccagaacctggcggcagcgcaaaagatg

SEQ ID NO: 70051 - DNA, 103 bp, Artificial Sequence
  Synthetic Polynucleotide
taatacgactcactatagggcttaataactggatctactggcttctcctgaacagaggagacaggagatgccagtagataacctggcggcagcgcaaaagatg

SEQ ID NO: 70052 - DNA, 103 bp, Artificial Sequence
  Synthetic Polynucleotide
taatacgactcactatagggaaaaacttaataactggatctactggcttcaacagaggagagaagccatgagatccagtaacctggcggcagcgcaaaagatg

SEQ ID NO: 70053 - DNA, 103 bp, Artificial Sequence
  Synthetic Polynucleotide
taatacgactcactatagggtgttaaaaaacttaataactggatctactgaacagaggagacagtagatgcagttattaaacctggcggcagcgcaaaagatg

SEQ ID NO: 70054 - DNA, 103 bp, Artificial Sequence
  Synthetic Polynucleotide
taatacgactcactataggggtatgtgttaaaaaacttaataactggatcaacagaggagagatccaatgattaagtttaacctggcggcagcgcaaaagatg

SEQ ID NO: 70055 - DNA, 103 bp, Artificial Sequence
  Synthetic Polynucleotide
taatacgactcactatagggccagcgtatgtgttaaaaaacttaataactaacagaggagaagttatatggttttttaaaacctggcggcagcgcaaaagatg

SEQ ID NO: 70056 - DNA, 103 bp, Artificial Sequence
  Synthetic Polynucleotide
taatacgactcactatagggctaatccagcgtatgtgttaaaaaacttaaaacagaggagattaagtatgttaacacataacctggcggcagcgcaaaagatg

SEQ ID NO: 70057 - DNA, 103 bp, Artificial Sequence
  Synthetic Polynucleotide
taatacgactcactatagggggatactaatccagcgtatgtgttaaaaaaaacagaggagattttttatgacatacgctaacctggcggcagcgcaaaagatg

SEQ ID NO: 70058 - DNA, 103 bp, Artificial Sequence
  Synthetic Polynucleotide
taatacgactcactatagggctatcggatactaatccagcgtatgtgttaaacagaggagataacacatgcgctggattaacctggcggcagcgcaaaagatg

SEQ ID NO: 70059 - DNA, 103 bp, Artificial Sequence
  Synthetic Polynucleotide
taatacgactcactatagggttagtcttactcttttgtattgcatctcttaacagaggagaaagagaatgaatacaaaaaacctggcggcagcgcaaaagatg

SEQ ID NO: 70060 - DNA, 103 bp, Artificial Sequence
  Synthetic Polynucleotide
taatacgactcactatagggtactactatcggatactaatccagcgtatgaacagaggagacatacgatggattagtataacctggcggcagcgcaaaagatg

SEQ ID NO: 70061 - DNA, 103 bp, Artificial Sequence
  Synthetic Polynucleotide
taatacgactcactatagggcattttactactatcggatactaatccagcaacagaggagagctggaatggtatccgataacctggcggcagcgcaaaagatg

SEQ ID NO: 70062 - DNA, 103 bp, Artificial Sequence
  Synthetic Polynucleotide
taatacgactcactatagggacacccattttactactatcggatactaataacagaggagaattagtatgcgatagtagaacctggcggcagcgcaaaagatg

SEQ ID NO: 70063 - DNA, 103 bp, Artificial Sequence
  Synthetic Polynucleotide
taatacgactcactatagggtccttacacccattttactactatcggataaacagaggagatatccgatggtagtaaaaaacctggcggcagcgcaaaagatg

SEQ ID NO: 70064 - DNA, 103 bp, Artificial Sequence
  Synthetic Polynucleotide
taatacgactcactatagggacatttccttacacccattttactactatcaacagaggagagatagtatgaaaatgggtaacctggcggcagcgcaaaagatg

SEQ ID NO: 70065 - DNA, 103 bp, Artificial Sequence
  Synthetic Polynucleotide
taatacgactcactataggggtcaaacatttccttacacccattttactaaacagaggagatagtaaatggggtgtaagaacctggcggcagcgcaaaagatg

SEQ ID NO: 70066 - DNA, 103 bp, Artificial Sequence
  Synthetic Polynucleotide
taatacgactcactatagggcaggcgtcaaacatttccttacacccatttaacagaggagaaaatggatgtaaggaaataacctggcggcagcgcaaaagatg

SEQ ID NO: 70067 - DNA, 103 bp, Artificial Sequence
  Synthetic Polynucleotide
taatacgactcactatagggttctccaggcgtcaaacatttccttacaccaacagaggagaggtgtaatgaaatgtttgaacctggcggcagcgcaaaagatg

SEQ ID NO: 70068 - DNA, 103 bp, Artificial Sequence
  Synthetic Polynucleotide
taatacgactcactataggggtgtcttctccaggcgtcaaacatttccttaacagaggagaaaggaaatgtttgacgccaacctggcggcagcgcaaaagatg

SEQ ID NO: 70069 - DNA, 103 bp, Artificial Sequence
  Synthetic Polynucleotide
taatacgactcactatagggtaagtgtgtcttctccaggcgtcaaacattaacagaggagaaatgttatgcgcctggagaacctggcggcagcgcaaaagatg

SEQ ID NO: 70070 - DNA, 103 bp, Artificial Sequence
  Synthetic Polynucleotide
taatacgactcactatagggacaaattagtcttactcttttgtattgcataacagaggagaatgcaaatgaaaagagtaaacctggcggcagcgcaaaagatg

SEQ ID NO: 70071 - DNA, 103 bp, Artificial Sequence
  Synthetic Polynucleotide
taatacgactcactataggggtaaataagtgtgtcttctccaggcgtcaaaacagaggagattgacgatgggagaagacaacctggcggcagcgcaaaagatg

SEQ ID NO: 70072 - DNA, 103 bp, Artificial Sequence
  Synthetic Polynucleotide
taatacgactcactataggggcgatgtaaataagtgtgtcttctccaggcaacagaggagagcctggatgagacacactaacctggcggcagcgcaaaagatg

SEQ ID NO: 70073 - DNA, 103 bp, Artificial Sequence
  Synthetic Polynucleotide
taatacgactcactatagggtgtatgcgatgtaaataagtgtgtcttctcaacagaggagagagaagatgcacttatttaacctggcggcagcgcaaaagatg

SEQ ID NO: 70074 - DNA, 103 bp, Artificial Sequence
  Synthetic Polynucleotide
taatacgactcactataggggtttttgtatgcgatgtaaataagtgtgtcaacagaggagagacacaatgatttacatcaacctggcggcagcgcaaaagatg

SEQ ID NO: 70075 - DNA, 103 bp, Artificial Sequence
  Synthetic Polynucleotide
taatacgactcactataggggaatcgtttttgtatgcgatgtaaataagtaacagaggagaacttatatgcatcgcataaacctggcggcagcgcaaaagatg

SEQ ID NO: 70076 - DNA, 103 bp, Artificial Sequence
  Synthetic Polynucleotide
taatacgactcactatagggaactggaatcgtttttgtatgcgatgtaaaaacagaggagatttacaatgcatacaaaaaacctggcggcagcgcaaaagatg

SEQ ID NO: 70077 - DNA, 103 bp, Artificial Sequence
  Synthetic Polynucleotide
taatacgactcactatagggtttaaaactggaatcgtttttgtatgcgataacagaggagaatcgcaatgaaaaacgataacctggcggcagcgcaaaagatg

SEQ ID NO: 70078 - DNA, 103 bp, Artificial Sequence
  Synthetic Polynucleotide
taatacgactcactatagggttttgtttaaaactggaatcgtttttgtataacagaggagaatacaaatgcgattccagaacctggcggcagcgcaaaagatg

SEQ ID NO: 70079 - DNA, 103 bp, Artificial Sequence
  Synthetic Polynucleotide
taatacgactcactatagggccgtattttgtttaaaactggaatcgttttaacagaggagaaaaacgatgccagttttaaacctggcggcagcgcaaaagatg

SEQ ID NO: 70080 - DNA, 103 bp, Artificial Sequence
  Synthetic Polynucleotide
taatacgactcactatagggtgcctccgtattttgtttaaaactggaatcaacagaggagagattccatgtttaaacaaaacctggcggcagcgcaaaagatg

SEQ ID NO: 70081 - DNA, 103 bp, Artificial Sequence
  Synthetic Polynucleotide
taatacgactcactatagggggtttacaaattagtcttactcttttgtataacagaggagaatacaaatgagtaagactaacctggcggcagcgcaaaagatg

SEQ ID NO: 70082 - DNA, 103 bp, Artificial Sequence
  Synthetic Polynucleotide
taatacgactcactataggggccattgcctccgtattttgtttaaaactgaacagaggagacagtttatgacaaaatacaacctggcggcagcgcaaaagatg

SEQ ID NO: 70083 - DNA, 103 bp, Artificial Sequence
  Synthetic Polynucleotide
taatacgactcactatagggataaagccattgcctccgtattttgtttaaaacagaggagattaaacatgatacggaggaacctggcggcagcgcaaaagatg

SEQ ID NO: 70084 - DNA, 103 bp, Artificial Sequence
  Synthetic Polynucleotide
taatacgactcactataggggaaatataaagccattgcctccgtattttgaacagaggagacaaaatatggaggcaatgaacctggcggcagcgcaaaagatg

SEQ ID NO: 70085 - DNA, 103 bp, Artificial Sequence
  Synthetic Polynucleotide
taatacgactcactatagggtctaagaaatataaagccattgcctccgtaaacagaggagatacggaatgaatggctttaacctggcggcagcgcaaaagatg

SEQ ID NO: 70086 - DNA, 103 bp, Artificial Sequence
  Synthetic Polynucleotide
taatacgactcactatagggtaacatctaagaaatataaagccattgcctaacagaggagaaggcaaatgctttatattaacctggcggcagcgcaaaagatg

SEQ ID NO: 70087 - DNA, 103 bp, Artificial Sequence
  Synthetic Polynucleotide
taatacgactcactataggggttgataacatctaagaaatataaagccataacagaggagaatggctatgtatttcttaaacctggcggcagcgcaaaagatg

SEQ ID NO: 70088 - DNA, 103 bp, Artificial Sequence
  Synthetic Polynucleotide
taatacgactcactatagggtctgagttgataacatctaagaaatataaaaacagaggagatttataatgcttagatgtaacctggcggcagcgcaaaagatg

SEQ ID NO: 70089 - DNA, 103 bp, Artificial Sequence
  Synthetic Polynucleotide
taatacgactcactatagggggatctctgagttgataacatctaagaaataacagaggagaatttctatgatgttatcaaacctggcggcagcgcaaaagatg

SEQ ID NO: 70090 - DNA, 103 bp, Artificial Sequence
  Synthetic Polynucleotide
taatacgactcactatagggatataggatctctgagttgataacatctaaaacagaggagattagatatgatcaactcaaacctggcggcagcgcaaaagatg

SEQ ID NO: 70091 - DNA, 103 bp, Artificial Sequence
  Synthetic Polynucleotide
taatacgactcactatagggtttagatataggatctctgagttgataacaaacagaggagatgttatatgctcagagataacctggcggcagcgcaaaagatg

SEQ ID NO: 70092 - DNA, 103 bp, Artificial Sequence
  Synthetic Polynucleotide
taatacgactcactatagggaagatggtttacaaattagtcttactctttaacagaggagaaaagagatggactaatttaacctggcggcagcgcaaaagatg

SEQ ID NO: 70093 - DNA, 103 bp, Artificial Sequence
  Synthetic Polynucleotide
taatacgactcactatagggatgtgtttagatataggatctctgagttgaaacagaggagatcaactatgagatcctataacctggcggcagcgcaaaagatg

SEQ ID NO: 70094 - DNA, 103 bp, Artificial Sequence
  Synthetic Polynucleotide
taatacgactcactatagggatttgatgtgtttagatataggatctctgaaacagaggagatcagagatgctatatctaaacctggcggcagcgcaaaagatg

SEQ ID NO: 70095 - DNA, 103 bp, Artificial Sequence
  Synthetic Polynucleotide
taatacgactcactatagggactaaatttgatgtgtttagatataggatcaacagaggagagatcctatgtctaaacacaacctggcggcagcgcaaaagatg

SEQ ID NO: 70096 - DNA, 103 bp, Artificial Sequence
  Synthetic Polynucleotide
taatacgactcactatagggctaaaactaaatttgatgtgtttagatataaacagaggagatatatcatgacacatcaaaacctggcggcagcgcaaaagatg

SEQ ID NO: 70097 - DNA, 103 bp, Artificial Sequence
  Synthetic Polynucleotide
taatacgactcactatagggatactctaaaactaaatttgatgtgtttagaacagaggagactaaacatgtcaaatttaaacctggcggcagcgcaaaagatg

SEQ ID NO: 70098 - DNA, 103 bp, Artificial Sequence
  Synthetic Polynucleotide
taatacgactcactatagggagatgatactctaaaactaaatttgatgtgaacagaggagacacatcatgtttagttttaacctggcggcagcgcaaaagatg

SEQ ID NO: 70099 - DNA, 103 bp, Artificial Sequence
  Synthetic Polynucleotide
taatacgactcactatagggcctttagatgatactctaaaactaaatttgaacagaggagacaaattatgttttagagtaacctggcggcagcgcaaaagatg

SEQ ID NO: 70100 - DNA, 103 bp, Artificial Sequence
  Synthetic Polynucleotide
taatacgactcactatagggagccacctttagatgatactctaaaactaaaacagaggagattagttatggagtatcataacctggcggcagcgcaaaagatg

SEQ ID NO: 70101 - DNA, 103 bp, Artificial Sequence
  Synthetic Polynucleotide
taatacgactcactatagggggacaagccacctttagatgatactctaaaaacagaggagatttagaatgtcatctaaaaacctggcggcagcgcaaaagatg

SEQ ID NO: 70102 - DNA, 103 bp, Artificial Sequence
  Synthetic Polynucleotide
taatacgactcactatagggctatgggacaagccacctttagatgatactaacagaggagaagtatcatgtaaaggtggaacctggcggcagcgcaaaagatg

SEQ ID NO: 70103 - DNA, 103 bp, Artificial Sequence
  Synthetic Polynucleotide
taatacgactcactatagggtaagtaagatggtttacaaattagtcttacaacagaggagagtaagaatgatttgtaaaaacctggcggcagcgcaaaagatg

SEQ ID NO: 70104 - DNA, 103 bp, Artificial Sequence
  Synthetic Polynucleotide
taatacgactcactatagggtgttcctatgggacaagccacctttagatgaacagaggagacatctaatggtggcttgtaacctggcggcagcgcaaaagatg

SEQ ID NO: 70105 - DNA, 103 bp, Artificial Sequence
  Synthetic Polynucleotide
taatacgactcactatagggcttaatgttcctatgggacaagccacctttaacagaggagaaaaggtatgttgtcccataacctggcggcagcgcaaaagatg

SEQ ID NO: 70106 - DNA, 103 bp, Artificial Sequence
  Synthetic Polynucleotide
taatacgactcactatagggcagatcttaatgttcctatgggacaagccaaacagaggagatggcttatgccataggaaaacctggcggcagcgcaaaagatg

SEQ ID NO: 70107 - DNA, 103 bp, Artificial Sequence
  Synthetic Polynucleotide
taatacgactcactatagggatctacagatcttaatgttcctatgggacaaacagaggagatgtcccatgggaacattaaacctggcggcagcgcaaaagatg

SEQ ID NO: 70108 - DNA, 103 bp, Artificial Sequence
  Synthetic Polynucleotide
taatacgactcactatagggtccacatctacagatcttaatgttcctatgaacagaggagacataggatgattaagatcaacctggcggcagcgcaaaagatg

SEQ ID NO: 70109 - DNA, 103 bp, Artificial Sequence
  Synthetic Polynucleotide
taatacgactcactatagggttatgtccacatctacagatcttaatgttcaacagaggagagaacatatggatctgtagaacctggcggcagcgcaaaagatg

SEQ ID NO: 70110 - DNA, 103 bp, Artificial Sequence
  Synthetic Polynucleotide
taatacgactcactatagggcgcagttatgtccacatctacagatcttaaaacagaggagattaagaatggtagatgtgaacctggcggcagcgcaaaagatg

SEQ ID NO: 70111 - DNA, 103 bp, Artificial Sequence
  Synthetic Polynucleotide
taatacgactcactataggggtatacgcagttatgtccacatctacagataacagaggagaatctgtatgtgtggacataacctggcggcagcgcaaaagatg

SEQ ID NO: 70112 - DNA, 103 bp, Artificial Sequence
  Synthetic Polynucleotide
taatacgactcactatagggatattgtatacgcagttatgtccacatctaaacagaggagatagatgatgacataactgaacctggcggcagcgcaaaagatg

SEQ ID NO: 70113 - DNA, 103 bp, Artificial Sequence
  Synthetic Polynucleotide
taatacgactcactatagggatataatattgtatacgcagttatgtccacaacagaggagagtggacatgactgcgtataacctggcggcagcgcaaaagatg

SEQ ID NO: 70114 - DNA, 103 bp, Artificial Sequence
  Synthetic Polynucleotide
taatacgactcactatagggtattttaagtaagatggtttacaaattagtaacagaggagaactaatatgtaaaccatcaacctggcggcagcgcaaaagatg

SEQ ID NO: 70115 - DNA, 103 bp, Artificial Sequence
  Synthetic Polynucleotide
taatacgactcactataggggtatcatataatattgtatacgcagttatgaacagaggagacataacatggtatacaataacctggcggcagcgcaaaagatg

SEQ ID NO: 70116 - DNA, 103 bp, Artificial Sequence
  Synthetic Polynucleotide
taatacgactcactatagggccgctgtatcatataatattgtatacgcagaacagaggagactgcgtatgcaatattataacctggcggcagcgcaaaagatg

SEQ ID NO: 70117 - DNA, 103 bp, Artificial Sequence
  Synthetic Polynucleotide
taatacgactcactatagggattatccgctgtatcatataatattgtataaacagaggagatatacaatgttatatgataacctggcggcagcgcaaaagatg

SEQ ID NO: 70118 - DNA, 103 bp, Artificial Sequence
  Synthetic Polynucleotide
taatacgactcactatagggttaatattatccgctgtatcatataatattaacagaggagaaatattatgtgatacagcaacctggcggcagcgcaaaagatg

SEQ ID NO: 70119 - DNA, 103 bp, Artificial Sequence
  Synthetic Polynucleotide
taatacgactcactatagggattttttaatattatccgctgtatcatataaacagaggagatatatgatgcagcggataaacctggcggcagcgcaaaagatg

SEQ ID NO: 70120 - DNA, 103 bp, Artificial Sequence
  Synthetic Polynucleotide
taatacgactcactatagggcttgtattttttaatattatccgctgtatcaacagaggagagatacaatggataatattaacctggcggcagcgcaaaagatg

SEQ ID NO: 70121 - DNA, 103 bp, Artificial Sequence
  Synthetic Polynucleotide
taatacgactcactatagggataaacttgtattttttaatattatccgctaacagaggagaagcggaatgtattaaaaaaacctggcggcagcgcaaaagatg

SEQ ID NO: 70122 - DNA, 103 bp, Artificial Sequence
  Synthetic Polynucleotide
taatacgactcactatagggttctgataaacttgtattttttaatattataacagaggagaataataatgaaaaatacaaacctggcggcagcgcaaaagatg

SEQ ID NO: 70123 - DNA, 103 bp, Artificial Sequence
  Synthetic Polynucleotide
taatacgactcactatagggtgccattctgataaacttgtattttttaataacagaggagaattaaaatgtacaagtttaacctggcggcagcgcaaaagatg

SEQ ID NO: 70124 - DNA, 103 bp, Artificial Sequence
  Synthetic Polynucleotide
taatacgactcactatagggagcgttgccattctgataaacttgtattttaacagaggagaaaaataatggtttatcagaacctggcggcagcgcaaaagatg

SEQ ID NO: 70125 - DNA, 103 bp, Artificial Sequence
  Synthetic Polynucleotide
taatacgactcactatagggattttgtgtttatgctgtttctcagtgtgtaacagaggagaacacacatggaaacagcaaacctggcggcagcgcaaaagatg

SEQ ID NO: 70126 - DNA, 103 bp, Artificial Sequence
  Synthetic Polynucleotide
taatacgactcactatagggttacatattttaagtaagatggtttacaaaaacagaggagatttgtaatgcatcttactaacctggcggcagcgcaaaagatg

SEQ ID NO: 70127 - DNA, 103 bp, Artificial Sequence
  Synthetic Polynucleotide
taatacgactcactatagggatagtagcgttgccattctgataaacttgtaacagaggagaacaagtatgtcagaatggaacctggcggcagcgcaaaagatg

SEQ ID NO: 70128 - DNA, 103 bp, Artificial Sequence
  Synthetic Polynucleotide
taatacgactcactatagggtttggatagtagcgttgccattctgataaaaacagaggagatttatcatgatggcaacgaacctggcggcagcgcaaaagatg

SEQ ID NO: 70129 - DNA, 103 bp, Artificial Sequence
  Synthetic Polynucleotide
taatacgactcactatagggggatgtttggatagtagcgttgccattctgaacagaggagacagaatatgaacgctactaacctggcggcagcgcaaaagatg

SEQ ID NO: 70130 - DNA, 103 bp, Artificial Sequence
  Synthetic Polynucleotide
taatacgactcactatagggtaactggatgtttggatagtagcgttgccaaacagaggagatggcaaatgtactatccaaacctggcggcagcgcaaaagatg

SEQ ID NO: 70131 - DNA, 103 bp, Artificial Sequence
  Synthetic Polynucleotide
taatacgactcactatagggtctaataactggatgtttggatagtagcgtaacagaggagaacgctaatgtccaaacataacctggcggcagcgcaaaagatg

SEQ ID NO: 70132 - DNA, 103 bp, Artificial Sequence
  Synthetic Polynucleotide
taatacgactcactataggggtcaatctaataactggatgtttggatagtaacagaggagaactatcatgacatccagtaacctggcggcagcgcaaaagatg

SEQ ID NO: 70133 - DNA, 103 bp, Artificial Sequence
  Synthetic Polynucleotide
taatacgactcactatagggcacatgtcaatctaataactggatgtttggaacagaggagaccaaacatgcagttattaaacctggcggcagcgcaaaagatg

SEQ ID NO: 70134 - DNA, 103 bp, Artificial Sequence
  Synthetic Polynucleotide
taatacgactcactatagggtaaaccacatgtcaatctaataactggatgaacagaggagacatccaatgattagattgaacctggcggcagcgcaaaagatg

SEQ ID NO: 70135 - DNA, 103 bp, Artificial Sequence
  Synthetic Polynucleotide
taatacgactcactataggggctgctaaaccacatgtcaatctaataactaacagaggagaagttatatgattgacatgaacctggcggcagcgcaaaagatg

SEQ ID NO: 70136 - DNA, 103 bp, Artificial Sequence
  Synthetic Polynucleotide
taatacgactcactatagggatgttgctgctaaaccacatgtcaatctaaaacagaggagattagatatgcatgtggttaacctggcggcagcgcaaaagatg

SEQ ID NO: 70137 - DNA, 103 bp, Artificial Sequence
  Synthetic Polynucleotide
taatacgactcactatagggtattgttacatattttaagtaagatggtttaacagaggagaaaaccaatgtacttaaaaaacctggcggcagcgcaaaagatg

SEQ ID NO: 70138 - DNA, 103 bp, Artificial Sequence
  Synthetic Polynucleotide
taatacgactcactatagggtaccaatgttgctgctaaaccacatgtcaaaacagaggagattgacaatgggtttagcaaacctggcggcagcgcaaaagatg

SEQ ID NO: 70139 - DNA, 103 bp, Artificial Sequence
  Synthetic Polynucleotide
taatacgactcactatagggttaattaccaatgttgctgctaaaccacataacagaggagaatgtggatgagcagcaacaacctggcggcagcgcaaaagatg

SEQ ID NO: 70140 - DNA, 103 bp, Artificial Sequence
  Synthetic Polynucleotide
taatacgactcactatagggacggtttaattaccaatgttgctgctaaacaacagaggagagtttagatgcaacattggaacctggcggcagcgcaaaagatg

SEQ ID NO: 70141 - DNA, 103 bp, Artificial Sequence
  Synthetic Polynucleotide
taatacgactcactatagggctcgtacggtttaattaccaatgttgctgcaacagaggagagcagcaatgttggtaattaacctggcggcagcgcaaaagatg

SEQ ID NO: 70142 - DNA, 103 bp, Artificial Sequence
  Synthetic Polynucleotide
taatacgactcactatagggggtacctcgtacggtttaattaccaatgttaacagaggagaaacattatgaattaaaccaacctggcggcagcgcaaaagatg

SEQ ID NO: 70143 - DNA, 103 bp, Artificial Sequence
  Synthetic Polynucleotide
taatacgactcactatagggtgatgggtacctcgtacggtttaattaccaaacagaggagatggtaaatgaaccgtacgaacctggcggcagcgcaaaagatg

SEQ ID NO: 70144 - DNA, 103 bp, Artificial Sequence
  Synthetic Polynucleotide
taatacgactcactatagggatcactgatgggtacctcgtacggtttaataacagaggagaattaaaatgtacgaggtaaacctggcggcagcgcaaaagatg

SEQ ID NO: 70145 - DNA, 103 bp, Artificial Sequence
  Synthetic Polynucleotide
taatacgactcactatagggtgcatatcactgatgggtacctcgtacggtaacagaggagaaccgtaatgggtacccataacctggcggcagcgcaaaagatg

SEQ ID NO: 70146 - DNA, 103 bp, Artificial Sequence
  Synthetic Polynucleotide
taatacgactcactataggggtagttgcatatcactgatgggtacctcgtaacagaggagaacgaggatgccatcagtgaacctggcggcagcgcaaaagatg

SEQ ID NO: 70147 - DNA, 103 bp, Artificial Sequence
  Synthetic Polynucleotide
taatacgactcactatagggttttagtagttgcatatcactgatgggtacaacagaggagagtacccatgagtgatatgaacctggcggcagcgcaaaagatg

SEQ ID NO: 70148 - DNA, 103 bp, Artificial Sequence
  Synthetic Polynucleotide
taatacgactcactatagggcgtactattgttacatattttaagtaagataacagaggagaatcttaatgaaaatatgtaacctggcggcagcgcaaaagatg

SEQ ID NO: 70149 - DNA, 103 bp, Artificial Sequence
  Synthetic Polynucleotide
taatacgactcactataggggccatttttagtagttgcatatcactgatgaacagaggagacatcagatgtatgcaactaacctggcggcagcgcaaaagatg

SEQ ID NO: 70150 - DNA, 103 bp, Artificial Sequence
  Synthetic Polynucleotide
taatacgactcactataggggcgttgccatttttagtagttgcatatcacaacagaggagagtgataatgaactactaaaacctggcggcagcgcaaaagatg

SEQ ID NO: 70151 - DNA, 103 bp, Artificial Sequence
  Synthetic Polynucleotide
taatacgactcactatagggaccatgcgttgccatttttagtagttgcataacagaggagaatgcaaatgctaaaaatgaacctggcggcagcgcaaaagatg

SEQ ID NO: 70152 - DNA, 103 bp, Artificial Sequence
  Synthetic Polynucleotide
taatacgactcactatagggggttcaccatgcgttgccatttttagtagtaacagaggagaactactatgaatggcaacaacctggcggcagcgcaaaagatg

SEQ ID NO: 70153 - DNA, 103 bp, Artificial Sequence
  Synthetic Polynucleotide
taatacgactcactatagggattctggttcaccatgcgttgccatttttaaacagaggagataaaaaatgcaacgcatgaacctggcggcagcgcaaaagatg

SEQ ID NO: 70154 - DNA, 103 bp, Artificial Sequence
  Synthetic Polynucleotide
taatacgactcactatagggagtggattctggttcaccatgcgttgccataacagaggagaatggcaatgcatggtgaaaacctggcggcagcgcaaaagatg

SEQ ID NO: 70155 - DNA, 103 bp, Artificial Sequence
  Synthetic Polynucleotide
taatacgactcactataggggatttagtggattctggttcaccatgcgttaacagaggagaaacgcaatgtgaaccagaaacctggcggcagcgcaaaagatg

SEQ ID NO: 70156 - DNA, 103 bp, Artificial Sequence
  Synthetic Polynucleotide
taatacgactcactataggggtattgatttagtggattctggttcaccataacagaggagaatggtgatgcagaatccaaacctggcggcagcgcaaaagatg

SEQ ID NO: 70157 - DNA, 103 bp, Artificial Sequence
  Synthetic Polynucleotide
taatacgactcactatagggagatggtattgatttagtggattctggttcaacagaggagagaaccaatgtccactaaaaacctggcggcagcgcaaaagatg

SEQ ID NO: 70158 - DNA, 103 bp, Artificial Sequence
  Synthetic Polynucleotide
taatacgactcactatagggacatcagatggtattgatttagtggattctaacagaggagaagaatcatgtaaatcaataacctggcggcagcgcaaaagatg

SEQ ID NO: 70159 - DNA, 103 bp, Artificial Sequence
  Synthetic Polynucleotide
taatacgactcactatagggttcatcgtactattgttacatattttaagtaacagaggagaacttaaatgatgtaacaaaacctggcggcagcgcaaaagatg

SEQ ID NO: 70160 - DNA, 103 bp, Artificial Sequence
  Synthetic Polynucleotide
taatacgactcactatagggcacagacatcagatggtattgatttagtggaacagaggagaccactaatgcaataccataacctggcggcagcgcaaaagatg

SEQ ID NO: 70161 - DNA, 103 bp, Artificial Sequence
  Synthetic Polynucleotide
taatacgactcactatagggcctatcacagacatcagatggtattgatttaacagaggagaaaatcaatgccatctgataacctggcggcagcgcaaaagatg

SEQ ID NO: 70162 - DNA, 103 bp, Artificial Sequence
  Synthetic Polynucleotide
taatacgactcactatagggggatacctatcacagacatcagatggtattaacagaggagaaataccatgtgatgtctgaacctggcggcagcgcaaaagatg

SEQ ID NO: 70163 - DNA, 103 bp, Artificial Sequence
  Synthetic Polynucleotide
taatacgactcactatagggttagaggatacctatcacagacatcagatgaacagaggagacatctgatgtctgtgataaacctggcggcagcgcaaaagatg

SEQ ID NO: 70164 - DNA, 103 bp, Artificial Sequence
  Synthetic Polynucleotide
taatacgactcactatagggtttctttagaggatacctatcacagacatcaacagaggagagatgtcatggataggtataacctggcggcagcgcaaaagatg

SEQ ID NO: 70165 - DNA, 103 bp, Artificial Sequence
  Synthetic Polynucleotide
taatacgactcactatagggtagaatttctttagaggatacctatcacagaacagaggagactgtgaatggtatcctctaacctggcggcagcgcaaaagatg

SEQ ID NO: 70166 - DNA, 103 bp, Artificial Sequence
  Synthetic Polynucleotide
taatacgactcactatagggaaagatagaatttctttagaggatacctataacagaggagaataggtatgctctaaagaaacctggcggcagcgcaaaagatg

SEQ ID NO: 70167 - DNA, 103 bp, Artificial Sequence
  Synthetic Polynucleotide
taatacgactcactatagggagccaaaagatagaatttctttagaggataaacagaggagatatcctatgaagaaattcaacctggcggcagcgcaaaagatg

SEQ ID NO: 70168 - DNA, 103 bp, Artificial Sequence
  Synthetic Polynucleotide
taatacgactcactatagggccaccagccaaaagatagaatttctttagaaacagaggagatctaaaatgattctatctaacctggcggcagcgcaaaagatg

SEQ ID NO: 70169 - DNA, 103 bp, Artificial Sequence
  Synthetic Polynucleotide
taatacgactcactataggggacaaccaccagccaaaagatagaatttctaacagaggagaagaaatatgatcttttggaacctggcggcagcgcaaaagatg

SEQ ID NO: 70170 - DNA, 103 bp, Artificial Sequence
  Synthetic Polynucleotide
taatacgactcactatagggactcattcatcgtactattgttacatatttaacagaggagaaaatatatgacaatagtaaacctggcggcagcgcaaaagatg

SEQ ID NO: 70171 - DNA, 103 bp, Artificial Sequence
  Synthetic Polynucleotide
taatacgactcactatagggatatggacaaccaccagccaaaagatagaaaacagaggagattctatatgttggctggtaacctggcggcagcgcaaaagatg

SEQ ID NO: 70172 - DNA, 103 bp, Artificial Sequence
  Synthetic Polynucleotide
taatacgactcactataggggtatcatatggacaaccaccagccaaaagaaacagaggagatcttttatgtggtggttgaacctggcggcagcgcaaaagatg

SEQ ID NO: 70173 - DNA, 103 bp, Artificial Sequence
  Synthetic Polynucleotide
taatacgactcactataggggagatgtatcatatggacaaccaccagccaaacagaggagatggctgatggttgtccataacctggcggcagcgcaaaagatg

SEQ ID NO: 70174 - DNA, 103 bp, Artificial Sequence
  Synthetic Polynucleotide
taatacgactcactatagggagtttgagatgtatcatatggacaaccaccaacagaggagaggtggtatgccatatgataacctggcggcagcgcaaaagatg

SEQ ID NO: 70175 - DNA, 103 bp, Artificial Sequence
  Synthetic Polynucleotide
taatacgactcactatagggataaaagtttgagatgtatcatatggacaaaacagaggagattgtccatgtgatacatcaacctggcggcagcgcaaaagatg

SEQ ID NO: 70176 - DNA, 103 bp, Artificial Sequence
  Synthetic Polynucleotide
taatacgactcactataggggtacaataaaagtttgagatgtatcatatgaacagaggagacatatgatgcatctcaaaaacctggcggcagcgcaaaagatg

SEQ ID NO: 70177 - DNA, 103 bp, Artificial Sequence
  Synthetic Polynucleotide
taatacgactcactatagggagtatgtacaataaaagtttgagatgtatcaacagaggagagatacaatgcaaacttttaacctggcggcagcgcaaaagatg

SEQ ID NO: 70178 - DNA, 103 bp, Artificial Sequence
  Synthetic Polynucleotide
taatacgactcactatagggcaagtagtatgtacaataaaagtttgagataacagaggagaatctcaatgttttattgtaacctggcggcagcgcaaaagatg

SEQ ID NO: 70179 - DNA, 103 bp, Artificial Sequence
  Synthetic Polynucleotide
taatacgactcactatagggtactgcaagtagtatgtacaataaaagtttaacagaggagaaaacttatgttgtacataaacctggcggcagcgcaaaagatg

SEQ ID NO: 70180 - DNA, 103 bp, Artificial Sequence
  Synthetic Polynucleotide
taatacgactcactatagggtaaaatactgcaagtagtatgtacaataaaaacagaggagatttattatgcatactactaacctggcggcagcgcaaaagatg

SEQ ID NO: 70181 - DNA, 103 bp, Artificial Sequence
  Synthetic Polynucleotide
taatacgactcactatagggttattactcattcatcgtactattgttacaaacagaggagatgtaacatgagtacgatgaacctggcggcagcgcaaaagatg

SEQ ID NO: 70182 - DNA, 103 bp, Artificial Sequence
  Synthetic Polynucleotide
taatacgactcactatagggcttagtaaaatactgcaagtagtatgtacaaacagaggagatgtacaatgtacttgcagaacctggcggcagcgcaaaagatg

SEQ ID NO: 70183 - DNA, 103 bp, Artificial Sequence
  Synthetic Polynucleotide
taatacgactcactatagggctgttcttagtaaaatactgcaagtagtataacagaggagaatactaatggcagtatttaacctggcggcagcgcaaaagatg

SEQ ID NO: 70184 - DNA, 103 bp, Artificial Sequence
  Synthetic Polynucleotide
taatacgactcactatagggtgtagctgttcttagtaaaatactgcaagtaacagaggagaacttgcatgattttactaaacctggcggcagcgcaaaagatg

SEQ ID NO: 70185 - DNA, 103 bp, Artificial Sequence
  Synthetic Polynucleotide
taatacgactcactatagggtcccatgtagctgttcttagtaaaatactgaacagaggagacagtatatgactaagaacaacctggcggcagcgcaaaagatg

SEQ ID NO: 70186 - DNA, 103 bp, Artificial Sequence
  Synthetic Polynucleotide
taatacgactcactatagggactgatcccatgtagctgttcttagtaaaaaacagaggagattttacatggaacagctaaacctggcggcagcgcaaaagatg

SEQ ID NO: 70187 - DNA, 103 bp, Artificial Sequence
  Synthetic Polynucleotide
taatacgactcactatagggtctaaactgatcccatgtagctgttcttagaacagaggagactaagaatggctacatggaacctggcggcagcgcaaaagatg

SEQ ID NO: 70188 - DNA, 103 bp, Artificial Sequence
  Synthetic Polynucleotide
taatacgactcactatagggctgtttctaaactgatcccatgtagctgttaacagaggagaaacagcatgatgggatcaaacctggcggcagcgcaaaagatg

SEQ ID NO: 70189 - DNA, 103 bp, Artificial Sequence
  Synthetic Polynucleotide
taatacgactcactatagggcccatctgtttctaaactgatcccatgtagaacagaggagactacatatgatcagtttaaacctggcggcagcgcaaaagatg

SEQ ID NO: 70190 - DNA, 103 bp, Artificial Sequence
  Synthetic Polynucleotide
taatacgactcactatagggtaacacccatctgtttctaaactgatcccaaacagaggagatgggatatgtttagaaacaacctggcggcagcgcaaaagatg

SEQ ID NO: 70191 - DNA, 103 bp, Artificial Sequence
  Synthetic Polynucleotide
taatacgactcactatagggttttgtaacacccatctgtttctaaactgaaacagaggagatcagttatgaaacagatgaacctggcggcagcgcaaaagatg

SEQ ID NO: 70192 - DNA, 103 bp, Artificial Sequence
  Synthetic Polynucleotide
taatacgactcactatagggatttcttattactcattcatcgtactattgaacagaggagacaatagatggatgaatgaaacctggcggcagcgcaaaagatg

SEQ ID NO: 70193 - DNA, 103 bp, Artificial Sequence
  Synthetic Polynucleotide
taatacgactcactatagggatggattttgtaacacccatctgtttctaaaacagaggagattagaaatggatgggtgtaacctggcggcagcgcaaaagatg

SEQ ID NO: 70194 - DNA, 103 bp, Artificial Sequence
  Synthetic Polynucleotide
taatacgactcactatagggcctaaatggattttgtaacacccatctgttaacagaggagaaacagaatggtgttacaaaacctggcggcagcgcaaaagatg

SEQ ID NO: 70195 - DNA, 103 bp, Artificial Sequence
  Synthetic Polynucleotide
taatacgactcactatagggtcttgcctaaatggattttgtaacacccataacagaggagaatgggtatgacaaaatccaacctggcggcagcgcaaaagatg

SEQ ID NO: 70196 - DNA, 103 bp, Artificial Sequence
  Synthetic Polynucleotide
taatacgactcactatagggtcccttcttgcctaaatggattttgtaacaaacagaggagatgttacatgatccatttaaacctggcggcagcgcaaaagatg

SEQ ID NO: 70197 - DNA, 103 bp, Artificial Sequence
  Synthetic Polynucleotide
taatacgactcactatagggatatgtcccttcttgcctaaatggattttgaacagaggagacaaaatatgtttaggcaaaacctggcggcagcgcaaaagatg

SEQ ID NO: 70198 - DNA, 103 bp, Artificial Sequence
  Synthetic Polynucleotide
taatacgactcactatagggtgcttatatgtcccttcttgcctaaatggaaacagaggagatccattatggcaagaaggaacctggcggcagcgcaaaagatg

SEQ ID NO: 70199 - DNA, 103 bp, Artificial Sequence
  Synthetic Polynucleotide
taatacgactcactatagggacagttgcttatatgtcccttcttgcctaaaacagaggagattaggcatgaagggacataacctggcggcagcgcaaaagatg

SEQ ID NO: 70200 - DNA, 103 bp, Artificial Sequence
  Synthetic Polynucleotide
taatacgactcactatagggggtaaacagttgcttatatgtcccttcttgaacagaggagacaagaaatgacatataagaacctggcggcagcgcaaaagatg

SEQ ID NO: 70201 - DNA, 103 bp, Artificial Sequence
  Synthetic Polynucleotide
taatacgactcactatagggctaaaggtaaacagttgcttatatgtccctaacagaggagaagggacatgtaagcaactaacctggcggcagcgcaaaagatg

SEQ ID NO: 70202 - DNA, 103 bp, Artificial Sequence
  Synthetic Polynucleotide
taatacgactcactatagggatttgctaaaggtaaacagttgcttatatgaacagaggagacatataatgaactgtttaaacctggcggcagcgcaaaagatg

SEQ ID NO: 70203 - DNA, 103 bp, Artificial Sequence
  Synthetic Polynucleotide
taatacgactcactatagggttcatatttcttattactcattcatcgtacaacagaggagagtacgaatgatgagtaataacctggcggcagcgcaaaagatg

SEQ ID NO: 70204 - DNA, 103 bp, Artificial Sequence
  Synthetic Polynucleotide
taatacgactcactatagggatcgtatttgctaaaggtaaacagttgcttaacagaggagaaagcaaatgtttacctttaacctggcggcagcgcaaaagatg

SEQ ID NO: 70205 - DNA, 103 bp, Artificial Sequence
  Synthetic Polynucleotide
taatacgactcactatagggttaaaatcgtatttgctaaaggtaaacagtaacagaggagaactgttatgctttagcaaaacctggcggcagcgcaaaagatg

SEQ ID NO: 70206 - DNA, 103 bp, Artificial Sequence
  Synthetic Polynucleotide
taatacgactcactatagggtgtcgttaaaatcgtatttgctaaaggtaaaacagaggagattacctatggcaaatacgaacctggcggcagcgcaaaagatg

SEQ ID NO: 70207 - DNA, 103 bp, Artificial Sequence
  Synthetic Polynucleotide
taatacgactcactatagggtatggtgtcgttaaaatcgtatttgctaaaaacagaggagatttagcatgtacgattttaacctggcggcagcgcaaaagatg

SEQ ID NO: 70208 - DNA, 103 bp, Artificial Sequence
  Synthetic Polynucleotide
taatacgactcactatagggtctattatggtgtcgttaaaatcgtatttgaacagaggagacaaataatgttttaacgaaacctggcggcagcgcaaaagatg

SEQ ID NO: 70209 - DNA, 103 bp, Artificial Sequence
  Synthetic Polynucleotide
taatacgactcactatagggtaggatctattatggtgtcgttaaaatcgtaacagaggagaacgattatgacgacaccaaacctggcggcagcgcaaaagatg

SEQ ID NO: 70210 - DNA, 103 bp, Artificial Sequence
  Synthetic Polynucleotide
taatacgactcactatagggaccattaggatctattatggtgtcgttaaaaacagaggagatttaacatgaccataataaacctggcggcagcgcaaaagatg

SEQ ID NO: 70211 - DNA, 103 bp, Artificial Sequence
  Synthetic Polynucleotide
taatacgactcactataggggccacaccattaggatctattatggtgtcgaacagaggagacgacacatgaatagatccaacctggcggcagcgcaaaagatg

SEQ ID NO: 70212 - DNA, 103 bp, Artificial Sequence
  Synthetic Polynucleotide
taatacgactcactataggggacccgccacaccattaggatctattatggaacagaggagaccataaatgatcctaatgaacctggcggcagcgcaaaagatg

SEQ ID NO: 70213 - DNA, 103 bp, Artificial Sequence
  Synthetic Polynucleotide
taatacgactcactatagggagcatgacccgccacaccattaggatctataacagaggagaatagatatgaatggtgtgaacctggcggcagcgcaaaagatg

SEQ ID NO: 70214 - DNA, 103 bp, Artificial Sequence
  Synthetic Polynucleotide
taatacgactcactatagggtagatttcatatttcttattactcattcataacagaggagaatgaatatgtaataagaaaacctggcggcagcgcaaaagatg

SEQ ID NO: 70215 - DNA, 103 bp, Artificial Sequence
  Synthetic Polynucleotide
taatacgactcactatagggaagctagcatgacccgccacaccattaggaaacagaggagatcctaaatgtgtggcgggaacctggcggcagcgcaaaagatg

SEQ ID NO: 70216 - DNA, 103 bp, Artificial Sequence
  Synthetic Polynucleotide
taatacgactcactatagggtacaaaagctagcatgacccgccacaccataacagaggagaatggtgatgcgggtcatgaacctggcggcagcgcaaaagatg

SEQ ID NO: 70217 - DNA, 103 bp, Artificial Sequence
  Synthetic Polynucleotide
taatacgactcactatagggattggtacaaaagctagcatgacccgccacaacagaggagagtggcgatgcatgctagcaacctggcggcagcgcaaaagatg

SEQ ID NO: 70218 - DNA, 103 bp, Artificial Sequence
  Synthetic Polynucleotide
taatacgactcactatagggcttctattggtacaaaagctagcatgacccaacagaggagagggtcaatgtagcttttgaacctggcggcagcgcaaaagatg

SEQ ID NO: 70219 - DNA, 103 bp, Artificial Sequence
  Synthetic Polynucleotide
taatacgactcactatagggtgctgcttctattggtacaaaagctagcataacagaggagaatgctaatgtttgtaccaaacctggcggcagcgcaaaagatg

SEQ ID NO: 70220 - DNA, 103 bp, Artificial Sequence
  Synthetic Polynucleotide
taatacgactcactatagggttggttgctgcttctattggtacaaaagctaacagaggagaagctttatgaccaatagaaacctggcggcagcgcaaaagatg

SEQ ID NO: 70221 - DNA, 103 bp, Artificial Sequence
  Synthetic Polynucleotide
taatacgactcactatagggaaacattggttgctgcttctattggtacaaaacagaggagattgtacatgtagaagcagaacctggcggcagcgcaaaagatg

SEQ ID NO: 70222 - DNA, 103 bp, Artificial Sequence
  Synthetic Polynucleotide
taatacgactcactatagggaccagaaacattggttgctgcttctattggaacagaggagaccaataatggcagcaaccaacctggcggcagcgcaaaagatg

SEQ ID NO: 70223 - DNA, 103 bp, Artificial Sequence
  Synthetic Polynucleotide
taatacgactcactatagggttctgaccagaaacattggttgctgcttctaacagaggagaagaagcatgaaccaatgtaacctggcggcagcgcaaaagatg

SEQ ID NO: 70224 - DNA, 103 bp, Artificial Sequence
  Synthetic Polynucleotide
taatacgactcactatagggataggttctgaccagaaacattggttgctgaacagaggagacagcaaatgatgtttctgaacctggcggcagcgcaaaagatg

SEQ ID NO: 70225 - DNA, 103 bp, Artificial Sequence
  Synthetic Polynucleotide
taatacgactcactatagggtaagatagatttcatatttcttattactcaaacagaggagatgagtaatgagaaatatgaacctggcggcagcgcaaaagatg

SEQ ID NO: 70226 - DNA, 103 bp, Artificial Sequence
  Synthetic Polynucleotide
taatacgactcactatagggatatcataggttctgaccagaaacattggtaacagaggagaaccaatatgtctggtcagaacctggcggcagcgcaaaagatg

SEQ ID NO: 70227 - DNA, 103 bp, Artificial Sequence
  Synthetic Polynucleotide
taatacgactcactatagggttccaatatcataggttctgaccagaaacaaacagaggagatgtttcatgtcagaacctaacctggcggcagcgcaaaagatg

SEQ ID NO: 70228 - DNA, 103 bp, Artificial Sequence
  Synthetic Polynucleotide
taatacgactcactatagggacatcttccaatatcataggttctgaccagaacagaggagactggtcatgacctatgataacctggcggcagcgcaaaagatg

SEQ ID NO: 70229 - DNA, 103 bp, Artificial Sequence
  Synthetic Polynucleotide
taatacgactcactatagggatgatacatcttccaatatcataggttctgaacagaggagacagaacatgtgatattggaacctggcggcagcgcaaaagatg

SEQ ID NO: 70230 - DNA, 103 bp, Artificial Sequence
  Synthetic Polynucleotide
taatacgactcactatagggacacgatgatacatcttccaatatcataggaacagaggagacctatgatgttggaagataacctggcggcagcgcaaaagatg

SEQ ID NO: 70231 - DNA, 103 bp, Artificial Sequence
  Synthetic Polynucleotide
taatacgactcactataggggaactacacgatgatacatcttccaatatcaacagaggagagatattatgagatgtatcaacctggcggcagcgcaaaagatg

SEQ ID NO: 70232 - DNA, 103 bp, Artificial Sequence
  Synthetic Polynucleotide
taatacgactcactatagggttctagaactacacgatgatacatcttccaaacagaggagatggaagatgtatcatcgtaacctggcggcagcgcaaaagatg

SEQ ID NO: 70233 - DNA, 103 bp, Artificial Sequence
  Synthetic Polynucleotide
taatacgactcactatagggtctagttctagaactacacgatgatacatcaacagaggagagatgtaatgtcgtgtagtaacctggcggcagcgcaaaagatg

SEQ ID NO: 70234 - DNA, 103 bp, Artificial Sequence
  Synthetic Polynucleotide
taatacgactcactatagggatttttctagttctagaactacacgatgataacagaggagaatcatcatgtagttctagaacctggcggcagcgcaaaagatg

SEQ ID NO: 70235 - DNA, 103 bp, Artificial Sequence
  Synthetic Polynucleotide
taatacgactcactatagggcgtatatttttctagttctagaactacacgaacagaggagacgtgtaatgctagaactaaacctggcggcagcgcaaaagatg

SEQ ID NO: 70236 - DNA, 103 bp, Artificial Sequence
  Synthetic Polynucleotide
taatacgactcactataggggatggattttgtgtttatgctgtttctcagaacagaggagactgagaatgagcataaacaacctggcggcagcgcaaaagatg

SEQ ID NO: 70237 - DNA, 103 bp, Artificial Sequence
  Synthetic Polynucleotide
taatacgactcactataggggtatataagatagatttcatatttcttattaacagaggagaaataagatgtatgaaatcaacctggcggcagcgcaaaagatg

SEQ ID NO: 70238 - DNA, 103 bp, Artificial Sequence
  Synthetic Polynucleotide
taatacgactcactatagggttttacgtatatttttctagttctagaactaacagaggagaagttctatgactagaaaaaacctggcggcagcgcaaaagatg

SEQ ID NO: 70239 - DNA, 103 bp, Artificial Sequence
  Synthetic Polynucleotide
taatacgactcactatagggcccagttttacgtatatttttctagttctaaacagaggagatagaacatgaaaaatataaacctggcggcagcgcaaaagatg

SEQ ID NO: 70240 - DNA, 103 bp, Artificial Sequence
  Synthetic Polynucleotide
taatacgactcactatagggatattcccagttttacgtatatttttctagaacagaggagactagaaatgtatacgtaaaacctggcggcagcgcaaaagatg

SEQ ID NO: 70241 - DNA, 103 bp, Artificial Sequence
  Synthetic Polynucleotide
taatacgactcactatagggattaaatattcccagttttacgtatattttaacagaggagaaaaataatggtaaaactgaacctggcggcagcgcaaaagatg

SEQ ID NO: 70242 - DNA, 103 bp, Artificial Sequence
  Synthetic Polynucleotide
taatacgactcactatagggtcagtattaaatattcccagttttacgtataacagaggagaatacgtatgactgggaataacctggcggcagcgcaaaagatg

SEQ ID NO: 70243 - DNA, 103 bp, Artificial Sequence
  Synthetic Polynucleotide
taatacgactcactatagggacccttcagtattaaatattcccagttttaaacagaggagataaaacatggaatatttaaacctggcggcagcgcaaaagatg

SEQ ID NO: 70244 - DNA, 103 bp, Artificial Sequence
  Synthetic Polynucleotide
taatacgactcactatagggattaaacccttcagtattaaatattcccagaacagaggagactgggaatgtttaatactaacctggcggcagcgcaaaagatg

SEQ ID NO: 70245 - DNA, 103 bp, Artificial Sequence
  Synthetic Polynucleotide
taatacgactcactatagggaaactattaaacccttcagtattaaatattaacagaggagaaatattatgtactgaaggaacctggcggcagcgcaaaagatg

SEQ ID NO: 70246 - DNA, 103 bp, Artificial Sequence
  Synthetic Polynucleotide
taatacgactcactataggggtacaaaactattaaacccttcagtattaaaacagaggagattaataatgaagggtttaaacctggcggcagcgcaaaagatg

SEQ ID NO: 70247 - DNA, 103 bp, Artificial Sequence
  Synthetic Polynucleotide
taatacgactcactataggggtttagtacaaaactattaaacccttcagtaacagaggagaactgaaatgtttaatagtaacctggcggcagcgcaaaagatg

SEQ ID NO: 70248 - DNA, 103 bp, Artificial Sequence
  Synthetic Polynucleotide
taatacgactcactatagggtatgtgtatataagatagatttcatatttcaacagaggagagaaataatgaatctatctaacctggcggcagcgcaaaagatg

SEQ ID NO: 70249 - DNA, 103 bp, Artificial Sequence
  Synthetic Polynucleotide
taatacgactcactatagggggacagtttagtacaaaactattaaaccctaacagaggagaagggttatgtagttttgtaacctggcggcagcgcaaaagatg

SEQ ID NO: 70250 - DNA, 103 bp, Artificial Sequence
  Synthetic Polynucleotide
taatacgactcactatagggcagttggacagtttagtacaaaactattaaaacagaggagattaataatgttgtactaaaacctggcggcagcgcaaaagatg

SEQ ID NO: 70251 - DNA, 103 bp, Artificial Sequence
  Synthetic Polynucleotide
taatacgactcactatagggagacccagttggacagtttagtacaaaactaacagaggagaagttttatgctaaactgtaacctggcggcagcgcaaaagatg

SEQ ID NO: 70252 - DNA, 103 bp, Artificial Sequence
  Synthetic Polynucleotide
taatacgactcactatagggggcgtagacccagttggacagtttagtacaaacagaggagatgtactatgctgtccaacaacctggcggcagcgcaaaagatg

SEQ ID NO: 70253 - DNA, 103 bp, Artificial Sequence
  Synthetic Polynucleotide
taatacgactcactatagggatgttggcgtagacccagttggacagtttaaacagaggagataaactatgcaactgggtaacctggcggcagcgcaaaagatg

SEQ ID NO: 70254 - DNA, 103 bp, Artificial Sequence
  Synthetic Polynucleotide
taatacgactcactataggggatgtatgttggcgtagacccagttggacaaacagaggagatgtccaatggggtctacgaacctggcggcagcgcaaaagatg

SEQ ID NO: 70255 - DNA, 103 bp, Artificial Sequence
  Synthetic Polynucleotide
taatacgactcactatagggtctttgatgtatgttggcgtagacccagttaacagaggagaaactggatgtacgccaacaacctggcggcagcgcaaaagatg

SEQ ID NO: 70256 - DNA, 103 bp, Artificial Sequence
  Synthetic Polynucleotide
taatacgactcactatagggttttatctttgatgtatgttggcgtagaccaacagaggagaggtctaatgcaacatacaaacctggcggcagcgcaaaagatg

SEQ ID NO: 70257 - DNA, 103 bp, Artificial Sequence
  Synthetic Polynucleotide
taatacgactcactatagggcgtatttttatctttgatgtatgttggcgtaacagaggagaacgccaatgtacatcaaaaacctggcggcagcgcaaaagatg

SEQ ID NO: 70258 - DNA, 103 bp, Artificial Sequence
  Synthetic Polynucleotide
taatacgactcactatagggctgtccgtatttttatctttgatgtatgttaacagaggagaaacataatgcaaagataaaacctggcggcagcgcaaaagatg

SEQ ID NO: 70259 - DNA, 103 bp, Artificial Sequence
  Synthetic Polynucleotide
taatacgactcactatagggataattatgtgtatataagatagatttcataacagaggagaatgaaaatgatcttatataacctggcggcagcgcaaaagatg

SEQ ID NO: 70260 - DNA, 103 bp, Artificial Sequence
  Synthetic Polynucleotide
taatacgactcactatagggtgttactgtccgtatttttatctttgatgtaacagaggagaacatcaatgataaaaataaacctggcggcagcgcaaaagatg

SEQ ID NO: 70261 - DNA, 103 bp, Artificial Sequence
  Synthetic Polynucleotide
taatacgactcactatagggaacattgttactgtccgtatttttatctttaacagaggagaaaagatatgaatacggacaacctggcggcagcgcaaaagatg

SEQ ID NO: 70262 - DNA, 103 bp, Artificial Sequence
  Synthetic Polynucleotide
taatacgactcactatagggatgataacattgttactgtccgtatttttaaacagaggagataaaaaatgggacagtaaaacctggcggcagcgcaaaagatg

SEQ ID NO: 70263 - DNA, 103 bp, Artificial Sequence
  Synthetic Polynucleotide
taatacgactcactataggggctctatgataacattgttactgtccgtataacagaggagaatacggatggtaacaatgaacctggcggcagcgcaaaagatg

SEQ ID NO: 70264 - DNA, 103 bp, Artificial Sequence
  Synthetic Polynucleotide
taatacgactcactatagggaggtagctctatgataacattgttactgtcaacagaggagagacagtatgaatgttatcaacctggcggcagcgcaaaagatg

SEQ ID NO: 70265 - DNA, 103 bp, Artificial Sequence
  Synthetic Polynucleotide
taatacgactcactatagggcctacaggtagctctatgataacattgttaaacagaggagataacaaatgtatcatagaaacctggcggcagcgcaaaagatg

SEQ ID NO: 70266 - DNA, 103 bp, Artificial Sequence
  Synthetic Polynucleotide
taatacgactcactatagggaatcacctacaggtagctctatgataacataacagaggagaatgttaatgtagagctacaacctggcggcagcgcaaaagatg

SEQ ID NO: 70267 - DNA, 103 bp, Artificial Sequence
  Synthetic Polynucleotide
taatacgactcactataggggccgtaatcacctacaggtagctctatgataacagaggagaatcataatgctacctgtaaacctggcggcagcgcaaaagatg

SEQ ID NO: 70268 - DNA, 103 bp, Artificial Sequence
  Synthetic Polynucleotide
taatacgactcactataggggcagtgccgtaatcacctacaggtagctctaacagaggagaagagctatgtgtaggtgaaacctggcggcagcgcaaaagatg

SEQ ID NO: 70269 - DNA, 103 bp, Artificial Sequence
  Synthetic Polynucleotide
taatacgactcactatagggatttggcagtgccgtaatcacctacaggtaaacagaggagatacctgatggtgattacgaacctggcggcagcgcaaaagatg

SEQ ID NO: 70270 - DNA, 103 bp, Artificial Sequence
  Synthetic Polynucleotide
taatacgactcactatagggatagaataattatgtgtatataagatagataacagaggagaatctatatgatatacacaaacctggcggcagcgcaaaagatg

SEQ ID NO: 70271 - DNA, 103 bp, Artificial Sequence
  Synthetic Polynucleotide
taatacgactcactatagggatacaatttggcagtgccgtaatcacctacaacagaggagagtaggtatgtacggcactaacctggcggcagcgcaaaagatg

SEQ ID NO: 70272 - DNA, 103 bp, Artificial Sequence
  Synthetic Polynucleotide
taatacgactcactatagggaccgaatacaatttggcagtgccgtaatcaaacagaggagatgattaatgcactgccaaaacctggcggcagcgcaaaagatg

SEQ ID NO: 70273 - DNA, 103 bp, Artificial Sequence
  Synthetic Polynucleotide
taatacgactcactatagggttgttaccgaatacaatttggcagtgccgtaacagaggagaacggcaatgccaaattgtaacctggcggcagcgcaaaagatg

SEQ ID NO: 70274 - DNA, 103 bp, Artificial Sequence
  Synthetic Polynucleotide
taatacgactcactatagggtggttttgttaccgaatacaatttggcagtaacagaggagaactgccatgttgtattcgaacctggcggcagcgcaaaagatg

SEQ ID NO: 70275 - DNA, 103 bp, Artificial Sequence
  Synthetic Polynucleotide
taatacgactcactatagggctcgatggttttgttaccgaatacaatttgaacagaggagacaaattatgttcggtaacaacctggcggcagcgcaaaagatg

SEQ ID NO: 70276 - DNA, 103 bp, Artificial Sequence
  Synthetic Polynucleotide
taatacgactcactatagggctattctcgatggttttgttaccgaatacaaacagaggagatgtattatgtaacaaaacaacctggcggcagcgcaaaagatg

SEQ ID NO: 70277 - DNA, 103 bp, Artificial Sequence
  Synthetic Polynucleotide
taatacgactcactatagggtacagctattctcgatggttttgttaccgaaacagaggagatcggtaatgaaaccatcgaacctggcggcagcgcaaaagatg

SEQ ID NO: 70278 - DNA, 103 bp, Artificial Sequence
  Synthetic Polynucleotide
taatacgactcactatagggcagaatacagctattctcgatggttttgttaacagaggagaaacaaaatgatcgagaataacctggcggcagcgcaaaagatg

SEQ ID NO: 70279 - DNA, 103 bp, Artificial Sequence
  Synthetic Polynucleotide
taatacgactcactataggggtgtgcagaatacagctattctcgatggttaacagaggagaaaccatatggaatagctgaacctggcggcagcgcaaaagatg

SEQ ID NO: 70280 - DNA, 103 bp, Artificial Sequence
  Synthetic Polynucleotide
taatacgactcactataggggttatgtgtgcagaatacagctattctcgaaacagaggagatcgagaatggctgtattcaacctggcggcagcgcaaaagatg

SEQ ID NO: 70281 - DNA, 103 bp, Artificial Sequence
  Synthetic Polynucleotide
taatacgactcactatagggaattgatagaataattatgtgtatataagaaacagaggagatcttatatgcacataattaacctggcggcagcgcaaaagatg

SEQ ID NO: 70282 - DNA, 103 bp, Artificial Sequence
  Synthetic Polynucleotide
taatacgactcactatagggtcatagttatgtgtgcagaatacagctattaacagaggagaaatagcatgattctgcacaacctggcggcagcgcaaaagatg

SEQ ID NO: 70283 - DNA, 103 bp, Artificial Sequence
  Synthetic Polynucleotide
taatacgactcactataggggtttatcatagttatgtgtgcagaatacagaacagaggagactgtatatggcacacataaacctggcggcagcgcaaaagatg

SEQ ID NO: 70284 - DNA, 103 bp, Artificial Sequence
  Synthetic Polynucleotide
taatacgactcactataggggaatcgtttatcatagttatgtgtgcagaaaacagaggagattctgcatgcataactataacctggcggcagcgcaaaagatg

SEQ ID NO: 70285 - DNA, 103 bp, Artificial Sequence
  Synthetic Polynucleotide
taatacgactcactataggggatttgaatcgtttatcatagttatgtgtgaacagaggagacacacaatgctatgataaaacctggcggcagcgcaaaagatg

SEQ ID NO: 70286 - DNA, 103 bp, Artificial Sequence
  Synthetic Polynucleotide
taatacgactcactatagggtatctgatttgaatcgtttatcatagttataacagaggagaataactatgataaacgataacctggcggcagcgcaaaagatg

SEQ ID NO: 70287 - DNA, 103 bp, Artificial Sequence
  Synthetic Polynucleotide
taatacgactcactatagggtataatatctgatttgaatcgtttatcataaacagaggagatatgatatgcgattcaaaaacctggcggcagcgcaaaagatg

SEQ ID NO: 70288 - DNA, 103 bp, Artificial Sequence
  Synthetic Polynucleotide
taatacgactcactatagggagaactataatatctgatttgaatcgtttaaacagaggagataaacgatgcaaatcagaaacctggcggcagcgcaaaagatg

SEQ ID NO: 70289 - DNA, 103 bp, Artificial Sequence
  Synthetic Polynucleotide
taatacgactcactatagggatattagaactataatatctgatttgaatcaacagaggagagattcaatgcagatattaaacctggcggcagcgcaaaagatg

SEQ ID NO: 70290 - DNA, 103 bp, Artificial Sequence
  Synthetic Polynucleotide
taatacgactcactatagggattaaatattagaactataatatctgatttaacagaggagaaaatcaatgattatagttaacctggcggcagcgcaaaagatg

SEQ ID NO: 70291 - DNA, 103 bp, Artificial Sequence
  Synthetic Polynucleotide
taatacgactcactatagggatactattaaatattagaactataatatctaacagaggagaagatatatgagttctaataacctggcggcagcgcaaaagatg

SEQ ID NO: 70292 - DNA, 103 bp, Artificial Sequence
  Synthetic Polynucleotide
taatacgactcactatagggggtaaaattgatagaataattatgtgtataaacagaggagatatacaatgaattattctaacctggcggcagcgcaaaagatg

SEQ ID NO: 70293 - DNA, 103 bp, Artificial Sequence
  Synthetic Polynucleotide
taatacgactcactatagggcactgatactattaaatattagaactataaaacagaggagattatagatgtaatatttaaacctggcggcagcgcaaaagatg

SEQ ID NO: 70294 - DNA, 103 bp, Artificial Sequence
  Synthetic Polynucleotide
taatacgactcactatagggaataccactgatactattaaatattagaacaacagaggagagttctaatgtttaatagtaacctggcggcagcgcaaaagatg

SEQ ID NO: 70295 - DNA, 103 bp, Artificial Sequence
  Synthetic Polynucleotide
taatacgactcactatagggaatggaataccactgatactattaaatattaacagaggagaaatattatgtagtatcagaacctggcggcagcgcaaaagatg

SEQ ID NO: 70296 - DNA, 103 bp, Artificial Sequence
  Synthetic Polynucleotide
taatacgactcactatagggtcgaaaatggaataccactgatactattaaaacagaggagattaataatgtcagtggtaaacctggcggcagcgcaaaagatg

SEQ ID NO: 70297 - DNA, 103 bp, Artificial Sequence
  Synthetic Polynucleotide
taatacgactcactatagggtatgctcgaaaatggaataccactgatactaacagaggagaagtatcatgggtattccaaacctggcggcagcgcaaaagatg

SEQ ID NO: 70298 - DNA, 103 bp, Artificial Sequence
  Synthetic Polynucleotide
taatacgactcactataggggtgtatatgctcgaaaatggaataccactgaacagaggagacagtggatgtccattttcaacctggcggcagcgcaaaagatg

SEQ ID NO: 70299 - DNA, 103 bp, Artificial Sequence
  Synthetic Polynucleotide
taatacgactcactatagggttcctgtgtatatgctcgaaaatggaatacaacagaggagagtattcatgtttcgagcaaacctggcggcagcgcaaaagatg

SEQ ID NO: 70300 - DNA, 103 bp, Artificial Sequence
  Synthetic Polynucleotide
taatacgactcactatagggcacacttcctgtgtatatgctcgaaaatggaacagaggagaccatttatgagcatatacaacctggcggcagcgcaaaagatg

SEQ ID NO: 70301 - DNA, 103 bp, Artificial Sequence
  Synthetic Polynucleotide
taatacgactcactatagggccgttcacacttcctgtgtatatgctcgaaaacagaggagattcgagatgatacacaggaacctggcggcagcgcaaaagatg

SEQ ID NO: 70302 - DNA, 103 bp, Artificial Sequence
  Synthetic Polynucleotide
taatacgactcactatagggttctaccgttcacacttcctgtgtatatgcaacagaggagagcatatatgcaggaagtgaacctggcggcagcgcaaaagatg

SEQ ID NO: 70303 - DNA, 103 bp, Artificial Sequence
  Synthetic Polynucleotide
taatacgactcactatagggtaattggtaaaattgatagaataattatgtaacagaggagaacataaatgttctatcaaaacctggcggcagcgcaaaagatg

SEQ ID NO: 70304 - DNA, 103 bp, Artificial Sequence
  Synthetic Polynucleotide
taatacgactcactatagggtctatttctaccgttcacacttcctgtgtaaacagaggagatacacaatgagtgtgaacaacctggcggcagcgcaaaagatg

SEQ ID NO: 70305 - DNA, 103 bp, Artificial Sequence
  Synthetic Polynucleotide
taatacgactcactatagggaacagtctatttctaccgttcacacttcctaacagaggagaaggaagatggaacggtagaacctggcggcagcgcaaaagatg

SEQ ID NO: 70306 - DNA, 103 bp, Artificial Sequence
  Synthetic Polynucleotide
taatacgactcactatagggtggtgaacagtctatttctaccgttcacacaacagaggagagtgtgaatggtagaaataaacctggcggcagcgcaaaagatg

SEQ ID NO: 70307 - DNA, 103 bp, Artificial Sequence
  Synthetic Polynucleotide
taatacgactcactatagggcaatgtggtgaacagtctatttctaccgttaacagaggagaaacggtatgaatagactgaacctggcggcagcgcaaaagatg

SEQ ID NO: 70308 - DNA, 103 bp, Artificial Sequence
  Synthetic Polynucleotide
taatacgactcactatagggttagacaatgtggtgaacagtctatttctaaacagaggagatagaaaatgactgttcacaacctggcggcagcgcaaaagatg

SEQ ID NO: 70309 - DNA, 103 bp, Artificial Sequence
  Synthetic Polynucleotide
taatacgactcactatagggttcctttagacaatgtggtgaacagtctataacagaggagaatagacatgtcaccacataacctggcggcagcgcaaaagatg

SEQ ID NO: 70310 - DNA, 103 bp, Artificial Sequence
  Synthetic Polynucleotide
taatacgactcactatagggtggcattcctttagacaatgtggtgaacagaacagaggagactgttcatgacattgtctaacctggcggcagcgcaaaagatg

SEQ ID NO: 70311 - DNA, 103 bp, Artificial Sequence
  Synthetic Polynucleotide
taatacgactcactatagggctatatggcattcctttagacaatgtggtgaacagaggagacaccacatggtctaaaggaacctggcggcagcgcaaaagatg

SEQ ID NO: 70312 - DNA, 103 bp, Artificial Sequence
  Synthetic Polynucleotide
taatacgactcactatagggttgatctatatggcattcctttagacaatgaacagaggagacattgtatgaaggaatgcaacctggcggcagcgcaaaagatg

SEQ ID NO: 70313 - DNA, 103 bp, Artificial Sequence
  Synthetic Polynucleotide
taatacgactcactatagggatacattgatctatatggcattcctttagaaacagaggagatctaaaatgatgccatataacctggcggcagcgcaaaagatg

SEQ ID NO: 70314 - DNA, 103 bp, Artificial Sequence
  Synthetic Polynucleotide
taatacgactcactatagggctaactaattggtaaaattgatagaataataacagaggagaattattatgtcaattttaaacctggcggcagcgcaaaagatg

SEQ ID NO: 70315 - DNA, 103 bp, Artificial Sequence
  Synthetic Polynucleotide
taatacgactcactatagggtcgcaatacattgatctatatggcattcctaacagaggagaaggaatatgatatagatcaacctggcggcagcgcaaaagatg

SEQ ID NO: 70316 - DNA, 103 bp, Artificial Sequence
  Synthetic Polynucleotide
taatacgactcactatagggtgttatcgcaatacattgatctatatggcaaacagaggagatgccatatggatcaatgtaacctggcggcagcgcaaaagatg

SEQ ID NO: 70317 - DNA, 103 bp, Artificial Sequence
  Synthetic Polynucleotide
taatacgactcactatagggtcgtctgttatcgcaatacattgatctataaacagaggagatatagaatgatgtattgcaacctggcggcagcgcaaaagatg

SEQ ID NO: 70318 - DNA, 103 bp, Artificial Sequence
  Synthetic Polynucleotide
taatacgactcactatagggcctggtcgtctgttatcgcaatacattgataacagaggagaatcaatatgttgcgataaaacctggcggcagcgcaaaagatg

SEQ ID NO: 70319 - DNA, 103 bp, Artificial Sequence
  Synthetic Polynucleotide
taatacgactcactatagggaacaacctggtcgtctgttatcgcaatacaaacagaggagatgtattatgataacagacaacctggcggcagcgcaaaagatg

SEQ ID NO: 70320 - DNA, 103 bp, Artificial Sequence
  Synthetic Polynucleotide
taatacgactcactatagggataataacaacctggtcgtctgttatcgcaaacagaggagatgcgatatgagacgaccaaacctggcggcagcgcaaaagatg

SEQ ID NO: 70321 - DNA, 103 bp, Artificial Sequence
  Synthetic Polynucleotide
taatacgactcactatagggcctgcataataacaacctggtcgtctgttaaacagaggagataacagatgaccaggttgaacctggcggcagcgcaaaagatg

SEQ ID NO: 70322 - DNA, 103 bp, Artificial Sequence
  Synthetic Polynucleotide
taatacgactcactataggggtattcctgcataataacaacctggtcgtcaacagaggagagacgacatggttgttattaacctggcggcagcgcaaaagatg

SEQ ID NO: 70323 - DNA, 103 bp, Artificial Sequence
  Synthetic Polynucleotide
taatacgactcactatagggaaatggtattcctgcataataacaacctggaacagaggagaccaggtatgtattatgcaaacctggcggcagcgcaaaagatg

SEQ ID NO: 70324 - DNA, 103 bp, Artificial Sequence
  Synthetic Polynucleotide
taatacgactcactatagggtcattaaatggtattcctgcataataacaaaacagaggagattgttaatgtgcaggaataacctggcggcagcgcaaaagatg

SEQ ID NO: 70325 - DNA, 103 bp, Artificial Sequence
  Synthetic Polynucleotide
taatacgactcactatagggaaacactaactaattggtaaaattgatagaaacagaggagatctatcatgtttaccaataacctggcggcagcgcaaaagatg

SEQ ID NO: 70326 - DNA, 103 bp, Artificial Sequence
  Synthetic Polynucleotide
taatacgactcactatagggtattttcattaaatggtattcctgcataataacagaggagaattatgatggaataccataacctggcggcagcgcaaaagatg

SEQ ID NO: 70327 - DNA, 103 bp, Artificial Sequence
  Synthetic Polynucleotide
taatacgactcactatagggtacactattttcattaaatggtattcctgcaacagaggagagcaggaatgccatttaataacctggcggcagcgcaaaagatg

SEQ ID NO: 70328 - DNA, 103 bp, Artificial Sequence
  Synthetic Polynucleotide
taatacgactcactataggggattctacactattttcattaaatggtattaacagaggagaaataccatgtaatgaaaaaacctggcggcagcgcaaaagatg

SEQ ID NO: 70329 - DNA, 103 bp, Artificial Sequence
  Synthetic Polynucleotide
taatacgactcactataggggatctgattctacactattttcattaaatgaacagaggagacatttaatgaaaatagtgaacctggcggcagcgcaaaagatg

SEQ ID NO: 70330 - DNA, 103 bp, Artificial Sequence
  Synthetic Polynucleotide
taatacgactcactatagggatgcagatctgattctacactattttcattaacagaggagaaatgaaatgagtgtagaaaacctggcggcagcgcaaaagatg

SEQ ID NO: 70331 - DNA, 103 bp, Artificial Sequence
  Synthetic Polynucleotide
taatacgactcactatagggccataatgcagatctgattctacactatttaacagaggagaaaatagatgagaatcagaaacctggcggcagcgcaaaagatg

SEQ ID NO: 70332 - DNA, 103 bp, Artificial Sequence
  Synthetic Polynucleotide
taatacgactcactatagggctggtccataatgcagatctgattctacacaacagaggagagtgtagatgcagatctgcaacctggcggcagcgcaaaagatg

SEQ ID NO: 70333 - DNA, 103 bp, Artificial Sequence
  Synthetic Polynucleotide
taatacgactcactatagggtatttctggtccataatgcagatctgattcaacagaggagagaatcaatgctgcattataacctggcggcagcgcaaaagatg

SEQ ID NO: 70334 - DNA, 103 bp, Artificial Sequence
  Synthetic Polynucleotide
taatacgactcactatagggagcattatttctggtccataatgcagatctaacagaggagaagatctatgttatggaccaacctggcggcagcgcaaaagatg

SEQ ID NO: 70335 - DNA, 103 bp, Artificial Sequence
  Synthetic Polynucleotide
taatacgactcactatagggccttaagcattatttctggtccataatgcaaacagaggagatgcattatggaccagaaaaacctggcggcagcgcaaaagatg

SEQ ID NO: 70336 - DNA, 103 bp, Artificial Sequence
  Synthetic Polynucleotide
taatacgactcactatagggttattaaacactaactaattggtaaaattgaacagaggagacaatttatgcaattagttaacctggcggcagcgcaaaagatg

SEQ ID NO: 70337 - DNA, 103 bp, Artificial Sequence
  Synthetic Polynucleotide
taatacgactcactatagggtgtttccttaagcattatttctggtccataaacagaggagatatggaatggaaataatgaacctggcggcagcgcaaaagatg

SEQ ID NO: 70338 - DNA, 103 bp, Artificial Sequence
  Synthetic Polynucleotide
taatacgactcactatagggtcatatgtttccttaagcattatttctggtaacagaggagaaccagaatgaatgcttaaaacctggcggcagcgcaaaagatg

SEQ ID NO: 70339 - DNA, 103 bp, Artificial Sequence
  Synthetic Polynucleotide
taatacgactcactatagggttgtgtcatatgtttccttaagcattatttaacagaggagaaaataaatgttaaggaaaaacctggcggcagcgcaaaagatg

SEQ ID NO: 70340 - DNA, 103 bp, Artificial Sequence
  Synthetic Polynucleotide
taatacgactcactatagggactgtttgtgtcatatgtttccttaagcataacagaggagaatgcttatggaaacatataacctggcggcagcgcaaaagatg

SEQ ID NO: 70341 - DNA, 103 bp, Artificial Sequence
  Synthetic Polynucleotide
taatacgactcactatagggtcaatactgtttgtgtcatatgtttccttaaacagaggagataaggaatgatatgacacaacctggcggcagcgcaaaagatg

SEQ ID NO: 70342 - DNA, 103 bp, Artificial Sequence
  Synthetic Polynucleotide
taatacgactcactataggggtggatcaatactgtttgtgtcatatgtttaacagaggagaaaacatatgacacaaacaaacctggcggcagcgcaaaagatg

SEQ ID NO: 70343 - DNA, 103 bp, Artificial Sequence
  Synthetic Polynucleotide
taatacgactcactatagggaacttgtggatcaatactgtttgtgtcataaacagaggagatatgacatgaacagtattaacctggcggcagcgcaaaagatg

SEQ ID NO: 70344 - DNA, 103 bp, Artificial Sequence
  Synthetic Polynucleotide
taatacgactcactataggggttataacttgtggatcaatactgtttgtgaacagaggagacacaaaatgtattgatccaacctggcggcagcgcaaaagatg

SEQ ID NO: 70345 - DNA, 103 bp, Artificial Sequence
  Synthetic Polynucleotide
taatacgactcactatagggactttgttataacttgtggatcaatactgtaacagaggagaacagtaatgatccacaagaacctggcggcagcgcaaaagatg

SEQ ID NO: 70346 - DNA, 103 bp, Artificial Sequence
  Synthetic Polynucleotide
taatacgactcactatagggttttgactttgttataacttgtggatcaataacagaggagaattgatatgcaagttataaacctggcggcagcgcaaaagatg

SEQ ID NO: 70347 - DNA, 103 bp, Artificial Sequence
  Synthetic Polynucleotide
taatacgactcactatagggtttttgatggattttgtgtttatgctgtttaacagaggagaaaacagatgaaacacaaaaacctggcggcagcgcaaaagatg

SEQ ID NO: 70348 - DNA, 103 bp, Artificial Sequence
  Synthetic Polynucleotide
taatacgactcactatagggtatttttattaaacactaactaattggtaaaacagaggagattaccaatgagttagtgtaacctggcggcagcgcaaaagatg

SEQ ID NO: 70349 - DNA, 103 bp, Artificial Sequence
  Synthetic Polynucleotide
taatacgactcactatagggtgtgtttttgactttgttataacttgtggaaacagaggagatccacaatgtataacaaaaacctggcggcagcgcaaaagatg

SEQ ID NO: 70350 - DNA, 103 bp, Artificial Sequence
  Synthetic Polynucleotide
taatacgactcactataggggaaagtgtgtttttgactttgttataacttaacagaggagaaagttaatgcaaagtcaaaacctggcggcagcgcaaaagatg

SEQ ID NO: 70351 - DNA, 103 bp, Artificial Sequence
  Synthetic Polynucleotide
taatacgactcactatagggagtaggaaagtgtgtttttgactttgttataacagaggagaataacaatgtcaaaaacaaacctggcggcagcgcaaaagatg

SEQ ID NO: 70352 - DNA, 103 bp, Artificial Sequence
  Synthetic Polynucleotide
taatacgactcactatagggattggagtaggaaagtgtgtttttgactttaacagaggagaaaagtcatgaacacacttaacctggcggcagcgcaaaagatg

SEQ ID NO: 70353 - DNA, 103 bp, Artificial Sequence
  Synthetic Polynucleotide
taatacgactcactatagggcacttattggagtaggaaagtgtgtttttgaacagaggagacaaaaaatgactttcctaaacctggcggcagcgcaaaagatg

SEQ ID NO: 70354 - DNA, 103 bp, Artificial Sequence
  Synthetic Polynucleotide
taatacgactcactatagggttttacacttattggagtaggaaagtgtgtaacagaggagaacacacatgcctactccaaacctggcggcagcgcaaaagatg

SEQ ID NO: 70355 - DNA, 103 bp, Artificial Sequence
  Synthetic Polynucleotide
taatacgactcactataggggtaaattttacacttattggagtaggaaagaacagaggagactttccatgtccaataagaacctggcggcagcgcaaaagatg

SEQ ID NO: 70356 - DNA, 103 bp, Artificial Sequence
  Synthetic Polynucleotide
taatacgactcactatagggcaaccgtaaattttacacttattggagtagaacagaggagactactcatgtaagtgtaaaacctggcggcagcgcaaaagatg

SEQ ID NO: 70357 - DNA, 103 bp, Artificial Sequence
  Synthetic Polynucleotide
taatacgactcactatagggattgtcaaccgtaaattttacacttattggaacagaggagaccaataatggtaaaatttaacctggcggcagcgcaaaagatg

SEQ ID NO: 70358 - DNA, 103 bp, Artificial Sequence
  Synthetic Polynucleotide
taatacgactcactatagggcctaaattgtcaaccgtaaattttacacttaacagaggagaaagtgtatgatttacggtaacctggcggcagcgcaaaagatg

SEQ ID NO: 70359 - DNA, 103 bp, Artificial Sequence
  Synthetic Polynucleotide
taatacgactcactatagggtcccatatttttattaaacactaactaattaacagaggagaaattagatggtgtttaataacctggcggcagcgcaaaagatg

SEQ ID NO: 70360 - DNA, 103 bp, Artificial Sequence
  Synthetic Polynucleotide
taatacgactcactatagggcatttcctaaattgtcaaccgtaaattttaaacagaggagataaaatatgcggttgacaaacctggcggcagcgcaaaagatg

SEQ ID NO: 70361 - DNA, 103 bp, Artificial Sequence
  Synthetic Polynucleotide
taatacgactcactatagggatacccatttcctaaattgtcaaccgtaaaaacagaggagatttacgatggacaatttaaacctggcggcagcgcaaaagatg

SEQ ID NO: 70362 - DNA, 103 bp, Artificial Sequence
  Synthetic Polynucleotide
taatacgactcactatagggttgttatacccatttcctaaattgtcaaccaacagaggagaggttgaatgtttaggaaaaacctggcggcagcgcaaaagatg

SEQ ID NO: 70363 - DNA, 103 bp, Artificial Sequence
  Synthetic Polynucleotide
taatacgactcactatagggcgggtttgttatacccatttcctaaattgtaacagaggagaacaattatggaaatgggtaacctggcggcagcgcaaaagatg

SEQ ID NO: 70364 - DNA, 103 bp, Artificial Sequence
  Synthetic Polynucleotide
taatacgactcactatagggattttcgggtttgttatacccatttcctaaaacagaggagattaggaatggggtataacaacctggcggcagcgcaaaagatg

SEQ ID NO: 70365 - DNA, 103 bp, Artificial Sequence
  Synthetic Polynucleotide
taatacgactcactatagggcaaaaattttcgggtttgttatacccatttaacagaggagaaaatggatgtaacaaaccaacctggcggcagcgcaaaagatg

SEQ ID NO: 70366 - DNA, 103 bp, Artificial Sequence
  Synthetic Polynucleotide
taatacgactcactatagggctttccaaaaattttcgggtttgttataccaacagaggagaggtataatgaacccgaaaaacctggcggcagcgcaaaagatg

SEQ ID NO: 70367 - DNA, 103 bp, Artificial Sequence
  Synthetic Polynucleotide
taatacgactcactatagggagcgtctttccaaaaattttcgggtttgttaacagaggagaaacaaaatggaaaattttaacctggcggcagcgcaaaagatg

SEQ ID NO: 70368 - DNA, 103 bp, Artificial Sequence
  Synthetic Polynucleotide
taatacgactcactatagggcttttagcgtctttccaaaaattttcgggtaacagaggagaacccgaatgtttttggaaaacctggcggcagcgcaaaagatg

SEQ ID NO: 70369 - DNA, 103 bp, Artificial Sequence
  Synthetic Polynucleotide
taatacgactcactatagggtcttacttttagcgtctttccaaaaattttaacagaggagaaaaattatgggaaagacgaacctggcggcagcgcaaaagatg

SEQ ID NO: 70370 - DNA, 103 bp, Artificial Sequence
  Synthetic Polynucleotide
taatacgactcactatagggtagattcccatatttttattaaacactaacaacagaggagagttagtatgtaataaaaaaacctggcggcagcgcaaaagatg

SEQ ID NO: 70371 - DNA, 103 bp, Artificial Sequence
  Synthetic Polynucleotide
taatacgactcactatagggccttttcttacttttagcgtctttccaaaaaacagaggagattttggatggacgctaaaaacctggcggcagcgcaaaagatg

SEQ ID NO: 70372 - DNA, 103 bp, Artificial Sequence
  Synthetic Polynucleotide
taatacgactcactatagggtatgtccttttcttacttttagcgtctttcaacagaggagagaaagaatgtaaaagtaaaacctggcggcagcgcaaaagatg

SEQ ID NO: 70373 - DNA, 103 bp, Artificial Sequence
  Synthetic Polynucleotide
taatacgactcactatagggcgctatatgtccttttcttacttttagcgtaacagaggagaacgctaatggtaagaaaaaacctggcggcagcgcaaaagatg

SEQ ID NO: 70374 - DNA, 103 bp, Artificial Sequence
  Synthetic Polynucleotide
taatacgactcactatagggcattgcgctatatgtccttttcttacttttaacagaggagaaaaagtatgaaaaggacaaacctggcggcagcgcaaaagatg

SEQ ID NO: 70375 - DNA, 103 bp, Artificial Sequence
  Synthetic Polynucleotide
taatacgactcactatagggattgtcattgcgctatatgtccttttcttaaacagaggagataagaaatggacatatagaacctggcggcagcgcaaaagatg

SEQ ID NO: 70376 - DNA, 103 bp, Artificial Sequence
  Synthetic Polynucleotide
taatacgactcactatagggtttttattgtcattgcgctatatgtcctttaacagaggagaaaaggaatgatagcgcaaaacctggcggcagcgcaaaagatg

SEQ ID NO: 70377 - DNA, 103 bp, Artificial Sequence
  Synthetic Polynucleotide
taatacgactcactatagggtaggatttttattgtcattgcgctatatgtaacagaggagaacatatatggcaatgacaaacctggcggcagcgcaaaagatg

SEQ ID NO: 70378 - DNA, 103 bp, Artificial Sequence
  Synthetic Polynucleotide
taatacgactcactatagggcatggtaggatttttattgtcattgcgctaaacagaggagatagcgcatggacaataaaaacctggcggcagcgcaaaagatg

SEQ ID NO: 70379 - DNA, 103 bp, Artificial Sequence
  Synthetic Polynucleotide
taatacgactcactatagggctgtacatggtaggatttttattgtcattgaacagaggagacaatgaatgtaaaaatccaacctggcggcagcgcaaaagatg

SEQ ID NO: 70380 - DNA, 103 bp, Artificial Sequence
  Synthetic Polynucleotide
taatacgactcactatagggtctcactgtacatggtaggatttttattgtaacagaggagaacaataatgatcctaccaaacctggcggcagcgcaaaagatg

SEQ ID NO: 70381 - DNA, 103 bp, Artificial Sequence
  Synthetic Polynucleotide
taatacgactcactatagggttaattagattcccatatttttattaaacaaacagaggagatgtttaatgaaaatatggaacctggcggcagcgcaaaagatg

SEQ ID NO: 70382 - DNA, 103 bp, Artificial Sequence
  Synthetic Polynucleotide
taatacgactcactatagggttatttctcactgtacatggtaggatttttaacagaggagaaaaaatatgaccatgtacaacctggcggcagcgcaaaagatg

SEQ ID NO: 70383 - DNA, 103 bp, Artificial Sequence
  Synthetic Polynucleotide
taatacgactcactatagggcatttttatttctcactgtacatggtaggaaacagaggagatcctacatggtacagtgaaacctggcggcagcgcaaaagatg

SEQ ID NO: 70384 - DNA, 103 bp, Artificial Sequence
  Synthetic Polynucleotide
taatacgactcactataggggtctacatttttatttctcactgtacatggaacagaggagaccatgtatggtgagaaataacctggcggcagcgcaaaagatg

SEQ ID NO: 70385 - DNA, 103 bp, Artificial Sequence
  Synthetic Polynucleotide
taatacgactcactatagggccaaagtctacatttttatttctcactgtaaacagaggagatacagtatgaaataaaaaaacctggcggcagcgcaaaagatg

SEQ ID NO: 70386 - DNA, 103 bp, Artificial Sequence
  Synthetic Polynucleotide
taatacgactcactatagggtatatccaaagtctacatttttatttctcaaacagaggagatgagaaatgaaaatgtagaacctggcggcagcgcaaaagatg

SEQ ID NO: 70387 - DNA, 103 bp, Artificial Sequence
  Synthetic Polynucleotide
taatacgactcactatagggatagttatatccaaagtctacatttttattaacagaggagaaataaaatggtagactttaacctggcggcagcgcaaaagatg

SEQ ID NO: 70388 - DNA, 103 bp, Artificial Sequence
  Synthetic Polynucleotide
taatacgactcactatagggtgtccatagttatatccaaagtctacatttaacagaggagaaaatgtatgctttggataaacctggcggcagcgcaaaagatg

SEQ ID NO: 70389 - DNA, 103 bp, Artificial Sequence
  Synthetic Polynucleotide
taatacgactcactatagggtaatatgtccatagttatatccaaagtctaaacagaggagatagactatggatataactaacctggcggcagcgcaaaagatg

SEQ ID NO: 70390 - DNA, 103 bp, Artificial Sequence
  Synthetic Polynucleotide
taatacgactcactatagggggaaataatatgtccatagttatatccaaaaacagaggagatttggaatgaactatggaaacctggcggcagcgcaaaagatg

SEQ ID NO: 70391 - DNA, 103 bp, Artificial Sequence
  Synthetic Polynucleotide
taatacgactcactatagggatattggaaataatatgtccatagttatataacagaggagaatataaatgtggacatataacctggcggcagcgcaaaagatg

SEQ ID NO: 70392 - DNA, 103 bp, Artificial Sequence
  Synthetic Polynucleotide
taatacgactcactatagggaaaaattaattagattcccatatttttattaacagaggagaaataaaatgatgggaatcaacctggcggcagcgcaaaagatg

SEQ ID NO: 70393 - DNA, 103 bp, Artificial Sequence
  Synthetic Polynucleotide
taatacgactcactatagggaaaccatattggaaataatatgtccatagtaacagaggagaactatgatgatattatttaacctggcggcagcgcaaaagatg

SEQ ID NO: 70394 - DNA, 103 bp, Artificial Sequence
  Synthetic Polynucleotide
taatacgactcactatagggtgcataaaccatattggaaataatatgtccaacagaggagaggacatatgatttccaataacctggcggcagcgcaaaagatg

SEQ ID NO: 70395 - DNA, 103 bp, Artificial Sequence
  Synthetic Polynucleotide
taatacgactcactataggggattgtgcataaaccatattggaaataataaacagaggagatattatatgcaatatggtaacctggcggcagcgcaaaagatg

SEQ ID NO: 70396 - DNA, 103 bp, Artificial Sequence
  Synthetic Polynucleotide
taatacgactcactatagggtagtagattgtgcataaaccatattggaaaaacagaggagatttccaatgtggtttatgaacctggcggcagcgcaaaagatg

SEQ ID NO: 70397 - DNA, 103 bp, Artificial Sequence
  Synthetic Polynucleotide
taatacgactcactatagggctgactagtagattgtgcataaaccatattaacagaggagaaatatgatgtatgcacaaaacctggcggcagcgcaaaagatg

SEQ ID NO: 70398 - DNA, 103 bp, Artificial Sequence
  Synthetic Polynucleotide
taatacgactcactatagggtaatcctgactagtagattgtgcataaaccaacagaggagaggtttaatgacaatctacaacctggcggcagcgcaaaagatg

SEQ ID NO: 70399 - DNA, 103 bp, Artificial Sequence
  Synthetic Polynucleotide
taatacgactcactatagggctccataatcctgactagtagattgtgcataacagaggagaatgcacatgctactagtcaacctggcggcagcgcaaaagatg

SEQ ID NO: 70400 - DNA, 103 bp, Artificial Sequence
  Synthetic Polynucleotide
taatacgactcactatagggaccatctccataatcctgactagtagattgaacagaggagacaatctatgagtcaggataacctggcggcagcgcaaaagatg

SEQ ID NO: 70401 - DNA, 103 bp, Artificial Sequence
  Synthetic Polynucleotide
taatacgactcactatagggttggtaccatctccataatcctgactagtaaacagaggagatactagatgggattatggaacctggcggcagcgcaaaagatg

SEQ ID NO: 70402 - DNA, 103 bp, Artificial Sequence
  Synthetic Polynucleotide
taatacgactcactatagggtatagttggtaccatctccataatcctgacaacagaggagagtcaggatgatggagatgaacctggcggcagcgcaaaagatg

SEQ ID NO: 70403 - DNA, 103 bp, Artificial Sequence
  Synthetic Polynucleotide
taatacgactcactatagggtaaggaaaaattaattagattcccatatttaacagaggagaaaatatatgaatctaattaacctggcggcagcgcaaaagatg

SEQ ID NO: 70404 - DNA, 103 bp, Artificial Sequence
  Synthetic Polynucleotide
taatacgactcactatagggaaatgtatagttggtaccatctccataatcaacagaggagagattatatggatggtaccaacctggcggcagcgcaaaagatg

SEQ ID NO: 70405 - DNA, 103 bp, Artificial Sequence
  Synthetic Polynucleotide
taatacgactcactataggggatttaaatgtatagttggtaccatctccaaacagaggagatggagaatgtaccaactaaacctggcggcagcgcaaaagatg

SEQ ID NO: 70406 - DNA, 103 bp, Artificial Sequence
  Synthetic Polynucleotide
taatacgactcactatagggttacagatttaaatgtatagttggtaccataacagaggagaatggtaatgactatacataacctggcggcagcgcaaaagatg

SEQ ID NO: 70407 - DNA, 103 bp, Artificial Sequence
  Synthetic Polynucleotide
taatacgactcactatagggtctatttacagatttaaatgtatagttggtaacagaggagaaccaacatgacatttaaaaacctggcggcagcgcaaaagatg

SEQ ID NO: 70408 - DNA, 103 bp, Artificial Sequence
  Synthetic Polynucleotide
taatacgactcactatagggtcggatctatttacagatttaaatgtatagaacagaggagactatacatgtaaatctgtaacctggcggcagcgcaaaagatg

SEQ ID NO: 70409 - DNA, 103 bp, Artificial Sequence
  Synthetic Polynucleotide
taatacgactcactatagggcatgatcggatctatttacagatttaaatgaacagaggagacatttaatgctgtaaataaacctggcggcagcgcaaaagatg

SEQ ID NO: 70410 - DNA, 103 bp, Artificial Sequence
  Synthetic Polynucleotide
taatacgactcactatagggacactcatgatcggatctatttacagatttaacagaggagaaaatctatgaatagatccaacctggcggcagcgcaaaagatg

SEQ ID NO: 70411 - DNA, 103 bp, Artificial Sequence
  Synthetic Polynucleotide
taatacgactcactataggggattcacactcatgatcggatctatttacaaacagaggagatgtaaaatgatccgatcaaacctggcggcagcgcaaaagatg

SEQ ID NO: 70412 - DNA, 103 bp, Artificial Sequence
  Synthetic Polynucleotide
taatacgactcactatagggaaatagattcacactcatgatcggatctataacagaggagaatagatatgatcatgagtaacctggcggcagcgcaaaagatg

SEQ ID NO: 70413 - DNA, 103 bp, Artificial Sequence
  Synthetic Polynucleotide
taatacgactcactatagggatctaaaatagattcacactcatgatcggaaacagaggagatccgatatggagtgtgaaaacctggcggcagcgcaaaagatg

SEQ ID NO: 70414 - DNA, 103 bp, Artificial Sequence
  Synthetic Polynucleotide
taatacgactcactatagggttgtgtaaggaaaaattaattagattcccaaacagaggagatgggaaatgaattaatttaacctggcggcagcgcaaaagatg

SEQ ID NO: 70415 - DNA, 103 bp, Artificial Sequence
  Synthetic Polynucleotide
taatacgactcactatagggttcaaatctaaaatagattcacactcatgaaacagaggagatcatgaatgtgaatctataacctggcggcagcgcaaaagatg

SEQ ID NO: 70416 - DNA, 103 bp, Artificial Sequence
  Synthetic Polynucleotide
taatacgactcactatagggtagccttcaaatctaaaatagattcacactaacagaggagaagtgtgatgctattttagaacctggcggcagcgcaaaagatg

SEQ ID NO: 70417 - DNA, 103 bp, Artificial Sequence
  Synthetic Polynucleotide
taatacgactcactatagggttccttagccttcaaatctaaaatagattcaacagaggagagaatctatgttagatttgaacctggcggcagcgcaaaagatg

SEQ ID NO: 70418 - DNA, 103 bp, Artificial Sequence
  Synthetic Polynucleotide
taatacgactcactataggggttacttccttagccttcaaatctaaaataaacagaggagatattttatgtttgaaggcaacctggcggcagcgcaaaagatg

SEQ ID NO: 70419 - DNA, 103 bp, Artificial Sequence
  Synthetic Polynucleotide
taatacgactcactatagggtcacagttacttccttagccttcaaatctaaacagaggagatagattatgaggctaaggaacctggcggcagcgcaaaagatg

SEQ ID NO: 70420 - DNA, 103 bp, Artificial Sequence
  Synthetic Polynucleotide
taatacgactcactatagggacacatcacagttacttccttagccttcaaaacagaggagattgaagatgaaggaagtaaacctggcggcagcgcaaaagatg

SEQ ID NO: 70421 - DNA, 103 bp, Artificial Sequence
  Synthetic Polynucleotide
taatacgactcactataggggcgggacacatcacagttacttccttagccaacagaggagaggctaaatgagtaactgtaacctggcggcagcgcaaaagatg

SEQ ID NO: 70422 - DNA, 103 bp, Artificial Sequence
  Synthetic Polynucleotide
taatacgactcactatagggtaaacgcgggacacatcacagttacttcctaacagaggagaaggaagatgctgtgatgtaacctggcggcagcgcaaaagatg

SEQ ID NO: 70423 - DNA, 103 bp, Artificial Sequence
  Synthetic Polynucleotide
taatacgactcactatagggtatactaaacgcgggacacatcacagttacaacagaggagagtaactatgatgtgtcccaacctggcggcagcgcaaaagatg

SEQ ID NO: 70424 - DNA, 103 bp, Artificial Sequence
  Synthetic Polynucleotide
taatacgactcactatagggcttggtatactaaacgcgggacacatcacaaacagaggagatgtgatatgtcccgcgttaacctggcggcagcgcaaaagatg

SEQ ID NO: 70425 - DNA, 103 bp, Artificial Sequence
  Synthetic Polynucleotide
taatacgactcactataggggtcgattgtgtaaggaaaaattaattagataacagaggagaatctaaatgatttttcctaacctggcggcagcgcaaaagatg

SEQ ID NO: 70426 - DNA, 103 bp, Artificial Sequence
  Synthetic Polynucleotide
taatacgactcactatagggtatttcttggtatactaaacgcgggacacaaacagaggagatgtgtcatgcgtttagtaaacctggcggcagcgcaaaagatg

SEQ ID NO: 70427 - DNA, 103 bp, Artificial Sequence
  Synthetic Polynucleotide
taatacgactcactatagggtgatatatttcttggtatactaaacgcgggaacagaggagacccgcgatgagtataccaaacctggcggcagcgcaaaagatg

SEQ ID NO: 70428 - DNA, 103 bp, Artificial Sequence
  Synthetic Polynucleotide
taatacgactcactatagggtacgctgatatatttcttggtatactaaacaacagaggagagtttagatgaccaagaaaaacctggcggcagcgcaaaagatg

SEQ ID NO: 70429 - DNA, 103 bp, Artificial Sequence
  Synthetic Polynucleotide
taatacgactcactatagggcttcatacgctgatatatttcttggtatacaacagaggagagtatacatggaaatatataacctggcggcagcgcaaaagatg

SEQ ID NO: 70430 - DNA, 103 bp, Artificial Sequence
  Synthetic Polynucleotide
taatacgactcactatagggtagaccttcatacgctgatatatttcttggaacagaggagaccaagaatgatatcagcgaacctggcggcagcgcaaaagatg

SEQ ID NO: 70431 - DNA, 103 bp, Artificial Sequence
  Synthetic Polynucleotide
taatacgactcactatagggaagcatagaccttcatacgctgatatatttaacagaggagaaaatatatgagcgtatgaaacctggcggcagcgcaaaagatg

SEQ ID NO: 70432 - DNA, 103 bp, Artificial Sequence
  Synthetic Polynucleotide
taatacgactcactatagggcactaaagcatagaccttcatacgctgataaacagaggagatatcagatgatgaaggtcaacctggcggcagcgcaaaagatg

SEQ ID NO: 70433 - DNA, 103 bp, Artificial Sequence
  Synthetic Polynucleotide
taatacgactcactatagggagtgacactaaagcatagaccttcatacgcaacagaggagagcgtatatgggtctatgcaacctggcggcagcgcaaaagatg

SEQ ID NO: 70434 - DNA, 103 bp, Artificial Sequence
  Synthetic Polynucleotide
taatacgactcactataggggatgtagtgacactaaagcatagaccttcaaacagaggagatgaaggatgatgctttagaacctggcggcagcgcaaaagatg

SEQ ID NO: 70435 - DNA, 103 bp, Artificial Sequence
  Synthetic Polynucleotide
taatacgactcactatagggctttagatgtagtgacactaaagcatagacaacagaggagagtctatatgttagtgtcaaacctggcggcagcgcaaaagatg

SEQ ID NO: 70436 - DNA, 103 bp, Artificial Sequence
  Synthetic Polynucleotide
taatacgactcactatagggtgtacgtcgattgtgtaaggaaaaattaataacagaggagaattaatatgtccttacacaacctggcggcagcgcaaaagatg

SEQ ID NO: 70437 - DNA, 103 bp, Artificial Sequence
  Synthetic Polynucleotide
taatacgactcactatagggatgatctttagatgtagtgacactaaagcaaacagaggagatgctttatggtcactacaaacctggcggcagcgcaaaagatg

SEQ ID NO: 70438 - DNA, 103 bp, Artificial Sequence
  Synthetic Polynucleotide
taatacgactcactataggggcacaatgatctttagatgtagtgacactaaacagaggagatagtgtatgtacatctaaaacctggcggcagcgcaaaagatg

SEQ ID NO: 70439 - DNA, 103 bp, Artificial Sequence
  Synthetic Polynucleotide
taatacgactcactatagggttgaggcacaatgatctttagatgtagtgaaacagaggagatcactaatgctaaagatcaacctggcggcagcgcaaaagatg

SEQ ID NO: 70440 - DNA, 103 bp, Artificial Sequence
  Synthetic Polynucleotide
taatacgactcactatagggcttatttgaggcacaatgatctttagatgtaacagaggagaacatctatggatcattgtaacctggcggcagcgcaaaagatg

SEQ ID NO: 70441 - DNA, 103 bp, Artificial Sequence
  Synthetic Polynucleotide
taatacgactcactatagggcattccttatttgaggcacaatgatctttaaacagaggagataaagaatgttgtgcctcaacctggcggcagcgcaaaagatg

SEQ ID NO: 70442 - DNA, 103 bp, Artificial Sequence
  Synthetic Polynucleotide
taatacgactcactatagggttaaccattccttatttgaggcacaatgataacagaggagaatcattatgcctcaaataaacctggcggcagcgcaaaagatg

SEQ ID NO: 70443 - DNA, 103 bp, Artificial Sequence
  Synthetic Polynucleotide
taatacgactcactatagggagattttaaccattccttatttgaggcacaaacagaggagatgtgccatgaataaggaaaacctggcggcagcgcaaaagatg

SEQ ID NO: 70444 - DNA, 103 bp, Artificial Sequence
  Synthetic Polynucleotide
taatacgactcactatagggccataagattttaaccattccttatttgagaacagaggagactcaaaatgggaatggttaacctggcggcagcgcaaaagatg

SEQ ID NO: 70445 - DNA, 103 bp, Artificial Sequence
  Synthetic Polynucleotide
taatacgactcactatagggcataaccataagattttaaccattccttataacagaggagaataaggatgggttaaaataacctggcggcagcgcaaaagatg

SEQ ID NO: 70446 - DNA, 103 bp, Artificial Sequence
  Synthetic Polynucleotide
taatacgactcactatagggattcccataaccataagattttaaccattcaacagaggagagaatggatgaaatcttataacctggcggcagcgcaaaagatg

SEQ ID NO: 70447 - DNA, 103 bp, Artificial Sequence
  Synthetic Polynucleotide
taatacgactcactatagggactcatgtacgtcgattgtgtaaggaaaaaaacagaggagatttttcatgacacaatcgaacctggcggcagcgcaaaagatg

SEQ ID NO: 70448 - DNA, 103 bp, Artificial Sequence
  Synthetic Polynucleotide
taatacgactcactatagggtctgtattcccataaccataagattttaacaacagaggagagttaaaatgttatggttaaacctggcggcagcgcaaaagatg

SEQ ID NO: 70449 - DNA, 103 bp, Artificial Sequence
  Synthetic Polynucleotide
taatacgactcactatagggtagcatctgtattcccataaccataagattaacagaggagaaatcttatggttatgggaaacctggcggcagcgcaaaagatg

SEQ ID NO: 70450 - DNA, 103 bp, Artificial Sequence
  Synthetic Polynucleotide
taatacgactcactatagggtttagtagcatctgtattcccataaccataaacagaggagatatggtatggggaatacaaacctggcggcagcgcaaaagatg

SEQ ID NO: 70451 - DNA, 103 bp, Artificial Sequence
  Synthetic Polynucleotide
taatacgactcactatagggcgttgtttagtagcatctgtattcccataaaacagaggagattatggatgtacagatgcaacctggcggcagcgcaaaagatg

SEQ ID NO: 70452 - DNA, 103 bp, Artificial Sequence
  Synthetic Polynucleotide
taatacgactcactatagggagacacgttgtttagtagcatctgtattccaacagaggagaggaataatgatgctactaaacctggcggcagcgcaaaagatg

SEQ ID NO: 70453 - DNA, 103 bp, Artificial Sequence
  Synthetic Polynucleotide
taatacgactcactatagggaaaacagacacgttgtttagtagcatctgtaacagaggagaacagatatgactaaacaaaacctggcggcagcgcaaaagatg

SEQ ID NO: 70454 - DNA, 103 bp, Artificial Sequence
  Synthetic Polynucleotide
taatacgactcactatagggtgatgaaaacagacacgttgtttagtagcaaacagaggagatgctacatgacaacgtgtaacctggcggcagcgcaaaagatg

SEQ ID NO: 70455 - DNA, 103 bp, Artificial Sequence
  Synthetic Polynucleotide
taatacgactcactatagggtccaatgatgaaaacagacacgttgtttagaacagaggagactaaacatggtgtctgttaacctggcggcagcgcaaaagatg

SEQ ID NO: 70456 - DNA, 103 bp, Artificial Sequence
  Synthetic Polynucleotide
taatacgactcactatagggataattccaatgatgaaaacagacacgttgaacagaggagacaacgtatgtgttttcataacctggcggcagcgcaaaagatg

SEQ ID NO: 70457 - DNA, 103 bp, Artificial Sequence
  Synthetic Polynucleotide
taatacgactcactataggggtgacataattccaatgatgaaaacagacaaacagaggagatgtctgatgtcatcattgaacctggcggcagcgcaaaagatg

SEQ ID NO: 70458 - DNA, 103 bp, Artificial Sequence
  Synthetic Polynucleotide
taatacgactcactatagggcgacatttttgatggattttgtgtttatgcaacagaggagagcataaatgcaaaatccaaacctggcggcagcgcaaaagatg

SEQ ID NO: 70459 - DNA, 103 bp, Artificial Sequence
  Synthetic Polynucleotide
taatacgactcactatagggctcagactcatgtacgtcgattgtgtaaggaacagaggagaccttacatgatcgacgtaaacctggcggcagcgcaaaagatg

SEQ ID NO: 70460 - DNA, 103 bp, Artificial Sequence
  Synthetic Polynucleotide
taatacgactcactatagggacgttgtgacataattccaatgatgaaaacaacagaggagagttttcatgattggaattaacctggcggcagcgcaaaagatg

SEQ ID NO: 70461 - DNA, 103 bp, Artificial Sequence
  Synthetic Polynucleotide
taatacgactcactatagggcaacgacgttgtgacataattccaatgatgaacagaggagacatcatatgaattatgtcaacctggcggcagcgcaaaagatg

SEQ ID NO: 70462 - DNA, 103 bp, Artificial Sequence
  Synthetic Polynucleotide
taatacgactcactatagggtaatccaacgacgttgtgacataattccaaaacagaggagattggaaatgtgtcacaacaacctggcggcagcgcaaaagatg

SEQ ID NO: 70463 - DNA, 103 bp, Artificial Sequence
  Synthetic Polynucleotide
taatacgactcactatagggagtaataatccaacgacgttgtgacataataacagaggagaattatgatgcaacgtcgtaacctggcggcagcgcaaaagatg

SEQ ID NO: 70464 - DNA, 103 bp, Artificial Sequence
  Synthetic Polynucleotide
taatacgactcactatagggtgaacagtaataatccaacgacgttgtgacaacagaggagagtcacaatgtcgttggataacctggcggcagcgcaaaagatg

SEQ ID NO: 70465 - DNA, 103 bp, Artificial Sequence
  Synthetic Polynucleotide
taatacgactcactatagggtcgtatgaacagtaataatccaacgacgttaacagaggagaaacgtcatgggattattaaacctggcggcagcgcaaaagatg

SEQ ID NO: 70466 - DNA, 103 bp, Artificial Sequence
  Synthetic Polynucleotide
taatacgactcactatagggtatcttcgtatgaacagtaataatccaacgaacagaggagacgttggatgattactgttaacctggcggcagcgcaaaagatg

SEQ ID NO: 70467 - DNA, 103 bp, Artificial Sequence
  Synthetic Polynucleotide
taatacgactcactatagggccaaatatcttcgtatgaacagtaataatcaacagaggagagattatatgtgttcatacaacctggcggcagcgcaaaagatg

SEQ ID NO: 70468 - DNA, 103 bp, Artificial Sequence
  Synthetic Polynucleotide
taatacgactcactatagggcttttccaaatatcttcgtatgaacagtaaaacagaggagattactgatgatacgaagaaacctggcggcagcgcaaaagatg

SEQ ID NO: 70469 - DNA, 103 bp, Artificial Sequence
  Synthetic Polynucleotide
taatacgactcactatagggagtcgcttttccaaatatcttcgtatgaacaacagaggagagttcatatgaagatatttaacctggcggcagcgcaaaagatg

SEQ ID NO: 70470 - DNA, 103 bp, Artificial Sequence
  Synthetic Polynucleotide
taatacgactcactatagggaggaactcagactcatgtacgtcgattgtgaacagaggagacacaatatgcgtacatgaaacctggcggcagcgcaaaagatg

SEQ ID NO: 70471 - DNA, 103 bp, Artificial Sequence
  Synthetic Polynucleotide
taatacgactcactatagggaggccagtcgcttttccaaatatcttcgtaaacagaggagatacgaaatgatttggaaaaacctggcggcagcgcaaaagatg

SEQ ID NO: 70472 - DNA, 103 bp, Artificial Sequence
  Synthetic Polynucleotide
taatacgactcactatagggtagtcaggccagtcgcttttccaaatatctaacagaggagaagatatatggaaaagcgaaacctggcggcagcgcaaaagatg

SEQ ID NO: 70473 - DNA, 103 bp, Artificial Sequence
  Synthetic Polynucleotide
taatacgactcactataggggatcatagtcaggccagtcgcttttccaaaaacagaggagatttggaatggcgactggcaacctggcggcagcgcaaaagatg

SEQ ID NO: 70474 - DNA, 103 bp, Artificial Sequence
  Synthetic Polynucleotide
taatacgactcactatagggacatggatcatagtcaggccagtcgcttttaacagaggagaaaaagcatgtggcctgacaacctggcggcagcgcaaaagatg

SEQ ID NO: 70475 - DNA, 103 bp, Artificial Sequence
  Synthetic Polynucleotide
taatacgactcactataggggacttacatggatcatagtcaggccagtcgaacagaggagacgactgatgtgactatgaaacctggcggcagcgcaaaagatg

SEQ ID NO: 70476 - DNA, 103 bp, Artificial Sequence
  Synthetic Polynucleotide
taatacgactcactatagggtatatgacttacatggatcatagtcaggccaacagaggagaggcctgatgatgatccataacctggcggcagcgcaaaagatg

SEQ ID NO: 70477 - DNA, 103 bp, Artificial Sequence
  Synthetic Polynucleotide
taatacgactcactatagggataaatatatgacttacatggatcatagtcaacagaggagagactatatgccatgtaagaacctggcggcagcgcaaaagatg

SEQ ID NO: 70478 - DNA, 103 bp, Artificial Sequence
  Synthetic Polynucleotide
taatacgactcactatagggtctatataaatatatgacttacatggatcaaacagaggagatgatccatgtaagtcataaacctggcggcagcgcaaaagatg

SEQ ID NO: 70479 - DNA, 103 bp, Artificial Sequence
  Synthetic Polynucleotide
taatacgactcactatagggtatactctatataaatatatgacttacatgaacagaggagacatgtaatgcatatatttaacctggcggcagcgcaaaagatg

SEQ ID NO: 70480 - DNA, 103 bp, Artificial Sequence
  Synthetic Polynucleotide
taatacgactcactataggggtctctatactctatataaatatatgacttaacagaggagaaagtcaatgatttatataaacctggcggcagcgcaaaagatg

SEQ ID NO: 70481 - DNA, 103 bp, Artificial Sequence
  Synthetic Polynucleotide
taatacgactcactatagggaaacaaggaactcagactcatgtacgtcgaaacagaggagatcgacgatgatgagtctgaacctggcggcagcgcaaaagatg

SEQ ID NO: 70482 - DNA, 103 bp, Artificial Sequence
  Synthetic Polynucleotide
taatacgactcactatagggcatatgtctctatactctatataaatatataacagaggagaatatatatgtatagagtaaacctggcggcagcgcaaaagatg

SEQ ID NO: 70483 - DNA, 103 bp, Artificial Sequence
  Synthetic Polynucleotide
taatacgactcactatagggctatccatatgtctctatactctatataaaaacagaggagatttataatgagtatagagaacctggcggcagcgcaaaagatg

SEQ ID NO: 70484 - DNA, 103 bp, Artificial Sequence
  Synthetic Polynucleotide
taatacgactcactatagggagattctatccatatgtctctatactctataacagaggagaatagagatgagagacataaacctggcggcagcgcaaaagatg

SEQ ID NO: 70485 - DNA, 103 bp, Artificial Sequence
  Synthetic Polynucleotide
taatacgactcactatagggactttagattctatccatatgtctctatacaacagaggagagtatagatgcatatggataacctggcggcagcgcaaaagatg

SEQ ID NO: 70486 - DNA, 103 bp, Artificial Sequence
  Synthetic Polynucleotide
taatacgactcactataggggcaacactttagattctatccatatgtctcaacagaggagagagacaatgggatagaataacctggcggcagcgcaaaagatg

SEQ ID NO: 70487 - DNA, 103 bp, Artificial Sequence
  Synthetic Polynucleotide
taatacgactcactatagggttgctgcaacactttagattctatccatataacagaggagaatatggatggaatctaaaaacctggcggcagcgcaaaagatg

SEQ ID NO: 70488 - DNA, 103 bp, Artificial Sequence
  Synthetic Polynucleotide
taatacgactcactatagggggaggttgctgcaacactttagattctatcaacagaggagagatagaatgtaaagtgttaacctggcggcagcgcaaaagatg

SEQ ID NO: 70489 - DNA, 103 bp, Artificial Sequence
  Synthetic Polynucleotide
taatacgactcactatagggtataaggaggttgctgcaacactttagattaacagaggagaaatctaatgtgttgcagcaacctggcggcagcgcaaaagatg

SEQ ID NO: 70490 - DNA, 103 bp, Artificial Sequence
  Synthetic Polynucleotide
taatacgactcactataggggaatgtataaggaggttgctgcaacactttaacagaggagaaaagtgatgcagcaacctaacctggcggcagcgcaaaagatg

SEQ ID NO: 70491 - DNA, 103 bp, Artificial Sequence
  Synthetic Polynucleotide
taatacgactcactatagggaattcgaatgtataaggaggttgctgcaacaacagaggagagttgcaatgacctccttaaacctggcggcagcgcaaaagatg

SEQ ID NO: 70492 - DNA, 103 bp, Artificial Sequence
  Synthetic Polynucleotide
taatacgactcactatagggagcaaaaacaaggaactcagactcatgtacaacagaggagagtacatatgtctgagttcaacctggcggcagcgcaaaagatg

SEQ ID NO: 70493 - DNA, 103 bp, Artificial Sequence
  Synthetic Polynucleotide
taatacgactcactataggggtgtgaattcgaatgtataaggaggttgctaacagaggagaagcaacatgcttatacataacctggcggcagcgcaaaagatg

SEQ ID NO: 70494 - DNA, 103 bp, Artificial Sequence
  Synthetic Polynucleotide
taatacgactcactataggggtcatgtgtgaattcgaatgtataaggaggaacagaggagacctcctatgacattcgaaaacctggcggcagcgcaaaagatg

SEQ ID NO: 70495 - DNA, 103 bp, Artificial Sequence
  Synthetic Polynucleotide
taatacgactcactataggggaatcgtcatgtgtgaattcgaatgtataaaacagaggagattatacatgcgaattcacaacctggcggcagcgcaaaagatg

SEQ ID NO: 70496 - DNA, 103 bp, Artificial Sequence
  Synthetic Polynucleotide
taatacgactcactatagggcattagaatcgtcatgtgtgaattcgaatgaacagaggagacattcgatgtcacacatgaacctggcggcagcgcaaaagatg

SEQ ID NO: 70497 - DNA, 103 bp, Artificial Sequence
  Synthetic Polynucleotide
taatacgactcactataggggtattcattagaatcgtcatgtgtgaattcaacagaggagagaattcatgcatgacgataacctggcggcagcgcaaaagatg

SEQ ID NO: 70498 - DNA, 103 bp, Artificial Sequence
  Synthetic Polynucleotide
taatacgactcactatagggttcacgtattcattagaatcgtcatgtgtgaacagaggagacacacaatgcgattctaaaacctggcggcagcgcaaaagatg

SEQ ID NO: 70499 - DNA, 103 bp, Artificial Sequence
  Synthetic Polynucleotide
taatacgactcactatagggctttattcacgtattcattagaatcgtcataacagaggagaatgacgatgctaatgaataacctggcggcagcgcaaaagatg

SEQ ID NO: 70500 - DNA, 103 bp, Artificial Sequence
  Synthetic Polynucleotide
taatacgactcactatagggaatttctttattcacgtattcattagaatcaacagaggagagattctatggaatacgtgaacctggcggcagcgcaaaagatg

SEQ ID NO: 70501 - DNA, 103 bp, Artificial Sequence
  Synthetic Polynucleotide
taatacgactcactatagggttactaatttctttattcacgtattcattaaacagaggagataatgaatgcgtgaataaaacctggcggcagcgcaaaagatg

SEQ ID NO: 70502 - DNA, 103 bp, Artificial Sequence
  Synthetic Polynucleotide
taatacgactcactatagggatttgttactaatttctttattcacgtattaacagaggagaaatacgatgataaagaaaaacctggcggcagcgcaaaagatg

SEQ ID NO: 70503 - DNA, 103 bp, Artificial Sequence
  Synthetic Polynucleotide
taatacgactcactatagggtaattagcaaaaacaaggaactcagactcaaacagaggagatgagtcatggttccttgtaacctggcggcagcgcaaaagatg

SEQ ID NO: 70504 - DNA, 103 bp, Artificial Sequence
  Synthetic Polynucleotide
taatacgactcactatagggattcaatttgttactaatttctttattcacaacagaggagagtgaatatggaaattagtaacctggcggcagcgcaaaagatg

SEQ ID NO: 70505 - DNA, 103 bp, Artificial Sequence
  Synthetic Polynucleotide
taatacgactcactatagggagatcattcaatttgttactaatttctttaaacagaggagataaagaatgtagtaacaaaacctggcggcagcgcaaaagatg

SEQ ID NO: 70506 - DNA, 103 bp, Artificial Sequence
  Synthetic Polynucleotide
taatacgactcactatagggtgtacagatcattcaatttgttactaatttaacagaggagaaaattaatgacaaattgaaacctggcggcagcgcaaaagatg

SEQ ID NO: 70507 - DNA, 103 bp, Artificial Sequence
  Synthetic Polynucleotide
taatacgactcactatagggttcattgtacagatcattcaatttgttactaacagaggagaagtaacatgttgaatgataacctggcggcagcgcaaaagatg

SEQ ID NO: 70508 - DNA, 103 bp, Artificial Sequence
  Synthetic Polynucleotide
taatacgactcactatagggttgtattcattgtacagatcattcaatttgaacagaggagacaaattatgtgatctgtaaacctggcggcagcgcaaaagatg

SEQ ID NO: 70509 - DNA, 103 bp, Artificial Sequence
  Synthetic Polynucleotide
taatacgactcactatagggtgttcttgtattcattgtacagatcattcaaacagaggagatgaatgatgtgtacaatgaacctggcggcagcgcaaaagatg

SEQ ID NO: 70510 - DNA, 103 bp, Artificial Sequence
  Synthetic Polynucleotide
taatacgactcactatagggcataatgttcttgtattcattgtacagatcaacagaggagagatctgatgaatgaatacaacctggcggcagcgcaaaagatg

SEQ ID NO: 70511 - DNA, 103 bp, Artificial Sequence
  Synthetic Polynucleotide
taatacgactcactatagggtattccataatgttcttgtattcattgtacaacagaggagagtacaaatgatacaagaaaacctggcggcagcgcaaaagatg

SEQ ID NO: 70512 - DNA, 103 bp, Artificial Sequence
  Synthetic Polynucleotide
taatacgactcactatagggcgctatattccataatgttcttgtattcataacagaggagaatgaatatgagaacattaaacctggcggcagcgcaaaagatg

SEQ ID NO: 70513 - DNA, 103 bp, Artificial Sequence
  Synthetic Polynucleotide
taatacgactcactatagggtccgtcgctatattccataatgttcttgtaaacagaggagatacaagatgattatggaaaacctggcggcagcgcaaaagatg

SEQ ID NO: 70514 - DNA, 103 bp, Artificial Sequence
  Synthetic Polynucleotide
taatacgactcactatagggtgaaataattagcaaaaacaaggaactcagaacagaggagactgagtatgttgtttttgaacctggcggcagcgcaaaagatg

SEQ ID NO: 70515 - DNA, 103 bp, Artificial Sequence
  Synthetic Polynucleotide
taatacgactcactatagggaatgatccgtcgctatattccataatgttcaacagaggagagaacatatgggaatatagaacctggcggcagcgcaaaagatg

SEQ ID NO: 70516 - DNA, 103 bp, Artificial Sequence
  Synthetic Polynucleotide
taatacgactcactatagggcaggcaatgatccgtcgctatattccataaaacagaggagattatggatgatagcgacgaacctggcggcagcgcaaaagatg

SEQ ID NO: 70517 - DNA, 103 bp, Artificial Sequence
  Synthetic Polynucleotide
taatacgactcactatagggagaagcaggcaatgatccgtcgctatattcaacagaggagagaatatatggacggatcaaacctggcggcagcgcaaaagatg

SEQ ID NO: 70518 - DNA, 103 bp, Artificial Sequence
  Synthetic Polynucleotide
taatacgactcactatagggtttatagaagcaggcaatgatccgtcgctaaacagaggagatagcgaatgatcattgccaacctggcggcagcgcaaaagatg

SEQ ID NO: 70519 - DNA, 103 bp, Artificial Sequence
  Synthetic Polynucleotide
taatacgactcactatagggatctgtttatagaagcaggcaatgatccgtaacagaggagaacggatatgtgcctgcttaacctggcggcagcgcaaaagatg

SEQ ID NO: 70520 - DNA, 103 bp, Artificial Sequence
  Synthetic Polynucleotide
taatacgactcactatagggtgctaatctgtttatagaagcaggcaatgaaacagaggagatcattgatggcttctataaacctggcggcagcgcaaaagatg

SEQ ID NO: 70521 - DNA, 103 bp, Artificial Sequence
  Synthetic Polynucleotide
taatacgactcactataggggattttgctaatctgtttatagaagcaggcaacagaggagagcctgcatgtataaacagaacctggcggcagcgcaaaagatg

SEQ ID NO: 70522 - DNA, 103 bp, Artificial Sequence
  Synthetic Polynucleotide
taatacgactcactatagggttaatgattttgctaatctgtttatagaagaacagaggagacttctaatgacagattagaacctggcggcagcgcaaaagatg

SEQ ID NO: 70523 - DNA, 103 bp, Artificial Sequence
  Synthetic Polynucleotide
taatacgactcactatagggtgaagttaatgattttgctaatctgtttataacagaggagaataaacatgttagcaaaaaacctggcggcagcgcaaaagatg

SEQ ID NO: 70524 - DNA, 103 bp, Artificial Sequence
  Synthetic Polynucleotide
taatacgactcactatagggccctctgaagttaatgattttgctaatctgaacagaggagacagattatgaaaatcattaacctggcggcagcgcaaaagatg

SEQ ID NO: 70525 - DNA, 103 bp, Artificial Sequence
  Synthetic Polynucleotide
taatacgactcactatagggttggatgaaataattagcaaaaacaaggaaaacagaggagattccttatgtttgctaataacctggcggcagcgcaaaagatg

SEQ ID NO: 70526 - DNA, 103 bp, Artificial Sequence
  Synthetic Polynucleotide
taatacgactcactatagggctctaccctctgaagttaatgattttgctaaacagaggagatagcaaatgcattaacttaacctggcggcagcgcaaaagatg

SEQ ID NO: 70527 - DNA, 103 bp, Artificial Sequence
  Synthetic Polynucleotide
taatacgactcactatagggtatttctctaccctctgaagttaatgatttaacagaggagaaaatcaatgacttcagagaacctggcggcagcgcaaaagatg

SEQ ID NO: 70528 - DNA, 103 bp, Artificial Sequence
  Synthetic Polynucleotide
taatacgactcactatagggcttgctatttctctaccctctgaagttaataacagaggagaattaacatgagagggtagaacctggcggcagcgcaaaagatg

SEQ ID NO: 70529 - DNA, 103 bp, Artificial Sequence
  Synthetic Polynucleotide
taatacgactcactatagggtaacacttgctatttctctaccctctgaagaacagaggagacttcagatggtagagaaaaacctggcggcagcgcaaaagatg

SEQ ID NO: 70530 - DNA, 103 bp, Artificial Sequence
  Synthetic Polynucleotide
taatacgactcactatagggtatattaacacttgctatttctctaccctcaacagaggagagagggtatggaaatagcaaacctggcggcagcgcaaaagatg

SEQ ID NO: 70531 - DNA, 103 bp, Artificial Sequence
  Synthetic Polynucleotide
taatacgactcactatagggccatctatattaacacttgctatttctctaaacagaggagatagagaatgagcaagtgtaacctggcggcagcgcaaaagatg

SEQ ID NO: 70532 - DNA, 103 bp, Artificial Sequence
  Synthetic Polynucleotide
taatacgactcactataggggattaccatctatattaacacttgctatttaacagaggagaaaatagatggtgttaataaacctggcggcagcgcaaaagatg

SEQ ID NO: 70533 - DNA, 103 bp, Artificial Sequence
  Synthetic Polynucleotide
taatacgactcactatagggtaacagattaccatctatattaacacttgcaacagaggagagcaagtatgaatatagataacctggcggcagcgcaaaagatg

SEQ ID NO: 70534 - DNA, 103 bp, Artificial Sequence
  Synthetic Polynucleotide
taatacgactcactatagggatatctaacagattaccatctatattaacaaacagaggagatgttaaatgagatggtaaaacctggcggcagcgcaaaagatg

SEQ ID NO: 70535 - DNA, 103 bp, Artificial Sequence
  Synthetic Polynucleotide
taatacgactcactatagggatgcaatatctaacagattaccatctatataacagaggagaatatagatggtaatctgtaacctggcggcagcgcaaaagatg

SEQ ID NO: 70536 - DNA, 103 bp, Artificial Sequence
  Synthetic Polynucleotide
taatacgactcactatagggataaattggatgaaataattagcaaaaacaaacagaggagatgttttatgtaattatttaacctggcggcagcgcaaaagatg

SEQ ID NO: 70537 - DNA, 103 bp, Artificial Sequence
  Synthetic Polynucleotide
taatacgactcactatagggttgatatgcaatatctaacagattaccatcaacagaggagagatggtatgctgttagataacctggcggcagcgcaaaagatg

SEQ ID NO: 70538 - DNA, 103 bp, Artificial Sequence
  Synthetic Polynucleotide
taatacgactcactatagggtctgcttgatatgcaatatctaacagattaaacagaggagataatctatgagatattgcaacctggcggcagcgcaaaagatg

SEQ ID NO: 70539 - DNA, 103 bp, Artificial Sequence
  Synthetic Polynucleotide
taatacgactcactatagggccttatctgcttgatatgcaatatctaacaaacagaggagatgttagatgttgcatatcaacctggcggcagcgcaaaagatg

SEQ ID NO: 70540 - DNA, 103 bp, Artificial Sequence
  Synthetic Polynucleotide
taatacgactcactatagggcttttccttatctgcttgatatgcaatatcaacagaggagagatattatgtatcaagcaaacctggcggcagcgcaaaagatg

SEQ ID NO: 70541 - DNA, 103 bp, Artificial Sequence
  Synthetic Polynucleotide
taatacgactcactataggggccatcttttccttatctgcttgatatgcaaacagaggagatgcataatgagcagataaaacctggcggcagcgcaaaagatg

SEQ ID NO: 70542 - DNA, 103 bp, Artificial Sequence
  Synthetic Polynucleotide
taatacgactcactatagggtatcagccatcttttccttatctgcttgataacagaggagaatcaagatgataaggaaaaacctggcggcagcgcaaaagatg

SEQ ID NO: 70543 - DNA, 103 bp, Artificial Sequence
  Synthetic Polynucleotide
taatacgactcactatagggctgtatatcagccatcttttccttatctgcaacagaggagagcagatatggaaaagatgaacctggcggcagcgcaaaagatg

SEQ ID NO: 70544 - DNA, 103 bp, Artificial Sequence
  Synthetic Polynucleotide
taatacgactcactatagggttgttctgtatatcagccatcttttccttaaacagaggagataaggaatggatggctgaaacctggcggcagcgcaaaagatg

SEQ ID NO: 70545 - DNA, 103 bp, Artificial Sequence
  Synthetic Polynucleotide
taatacgactcactatagggttattttgttctgtatatcagccatcttttaacagaggagaaaaagaatgctgatatacaacctggcggcagcgcaaaagatg

SEQ ID NO: 70546 - DNA, 103 bp, Artificial Sequence
  Synthetic Polynucleotide
taatacgactcactataggggtcatttattttgttctgtatatcagccataacagaggagaatggctatgatacagaacaacctggcggcagcgcaaaagatg

SEQ ID NO: 70547 - DNA, 103 bp, Artificial Sequence
  Synthetic Polynucleotide
taatacgactcactatagggaaataataaattggatgaaataattagcaaaacagaggagattgctaatgatttcatccaacctggcggcagcgcaaaagatg

SEQ ID NO: 70548 - DNA, 103 bp, Artificial Sequence
  Synthetic Polynucleotide
taatacgactcactataggggtgatgtcatttattttgttctgtatatcaaacagaggagatgatatatggaacaaaataacctggcggcagcgcaaaagatg

SEQ ID NO: 70549 - DNA, 103 bp, Artificial Sequence
  Synthetic Polynucleotide
taatacgactcactatagggctcttgtgatgtcatttattttgttctgtaaacagaggagatacagaatgaaataaatgaacctggcggcagcgcaaaagatg

SEQ ID NO: 70550 - DNA, 103 bp, Artificial Sequence
  Synthetic Polynucleotide
taatacgactcactatagggtaaatctcttgtgatgtcatttattttgttaacagaggagaaacaaaatgaatgacatcaacctggcggcagcgcaaaagatg

SEQ ID NO: 70551 - DNA, 103 bp, Artificial Sequence
  Synthetic Polynucleotide
taatacgactcactatagggatgaataaatctcttgtgatgtcatttattaacagaggagaaataaaatgcatcacaagaacctggcggcagcgcaaaagatg

SEQ ID NO: 70552 - DNA, 103 bp, Artificial Sequence
  Synthetic Polynucleotide
taatacgactcactatagggtgtgaatgaataaatctcttgtgatgtcataacagaggagaatgacaatgcaagagattaacctggcggcagcgcaaaagatg

SEQ ID NO: 70553 - DNA, 103 bp, Artificial Sequence
  Synthetic Polynucleotide
taatacgactcactatagggtaaagtgtgaatgaataaatctcttgtgataacagaggagaatcacaatggatttattcaacctggcggcagcgcaaaagatg

SEQ ID NO: 70554 - DNA, 103 bp, Artificial Sequence
  Synthetic Polynucleotide
taatacgactcactatagggtttgataaagtgtgaatgaataaatctcttaacagaggagaaagagaatgattcattcaaacctggcggcagcgcaaaagatg

SEQ ID NO: 70555 - DNA, 103 bp, Artificial Sequence
  Synthetic Polynucleotide
taatacgactcactatagggctttgtttgataaagtgtgaatgaataaataacagaggagaatttatatgttcacacttaacctggcggcagcgcaaaagatg

SEQ ID NO: 70556 - DNA, 103 bp, Artificial Sequence
  Synthetic Polynucleotide
taatacgactcactatagggtatatctttgtttgataaagtgtgaatgaaaacagaggagattcattatgactttatcaaacctggcggcagcgcaaaagatg

SEQ ID NO: 70557 - DNA, 103 bp, Artificial Sequence
  Synthetic Polynucleotide
taatacgactcactatagggtcttttatatctttgtttgataaagtgtgaaacagaggagatcacacatgatcaaacaaaacctggcggcagcgcaaaagatg

SEQ ID NO: 70558 - DNA, 103 bp, Artificial Sequence
  Synthetic Polynucleotide
taatacgactcactataggggtcaaaaataataaattggatgaaataattaacagaggagaaattatatgatccaatttaacctggcggcagcgcaaaagatg

SEQ ID NO: 70559 - DNA, 103 bp, Artificial Sequence
  Synthetic Polynucleotide
taatacgactcactatagggtaatgtcttttatatctttgtttgataaagaacagaggagactttatatgacaaagataaacctggcggcagcgcaaaagatg

SEQ ID NO: 70560 - DNA, 103 bp, Artificial Sequence
  Synthetic Polynucleotide
taatacgactcactatagggttctataatgtcttttatatctttgtttgaaacagaggagatcaaacatggatataaaaaacctggcggcagcgcaaaagatg

SEQ ID NO: 70561 - DNA, 103 bp, Artificial Sequence
  Synthetic Polynucleotide
taatacgactcactatagggtcggattctataatgtcttttatatctttgaacagaggagacaaagaatgaaaagacataacctggcggcagcgcaaaagatg

SEQ ID NO: 70562 - DNA, 103 bp, Artificial Sequence
  Synthetic Polynucleotide
taatacgactcactatagggcttcttcggattctataatgtcttttatataacagaggagaatataaatgacattatagaacctggcggcagcgcaaaagatg

SEQ ID NO: 70563 - DNA, 103 bp, Artificial Sequence
  Synthetic Polynucleotide
taatacgactcactatagggcttaccttcttcggattctataatgtctttaacagaggagaaaagacatgatagaatccaacctggcggcagcgcaaaagatg

SEQ ID NO: 70564 - DNA, 103 bp, Artificial Sequence
  Synthetic Polynucleotide
taatacgactcactatagggcatctcttaccttcttcggattctataatgaacagaggagacattatatgatccgaagaaacctggcggcagcgcaaaagatg

SEQ ID NO: 70565 - DNA, 103 bp, Artificial Sequence
  Synthetic Polynucleotide
taatacgactcactatagggtacaacatctcttaccttcttcggattctaaacagaggagatagaatatgaagaaggtaaacctggcggcagcgcaaaagatg

SEQ ID NO: 70566 - DNA, 103 bp, Artificial Sequence
  Synthetic Polynucleotide
taatacgactcactatagggtattatacaacatctcttaccttcttcggaaacagaggagatccgaaatgggtaagagaaacctggcggcagcgcaaaagatg

SEQ ID NO: 70567 - DNA, 103 bp, Artificial Sequence
  Synthetic Polynucleotide
taatacgactcactatagggacatctattatacaacatctcttaccttctaacagaggagaagaaggatggagatgttgaacctggcggcagcgcaaaagatg

SEQ ID NO: 70568 - DNA, 103 bp, Artificial Sequence
  Synthetic Polynucleotide
taatacgactcactatagggtcttaacatctattatacaacatctcttacaacagaggagagtaagaatggttgtataaaacctggcggcagcgcaaaagatg

SEQ ID NO: 70569 - DNA, 103 bp, Artificial Sequence
  Synthetic Polynucleotide
taatacgactcactatagggttcatcgacatttttgatggattttgtgttaacagaggagaaacacaatgtccatcaaaaacctggcggcagcgcaaaagatg

SEQ ID NO: 70570 - DNA, 103 bp, Artificial Sequence
  Synthetic Polynucleotide
taatacgactcactatagggacatcgtcaaaaataataaattggatgaaaaacagaggagatttcatatgatttattataacctggcggcagcgcaaaagatg

SEQ ID NO: 70571 - DNA, 103 bp, Artificial Sequence
  Synthetic Polynucleotide
taatacgactcactatagggattgttcttaacatctattatacaacatctaacagaggagaagatgtatgataatagataacctggcggcagcgcaaaagatg

SEQ ID NO: 70572 - DNA, 103 bp, Artificial Sequence
  Synthetic Polynucleotide
taatacgactcactatagggacacgattgttcttaacatctattatacaaaacagaggagattgtatatgagatgttaaaacctggcggcagcgcaaaagatg

SEQ ID NO: 70573 - DNA, 103 bp, Artificial Sequence
  Synthetic Polynucleotide
taatacgactcactatagggttttaacacgattgttcttaacatctattaaacagaggagataatagatgttaagaacaaacctggcggcagcgcaaaagatg

SEQ ID NO: 70574 - DNA, 103 bp, Artificial Sequence
  Synthetic Polynucleotide
taatacgactcactataggggtactttttaacacgattgttcttaacatcaacagaggagagatgttatgaacaatcgtaacctggcggcagcgcaaaagatg

SEQ ID NO: 70575 - DNA, 103 bp, Artificial Sequence
  Synthetic Polynucleotide
taatacgactcactatagggggatagtactttttaacacgattgttcttaaacagaggagataagaaatgtcgtgttaaaacctggcggcagcgcaaaagatg

SEQ ID NO: 70576 - DNA, 103 bp, Artificial Sequence
  Synthetic Polynucleotide
taatacgactcactatagggcaataggatagtactttttaacacgattgtaacagaggagaacaatcatgttaaaaagtaacctggcggcagcgcaaaagatg

SEQ ID NO: 70577 - DNA, 103 bp, Artificial Sequence
  Synthetic Polynucleotide
taatacgactcactatagggattatcaataggatagtactttttaacacgaacagaggagacgtgttatgaagtactataacctggcggcagcgcaaaagatg

SEQ ID NO: 70578 - DNA, 103 bp, Artificial Sequence
  Synthetic Polynucleotide
taatacgactcactatagggagataattatcaataggatagtactttttaaacagaggagataaaaaatgctatcctataacctggcggcagcgcaaaagatg

SEQ ID NO: 70579 - DNA, 103 bp, Artificial Sequence
  Synthetic Polynucleotide
taatacgactcactatagggcacatagataattatcaataggatagtactaacagaggagaagtactatgctattgataaacctggcggcagcgcaaaagatg

SEQ ID NO: 70580 - DNA, 103 bp, Artificial Sequence
  Synthetic Polynucleotide
taatacgactcactatagggagtaccacatagataattatcaataggataaacagaggagatatcctatggataattataacctggcggcagcgcaaaagatg

SEQ ID NO: 70581 - DNA, 103 bp, Artificial Sequence
  Synthetic Polynucleotide
taatacgactcactatagggtcttgacatcgtcaaaaataataaattggaaacagaggagatccaatatgttatttttgaacctggcggcagcgcaaaagatg

SEQ ID NO: 70582 - DNA, 103 bp, Artificial Sequence
  Synthetic Polynucleotide
taatacgactcactatagggtctaaagtaccacatagataattatcaataaacagaggagatattgaatgttatctatgaacctggcggcagcgcaaaagatg

SEQ ID NO: 70583 - DNA, 103 bp, Artificial Sequence
  Synthetic Polynucleotide
taatacgactcactatagggaatcatctaaagtaccacatagataattataacagaggagaataattatgtatgtggtaaacctggcggcagcgcaaaagatg

SEQ ID NO: 70584 - DNA, 103 bp, Artificial Sequence
  Synthetic Polynucleotide
taatacgactcactatagggtatataatcatctaaagtaccacatagataaacagaggagatatctaatgggtactttaaacctggcggcagcgcaaaagatg

SEQ ID NO: 70585 - DNA, 103 bp, Artificial Sequence
  Synthetic Polynucleotide
taatacgactcactataggggtgtatatataatcatctaaagtaccacataacagaggagaatgtggatgtttagatgaaacctggcggcagcgcaaaagatg

SEQ ID NO: 70586 - DNA, 103 bp, Artificial Sequence
  Synthetic Polynucleotide
taatacgactcactatagggcagaagtgtatatataatcatctaaagtacaacagaggagagtacttatgatgattataaacctggcggcagcgcaaaagatg

SEQ ID NO: 70587 - DNA, 103 bp, Artificial Sequence
  Synthetic Polynucleotide
taatacgactcactatagggttctacagaagtgtatatataatcatctaaaacagaggagattagatatgtatatatacaacctggcggcagcgcaaaagatg

SEQ ID NO: 70588 - DNA, 103 bp, Artificial Sequence
  Synthetic Polynucleotide
taatacgactcactatagggttatattctacagaagtgtatatataatcaaacagaggagatgattaatgatacacttcaacctggcggcagcgcaaaagatg

SEQ ID NO: 70589 - DNA, 103 bp, Artificial Sequence
  Synthetic Polynucleotide
taatacgactcactatagggatttgttatattctacagaagtgtatatataacagaggagaatatatatgcttctgtagaacctggcggcagcgcaaaagatg

SEQ ID NO: 70590 - DNA, 103 bp, Artificial Sequence
  Synthetic Polynucleotide
taatacgactcactatagggataggatttgttatattctacagaagtgtaaacagaggagatacactatggtagaatataacctggcggcagcgcaaaagatg

SEQ ID NO: 70591 - DNA, 103 bp, Artificial Sequence
  Synthetic Polynucleotide
taatacgactcactatagggaacacataggatttgttatattctacagaaaacagaggagattctgtatgatataacaaaacctggcggcagcgcaaaagatg

SEQ ID NO: 70592 - DNA, 103 bp, Artificial Sequence
  Synthetic Polynucleotide
taatacgactcactatagggaaagatcttgacatcgtcaaaaataataaaaacagaggagatttattatgtttgacgataacctggcggcagcgcaaaagatg

SEQ ID NO: 70593 - DNA, 103 bp, Artificial Sequence
  Synthetic Polynucleotide
taatacgactcactatagggttattaacacataggatttgttatattctaaacagaggagatagaatatgacaaatcctaacctggcggcagcgcaaaagatg

SEQ ID NO: 70594 - DNA, 103 bp, Artificial Sequence
  Synthetic Polynucleotide
taatacgactcactataggggtcgtttattaacacataggatttgttataaacagaggagatataacatgtcctatgtgaacctggcggcagcgcaaaagatg

SEQ ID NO: 70595 - DNA, 103 bp, Artificial Sequence
  Synthetic Polynucleotide
taatacgactcactatagggtaagtgtcgtttattaacacataggatttgaacagaggagacaaatcatgtgtgttaataacctggcggcagcgcaaaagatg

SEQ ID NO: 70596 - DNA, 103 bp, Artificial Sequence
  Synthetic Polynucleotide
taatacgactcactatagggtcatgtaagtgtcgtttattaacacataggaacagaggagacctatgatgtaataaacgaacctggcggcagcgcaaaagatg

SEQ ID NO: 70597 - DNA, 103 bp, Artificial Sequence
  Synthetic Polynucleotide
taatacgactcactatagggatagctcatgtaagtgtcgtttattaacacaacagaggagagtgttaatgaacgacactaacctggcggcagcgcaaaagatg

SEQ ID NO: 70598 - DNA, 103 bp, Artificial Sequence
  Synthetic Polynucleotide
taatacgactcactatagggtagtcatagctcatgtaagtgtcgtttattaacagaggagaaataaaatgcacttacataacctggcggcagcgcaaaagatg

SEQ ID NO: 70599 - DNA, 103 bp, Artificial Sequence
  Synthetic Polynucleotide
taatacgactcactatagggcaagatagtcatagctcatgtaagtgtcgtaacagaggagaacgacaatgacatgagctaacctggcggcagcgcaaaagatg

SEQ ID NO: 70600 - DNA, 103 bp, Artificial Sequence
  Synthetic Polynucleotide
taatacgactcactatagggtgattcaagatagtcatagctcatgtaagtaacagaggagaacttacatgagctatgacaacctggcggcagcgcaaaagatg

SEQ ID NO: 70601 - DNA, 103 bp, Artificial Sequence
  Synthetic Polynucleotide
taatacgactcactatagggcctgatgattcaagatagtcatagctcatgaacagaggagacatgagatgtgactatctaacctggcggcagcgcaaaagatg

SEQ ID NO: 70602 - DNA, 103 bp, Artificial Sequence
  Synthetic Polynucleotide
taatacgactcactatagggctacacctgatgattcaagatagtcatagcaacagaggagagctatgatgatcttgaataacctggcggcagcgcaaaagatg

SEQ ID NO: 70603 - DNA, 103 bp, Artificial Sequence
  Synthetic Polynucleotide
taatacgactcactatagggatacaaaagatcttgacatcgtcaaaaataaacagaggagatattttatgcgatgtcaaaacctggcggcagcgcaaaagatg

SEQ ID NO: 70604 - DNA, 103 bp, Artificial Sequence
  Synthetic Polynucleotide
taatacgactcactatagggaacaactacacctgatgattcaagatagtcaacagaggagagactatatggaatcatcaaacctggcggcagcgcaaaagatg

SEQ ID NO: 70605 - DNA, 103 bp, Artificial Sequence
  Synthetic Polynucleotide
taatacgactcactataggggataaaacaactacacctgatgattcaagaaacagaggagatcttgaatgatcaggtgtaacctggcggcagcgcaaaagatg

SEQ ID NO: 70606 - DNA, 103 bp, Artificial Sequence
  Synthetic Polynucleotide
taatacgactcactatagggaacatgataaaacaactacacctgatgattaacagaggagaaatcatatggtgtagttgaacctggcggcagcgcaaaagatg

SEQ ID NO: 70607 - DNA, 103 bp, Artificial Sequence
  Synthetic Polynucleotide
taatacgactcactatagggttcataacatgataaaacaactacacctgaaacagaggagatcaggtatggttgttttaaacctggcggcagcgcaaaagatg

SEQ ID NO: 70608 - DNA, 103 bp, Artificial Sequence
  Synthetic Polynucleotide
taatacgactcactataggggtcatttcataacatgataaaacaactacaaacagaggagatgtagtatgtttatcatgaacctggcggcagcgcaaaagatg

SEQ ID NO: 70609 - DNA, 103 bp, Artificial Sequence
  Synthetic Polynucleotide
taatacgactcactatagggttatagtcatttcataacatgataaaacaaaacagaggagattgtttatgcatgttatgaacctggcggcagcgcaaaagatg

SEQ ID NO: 70610 - DNA, 103 bp, Artificial Sequence
  Synthetic Polynucleotide
taatacgactcactatagggggagattatagtcatttcataacatgataaaacagaggagattatcaatgtatgaaatgaacctggcggcagcgcaaaagatg

SEQ ID NO: 70611 - DNA, 103 bp, Artificial Sequence
  Synthetic Polynucleotide
taatacgactcactatagggtccaaggagattatagtcatttcataacataacagaggagaatgttaatgaatgactataacctggcggcagcgcaaaagatg

SEQ ID NO: 70612 - DNA, 103 bp, Artificial Sequence
  Synthetic Polynucleotide
taatacgactcactatagggttgtatccaaggagattatagtcatttcataacagaggagaatgaaaatgctataatctaacctggcggcagcgcaaaagatg

SEQ ID NO: 70613 - DNA, 103 bp, Artificial Sequence
  Synthetic Polynucleotide
taatacgactcactataggggtcttttgtatccaaggagattatagtcataacagaggagaatgactatgatctccttgaacctggcggcagcgcaaaagatg

SEQ ID NO: 70614 - DNA, 103 bp, Artificial Sequence
  Synthetic Polynucleotide
taatacgactcactatagggctcctatacaaaagatcttgacatcgtcaaaacagaggagattgacgatgtcaagatctaacctggcggcagcgcaaaagatg

SEQ ID NO: 70615 - DNA, 103 bp, Artificial Sequence
  Synthetic Polynucleotide
taatacgactcactatagggttggcgtcttttgtatccaaggagattataaacagaggagatataatatgcttggatacaacctggcggcagcgcaaaagatg

SEQ ID NO: 70616 - DNA, 103 bp, Artificial Sequence
  Synthetic Polynucleotide
taatacgactcactatagggcatctttggcgtcttttgtatccaaggagaaacagaggagatctcctatgatacaaaagaacctggcggcagcgcaaaagatg

SEQ ID NO: 70617 - DNA, 103 bp, Artificial Sequence
  Synthetic Polynucleotide
taatacgactcactatagggtatagcatctttggcgtcttttgtatccaaaacagaggagattggatatgaaagacgccaacctggcggcagcgcaaaagatg

SEQ ID NO: 70618 - DNA, 103 bp, Artificial Sequence
  Synthetic Polynucleotide
taatacgactcactatagggtcttctatagcatctttggcgtcttttgtaaacagaggagatacaaaatgcgccaaagaaacctggcggcagcgcaaaagatg

SEQ ID NO: 70619 - DNA, 103 bp, Artificial Sequence
  Synthetic Polynucleotide
taatacgactcactatagggtctcatcttctatagcatctttggcgtcttaacagaggagaaagacgatgaagatgctaaacctggcggcagcgcaaaagatg

SEQ ID NO: 70620 - DNA, 103 bp, Artificial Sequence
  Synthetic Polynucleotide
taatacgactcactatagggtactatctcatcttctatagcatctttggcaacagaggagagccaaaatggctatagaaaacctggcggcagcgcaaaagatg

SEQ ID NO: 70621 - DNA, 103 bp, Artificial Sequence
  Synthetic Polynucleotide
taatacgactcactatagggcttgctactatctcatcttctatagcatctaacagaggagaagatgcatgagaagatgaaacctggcggcagcgcaaaagatg

SEQ ID NO: 70622 - DNA, 103 bp, Artificial Sequence
  Synthetic Polynucleotide
taatacgactcactatagggcagcacttgctactatctcatcttctatagaacagaggagactatagatgatgagatagaacctggcggcagcgcaaaagatg

SEQ ID NO: 70623 - DNA, 103 bp, Artificial Sequence
  Synthetic Polynucleotide
taatacgactcactatagggggctacagcacttgctactatctcatcttcaacagaggagagaagatatgatagtagcaaacctggcggcagcgcaaaagatg

SEQ ID NO: 70624 - DNA, 103 bp, Artificial Sequence
  Synthetic Polynucleotide
taatacgactcactataggggcttcggctacagcacttgctactatctcaaacagaggagatgagatatgagcaagtgcaacctggcggcagcgcaaaagatg

SEQ ID NO: 70625 - DNA, 103 bp, Artificial Sequence
  Synthetic Polynucleotide
taatacgactcactatagggtctgactcctatacaaaagatcttgacatcaacagaggagagatgtcatgatcttttgtaacctggcggcagcgcaaaagatg

SEQ ID NO: 70626 - DNA, 103 bp, Artificial Sequence
  Synthetic Polynucleotide
taatacgactcactatagggtcaatgcttcggctacagcacttgctactaaacagaggagatagtagatggtgctgtagaacctggcggcagcgcaaaagatg

SEQ ID NO: 70627 - DNA, 103 bp, Artificial Sequence
  Synthetic Polynucleotide
taatacgactcactataggggtcattcaatgcttcggctacagcacttgcaacagaggagagcaagtatggtagccgaaaacctggcggcagcgcaaaagatg

SEQ ID NO: 70628 - DNA, 103 bp, Artificial Sequence
  Synthetic Polynucleotide
taatacgactcactatagggaacatgtcattcaatgcttcggctacagcaaacagaggagatgctgtatgcgaagcattaacctggcggcagcgcaaaagatg

SEQ ID NO: 70629 - DNA, 103 bp, Artificial Sequence
  Synthetic Polynucleotide
taatacgactcactatagggccttaaacatgtcattcaatgcttcggctaaacagaggagatagccgatgcattgaatgaacctggcggcagcgcaaaagatg

SEQ ID NO: 70630 - DNA, 103 bp, Artificial Sequence
  Synthetic Polynucleotide
taatacgactcactatagggaaattccttaaacatgtcattcaatgcttcaacagaggagagaagcaatgaatgacatgaacctggcggcagcgcaaaagatg

SEQ ID NO: 70631 - DNA, 103 bp, Artificial Sequence
  Synthetic Polynucleotide
taatacgactcactatagggttatcaaattccttaaacatgtcattcaataacagaggagaattgaaatgcatgtttaaaacctggcggcagcgcaaaagatg

SEQ ID NO: 70632 - DNA, 103 bp, Artificial Sequence
  Synthetic Polynucleotide
taatacgactcactatagggcgtttttatcaaattccttaaacatgtcataacagaggagaatgacaatgttaaggaataacctggcggcagcgcaaaagatg

SEQ ID NO: 70633 - DNA, 103 bp, Artificial Sequence
  Synthetic Polynucleotide
taatacgactcactatagggacttacgtttttatcaaattccttaaacataacagaggagaatgtttatggaatttgataacctggcggcagcgcaaaagatg

SEQ ID NO: 70634 - DNA, 103 bp, Artificial Sequence
  Synthetic Polynucleotide
taatacgactcactatagggataacacttacgtttttatcaaattccttaaacagaggagataaggaatgtgataaaaaaacctggcggcagcgcaaaagatg

SEQ ID NO: 70635 - DNA, 103 bp, Artificial Sequence
  Synthetic Polynucleotide
taatacgactcactatagggttataataacacttacgtttttatcaaattaacagaggagaaatttgatgaaaacgtaaaacctggcggcagcgcaaaagatg

SEQ ID NO: 70636 - DNA, 103 bp, Artificial Sequence
  Synthetic Polynucleotide
taatacgactcactatagggacaagtctgactcctatacaaaagatcttgaacagaggagacaagatatgttgtataggaacctggcggcagcgcaaaagatg

SEQ ID NO: 70637 - DNA, 103 bp, Artificial Sequence
  Synthetic Polynucleotide
taatacgactcactatagggttttattataataacacttacgtttttatcaacagaggagagataaaatggtaagtgttaacctggcggcagcgcaaaagatg

SEQ ID NO: 70638 - DNA, 103 bp, Artificial Sequence
  Synthetic Polynucleotide
taatacgactcactatagggtcttcttttattataataacacttacgtttaacagaggagaaaacgtatgtgttattataacctggcggcagcgcaaaagatg

SEQ ID NO: 70639 - DNA, 103 bp, Artificial Sequence
  Synthetic Polynucleotide
taatacgactcactatagggtatcttcttcttttattataataacacttaaacagaggagataagtgatgttataataaaacctggcggcagcgcaaaagatg

SEQ ID NO: 70640 - DNA, 103 bp, Artificial Sequence
  Synthetic Polynucleotide
taatacgactcactatagggataattatcttcttcttttattataataacaacagaggagagttattatgataaaagaaaacctggcggcagcgcaaaagatg

SEQ ID NO: 70641 - DNA, 103 bp, Artificial Sequence
  Synthetic Polynucleotide
taatacgactcactatagggtttagataattatcttcttcttttattataaacagaggagatataatatgagaagaagaaacctggcggcagcgcaaaagatg

SEQ ID NO: 70642 - DNA, 103 bp, Artificial Sequence
  Synthetic Polynucleotide
taatacgactcactatagggaactgtttagataattatcttcttcttttaaacagaggagataaaagatgaagataattaacctggcggcagcgcaaaagatg

SEQ ID NO: 70643 - DNA, 103 bp, Artificial Sequence
  Synthetic Polynucleotide
taatacgactcactatagggcggagaactgtttagataattatcttcttcaacagaggagagaagaaatgaattatctaaacctggcggcagcgcaaaagatg

SEQ ID NO: 70644 - DNA, 103 bp, Artificial Sequence
  Synthetic Polynucleotide
taatacgactcactatagggatattcggagaactgtttagataattatctaacagaggagaagataaatgtctaaacagaacctggcggcagcgcaaaagatg

SEQ ID NO: 70645 - DNA, 103 bp, Artificial Sequence
  Synthetic Polynucleotide
taatacgactcactatagggggtatatattcggagaactgtttagataataacagaggagaattatcatgacagttctcaacctggcggcagcgcaaaagatg

SEQ ID NO: 70646 - DNA, 103 bp, Artificial Sequence
  Synthetic Polynucleotide
taatacgactcactatagggtatatggtatatattcggagaactgtttagaacagaggagactaaacatgtctccgaataacctggcggcagcgcaaaagatg

SEQ ID NO: 70647 - DNA, 103 bp, Artificial Sequence
  Synthetic Polynucleotide
taatacgactcactatagggtgaatacaagtctgactcctatacaaaagaaacagaggagatcttttatgtaggagtcaaacctggcggcagcgcaaaagatg

SEQ ID NO: 70648 - DNA, 103 bp, Artificial Sequence
  Synthetic Polynucleotide
taatacgactcactatagggtatattatatggtatatattcggagaactgaacagaggagacagttcatggaatatataaacctggcggcagcgcaaaagatg

SEQ ID NO: 70649 - DNA, 103 bp, Artificial Sequence
  Synthetic Polynucleotide
taatacgactcactatagggtgatgtatattatatggtatatattcggagaacagaggagactccgaatgtataccataaacctggcggcagcgcaaaagatg

SEQ ID NO: 70650 - DNA, 103 bp, Artificial Sequence
  Synthetic Polynucleotide
taatacgactcactataggggcctatgatgtatattatatggtatatattaacagaggagaaatataatgcatataataaacctggcggcagcgcaaaagatg

SEQ ID NO: 70651 - DNA, 103 bp, Artificial Sequence
  Synthetic Polynucleotide
taatacgactcactataggggtgccgcctatgatgtatattatatggtataacagaggagaataccaatgaatatacataacctggcggcagcgcaaaagatg

SEQ ID NO: 70652 - DNA, 103 bp, Artificial Sequence
  Synthetic Polynucleotide
taatacgactcactataggggaatagtgccgcctatgatgtatattatataacagaggagaatataaatgacatcatagaacctggcggcagcgcaaaagatg

SEQ ID NO: 70653 - DNA, 103 bp, Artificial Sequence
  Synthetic Polynucleotide
taatacgactcactatagggtatcagaatagtgccgcctatgatgtatataacagaggagaatatacatgataggcggcaacctggcggcagcgcaaaagatg

SEQ ID NO: 70654 - DNA, 103 bp, Artificial Sequence
  Synthetic Polynucleotide
taatacgactcactatagggaacagtatcagaatagtgccgcctatgatgaacagaggagacatcatatgcggcactataacctggcggcagcgcaaaagatg

SEQ ID NO: 70655 - DNA, 103 bp, Artificial Sequence
  Synthetic Polynucleotide
taatacgactcactatagggtgactaacagtatcagaatagtgccgcctaaacagaggagataggcgatgctattctgaaacctggcggcagcgcaaaagatg

SEQ ID NO: 70656 - DNA, 103 bp, Artificial Sequence
  Synthetic Polynucleotide
taatacgactcactatagggaataatgactaacagtatcagaatagtgccaacagaggagaggcactatgctgatactgaacctggcggcagcgcaaaagatg

SEQ ID NO: 70657 - DNA, 103 bp, Artificial Sequence
  Synthetic Polynucleotide
taatacgactcactatagggattaaaataatgactaacagtatcagaataaacagaggagatattctatgactgttagtaacctggcggcagcgcaaaagatg

SEQ ID NO: 70658 - DNA, 103 bp, Artificial Sequence
  Synthetic Polynucleotide
taatacgactcactatagggcatgttgaatacaagtctgactcctatacaaacagaggagatgtataatggtcagacttaacctggcggcagcgcaaaagatg

SEQ ID NO: 70659 - DNA, 103 bp, Artificial Sequence
  Synthetic Polynucleotide
taatacgactcactatagggccaatattaaaataatgactaacagtatcaaacagaggagatgatacatgtagtcattaaacctggcggcagcgcaaaagatg

SEQ ID NO: 70660 - DNA, 103 bp, Artificial Sequence
  Synthetic Polynucleotide
taatacgactcactatagggaattaccaatattaaaataatgactaacagaacagaggagactgttaatgattattttaaacctggcggcagcgcaaaagatg

SEQ ID NO: 70661 - DNA, 103 bp, Artificial Sequence
  Synthetic Polynucleotide
taatacgactcactatagggatataaattaccaatattaaaataatgactaacagaggagaagtcatatgtttaatattaacctggcggcagcgcaaaagatg

SEQ ID NO: 70662 - DNA, 103 bp, Artificial Sequence
  Synthetic Polynucleotide
taatacgactcactatagggatgctatataaattaccaatattaaaataaaacagaggagattatttatgtattggtaaaacctggcggcagcgcaaaagatg

SEQ ID NO: 70663 - DNA, 103 bp, Artificial Sequence
  Synthetic Polynucleotide
taatacgactcactatagggattgcatgctatataaattaccaatattaaaacagaggagattaataatggtaatttataacctggcggcagcgcaaaagatg

SEQ ID NO: 70664 - DNA, 103 bp, Artificial Sequence
  Synthetic Polynucleotide
taatacgactcactatagggtatttattgcatgctatataaattaccaataacagaggagaattggtatgttatatagcaacctggcggcagcgcaaaagatg

SEQ ID NO: 70665 - DNA, 103 bp, Artificial Sequence
  Synthetic Polynucleotide
taatacgactcactatagggttctgtatttattgcatgctatataaattaaacagaggagataatttatgtagcatgcaaacctggcggcagcgcaaaagatg

SEQ ID NO: 70666 - DNA, 103 bp, Artificial Sequence
  Synthetic Polynucleotide
taatacgactcactatagggcctggttctgtatttattgcatgctatataaacagaggagatatataatgtgcaataaaaacctggcggcagcgcaaaagatg

SEQ ID NO: 70667 - DNA, 103 bp, Artificial Sequence
  Synthetic Polynucleotide
taatacgactcactatagggtatttcctggttctgtatttattgcatgctaacagaggagaagcatgatgtaaatacagaacctggcggcagcgcaaaagatg

SEQ ID NO: 70668 - DNA, 103 bp, Artificial Sequence
  Synthetic Polynucleotide
taatacgactcactatagggttttatatttcctggttctgtatttattgcaacagaggagagcaataatgacagaaccaaacctggcggcagcgcaaaagatg

SEQ ID NO: 70669 - DNA, 103 bp, Artificial Sequence
  Synthetic Polynucleotide
taatacgactcactatagggaaaagcatgttgaatacaagtctgactcctaacagaggagaaggagtatgacttgtattaacctggcggcagcgcaaaagatg

SEQ ID NO: 70670 - DNA, 103 bp, Artificial Sequence
  Synthetic Polynucleotide
taatacgactcactatagggcattattttatatttcctggttctgtatttaacagaggagaaaatacatgaccaggaaaaacctggcggcagcgcaaaagatg

SEQ ID NO: 70671 - DNA, 103 bp, Artificial Sequence
  Synthetic Polynucleotide
taatacgactcactatagggtctttcattattttatatttcctggttctgaacagaggagacagaacatggaaatataaaacctggcggcagcgcaaaagatg

SEQ ID NO: 70672 - DNA, 103 bp, Artificial Sequence
  Synthetic Polynucleotide
taatacgactcactatagggtatcatctttcattattttatatttcctggaacagaggagaccaggaatgataaaataaaacctggcggcagcgcaaaagatg

SEQ ID NO: 70673 - DNA, 103 bp, Artificial Sequence
  Synthetic Polynucleotide
taatacgactcactatagggcatagtatcatctttcattattttatatttaacagaggagaaaatatatgataatgaaaaacctggcggcagcgcaaaagatg

SEQ ID NO: 70674 - DNA, 103 bp, Artificial Sequence
  Synthetic Polynucleotide
taatacgactcactatagggatgctcatagtatcatctttcattattttaaacagaggagataaaatatggaaagatgaaacctggcggcagcgcaaaagatg

SEQ ID NO: 70675 - DNA, 103 bp, Artificial Sequence
  Synthetic Polynucleotide
taatacgactcactatagggatttaatgctcatagtatcatctttcattaaacagaggagataatgaatgatgatactaaacctggcggcagcgcaaaagatg

SEQ ID NO: 70676 - DNA, 103 bp, Artificial Sequence
  Synthetic Polynucleotide
taatacgactcactatagggctcagatttaatgctcatagtatcatctttaacagaggagaaaagatatgactatgagcaacctggcggcagcgcaaaagatg

SEQ ID NO: 70677 - DNA, 103 bp, Artificial Sequence
  Synthetic Polynucleotide
taatacgactcactatagggtgatgctcagatttaatgctcatagtatcaaacagaggagatgatacatggagcattaaaacctggcggcagcgcaaaagatg

SEQ ID NO: 70678 - DNA, 103 bp, Artificial Sequence
  Synthetic Polynucleotide
taatacgactcactatagggtattatgatgctcagatttaatgctcatagaacagaggagactatgaatgttaaatctgaacctggcggcagcgcaaaagatg

SEQ ID NO: 70679 - DNA, 103 bp, Artificial Sequence
  Synthetic Polynucleotide
taatacgactcactatagggaagactattatgatgctcagatttaatgctaacagaggagaagcattatgtctgagcataacctggcggcagcgcaaaagatg

SEQ ID NO: 70680 - DNA, 103 bp, Artificial Sequence
  Synthetic Polynucleotide
taatacgactcactataggggcacatgtattctatgtcgtctactggatgaacagaggagacatccaatggacgacataaacctggcggcagcgcaaaagatg

SEQ ID NO: 70681 - DNA, 103 bp, Artificial Sequence
  Synthetic Polynucleotide
taatacgactcactataggggatatttcatcgacatttttgatggattttaacagaggagaaaaatcatgcaaaaatgtaacctggcggcagcgcaaaagatg

SEQ ID NO: 70682 - DNA, 103 bp, Artificial Sequence
  Synthetic Polynucleotide
taatacgactcactatagggtatagaaaagcatgttgaatacaagtctgaaacagaggagatcagacatgtattcaacaaacctggcggcagcgcaaaagatg

SEQ ID NO: 70683 - DNA, 103 bp, Artificial Sequence
  Synthetic Polynucleotide
taatacgactcactataggggtttcaagactattatgatgctcagatttaaacagaggagataaatcatggcatcataaaacctggcggcagcgcaaaagatg

SEQ ID NO: 70684 - DNA, 103 bp, Artificial Sequence
  Synthetic Polynucleotide
taatacgactcactatagggatactgtttcaagactattatgatgctcagaacagaggagactgagcatgataatagtcaacctggcggcagcgcaaaagatg

SEQ ID NO: 70685 - DNA, 103 bp, Artificial Sequence
  Synthetic Polynucleotide
taatacgactcactatagggcatagatactgtttcaagactattatgatgaacagaggagacatcatatgagtcttgaaaacctggcggcagcgcaaaagatg

SEQ ID NO: 70686 - DNA, 103 bp, Artificial Sequence
  Synthetic Polynucleotide
taatacgactcactatagggatttccatagatactgtttcaagactattaaacagaggagataatagatgtgaaacagtaacctggcggcagcgcaaaagatg

SEQ ID NO: 70687 - DNA, 103 bp, Artificial Sequence
  Synthetic Polynucleotide
taatacgactcactatagggccataatttccatagatactgtttcaagacaacagaggagagtcttgatgcagtatctaaacctggcggcagcgcaaaagatg

SEQ ID NO: 70688 - DNA, 103 bp, Artificial Sequence
  Synthetic Polynucleotide
taatacgactcactatagggattatccataatttccatagatactgtttcaacagaggagagaaacaatgtctatggaaaacctggcggcagcgcaaaagatg

SEQ ID NO: 70689 - DNA, 103 bp, Artificial Sequence
  Synthetic Polynucleotide
taatacgactcactatagggtaccgattatccataatttccatagatactaacagaggagaagtatcatgggaaattataacctggcggcagcgcaaaagatg

SEQ ID NO: 70690 - DNA, 103 bp, Artificial Sequence
  Synthetic Polynucleotide
taatacgactcactatagggattagtaccgattatccataatttccatagaacagaggagactatggatgttatggataaacctggcggcagcgcaaaagatg

SEQ ID NO: 70691 - DNA, 103 bp, Artificial Sequence
  Synthetic Polynucleotide
taatacgactcactatagggtttttattagtaccgattatccataatttcaacagaggagagaaattatggataatcggaacctggcggcagcgcaaaagatg

SEQ ID NO: 70692 - DNA, 103 bp, Artificial Sequence
  Synthetic Polynucleotide
taatacgactcactatagggactattttttattagtaccgattatccataaacagaggagatatggaatgtcggtactaaacctggcggcagcgcaaaagatg

SEQ ID NO: 70693 - DNA, 103 bp, Artificial Sequence
  Synthetic Polynucleotide
taatacgactcactatagggatgattatagaaaagcatgttgaatacaagaacagaggagacttgtaatgaacatgcttaacctggcggcagcgcaaaagatg

SEQ ID NO: 70694 - DNA, 103 bp, Artificial Sequence
  Synthetic Polynucleotide
taatacgactcactataggggttaaactattttttattagtaccgattataacagaggagaataatcatgactaataaaaacctggcggcagcgcaaaagatg

SEQ ID NO: 70695 - DNA, 103 bp, Artificial Sequence
  Synthetic Polynucleotide
taatacgactcactatagggaaagagttaaactattttttattagtaccgaacagaggagacggtacatgtaaaaaataaacctggcggcagcgcaaaagatg

SEQ ID NO: 70696 - DNA, 103 bp, Artificial Sequence
  Synthetic Polynucleotide
taatacgactcactatagggtctaaaaagagttaaactattttttattagaacagaggagactaataatgaatagtttaaacctggcggcagcgcaaaagatg

SEQ ID NO: 70697 - DNA, 103 bp, Artificial Sequence
  Synthetic Polynucleotide
taatacgactcactatagggctggttctaaaaagagttaaactattttttaacagaggagaaaaaaaatgtttaactctaacctggcggcagcgcaaaagatg

SEQ ID NO: 70698 - DNA, 103 bp, Artificial Sequence
  Synthetic Polynucleotide
taatacgactcactatagggccaaactggttctaaaaagagttaaactataacagaggagaatagttatgctctttttaaacctggcggcagcgcaaaagatg

SEQ ID NO: 70699 - DNA, 103 bp, Artificial Sequence
  Synthetic Polynucleotide
taatacgactcactatagggcagtaccaaactggttctaaaaagagttaaaacagaggagattaactatgtttagaaccaacctggcggcagcgcaaaagatg

SEQ ID NO: 70700 - DNA, 103 bp, Artificial Sequence
  Synthetic Polynucleotide
taatacgactcactatagggaattccagtaccaaactggttctaaaaagaaacagaggagatcttttatgaaccagtttaacctggcggcagcgcaaaagatg

SEQ ID NO: 70701 - DNA, 103 bp, Artificial Sequence
  Synthetic Polynucleotide
taatacgactcactatagggactgaaattccagtaccaaactggttctaaaacagaggagattagaaatggtttggtacaacctggcggcagcgcaaaagatg

SEQ ID NO: 70702 - DNA, 103 bp, Artificial Sequence
  Synthetic Polynucleotide
taatacgactcactatagggaatgaactgaaattccagtaccaaactggtaacagaggagaaccagtatggtactggaaaacctggcggcagcgcaaaagatg

SEQ ID NO: 70703 - DNA, 103 bp, Artificial Sequence
  Synthetic Polynucleotide
taatacgactcactatagggcaacgaatgaactgaaattccagtaccaaaaacagaggagatttggtatgggaatttcaaacctggcggcagcgcaaaagatg

SEQ ID NO: 70704 - DNA, 103 bp, Artificial Sequence
  Synthetic Polynucleotide
taatacgactcactatagggtaaaaatgattatagaaaagcatgttgaataacagaggagaattcaaatggcttttctaaacctggcggcagcgcaaaagatg

SEQ ID NO: 70705 - DNA, 103 bp, Artificial Sequence
  Synthetic Polynucleotide
taatacgactcactatagggattctcaacgaatgaactgaaattccagtaaacagaggagatactggatgttcagttcaaacctggcggcagcgcaaaagatg

SEQ ID NO: 70706 - DNA, 103 bp, Artificial Sequence
  Synthetic Polynucleotide
taatacgactcactatagggtcaatattctcaacgaatgaactgaaattcaacagaggagagaatttatgttcattcgtaacctggcggcagcgcaaaagatg

SEQ ID NO: 70707 - DNA, 103 bp, Artificial Sequence
  Synthetic Polynucleotide
taatacgactcactatagggaatcatcaatattctcaacgaatgaactgaaacagaggagatcagttatgtcgttgagaaacctggcggcagcgcaaaagatg

SEQ ID NO: 70708 - DNA, 103 bp, Artificial Sequence
  Synthetic Polynucleotide
taatacgactcactatagggaaaaaaatcatcaatattctcaacgaatgaaacagaggagatcattcatggagaatattaacctggcggcagcgcaaaagatg

SEQ ID NO: 70709 - DNA, 103 bp, Artificial Sequence
  Synthetic Polynucleotide
taatacgactcactatagggtcttaaaaaaaatcatcaatattctcaacgaacagaggagacgttgaatgtattgatgaaacctggcggcagcgcaaaagatg

SEQ ID NO: 70710 - DNA, 103 bp, Artificial Sequence
  Synthetic Polynucleotide
taatacgactcactatagggtatcatcttaaaaaaaatcatcaatattctaacagaggagaagaataatgatgatttttaacctggcggcagcgcaaaagatg

SEQ ID NO: 70711 - DNA, 103 bp, Artificial Sequence
  Synthetic Polynucleotide
taatacgactcactataggggtaaatatcatcttaaaaaaaatcatcaataacagaggagaattgatatgtttttttaaaacctggcggcagcgcaaaagatg

SEQ ID NO: 70712 - DNA, 103 bp, Artificial Sequence
  Synthetic Polynucleotide
taatacgactcactatagggaaaaagtaaatatcatcttaaaaaaaatcaaacagaggagatgatttatgttaagatgaaacctggcggcagcgcaaaagatg

SEQ ID NO: 70713 - DNA, 103 bp, Artificial Sequence
  Synthetic Polynucleotide
taatacgactcactatagggcatataaaaagtaaatatcatcttaaaaaaaacagaggagattttttatgatgatatttaacctggcggcagcgcaaaagatg

SEQ ID NO: 70714 - DNA, 103 bp, Artificial Sequence
  Synthetic Polynucleotide
taatacgactcactataggggcaagcatataaaaagtaaatatcatcttaaacagaggagataagatatgatttactttaacctggcggcagcgcaaaagatg

SEQ ID NO: 70715 - DNA, 103 bp, Artificial Sequence
  Synthetic Polynucleotide
taatacgactcactatagggatagctaaaaatgattatagaaaagcatgtaacagaggagaacatgcatgtctataatcaacctggcggcagcgcaaaagatg

SEQ ID NO: 70716 - DNA, 103 bp, Artificial Sequence
  Synthetic Polynucleotide
taatacgactcactataggggtaatgcaagcatataaaaagtaaatatcaaacagaggagatgatatatgctttttataaacctggcggcagcgcaaaagatg

SEQ ID NO: 70717 - DNA, 103 bp, Artificial Sequence
  Synthetic Polynucleotide
taatacgactcactatagggattctgtaatgcaagcatataaaaagtaaaaacagaggagatttactatgtatatgcttaacctggcggcagcgcaaaagatg

SEQ ID NO: 70718 - DNA, 103 bp, Artificial Sequence
  Synthetic Polynucleotide
taatacgactcactatagggatattattctgtaatgcaagcatataaaaaaacagaggagatttttaatggcttgcattaacctggcggcagcgcaaaagatg

SEQ ID NO: 70719 - DNA, 103 bp, Artificial Sequence
  Synthetic Polynucleotide
taatacgactcactatagggtgtgaatattattctgtaatgcaagcatataacagaggagaatatgcatgcattacagaaacctggcggcagcgcaaaagatg

SEQ ID NO: 70720 - DNA, 103 bp, Artificial Sequence
  Synthetic Polynucleotide
taatacgactcactatagggatacctgtgaatattattctgtaatgcaagaacagaggagacttgcaatgcagaataataacctggcggcagcgcaaaagatg

SEQ ID NO: 70721 - DNA, 103 bp, Artificial Sequence
  Synthetic Polynucleotide
taatacgactcactatagggtaataatacctgtgaatattattctgtaataacagaggagaattacaatgtaatattcaaacctggcggcagcgcaaaagatg

SEQ ID NO: 70722 - DNA, 103 bp, Artificial Sequence
  Synthetic Polynucleotide
taatacgactcactatagggcattttaataatacctgtgaatattattctaacagaggagaagaataatgttcacaggtaacctggcggcagcgcaaaagatg

SEQ ID NO: 70723 - DNA, 103 bp, Artificial Sequence
  Synthetic Polynucleotide
taatacgactcactatagggatactcattttaataatacctgtgaatattaacagaggagaaatattatgaggtattataacctggcggcagcgcaaaagatg

SEQ ID NO: 70724 - DNA, 103 bp, Artificial Sequence
  Synthetic Polynucleotide
taatacgactcactatagggctccgatactcattttaataatacctgtgaaacagaggagatcacagatgttattaaaaaacctggcggcagcgcaaaagatg

SEQ ID NO: 70725 - DNA, 103 bp, Artificial Sequence
  Synthetic Polynucleotide
taatacgactcactatagggtgtagctccgatactcattttaataataccaacagaggagaggtattatgaaaatgagtaacctggcggcagcgcaaaagatg

SEQ ID NO: 70726 - DNA, 103 bp, Artificial Sequence
  Synthetic Polynucleotide
taatacgactcactatagggccgaaatagctaaaaatgattatagaaaagaacagaggagacttttcatgaatcattttaacctggcggcagcgcaaaagatg

SEQ ID NO: 70727 - DNA, 103 bp, Artificial Sequence
  Synthetic Polynucleotide
taatacgactcactatagggggtaatgtagctccgatactcattttaataaacagaggagatattaaatggagtatcggaacctggcggcagcgcaaaagatg

SEQ ID NO: 70728 - DNA, 103 bp, Artificial Sequence
  Synthetic Polynucleotide
taatacgactcactataggggatatggtaatgtagctccgatactcatttaacagaggagaaaatgaatgtcggagctaaacctggcggcagcgcaaaagatg

SEQ ID NO: 70729 - DNA, 103 bp, Artificial Sequence
  Synthetic Polynucleotide
taatacgactcactatagggatgatgatatggtaatgtagctccgatactaacagaggagaagtatcatggctacattaaacctggcggcagcgcaaaagatg

SEQ ID NO: 70730 - DNA, 103 bp, Artificial Sequence
  Synthetic Polynucleotide
taatacgactcactatagggcatggatgatgatatggtaatgtagctccgaacagaggagacggagcatgattaccataaacctggcggcagcgcaaaagatg

SEQ ID NO: 70731 - DNA, 103 bp, Artificial Sequence
  Synthetic Polynucleotide
taatacgactcactatagggatgagcatggatgatgatatggtaatgtagaacagaggagactacatatgcatatcatcaacctggcggcagcgcaaaagatg

SEQ ID NO: 70732 - DNA, 103 bp, Artificial Sequence
  Synthetic Polynucleotide
taatacgactcactatagggtccacatgagcatggatgatgatatggtaaaacagaggagattaccaatgcatcatccaaacctggcggcagcgcaaaagatg

SEQ ID NO: 70733 - DNA, 103 bp, Artificial Sequence
  Synthetic Polynucleotide
taatacgactcactatagggttccatccacatgagcatggatgatgatataacagaggagaatatcaatgtccatgctcaacctggcggcagcgcaaaagatg

SEQ ID NO: 70734 - DNA, 103 bp, Artificial Sequence
  Synthetic Polynucleotide
taatacgactcactatagggggattttccatccacatgagcatggatgataacagaggagaatcatcatggctcatgtgaacctggcggcagcgcaaaagatg

SEQ ID NO: 70735 - DNA, 103 bp, Artificial Sequence
  Synthetic Polynucleotide
taatacgactcactatagggtggatggattttccatccacatgagcatggaacagaggagaccatgcatgtgtggatggaacctggcggcagcgcaaaagatg

SEQ ID NO: 70736 - DNA, 103 bp, Artificial Sequence
  Synthetic Polynucleotide
taatacgactcactatagggtataatggatggattttccatccacatgagaacagaggagactcatgatgatggaaaataacctggcggcagcgcaaaagatg

SEQ ID NO: 70737 - DNA, 103 bp, Artificial Sequence
  Synthetic Polynucleotide
taatacgactcactatagggtgatgccgaaatagctaaaaatgattatagaacagaggagactataaatgtttttagctaacctggcggcagcgcaaaagatg

SEQ ID NO: 70738 - DNA, 103 bp, Artificial Sequence
  Synthetic Polynucleotide
taatacgactcactatagggaattatataatggatggattttccatccacaacagaggagagtggatatgaaatccatcaacctggcggcagcgcaaaagatg

SEQ ID NO: 70739 - DNA, 103 bp, Artificial Sequence
  Synthetic Polynucleotide
taatacgactcactatagggtcattaattatataatggatggattttccaaacagaggagatggaaaatgcatccattaaacctggcggcagcgcaaaagatg

SEQ ID NO: 70740 - DNA, 103 bp, Artificial Sequence
  Synthetic Polynucleotide
taatacgactcactatagggacgtatcattaattatataatggatggattaacagaggagaaatccaatgattatataaaacctggcggcagcgcaaaagatg

SEQ ID NO: 70741 - DNA, 103 bp, Artificial Sequence
  Synthetic Polynucleotide
taatacgactcactatagggcatgcacgtatcattaattatataatggataacagaggagaatccatatgataattaataacctggcggcagcgcaaaagatg

SEQ ID NO: 70742 - DNA, 103 bp, Artificial Sequence
  Synthetic Polynucleotide
taatacgactcactatagggtcaaacatgcacgtatcattaattatataaaacagaggagattatatatgtaatgatacaacctggcggcagcgcaaaagatg

SEQ ID NO: 70743 - DNA, 103 bp, Artificial Sequence
  Synthetic Polynucleotide
taatacgactcactatagggatatatcaaacatgcacgtatcattaattaaacagaggagataattaatgatacgtgcaaacctggcggcagcgcaaaagatg

SEQ ID NO: 70744 - DNA, 103 bp, Artificial Sequence
  Synthetic Polynucleotide
taatacgactcactatagggaaagaatatatcaaacatgcacgtatcattaacagaggagaaatgatatgtgcatgtttaacctggcggcagcgcaaaagatg

SEQ ID NO: 70745 - DNA, 103 bp, Artificial Sequence
  Synthetic Polynucleotide
taatacgactcactatagggcatttaaagaatatatcaaacatgcacgtaaacagaggagatacgtgatggtttgatataacctggcggcagcgcaaaagatg

SEQ ID NO: 70746 - DNA, 103 bp, Artificial Sequence
  Synthetic Polynucleotide
taatacgactcactatagggtgttccatttaaagaatatatcaaacatgcaacagaggagagcatgtatgatatattctaacctggcggcagcgcaaaagatg

SEQ ID NO: 70747 - DNA, 103 bp, Artificial Sequence
  Synthetic Polynucleotide
taatacgactcactatagggatgtctgttccatttaaagaatatatcaaaaacagaggagatttgatatgttctttaaaaacctggcggcagcgcaaaagatg

SEQ ID NO: 70748 - DNA, 103 bp, Artificial Sequence
  Synthetic Polynucleotide
taatacgactcactatagggttggatgatgccgaaatagctaaaaatgataacagaggagaatcattatgagctatttcaacctggcggcagcgcaaaagatg

SEQ ID NO: 70749 - DNA, 103 bp, Artificial Sequence
  Synthetic Polynucleotide
taatacgactcactatagggctgtgatgtctgttccatttaaagaatataaacagaggagatatattatgtaaatggaaaacctggcggcagcgcaaaagatg

SEQ ID NO: 70750 - DNA, 103 bp, Artificial Sequence
  Synthetic Polynucleotide
taatacgactcactatagggtcagtctgtgatgtctgttccatttaaagaaacagaggagatctttaatgggaacagacaacctggcggcagcgcaaaagatg

SEQ ID NO: 70751 - DNA, 103 bp, Artificial Sequence
  Synthetic Polynucleotide
taatacgactcactataggggtatctcagtctgtgatgtctgttccatttaacagaggagaaaatggatgagacatcacaacctggcggcagcgcaaaagatg

SEQ ID NO: 70752 - DNA, 103 bp, Artificial Sequence
  Synthetic Polynucleotide
taatacgactcactatagggtttgcgtatctcagtctgtgatgtctgttcaacagaggagagaacagatgtcacagactaacctggcggcagcgcaaaagatg

SEQ ID NO: 70753 - DNA, 103 bp, Artificial Sequence
  Synthetic Polynucleotide
taatacgactcactataggggattctttgcgtatctcagtctgtgatgtcaacagaggagagacatcatggactgagataacctggcggcagcgcaaaagatg

SEQ ID NO: 70754 - DNA, 103 bp, Artificial Sequence
  Synthetic Polynucleotide
taatacgactcactatagggtgtaggattctttgcgtatctcagtctgtgaacagaggagacacagaatgagatacgcaaacctggcggcagcgcaaaagatg

SEQ ID NO: 70755 - DNA, 103 bp, Artificial Sequence
  Synthetic Polynucleotide
taatacgactcactatagggaggaatgtaggattctttgcgtatctcagtaacagaggagaactgagatgcgcaaagaaaacctggcggcagcgcaaaagatg

SEQ ID NO: 70756 - DNA, 103 bp, Artificial Sequence
  Synthetic Polynucleotide
taatacgactcactatagggagtttaggaatgtaggattctttgcgtatcaacagaggagagatacgatgagaatcctaaacctggcggcagcgcaaaagatg

SEQ ID NO: 70757 - DNA, 103 bp, Artificial Sequence
  Synthetic Polynucleotide
taatacgactcactatagggtacaaagtttaggaatgtaggattctttgcaacagaggagagcaaagatgcctacattcaacctggcggcagcgcaaaagatg

SEQ ID NO: 70758 - DNA, 103 bp, Artificial Sequence
  Synthetic Polynucleotide
taatacgactcactatagggtcagatacaaagtttaggaatgtaggattcaacagaggagagaatccatgattcctaaaaacctggcggcagcgcaaaagatg

SEQ ID NO: 70759 - DNA, 103 bp, Artificial Sequence
  Synthetic Polynucleotide
taatacgactcactatagggtactattggatgatgccgaaatagctaaaaaacagaggagattttagatgtttcggcataacctggcggcagcgcaaaagatg

SEQ ID NO: 70760 - DNA, 103 bp, Artificial Sequence
  Synthetic Polynucleotide
taatacgactcactatagggttatgtcagatacaaagtttaggaatgtagaacagaggagactacatatgtaaactttgaacctggcggcagcgcaaaagatg

SEQ ID NO: 70761 - DNA, 103 bp, Artificial Sequence
  Synthetic Polynucleotide
taatacgactcactatagggtgttcttatgtcagatacaaagtttaggaaaacagaggagattcctaatgtttgtatctaacctggcggcagcgcaaaagatg

SEQ ID NO: 70762 - DNA, 103 bp, Artificial Sequence
  Synthetic Polynucleotide
taatacgactcactatagggctcactgttcttatgtcagatacaaagtttaacagaggagaaaacttatgatctgacataacctggcggcagcgcaaaagatg

SEQ ID NO: 70763 - DNA, 103 bp, Artificial Sequence
  Synthetic Polynucleotide
taatacgactcactatagggatcctctcactgttcttatgtcagatacaaaacagaggagattgtatatgacataagaaaacctggcggcagcgcaaaagatg

SEQ ID NO: 70764 - DNA, 103 bp, Artificial Sequence
  Synthetic Polynucleotide
taatacgactcactatagggagtcgatcctctcactgttcttatgtcagaaacagaggagatctgacatgagaacagtgaacctggcggcagcgcaaaagatg

SEQ ID NO: 70765 - DNA, 103 bp, Artificial Sequence
  Synthetic Polynucleotide
taatacgactcactatagggtatggagtcgatcctctcactgttcttatgaacagaggagacataagatgagtgagaggaacctggcggcagcgcaaaagatg

SEQ ID NO: 70766 - DNA, 103 bp, Artificial Sequence
  Synthetic Polynucleotide
taatacgactcactatagggtccactatggagtcgatcctctcactgttcaacagaggagagaacagatggaggatcgaaacctggcggcagcgcaaaagatg

SEQ ID NO: 70767 - DNA, 103 bp, Artificial Sequence
  Synthetic Polynucleotide
taatacgactcactatagggtgttgtccactatggagtcgatcctctcacaacagaggagagtgagaatgtcgactccaaacctggcggcagcgcaaaagatg

SEQ ID NO: 70768 - DNA, 103 bp, Artificial Sequence
  Synthetic Polynucleotide
taatacgactcactatagggattaatgttgtccactatggagtcgatcctaacagaggagaaggatcatgtccatagtgaacctggcggcagcgcaaaagatg

SEQ ID NO: 70769 - DNA, 103 bp, Artificial Sequence
  Synthetic Polynucleotide
taatacgactcactatagggtttgtattaatgttgtccactatggagtcgaacagaggagacgactcatgagtggacaaaacctggcggcagcgcaaaagatg

SEQ ID NO: 70770 - DNA, 103 bp, Artificial Sequence
  Synthetic Polynucleotide
taatacgactcactatagggaaatgtactattggatgatgccgaaatagcaacagaggagagctattatggcatcatccaacctggcggcagcgcaaaagatg

SEQ ID NO: 70771 - DNA, 103 bp, Artificial Sequence
  Synthetic Polynucleotide
taatacgactcactatagggtatcgtttgtattaatgttgtccactatggaacagaggagaccatagatgacaacattaaacctggcggcagcgcaaaagatg

SEQ ID NO: 70772 - DNA, 103 bp, Artificial Sequence
  Synthetic Polynucleotide
taatacgactcactatagggcaagttatcgtttgtattaatgttgtccacaacagaggagagtggacatgattaatacaaacctggcggcagcgcaaaagatg

SEQ ID NO: 70773 - DNA, 103 bp, Artificial Sequence
  Synthetic Polynucleotide
taatacgactcactataggggaaatcaagttatcgtttgtattaatgttgaacagaggagacaacatatgtacaaacgaaacctggcggcagcgcaaaagatg

SEQ ID NO: 70774 - DNA, 103 bp, Artificial Sequence
  Synthetic Polynucleotide
taatacgactcactatagggattttgaaatcaagttatcgtttgtattaaaacagaggagattaataatgacgataactaacctggcggcagcgcaaaagatg

SEQ ID NO: 70775 - DNA, 103 bp, Artificial Sequence
  Synthetic Polynucleotide
taatacgactcactatagggtgataattttgaaatcaagttatcgtttgtaacagaggagaacaaacatgaacttgattaacctggcggcagcgcaaaagatg

SEQ ID NO: 70776 - DNA, 103 bp, Artificial Sequence
  Synthetic Polynucleotide
taatacgactcactatagggtccattgataattttgaaatcaagttatcgaacagaggagacgataaatggatttcaaaaacctggcggcagcgcaaaagatg

SEQ ID NO: 70777 - DNA, 103 bp, Artificial Sequence
  Synthetic Polynucleotide
taatacgactcactataggggtatctccattgataattttgaaatcaagtaacagaggagaacttgaatgcaaaattataacctggcggcagcgcaaaagatg

SEQ ID NO: 70778 - DNA, 103 bp, Artificial Sequence
  Synthetic Polynucleotide
taatacgactcactatagggacgttgtatctccattgataattttgaaataacagaggagaatttcaatgttatcaatgaacctggcggcagcgcaaaagatg

SEQ ID NO: 70779 - DNA, 103 bp, Artificial Sequence
  Synthetic Polynucleotide
taatacgactcactatagggatttcacgttgtatctccattgataattttaacagaggagaaaaattatgaatggagataacctggcggcagcgcaaaagatg

SEQ ID NO: 70780 - DNA, 103 bp, Artificial Sequence
  Synthetic Polynucleotide
taatacgactcactatagggaaagtatttcacgttgtatctccattgataaacagaggagatatcaaatgagatacaacaacctggcggcagcgcaaaagatg

SEQ ID NO: 70781 - DNA, 103 bp, Artificial Sequence
  Synthetic Polynucleotide
taatacgactcactatagggctggaaaatgtactattggatgatgccgaaaacagaggagattcggcatgatccaatagaacctggcggcagcgcaaaagatg

SEQ ID NO: 70782 - DNA, 103 bp, Artificial Sequence
  Synthetic Polynucleotide
taatacgactcactataggggtaataaagtatttcacgttgtatctccataacagaggagaatggagatgcaacgtgaaaacctggcggcagcgcaaaagatg

SEQ ID NO: 70783 - DNA, 103 bp, Artificial Sequence
  Synthetic Polynucleotide
taatacgactcactatagggatggagtaataaagtatttcacgttgtatcaacagaggagagatacaatgtgaaatactaacctggcggcagcgcaaaagatg

SEQ ID NO: 70784 - DNA, 103 bp, Artificial Sequence
  Synthetic Polynucleotide
taatacgactcactatagggatttaatggagtaataaagtatttcacgttaacagaggagaaacgtgatgtactttattaacctggcggcagcgcaaaagatg

SEQ ID NO: 70785 - DNA, 103 bp, Artificial Sequence
  Synthetic Polynucleotide
taatacgactcactatagggacattatttaatggagtaataaagtatttcaacagaggagagaaataatgtattactccaacctggcggcagcgcaaaagatg

SEQ ID NO: 70786 - DNA, 103 bp, Artificial Sequence
  Synthetic Polynucleotide
taatacgactcactataggggtgatacattatttaatggagtaataaagtaacagaggagaactttaatgctccattaaaacctggcggcagcgcaaaagatg

SEQ ID NO: 70787 - DNA, 103 bp, Artificial Sequence
  Synthetic Polynucleotide
taatacgactcactatagggcgtaagtgatacattatttaatggagtaataacagaggagaattactatgttaaataataacctggcggcagcgcaaaagatg

SEQ ID NO: 70788 - DNA, 103 bp, Artificial Sequence
  Synthetic Polynucleotide
taatacgactcactatagggattatcgtaagtgatacattatttaatggaaacagaggagatccattatgtaatgtatcaacctggcggcagcgcaaaagatg

SEQ ID NO: 70789 - DNA, 103 bp, Artificial Sequence
  Synthetic Polynucleotide
taatacgactcactataggggagacattatcgtaagtgatacattatttaaacagaggagataaataatgtatcacttaaacctggcggcagcgcaaaagatg

SEQ ID NO: 70790 - DNA, 103 bp, Artificial Sequence
  Synthetic Polynucleotide
taatacgactcactatagggttatagagacattatcgtaagtgatacattaacagaggagaaatgtaatgcttacgataaacctggcggcagcgcaaaagatg

SEQ ID NO: 70791 - DNA, 103 bp, Artificial Sequence
  Synthetic Polynucleotide
taatacgactcactataggggtcgtttatagagacattatcgtaagtgataacagaggagaatcactatggataatgtcaacctggcggcagcgcaaaagatg

SEQ ID NO: 70792 - DNA, 103 bp, Artificial Sequence
  Synthetic Polynucleotide
taatacgactcactatagggcatcagatatttcatcgacatttttgatggaacagaggagaccatcaatgatgtcgatgaacctggcggcagcgcaaaagatg

SEQ ID NO: 70793 - DNA, 103 bp, Artificial Sequence
  Synthetic Polynucleotide
taatacgactcactatagggctaatctggaaaatgtactattggatgatgaacagaggagacatcatatgatagtacataacctggcggcagcgcaaaagatg

SEQ ID NO: 70794 - DNA, 103 bp, Artificial Sequence
  Synthetic Polynucleotide
taatacgactcactatagggaaccggtcgtttatagagacattatcgtaaaacagaggagattacgaatgtgtctctataacctggcggcagcgcaaaagatg

SEQ ID NO: 70795 - DNA, 103 bp, Artificial Sequence
  Synthetic Polynucleotide
taatacgactcactatagggtgataaaccggtcgtttatagagacattataacagaggagaataatgatgctataaacgaacctggcggcagcgcaaaagatg

SEQ ID NO: 70796 - DNA, 103 bp, Artificial Sequence
  Synthetic Polynucleotide
taatacgactcactatagggattaatgataaaccggtcgtttatagagacaacagaggagagtctctatgaacgaccggaacctggcggcagcgcaaaagatg

SEQ ID NO: 70797 - DNA, 103 bp, Artificial Sequence
  Synthetic Polynucleotide
taatacgactcactatagggtattaattaatgataaaccggtcgtttataaacagaggagatataaaatgccggtttataacctggcggcagcgcaaaagatg

SEQ ID NO: 70798 - DNA, 103 bp, Artificial Sequence
  Synthetic Polynucleotide
taatacgactcactatagggcattgtattaattaatgataaaccggtcgtaacagaggagaacgaccatgttatcattaaacctggcggcagcgcaaaagatg

SEQ ID NO: 70799 - DNA, 103 bp, Artificial Sequence
  Synthetic Polynucleotide
taatacgactcactatagggttagacattgtattaattaatgataaaccgaacagaggagacggtttatgattaattaaaacctggcggcagcgcaaaagatg

SEQ ID NO: 70800 - DNA, 103 bp, Artificial Sequence
  Synthetic Polynucleotide
taatacgactcactatagggggaatttagacattgtattaattaatgataaacagaggagatatcatatgttaatacaaaacctggcggcagcgcaaaagatg

SEQ ID NO: 70801 - DNA, 103 bp, Artificial Sequence
  Synthetic Polynucleotide
taatacgactcactataggggctatggaatttagacattgtattaattaaaacagaggagattaattatgacaatgtctaacctggcggcagcgcaaaagatg

SEQ ID NO: 70802 - DNA, 103 bp, Artificial Sequence
  Synthetic Polynucleotide
taatacgactcactatagggaatatgctatggaatttagacattgtattaaacagaggagataatacatggtctaaattaacctggcggcagcgcaaaagatg

SEQ ID NO: 70803 - DNA, 103 bp, Artificial Sequence
  Synthetic Polynucleotide
taatacgactcactatagggtttgtaatatgctatggaatttagacattgaacagaggagacaatgtatgaattccataaacctggcggcagcgcaaaagatg

SEQ ID NO: 70804 - DNA, 103 bp, Artificial Sequence
  Synthetic Polynucleotide
taatacgactcactatagggttctgctaatctggaaaatgtactattggaaacagaggagatccaatatgacattttccaacctggcggcagcgcaaaagatg

SEQ ID NO: 70805 - DNA, 103 bp, Artificial Sequence
  Synthetic Polynucleotide
taatacgactcactataggggtgattttgtaatatgctatggaatttagaaacagaggagatctaaaatgcatagcataaacctggcggcagcgcaaaagatg

SEQ ID NO: 70806 - DNA, 103 bp, Artificial Sequence
  Synthetic Polynucleotide
taatacgactcactatagggagacggtgattttgtaatatgctatggaataacagaggagaattccaatgcatattacaaacctggcggcagcgcaaaagatg

SEQ ID NO: 70807 - DNA, 103 bp, Artificial Sequence
  Synthetic Polynucleotide
taatacgactcactatagggatcttagacggtgattttgtaatatgctataacagaggagaatagcaatgtacaaaatcaacctggcggcagcgcaaaagatg

SEQ ID NO: 70808 - DNA, 103 bp, Artificial Sequence
  Synthetic Polynucleotide
taatacgactcactatagggttatcatcttagacggtgattttgtaatataacagaggagaatattaatgaatcaccgtaacctggcggcagcgcaaaagatg

SEQ ID NO: 70809 - DNA, 103 bp, Artificial Sequence
  Synthetic Polynucleotide
taatacgactcactatagggtgtttttatcatcttagacggtgattttgtaacagaggagaacaaaaatgccgtctaagaacctggcggcagcgcaaaagatg

SEQ ID NO: 70810 - DNA, 103 bp, Artificial Sequence
  Synthetic Polynucleotide
taatacgactcactatagggaaacgtgtttttatcatcttagacggtgataacagaggagaatcaccatgtaagatgataacctggcggcagcgcaaaagatg

SEQ ID NO: 70811 - DNA, 103 bp, Artificial Sequence
  Synthetic Polynucleotide
taatacgactcactatagggaaaataaacgtgtttttatcatcttagacgaacagaggagacgtctaatgtgataaaaaaacctggcggcagcgcaaaagatg

SEQ ID NO: 70812 - DNA, 103 bp, Artificial Sequence
  Synthetic Polynucleotide
taatacgactcactatagggcatataaaataaacgtgtttttatcatcttaacagaggagaaagatgatgaaaacacgtaacctggcggcagcgcaaaagatg

SEQ ID NO: 70813 - DNA, 103 bp, Artificial Sequence
  Synthetic Polynucleotide
taatacgactcactataggggttgacatataaaataaacgtgtttttatcaacagaggagagataaaatgacgtttattaacctggcggcagcgcaaaagatg

SEQ ID NO: 70814 - DNA, 103 bp, Artificial Sequence
  Synthetic Polynucleotide
taatacgactcactatagggtaatggttgacatataaaataaacgtgtttaacagaggagaaaacacatgtattttataaacctggcggcagcgcaaaagatg

SEQ ID NO: 70815 - DNA, 103 bp, Artificial Sequence
  Synthetic Polynucleotide
taatacgactcactatagggatctattctgctaatctggaaaatgtactaaacagaggagatagtacatgttccagattaacctggcggcagcgcaaaagatg

SEQ ID NO: 70816 - DNA, 103 bp, Artificial Sequence
  Synthetic Polynucleotide
taatacgactcactatagggtttagtaatggttgacatataaaataaacgaacagaggagacgtttaatgtatatgtcaaacctggcggcagcgcaaaagatg

SEQ ID NO: 70817 - DNA, 103 bp, Artificial Sequence
  Synthetic Polynucleotide
taatacgactcactatagggtattttttagtaatggttgacatataaaataacagaggagaattttaatggtcaaccataacctggcggcagcgcaaaagatg

SEQ ID NO: 70818 - DNA, 103 bp, Artificial Sequence
  Synthetic Polynucleotide
taatacgactcactatagggcaatatattttttagtaatggttgacatataacagaggagaatatgtatgccattactaaacctggcggcagcgcaaaagatg

SEQ ID NO: 70819 - DNA, 103 bp, Artificial Sequence
  Synthetic Polynucleotide
taatacgactcactatagggcagaacaatatattttttagtaatggttgaaacagaggagatcaaccatgactaaaaaaaacctggcggcagcgcaaaagatg

SEQ ID NO: 70820 - DNA, 103 bp, Artificial Sequence
  Synthetic Polynucleotide
taatacgactcactatagggaaaaacagaacaatatattttttagtaatgaacagaggagacattacatgaaaatatataacctggcggcagcgcaaaagatg

SEQ ID NO: 70821 - DNA, 103 bp, Artificial Sequence
  Synthetic Polynucleotide
taatacgactcactatagggaaaacaaaaacagaacaatatattttttagaacagaggagactaaaaatgatattgttcaacctggcggcagcgcaaaagatg

SEQ ID NO: 70822 - DNA, 103 bp, Artificial Sequence
  Synthetic Polynucleotide
taatacgactcactatagggaaaagaaaacaaaaacagaacaatatatttaacagaggagaaaatatatggttctgtttaacctggcggcagcgcaaaagatg

SEQ ID NO: 70823 - DNA, 103 bp, Artificial Sequence
  Synthetic Polynucleotide
taatacgactcactatagggtaagaaaaagaaaacaaaaacagaacaataaacagaggagatattgtatggtttttgttaacctggcggcagcgcaaaagatg

SEQ ID NO: 70824 - DNA, 103 bp, Artificial Sequence
  Synthetic Polynucleotide
taatacgactcactataggggtgtgtaagaaaaagaaaacaaaaacagaaaacagaggagattctgtatgtgttttcttaacctggcggcagcgcaaaagatg

SEQ ID NO: 70825 - DNA, 103 bp, Artificial Sequence
  Synthetic Polynucleotide
taatacgactcactataggggcgatgtgtgtaagaaaaagaaaacaaaaaaacagaggagatttttgatgtctttttctaacctggcggcagcgcaaaagatg

SEQ ID NO: 70826 - DNA, 103 bp, Artificial Sequence
  Synthetic Polynucleotide
taatacgactcactatagggttaatatctattctgctaatctggaaaatgaacagaggagacattttatggattagcagaacctggcggcagcgcaaaagatg

SEQ ID NO: 70827 - DNA, 103 bp, Artificial Sequence
  Synthetic Polynucleotide
taatacgactcactatagggaattagcgatgtgtgtaagaaaaagaaaacaacagaggagagttttcatgttcttacacaacctggcggcagcgcaaaagatg

SEQ ID NO: 70828 - DNA, 103 bp, Artificial Sequence
  Synthetic Polynucleotide
taatacgactcactatagggttcataattagcgatgtgtgtaagaaaaagaacagaggagactttttatgacacacatcaacctggcggcagcgcaaaagatg

SEQ ID NO: 70829 - DNA, 103 bp, Artificial Sequence
  Synthetic Polynucleotide
taatacgactcactatagggactttttcataattagcgatgtgtgtaagaaacagaggagatcttacatgcatcgctaaaacctggcggcagcgcaaaagatg

SEQ ID NO: 70830 - DNA, 103 bp, Artificial Sequence
  Synthetic Polynucleotide
taatacgactcactatagggcatttactttttcataattagcgatgtgtgaacagaggagacacacaatgctaattatgaacctggcggcagcgcaaaagatg

SEQ ID NO: 70831 - DNA, 103 bp, Artificial Sequence
  Synthetic Polynucleotide
taatacgactcactatagggttcatcatttactttttcataattagcgataacagaggagaatcgctatgtatgaaaaaaacctggcggcagcgcaaaagatg

SEQ ID NO: 70832 - DNA, 103 bp, Artificial Sequence
  Synthetic Polynucleotide
taatacgactcactatagggtacatttcatcatttactttttcataattaaacagaggagataattaatgaaaagtaaaaacctggcggcagcgcaaaagatg

SEQ ID NO: 70833 - DNA, 103 bp, Artificial Sequence
  Synthetic Polynucleotide
taatacgactcactatagggtctcatacatttcatcatttactttttcataacagaggagaatgaaaatgtaaatgatgaacctggcggcagcgcaaaagatg

SEQ ID NO: 70834 - DNA, 103 bp, Artificial Sequence
  Synthetic Polynucleotide
taatacgactcactatagggcaccatctcatacatttcatcatttactttaacagaggagaaaagtaatggatgaaatgaacctggcggcagcgcaaaagatg

SEQ ID NO: 70835 - DNA, 103 bp, Artificial Sequence
  Synthetic Polynucleotide
taatacgactcactatagggcatctcaccatctcatacatttcatcatttaacagaggagaaaatgaatgaatgtatgaaacctggcggcagcgcaaaagatg

SEQ ID NO: 70836 - DNA, 103 bp, Artificial Sequence
  Synthetic Polynucleotide
taatacgactcactatagggtcgtccatctcaccatctcatacatttcataacagaggagaatgaaaatgatgagatggaacctggcggcagcgcaaaagatg

SEQ ID NO: 70837 - DNA, 103 bp, Artificial Sequence
  Synthetic Polynucleotide
taatacgactcactatagggcgacattaatatctattctgctaatctggaaacagaggagatccagaatggcagaatagaacctggcggcagcgcaaaagatg

SEQ ID NO: 70838 - DNA, 103 bp, Artificial Sequence
  Synthetic Polynucleotide
taatacgactcactatagggcaatctcgtccatctcaccatctcatacataacagaggagaatgtatatgatggtgagaaacctggcggcagcgcaaaagatg

SEQ ID NO: 70839 - DNA, 103 bp, Artificial Sequence
  Synthetic Polynucleotide
taatacgactcactataggggttcacaatctcgtccatctcaccatctcaaacagaggagatgagatatggagatggacaacctggcggcagcgcaaaagatg

SEQ ID NO: 70840 - DNA, 103 bp, Artificial Sequence
  Synthetic Polynucleotide
taatacgactcactatagggacaatgttcacaatctcgtccatctcaccaaacagaggagatggtgaatgggacgagataacctggcggcagcgcaaaagatg

SEQ ID NO: 70841 - DNA, 103 bp, Artificial Sequence
  Synthetic Polynucleotide
taatacgactcactatagggcacgaacaatgttcacaatctcgtccatctaacagaggagaagatggatgagattgtgaaacctggcggcagcgcaaaagatg

SEQ ID NO: 70842 - DNA, 103 bp, Artificial Sequence
  Synthetic Polynucleotide
taatacgactcactatagggactatcacgaacaatgttcacaatctcgtcaacagaggagagacgagatggtgaacattaacctggcggcagcgcaaaagatg

SEQ ID NO: 70843 - DNA, 103 bp, Artificial Sequence
  Synthetic Polynucleotide
taatacgactcactatagggcacatactatcacgaacaatgttcacaatcaacagaggagagattgtatgcattgttcgaacctggcggcagcgcaaaagatg

SEQ ID NO: 70844 - DNA, 103 bp, Artificial Sequence
  Synthetic Polynucleotide
taatacgactcactatagggtaaaccacatactatcacgaacaatgttcaaacagaggagatgaacaatgttcgtgataaacctggcggcagcgcaaaagatg

SEQ ID NO: 70845 - DNA, 103 bp, Artificial Sequence
  Synthetic Polynucleotide
taatacgactcactatagggaggtataaaccacatactatcacgaacaataacagaggagaattgttatggatagtatgaacctggcggcagcgcaaaagatg

SEQ ID NO: 70846 - DNA, 103 bp, Artificial Sequence
  Synthetic Polynucleotide
taatacgactcactatagggacgttaggtataaaccacatactatcacgaaacagaggagatcgtgaatgtatgtggttaacctggcggcagcgcaaaagatg

SEQ ID NO: 70847 - DNA, 103 bp, Artificial Sequence
  Synthetic Polynucleotide
taatacgactcactatagggtaaatacgttaggtataaaccacatactataacagaggagaatagtaatgggtttatacaacctggcggcagcgcaaaagatg

SEQ ID NO: 70848 - DNA, 103 bp, Artificial Sequence
  Synthetic Polynucleotide
taatacgactcactatagggaaatacgacattaatatctattctgctaataacagaggagaattagcatgatagatattaacctggcggcagcgcaaaagatg

SEQ ID NO: 70849 - DNA, 103 bp, Artificial Sequence
  Synthetic Polynucleotide
taatacgactcactataggggtccataaatacgttaggtataaaccacataacagaggagaatgtggatgatacctaacaacctggcggcagcgcaaaagatg

SEQ ID NO: 70850 - DNA, 103 bp, Artificial Sequence
  Synthetic Polynucleotide
taatacgactcactatagggccgttgtccataaatacgttaggtataaacaacagaggagagtttatatgtaacgtattaacctggcggcagcgcaaaagatg

SEQ ID NO: 70851 - DNA, 103 bp, Artificial Sequence
  Synthetic Polynucleotide
taatacgactcactatagggtctcaccgttgtccataaatacgttaggtaaacagaggagatacctaatgtatttatggaacctggcggcagcgcaaaagatg

SEQ ID NO: 70852 - DNA, 103 bp, Artificial Sequence
  Synthetic Polynucleotide
taatacgactcactataggggtcattctcaccgttgtccataaatacgttaacagaggagaaacgtaatgatggacaacaacctggcggcagcgcaaaagatg

SEQ ID NO: 70853 - DNA, 103 bp, Artificial Sequence
  Synthetic Polynucleotide
taatacgactcactatagggtggccgtcattctcaccgttgtccataaataacagaggagaatttatatgcaacggtgaaacctggcggcagcgcaaaagatg

SEQ ID NO: 70854 - DNA, 103 bp, Artificial Sequence
  Synthetic Polynucleotide
taatacgactcactatagggaaacgtggccgtcattctcaccgttgtccaaacagaggagatggacaatggtgagaatgaacctggcggcagcgcaaaagatg

SEQ ID NO: 70855 - DNA, 103 bp, Artificial Sequence
  Synthetic Polynucleotide
taatacgactcactataggggacagaaacgtggccgtcattctcaccgttaacagaggagaaacggtatgaatgacggcaacctggcggcagcgcaaaagatg

SEQ ID NO: 70856 - DNA, 103 bp, Artificial Sequence
  Synthetic Polynucleotide
taatacgactcactatagggttgttgacagaaacgtggccgtcattctcaaacagaggagatgagaaatgcggccacgtaacctggcggcagcgcaaaagatg

SEQ ID NO: 70857 - DNA, 103 bp, Artificial Sequence
  Synthetic Polynucleotide
taatacgactcactatagggagacattgttgacagaaacgtggccgtcataacagaggagaatgacgatgacgtttctgaacctggcggcagcgcaaaagatg

SEQ ID NO: 70858 - DNA, 103 bp, Artificial Sequence
  Synthetic Polynucleotide
taatacgactcactatagggatgacagacattgttgacagaaacgtggccaacagaggagaggccacatgtctgtcaacaacctggcggcagcgcaaaagatg

SEQ ID NO: 70859 - DNA, 103 bp, Artificial Sequence
  Synthetic Polynucleotide
taatacgactcactatagggtgttcaaatacgacattaatatctattctgaacagaggagacagaatatgtattaatgtaacctggcggcagcgcaaaagatg

SEQ ID NO: 70860 - DNA, 103 bp, Artificial Sequence
  Synthetic Polynucleotide
taatacgactcactatagggtacatatgacagacattgttgacagaaacgaacagaggagacgtttcatgcaacaatgtaacctggcggcagcgcaaaagatg

SEQ ID NO: 70861 - DNA, 103 bp, Artificial Sequence
  Synthetic Polynucleotide
taatacgactcactatagggcgaaatacatatgacagacattgttgacagaacagaggagactgtcaatgatgtctgtcaacctggcggcagcgcaaaagatg

SEQ ID NO: 70862 - DNA, 103 bp, Artificial Sequence
  Synthetic Polynucleotide
taatacgactcactataggggaacgcgaaatacatatgacagacattgttaacagaggagaaacaatatgtgtcatatgaacctggcggcagcgcaaaagatg

SEQ ID NO: 70863 - DNA, 103 bp, Artificial Sequence
  Synthetic Polynucleotide
taatacgactcactatagggtcaaagaacgcgaaatacatatgacagacaaacagaggagatgtctgatgtatgtatttaacctggcggcagcgcaaaagatg

SEQ ID NO: 70864 - DNA, 103 bp, Artificial Sequence
  Synthetic Polynucleotide
taatacgactcactatagggcaacatcaaagaacgcgaaatacatatgacaacagaggagagtcataatgatttcgcgtaacctggcggcagcgcaaaagatg

SEQ ID NO: 70865 - DNA, 103 bp, Artificial Sequence
  Synthetic Polynucleotide
taatacgactcactatagggtgtatcaacatcaaagaacgcgaaatacataacagaggagaatgtatatggcgttctttaacctggcggcagcgcaaaagatg

SEQ ID NO: 70866 - DNA, 103 bp, Artificial Sequence
  Synthetic Polynucleotide
taatacgactcactataggggacgatgtatcaacatcaaagaacgcgaaaaacagaggagatttcgcatgctttgatgtaacctggcggcagcgcaaaagatg

SEQ ID NO: 70867 - DNA, 103 bp, Artificial Sequence
  Synthetic Polynucleotide
taatacgactcactataggggatgagacgatgtatcaacatcaaagaacgaacagaggagacgttctatgatgttgataaacctggcggcagcgcaaaagatg

SEQ ID NO: 70868 - DNA, 103 bp, Artificial Sequence
  Synthetic Polynucleotide
taatacgactcactatagggaaacagatgagacgatgtatcaacatcaaaaacagaggagatttgatatggatacatcgaacctggcggcagcgcaaaagatg

SEQ ID NO: 70869 - DNA, 103 bp, Artificial Sequence
  Synthetic Polynucleotide
taatacgactcactatagggagcttaaacagatgagacgatgtatcaacaaacagaggagatgttgaatgatcgtctcaaacctggcggcagcgcaaaagatg

SEQ ID NO: 70870 - DNA, 103 bp, Artificial Sequence
  Synthetic Polynucleotide
taatacgactcactatagggggctctgttcaaatacgacattaatatctaaacagaggagatagataatgatgtcgtataacctggcggcagcgcaaaagatg

SEQ ID NO: 70871 - DNA, 103 bp, Artificial Sequence
  Synthetic Polynucleotide
taatacgactcactatagggtaactagcttaaacagatgagacgatgtataacagaggagaatacatatgctcatctgtaacctggcggcagcgcaaaagatg

SEQ ID NO: 70872 - DNA, 103 bp, Artificial Sequence
  Synthetic Polynucleotide
taatacgactcactatagggtttaataactagcttaaacagatgagacgaaacagaggagatcgtctatgctgtttaagaacctggcggcagcgcaaaagatg

SEQ ID NO: 70873 - DNA, 103 bp, Artificial Sequence
  Synthetic Polynucleotide
taatacgactcactatagggcagtgtttaataactagcttaaacagatgaaacagaggagatcatctatgtaagctagtaacctggcggcagcgcaaaagatg

SEQ ID NO: 70874 - DNA, 103 bp, Artificial Sequence
  Synthetic Polynucleotide
taatacgactcactataggggatcgcagtgtttaataactagcttaaacaaacagaggagatgtttaatgtagttattaaacctggcggcagcgcaaaagatg

SEQ ID NO: 70875 - DNA, 103 bp, Artificial Sequence
  Synthetic Polynucleotide
taatacgactcactatagggattcagatcgcagtgtttaataactagcttaacagaggagaaagctaatgattaaacacaacctggcggcagcgcaaaagatg

SEQ ID NO: 70876 - DNA, 103 bp, Artificial Sequence
  Synthetic Polynucleotide
taatacgactcactatagggtgtttattcagatcgcagtgtttaataactaacagaggagaagttatatgacactgcgaaacctggcggcagcgcaaaagatg

SEQ ID NO: 70877 - DNA, 103 bp, Artificial Sequence
  Synthetic Polynucleotide
taatacgactcactatagggttagttgtttattcagatcgcagtgtttaaaacagaggagattaaacatggcgatctgaaacctggcggcagcgcaaaagatg

SEQ ID NO: 70878 - DNA, 103 bp, Artificial Sequence
  Synthetic Polynucleotide
taatacgactcactatagggacattttagttgtttattcagatcgcagtgaacagaggagacactgcatgctgaataaaaacctggcggcagcgcaaaagatg

SEQ ID NO: 70879 - DNA, 103 bp, Artificial Sequence
  Synthetic Polynucleotide
taatacgactcactatagggataccacattttagttgtttattcagatcgaacagaggagacgatctatgtaaacaactaacctggcggcagcgcaaaagatg

SEQ ID NO: 70880 - DNA, 103 bp, Artificial Sequence
  Synthetic Polynucleotide
taatacgactcactataggggagacataccacattttagttgtttattcaaacagaggagatgaataatgaactaaaataacctggcggcagcgcaaaagatg

SEQ ID NO: 70881 - DNA, 103 bp, Artificial Sequence
  Synthetic Polynucleotide
taatacgactcactatagggttacaggctctgttcaaatacgacattaataacagaggagaattaatatggtatttgaaaacctggcggcagcgcaaaagatg

SEQ ID NO: 70882 - DNA, 103 bp, Artificial Sequence
  Synthetic Polynucleotide
taatacgactcactatagggtaatggagacataccacattttagttgtttaacagaggagaaaacaaatgaaatgtggtaacctggcggcagcgcaaaagatg

SEQ ID NO: 70883 - DNA, 103 bp, Artificial Sequence
  Synthetic Polynucleotide
taatacgactcactatagggcaatgtaatggagacataccacattttagtaacagaggagaactaaaatgtggtatgtcaacctggcggcagcgcaaaagatg

SEQ ID NO: 70884 - DNA, 103 bp, Artificial Sequence
  Synthetic Polynucleotide
taatacgactcactatagggcatagcaatgtaatggagacataccacattaacagaggagaaatgtgatgtgtctccataacctggcggcagcgcaaaagatg

SEQ ID NO: 70885 - DNA, 103 bp, Artificial Sequence
  Synthetic Polynucleotide
taatacgactcactatagggcatcacatagcaatgtaatggagacataccaacagaggagaggtatgatgccattacataacctggcggcagcgcaaaagatg

SEQ ID NO: 70886 - DNA, 103 bp, Artificial Sequence
  Synthetic Polynucleotide
taatacgactcactataggggtattcatcacatagcaatgtaatggagacaacagaggagagtctccatgacattgctaaacctggcggcagcgcaaaagatg

SEQ ID NO: 70887 - DNA, 103 bp, Artificial Sequence
  Synthetic Polynucleotide
taatacgactcactatagggatcgtgtattcatcacatagcaatgtaatgaacagaggagacattacatggctatgtgaaacctggcggcagcgcaaaagatg

SEQ ID NO: 70888 - DNA, 103 bp, Artificial Sequence
  Synthetic Polynucleotide
taatacgactcactatagggcttaaatcgtgtattcatcacatagcaatgaacagaggagacattgcatggtgatgaataacctggcggcagcgcaaaagatg

SEQ ID NO: 70889 - DNA, 103 bp, Artificial Sequence
  Synthetic Polynucleotide
taatacgactcactataggggatggcttaaatcgtgtattcatcacatagaacagaggagactatgtatggaatacacgaacctggcggcagcgcaaaagatg

SEQ ID NO: 70890 - DNA, 103 bp, Artificial Sequence
  Synthetic Polynucleotide
taatacgactcactatagggatacagatggcttaaatcgtgtattcatcaaacagaggagatgatgaatgcacgatttaaacctggcggcagcgcaaaagatg

SEQ ID NO: 70891 - DNA, 103 bp, Artificial Sequence
  Synthetic Polynucleotide
taatacgactcactatagggctttaatacagatggcttaaatcgtgtattaacagaggagaaatacaatgtttaagccaaacctggcggcagcgcaaaagatg

SEQ ID NO: 70892 - DNA, 103 bp, Artificial Sequence
  Synthetic Polynucleotide
taatacgactcactatagggaggtgttacaggctctgttcaaatacgacaaacagaggagatgtcgtatgtgaacagagaacctggcggcagcgcaaaagatg

SEQ ID NO: 70893 - DNA, 103 bp, Artificial Sequence
  Synthetic Polynucleotide
taatacgactcactatagggaatatctttaatacagatggcttaaatcgtaacagaggagaacgattatggccatctgtaacctggcggcagcgcaaaagatg

SEQ ID NO: 70894 - DNA, 103 bp, Artificial Sequence
  Synthetic Polynucleotide
taatacgactcactataggggtaacaatatctttaatacagatggcttaaaacagaggagattaagcatgctgtattaaaacctggcggcagcgcaaaagatg

SEQ ID NO: 70895 - DNA, 103 bp, Artificial Sequence
  Synthetic Polynucleotide
taatacgactcactataggggttgtgtaacaatatctttaatacagatggaacagaggagaccatctatgttaaagataaacctggcggcagcgcaaaagatg

SEQ ID NO: 70896 - DNA, 103 bp, Artificial Sequence
  Synthetic Polynucleotide
taatacgactcactatagggacaccgttgtgtaacaatatctttaatacaaacagaggagatgtattatggatattgttaacctggcggcagcgcaaaagatg

SEQ ID NO: 70897 - DNA, 103 bp, Artificial Sequence
  Synthetic Polynucleotide
taatacgactcactatagggtattcacaccgttgtgtaacaatatctttaaacagaggagataaagaatgtgttacacaaacctggcggcagcgcaaaagatg

SEQ ID NO: 70898 - DNA, 103 bp, Artificial Sequence
  Synthetic Polynucleotide
taatacgactcactatagggaaagttattcacaccgttgtgtaacaatataacagaggagaatattgatgcacaacggtaacctggcggcagcgcaaaagatg

SEQ ID NO: 70899 - DNA, 103 bp, Artificial Sequence
  Synthetic Polynucleotide
taatacgactcactatagggttatcaaagttattcacaccgttgtgtaacaacagaggagagttacaatgcggtgtgaaaacctggcggcagcgcaaaagatg

SEQ ID NO: 70900 - DNA, 103 bp, Artificial Sequence
  Synthetic Polynucleotide
taatacgactcactatagggccttattatcaaagttattcacaccgttgtaacagaggagaacaacgatgtgaataactaacctggcggcagcgcaaaagatg

SEQ ID NO: 70901 - DNA, 103 bp, Artificial Sequence
  Synthetic Polynucleotide
taatacgactcactataggggttatccttattatcaaagttattcacaccaacagaggagaggtgtgatgaactttgataacctggcggcagcgcaaaagatg

SEQ ID NO: 70902 - DNA, 103 bp, Artificial Sequence
  Synthetic Polynucleotide
taatacgactcactatagggcctttgttatccttattatcaaagttattcaacagaggagagaataaatgtgataataaaacctggcggcagcgcaaaagatg

SEQ ID NO: 70903 - DNA, 103 bp, Artificial Sequence
  Synthetic Polynucleotide
taatacgactcactatagggaacaacatcagatatttcatcgacatttttaacagaggagaaaaaatatggatgaaataaacctggcggcagcgcaaaagatg

SEQ ID NO: 70904 - DNA, 103 bp, Artificial Sequence
  Synthetic Polynucleotide
taatacgactcactatagggcattgaggtgttacaggctctgttcaaataaacagaggagatatttgatgagagcctgtaacctggcggcagcgcaaaagatg

SEQ ID NO: 70905 - DNA, 103 bp, Artificial Sequence
  Synthetic Polynucleotide
taatacgactcactatagggtatgtcctttgttatccttattatcaaagtaacagaggagaactttgatgataaggataaacctggcggcagcgcaaaagatg

SEQ ID NO: 70906 - DNA, 103 bp, Artificial Sequence
  Synthetic Polynucleotide
taatacgactcactatagggaggaatatgtcctttgttatccttattatcaacagaggagagataatatggataacaaaaacctggcggcagcgcaaaagatg

SEQ ID NO: 70907 - DNA, 103 bp, Artificial Sequence
  Synthetic Polynucleotide
taatacgactcactatagggtgtagaggaatatgtcctttgttatccttaaacagaggagataaggaatgcaaaggacaaacctggcggcagcgcaaaagatg

SEQ ID NO: 70908 - DNA, 103 bp, Artificial Sequence
  Synthetic Polynucleotide
taatacgactcactatagggagtggtgtagaggaatatgtcctttgttataacagaggagaataacaatggacatattcaacctggcggcagcgcaaaagatg

SEQ ID NO: 70909 - DNA, 103 bp, Artificial Sequence
  Synthetic Polynucleotide
taatacgactcactatagggcagatagtggtgtagaggaatatgtcctttaacagaggagaaaaggaatgattcctctaaacctggcggcagcgcaaaagatg

SEQ ID NO: 70910 - DNA, 103 bp, Artificial Sequence
  Synthetic Polynucleotide
taatacgactcactatagggtaaatcagatagtggtgtagaggaatatgtaacagaggagaacatatatgtctacaccaaacctggcggcagcgcaaaagatg

SEQ ID NO: 70911 - DNA, 103 bp, Artificial Sequence
  Synthetic Polynucleotide
taatacgactcactataggggtgaataaatcagatagtggtgtagaggaaaacagaggagattcctcatgaccactatcaacctggcggcagcgcaaaagatg

SEQ ID NO: 70912 - DNA, 103 bp, Artificial Sequence
  Synthetic Polynucleotide
taatacgactcactatagggtgatagtgaataaatcagatagtggtgtagaacagaggagactacacatgtatctgattaacctggcggcagcgcaaaagatg

SEQ ID NO: 70913 - DNA, 103 bp, Artificial Sequence
  Synthetic Polynucleotide
taatacgactcactatagggtcgattgatagtgaataaatcagatagtggaacagaggagaccactaatggatttattcaacctggcggcagcgcaaaagatg

SEQ ID NO: 70914 - DNA, 103 bp, Artificial Sequence
  Synthetic Polynucleotide
taatacgactcactatagggtgttatcgattgatagtgaataaatcagataacagaggagaatctgaatgattcactataacctggcggcagcgcaaaagatg

SEQ ID NO: 70915 - DNA, 103 bp, Artificial Sequence
  Synthetic Polynucleotide
taatacgactcactatagggaaagacattgaggtgttacaggctctgttcaacagaggagagaacagatgctgtaacacaacctggcggcagcgcaaaagatg

SEQ ID NO: 70916 - DNA, 103 bp, Artificial Sequence
  Synthetic Polynucleotide
taatacgactcactataggggaccttgttatcgattgatagtgaataaataacagaggagaatttatatgctatcaatcaacctggcggcagcgcaaaagatg

SEQ ID NO: 70917 - DNA, 103 bp, Artificial Sequence
  Synthetic Polynucleotide
taatacgactcactatagggtcaaagaccttgttatcgattgatagtgaaaacagaggagattcactatgaatcgataaaacctggcggcagcgcaaaagatg

SEQ ID NO: 70918 - DNA, 103 bp, Artificial Sequence
  Synthetic Polynucleotide
taatacgactcactataggggtatatcaaagaccttgttatcgattgataaacagaggagatatcaaatgataacaaggaacctggcggcagcgcaaaagatg

SEQ ID NO: 70919 - DNA, 103 bp, Artificial Sequence
  Synthetic Polynucleotide
taatacgactcactatagggagttagtatatcaaagaccttgttatcgataacagaggagaatcgatatgaaggtctttaacctggcggcagcgcaaaagatg

SEQ ID NO: 70920 - DNA, 103 bp, Artificial Sequence
  Synthetic Polynucleotide
taatacgactcactataggggggtcagttagtatatcaaagaccttgttaaacagaggagataacaaatgctttgatataacctggcggcagcgcaaaagatg

SEQ ID NO: 70921 - DNA, 103 bp, Artificial Sequence
  Synthetic Polynucleotide
taatacgactcactatagggcaatggggtcagttagtatatcaaagacctaacagaggagaaggtctatgatatactaaaacctggcggcagcgcaaaagatg

SEQ ID NO: 70922 - DNA, 103 bp, Artificial Sequence
  Synthetic Polynucleotide
taatacgactcactataggggtcatcaatggggtcagttagtatatcaaaaacagaggagatttgatatgctaactgacaacctggcggcagcgcaaaagatg

SEQ ID NO: 70923 - DNA, 103 bp, Artificial Sequence
  Synthetic Polynucleotide
taatacgactcactatagggctaaagtcatcaatggggtcagttagtataaacagaggagatatactatgtgaccccataacctggcggcagcgcaaaagatg

SEQ ID NO: 70924 - DNA, 103 bp, Artificial Sequence
  Synthetic Polynucleotide
taatacgactcactatagggatttactaaagtcatcaatggggtcagttaaacagaggagataactgatgccattgatgaacctggcggcagcgcaaaagatg

SEQ ID NO: 70925 - DNA, 103 bp, Artificial Sequence
  Synthetic Polynucleotide
taatacgactcactatagggggatgatttactaaagtcatcaatggggtcaacagaggagagaccccatggatgactttaacctggcggcagcgcaaaagatg

SEQ ID NO: 70926 - DNA, 103 bp, Artificial Sequence
  Synthetic Polynucleotide
taatacgactcactatagggataataaagacattgaggtgttacaggctcaacagaggagagagcctatgacacctcaaaacctggcggcagcgcaaaagatg

SEQ ID NO: 70927 - DNA, 103 bp, Artificial Sequence
  Synthetic Polynucleotide
taatacgactcactatagggagatcggatgatttactaaagtcatcaatgaacagaggagacattgaatgctttagtaaaacctggcggcagcgcaaaagatg

SEQ ID NO: 70928 - DNA, 103 bp, Artificial Sequence
  Synthetic Polynucleotide
taatacgactcactataggggcaatagatcggatgatttactaaagtcataacagaggagaatgactatggtaaatcataacctggcggcagcgcaaaagatg

SEQ ID NO: 70929 - DNA, 103 bp, Artificial Sequence
  Synthetic Polynucleotide
taatacgactcactatagggacacagcaatagatcggatgatttactaaaaacagaggagatttagtatgtcatccgataacctggcggcagcgcaaaagatg

SEQ ID NO: 70930 - DNA, 103 bp, Artificial Sequence
  Synthetic Polynucleotide
taatacgactcactatagggagataacacagcaatagatcggatgatttaaacagaggagataaatcatgcgatctattaacctggcggcagcgcaaaagatg

SEQ ID NO: 70931 - DNA, 103 bp, Artificial Sequence
  Synthetic Polynucleotide
taatacgactcactatagggatctaagataacacagcaatagatcggatgaacagaggagacatccgatgtattgctgtaacctggcggcagcgcaaaagatg

SEQ ID NO: 70932 - DNA, 103 bp, Artificial Sequence
  Synthetic Polynucleotide
taatacgactcactatagggtttatatctaagataacacagcaatagatcaacagaggagagatctaatgctgtgttataacctggcggcagcgcaaaagatg

SEQ ID NO: 70933 - DNA, 103 bp, Artificial Sequence
  Synthetic Polynucleotide
taatacgactcactatagggttgaatttatatctaagataacacagcaataacagaggagaattgctatgttatcttagaacctggcggcagcgcaaaagatg

SEQ ID NO: 70934 - DNA, 103 bp, Artificial Sequence
  Synthetic Polynucleotide
taatacgactcactatagggtcccattgaatttatatctaagataacacaaacagaggagatgtgttatgttagatataaacctggcggcagcgcaaaagatg

SEQ ID NO: 70935 - DNA, 103 bp, Artificial Sequence
  Synthetic Polynucleotide
taatacgactcactatagggtaatctcccattgaatttatatctaagataaacagaggagatatcttatgtataaattcaacctggcggcagcgcaaaagatg

SEQ ID NO: 70936 - DNA, 103 bp, Artificial Sequence
  Synthetic Polynucleotide
taatacgactcactatagggtagtttaatctcccattgaatttatatctaaacagaggagatagataatgattcaatggaacctggcggcagcgcaaaagatg

SEQ ID NO: 70937 - DNA, 103 bp, Artificial Sequence
  Synthetic Polynucleotide
taatacgactcactatagggtatagataataaagacattgaggtgttacaaacagaggagatgtaacatgtcaatgtctaacctggcggcagcgcaaaagatg

SEQ ID NO: 70938 - DNA, 103 bp, Artificial Sequence
  Synthetic Polynucleotide
taatacgactcactatagggcgtagtagtttaatctcccattgaatttataacagaggagaataaatatgatgggagataacctggcggcagcgcaaaagatg

SEQ ID NO: 70939 - DNA, 103 bp, Artificial Sequence
  Synthetic Polynucleotide
taatacgactcactatagggcagaacgtagtagtttaatctcccattgaaaacagaggagattcaatatgagattaaacaacctggcggcagcgcaaaagatg

SEQ ID NO: 70940 - DNA, 103 bp, Artificial Sequence
  Synthetic Polynucleotide
taatacgactcactatagggttgtacagaacgtagtagtttaatctcccaaacagaggagatgggagatgaaactactaaacctggcggcagcgcaaaagatg

SEQ ID NO: 70941 - DNA, 103 bp, Artificial Sequence
  Synthetic Polynucleotide
taatacgactcactatagggataatttgtacagaacgtagtagtttaatcaacagaggagagattaaatgactacgttcaacctggcggcagcgcaaaagatg

SEQ ID NO: 70942 - DNA, 103 bp, Artificial Sequence
  Synthetic Polynucleotide
taatacgactcactatagggagtcaataatttgtacagaacgtagtagttaacagaggagaaactacatggttctgtacaacctggcggcagcgcaaaagatg

SEQ ID NO: 70943 - DNA, 103 bp, Artificial Sequence
  Synthetic Polynucleotide
taatacgactcactatagggcctttagtcaataatttgtacagaacgtagaacagaggagactacgtatggtacaaattaacctggcggcagcgcaaaagatg

SEQ ID NO: 70944 - DNA, 103 bp, Artificial Sequence
  Synthetic Polynucleotide
taatacgactcactatagggcagatcctttagtcaataatttgtacagaaaacagaggagattctgtatgaattattgaaacctggcggcagcgcaaaagatg

SEQ ID NO: 70945 - DNA, 103 bp, Artificial Sequence
  Synthetic Polynucleotide
taatacgactcactatagggagggtcagatcctttagtcaataatttgtaaacagaggagatacaaaatgttgactaaaaacctggcggcagcgcaaaagatg

SEQ ID NO: 70946 - DNA, 103 bp, Artificial Sequence
  Synthetic Polynucleotide
taatacgactcactatagggcaattagggtcagatcctttagtcaataataacagaggagaattattatgtaaaggatcaacctggcggcagcgcaaaagatg

SEQ ID NO: 70947 - DNA, 103 bp, Artificial Sequence
  Synthetic Polynucleotide
taatacgactcactatagggcgacgcaattagggtcagatcctttagtcaaacagaggagatgactaatggatctgaccaacctggcggcagcgcaaaagatg

SEQ ID NO: 70948 - DNA, 103 bp, Artificial Sequence
  Synthetic Polynucleotide
taatacgactcactatagggttggctatagataataaagacattgaggtgaacagaggagacacctcatggtctttattaacctggcggcagcgcaaaagatg

SEQ ID NO: 70949 - DNA, 103 bp, Artificial Sequence
  Synthetic Polynucleotide
taatacgactcactatagggctcgtcgacgcaattagggtcagatcctttaacagaggagaaaaggaatggaccctaataacctggcggcagcgcaaaagatg

SEQ ID NO: 70950 - DNA, 103 bp, Artificial Sequence
  Synthetic Polynucleotide
taatacgactcactatagggccatcctcgtcgacgcaattagggtcagataacagaggagaatctgaatgtaattgcgtaacctggcggcagcgcaaaagatg

SEQ ID NO: 70951 - DNA, 103 bp, Artificial Sequence
  Synthetic Polynucleotide
taatacgactcactatagggtgagtccatcctcgtcgacgcaattagggtaacagaggagaaccctaatggcgtcgacgaacctggcggcagcgcaaaagatg

SEQ ID NO: 70952 - DNA, 103 bp, Artificial Sequence
  Synthetic Polynucleotide
taatacgactcactatagggagaagtgagtccatcctcgtcgacgcaattaacagaggagaaattgcatggacgaggataacctggcggcagcgcaaaagatg

SEQ ID NO: 70953 - DNA, 103 bp, Artificial Sequence
  Synthetic Polynucleotide
taatacgactcactatagggtgaagagaagtgagtccatcctcgtcgacgaacagaggagacgtcgaatgggatggactaacctggcggcagcgcaaaagatg

SEQ ID NO: 70954 - DNA, 103 bp, Artificial Sequence
  Synthetic Polynucleotide
taatacgactcactatagggagtaatgaagagaagtgagtccatcctcgtaacagaggagaacgaggatggactcacttaacctggcggcagcgcaaaagatg

SEQ ID NO: 70955 - DNA, 103 bp, Artificial Sequence
  Synthetic Polynucleotide
taatacgactcactatagggacagtagtaatgaagagaagtgagtccatcaacagaggagagatggaatgacttctcttaacctggcggcagcgcaaaagatg

SEQ ID NO: 70956 - DNA, 103 bp, Artificial Sequence
  Synthetic Polynucleotide
taatacgactcactatagggtgtttacagtagtaatgaagagaagtgagtaacagaggagaactcacatgtcttcattaaacctggcggcagcgcaaaagatg

SEQ ID NO: 70957 - DNA, 103 bp, Artificial Sequence
  Synthetic Polynucleotide
taatacgactcactatagggatatgtgtttacagtagtaatgaagagaagaacagaggagacttctcatgattactactaacctggcggcagcgcaaaagatg

SEQ ID NO: 70958 - DNA, 103 bp, Artificial Sequence
  Synthetic Polynucleotide
taatacgactcactatagggtgcggatatgtgtttacagtagtaatgaagaacagaggagacttcatatgtactgtaaaaacctggcggcagcgcaaaagatg

SEQ ID NO: 70959 - DNA, 103 bp, Artificial Sequence
  Synthetic Polynucleotide
taatacgactcactatagggttaaattggctatagataataaagacattgaacagaggagacaatgtatgtattatctaaacctggcggcagcgcaaaagatg

SEQ ID NO: 70960 - DNA, 103 bp, Artificial Sequence
  Synthetic Polynucleotide
taatacgactcactatagggtggaatgcggatatgtgtttacagtagtaaaacagaggagattactaatgtaaacacataacctggcggcagcgcaaaagatg

SEQ ID NO: 70961 - DNA, 103 bp, Artificial Sequence
  Synthetic Polynucleotide
taatacgactcactatagggtttcgtggaatgcggatatgtgtttacagtaacagaggagaactgtaatgacatatccgaacctggcggcagcgcaaaagatg

SEQ ID NO: 70962 - DNA, 103 bp, Artificial Sequence
  Synthetic Polynucleotide
taatacgactcactatagggattactttcgtggaatgcggatatgtgtttaacagaggagaaaacacatgtccgcattcaacctggcggcagcgcaaaagatg

SEQ ID NO: 70963 - DNA, 103 bp, Artificial Sequence
  Synthetic Polynucleotide
taatacgactcactatagggtaataattactttcgtggaatgcggatatgaacagaggagacatatcatgattccacgaaacctggcggcagcgcaaaagatg

SEQ ID NO: 70964 - DNA, 103 bp, Artificial Sequence
  Synthetic Polynucleotide
taatacgactcactatagggacttgtaataattactttcgtggaatgcggaacagaggagaccgcatatgacgaaagtaaacctggcggcagcgcaaaagatg

SEQ ID NO: 70965 - DNA, 103 bp, Artificial Sequence
  Synthetic Polynucleotide
taatacgactcactatagggctttgacttgtaataattactttcgtggaaaacagaggagattccacatgagtaattataacctggcggcagcgcaaaagatg

SEQ ID NO: 70966 - DNA, 103 bp, Artificial Sequence
  Synthetic Polynucleotide
taatacgactcactatagggtaactctttgacttgtaataattactttcgaacagaggagacgaaagatgttattacaaaacctggcggcagcgcaaaagatg

SEQ ID NO: 70967 - DNA, 103 bp, Artificial Sequence
  Synthetic Polynucleotide
taatacgactcactatagggtagtgtaactctttgacttgtaataattacaacagaggagagtaattatgacaagtcaaaacctggcggcagcgcaaaagatg

SEQ ID NO: 70968 - DNA, 103 bp, Artificial Sequence
  Synthetic Polynucleotide
taatacgactcactatagggcatcttagtgtaactctttgacttgtaataaacagaggagatattacatgtcaaagagtaacctggcggcagcgcaaaagatg

SEQ ID NO: 70969 - DNA, 103 bp, Artificial Sequence
  Synthetic Polynucleotide
taatacgactcactataggggctcgcatcttagtgtaactctttgacttgaacagaggagacaagtcatggagttacacaacctggcggcagcgcaaaagatg

SEQ ID NO: 70970 - DNA, 103 bp, Artificial Sequence
  Synthetic Polynucleotide
taatacgactcactatagggggacattaaattggctatagataataaagaaacagaggagatctttaatgtctatagccaacctggcggcagcgcaaaagatg

SEQ ID NO: 70971 - DNA, 103 bp, Artificial Sequence
  Synthetic Polynucleotide
taatacgactcactatagggtctcagctcgcatcttagtgtaactctttgaacagaggagacaaagaatgacactaagaaacctggcggcagcgcaaaagatg

SEQ ID NO: 70972 - DNA, 103 bp, Artificial Sequence
  Synthetic Polynucleotide
taatacgactcactatagggtcgcttctcagctcgcatcttagtgtaactaacagaggagaagttacatgaagatgcgaaacctggcggcagcgcaaaagatg

SEQ ID NO: 70973 - DNA, 103 bp, Artificial Sequence
  Synthetic Polynucleotide
taatacgactcactatagggatgaatcgcttctcagctcgcatcttagtgaacagaggagacactaaatggcgagctgaaacctggcggcagcgcaaaagatg

SEQ ID NO: 70974 - DNA, 103 bp, Artificial Sequence
  Synthetic Polynucleotide
taatacgactcactatagggtatagatgaatcgcttctcagctcgcatctaacagaggagaagatgcatgctgagaagcaacctggcggcagcgcaaaagatg

SEQ ID NO: 70975 - DNA, 103 bp, Artificial Sequence
  Synthetic Polynucleotide
taatacgactcactatagggtatcgtatagatgaatcgcttctcagctcgaacagaggagacgagctatgaagcgattcaacctggcggcagcgcaaaagatg

SEQ ID NO: 70976 - DNA, 103 bp, Artificial Sequence
  Synthetic Polynucleotide
taatacgactcactatagggtttattatcgtatagatgaatcgcttctcaaacagaggagatgagaaatgattcatctaaacctggcggcagcgcaaaagatg

SEQ ID NO: 70977 - DNA, 103 bp, Artificial Sequence
  Synthetic Polynucleotide
taatacgactcactatagggcatgatttattatcgtatagatgaatcgctaacagaggagaagcgatatgtctatacgaaacctggcggcagcgcaaaagatg

SEQ ID NO: 70978 - DNA, 103 bp, Artificial Sequence
  Synthetic Polynucleotide
taatacgactcactatagggtgccccatgatttattatcgtatagatgaaaacagaggagattcatcatgacgataataaacctggcggcagcgcaaaagatg

SEQ ID NO: 70979 - DNA, 103 bp, Artificial Sequence
  Synthetic Polynucleotide
taatacgactcactatagggatgtttgccccatgatttattatcgtatagaacagaggagactatacatgaataaatcaaacctggcggcagcgcaaaagatg

SEQ ID NO: 70980 - DNA, 103 bp, Artificial Sequence
  Synthetic Polynucleotide
taatacgactcactatagggcgttaatgtttgccccatgatttattatcgaacagaggagacgataaatgatcatggggaacctggcggcagcgcaaaagatg

SEQ ID NO: 70981 - DNA, 103 bp, Artificial Sequence
  Synthetic Polynucleotide
taatacgactcactatagggattccggacattaaattggctatagataataacagaggagaattatcatgagccaatttaacctggcggcagcgcaaaagatg

SEQ ID NO: 70982 - DNA, 103 bp, Artificial Sequence
  Synthetic Polynucleotide
taatacgactcactatagggaaccgcgttaatgtttgccccatgatttataacagaggagaataaatatgggggcaaacaacctggcggcagcgcaaaagatg

SEQ ID NO: 70983 - DNA, 103 bp, Artificial Sequence
  Synthetic Polynucleotide
taatacgactcactatagggttcgtaaccgcgttaatgtttgccccatgaaacagaggagatcatggatgaaacattaaaacctggcggcagcgcaaaagatg

SEQ ID NO: 70984 - DNA, 103 bp, Artificial Sequence
  Synthetic Polynucleotide
taatacgactcactatagggcgattttcgtaaccgcgttaatgtttgcccaacagaggagagggcaaatgttaacgcggaacctggcggcagcgcaaaagatg

SEQ ID NO: 70985 - DNA, 103 bp, Artificial Sequence
  Synthetic Polynucleotide
taatacgactcactatagggatttccgattttcgtaaccgcgttaatgttaacagaggagaaacattatggcggttacgaacctggcggcagcgcaaaagatg

SEQ ID NO: 70986 - DNA, 103 bp, Artificial Sequence
  Synthetic Polynucleotide
taatacgactcactatagggggcgtatttccgattttcgtaaccgcgttaaacagaggagataacgcatgtacgaaaataacctggcggcagcgcaaaagatg

SEQ ID NO: 70987 - DNA, 103 bp, Artificial Sequence
  Synthetic Polynucleotide
taatacgactcactataggggtaacggcgtatttccgattttcgtaaccgaacagaggagacggttaatgaaatcggaaaacctggcggcagcgcaaaagatg

SEQ ID NO: 70988 - DNA, 103 bp, Artificial Sequence
  Synthetic Polynucleotide
taatacgactcactatagggagtgtgtaacggcgtatttccgattttcgtaacagaggagaacgaaaatgggaaatacgaacctggcggcagcgcaaaagatg

SEQ ID NO: 70989 - DNA, 103 bp, Artificial Sequence
  Synthetic Polynucleotide
taatacgactcactatagggaggtaagtgtgtaacggcgtatttccgattaacagaggagaaatcggatgtacgccgttaacctggcggcagcgcaaaagatg

SEQ ID NO: 70990 - DNA, 103 bp, Artificial Sequence
  Synthetic Polynucleotide
taatacgactcactataggggttgaaggtaagtgtgtaacggcgtatttcaacagaggagagaaataatgcgttacacaaacctggcggcagcgcaaaagatg

SEQ ID NO: 70991 - DNA, 103 bp, Artificial Sequence
  Synthetic Polynucleotide
taatacgactcactatagggatactgttgaaggtaagtgtgtaacggcgtaacagaggagaacgccgatgcacacttacaacctggcggcagcgcaaaagatg

SEQ ID NO: 70992 - DNA, 103 bp, Artificial Sequence
  Synthetic Polynucleotide
taatacgactcactatagggtcttcattccggacattaaattggctatagaacagaggagactatagatgatttaatgtaacctggcggcagcgcaaaagatg

SEQ ID NO: 70993 - DNA, 103 bp, Artificial Sequence
  Synthetic Polynucleotide
taatacgactcactatagggttggtatactgttgaaggtaagtgtgtaacaacagaggagagttacaatgttaccttcaaacctggcggcagcgcaaaagatg

SEQ ID NO: 70994 - DNA, 103 bp, Artificial Sequence
  Synthetic Polynucleotide
taatacgactcactatagggtatgtttggtatactgttgaaggtaagtgtaacagaggagaacacttatgttcaacagtaacctggcggcagcgcaaaagatg

SEQ ID NO: 70995 - DNA, 103 bp, Artificial Sequence
  Synthetic Polynucleotide
taatacgactcactatagggaggactatgtttggtatactgttgaaggtaaacagaggagataccttatgcagtataccaacctggcggcagcgcaaaagatg

SEQ ID NO: 70996 - DNA, 103 bp, Artificial Sequence
  Synthetic Polynucleotide
taatacgactcactatagggacacgaggactatgtttggtatactgttgaaacagaggagatcaacaatgtaccaaacaaacctggcggcagcgcaaaagatg

SEQ ID NO: 70997 - DNA, 103 bp, Artificial Sequence
  Synthetic Polynucleotide
taatacgactcactatagggacaccacacgaggactatgtttggtatactaacagaggagaagtataatgaacatagtcaacctggcggcagcgcaaaagatg

SEQ ID NO: 70998 - DNA, 103 bp, Artificial Sequence
  Synthetic Polynucleotide
taatacgactcactatagggagcatacaccacacgaggactatgtttggtaacagaggagaaccaaaatgagtcctcgtaacctggcggcagcgcaaaagatg

SEQ ID NO: 70999 - DNA, 103 bp, Artificial Sequence
  Synthetic Polynucleotide
taatacgactcactatagggaaaagagcatacaccacacgaggactatgtaacagaggagaacatagatgtcgtgtggtaacctggcggcagcgcaaaagatg

SEQ ID NO: 71000 - DNA, 103 bp, Artificial Sequence
  Synthetic Polynucleotide
taatacgactcactataggggagataaaagagcatacaccacacgaggacaacagaggagagtcctcatgtggtgtatgaacctggcggcagcgcaaaagatg

SEQ ID NO: 71001 - DNA, 103 bp, Artificial Sequence
  Synthetic Polynucleotide
taatacgactcactatagggtcctcgagataaaagagcatacaccacacgaacagaggagacgtgtgatgtatgctcttaacctggcggcagcgcaaaagatg

SEQ ID NO: 71002 - DNA, 103 bp, Artificial Sequence
  Synthetic Polynucleotide
taatacgactcactatagggtcggctcctcgagataaaagagcatacaccaacagaggagaggtgtaatgtcttttatcaacctggcggcagcgcaaaagatg

SEQ ID NO: 71003 - DNA, 103 bp, Artificial Sequence
  Synthetic Polynucleotide
taatacgactcactatagggccttctcttcattccggacattaaattggcaacagaggagagccaatatgatgtccggaaacctggcggcagcgcaaaagatg

SEQ ID NO: 71004 - DNA, 103 bp, Artificial Sequence
  Synthetic Polynucleotide
taatacgactcactatagggtcgtatcggctcctcgagataaaagagcataacagaggagaatgctcatgtatctcgagaacctggcggcagcgcaaaagatg

SEQ ID NO: 71005 - DNA, 103 bp, Artificial Sequence
  Synthetic Polynucleotide
taatacgactcactatagggtattctcgtatcggctcctcgagataaaagaacagaggagacttttaatgcgaggagccaacctggcggcagcgcaaaagatg

SEQ ID NO: 71006 - DNA, 103 bp, Artificial Sequence
  Synthetic Polynucleotide
taatacgactcactatagggttacgtattctcgtatcggctcctcgagataacagaggagaatctcgatgagccgatacaacctggcggcagcgcaaaagatg

SEQ ID NO: 71007 - DNA, 103 bp, Artificial Sequence
  Synthetic Polynucleotide
taatacgactcactatagggaattattacgtattctcgtatcggctcctcaacagaggagagaggagatgatacgagaaaacctggcggcagcgcaaaagatg

SEQ ID NO: 71008 - DNA, 103 bp, Artificial Sequence
  Synthetic Polynucleotide
taatacgactcactatagggatcaaaattattacgtattctcgtatcggcaacagaggagagccgatatgagaatacgtaacctggcggcagcgcaaaagatg

SEQ ID NO: 71009 - DNA, 103 bp, Artificial Sequence
  Synthetic Polynucleotide
taatacgactcactataggggtacaatcaaaattattacgtattctcgtaaacagaggagatacgagatgacgtaataaaacctggcggcagcgcaaaagatg

SEQ ID NO: 71010 - DNA, 103 bp, Artificial Sequence
  Synthetic Polynucleotide
taatacgactcactatagggtgggtgtacaatcaaaattattacgtattcaacagaggagagaatacatgataattttgaacctggcggcagcgcaaaagatg

SEQ ID NO: 71011 - DNA, 103 bp, Artificial Sequence
  Synthetic Polynucleotide
taatacgactcactatagggcatgatgggtgtacaatcaaaattattacgaacagaggagacgtaatatgtttgattgtaacctggcggcagcgcaaaagatg

SEQ ID NO: 71012 - DNA, 103 bp, Artificial Sequence
  Synthetic Polynucleotide
taatacgactcactatagggtattccatgatgggtgtacaatcaaaattaaacagaggagataatttatgttgtacaccaacctggcggcagcgcaaaagatg

SEQ ID NO: 71013 - DNA, 103 bp, Artificial Sequence
  Synthetic Polynucleotide
taatacgactcactatagggttatgtattccatgatgggtgtacaatcaaaacagaggagattgattatgcacccatcaaacctggcggcagcgcaaaagatg

SEQ ID NO: 71014 - DNA, 103 bp, Artificial Sequence
  Synthetic Polynucleotide
taatacgactcactatagggcgaacaacaacatcagatatttcatcgacaaacagaggagatgtcgaatgaatatctgaaacctggcggcagcgcaaaagatg

SEQ ID NO: 71015 - DNA, 103 bp, Artificial Sequence
  Synthetic Polynucleotide
taatacgactcactatagggaatttccttctcttcattccggacattaaaaacagaggagatttaatatgcggaatgaaaacctggcggcagcgcaaaagatg

SEQ ID NO: 71016 - DNA, 103 bp, Artificial Sequence
  Synthetic Polynucleotide
taatacgactcactataggggttctttatgtattccatgatgggtgtacaaacagaggagatgtacaatgatcatggaaaacctggcggcagcgcaaaagatg

SEQ ID NO: 71017 - DNA, 103 bp, Artificial Sequence
  Synthetic Polynucleotide
taatacgactcactatagggcaatcgttctttatgtattccatgatgggtaacagaggagaacccatatgggaatacataacctggcggcagcgcaaaagatg

SEQ ID NO: 71018 - DNA, 103 bp, Artificial Sequence
  Synthetic Polynucleotide
taatacgactcactatagggttacacaatcgttctttatgtattccatgaaacagaggagatcatggatgacataaagaaacctggcggcagcgcaaaagatg

SEQ ID NO: 71019 - DNA, 103 bp, Artificial Sequence
  Synthetic Polynucleotide
taatacgactcactatagggacctgttacacaatcgttctttatgtattcaacagaggagagaatacatgaagaacgataacctggcggcagcgcaaaagatg

SEQ ID NO: 71020 - DNA, 103 bp, Artificial Sequence
  Synthetic Polynucleotide
taatacgactcactatagggatatgacctgttacacaatcgttctttatgaacagaggagacataaaatgcgattgtgtaacctggcggcagcgcaaaagatg

SEQ ID NO: 71021 - DNA, 103 bp, Artificial Sequence
  Synthetic Polynucleotide
taatacgactcactatagggtgagaatatgacctgttacacaatcgttctaacagaggagaagaacgatggtgtaacagaacctggcggcagcgcaaaagatg

SEQ ID NO: 71022 - DNA, 103 bp, Artificial Sequence
  Synthetic Polynucleotide
taatacgactcactatagggcattatgagaatatgacctgttacacaatcaacagaggagagattgtatgacaggtcataacctggcggcagcgcaaaagatg

SEQ ID NO: 71023 - DNA, 103 bp, Artificial Sequence
  Synthetic Polynucleotide
taatacgactcactatagggagtaacattatgagaatatgacctgttacaaacagaggagatgtaacatgtcatattctaacctggcggcagcgcaaaagatg

SEQ ID NO: 71024 - DNA, 103 bp, Artificial Sequence
  Synthetic Polynucleotide
taatacgactcactatagggaattgagtaacattatgagaatatgacctgaacagaggagacaggtcatgttctcataaaacctggcggcagcgcaaaagatg

SEQ ID NO: 71025 - DNA, 103 bp, Artificial Sequence
  Synthetic Polynucleotide
taatacgactcactataggggtgccaattgagtaacattatgagaatatgaacagaggagacatattatgataatgttaaacctggcggcagcgcaaaagatg

SEQ ID NO: 71026 - DNA, 103 bp, Artificial Sequence
  Synthetic Polynucleotide
taatacgactcactatagggccaataatttccttctcttcattccggacaaacagaggagatgtccgatgtgaagagaaaacctggcggcagcgcaaaagatg

SEQ ID NO: 71027 - DNA, 103 bp, Artificial Sequence
  Synthetic Polynucleotide
taatacgactcactatagggtgttcgtgccaattgagtaacattatgagaaacagaggagatctcatatggttactcaaaacctggcggcagcgcaaaagatg

SEQ ID NO: 71028 - DNA, 103 bp, Artificial Sequence
  Synthetic Polynucleotide
taatacgactcactatagggatttttgttcgtgccaattgagtaacattaaacagaggagataatgtatgtcaattggcaacctggcggcagcgcaaaagatg

SEQ ID NO: 71029 - DNA, 103 bp, Artificial Sequence
  Synthetic Polynucleotide
taatacgactcactatagggcccgtatttttgttcgtgccaattgagtaaaacagaggagattactcatgtggcacgaaaacctggcggcagcgcaaaagatg

SEQ ID NO: 71030 - DNA, 103 bp, Artificial Sequence
  Synthetic Polynucleotide
taatacgactcactatagggaatttcccgtatttttgttcgtgccaattgaacagaggagacaattgatgcgaacaaaaaacctggcggcagcgcaaaagatg

SEQ ID NO: 71031 - DNA, 103 bp, Artificial Sequence
  Synthetic Polynucleotide
taatacgactcactatagggtttgtaatttcccgtatttttgttcgtgccaacagaggagaggcacgatgaaaaatacgaacctggcggcagcgcaaaagatg

SEQ ID NO: 71032 - DNA, 103 bp, Artificial Sequence
  Synthetic Polynucleotide
taatacgactcactatagggttccttttgtaatttcccgtatttttgttcaacagaggagagaacaaatgtacgggaaaaacctggcggcagcgcaaaagatg

SEQ ID NO: 71033 - DNA, 103 bp, Artificial Sequence
  Synthetic Polynucleotide
taatacgactcactatagggccttcttccttttgtaatttcccgtattttaacagaggagaaaaataatggaaattacaaacctggcggcagcgcaaaagatg

SEQ ID NO: 71034 - DNA, 103 bp, Artificial Sequence
  Synthetic Polynucleotide
taatacgactcactatagggggtgtccttcttccttttgtaatttcccgtaacagaggagaacgggaatgtacaaaaggaacctggcggcagcgcaaaagatg

SEQ ID NO: 71035 - DNA, 103 bp, Artificial Sequence
  Synthetic Polynucleotide
taatacgactcactatagggtaaatggtgtccttcttccttttgtaatttaacagaggagaaaattaatgaaggaagaaaacctggcggcagcgcaaaagatg

SEQ ID NO: 71036 - DNA, 103 bp, Artificial Sequence
  Synthetic Polynucleotide
taatacgactcactatagggtaaagtaaatggtgtccttcttccttttgtaacagaggagaacaaaaatgagaaggacaaacctggcggcagcgcaaaagatg

SEQ ID NO: 71037 - DNA, 103 bp, Artificial Sequence
  Synthetic Polynucleotide
taatacgactcactatagggaaacaccaataatttccttctcttcattccaacagaggagaggaatgatgagaaggaaaaacctggcggcagcgcaaaagatg

SEQ ID NO: 71038 - DNA, 103 bp, Artificial Sequence
  Synthetic Polynucleotide
taatacgactcactatagggatagataaagtaaatggtgtccttcttcctaacagaggagaaggaagatggacaccattaacctggcggcagcgcaaaagatg

SEQ ID NO: 71039 - DNA, 103 bp, Artificial Sequence
  Synthetic Polynucleotide
taatacgactcactatagggtatgaatagataaagtaaatggtgtccttcaacagaggagagaaggaatgcatttacttaacctggcggcagcgcaaaagatg

SEQ ID NO: 71040 - DNA, 103 bp, Artificial Sequence
  Synthetic Polynucleotide
taatacgactcactatagggtgttttatgaatagataaagtaaatggtgtaacagaggagaacaccaatgactttatctaacctggcggcagcgcaaaagatg

SEQ ID NO: 71041 - DNA, 103 bp, Artificial Sequence
  Synthetic Polynucleotide
taatacgactcactataggggattatgttttatgaatagataaagtaaataacagaggagaatttacatgatctattcaaacctggcggcagcgcaaaagatg

SEQ ID NO: 71042 - DNA, 103 bp, Artificial Sequence
  Synthetic Polynucleotide
taatacgactcactatagggtccttgattatgttttatgaatagataaagaacagaggagactttatatgttcataaaaaacctggcggcagcgcaaaagatg

SEQ ID NO: 71043 - DNA, 103 bp, Artificial Sequence
  Synthetic Polynucleotide
taatacgactcactatagggccgtatccttgattatgttttatgaatagaaacagaggagatctattatgaaaacataaaacctggcggcagcgcaaaagatg

SEQ ID NO: 71044 - DNA, 103 bp, Artificial Sequence
  Synthetic Polynucleotide
taatacgactcactataggggacttccgtatccttgattatgttttatgaaacagaggagatcataaatgataatcaagaacctggcggcagcgcaaaagatg

SEQ ID NO: 71045 - DNA, 103 bp, Artificial Sequence
  Synthetic Polynucleotide
taatacgactcactatagggagcgtgacttccgtatccttgattatgtttaacagaggagaaaacatatgcaaggatacaacctggcggcagcgcaaaagatg

SEQ ID NO: 71046 - DNA, 103 bp, Artificial Sequence
  Synthetic Polynucleotide
taatacgactcactatagggttgaaagcgtgacttccgtatccttgattaaacagaggagataatcaatgatacggaagaacctggcggcagcgcaaaagatg

SEQ ID NO: 71047 - DNA, 103 bp, Artificial Sequence
  Synthetic Polynucleotide
taatacgactcactatagggatatattgaaagcgtgacttccgtatccttaacagaggagaaaggatatggaagtcacgaacctggcggcagcgcaaaagatg

SEQ ID NO: 71048 - DNA, 103 bp, Artificial Sequence
  Synthetic Polynucleotide
taatacgactcactatagggccgtcaaacaccaataatttccttctcttcaacagaggagagaagagatggaaattattaacctggcggcagcgcaaaagatg

SEQ ID NO: 71049 - DNA, 103 bp, Artificial Sequence
  Synthetic Polynucleotide
taatacgactcactatagggccgtaatatattgaaagcgtgacttccgtaaacagaggagatacggaatgcacgctttcaacctggcggcagcgcaaaagatg

SEQ ID NO: 71050 - DNA, 103 bp, Artificial Sequence
  Synthetic Polynucleotide
taatacgactcactatagggagataccgtaatatattgaaagcgtgacttaacagaggagaaagtcaatgtttcaatataacctggcggcagcgcaaaagatg

SEQ ID NO: 71051 - DNA, 103 bp, Artificial Sequence
  Synthetic Polynucleotide
taatacgactcactatagggctagtagataccgtaatatattgaaagcgtaacagaggagaacgcttatgatatattacaacctggcggcagcgcaaaagatg

SEQ ID NO: 71052 - DNA, 103 bp, Artificial Sequence
  Synthetic Polynucleotide
taatacgactcactatagggcctatctagtagataccgtaatatattgaaaacagaggagattcaatatgttacggtataacctggcggcagcgcaaaagatg

SEQ ID NO: 71053 - DNA, 103 bp, Artificial Sequence
  Synthetic Polynucleotide
taatacgactcactatagggtcgaacctatctagtagataccgtaatataaacagaggagatatattatggtatctactaacctggcggcagcgcaaaagatg

SEQ ID NO: 71054 - DNA, 103 bp, Artificial Sequence
  Synthetic Polynucleotide
taatacgactcactataggggaatgtcgaacctatctagtagataccgtaaacagaggagatacggtatgtactagataaacctggcggcagcgcaaaagatg

SEQ ID NO: 71055 - DNA, 103 bp, Artificial Sequence
  Synthetic Polynucleotide
taatacgactcactatagggtttctgaatgtcgaacctatctagtagataaacagaggagatatctaatggataggttcaacctggcggcagcgcaaaagatg

SEQ ID NO: 71056 - DNA, 103 bp, Artificial Sequence
  Synthetic Polynucleotide
taatacgactcactatagggtcgtctttctgaatgtcgaacctatctagtaacagaggagaactagaatggttcgacataacctggcggcagcgcaaaagatg

SEQ ID NO: 71057 - DNA, 103 bp, Artificial Sequence
  Synthetic Polynucleotide
taatacgactcactatagggaatattcgtctttctgaatgtcgaacctataacagaggagaataggtatgacattcagaaacctggcggcagcgcaaaagatg

SEQ ID NO: 71058 - DNA, 103 bp, Artificial Sequence
  Synthetic Polynucleotide
taatacgactcactatagggattataatattcgtctttctgaatgtcgaaaacagaggagattcgacatgcagaaagacaacctggcggcagcgcaaaagatg

SEQ ID NO: 71059 - DNA, 103 bp, Artificial Sequence
  Synthetic Polynucleotide
taatacgactcactatagggtgacgccgtcaaacaccaataatttccttcaacagaggagagaaggaatgtattggtgtaacctggcggcagcgcaaaagatg

SEQ ID NO: 71060 - DNA, 103 bp, Artificial Sequence
  Synthetic Polynucleotide
taatacgactcactatagggatggtattataatattcgtctttctgaatgaacagaggagacattcaatgagacgaataaacctggcggcagcgcaaaagatg

SEQ ID NO: 71061 - DNA, 103 bp, Artificial Sequence
  Synthetic Polynucleotide
taatacgactcactataggggagtcatggtattataatattcgtctttctaacagaggagaagaaagatgaatattataaacctggcggcagcgcaaaagatg

SEQ ID NO: 71062 - DNA, 103 bp, Artificial Sequence
  Synthetic Polynucleotide
taatacgactcactatagggaagaggagtcatggtattataatattcgtcaacagaggagagacgaaatgtataataccaacctggcggcagcgcaaaagatg

SEQ ID NO: 71063 - DNA, 103 bp, Artificial Sequence
  Synthetic Polynucleotide
taatacgactcactataggggtatgaagaggagtcatggtattataatataacagaggagaatattaatgtaccatgacaacctggcggcagcgcaaaagatg

SEQ ID NO: 71064 - DNA, 103 bp, Artificial Sequence
  Synthetic Polynucleotide
taatacgactcactatagggaggctgtatgaagaggagtcatggtattataacagaggagaataataatgtgactcctcaacctggcggcagcgcaaaagatg

SEQ ID NO: 71065 - DNA, 103 bp, Artificial Sequence
  Synthetic Polynucleotide
taatacgactcactatagggctggaaggctgtatgaagaggagtcatggtaacagaggagaaccatgatgcctcttcataacctggcggcagcgcaaaagatg

SEQ ID NO: 71066 - DNA, 103 bp, Artificial Sequence
  Synthetic Polynucleotide
taatacgactcactatagggcaattctggaaggctgtatgaagaggagtcaacagaggagagactccatgtcatacagcaacctggcggcagcgcaaaagatg

SEQ ID NO: 71067 - DNA, 103 bp, Artificial Sequence
  Synthetic Polynucleotide
taatacgactcactatagggtgttacaattctggaaggctgtatgaagagaacagaggagactcttcatgcagccttccaacctggcggcagcgcaaaagatg

SEQ ID NO: 71068 - DNA, 103 bp, Artificial Sequence
  Synthetic Polynucleotide
taatacgactcactatagggattgttgttacaattctggaaggctgtatgaacagaggagacatacaatgttccagaataacctggcggcagcgcaaaagatg

SEQ ID NO: 71069 - DNA, 103 bp, Artificial Sequence
  Synthetic Polynucleotide
taatacgactcactataggggcaacattgttgttacaattctggaaggctaacagaggagaagccttatggaattgtaaaacctggcggcagcgcaaaagatg

SEQ ID NO: 71070 - DNA, 103 bp, Artificial Sequence
  Synthetic Polynucleotide
taatacgactcactatagggctatatgacgccgtcaaacaccaataatttaacagaggagaaaattaatggtgtttgacaacctggcggcagcgcaaaagatg

SEQ ID NO: 71071 - DNA, 103 bp, Artificial Sequence
  Synthetic Polynucleotide
taatacgactcactatagggatgaggcaacattgttgttacaattctggaaacagaggagatccagaatggtaacaacaaacctggcggcagcgcaaaagatg

SEQ ID NO: 71072 - DNA, 103 bp, Artificial Sequence
  Synthetic Polynucleotide
taatacgactcactatagggaaggtatgaggcaacattgttgttacaattaacagaggagaaattgtatgaacaatgttaacctggcggcagcgcaaaagatg

SEQ ID NO: 71073 - DNA, 103 bp, Artificial Sequence
  Synthetic Polynucleotide
taatacgactcactatagggtatacaaggtatgaggcaacattgttgttaaacagaggagataacaaatgtgttgcctcaacctggcggcagcgcaaaagatg

SEQ ID NO: 71074 - DNA, 103 bp, Artificial Sequence
  Synthetic Polynucleotide
taatacgactcactatagggcgatgtatacaaggtatgaggcaacattgtaacagaggagaacaatgatgcctcataccaacctggcggcagcgcaaaagatg

SEQ ID NO: 71075 - DNA, 103 bp, Artificial Sequence
  Synthetic Polynucleotide
taatacgactcactataggggtatccgatgtatacaaggtatgaggcaacaacagaggagagttgccatgtaccttgtaaacctggcggcagcgcaaaagatg

SEQ ID NO: 71076 - DNA, 103 bp, Artificial Sequence
  Synthetic Polynucleotide
taatacgactcactatagggatgtcgtatccgatgtatacaaggtatgagaacagaggagactcataatgtgtatacataacctggcggcagcgcaaaagatg

SEQ ID NO: 71077 - DNA, 103 bp, Artificial Sequence
  Synthetic Polynucleotide
taatacgactcactatagggggttgatgtcgtatccgatgtatacaaggtaacagaggagaaccttgatgacatcggataacctggcggcagcgcaaaagatg

SEQ ID NO: 71078 - DNA, 103 bp, Artificial Sequence
  Synthetic Polynucleotide
taatacgactcactatagggaggaaggttgatgtcgtatccgatgtatacaacagaggagagtatacatgggatacgacaacctggcggcagcgcaaaagatg

SEQ ID NO: 71079 - DNA, 103 bp, Artificial Sequence
  Synthetic Polynucleotide
taatacgactcactatagggttagtaggaaggttgatgtcgtatccgatgaacagaggagacatcggatgcgacatcaaaacctggcggcagcgcaaaagatg

SEQ ID NO: 71080 - DNA, 103 bp, Artificial Sequence
  Synthetic Polynucleotide
taatacgactcactatagggcgtctttagtaggaaggttgatgtcgtatcaacagaggagagatacgatgtcaaccttcaacctggcggcagcgcaaaagatg

SEQ ID NO: 71081 - DNA, 103 bp, Artificial Sequence
  Synthetic Polynucleotide
taatacgactcactatagggctcgactatatgacgccgtcaaacaccaataacagaggagaattggtatgtgacggcgtaacctggcggcagcgcaaaagatg

SEQ ID NO: 71082 - DNA, 103 bp, Artificial Sequence
  Synthetic Polynucleotide
taatacgactcactatagggcttatcgtctttagtaggaaggttgatgtcaacagaggagagacatcatgcttcctactaacctggcggcagcgcaaaagatg

SEQ ID NO: 71083 - DNA, 103 bp, Artificial Sequence
  Synthetic Polynucleotide
taatacgactcactatagggactgtcttatcgtctttagtaggaaggttgaacagaggagacaacctatgtactaaagaaacctggcggcagcgcaaaagatg

SEQ ID NO: 71084 - DNA, 103 bp, Artificial Sequence
  Synthetic Polynucleotide
taatacgactcactatagggcgaatactgtcttatcgtctttagtaggaaaacagaggagattcctaatgaagacgataaacctggcggcagcgcaaaagatg

SEQ ID NO: 71085 - DNA, 103 bp, Artificial Sequence
  Synthetic Polynucleotide
taatacgactcactatagggcaagtcgaatactgtcttatcgtctttagtaacagaggagaactaaaatggataagacaaacctggcggcagcgcaaaagatg

SEQ ID NO: 71086 - DNA, 103 bp, Artificial Sequence
  Synthetic Polynucleotide
taatacgactcactatagggaacaccaagtcgaatactgtcttatcgtctaacagaggagaagacgaatggacagtattaacctggcggcagcgcaaaagatg

SEQ ID NO: 71087 - DNA, 103 bp, Artificial Sequence
  Synthetic Polynucleotide
taatacgactcactatagggtttcaaacaccaagtcgaatactgtcttataacagaggagaataagaatgtattcgactaacctggcggcagcgcaaaagatg

SEQ ID NO: 71088 - DNA, 103 bp, Artificial Sequence
  Synthetic Polynucleotide
taatacgactcactatagggtctgttttcaaacaccaagtcgaatactgtaacagaggagaacagtaatggacttggtgaacctggcggcagcgcaaaagatg

SEQ ID NO: 71089 - DNA, 103 bp, Artificial Sequence
  Synthetic Polynucleotide
taatacgactcactatagggatgtttctgttttcaaacaccaagtcgaataacagaggagaattcgaatgggtgtttgaaacctggcggcagcgcaaaagatg

SEQ ID NO: 71090 - DNA, 103 bp, Artificial Sequence
  Synthetic Polynucleotide
taatacgactcactatagggataagatgtttctgttttcaaacaccaagtaacagaggagaacttggatgttgaaaacaaacctggcggcagcgcaaaagatg

SEQ ID NO: 71091 - DNA, 103 bp, Artificial Sequence
  Synthetic Polynucleotide
taatacgactcactatagggattgaataagatgtttctgttttcaaacacaacagaggagagtgtttatgaacagaaacaacctggcggcagcgcaaaagatg

SEQ ID NO: 71092 - DNA, 103 bp, Artificial Sequence
  Synthetic Polynucleotide
taatacgactcactatagggttttgctcgactatatgacgccgtcaaacaaacagaggagatgtttgatggcgtcatataacctggcggcagcgcaaaagatg

SEQ ID NO: 71093 - DNA, 103 bp, Artificial Sequence
  Synthetic Polynucleotide
taatacgactcactatagggcccgcattgaataagatgtttctgttttcaaacagaggagatgaaaaatgaaacatcttaacctggcggcagcgcaaaagatg

SEQ ID NO: 71094 - DNA, 103 bp, Artificial Sequence
  Synthetic Polynucleotide
taatacgactcactatagggtaacacccgcattgaataagatgtttctgtaacagaggagaacagaaatgtcttattcaaacctggcggcagcgcaaaagatg

SEQ ID NO: 71095 - DNA, 103 bp, Artificial Sequence
  Synthetic Polynucleotide
taatacgactcactataggggtgaataacacccgcattgaataagatgttaacagaggagaaacatcatgttcaatgcgaacctggcggcagcgcaaaagatg

SEQ ID NO: 71096 - DNA, 103 bp, Artificial Sequence
  Synthetic Polynucleotide
taatacgactcactatagggatgttgtgaataacacccgcattgaataagaacagaggagacttattatgtgcgggtgtaacctggcggcagcgcaaaagatg

SEQ ID NO: 71097 - DNA, 103 bp, Artificial Sequence
  Synthetic Polynucleotide
taatacgactcactatagggggatgatgttgtgaataacacccgcattgaaacagaggagatcaatgatggtgttattcaacctggcggcagcgcaaaagatg

SEQ ID NO: 71098 - DNA, 103 bp, Artificial Sequence
  Synthetic Polynucleotide
taatacgactcactataggggtggtggatgatgttgtgaataacacccgcaacagaggagagcgggtatgattcacaacaacctggcggcagcgcaaaagatg

SEQ ID NO: 71099 - DNA, 103 bp, Artificial Sequence
  Synthetic Polynucleotide
taatacgactcactatagggagtctgtggtggatgatgttgtgaataacaaacagaggagatgttatatgcaacatcataacctggcggcagcgcaaaagatg

SEQ ID NO: 71100 - DNA, 103 bp, Artificial Sequence
  Synthetic Polynucleotide
taatacgactcactatagggctttcagtctgtggtggatgatgttgtgaaaacagaggagattcacaatgtcatccaccaacctggcggcagcgcaaaagatg

SEQ ID NO: 71101 - DNA, 103 bp, Artificial Sequence
  Synthetic Polynucleotide
taatacgactcactatagggagatactttcagtctgtggtggatgatgttaacagaggagaaacatcatgcaccacagaaacctggcggcagcgcaaaagatg

SEQ ID NO: 71102 - DNA, 103 bp, Artificial Sequence
  Synthetic Polynucleotide
taatacgactcactatagggggtagagatactttcagtctgtggtggatgaacagaggagacatccaatgcagactgaaaacctggcggcagcgcaaaagatg

SEQ ID NO: 71103 - DNA, 103 bp, Artificial Sequence
  Synthetic Polynucleotide
taatacgactcactataggggattcttttgctcgactatatgacgccgtcaacagaggagagacggcatgatatagtcgaacctggcggcagcgcaaaagatg

SEQ ID NO: 71104 - DNA, 103 bp, Artificial Sequence
  Synthetic Polynucleotide
taatacgactcactatagggtcataggtagagatactttcagtctgtggtaacagaggagaaccacaatgtgaaagtataacctggcggcagcgcaaaagatg

SEQ ID NO: 71105 - DNA, 103 bp, Artificial Sequence
  Synthetic Polynucleotide
taatacgactcactatagggtttaatcataggtagagatactttcagtctaacagaggagaagactgatggtatctctaaacctggcggcagcgcaaaagatg

SEQ ID NO: 71106 - DNA, 103 bp, Artificial Sequence
  Synthetic Polynucleotide
taatacgactcactatagggaacgatttaatcataggtagagatactttcaacagaggagagaaagtatgtctacctataacctggcggcagcgcaaaagatg

SEQ ID NO: 71107 - DNA, 103 bp, Artificial Sequence
  Synthetic Polynucleotide
taatacgactcactatagggagaacaacgatttaatcataggtagagataaacagaggagatatctcatgctatgattaaacctggcggcagcgcaaaagatg

SEQ ID NO: 71108 - DNA, 103 bp, Artificial Sequence
  Synthetic Polynucleotide
taatacgactcactatagggcttatagaacaacgatttaatcataggtagaacagaggagactacctatgattaaatcgaacctggcggcagcgcaaaagatg

SEQ ID NO: 71109 - DNA, 103 bp, Artificial Sequence
  Synthetic Polynucleotide
taatacgactcactatagggaacatcttatagaacaacgatttaatcataaacagaggagatatgatatgatcgttgttaacctggcggcagcgcaaaagatg

SEQ ID NO: 71110 - DNA, 103 bp, Artificial Sequence
  Synthetic Polynucleotide
taatacgactcactatagggattctaacatcttatagaacaacgatttaaaacagaggagattaaatatgtgttctataaacctggcggcagcgcaaaagatg

SEQ ID NO: 71111 - DNA, 103 bp, Artificial Sequence
  Synthetic Polynucleotide
taatacgactcactatagggagagaattctaacatcttatagaacaacgaaacagaggagatcgttgatgtataagatgaacctggcggcagcgcaaaagatg

SEQ ID NO: 71112 - DNA, 103 bp, Artificial Sequence
  Synthetic Polynucleotide
taatacgactcactatagggtagggagagaattctaacatcttatagaacaacagaggagagttctaatggatgttagaaacctggcggcagcgcaaaagatg

SEQ ID NO: 71113 - DNA, 103 bp, Artificial Sequence
  Synthetic Polynucleotide
taatacgactcactatagggcgtcgtagggagagaattctaacatcttataacagaggagaataagaatgtagaattctaacctggcggcagcgcaaaagatg

SEQ ID NO: 71114 - DNA, 103 bp, Artificial Sequence
  Synthetic Polynucleotide
taatacgactcactatagggatgatgattcttttgctcgactatatgacgaacagaggagacgtcatatggtcgagcaaaacctggcggcagcgcaaaagatg

SEQ ID NO: 71115 - DNA, 103 bp, Artificial Sequence
  Synthetic Polynucleotide
taatacgactcactataggggtaatcgtcgtagggagagaattctaacataacagaggagaatgttaatgttctctcccaacctggcggcagcgcaaaagatg

SEQ ID NO: 71116 - DNA, 103 bp, Artificial Sequence
  Synthetic Polynucleotide
taatacgactcactatagggacgtagtaatcgtcgtagggagagaattctaacagaggagaagaattatgtccctacgaaacctggcggcagcgcaaaagatg

SEQ ID NO: 71117 - DNA, 103 bp, Artificial Sequence
  Synthetic Polynucleotide
taatacgactcactatagggtctttacgtagtaatcgtcgtagggagagaaacagaggagatctctcatgacgacgattaacctggcggcagcgcaaaagatg

SEQ ID NO: 71118 - DNA, 103 bp, Artificial Sequence
  Synthetic Polynucleotide
taatacgactcactatagggtatcttctttacgtagtaatcgtcgtagggaacagaggagaccctacatggattactacaacctggcggcagcgcaaaagatg

SEQ ID NO: 71119 - DNA, 103 bp, Artificial Sequence
  Synthetic Polynucleotide
taatacgactcactataggggctattatcttctttacgtagtaatcgtcgaacagaggagacgacgaatgctacgtaaaaacctggcggcagcgcaaaagatg

SEQ ID NO: 71120 - DNA, 103 bp, Artificial Sequence
  Synthetic Polynucleotide
taatacgactcactatagggagtaggctattatcttctttacgtagtaataacagaggagaattactatgtaaagaagaaacctggcggcagcgcaaaagatg

SEQ ID NO: 71121 - DNA, 103 bp, Artificial Sequence
  Synthetic Polynucleotide
taatacgactcactatagggtatgcagtaggctattatcttctttacgtaaacagaggagatacgtaatgaagataataaacctggcggcagcgcaaaagatg

SEQ ID NO: 71122 - DNA, 103 bp, Artificial Sequence
  Synthetic Polynucleotide
taatacgactcactatagggcttaatatgcagtaggctattatcttctttaacagaggagaaaagaaatgaatagcctaaacctggcggcagcgcaaaagatg

SEQ ID NO: 71123 - DNA, 103 bp, Artificial Sequence
  Synthetic Polynucleotide
taatacgactcactatagggcgtcccttaatatgcagtaggctattatctaacagaggagaagataaatgcctactgcaaacctggcggcagcgcaaaagatg

SEQ ID NO: 71124 - DNA, 103 bp, Artificial Sequence
  Synthetic Polynucleotide
taatacgactcactatagggtgactcgtcccttaatatgcagtaggctataacagaggagaatagccatgtgcatattaaacctggcggcagcgcaaaagatg

SEQ ID NO: 71125 - DNA, 103 bp, Artificial Sequence
  Synthetic Polynucleotide
taatacgactcactatagggagcagcgaacaacaacatcagatatttcataacagaggagaatgaaaatgctgatgttgaacctggcggcagcgcaaaagatg

SEQ ID NO: 71126 - DNA, 103 bp, Artificial Sequence
  Synthetic Polynucleotide
taatacgactcactatagggtggatatgatgattcttttgctcgactataaacagaggagatatagtatggcaaaagaaaacctggcggcagcgcaaaagatg

SEQ ID NO: 71127 - DNA, 103 bp, Artificial Sequence
  Synthetic Polynucleotide
taatacgactcactataggggtgaatgactcgtcccttaatatgcagtagaacagaggagactactgatgattaagggaaacctggcggcagcgcaaaagatg

SEQ ID NO: 71128 - DNA, 103 bp, Artificial Sequence
  Synthetic Polynucleotide
taatacgactcactataggggttccgtgaatgactcgtcccttaatatgcaacagaggagagcatatatggggacgagtaacctggcggcagcgcaaaagatg

SEQ ID NO: 71129 - DNA, 103 bp, Artificial Sequence
  Synthetic Polynucleotide
taatacgactcactatagggatgtagttccgtgaatgactcgtcccttaaaacagaggagattaaggatggagtcattcaacctggcggcagcgcaaaagatg

SEQ ID NO: 71130 - DNA, 103 bp, Artificial Sequence
  Synthetic Polynucleotide
taatacgactcactatagggttactatgtagttccgtgaatgactcgtccaacagaggagaggacgaatgattcacggaaacctggcggcagcgcaaaagatg

SEQ ID NO: 71131 - DNA, 103 bp, Artificial Sequence
  Synthetic Polynucleotide
taatacgactcactatagggagaatttactatgtagttccgtgaatgactaacagaggagaagtcatatgcggaactacaacctggcggcagcgcaaaagatg

SEQ ID NO: 71132 - DNA, 103 bp, Artificial Sequence
  Synthetic Polynucleotide
taatacgactcactatagggtaaacagaatttactatgtagttccgtgaaaacagaggagattcacgatgctacatagtaacctggcggcagcgcaaaagatg

SEQ ID NO: 71133 - DNA, 103 bp, Artificial Sequence
  Synthetic Polynucleotide
taatacgactcactatagggtcgtttaaacagaatttactatgtagttccaacagaggagaggaactatgtagtaaattaacctggcggcagcgcaaaagatg

SEQ ID NO: 71134 - DNA, 103 bp, Artificial Sequence
  Synthetic Polynucleotide
taatacgactcactatagggagtcctcgtttaaacagaatttactatgtaaacagaggagatacataatgaattctgttaacctggcggcagcgcaaaagatg

SEQ ID NO: 71135 - DNA, 103 bp, Artificial Sequence
  Synthetic Polynucleotide
taatacgactcactatagggtttatagtcctcgtttaaacagaatttactaacagaggagaagtaaaatgtgtttaaacaacctggcggcagcgcaaaagatg

SEQ ID NO: 71136 - DNA, 103 bp, Artificial Sequence
  Synthetic Polynucleotide
taatacgactcactatagggacacttttatagtcctcgtttaaacagaataacagaggagaattctgatgaaacgaggaaacctggcggcagcgcaaaagatg

SEQ ID NO: 71137 - DNA, 103 bp, Artificial Sequence
  Synthetic Polynucleotide
taatacgactcactatagggacacgtggatatgatgattcttttgctcgaaacagaggagatcgagcatgagaatcatcaacctggcggcagcgcaaaagatg

SEQ ID NO: 71138 - DNA, 103 bp, Artificial Sequence
  Synthetic Polynucleotide
taatacgactcactatagggtaaatacacttttatagtcctcgtttaaacaacagaggagagtttaaatgaggactataaacctggcggcagcgcaaaagatg

SEQ ID NO: 71139 - DNA, 103 bp, Artificial Sequence
  Synthetic Polynucleotide
taatacgactcactatagggtttcataaatacacttttatagtcctcgttaacagaggagaaacgagatgtataaaagtaacctggcggcagcgcaaaagatg

SEQ ID NO: 71140 - DNA, 103 bp, Artificial Sequence
  Synthetic Polynucleotide
taatacgactcactatagggatatttttcataaatacacttttatagtccaacagaggagaggactaatgaagtgtattaacctggcggcagcgcaaaagatg

SEQ ID NO: 71141 - DNA, 103 bp, Artificial Sequence
  Synthetic Polynucleotide
taatacgactcactatagggatgatatatttttcataaatacacttttataacagaggagaataaaaatgtatttatgaaacctggcggcagcgcaaaagatg

SEQ ID NO: 71142 - DNA, 103 bp, Artificial Sequence
  Synthetic Polynucleotide
taatacgactcactatagggatcgaatgatatatttttcataaatacactaacagaggagaagtgtaatgatgaaaaataacctggcggcagcgcaaaagatg

SEQ ID NO: 71143 - DNA, 103 bp, Artificial Sequence
  Synthetic Polynucleotide
taatacgactcactatagggatcttatcgaatgatatatttttcataaataacagaggagaatttatatgaaatatatcaacctggcggcagcgcaaaagatg

SEQ ID NO: 71144 - DNA, 103 bp, Artificial Sequence
  Synthetic Polynucleotide
taatacgactcactatagggaatctatcttatcgaatgatatatttttcaaacagaggagatgaaaaatgtatcattcgaacctggcggcagcgcaaaagatg

SEQ ID NO: 71145 - DNA, 103 bp, Artificial Sequence
  Synthetic Polynucleotide
taatacgactcactataggggatggaatctatcttatcgaatgatatattaacagaggagaaatataatgttcgataagaacctggcggcagcgcaaaagatg

SEQ ID NO: 71146 - DNA, 103 bp, Artificial Sequence
  Synthetic Polynucleotide
taatacgactcactatagggttgatgatggaatctatcttatcgaatgataacagaggagaatcattatgtaagatagaaacctggcggcagcgcaaaagatg

SEQ ID NO: 71147 - DNA, 103 bp, Artificial Sequence
  Synthetic Polynucleotide
taatacgactcactatagggattttttgatgatggaatctatcttatcgaaacagaggagatcgataatgtagattccaaacctggcggcagcgcaaaagatg

SEQ ID NO: 71148 - DNA, 103 bp, Artificial Sequence
  Synthetic Polynucleotide
taatacgactcactatagggaatggacacgtggatatgatgattcttttgaacagaggagacaaaagatgcatcatatcaacctggcggcagcgcaaaagatg

SEQ ID NO: 71149 - DNA, 103 bp, Artificial Sequence
  Synthetic Polynucleotide
taatacgactcactataggggttgcattttttgatgatggaatctatcttaacagaggagaaagataatgtccatcatcaacctggcggcagcgcaaaagatg

SEQ ID NO: 71150 - DNA, 103 bp, Artificial Sequence
  Synthetic Polynucleotide
taatacgactcactatagggtcccagttgcattttttgatgatggaatctaacagaggagaagattcatgcatcaaaaaaacctggcggcagcgcaaaagatg

SEQ ID NO: 71151 - DNA, 103 bp, Artificial Sequence
  Synthetic Polynucleotide
taatacgactcactatagggttatgtcccagttgcattttttgatgatggaacagaggagaccatcaatgaaaaatgcaaacctggcggcagcgcaaaagatg

SEQ ID NO: 71152 - DNA, 103 bp, Artificial Sequence
  Synthetic Polynucleotide
taatacgactcactataggggcgacttatgtcccagttgcattttttgataacagaggagaatcaaaatgtgcaactggaacctggcggcagcgcaaaagatg

SEQ ID NO: 71153 - DNA, 103 bp, Artificial Sequence
  Synthetic Polynucleotide
taatacgactcactatagggttgaggcgacttatgtcccagttgcattttaacagaggagaaaaatgatgctgggacataacctggcggcagcgcaaaagatg

SEQ ID NO: 71154 - DNA, 103 bp, Artificial Sequence
  Synthetic Polynucleotide
taatacgactcactatagggtatctttgaggcgacttatgtcccagttgcaacagaggagagcaactatgacataagtcaacctggcggcagcgcaaaagatg

SEQ ID NO: 71155 - DNA, 103 bp, Artificial Sequence
  Synthetic Polynucleotide
taatacgactcactatagggttgaatatctttgaggcgacttatgtcccaaacagaggagatgggacatgagtcgcctcaacctggcggcagcgcaaaagatg

SEQ ID NO: 71156 - DNA, 103 bp, Artificial Sequence
  Synthetic Polynucleotide
taatacgactcactataggggagatttgaatatctttgaggcgacttatgaacagaggagacataagatgcctcaaagaaacctggcggcagcgcaaaagatg

SEQ ID NO: 71157 - DNA, 103 bp, Artificial Sequence
  Synthetic Polynucleotide
taatacgactcactatagggtgtcagagatttgaatatctttgaggcgacaacagaggagagtcgccatgaagatattcaacctggcggcagcgcaaaagatg

SEQ ID NO: 71158 - DNA, 103 bp, Artificial Sequence
  Synthetic Polynucleotide
taatacgactcactataggggttggtgtcagagatttgaatatctttgagaacagaggagactcaaaatgattcaaatcaacctggcggcagcgcaaaagatg

SEQ ID NO: 71159 - DNA, 103 bp, Artificial Sequence
  Synthetic Polynucleotide
taatacgactcactatagggataaaaatggacacgtggatatgatgattcaacagaggagagaatcaatgtatccacgtaacctggcggcagcgcaaaagatg

SEQ ID NO: 71160 - DNA, 103 bp, Artificial Sequence
  Synthetic Polynucleotide
taatacgactcactatagggtacaggttggtgtcagagatttgaatatctaacagaggagaagatatatgaatctctgaaacctggcggcagcgcaaaagatg

SEQ ID NO: 71161 - DNA, 103 bp, Artificial Sequence
  Synthetic Polynucleotide
taatacgactcactatagggcagtatacaggttggtgtcagagatttgaaaacagaggagattcaaaatgctgacaccaaacctggcggcagcgcaaaagatg

SEQ ID NO: 71162 - DNA, 103 bp, Artificial Sequence
  Synthetic Polynucleotide
taatacgactcactatagggtaatacagtatacaggttggtgtcagagataacagaggagaatctctatgaccaacctgaacctggcggcagcgcaaaagatg

SEQ ID NO: 71163 - DNA, 103 bp, Artificial Sequence
  Synthetic Polynucleotide
taatacgactcactataggggttcttaatacagtatacaggttggtgtcaaacagaggagatgacacatgcctgtatacaacctggcggcagcgcaaaagatg

SEQ ID NO: 71164 - DNA, 103 bp, Artificial Sequence
  Synthetic Polynucleotide
taatacgactcactatagggcttctgttcttaatacagtatacaggttggaacagaggagaccaaccatgatactgtataacctggcggcagcgcaaaagatg

SEQ ID NO: 71165 - DNA, 103 bp, Artificial Sequence
  Synthetic Polynucleotide
taatacgactcactataggggatgtcttctgttcttaatacagtatacagaacagaggagactgtatatggtattaagaaacctggcggcagcgcaaaagatg

SEQ ID NO: 71166 - DNA, 103 bp, Artificial Sequence
  Synthetic Polynucleotide
taatacgactcactatagggtaccggatgtcttctgttcttaatacagtaaacagaggagatactgtatgaagaacagaaacctggcggcagcgcaaaagatg

SEQ ID NO: 71167 - DNA, 103 bp, Artificial Sequence
  Synthetic Polynucleotide
taatacgactcactatagggtacgataccggatgtcttctgttcttaataaacagaggagatattaaatgcagaagacaaacctggcggcagcgcaaaagatg

SEQ ID NO: 71168 - DNA, 103 bp, Artificial Sequence
  Synthetic Polynucleotide
taatacgactcactatagggataggtacgataccggatgtcttctgttctaacagaggagaagaacaatggacatccggaacctggcggcagcgcaaaagatg

SEQ ID NO: 71169 - DNA, 103 bp, Artificial Sequence
  Synthetic Polynucleotide
taatacgactcactatagggttaagataggtacgataccggatgtcttctaacagaggagaagaagaatgccggtatcgaacctggcggcagcgcaaaagatg

SEQ ID NO: 71170 - DNA, 103 bp, Artificial Sequence
  Synthetic Polynucleotide
taatacgactcactatagggccactataaaaatggacacgtggatatgataacagaggagaatcataatgacgtgtccaaacctggcggcagcgcaaaagatg

SEQ ID NO: 71171 - DNA, 103 bp, Artificial Sequence
  Synthetic Polynucleotide
taatacgactcactatagggtggctttaagataggtacgataccggatgtaacagaggagaacatccatgatcgtacctaacctggcggcagcgcaaaagatg

SEQ ID NO: 71172 - DNA, 103 bp, Artificial Sequence
  Synthetic Polynucleotide
taatacgactcactatagggatgtatggctttaagataggtacgataccgaacagaggagacggtatatgacctatcttaacctggcggcagcgcaaaagatg

SEQ ID NO: 71173 - DNA, 103 bp, Artificial Sequence
  Synthetic Polynucleotide
taatacgactcactatagggtctaaatgtatggctttaagataggtacgaaacagaggagatcgtacatgtcttaaagcaacctggcggcagcgcaaaagatg

SEQ ID NO: 71174 - DNA, 103 bp, Artificial Sequence
  Synthetic Polynucleotide
taatacgactcactataggggactatctaaatgtatggctttaagataggaacagaggagacctatcatgaagccatacaacctggcggcagcgcaaaagatg

SEQ ID NO: 71175 - DNA, 103 bp, Artificial Sequence
  Synthetic Polynucleotide
taatacgactcactatagggaatgtgactatctaaatgtatggctttaagaacagaggagacttaaaatgatacatttaaacctggcggcagcgcaaaagatg

SEQ ID NO: 71176 - DNA, 103 bp, Artificial Sequence
  Synthetic Polynucleotide
taatacgactcactatagggaatgaaatgtgactatctaaatgtatggctaacagaggagaagccatatgtttagatagaacctggcggcagcgcaaaagatg

SEQ ID NO: 71177 - DNA, 103 bp, Artificial Sequence
  Synthetic Polynucleotide
taatacgactcactatagggtgggaaatgaaatgtgactatctaaatgtaaacagaggagatacattatgatagtcacaaacctggcggcagcgcaaaagatg

SEQ ID NO: 71178 - DNA, 103 bp, Artificial Sequence
  Synthetic Polynucleotide
taatacgactcactataggggtacatgggaaatgaaatgtgactatctaaaacagaggagattagatatgcacatttcaaacctggcggcagcgcaaaagatg

SEQ ID NO: 71179 - DNA, 103 bp, Artificial Sequence
  Synthetic Polynucleotide
taatacgactcactatagggtcgtcgtacatgggaaatgaaatgtgactaaacagaggagatagtcaatgttcatttccaacctggcggcagcgcaaaagatg

SEQ ID NO: 71180 - DNA, 103 bp, Artificial Sequence
  Synthetic Polynucleotide
taatacgactcactatagggtaagatcgtcgtacatgggaaatgaaatgtaacagaggagaacatttatgttcccatgtaacctggcggcagcgcaaaagatg

SEQ ID NO: 71181 - DNA, 103 bp, Artificial Sequence
  Synthetic Polynucleotide
taatacgactcactatagggtcacaccactataaaaatggacacgtggataacagaggagaatccacatgtccatttttaacctggcggcagcgcaaaagatg

SEQ ID NO: 71182 - DNA, 103 bp, Artificial Sequence
  Synthetic Polynucleotide
taatacgactcactatagggttctataagatcgtcgtacatgggaaatgaaacagaggagatcatttatgatgtacgacaacctggcggcagcgcaaaagatg

SEQ ID NO: 71183 - DNA, 103 bp, Artificial Sequence
  Synthetic Polynucleotide
taatacgactcactatagggcactgttctataagatcgtcgtacatgggaaacagaggagatcccatatgcgacgatctaacctggcggcagcgcaaaagatg

SEQ ID NO: 71184 - DNA, 103 bp, Artificial Sequence
  Synthetic Polynucleotide
taatacgactcactataggggatgacactgttctataagatcgtcgtacaaacagaggagatgtacgatgatcttatagaacctggcggcagcgcaaaagatg

SEQ ID NO: 71185 - DNA, 103 bp, Artificial Sequence
  Synthetic Polynucleotide
taatacgactcactatagggcgatagatgacactgttctataagatcgtcaacagaggagagacgatatgatagaacagaacctggcggcagcgcaaaagatg

SEQ ID NO: 71186 - DNA, 103 bp, Artificial Sequence
  Synthetic Polynucleotide
taatacgactcactatagggtccatcgatagatgacactgttctataagaaacagaggagatcttatatgacagtgtcaaacctggcggcagcgcaaaagatg

SEQ ID NO: 71187 - DNA, 103 bp, Artificial Sequence
  Synthetic Polynucleotide
taatacgactcactatagggtacgctccatcgatagatgacactgttctaaacagaggagatagaacatggtcatctataacctggcggcagcgcaaaagatg

SEQ ID NO: 71188 - DNA, 103 bp, Artificial Sequence
  Synthetic Polynucleotide
taatacgactcactatagggacttttacgctccatcgatagatgacactgaacagaggagacagtgtatgctatcgatgaacctggcggcagcgcaaaagatg

SEQ ID NO: 71189 - DNA, 103 bp, Artificial Sequence
  Synthetic Polynucleotide
taatacgactcactatagggagtttacttttacgctccatcgatagatgaaacagaggagatcatctatggatggagcgaacctggcggcagcgcaaaagatg

SEQ ID NO: 71190 - DNA, 103 bp, Artificial Sequence
  Synthetic Polynucleotide
taatacgactcactatagggcgacgagtttacttttacgctccatcgataaacagaggagatatcgaatgagcgtaaaaaacctggcggcagcgcaaaagatg

SEQ ID NO: 71191 - DNA, 103 bp, Artificial Sequence
  Synthetic Polynucleotide
taatacgactcactatagggtttgtcgacgagtttacttttacgctccataacagaggagaatggagatgaaaagtaaaaacctggcggcagcgcaaaagatg

SEQ ID NO: 71192 - DNA, 103 bp, Artificial Sequence
  Synthetic Polynucleotide
taatacgactcactatagggtgtattcacaccactataaaaatggacacgaacagaggagacgtgtcatgttttatagtaacctggcggcagcgcaaaagatg

SEQ ID NO: 71193 - DNA, 103 bp, Artificial Sequence
  Synthetic Polynucleotide
taatacgactcactatagggagtactttgtcgacgagtttacttttacgcaacagaggagagcgtaaatgtaaactcgtaacctggcggcagcgcaaaagatg

SEQ ID NO: 71194 - DNA, 103 bp, Artificial Sequence
  Synthetic Polynucleotide
taatacgactcactatagggtattgagtactttgtcgacgagtttactttaacagaggagaaaagtaatgtcgtcgacaaacctggcggcagcgcaaaagatg

SEQ ID NO: 71195 - DNA, 103 bp, Artificial Sequence
  Synthetic Polynucleotide
taatacgactcactatagggtaatttattgagtactttgtcgacgagtttaacagaggagaaaactcatggacaaagtaaacctggcggcagcgcaaaagatg

SEQ ID NO: 71196 - DNA, 103 bp, Artificial Sequence
  Synthetic Polynucleotide
taatacgactcactataggggactttaatttattgagtactttgtcgacgaacagaggagacgtcgaatgagtactcaaaacctggcggcagcgcaaaagatg

SEQ ID NO: 71197 - DNA, 103 bp, Artificial Sequence
  Synthetic Polynucleotide
taatacgactcactatagggtggtagactttaatttattgagtactttgtaacagaggagaacaaagatgtcaataaataacctggcggcagcgcaaaagatg

SEQ ID NO: 71198 - DNA, 103 bp, Artificial Sequence
  Synthetic Polynucleotide
taatacgactcactatagggatcgatggtagactttaatttattgagtacaacagaggagagtactcatgaaattaaagaacctggcggcagcgcaaaagatg

SEQ ID NO: 71199 - DNA, 103 bp, Artificial Sequence
  Synthetic Polynucleotide
taatacgactcactatagggtgaccatcgatggtagactttaatttattgaacagaggagacaataaatgaaagtctacaacctggcggcagcgcaaaagatg

SEQ ID NO: 71200 - DNA, 103 bp, Artificial Sequence
  Synthetic Polynucleotide
taatacgactcactatagggtagattgaccatcgatggtagactttaattaacagaggagaaattaaatgctaccatcgaacctggcggcagcgcaaaagatg

SEQ ID NO: 71201 - DNA, 103 bp, Artificial Sequence
  Synthetic Polynucleotide
taatacgactcactatagggtagtctagattgaccatcgatggtagacttaacagaggagaaagtctatgatcgatggtaacctggcggcagcgcaaaagatg

SEQ ID NO: 71202 - DNA, 103 bp, Artificial Sequence
  Synthetic Polynucleotide
taatacgactcactatagggtacgatagtctagattgaccatcgatggtaaacagaggagataccatatgtggtcaatcaacctggcggcagcgcaaaagatg

SEQ ID NO: 71203 - DNA, 103 bp, Artificial Sequence
  Synthetic Polynucleotide
taatacgactcactatagggttagttgtattcacaccactataaaaatggaacagaggagaccatttatgtagtggtgtaacctggcggcagcgcaaaagatg

SEQ ID NO: 71204 - DNA, 103 bp, Artificial Sequence
  Synthetic Polynucleotide
taatacgactcactataggggcaaatacgatagtctagattgaccatcgaaacagaggagatcgatgatgaatctagacaacctggcggcagcgcaaaagatg

SEQ ID NO: 71205 - DNA, 103 bp, Artificial Sequence
  Synthetic Polynucleotide
taatacgactcactatagggtggaggcaaatacgatagtctagattgaccaacagaggagaggtcaaatgagactatcgaacctggcggcagcgcaaaagatg

SEQ ID NO: 71206 - DNA, 103 bp, Artificial Sequence
  Synthetic Polynucleotide
taatacgactcactatagggatttctggaggcaaatacgatagtctagataacagaggagaatctagatgatcgtatttaacctggcggcagcgcaaaagatg

SEQ ID NO: 71207 - DNA, 103 bp, Artificial Sequence
  Synthetic Polynucleotide
taatacgactcactataggggtataatttctggaggcaaatacgatagtcaacagaggagagactatatgatttgcctcaacctggcggcagcgcaaaagatg

SEQ ID NO: 71208 - DNA, 103 bp, Artificial Sequence
  Synthetic Polynucleotide
taatacgactcactataggggttgcgtataatttctggaggcaaatacgaaacagaggagatcgtatatgcctccagaaaacctggcggcagcgcaaaagatg

SEQ ID NO: 71209 - DNA, 103 bp, Artificial Sequence
  Synthetic Polynucleotide
taatacgactcactatagggatgatgttgcgtataatttctggaggcaaaaacagaggagatttgccatgagaaattataacctggcggcagcgcaaaagatg

SEQ ID NO: 71210 - DNA, 103 bp, Artificial Sequence
  Synthetic Polynucleotide
taatacgactcactatagggtggttatgatgttgcgtataatttctggagaacagaggagactccagatgttatacgcaaacctggcggcagcgcaaaagatg

SEQ ID NO: 71211 - DNA, 103 bp, Artificial Sequence
  Synthetic Polynucleotide
taatacgactcactatagggtagcttggttatgatgttgcgtataatttcaacagaggagagaaattatgcgcaacatcaacctggcggcagcgcaaaagatg

SEQ ID NO: 71212 - DNA, 103 bp, Artificial Sequence
  Synthetic Polynucleotide
taatacgactcactatagggtcgcttagcttggttatgatgttgcgtataaacagaggagatatacgatgcatcataacaacctggcggcagcgcaaaagatg

SEQ ID NO: 71213 - DNA, 103 bp, Artificial Sequence
  Synthetic Polynucleotide
taatacgactcactataggggatagtcgcttagcttggttatgatgttgcaacagaggagagcaacaatgtaaccaagcaacctggcggcagcgcaaaagatg

SEQ ID NO: 71214 - DNA, 103 bp, Artificial Sequence
  Synthetic Polynucleotide
taatacgactcactatagggtctccttagttgtattcacaccactataaaaacagaggagatttataatggtgtgaataaacctggcggcagcgcaaaagatg

SEQ ID NO: 71215 - DNA, 103 bp, Artificial Sequence
  Synthetic Polynucleotide
taatacgactcactatagggtagatgatagtcgcttagcttggttatgataacagaggagaatcataatgaagctaagcaacctggcggcagcgcaaaagatg

SEQ ID NO: 71216 - DNA, 103 bp, Artificial Sequence
  Synthetic Polynucleotide
taatacgactcactatagggctgtttagatgatagtcgcttagcttggttaacagaggagaaaccaaatgaagcgactaaacctggcggcagcgcaaaagatg

SEQ ID NO: 71217 - DNA, 103 bp, Artificial Sequence
  Synthetic Polynucleotide
taatacgactcactatagggacatactgtttagatgatagtcgcttagctaacagaggagaagctaaatgactatcatcaacctggcggcagcgcaaaagatg

SEQ ID NO: 71218 - DNA, 103 bp, Artificial Sequence
  Synthetic Polynucleotide
taatacgactcactataggggtacaacatactgtttagatgatagtcgctaacagaggagaagcgacatgcatctaaacaacctggcggcagcgcaaaagatg

SEQ ID NO: 71219 - DNA, 103 bp, Artificial Sequence
  Synthetic Polynucleotide
taatacgactcactatagggtttccgtacaacatactgtttagatgatagaacagaggagactatcaatgaaacagtataacctggcggcagcgcaaaagatg

SEQ ID NO: 71220 - DNA, 103 bp, Artificial Sequence
  Synthetic Polynucleotide
taatacgactcactatagggggttctttccgtacaacatactgtttagataacagaggagaatctaaatggtatgttgtaacctggcggcagcgcaaaagatg

SEQ ID NO: 71221 - DNA, 103 bp, Artificial Sequence
  Synthetic Polynucleotide
taatacgactcactataggggtaatggttctttccgtacaacatactgttaacagaggagaaacagtatgttgtacggaaacctggcggcagcgcaaaagatg

SEQ ID NO: 71222 - DNA, 103 bp, Artificial Sequence
  Synthetic Polynucleotide
taatacgactcactatagggtatttgtaatggttctttccgtacaacataaacagaggagatatgttatgcggaaagaaaacctggcggcagcgcaaaagatg

SEQ ID NO: 71223 - DNA, 103 bp, Artificial Sequence
  Synthetic Polynucleotide
taatacgactcactatagggtataatatttgtaatggttctttccgtacaaacagaggagatgtacgatgagaaccattaacctggcggcagcgcaaaagatg

SEQ ID NO: 71224 - DNA, 103 bp, Artificial Sequence
  Synthetic Polynucleotide
taatacgactcactatagggtcatgtataatatttgtaatggttctttccaacagaggagaggaaagatgcattacaaaaacctggcggcagcgcaaaagatg

SEQ ID NO: 71225 - DNA, 103 bp, Artificial Sequence
  Synthetic Polynucleotide
taatacgactcactataggggctattctccttagttgtattcacaccactaacagaggagaagtggtatgaatacaactaacctggcggcagcgcaaaagatg

SEQ ID NO: 71226 - DNA, 103 bp, Artificial Sequence
  Synthetic Polynucleotide
taatacgactcactatagggtcctatcatgtataatatttgtaatggttcaacagaggagagaaccaatgcaaatattaaacctggcggcagcgcaaaagatg

SEQ ID NO: 71227 - DNA, 103 bp, Artificial Sequence
  Synthetic Polynucleotide
taatacgactcactatagggtttcttcctatcatgtataatatttgtaataacagaggagaattacaatgattatacataacctggcggcagcgcaaaagatg

SEQ ID NO: 71228 - DNA, 103 bp, Artificial Sequence
  Synthetic Polynucleotide
taatacgactcactatagggaatattttcttcctatcatgtataatatttaacagaggagaaaatatatgacatgatagaacctggcggcagcgcaaaagatg

SEQ ID NO: 71229 - DNA, 103 bp, Artificial Sequence
  Synthetic Polynucleotide
taatacgactcactatagggttttaaatattttcttcctatcatgtataaaacagaggagattatacatgataggaagaaacctggcggcagcgcaaaagatg

SEQ ID NO: 71230 - DNA, 103 bp, Artificial Sequence
  Synthetic Polynucleotide
taatacgactcactatagggatattttttaaatattttcttcctatcatgaacagaggagacatgatatgaagaaaataaacctggcggcagcgcaaaagatg

SEQ ID NO: 71231 - DNA, 103 bp, Artificial Sequence
  Synthetic Polynucleotide
taatacgactcactatagggtatagatattttttaaatattttcttcctaaacagaggagataggaaatgaatatttaaaacctggcggcagcgcaaaagatg

SEQ ID NO: 71232 - DNA, 103 bp, Artificial Sequence
  Synthetic Polynucleotide
taatacgactcactatagggaatcatatagatattttttaaatattttctaacagaggagaagaaaaatgttaaaaaataacctggcggcagcgcaaaagatg

SEQ ID NO: 71233 - DNA, 103 bp, Artificial Sequence
  Synthetic Polynucleotide
taatacgactcactatagggtctccaatcatatagatattttttaaatataacagaggagaatatttatgaaatatctaaacctggcggcagcgcaaaagatg

SEQ ID NO: 71234 - DNA, 103 bp, Artificial Sequence
  Synthetic Polynucleotide
taatacgactcactatagggctacttctccaatcatatagatattttttaaacagaggagataaaaaatgtctatatgaaacctggcggcagcgcaaaagatg

SEQ ID NO: 71235 - DNA, 103 bp, Artificial Sequence
  Synthetic Polynucleotide
taatacgactcactataggggtttcctacttctccaatcatatagatattaacagaggagaaatatcatgatgattggaaacctggcggcagcgcaaaagatg

SEQ ID NO: 71236 - DNA, 103 bp, Artificial Sequence
  Synthetic Polynucleotide
taatacgactcactatagggatcatagcagcgaacaacaacatcagatataacagaggagaatatctatggttgttgttaacctggcggcagcgcaaaagatg

SEQ ID NO: 71237 - DNA, 103 bp, Artificial Sequence
  Synthetic Polynucleotide
taatacgactcactatagggatctggctattctccttagttgtattcacaaacagaggagatgtgaaatgaactaaggaaacctggcggcagcgcaaaagatg

SEQ ID NO: 71238 - DNA, 103 bp, Artificial Sequence
  Synthetic Polynucleotide
taatacgactcactatagggttcctgtttcctacttctccaatcatatagaacagaggagactatatatgtggagaagtaacctggcggcagcgcaaaagatg

SEQ ID NO: 71239 - DNA, 103 bp, Artificial Sequence
  Synthetic Polynucleotide
taatacgactcactatagggccgtgttcctgtttcctacttctccaatcaaacagaggagatgattgatgaagtaggaaaacctggcggcagcgcaaaagatg

SEQ ID NO: 71240 - DNA, 103 bp, Artificial Sequence
  Synthetic Polynucleotide
taatacgactcactatagggaatcaccgtgttcctgtttcctacttctccaacagaggagaggagaaatgggaaacaggaacctggcggcagcgcaaaagatg

SEQ ID NO: 71241 - DNA, 103 bp, Artificial Sequence
  Synthetic Polynucleotide
taatacgactcactataggggtagtaatcaccgtgttcctgtttcctactaacagaggagaagtaggatgcaggaacacaacctggcggcagcgcaaaagatg

SEQ ID NO: 71242 - DNA, 103 bp, Artificial Sequence
  Synthetic Polynucleotide
taatacgactcactatagggataatgtagtaatcaccgtgttcctgtttcaacagaggagagaaacaatgacacggtgaaacctggcggcagcgcaaaagatg

SEQ ID NO: 71243 - DNA, 103 bp, Artificial Sequence
  Synthetic Polynucleotide
taatacgactcactatagggatttaataatgtagtaatcaccgtgttcctaacagaggagaaggaacatggtgattactaacctggcggcagcgcaaaagatg

SEQ ID NO: 71244 - DNA, 103 bp, Artificial Sequence
  Synthetic Polynucleotide
taatacgactcactatagggtcatgatttaataatgtagtaatcaccgtgaacagaggagacacggtatgtactacattaacctggcggcagcgcaaaagatg

SEQ ID NO: 71245 - DNA, 103 bp, Artificial Sequence
  Synthetic Polynucleotide
taatacgactcactatagggggacttcatgatttaataatgtagtaatcaaacagaggagatgattaatgcattattaaaacctggcggcagcgcaaaagatg

SEQ ID NO: 71246 - DNA, 103 bp, Artificial Sequence
  Synthetic Polynucleotide
taatacgactcactatagggaatacggacttcatgatttaataatgtagtaacagaggagaactacaatgttaaatcataacctggcggcagcgcaaaagatg

SEQ ID NO: 71247 - DNA, 103 bp, Artificial Sequence
  Synthetic Polynucleotide
taatacgactcactatagggagtataatacggacttcatgatttaataataacagaggagaattattatgtcatgaagtaacctggcggcagcgcaaaagatg

SEQ ID NO: 71248 - DNA, 103 bp, Artificial Sequence
  Synthetic Polynucleotide
taatacgactcactatagggttttgatctggctattctccttagttgtataacagaggagaatacaaatgaggagaataaacctggcggcagcgcaaaagatg

SEQ ID NO: 71249 - DNA, 103 bp, Artificial Sequence
  Synthetic Polynucleotide
taatacgactcactatagggatacaagtataatacggacttcatgatttaaacagaggagataaatcatgaagtccgtaaacctggcggcagcgcaaaagatg

SEQ ID NO: 71250 - DNA, 103 bp, Artificial Sequence
  Synthetic Polynucleotide
taatacgactcactatagggaatatatacaagtataatacggacttcatgaacagaggagacatgaaatgcgtattataaacctggcggcagcgcaaaagatg

SEQ ID NO: 71251 - DNA, 103 bp, Artificial Sequence
  Synthetic Polynucleotide
taatacgactcactataggggaaacaatatatacaagtataatacggactaacagaggagaagtccgatgtatacttgtaacctggcggcagcgcaaaagatg

SEQ ID NO: 71252 - DNA, 103 bp, Artificial Sequence
  Synthetic Polynucleotide
taatacgactcactatagggtgagagaaacaatatatacaagtataatacaacagaggagagtattaatgttgtatataaacctggcggcagcgcaaaagatg

SEQ ID NO: 71253 - DNA, 103 bp, Artificial Sequence
  Synthetic Polynucleotide
taatacgactcactatagggatacatgagagaaacaatatatacaagtataacagaggagaatacttatgtatattgttaacctggcggcagcgcaaaagatg

SEQ ID NO: 71254 - DNA, 103 bp, Artificial Sequence
  Synthetic Polynucleotide
taatacgactcactatagggttattatacatgagagaaacaatatatacaaacagaggagatgtataatgtgtttctctaacctggcggcagcgcaaaagatg

SEQ ID NO: 71255 - DNA, 103 bp, Artificial Sequence
  Synthetic Polynucleotide
taatacgactcactataggggtttattattatacatgagagaaacaatataacagaggagaatattgatgctctcatgtaacctggcggcagcgcaaaagatg

SEQ ID NO: 71256 - DNA, 103 bp, Artificial Sequence
  Synthetic Polynucleotide
taatacgactcactatagggcttccgtttattattatacatgagagaaacaacagaggagagtttctatgatgtataataacctggcggcagcgcaaaagatg

SEQ ID NO: 71257 - DNA, 103 bp, Artificial Sequence
  Synthetic Polynucleotide
taatacgactcactatagggcatctcttccgtttattattatacatgagaaacagaggagatctcatatgtaataataaaacctggcggcagcgcaaaagatg

SEQ ID NO: 71258 - DNA, 103 bp, Artificial Sequence
  Synthetic Polynucleotide
taatacgactcactatagggtgctgcatctcttccgtttattattatacaaacagaggagatgtataatgataaacggaaacctggcggcagcgcaaaagatg

SEQ ID NO: 71259 - DNA, 103 bp, Artificial Sequence
  Synthetic Polynucleotide
taatacgactcactatagggtctacttttgatctggctattctccttagtaacagaggagaactaagatgaatagccagaacctggcggcagcgcaaaagatg

SEQ ID NO: 71260 - DNA, 103 bp, Artificial Sequence
  Synthetic Polynucleotide
taatacgactcactatagggtacggtgctgcatctcttccgtttattattaacagaggagaaataatatgcggaagagaaacctggcggcagcgcaaaagatg

SEQ ID NO: 71261 - DNA, 103 bp, Artificial Sequence
  Synthetic Polynucleotide
taatacgactcactataggggtgtatacggtgctgcatctcttccgtttaaacagaggagataaacgatggagatgcagaacctggcggcagcgcaaaagatg

SEQ ID NO: 71262 - DNA, 103 bp, Artificial Sequence
  Synthetic Polynucleotide
taatacgactcactataggggggtggtgtatacggtgctgcatctcttccaacagaggagaggaagaatggcagcaccgaacctggcggcagcgcaaaagatg

SEQ ID NO: 71263 - DNA, 103 bp, Artificial Sequence
  Synthetic Polynucleotide
taatacgactcactatagggccattgggtggtgtatacggtgctgcatctaacagaggagaagatgcatgaccgtatacaacctggcggcagcgcaaaagatg

SEQ ID NO: 71264 - DNA, 103 bp, Artificial Sequence
  Synthetic Polynucleotide
taatacgactcactatagggactttccattgggtggtgtatacggtgctgaacagaggagacagcacatgatacaccacaacctggcggcagcgcaaaagatg

SEQ ID NO: 71265 - DNA, 103 bp, Artificial Sequence
  Synthetic Polynucleotide
taatacgactcactatagggtttacactttccattgggtggtgtatacggaacagaggagaccgtatatgccacccaataacctggcggcagcgcaaaagatg

SEQ ID NO: 71266 - DNA, 103 bp, Artificial Sequence
  Synthetic Polynucleotide
taatacgactcactataggggtgtctttacactttccattgggtggtgtaaacagaggagatacaccatgcaatggaaaaacctggcggcagcgcaaaagatg

SEQ ID NO: 71267 - DNA, 103 bp, Artificial Sequence
  Synthetic Polynucleotide
taatacgactcactatagggattcggtgtctttacactttccattgggtgaacagaggagacacccaatggaaagtgtaaacctggcggcagcgcaaaagatg

SEQ ID NO: 71268 - DNA, 103 bp, Artificial Sequence
  Synthetic Polynucleotide
taatacgactcactatagggtttgtattcggtgtctttacactttccattaacagaggagaaatggaatgtgtaaagacaacctggcggcagcgcaaaagatg

SEQ ID NO: 71269 - DNA, 103 bp, Artificial Sequence
  Synthetic Polynucleotide
taatacgactcactatagggtggcgtttgtattcggtgtctttacactttaacagaggagaaaagtgatgagacaccgaaacctggcggcagcgcaaaagatg

SEQ ID NO: 71270 - DNA, 103 bp, Artificial Sequence
  Synthetic Polynucleotide
taatacgactcactatagggtaccatctacttttgatctggctattctccaacagaggagaggagaaatgccagatcaaaacctggcggcagcgcaaaagatg

SEQ ID NO: 71271 - DNA, 103 bp, Artificial Sequence
  Synthetic Polynucleotide
taatacgactcactataggggattatggcgtttgtattcggtgtctttacaacagaggagagtaaagatgccgaatacaaacctggcggcagcgcaaaagatg

SEQ ID NO: 71272 - DNA, 103 bp, Artificial Sequence
  Synthetic Polynucleotide
taatacgactcactatagggacacagattatggcgtttgtattcggtgtcaacagaggagagacaccatgtacaaacgcaacctggcggcagcgcaaaagatg

SEQ ID NO: 71273 - DNA, 103 bp, Artificial Sequence
  Synthetic Polynucleotide
taatacgactcactatagggaaacaacacagattatggcgtttgtattcgaacagaggagacgaataatgacgccataaaacctggcggcagcgcaaaagatg

SEQ ID NO: 71274 - DNA, 103 bp, Artificial Sequence
  Synthetic Polynucleotide
taatacgactcactatagggacgataaacaacacagattatggcgtttgtaacagaggagaacaaacatgataatctgtaacctggcggcagcgcaaaagatg

SEQ ID NO: 71275 - DNA, 103 bp, Artificial Sequence
  Synthetic Polynucleotide
taatacgactcactatagggaggacacgataaacaacacagattatggcgaacagaggagacgccatatgctgtgttgtaacctggcggcagcgcaaaagatg

SEQ ID NO: 71276 - DNA, 103 bp, Artificial Sequence
  Synthetic Polynucleotide
taatacgactcactatagggcccggaggacacgataaacaacacagattaaacagaggagataatctatgttgtttatcaacctggcggcagcgcaaaagatg

SEQ ID NO: 71277 - DNA, 103 bp, Artificial Sequence
  Synthetic Polynucleotide
taatacgactcactatagggatgttcccggaggacacgataaacaacacaaacagaggagatgtgttatgtatcgtgtcaacctggcggcagcgcaaaagatg

SEQ ID NO: 71278 - DNA, 103 bp, Artificial Sequence
  Synthetic Polynucleotide
taatacgactcactatagggagcgtatgttcccggaggacacgataaacaaacagaggagatgtttaatgtgtcctccgaacctggcggcagcgcaaaagatg

SEQ ID NO: 71279 - DNA, 103 bp, Artificial Sequence
  Synthetic Polynucleotide
taatacgactcactatagggctggaagcgtatgttcccggaggacacgataacagaggagaatcgtgatgtccgggaacaacctggcggcagcgcaaaagatg

SEQ ID NO: 71280 - DNA, 103 bp, Artificial Sequence
  Synthetic Polynucleotide
taatacgactcactatagggataatctggaagcgtatgttcccggaggacaacagaggagagtcctcatggaacatacgaacctggcggcagcgcaaaagatg

SEQ ID NO: 71281 - DNA, 103 bp, Artificial Sequence
  Synthetic Polynucleotide
taatacgactcactatagggagaaataccatctacttttgatctggctataacagaggagaatagccatgtcaaaagtaaacctggcggcagcgcaaaagatg

SEQ ID NO: 71282 - DNA, 103 bp, Artificial Sequence
  Synthetic Polynucleotide
taatacgactcactatagggatcacataatctggaagcgtatgttcccggaacagaggagaccgggaatgtacgcttccaacctggcggcagcgcaaaagatg

SEQ ID NO: 71283 - DNA, 103 bp, Artificial Sequence
  Synthetic Polynucleotide
taatacgactcactatagggttgctatcacataatctggaagcgtatgttaacagaggagaaacataatgttccagattaacctggcggcagcgcaaaagatg

SEQ ID NO: 71284 - DNA, 103 bp, Artificial Sequence
  Synthetic Polynucleotide
taatacgactcactatagggtagtcttgctatcacataatctggaagcgtaacagaggagaacgcttatggattatgtgaacctggcggcagcgcaaaagatg

SEQ ID NO: 71285 - DNA, 103 bp, Artificial Sequence
  Synthetic Polynucleotide
taatacgactcactatagggtgtgttagtcttgctatcacataatctggaaacagaggagatccagaatgtgtgatagcaacctggcggcagcgcaaaagatg

SEQ ID NO: 71286 - DNA, 103 bp, Artificial Sequence
  Synthetic Polynucleotide
taatacgactcactatagggcattgtgtgttagtcttgctatcacataataacagaggagaattatgatgtagcaagacaacctggcggcagcgcaaaagatg

SEQ ID NO: 71287 - DNA, 103 bp, Artificial Sequence
  Synthetic Polynucleotide
taatacgactcactataggggtgtacattgtgtgttagtcttgctatcacaacagaggagagtgataatgagactaacaaacctggcggcagcgcaaaagatg

SEQ ID NO: 71288 - DNA, 103 bp, Artificial Sequence
  Synthetic Polynucleotide
taatacgactcactatagggacacggtgtacattgtgtgttagtcttgctaacagaggagaagcaagatgaacacacaaaacctggcggcagcgcaaaagatg

SEQ ID NO: 71289 - DNA, 103 bp, Artificial Sequence
  Synthetic Polynucleotide
taatacgactcactataggggaaccacacggtgtacattgtgtgttagtcaacagaggagagactaaatgacaatgtacaacctggcggcagcgcaaaagatg

SEQ ID NO: 71290 - DNA, 103 bp, Artificial Sequence
  Synthetic Polynucleotide
taatacgactcactatagggtacccgaaccacacggtgtacattgtgtgtaacagaggagaacacacatggtacaccgtaacctggcggcagcgcaaaagatg

SEQ ID NO: 71291 - DNA, 103 bp, Artificial Sequence
  Synthetic Polynucleotide
taatacgactcactatagggaaaggtacccgaaccacacggtgtacattgaacagaggagacaatgtatgccgtgtggtaacctggcggcagcgcaaaagatg

SEQ ID NO: 71292 - DNA, 103 bp, Artificial Sequence
  Synthetic Polynucleotide
taatacgactcactatagggctttcagaaataccatctacttttgatctgaacagaggagacagatcatgagtagatggaacctggcggcagcgcaaaagatg

SEQ ID NO: 71293 - DNA, 103 bp, Artificial Sequence
  Synthetic Polynucleotide
taatacgactcactataggggatgtaaaggtacccgaaccacacggtgtaaacagaggagatacaccatgtggttcgggaacctggcggcagcgcaaaagatg

SEQ ID NO: 71294 - DNA, 103 bp, Artificial Sequence
  Synthetic Polynucleotide
taatacgactcactatagggtgcgagatgtaaaggtacccgaaccacacgaacagaggagacgtgtgatgcgggtacctaacctggcggcagcgcaaaagatg

SEQ ID NO: 71295 - DNA, 103 bp, Artificial Sequence
  Synthetic Polynucleotide
taatacgactcactatagggattattgcgagatgtaaaggtacccgaaccaacagaggagaggttcgatgacctttacaaacctggcggcagcgcaaaagatg

SEQ ID NO: 71296 - DNA, 103 bp, Artificial Sequence
  Synthetic Polynucleotide
taatacgactcactatagggaaatgattattgcgagatgtaaaggtacccaacagaggagagggtacatgtacatctcgaacctggcggcagcgcaaaagatg

SEQ ID NO: 71297 - DNA, 103 bp, Artificial Sequence
  Synthetic Polynucleotide
taatacgactcactatagggcgggtaaatgattattgcgagatgtaaaggaacagaggagacctttaatgctcgcaataaacctggcggcagcgcaaaagatg

SEQ ID NO: 71298 - DNA, 103 bp, Artificial Sequence
  Synthetic Polynucleotide
taatacgactcactatagggacaagcgggtaaatgattattgcgagatgtaacagaggagaacatctatgaataatcataacctggcggcagcgcaaaagatg

SEQ ID NO: 71299 - DNA, 103 bp, Artificial Sequence
  Synthetic Polynucleotide
taatacgactcactatagggcttagacaagcgggtaaatgattattgcgaaacagaggagatcgcaaatgtcatttaccaacctggcggcagcgcaaaagatg

SEQ ID NO: 71300 - DNA, 103 bp, Artificial Sequence
  Synthetic Polynucleotide
taatacgactcactatagggtacaacttagacaagcgggtaaatgattataacagaggagaataatcatgtacccgcttaacctggcggcagcgcaaaagatg

SEQ ID NO: 71301 - DNA, 103 bp, Artificial Sequence
  Synthetic Polynucleotide
taatacgactcactatagggtccgttacaacttagacaagcgggtaaatgaacagaggagacatttaatggcttgtctaaacctggcggcagcgcaaaagatg

SEQ ID NO: 71302 - DNA, 103 bp, Artificial Sequence
  Synthetic Polynucleotide
taatacgactcactatagggcatcttccgttacaacttagacaagcgggtaacagaggagaacccgcatgtctaagttgaacctggcggcagcgcaaaagatg

SEQ ID NO: 71303 - DNA, 103 bp, Artificial Sequence
  Synthetic Polynucleotide
taatacgactcactatagggactttctttcagaaataccatctacttttgaacagaggagacaaaagatgatggtatttaacctggcggcagcgcaaaagatg

SEQ ID NO: 71304 - DNA, 103 bp, Artificial Sequence
  Synthetic Polynucleotide
taatacgactcactatagggtattgcatcttccgttacaacttagacaagaacagaggagacttgtcatggttgtaacgaacctggcggcagcgcaaaagatg

SEQ ID NO: 71305 - DNA, 103 bp, Artificial Sequence
  Synthetic Polynucleotide
taatacgactcactatagggattactattgcatcttccgttacaacttagaacagaggagactaagtatgaacggaagaaacctggcggcagcgcaaaagatg

SEQ ID NO: 71306 - DNA, 103 bp, Artificial Sequence
  Synthetic Polynucleotide
taatacgactcactatagggacctgattactattgcatcttccgttacaaaacagaggagattgtaaatgaagatgcaaaacctggcggcagcgcaaaagatg

SEQ ID NO: 71307 - DNA, 103 bp, Artificial Sequence
  Synthetic Polynucleotide
taatacgactcactatagggtctctacctgattactattgcatcttccgtaacagaggagaacggaaatggcaatagtaaacctggcggcagcgcaaaagatg

SEQ ID NO: 71308 - DNA, 103 bp, Artificial Sequence
  Synthetic Polynucleotide
taatacgactcactatagggtcgcgtctctacctgattactattgcatctaacagaggagaagatgcatgagtaatcagaacctggcggcagcgcaaaagatg

SEQ ID NO: 71309 - DNA, 103 bp, Artificial Sequence
  Synthetic Polynucleotide
taatacgactcactatagggcacgatcgcgtctctacctgattactattgaacagaggagacaatagatgtcaggtagaaacctggcggcagcgcaaaagatg

SEQ ID NO: 71310 - DNA, 103 bp, Artificial Sequence
  Synthetic Polynucleotide
taatacgactcactatagggtgttacacgatcgcgtctctacctgattacaacagaggagagtaatcatgtagagacgcaacctggcggcagcgcaaaagatg

SEQ ID NO: 71311 - DNA, 103 bp, Artificial Sequence
  Synthetic Polynucleotide
taatacgactcactatagggagtcgtgttacacgatcgcgtctctacctgaacagaggagacaggtaatgacgcgatcgaacctggcggcagcgcaaaagatg

SEQ ID NO: 71312 - DNA, 103 bp, Artificial Sequence
  Synthetic Polynucleotide
taatacgactcactatagggttgtgagtcgtgttacacgatcgcgtctctaacagaggagaagagacatgatcgtgtaaaacctggcggcagcgcaaaagatg

SEQ ID NO: 71313 - DNA, 103 bp, Artificial Sequence
  Synthetic Polynucleotide
taatacgactcactatagggttctattgtgagtcgtgttacacgatcgcgaacagaggagacgcgatatggtaacacgaaacctggcggcagcgcaaaagatg

SEQ ID NO: 71314 - DNA, 103 bp, Artificial Sequence
  Synthetic Polynucleotide
taatacgactcactatagggatcatactttctttcagaaataccatctacaacagaggagagtagatatgatttctgaaaacctggcggcagcgcaaaagatg

SEQ ID NO: 71315 - DNA, 103 bp, Artificial Sequence
  Synthetic Polynucleotide
taatacgactcactatagggacagattctattgtgagtcgtgttacacgaaacagaggagatcgtgtatgacgactcacaacctggcggcagcgcaaaagatg

SEQ ID NO: 71316 - DNA, 103 bp, Artificial Sequence
  Synthetic Polynucleotide
taatacgactcactatagggcattcacagattctattgtgagtcgtgttaaacagaggagataacacatgtcacaatagaacctggcggcagcgcaaaagatg

SEQ ID NO: 71317 - DNA, 103 bp, Artificial Sequence
  Synthetic Polynucleotide
taatacgactcactataggggagagcattcacagattctattgtgagtcgaacagaggagacgactcatgatagaatctaacctggcggcagcgcaaaagatg

SEQ ID NO: 71318 - DNA, 103 bp, Artificial Sequence
  Synthetic Polynucleotide
taatacgactcactatagggtccgggagagcattcacagattctattgtgaacagaggagacacaatatgatctgtgaaaacctggcggcagcgcaaaagatg

SEQ ID NO: 71319 - DNA, 103 bp, Artificial Sequence
  Synthetic Polynucleotide
taatacgactcactatagggtaatatccgggagagcattcacagattctaaacagaggagatagaatatgtgaatgctcaacctggcggcagcgcaaaagatg

SEQ ID NO: 71320 - DNA, 103 bp, Artificial Sequence
  Synthetic Polynucleotide
taatacgactcactataggggacaataatatccgggagagcattcacagaaacagaggagatctgtgatggctctcccgaacctggcggcagcgcaaaagatg

SEQ ID NO: 71321 - DNA, 103 bp, Artificial Sequence
  Synthetic Polynucleotide
taatacgactcactatagggaagaagacaataatatccgggagagcattcaacagaggagagaatgcatgcccggatataacctggcggcagcgcaaaagatg

SEQ ID NO: 71322 - DNA, 103 bp, Artificial Sequence
  Synthetic Polynucleotide
taatacgactcactatagggcctttaagaagacaataatatccgggagagaacagaggagactctccatgatattattgaacctggcggcagcgcaaaagatg

SEQ ID NO: 71323 - DNA, 103 bp, Artificial Sequence
  Synthetic Polynucleotide
taatacgactcactatagggatgatcctttaagaagacaataatatccggaacagaggagaccggatatgattgtcttcaacctggcggcagcgcaaaagatg

SEQ ID NO: 71324 - DNA, 103 bp, Artificial Sequence
  Synthetic Polynucleotide
taatacgactcactatagggtccggatgatcctttaagaagacaataataaacagaggagatattatatgcttcttaaaaacctggcggcagcgcaaaagatg

SEQ ID NO: 71325 - DNA, 103 bp, Artificial Sequence
  Synthetic Polynucleotide
taatacgactcactatagggattatatcatactttctttcagaaataccaaacagaggagatggtatatgtgaaagaaaaacctggcggcagcgcaaaagatg

SEQ ID NO: 71326 - DNA, 103 bp, Artificial Sequence
  Synthetic Polynucleotide
taatacgactcactatagggttgcatccggatgatcctttaagaagacaaaacagaggagattgtctatgtaaaggatcaacctggcggcagcgcaaaagatg

SEQ ID NO: 71327 - DNA, 103 bp, Artificial Sequence
  Synthetic Polynucleotide
taatacgactcactatagggatgccttgcatccggatgatcctttaagaaaacagaggagattcttaatggatcatccgaacctggcggcagcgcaaaagatg

SEQ ID NO: 71328 - DNA, 103 bp, Artificial Sequence
  Synthetic Polynucleotide
taatacgactcactatagggaacacatgccttgcatccggatgatcctttaacagaggagaaaaggaatgtccggatgcaacctggcggcagcgcaaaagatg

SEQ ID NO: 71329 - DNA, 103 bp, Artificial Sequence
  Synthetic Polynucleotide
taatacgactcactatagggtgggaaacacatgccttgcatccggatgataacagaggagaatcatcatgatgcaaggcaacctggcggcagcgcaaaagatg

SEQ ID NO: 71330 - DNA, 103 bp, Artificial Sequence
  Synthetic Polynucleotide
taatacgactcactatagggttgtttgggaaacacatgccttgcatccggaacagaggagaccggatatgaggcatgtgaacctggcggcagcgcaaaagatg

SEQ ID NO: 71331 - DNA, 103 bp, Artificial Sequence
  Synthetic Polynucleotide
taatacgactcactatagggacattttgtttgggaaacacatgccttgcaaacagaggagatgcaagatgtgtgtttccaacctggcggcagcgcaaaagatg

SEQ ID NO: 71332 - DNA, 103 bp, Artificial Sequence
  Synthetic Polynucleotide
taatacgactcactatagggattccacattttgtttgggaaacacatgccaacagaggagaggcatgatgttcccaaacaacctggcggcagcgcaaaagatg

SEQ ID NO: 71333 - DNA, 103 bp, Artificial Sequence
  Synthetic Polynucleotide
taatacgactcactatagggatcctattccacattttgtttgggaaacacaacagaggagagtgtttatgaaacaaaataacctggcggcagcgcaaaagatg

SEQ ID NO: 71334 - DNA, 103 bp, Artificial Sequence
  Synthetic Polynucleotide
taatacgactcactatagggtccgtatcctattccacattttgtttgggaaacagaggagatcccaaatgaaatgtggaaacctggcggcagcgcaaaagatg

SEQ ID NO: 71335 - DNA, 103 bp, Artificial Sequence
  Synthetic Polynucleotide
taatacgactcactataggggatactccgtatcctattccacattttgttaacagaggagaaacaaaatgtggaataggaacctggcggcagcgcaaaagatg

SEQ ID NO: 71336 - DNA, 103 bp, Artificial Sequence
  Synthetic Polynucleotide
taatacgactcactatagggtaagtattatatcatactttctttcagaaaaacagaggagatttctgatggaaagtatgaacctggcggcagcgcaaaagatg

SEQ ID NO: 71337 - DNA, 103 bp, Artificial Sequence
  Synthetic Polynucleotide
taatacgactcactataggggtccggatactccgtatcctattccacattaacagaggagaaatgtgatgtaggatacgaacctggcggcagcgcaaaagatg

SEQ ID NO: 71338 - DNA, 103 bp, Artificial Sequence
  Synthetic Polynucleotide
taatacgactcactatagggcgtgtgtccggatactccgtatcctattccaacagaggagaggaataatgtacggagtaaacctggcggcagcgcaaaagatg

SEQ ID NO: 71339 - DNA, 103 bp, Artificial Sequence
  Synthetic Polynucleotide
taatacgactcactatagggacagacgtgtgtccggatactccgtatcctaacagaggagaaggataatgagtatccggaacctggcggcagcgcaaaagatg

SEQ ID NO: 71340 - DNA, 103 bp, Artificial Sequence
  Synthetic Polynucleotide
taatacgactcactatagggctccaacagacgtgtgtccggatactccgtaacagaggagaacggagatgccggacacaaacctggcggcagcgcaaaagatg

SEQ ID NO: 71341 - DNA, 103 bp, Artificial Sequence
  Synthetic Polynucleotide
taatacgactcactataggggacgtctccaacagacgtgtgtccggatacaacagaggagagtatccatgcacacgtctaacctggcggcagcgcaaaagatg

SEQ ID NO: 71342 - DNA, 103 bp, Artificial Sequence
  Synthetic Polynucleotide
taatacgactcactatagggcagatgacgtctccaacagacgtgtgtccgaacagaggagacggacaatggtctgttggaacctggcggcagcgcaaaagatg

SEQ ID NO: 71343 - DNA, 103 bp, Artificial Sequence
  Synthetic Polynucleotide
taatacgactcactataggggagaacagatgacgtctccaacagacgtgtaacagaggagaacacgtatgttggagacgaacctggcggcagcgcaaaagatg

SEQ ID NO: 71344 - DNA, 103 bp, Artificial Sequence
  Synthetic Polynucleotide
taatacgactcactatagggacacggagaacagatgacgtctccaacagaaacagaggagatctgttatggacgtcatcaacctggcggcagcgcaaaagatg

SEQ ID NO: 71345 - DNA, 103 bp, Artificial Sequence
  Synthetic Polynucleotide
taatacgactcactatagggaaaccacacggagaacagatgacgtctccaaacagaggagatggagaatgcatctgttcaacctggcggcagcgcaaaagatg

SEQ ID NO: 71346 - DNA, 103 bp, Artificial Sequence
  Synthetic Polynucleotide
taatacgactcactatagggttccgaaaccacacggagaacagatgacgtaacagaggagaacgtcaatggttctccgtaacctggcggcagcgcaaaagatg

SEQ ID NO: 71347 - DNA, 103 bp, Artificial Sequence
  Synthetic Polynucleotide
taatacgactcactatagggtaattatcatagcagcgaacaacaacatcaaacagaggagatgatgtatgtgttcgctgaacctggcggcagcgcaaaagatg

SEQ ID NO: 71348 - DNA, 103 bp, Artificial Sequence
  Synthetic Polynucleotide
taatacgactcactatagggtgatgtaagtattatatcatactttctttcaacagaggagagaaagaatgtatgatataaacctggcggcagcgcaaaagatg

SEQ ID NO: 71349 - DNA, 103 bp, Artificial Sequence
  Synthetic Polynucleotide
taatacgactcactatagggatatgttccgaaaccacacggagaacagataacagaggagaatctgtatgccgtgtggtaacctggcggcagcgcaaaagatg

SEQ ID NO: 71350 - DNA, 103 bp, Artificial Sequence
  Synthetic Polynucleotide
taatacgactcactatagggtgagaatatgttccgaaaccacacggagaaaacagaggagattctccatgtggtttcggaacctggcggcagcgcaaaagatg

SEQ ID NO: 71351 - DNA, 103 bp, Artificial Sequence
  Synthetic Polynucleotide
taatacgactcactatagggcggtgtgagaatatgttccgaaaccacacgaacagaggagacgtgtgatgtcggaacataacctggcggcagcgcaaaagatg

SEQ ID NO: 71352 - DNA, 103 bp, Artificial Sequence
  Synthetic Polynucleotide
taatacgactcactatagggagagacggtgtgagaatatgttccgaaaccaacagaggagaggtttcatgacatattctaacctggcggcagcgcaaaagatg

SEQ ID NO: 71353 - DNA, 103 bp, Artificial Sequence
  Synthetic Polynucleotide
taatacgactcactataggggcggaagagacggtgtgagaatatgttccgaacagaggagacggaacatgttctcacacaacctggcggcagcgcaaaagatg

SEQ ID NO: 71354 - DNA, 103 bp, Artificial Sequence
  Synthetic Polynucleotide
taatacgactcactatagggtatctgcggaagagacggtgtgagaatatgaacagaggagacatattatgacaccgtctaacctggcggcagcgcaaaagatg

SEQ ID NO: 71355 - DNA, 103 bp, Artificial Sequence
  Synthetic Polynucleotide
taatacgactcactataggggcatttatctgcggaagagacggtgtgagaaacagaggagatctcacatggtctcttccaacctggcggcagcgcaaaagatg

SEQ ID NO: 71356 - DNA, 103 bp, Artificial Sequence
  Synthetic Polynucleotide
taatacgactcactatagggggttcgcatttatctgcggaagagacggtgaacagaggagacaccgtatgttccgcagaaacctggcggcagcgcaaaagatg

SEQ ID NO: 71357 - DNA, 103 bp, Artificial Sequence
  Synthetic Polynucleotide
taatacgactcactataggggtacgggttcgcatttatctgcggaagagaaacagaggagatctcttatgcagataaataacctggcggcagcgcaaaagatg

SEQ ID NO: 71358 - DNA, 103 bp, Artificial Sequence
  Synthetic Polynucleotide
taatacgactcactataggggttgggtacgggttcgcatttatctgcggaaacagaggagatccgcaatgaaatgcgaaaacctggcggcagcgcaaaagatg

SEQ ID NO: 71359 - DNA, 103 bp, Artificial Sequence
  Synthetic Polynucleotide
taatacgactcactatagggcttaatgatgtaagtattatatcatactttaacagaggagaaaagtaatgtataatactaacctggcggcagcgcaaaagatg

SEQ ID NO: 71360 - DNA, 103 bp, Artificial Sequence
  Synthetic Polynucleotide
taatacgactcactataggggtattgttgggtacgggttcgcatttatctaacagaggagaagataaatgcgaacccgtaacctggcggcagcgcaaaagatg

SEQ ID NO: 71361 - DNA, 103 bp, Artificial Sequence
  Synthetic Polynucleotide
taatacgactcactatagggtaaatgtattgttgggtacgggttcgcattaacagaggagaaatgcgatgccgtacccaaacctggcggcagcgcaaaagatg

SEQ ID NO: 71362 - DNA, 103 bp, Artificial Sequence
  Synthetic Polynucleotide
taatacgactcactatagggatagttaaatgtattgttgggtacgggttcaacagaggagagaacccatgcccaacaataacctggcggcagcgcaaaagatg

SEQ ID NO: 71363 - DNA, 103 bp, Artificial Sequence
  Synthetic Polynucleotide
taatacgactcactatagggtcgatatagttaaatgtattgttgggtacgaacagaggagacgtaccatgcaatacattaacctggcggcagcgcaaaagatg

SEQ ID NO: 71364 - DNA, 103 bp, Artificial Sequence
  Synthetic Polynucleotide
taatacgactcactatagggccacatcgatatagttaaatgtattgttggaacagaggagaccaacaatgcatttaactaacctggcggcagcgcaaaagatg

SEQ ID NO: 71365 - DNA, 103 bp, Artificial Sequence
  Synthetic Polynucleotide
taatacgactcactatagggaatttccacatcgatatagttaaatgtattaacagaggagaaatacaatgaactatatcaacctggcggcagcgcaaaagatg

SEQ ID NO: 71366 - DNA, 103 bp, Artificial Sequence
  Synthetic Polynucleotide
taatacgactcactatagggagtgtaatttccacatcgatatagttaaataacagaggagaatttaaatgtatcgatgtaacctggcggcagcgcaaaagatg

SEQ ID NO: 71367 - DNA, 103 bp, Artificial Sequence
  Synthetic Polynucleotide
taatacgactcactataggggatacagtgtaatttccacatcgatatagtaacagaggagaactataatgatgtggaaaaacctggcggcagcgcaaaagatg

SEQ ID NO: 71368 - DNA, 103 bp, Artificial Sequence
  Synthetic Polynucleotide
taatacgactcactatagggaactggatacagtgtaatttccacatcgataacagaggagaatcgatatggaaattacaaacctggcggcagcgcaaaagatg

SEQ ID NO: 71369 - DNA, 103 bp, Artificial Sequence
  Synthetic Polynucleotide
taatacgactcactatagggtcgttaactggatacagtgtaatttccacaaacagaggagatgtggaatgtacactgtaaacctggcggcagcgcaaaagatg

SEQ ID NO: 71370 - DNA, 103 bp, Artificial Sequence
  Synthetic Polynucleotide
taatacgactcactatagggtcatgcttaatgatgtaagtattatatcataacagaggagaatgataatgtacttacataacctggcggcagcgcaaaagatg

SEQ ID NO: 71371 - DNA, 103 bp, Artificial Sequence
  Synthetic Polynucleotide
taatacgactcactatagggatgtgtcgttaactggatacagtgtaatttaacagaggagaaaattaatgtgtatccagaacctggcggcagcgcaaaagatg

SEQ ID NO: 71372 - DNA, 103 bp, Artificial Sequence
  Synthetic Polynucleotide
taatacgactcactatagggacacgatgtgtcgttaactggatacagtgtaacagaggagaacactgatgccagttaacaacctggcggcagcgcaaaagatg

SEQ ID NO: 71373 - DNA, 103 bp, Artificial Sequence
  Synthetic Polynucleotide
taatacgactcactatagggcgagtacacgatgtgtcgttaactggatacaacagaggagagtatccatgtaacgacacaacctggcggcagcgcaaaagatg

SEQ ID NO: 71374 - DNA, 103 bp, Artificial Sequence
  Synthetic Polynucleotide
taatacgactcactatagggtcgtccgagtacacgatgtgtcgttaactgaacagaggagacagttaatgacacatcgtaacctggcggcagcgcaaaagatg

SEQ ID NO: 71375 - DNA, 103 bp, Artificial Sequence
  Synthetic Polynucleotide
taatacgactcactatagggagtggtcgtccgagtacacgatgtgtcgttaacagaggagaaacgacatgtcgtgtactaacctggcggcagcgcaaaagatg

SEQ ID NO: 71376 - DNA, 103 bp, Artificial Sequence
  Synthetic Polynucleotide
taatacgactcactatagggccggtagtggtcgtccgagtacacgatgtgaacagaggagacacatcatgtactcggacaacctggcggcagcgcaaaagatg

SEQ ID NO: 71377 - DNA, 103 bp, Artificial Sequence
  Synthetic Polynucleotide
taatacgactcactatagggtgagaccggtagtggtcgtccgagtacacgaacagaggagacgtgtaatgggacgaccaaacctggcggcagcgcaaaagatg

SEQ ID NO: 71378 - DNA, 103 bp, Artificial Sequence
  Synthetic Polynucleotide
taatacgactcactatagggttcgctgagaccggtagtggtcgtccgagtaacagaggagaactcggatgaccactaccaacctggcggcagcgcaaaagatg

SEQ ID NO: 71379 - DNA, 103 bp, Artificial Sequence
  Synthetic Polynucleotide
taatacgactcactatagggatggattcgctgagaccggtagtggtcgtcaacagaggagagacgacatgtaccggtctaacctggcggcagcgcaaaagatg

SEQ ID NO: 71380 - DNA, 103 bp, Artificial Sequence
  Synthetic Polynucleotide
taatacgactcactatagggttaagatggattcgctgagaccggtagtggaacagaggagaccactaatggtctcagcgaacctggcggcagcgcaaaagatg

SEQ ID NO: 71381 - DNA, 103 bp, Artificial Sequence
  Synthetic Polynucleotide
taatacgactcactatagggtaccgtcatgcttaatgatgtaagtattataacagaggagaataataatgacatcattaaacctggcggcagcgcaaaagatg

SEQ ID NO: 71382 - DNA, 103 bp, Artificial Sequence
  Synthetic Polynucleotide
taatacgactcactatagggcgacgttaagatggattcgctgagaccggtaacagaggagaaccggtatgagcgaatccaacctggcggcagcgcaaaagatg

SEQ ID NO: 71383 - DNA, 103 bp, Artificial Sequence
  Synthetic Polynucleotide
taatacgactcactatagggagttccgacgttaagatggattcgctgagaaacagaggagatctcagatgatccatcttaacctggcggcagcgcaaaagatg

SEQ ID NO: 71384 - DNA, 103 bp, Artificial Sequence
  Synthetic Polynucleotide
taatacgactcactatagggtagttagttccgacgttaagatggattcgcaacagaggagagcgaatatgtcttaacgtaacctggcggcagcgcaaaagatg

SEQ ID NO: 71385 - DNA, 103 bp, Artificial Sequence
  Synthetic Polynucleotide
taatacgactcactatagggagtaatagttagttccgacgttaagatggaaacagaggagatccatcatgacgtcggaaaacctggcggcagcgcaaaagatg

SEQ ID NO: 71386 - DNA, 103 bp, Artificial Sequence
  Synthetic Polynucleotide
taatacgactcactatagggttcatagtaatagttagttccgacgttaagaacagaggagacttaacatgggaactaacaacctggcggcagcgcaaaagatg

SEQ ID NO: 71387 - DNA, 103 bp, Artificial Sequence
  Synthetic Polynucleotide
taatacgactcactatagggtatgattcatagtaatagttagttccgacgaacagaggagacgtcggatgtaactattaaacctggcggcagcgcaaaagatg

SEQ ID NO: 71388 - DNA, 103 bp, Artificial Sequence
  Synthetic Polynucleotide
taatacgactcactatagggatctgtatgattcatagtaatagttagttcaacagaggagagaactaatgattactatgaacctggcggcagcgcaaaagatg

SEQ ID NO: 71389 - DNA, 103 bp, Artificial Sequence
  Synthetic Polynucleotide
taatacgactcactatagggttgcaatctgtatgattcatagtaatagttaacagaggagaaactatatgtatgaatcaaacctggcggcagcgcaaaagatg

SEQ ID NO: 71390 - DNA, 103 bp, Artificial Sequence
  Synthetic Polynucleotide
taatacgactcactatagggcgggattgcaatctgtatgattcatagtaaaacagaggagattactaatgatcatacagaacctggcggcagcgcaaaagatg

SEQ ID NO: 71391 - DNA, 103 bp, Artificial Sequence
  Synthetic Polynucleotide
taatacgactcactatagggaaatacgggattgcaatctgtatgattcataacagaggagaatgaatatgacagattgcaacctggcggcagcgcaaaagatg

SEQ ID NO: 71392 - DNA, 103 bp, Artificial Sequence
  Synthetic Polynucleotide
taatacgactcactatagggtatcataccgtcatgcttaatgatgtaagtaacagaggagaacttacatgattaagcataacctggcggcagcgcaaaagatg

SEQ ID NO: 71393 - DNA, 103 bp, Artificial Sequence
  Synthetic Polynucleotide
taatacgactcactatagggtcacgaaatacgggattgcaatctgtatgaaacagaggagatcatacatgttgcaatccaacctggcggcagcgcaaaagatg

SEQ ID NO: 71394 - DNA, 103 bp, Artificial Sequence
  Synthetic Polynucleotide
taatacgactcactatagggattcctcacgaaatacgggattgcaatctgaacagaggagacagattatgatcccgtataacctggcggcagcgcaaaagatg

SEQ ID NO: 71395 - DNA, 103 bp, Artificial Sequence
  Synthetic Polynucleotide
taatacgactcactataggggaagtattcctcacgaaatacgggattgcaaacagaggagatgcaatatggtatttcgtaacctggcggcagcgcaaaagatg

SEQ ID NO: 71396 - DNA, 103 bp, Artificial Sequence
  Synthetic Polynucleotide
taatacgactcactatagggacagagaagtattcctcacgaaatacgggaaacagaggagatcccgtatgtcgtgaggaaacctggcggcagcgcaaaagatg

SEQ ID NO: 71397 - DNA, 103 bp, Artificial Sequence
  Synthetic Polynucleotide
taatacgactcactatagggtaaggacagagaagtattcctcacgaaataaacagaggagatatttcatgaggaatactaacctggcggcagcgcaaaagatg

SEQ ID NO: 71398 - DNA, 103 bp, Artificial Sequence
  Synthetic Polynucleotide
taatacgactcactatagggcttattaaggacagagaagtattcctcacgaacagaggagacgtgagatgtacttctctaacctggcggcagcgcaaaagatg

SEQ ID NO: 71399 - DNA, 103 bp, Artificial Sequence
  Synthetic Polynucleotide
taatacgactcactataggggctaccttattaaggacagagaagtattccaacagaggagaggaataatgctctgtcctaacctggcggcagcgcaaaagatg

SEQ ID NO: 71400 - DNA, 103 bp, Artificial Sequence
  Synthetic Polynucleotide
taatacgactcactatagggaagttgctaccttattaaggacagagaagtaacagaggagaacttctatgtccttaataaacctggcggcagcgcaaaagatg

SEQ ID NO: 71401 - DNA, 103 bp, Artificial Sequence
  Synthetic Polynucleotide
taatacgactcactatagggtcctgaagttgctaccttattaaggacagaaacagaggagatctgtcatgaataaggtaaacctggcggcagcgcaaaagatg

SEQ ID NO: 71402 - DNA, 103 bp, Artificial Sequence
  Synthetic Polynucleotide
taatacgactcactatagggaaaaatcctgaagttgctaccttattaaggaacagaggagaccttaaatgggtagcaacaacctggcggcagcgcaaaagatg

SEQ ID NO: 71403 - DNA, 103 bp, Artificial Sequence
  Synthetic Polynucleotide
taatacgactcactatagggcattttatcataccgtcatgcttaatgatgaacagaggagacatcatatggcatgacggaacctggcggcagcgcaaaagatg

SEQ ID NO: 71404 - DNA, 103 bp, Artificial Sequence
  Synthetic Polynucleotide
taatacgactcactatagggctgtaaaaaatcctgaagttgctaccttataacagaggagaataaggatgcaacttcagaacctggcggcagcgcaaaagatg

SEQ ID NO: 71405 - DNA, 103 bp, Artificial Sequence
  Synthetic Polynucleotide
taatacgactcactatagggttctcctgtaaaaaatcctgaagttgctacaacagaggagagtagcaatgtcaggatttaacctggcggcagcgcaaaagatg

SEQ ID NO: 71406 - DNA, 103 bp, Artificial Sequence
  Synthetic Polynucleotide
taatacgactcactatagggctattttctcctgtaaaaaatcctgaagttaacagaggagaaacttcatgattttttacaacctggcggcagcgcaaaagatg

SEQ ID NO: 71407 - DNA, 103 bp, Artificial Sequence
  Synthetic Polynucleotide
taatacgactcactataggggatatctattttctcctgtaaaaaatcctgaacagaggagacaggatatgttacaggagaacctggcggcagcgcaaaagatg

SEQ ID NO: 71408 - DNA, 103 bp, Artificial Sequence
  Synthetic Polynucleotide
taatacgactcactatagggattttgatatctattttctcctgtaaaaaaaacagaggagattttttatgggagaaaataacctggcggcagcgcaaaagatg

SEQ ID NO: 71409 - DNA, 103 bp, Artificial Sequence
  Synthetic Polynucleotide
taatacgactcactataggggaaatattttgatatctattttctcctgtaaacagaggagatacaggatgaaatagataaacctggcggcagcgcaaaagatg

SEQ ID NO: 71410 - DNA, 103 bp, Artificial Sequence
  Synthetic Polynucleotide
taatacgactcactatagggcctttgaaatattttgatatctattttctcaacagaggagagagaaaatggatatcaaaaacctggcggcagcgcaaaagatg

SEQ ID NO: 71411 - DNA, 103 bp, Artificial Sequence
  Synthetic Polynucleotide
taatacgactcactatagggacacacctttgaaatattttgatatctattaacagaggagaaatagaatgcaaaatattaacctggcggcagcgcaaaagatg

SEQ ID NO: 71412 - DNA, 103 bp, Artificial Sequence
  Synthetic Polynucleotide
taatacgactcactatagggaaagtacacacctttgaaatattttgatataacagaggagaatatcaatgtatttcaaaaacctggcggcagcgcaaaagatg

SEQ ID NO: 71413 - DNA, 103 bp, Artificial Sequence
  Synthetic Polynucleotide
taatacgactcactatagggaatttaaagtacacacctttgaaatattttaacagaggagaaaaataatgcaaaggtgtaacctggcggcagcgcaaaagatg

SEQ ID NO: 71414 - DNA, 103 bp, Artificial Sequence
  Synthetic Polynucleotide
taatacgactcactatagggaacttcattttatcataccgtcatgcttaaaacagaggagattaagcatgacggtatgaaacctggcggcagcgcaaaagatg

SEQ ID NO: 71415 - DNA, 103 bp, Artificial Sequence
  Synthetic Polynucleotide
taatacgactcactatagggctcaaaatttaaagtacacacctttgaaataacagaggagaatttcaatggtgtgtactaacctggcggcagcgcaaaagatg

SEQ ID NO: 71416 - DNA, 103 bp, Artificial Sequence
  Synthetic Polynucleotide
taatacgactcactatagggttaatctcaaaatttaaagtacacacctttaacagaggagaaaaggtatgtactttaaaaacctggcggcagcgcaaaagatg

SEQ ID NO: 71417 - DNA, 103 bp, Artificial Sequence
  Synthetic Polynucleotide
taatacgactcactatagggtacatttaatctcaaaatttaaagtacacaaacagaggagatgtgtaatgtaaattttgaacctggcggcagcgcaaaagatg

SEQ ID NO: 71418 - DNA, 103 bp, Artificial Sequence
  Synthetic Polynucleotide
taatacgactcactataggggttattacatttaatctcaaaatttaaagtaacagaggagaactttaatgtttgagattaacctggcggcagcgcaaaagatg

SEQ ID NO: 71419 - DNA, 103 bp, Artificial Sequence
  Synthetic Polynucleotide
taatacgactcactatagggcctttgttattacatttaatctcaaaatttaacagaggagaaaatttatggattaaatgaacctggcggcagcgcaaaagatg

SEQ ID NO: 71420 - DNA, 103 bp, Artificial Sequence
  Synthetic Polynucleotide
taatacgactcactatagggaagaacctttgttattacatttaatctcaaaacagaggagattgagaatgaatgtaataaacctggcggcagcgcaaaagatg

SEQ ID NO: 71421 - DNA, 103 bp, Artificial Sequence
  Synthetic Polynucleotide
taatacgactcactataggggaaggaagaacctttgttattacatttaataacagaggagaattaaaatgaataacaaaaacctggcggcagcgcaaaagatg

SEQ ID NO: 71422 - DNA, 103 bp, Artificial Sequence
  Synthetic Polynucleotide
taatacgactcactatagggtgtttgaaggaagaacctttgttattacataacagaggagaatgtaaatgcaaaggttcaacctggcggcagcgcaaaagatg

SEQ ID NO: 71423 - DNA, 103 bp, Artificial Sequence
  Synthetic Polynucleotide
taatacgactcactatagggttagctgtttgaaggaagaacctttgttataacagaggagaataacaatggttcttcctaacctggcggcagcgcaaaagatg

SEQ ID NO: 71424 - DNA, 103 bp, Artificial Sequence
  Synthetic Polynucleotide
taatacgactcactatagggtttcgttagctgtttgaaggaagaacctttaacagaggagaaaaggtatgtccttcaaaaacctggcggcagcgcaaaagatg

SEQ ID NO: 71425 - DNA, 103 bp, Artificial Sequence
  Synthetic Polynucleotide
taatacgactcactatagggtggaaaacttcattttatcataccgtcatgaacagaggagacatgacatgatgataaaaaacctggcggcagcgcaaaagatg

SEQ ID NO: 71426 - DNA, 103 bp, Artificial Sequence
  Synthetic Polynucleotide
taatacgactcactatagggtttgctttcgttagctgtttgaaggaagaaaacagaggagattcttcatgcaaacagctaacctggcggcagcgcaaaagatg

SEQ ID NO: 71427 - DNA, 103 bp, Artificial Sequence
  Synthetic Polynucleotide
taatacgactcactatagggcattctttgctttcgttagctgtttgaaggaacagaggagaccttcaatgagctaacgaaacctggcggcagcgcaaaagatg

SEQ ID NO: 71428 - DNA, 103 bp, Artificial Sequence
  Synthetic Polynucleotide
taatacgactcactataggggtcatcattctttgctttcgttagctgtttaacagaggagaaaacagatgacgaaagcaaacctggcggcagcgcaaaagatg

SEQ ID NO: 71429 - DNA, 103 bp, Artificial Sequence
  Synthetic Polynucleotide
taatacgactcactatagggataccgtcatcattctttgctttcgttagcaacagaggagagctaacatgagcaaagaaaacctggcggcagcgcaaaagatg

SEQ ID NO: 71430 - DNA, 103 bp, Artificial Sequence
  Synthetic Polynucleotide
taatacgactcactatagggacatcataccgtcatcattctttgctttcgaacagaggagacgaaagatgagaatgatgaacctggcggcagcgcaaaagatg

SEQ ID NO: 71431 - DNA, 103 bp, Artificial Sequence
  Synthetic Polynucleotide
taatacgactcactatagggatgcgacatcataccgtcatcattctttgcaacagaggagagcaaagatggatgacggtaacctggcggcagcgcaaaagatg

SEQ ID NO: 71432 - DNA, 103 bp, Artificial Sequence
  Synthetic Polynucleotide
taatacgactcactatagggtccgaatgcgacatcataccgtcatcattcaacagaggagagaatgaatgcggtatgataacctggcggcagcgcaaaagatg

SEQ ID NO: 71433 - DNA, 103 bp, Artificial Sequence
  Synthetic Polynucleotide
taatacgactcactatagggccgtctccgaatgcgacatcataccgtcataacagaggagaatgacgatgtgatgtcgcaacctggcggcagcgcaaaagatg

SEQ ID NO: 71434 - DNA, 103 bp, Artificial Sequence
  Synthetic Polynucleotide
taatacgactcactatagggagttaccgtctccgaatgcgacatcataccaacagaggagaggtatgatgtcgcattcgaacctggcggcagcgcaaaagatg

SEQ ID NO: 71435 - DNA, 103 bp, Artificial Sequence
  Synthetic Polynucleotide
taatacgactcactataggggctagagttaccgtctccgaatgcgacatcaacagaggagagatgtcatgttcggagacaacctggcggcagcgcaaaagatg

SEQ ID NO: 71436 - DNA, 103 bp, Artificial Sequence
  Synthetic Polynucleotide
taatacgactcactatagggctggatggaaaacttcattttatcataccgaacagaggagacggtatatgaaaatgaagaacctggcggcagcgcaaaagatg

SEQ ID NO: 71437 - DNA, 103 bp, Artificial Sequence
  Synthetic Polynucleotide
taatacgactcactatagggcacccgctagagttaccgtctccgaatgcgaacagaggagacgcattatgagacggtaaaacctggcggcagcgcaaaagatg

SEQ ID NO: 71438 - DNA, 103 bp, Artificial Sequence
  Synthetic Polynucleotide
taatacgactcactatagggacagtcacccgctagagttaccgtctccgaaacagaggagatcggagatggtaactctaaacctggcggcagcgcaaaagatg

SEQ ID NO: 71439 - DNA, 103 bp, Artificial Sequence
  Synthetic Polynucleotide
taatacgactcactataggggatagacagtcacccgctagagttaccgtcaacagaggagagacggtatgtctagcgggaacctggcggcagcgcaaaagatg

SEQ ID NO: 71440 - DNA, 103 bp, Artificial Sequence
  Synthetic Polynucleotide
taatacgactcactatagggcgctagatagacagtcacccgctagagttaaacagaggagataactcatgcgggtgactaacctggcggcagcgcaaaagatg

SEQ ID NO: 71441 - DNA, 103 bp, Artificial Sequence
  Synthetic Polynucleotide
taatacgactcactataggggtcgacgctagatagacagtcacccgctagaacagaggagactagcgatggactgtctaaacctggcggcagcgcaaaagatg

SEQ ID NO: 71442 - DNA, 103 bp, Artificial Sequence
  Synthetic Polynucleotide
taatacgactcactatagggtagatgtcgacgctagatagacagtcacccaacagaggagagggtgaatgtctatctagaacctggcggcagcgcaaaagatg

SEQ ID NO: 71443 - DNA, 103 bp, Artificial Sequence
  Synthetic Polynucleotide
taatacgactcactataggggtatatagatgtcgacgctagatagacagtaacagaggagaactgtcatgctagcgtcgaacctggcggcagcgcaaaagatg

SEQ ID NO: 71444 - DNA, 103 bp, Artificial Sequence
  Synthetic Polynucleotide
taatacgactcactatagggatatagtatatagatgtcgacgctagatagaacagaggagactatctatggtcgacatcaacctggcggcagcgcaaaagatg

SEQ ID NO: 71445 - DNA, 103 bp, Artificial Sequence
  Synthetic Polynucleotide
taatacgactcactatagggttactatatagtatatagatgtcgacgctaaacagaggagatagcgtatgcatctatataacctggcggcagcgcaaaagatg

SEQ ID NO: 71446 - DNA, 103 bp, Artificial Sequence
  Synthetic Polynucleotide
taatacgactcactatagggtggtattactatatagtatatagatgtcgaaacagaggagatcgacaatgatatactataacctggcggcagcgcaaaagatg

SEQ ID NO: 71447 - DNA, 103 bp, Artificial Sequence
  Synthetic Polynucleotide
taatacgactcactataggggaaaactggatggaaaacttcattttatcaaacagaggagatgataaatggaagttttcaacctggcggcagcgcaaaagatg

SEQ ID NO: 71448 - DNA, 103 bp, Artificial Sequence
  Synthetic Polynucleotide
taatacgactcactatagggagcattggtattactatatagtatatagataacagaggagaatctatatgctatatagtaacctggcggcagcgcaaaagatg

SEQ ID NO: 71449 - DNA, 103 bp, Artificial Sequence
  Synthetic Polynucleotide
taatacgactcactatagggtcttgagcattggtattactatatagtataaacagaggagatatactatgtagtaatacaacctggcggcagcgcaaaagatg

SEQ ID NO: 71450 - DNA, 103 bp, Artificial Sequence
  Synthetic Polynucleotide
taatacgactcactatagggcgtagtcttgagcattggtattactatataaacagaggagatatataatgataccaatgaacctggcggcagcgcaaaagatg

SEQ ID NO: 71451 - DNA, 103 bp, Artificial Sequence
  Synthetic Polynucleotide
taatacgactcactatagggagtttcgtagtcttgagcattggtattactaacagaggagaagtaatatgaatgctcaaaacctggcggcagcgcaaaagatg

SEQ ID NO: 71452 - DNA, 103 bp, Artificial Sequence
  Synthetic Polynucleotide
taatacgactcactataggggtatcagtttcgtagtcttgagcattggtaaacagaggagataccaaatgtcaagactaaacctggcggcagcgcaaaagatg

SEQ ID NO: 71453 - DNA, 103 bp, Artificial Sequence
  Synthetic Polynucleotide
taatacgactcactatagggagattgtatcagtttcgtagtcttgagcataacagaggagaatgctcatgactacgaaaaacctggcggcagcgcaaaagatg

SEQ ID NO: 71454 - DNA, 103 bp, Artificial Sequence
  Synthetic Polynucleotide
taatacgactcactatagggataagagattgtatcagtttcgtagtcttgaacagaggagacaagacatggaaactgataacctggcggcagcgcaaaagatg

SEQ ID NO: 71455 - DNA, 103 bp, Artificial Sequence
  Synthetic Polynucleotide
taatacgactcactatagggacacgataagagattgtatcagtttcgtagaacagaggagactacgaatgtgatacaataacctggcggcagcgcaaaagatg

SEQ ID NO: 71456 - DNA, 103 bp, Artificial Sequence
  Synthetic Polynucleotide
taatacgactcactatagggtacccacacgataagagattgtatcagtttaacagaggagaaaactgatgcaatctcttaacctggcggcagcgcaaaagatg

SEQ ID NO: 71457 - DNA, 103 bp, Artificial Sequence
  Synthetic Polynucleotide
taatacgactcactatagggaacattacccacacgataagagattgtatcaacagaggagagatacaatgtcttatcgtaacctggcggcagcgcaaaagatg

SEQ ID NO: 71458 - DNA, 103 bp, Artificial Sequence
  Synthetic Polynucleotide
taatacgactcactatagggtgatctaattatcatagcagcgaacaacaaaacagaggagattgttgatggctgctatgaacctggcggcagcgcaaaagatg

SEQ ID NO: 71459 - DNA, 103 bp, Artificial Sequence
  Synthetic Polynucleotide
taatacgactcactatagggtatgggaaaactggatggaaaacttcatttaacagaggagaaaatgaatgtttccatccaacctggcggcagcgcaaaagatg

SEQ ID NO: 71460 - DNA, 103 bp, Artificial Sequence
  Synthetic Polynucleotide
taatacgactcactatagggtcgagaacattacccacacgataagagattaacagaggagaaatctcatgtcgtgtgggaacctggcggcagcgcaaaagatg

SEQ ID NO: 71461 - DNA, 103 bp, Artificial Sequence
  Synthetic Polynucleotide
taatacgactcactatagggcatcatcgagaacattacccacacgataagaacagaggagacttatcatgtgggtaatgaacctggcggcagcgcaaaagatg

SEQ ID NO: 71462 - DNA, 103 bp, Artificial Sequence
  Synthetic Polynucleotide
taatacgactcactataggggctatcatcatcgagaacattacccacacgaacagaggagacgtgtgatgaatgttctcaacctggcggcagcgcaaaagatg

SEQ ID NO: 71463 - DNA, 103 bp, Artificial Sequence
  Synthetic Polynucleotide
taatacgactcactatagggatatggctatcatcatcgagaacattacccaacagaggagagggtaaatgtctcgatgaaacctggcggcagcgcaaaagatg

SEQ ID NO: 71464 - DNA, 103 bp, Artificial Sequence
  Synthetic Polynucleotide
taatacgactcactatagggcgggcatatggctatcatcatcgagaacataacagaggagaatgttcatgatgatgataaacctggcggcagcgcaaaagatg

SEQ ID NO: 71465 - DNA, 103 bp, Artificial Sequence
  Synthetic Polynucleotide
taatacgactcactatagggactaccgggcatatggctatcatcatcgagaacagaggagactcgatatggatagccataacctggcggcagcgcaaaagatg

SEQ ID NO: 71466 - DNA, 103 bp, Artificial Sequence
  Synthetic Polynucleotide
taatacgactcactatagggttgcaactaccgggcatatggctatcatcaaacagaggagatgatgaatgccatatgccaacctggcggcagcgcaaaagatg

SEQ ID NO: 71467 - DNA, 103 bp, Artificial Sequence
  Synthetic Polynucleotide
taatacgactcactataggggtatattgcaactaccgggcatatggctataacagaggagaatagccatgtgcccggtaaacctggcggcagcgcaaaagatg

SEQ ID NO: 71468 - DNA, 103 bp, Artificial Sequence
  Synthetic Polynucleotide
taatacgactcactatagggtttatgtatattgcaactaccgggcatatgaacagaggagacatatgatgggtagttgcaacctggcggcagcgcaaaagatg

SEQ ID NO: 71469 - DNA, 103 bp, Artificial Sequence
  Synthetic Polynucleotide
taatacgactcactatagggatcggtttatgtatattgcaactaccgggcaacagaggagagcccggatgttgcaatataacctggcggcagcgcaaaagatg

SEQ ID NO: 71470 - DNA, 103 bp, Artificial Sequence
  Synthetic Polynucleotide
taatacgactcactatagggtgttctatgggaaaactggatggaaaacttaacagaggagaaagtttatgatccagtttaacctggcggcagcgcaaaagatg

SEQ ID NO: 71471 - DNA, 103 bp, Artificial Sequence
  Synthetic Polynucleotide
taatacgactcactatagggtagtgatcggtttatgtatattgcaactacaacagaggagagtagttatgatatacataaacctggcggcagcgcaaaagatg

SEQ ID NO: 71472 - DNA, 103 bp, Artificial Sequence
  Synthetic Polynucleotide
taatacgactcactatagggggaattagtgatcggtttatgtatattgcaaacagaggagatgcaatatgcataaaccgaacctggcggcagcgcaaaagatg

SEQ ID NO: 71473 - DNA, 103 bp, Artificial Sequence
  Synthetic Polynucleotide
taatacgactcactatagggggtttggaattagtgatcggtttatgtataaacagaggagatatacaatgaccgatcacaacctggcggcagcgcaaaagatg

SEQ ID NO: 71474 - DNA, 103 bp, Artificial Sequence
  Synthetic Polynucleotide
taatacgactcactataggggggtgggtttggaattagtgatcggtttataacagaggagaataaacatgtcactaattaacctggcggcagcgcaaaagatg

SEQ ID NO: 71475 - DNA, 103 bp, Artificial Sequence
  Synthetic Polynucleotide
taatacgactcactatagggaaagcgggtgggtttggaattagtgatcggaacagaggagaccgatcatgaattccaaaaacctggcggcagcgcaaaagatg

SEQ ID NO: 71476 - DNA, 103 bp, Artificial Sequence
  Synthetic Polynucleotide
taatacgactcactatagggtataaaaagcgggtgggtttggaattagtgaacagaggagacactaaatgcaaacccacaacctggcggcagcgcaaaagatg

SEQ ID NO: 71477 - DNA, 103 bp, Artificial Sequence
  Synthetic Polynucleotide
taatacgactcactatagggcttactataaaaagcgggtgggtttggaataacagaggagaattccaatgccacccgctaacctggcggcagcgcaaaagatg

SEQ ID NO: 71478 - DNA, 103 bp, Artificial Sequence
  Synthetic Polynucleotide
taatacgactcactatagggaaaaacttactataaaaagcgggtgggtttaacagaggagaaaacccatgcgctttttaaacctggcggcagcgcaaaagatg

SEQ ID NO: 71479 - DNA, 103 bp, Artificial Sequence
  Synthetic Polynucleotide
taatacgactcactataggggggtgaaaaacttactataaaaagcgggtgaacagaggagacacccgatgtttatagtaaacctggcggcagcgcaaaagatg

SEQ ID NO: 71480 - DNA, 103 bp, Artificial Sequence
  Synthetic Polynucleotide
taatacgactcactatagggtttatgggtgaaaaacttactataaaaagcaacagaggagagcttttatgagtaagtttaacctggcggcagcgcaaaagatg

SEQ ID NO: 71481 - DNA, 103 bp, Artificial Sequence
  Synthetic Polynucleotide
taatacgactcactatagggacttatgttctatgggaaaactggatggaaaacagaggagattccatatggttttcccaaacctggcggcagcgcaaaagatg

SEQ ID NO: 71482 - DNA, 103 bp, Artificial Sequence
  Synthetic Polynucleotide
taatacgactcactatagggtactatttatgggtgaaaaacttactataaaacagaggagattatagatggtttttcacaacctggcggcagcgcaaaagatg

SEQ ID NO: 71483 - DNA, 103 bp, Artificial Sequence
  Synthetic Polynucleotide
taatacgactcactataggggtatttactatttatgggtgaaaaacttacaacagaggagagtaagtatgtcacccataaacctggcggcagcgcaaaagatg

SEQ ID NO: 71484 - DNA, 103 bp, Artificial Sequence
  Synthetic Polynucleotide
taatacgactcactatagggttattgtatttactatttatgggtgaaaaaaacagaggagatttttcatgcataaatagaacctggcggcagcgcaaaagatg

SEQ ID NO: 71485 - DNA, 103 bp, Artificial Sequence
  Synthetic Polynucleotide
taatacgactcactatagggattaattattgtatttactatttatgggtgaacagaggagacacccaatgatagtaaataacctggcggcagcgcaaaagatg

SEQ ID NO: 71486 - DNA, 103 bp, Artificial Sequence
  Synthetic Polynucleotide
taatacgactcactataggggagaaattaattattgtatttactatttataacagaggagaataaatatgaaatacaataacctggcggcagcgcaaaagatg

SEQ ID NO: 71487 - DNA, 103 bp, Artificial Sequence
  Synthetic Polynucleotide
taatacgactcactatagggtttacgagaaattaattattgtatttactaaacagaggagatagtaaatgcaataattaaacctggcggcagcgcaaaagatg

SEQ ID NO: 71488 - DNA, 103 bp, Artificial Sequence
  Synthetic Polynucleotide
taatacgactcactatagggctacttttacgagaaattaattattgtattaacagaggagaaatacaatgattaatttcaacctggcggcagcgcaaaagatg

SEQ ID NO: 71489 - DNA, 103 bp, Artificial Sequence
  Synthetic Polynucleotide
taatacgactcactatagggattttctacttttacgagaaattaattattaacagaggagaaataatatgtttctcgtaaacctggcggcagcgcaaaagatg

SEQ ID NO: 71490 - DNA, 103 bp, Artificial Sequence
  Synthetic Polynucleotide
taatacgactcactatagggaatatattttctacttttacgagaaattaaaacagaggagattaattatgcgtaaaagtaacctggcggcagcgcaaaagatg

SEQ ID NO: 71491 - DNA, 103 bp, Artificial Sequence
  Synthetic Polynucleotide
taatacgactcactatagggattagaatatattttctacttttacgagaaaacagaggagattctcgatgaagtagaaaaacctggcggcagcgcaaaagatg

SEQ ID NO: 71492 - DNA, 103 bp, Artificial Sequence
  Synthetic Polynucleotide
taatacgactcactatagggtggagacttatgttctatgggaaaactggaaacagaggagatccagtatgcccatagaaaacctggcggcagcgcaaaagatg

SEQ ID NO: 71493 - DNA, 103 bp, Artificial Sequence
  Synthetic Polynucleotide
taatacgactcactatagggaataaattagaatatattttctacttttacaacagaggagagtaaaaatggaaaatataaacctggcggcagcgcaaaagatg

SEQ ID NO: 71494 - DNA, 103 bp, Artificial Sequence
  Synthetic Polynucleotide
taatacgactcactatagggcgtgcaataaattagaatatattttctactaacagaggagaagtagaatgtatattctaaacctggcggcagcgcaaaagatg

SEQ ID NO: 71495 - DNA, 103 bp, Artificial Sequence
  Synthetic Polynucleotide
taatacgactcactatagggcttaccgtgcaataaattagaatatattttaacagaggagaaaaataatgtctaatttaaacctggcggcagcgcaaaagatg

SEQ ID NO: 71496 - DNA, 103 bp, Artificial Sequence
  Synthetic Polynucleotide
taatacgactcactatagggacttccttaccgtgcaataaattagaatataacagaggagaatattcatgtttattgcaaacctggcggcagcgcaaaagatg

SEQ ID NO: 71497 - DNA, 103 bp, Artificial Sequence
  Synthetic Polynucleotide
taatacgactcactatagggattctacttccttaccgtgcaataaattagaacagaggagactaattatgtgcacggtaaacctggcggcagcgcaaaagatg

SEQ ID NO: 71498 - DNA, 103 bp, Artificial Sequence
  Synthetic Polynucleotide
taatacgactcactatagggttatgattctacttccttaccgtgcaataaaacagaggagattattgatgggtaaggaaaacctggcggcagcgcaaaagatg

SEQ ID NO: 71499 - DNA, 103 bp, Artificial Sequence
  Synthetic Polynucleotide
taatacgactcactataggggttctttatgattctacttccttaccgtgcaacagaggagagcacggatgggaagtagaaacctggcggcagcgcaaaagatg

SEQ ID NO: 71500 - DNA, 103 bp, Artificial Sequence
  Synthetic Polynucleotide
taatacgactcactataggggtactgttctttatgattctacttccttacaacagaggagagtaaggatgtagaatcataacctggcggcagcgcaaaagatg

SEQ ID NO: 71501 - DNA, 103 bp, Artificial Sequence
  Synthetic Polynucleotide
taatacgactcactatagggattgagtactgttctttatgattctacttcaacagaggagagaagtaatgtcataaagaaacctggcggcagcgcaaaagatg

SEQ ID NO: 71502 - DNA, 103 bp, Artificial Sequence
  Synthetic Polynucleotide
taatacgactcactatagggtattgattgagtactgttctttatgattctaacagaggagaagaatcatgaagaacagtaacctggcggcagcgcaaaagatg

SEQ ID NO: 71503 - DNA, 103 bp, Artificial Sequence
  Synthetic Polynucleotide
taatacgactcactatagggaaaattggagacttatgttctatgggaaaaaacagaggagattttccatgagaacataaaacctggcggcagcgcaaaagatg

SEQ ID NO: 71504 - DNA, 103 bp, Artificial Sequence
  Synthetic Polynucleotide
taatacgactcactatagggattgctattgattgagtactgttctttatgaacagaggagacataaaatgcagtactcaaacctggcggcagcgcaaaagatg

SEQ ID NO: 71505 - DNA, 103 bp, Artificial Sequence
  Synthetic Polynucleotide
taatacgactcactatagggtcatgattgctattgattgagtactgttctaacagaggagaagaacaatgctcaatcaaaacctggcggcagcgcaaaagatg

SEQ ID NO: 71506 - DNA, 103 bp, Artificial Sequence
  Synthetic Polynucleotide
taatacgactcactatagggttgtttcatgattgctattgattgagtactaacagaggagaagtactatgtcaatagcaaacctggcggcagcgcaaaagatg

SEQ ID NO: 71507 - DNA, 103 bp, Artificial Sequence
  Synthetic Polynucleotide
taatacgactcactatagggatatattgtttcatgattgctattgattgaaacagaggagatcaatcatgagcaatcataacctggcggcagcgcaaaagatg

SEQ ID NO: 71508 - DNA, 103 bp, Artificial Sequence
  Synthetic Polynucleotide
taatacgactcactatagggggacgatatattgtttcatgattgctattgaacagaggagacaatagatgtcatgaaacaacctggcggcagcgcaaaagatg

SEQ ID NO: 71509 - DNA, 103 bp, Artificial Sequence
  Synthetic Polynucleotide
taatacgactcactatagggtgccaggacgatatattgtttcatgattgcaacagaggagagcaatcatgaaacaatataacctggcggcagcgcaaaagatg

SEQ ID NO: 71510 - DNA, 103 bp, Artificial Sequence
  Synthetic Polynucleotide
taatacgactcactatagggatgcatgccaggacgatatattgtttcatgaacagaggagacatgaaatgatatatcgtaacctggcggcagcgcaaaagatg

SEQ ID NO: 71511 - DNA, 103 bp, Artificial Sequence
  Synthetic Polynucleotide
taatacgactcactatagggggcacatgcatgccaggacgatatattgttaacagaggagaaacaatatgtcgtcctggaacctggcggcagcgcaaaagatg

SEQ ID NO: 71512 - DNA, 103 bp, Artificial Sequence
  Synthetic Polynucleotide
taatacgactcactatagggcgccaggcacatgcatgccaggacgatataaacagaggagatatatcatgctggcatgcaacctggcggcagcgcaaaagatg

SEQ ID NO: 71513 - DNA, 103 bp, Artificial Sequence
  Synthetic Polynucleotide
taatacgactcactataggggctgccgccaggcacatgcatgccaggacgaacagaggagacgtcctatgatgcatgtgaacctggcggcagcgcaaaagatg

SEQ ID NO: 71514 - DNA, 103 bp, Artificial Sequence
  Synthetic Polynucleotide
taatacgactcactatagggtaagaaaaattggagacttatgttctatggaacagaggagaccatagatgataagtctcaacctggcggcagcgcaaaagatg

SEQ ID NO: 71515 - DNA, 103 bp, Artificial Sequence
  Synthetic Polynucleotide
taatacgactcactatagggtagcagctgccgccaggcacatgcatgccaaacagaggagatggcatatgtgtgcctggaacctggcggcagcgcaaaagatg

SEQ ID NO: 71516 - DNA, 103 bp, Artificial Sequence
  Synthetic Polynucleotide
taatacgactcactatagggaggcatagcagctgccgccaggcacatgcaaacagaggagatgcatgatgctggcggcaaacctggcggcagcgcaaaagatg

SEQ ID NO: 71517 - DNA, 103 bp, Artificial Sequence
  Synthetic Polynucleotide
taatacgactcactatagggctggcaggcatagcagctgccgccaggcacaacagaggagagtgcctatgggcagctgcaacctggcggcagcgcaaaagatg

SEQ ID NO: 71518 - DNA, 103 bp, Artificial Sequence
  Synthetic Polynucleotide
taatacgactcactataggggaagactggcaggcatagcagctgccgccaaacagaggagatggcggatgctgctatgcaacctggcggcagcgcaaaagatg

SEQ ID NO: 71519 - DNA, 103 bp, Artificial Sequence
  Synthetic Polynucleotide
taatacgactcactatagggttgctgaagactggcaggcatagcagctgcaacagaggagagcagctatgatgcctgccaacctggcggcagcgcaaaagatg

SEQ ID NO: 71520 - DNA, 103 bp, Artificial Sequence
  Synthetic Polynucleotide
taatacgactcactataggggaggattgctgaagactggcaggcatagcaaacagaggagatgctatatgtgccagtctaacctggcggcagcgcaaaagatg

SEQ ID NO: 71521 - DNA, 103 bp, Artificial Sequence
  Synthetic Polynucleotide
taatacgactcactatagggaggatgaggattgctgaagactggcaggcaaacagaggagatgcctgatggtcttcagcaacctggcggcagcgcaaaagatg

SEQ ID NO: 71522 - DNA, 103 bp, Artificial Sequence
  Synthetic Polynucleotide
taatacgactcactatagggacacgaggatgaggattgctgaagactggcaacagaggagagccagtatgcagcaatccaacctggcggcagcgcaaaagatg

SEQ ID NO: 71523 - DNA, 103 bp, Artificial Sequence
  Synthetic Polynucleotide
taatacgactcactatagggtcagtacacgaggatgaggattgctgaagaaacagaggagatcttcaatgatcctcatcaacctggcggcagcgcaaaagatg

SEQ ID NO: 71524 - DNA, 103 bp, Artificial Sequence
  Synthetic Polynucleotide
taatacgactcactatagggcttcttcagtacacgaggatgaggattgctaacagaggagaagcaatatgcatcctcgtaacctggcggcagcgcaaaagatg

SEQ ID NO: 71525 - DNA, 103 bp, Artificial Sequence
  Synthetic Polynucleotide
taatacgactcactatagggtgttttaagaaaaattggagacttatgttcaacagaggagagaacatatgtctccaattaacctggcggcagcgcaaaagatg

SEQ ID NO: 71526 - DNA, 103 bp, Artificial Sequence
  Synthetic Polynucleotide
taatacgactcactataggggttttcttcttcagtacacgaggatgaggaaacagaggagatcctcaatgtcgtgtactaacctggcggcagcgcaaaagatg

SEQ ID NO: 71527 - DNA, 103 bp, Artificial Sequence
  Synthetic Polynucleotide
taatacgactcactatagggtgtttgttttcttcttcagtacacgaggataacagaggagaatcctcatgtactgaagaaacctggcggcagcgcaaaagatg

SEQ ID NO: 71528 - DNA, 103 bp, Artificial Sequence
  Synthetic Polynucleotide
taatacgactcactatagggtataatgtttgttttcttcttcagtacacgaacagaggagacgtgtaatgaagaagaaaaacctggcggcagcgcaaaagatg

SEQ ID NO: 71529 - DNA, 103 bp, Artificial Sequence
  Synthetic Polynucleotide
taatacgactcactatagggtcccatataatgtttgttttcttcttcagtaacagaggagaactgaaatggaaaacaaaaacctggcggcagcgcaaaagatg

SEQ ID NO: 71530 - DNA, 103 bp, Artificial Sequence
  Synthetic Polynucleotide
taatacgactcactatagggtcgattcccatataatgtttgttttcttctaacagaggagaagaagaatgcaaacattaaacctggcggcagcgcaaaagatg

SEQ ID NO: 71531 - DNA, 103 bp, Artificial Sequence
  Synthetic Polynucleotide
taatacgactcactatagggtaacatcgattcccatataatgtttgttttaacagaggagaaaaacaatgattatatggaacctggcggcagcgcaaaagatg

SEQ ID NO: 71532 - DNA, 103 bp, Artificial Sequence
  Synthetic Polynucleotide
taatacgactcactataggggataataacatcgattcccatataatgtttaacagaggagaaaacatatgatgggaatcaacctggcggcagcgcaaaagatg

SEQ ID NO: 71533 - DNA, 103 bp, Artificial Sequence
  Synthetic Polynucleotide
taatacgactcactatagggactttgataataacatcgattcccatataaaacagaggagattatatatgaatcgatgtaacctggcggcagcgcaaaagatg

SEQ ID NO: 71534 - DNA, 103 bp, Artificial Sequence
  Synthetic Polynucleotide
taatacgactcactatagggttgtgactttgataataacatcgattcccaaacagaggagatgggaaatgatgttattaaacctggcggcagcgcaaaagatg

SEQ ID NO: 71535 - DNA, 103 bp, Artificial Sequence
  Synthetic Polynucleotide
taatacgactcactatagggttgctttgtgactttgataataacatcgataacagaggagaatcgatatgattatcaaaaacctggcggcagcgcaaaagatg

SEQ ID NO: 71536 - DNA, 103 bp, Artificial Sequence
  Synthetic Polynucleotide
taatacgactcactatagggaaaactgttttaagaaaaattggagacttaaacagaggagataagtcatgaatttttctaacctggcggcagcgcaaaagatg

SEQ ID NO: 71537 - DNA, 103 bp, Artificial Sequence
  Synthetic Polynucleotide
taatacgactcactatagggtggtcttgctttgtgactttgataataacaaacagaggagatgttatatgcaaagtcacaacctggcggcagcgcaaaagatg

SEQ ID NO: 71538 - DNA, 103 bp, Artificial Sequence
  Synthetic Polynucleotide
taatacgactcactataggggtgtttggtcttgctttgtgactttgataaaacagaggagattatcaatgtcacaaagcaacctggcggcagcgcaaaagatg

SEQ ID NO: 71539 - DNA, 103 bp, Artificial Sequence
  Synthetic Polynucleotide
taatacgactcactatagggggtcggtgtttggtcttgctttgtgactttaacagaggagaaaagtcatgaagcaagacaacctggcggcagcgcaaaagatg

SEQ ID NO: 71540 - DNA, 103 bp, Artificial Sequence
  Synthetic Polynucleotide
taatacgactcactatagggtcattggtcggtgtttggtcttgctttgtgaacagaggagacacaaaatgagaccaaacaacctggcggcagcgcaaaagatg

SEQ ID NO: 71541 - DNA, 103 bp, Artificial Sequence
  Synthetic Polynucleotide
taatacgactcactatagggtcttatcattggtcggtgtttggtcttgctaacagaggagaagcaagatgaaacaccgaaacctggcggcagcgcaaaagatg

SEQ ID NO: 71542 - DNA, 103 bp, Artificial Sequence
  Synthetic Polynucleotide
taatacgactcactataggggcaaatcttatcattggtcggtgtttggtcaacagaggagagaccaaatgccgaccaataacctggcggcagcgcaaaagatg

SEQ ID NO: 71543 - DNA, 103 bp, Artificial Sequence
  Synthetic Polynucleotide
taatacgactcactataggggattggcaaatcttatcattggtcggtgttaacagaggagaaacaccatgcaatgataaaacctggcggcagcgcaaaagatg

SEQ ID NO: 71544 - DNA, 103 bp, Artificial Sequence
  Synthetic Polynucleotide
taatacgactcactatagggttacggattggcaaatcttatcattggtcgaacagaggagacgaccaatgataagatttaacctggcggcagcgcaaaagatg

SEQ ID NO: 71545 - DNA, 103 bp, Artificial Sequence
  Synthetic Polynucleotide
taatacgactcactatagggttccgttacggattggcaaatcttatcattaacagaggagaaatgatatgatttgccaaaacctggcggcagcgcaaaagatg

SEQ ID NO: 71546 - DNA, 103 bp, Artificial Sequence
  Synthetic Polynucleotide
taatacgactcactataggggtaatttccgttacggattggcaaatcttaaacagaggagataagatatgccaatccgtaacctggcggcagcgcaaaagatg

SEQ ID NO: 71547 - DNA, 103 bp, Artificial Sequence
  Synthetic Polynucleotide
taatacgactcactatagggacggtaaaactgttttaagaaaaattggagaacagaggagactccaaatgttcttaaaaaacctggcggcagcgcaaaagatg

SEQ ID NO: 71548 - DNA, 103 bp, Artificial Sequence
  Synthetic Polynucleotide
taatacgactcactatagggactctgtaatttccgttacggattggcaaaaacagaggagatttgccatgccgtaacggaacctggcggcagcgcaaaagatg

SEQ ID NO: 71549 - DNA, 103 bp, Artificial Sequence
  Synthetic Polynucleotide
taatacgactcactatagggctcggactctgtaatttccgttacggattgaacagaggagacaatccatgacggaaattaacctggcggcagcgcaaaagatg

SEQ ID NO: 71550 - DNA, 103 bp, Artificial Sequence
  Synthetic Polynucleotide
taatacgactcactatagggtctgactcggactctgtaatttccgttacgaacagaggagacgtaacatgaattacagaaacctggcggcagcgcaaaagatg

SEQ ID NO: 71551 - DNA, 103 bp, Artificial Sequence
  Synthetic Polynucleotide
taatacgactcactatagggcgggatctgactcggactctgtaatttccgaacagaggagacggaaaatgcagagtccgaacctggcggcagcgcaaaagatg

SEQ ID NO: 71552 - DNA, 103 bp, Artificial Sequence
  Synthetic Polynucleotide
taatacgactcactatagggcacctcgggatctgactcggactctgtaataacagaggagaattacaatgtccgagtcaaacctggcggcagcgcaaaagatg

SEQ ID NO: 71553 - DNA, 103 bp, Artificial Sequence
  Synthetic Polynucleotide
taatacgactcactataggggattccacctcgggatctgactcggactctaacagaggagaagagtcatggtcagatccaacctggcggcagcgcaaaagatg

SEQ ID NO: 71554 - DNA, 103 bp, Artificial Sequence
  Synthetic Polynucleotide
taatacgactcactatagggcttctgattccacctcgggatctgactcggaacagaggagaccgagtatgatcccgaggaacctggcggcagcgcaaaagatg

SEQ ID NO: 71555 - DNA, 103 bp, Artificial Sequence
  Synthetic Polynucleotide
taatacgactcactatagggatcatcttctgattccacctcgggatctgaaacagaggagatcagatatggaggtggaaaacctggcggcagcgcaaaagatg

SEQ ID NO: 71556 - DNA, 103 bp, Artificial Sequence
  Synthetic Polynucleotide
taatacgactcactataggggtggaatcatcttctgattccacctcgggaaacagaggagatcccgaatgggaatcagaaacctggcggcagcgcaaaagatg

SEQ ID NO: 71557 - DNA, 103 bp, Artificial Sequence
  Synthetic Polynucleotide
taatacgactcactatagggctgatgtggaatcatcttctgattccacctaacagaggagaaggtggatgcagaagatgaacctggcggcagcgcaaaagatg

SEQ ID NO: 71558 - DNA, 103 bp, Artificial Sequence
  Synthetic Polynucleotide
taatacgactcactatagggtacaaacggtaaaactgttttaagaaaaataacagaggagaatttttatgaaaacagttaacctggcggcagcgcaaaagatg

SEQ ID NO: 71559 - DNA, 103 bp, Artificial Sequence
  Synthetic Polynucleotide
taatacgactcactatagggctcgactgatgtggaatcatcttctgattcaacagaggagagaatcaatggatgattccaacctggcggcagcgcaaaagatg

SEQ ID NO: 71560 - DNA, 103 bp, Artificial Sequence
  Synthetic Polynucleotide
taatacgactcactatagggacatcctcgactgatgtggaatcatcttctaacagaggagaagaagaatgttccacatcaacctggcggcagcgcaaaagatg

SEQ ID NO: 71561 - DNA, 103 bp, Artificial Sequence
  Synthetic Polynucleotide
taatacgactcactataggggatctacatcctcgactgatgtggaatcataacagaggagaatgattatgcatcagtcgaacctggcggcagcgcaaaagatg

SEQ ID NO: 71562 - DNA, 103 bp, Artificial Sequence
  Synthetic Polynucleotide
taatacgactcactatagggaggaggatctacatcctcgactgatgtggaaacagaggagatccacaatggtcgaggataacctggcggcagcgcaaaagatg

SEQ ID NO: 71563 - DNA, 103 bp, Artificial Sequence
  Synthetic Polynucleotide
taatacgactcactataggggtggtaggaggatctacatcctcgactgataacagaggagaatcagtatgggatgtagaaacctggcggcagcgcaaaagatg

SEQ ID NO: 71564 - DNA, 103 bp, Artificial Sequence
  Synthetic Polynucleotide
taatacgactcactatagggaataagtggtaggaggatctacatcctcgaaacagaggagatcgaggatgtagatcctcaacctggcggcagcgcaaaagatg

SEQ ID NO: 71565 - DNA, 103 bp, Artificial Sequence
  Synthetic Polynucleotide
taatacgactcactatagggggagtaataagtggtaggaggatctacatcaacagaggagagatgtaatgcctcctaccaacctggcggcagcgcaaaagatg

SEQ ID NO: 71566 - DNA, 103 bp, Artificial Sequence
  Synthetic Polynucleotide
taatacgactcactatagggataatggagtaataagtggtaggaggatctaacagaggagaagatccatgtaccacttaaacctggcggcagcgcaaaagatg

SEQ ID NO: 71567 - DNA, 103 bp, Artificial Sequence
  Synthetic Polynucleotide
taatacgactcactatagggcgccaataatggagtaataagtggtaggagaacagaggagactcctaatgcttattactaacctggcggcagcgcaaaagatg

SEQ ID NO: 71568 - DNA, 103 bp, Artificial Sequence
  Synthetic Polynucleotide
taatacgactcactatagggacctccgccaataatggagtaataagtggtaacagaggagaaccactatgtactccattaacctggcggcagcgcaaaagatg

SEQ ID NO: 71569 - DNA, 103 bp, Artificial Sequence
  Synthetic Polynucleotide
taatacgactcactataggggcgaatgatctaattatcatagcagcgaacaacagaggagagttcgcatgtatgataataacctggcggcagcgcaaaagatg

SEQ ID NO: 71570 - DNA, 103 bp, Artificial Sequence
  Synthetic Polynucleotide
taatacgactcactatagggtaacatacaaacggtaaaactgttttaagaaacagaggagatcttaaatgagttttaccaacctggcggcagcgcaaaagatg

SEQ ID NO: 71571 - DNA, 103 bp, Artificial Sequence
  Synthetic Polynucleotide
taatacgactcactatagggctcagacctccgccaataatggagtaataaaacagaggagattattaatgcattattggaacctggcggcagcgcaaaagatg

SEQ ID NO: 71572 - DNA, 103 bp, Artificial Sequence
  Synthetic Polynucleotide
taatacgactcactatagggtcattctcagacctccgccaataatggagtaacagaggagaactccaatgttggcggagaacctggcggcagcgcaaaagatg

SEQ ID NO: 71573 - DNA, 103 bp, Artificial Sequence
  Synthetic Polynucleotide
taatacgactcactatagggaaagttcattctcagacctccgccaataataacagaggagaattattatgggaggtctgaacctggcggcagcgcaaaagatg

SEQ ID NO: 71574 - DNA, 103 bp, Artificial Sequence
  Synthetic Polynucleotide
taatacgactcactatagggaatccaaagttcattctcagacctccgccaaacagaggagatggcggatgtctgagaataacctggcggcagcgcaaaagatg

SEQ ID NO: 71575 - DNA, 103 bp, Artificial Sequence
  Synthetic Polynucleotide
taatacgactcactatagggtggtgaatccaaagttcattctcagacctcaacagaggagagaggtcatggaatgaactaacctggcggcagcgcaaaagatg

SEQ ID NO: 71576 - DNA, 103 bp, Artificial Sequence
  Synthetic Polynucleotide
taatacgactcactatagggacatttggtgaatccaaagttcattctcagaacagaggagactgagaatgaactttggaaacctggcggcagcgcaaaagatg

SEQ ID NO: 71577 - DNA, 103 bp, Artificial Sequence
  Synthetic Polynucleotide
taatacgactcactatagggtgaggacatttggtgaatccaaagttcattaacagaggagaaatgaaatgtggattcacaacctggcggcagcgcaaaagatg

SEQ ID NO: 71578 - DNA, 103 bp, Artificial Sequence
  Synthetic Polynucleotide
taatacgactcactatagggtaatctgaggacatttggtgaatccaaagtaacagaggagaactttgatgtcaccaaataacctggcggcagcgcaaaagatg

SEQ ID NO: 71579 - DNA, 103 bp, Artificial Sequence
  Synthetic Polynucleotide
taatacgactcactatagggggatttaatctgaggacatttggtgaatccaacagaggagaggattcatgaaatgtcctaacctggcggcagcgcaaaagatg

SEQ ID NO: 71580 - DNA, 103 bp, Artificial Sequence
  Synthetic Polynucleotide
taatacgactcactataggggagatggatttaatctgaggacatttggtgaacagaggagacaccaaatgtcctcagataacctggcggcagcgcaaaagatg

SEQ ID NO: 71581 - DNA, 103 bp, Artificial Sequence
  Synthetic Polynucleotide
taatacgactcactatagggagtggtaacatacaaacggtaaaactgtttaacagaggagaaaacagatgtaccgtttgaacctggcggcagcgcaaaagatg

SEQ ID NO: 71582 - DNA, 103 bp, Artificial Sequence
  Synthetic Polynucleotide
taatacgactcactatagggattctgagatggatttaatctgaggacattaacagaggagaaatgtcatgagattaaataacctggcggcagcgcaaaagatg

SEQ ID NO: 71583 - DNA, 103 bp, Artificial Sequence
  Synthetic Polynucleotide
taatacgactcactatagggagcggattctgagatggatttaatctgaggaacagaggagacctcagatgaaatccatcaacctggcggcagcgcaaaagatg

SEQ ID NO: 71584 - DNA, 103 bp, Artificial Sequence
  Synthetic Polynucleotide
taatacgactcactatagggccattagcggattctgagatggatttaatcaacagaggagagattaaatgcatctcagaaacctggcggcagcgcaaaagatg

SEQ ID NO: 71585 - DNA, 103 bp, Artificial Sequence
  Synthetic Polynucleotide
taatacgactcactatagggcgtttccattagcggattctgagatggattaacagaggagaaatccaatgcagaatccgaacctggcggcagcgcaaaagatg

SEQ ID NO: 71586 - DNA, 103 bp, Artificial Sequence
  Synthetic Polynucleotide
taatacgactcactatagggcactgcgtttccattagcggattctgagataacagaggagaatctcaatgtccgctaataacctggcggcagcgcaaaagatg

SEQ ID NO: 71587 - DNA, 103 bp, Artificial Sequence
  Synthetic Polynucleotide
taatacgactcactataggggcattcactgcgtttccattagcggattctaacagaggagaagaatcatgtaatggaaaaacctggcggcagcgcaaaagatg

SEQ ID NO: 71588 - DNA, 103 bp, Artificial Sequence
  Synthetic Polynucleotide
taatacgactcactatagggatctagcattcactgcgtttccattagcggaacagaggagaccgctaatggaaacgcagaacctggcggcagcgcaaaagatg

SEQ ID NO: 71589 - DNA, 103 bp, Artificial Sequence
  Synthetic Polynucleotide
taatacgactcactatagggggacaatctagcattcactgcgtttccattaacagaggagaaatggaatggcagtgaataacctggcggcagcgcaaaagatg

SEQ ID NO: 71590 - DNA, 103 bp, Artificial Sequence
  Synthetic Polynucleotide
taatacgactcactatagggacgctggacaatctagcattcactgcgtttaacagaggagaaaacgcatggaatgctagaacctggcggcagcgcaaaagatg

SEQ ID NO: 71591 - DNA, 103 bp, Artificial Sequence
  Synthetic Polynucleotide
taatacgactcactatagggggggcacgctggacaatctagcattcactgaacagaggagacagtgaatgctagattgtaacctggcggcagcgcaaaagatg

SEQ ID NO: 71592 - DNA, 103 bp, Artificial Sequence
  Synthetic Polynucleotide
taatacgactcactatagggttgatagtggtaacatacaaacggtaaaacaacagaggagagttttaatgtttgtatgtaacctggcggcagcgcaaaagatg

SEQ ID NO: 71593 - DNA, 103 bp, Artificial Sequence
  Synthetic Polynucleotide
taatacgactcactatagggtcctaggggcacgctggacaatctagcattaacagaggagaaatgctatgttgtccagcaacctggcggcagcgcaaaagatg

SEQ ID NO: 71594 - DNA, 103 bp, Artificial Sequence
  Synthetic Polynucleotide
taatacgactcactatagggccttgtcctaggggcacgctggacaatctaaacagaggagatagattatgcagcgtgccaacctggcggcagcgcaaaagatg

SEQ ID NO: 71595 - DNA, 103 bp, Artificial Sequence
  Synthetic Polynucleotide
taatacgactcactatagggccttaccttgtcctaggggcacgctggacaaacagaggagatgtccaatgtgcccctagaacctggcggcagcgcaaaagatg

SEQ ID NO: 71596 - DNA, 103 bp, Artificial Sequence
  Synthetic Polynucleotide
taatacgactcactatagggagagtccttaccttgtcctaggggcacgctaacagaggagaagcgtgatgctaggacaaaacctggcggcagcgcaaaagatg

SEQ ID NO: 71597 - DNA, 103 bp, Artificial Sequence
  Synthetic Polynucleotide
taatacgactcactataggggcgggagagtccttaccttgtcctaggggcaacagaggagagcccctatgacaaggtaaaacctggcggcagcgcaaaagatg

SEQ ID NO: 71598 - DNA, 103 bp, Artificial Sequence
  Synthetic Polynucleotide
taatacgactcactatagggtgatagcgggagagtccttaccttgtcctaaacagaggagataggacatggtaaggactaacctggcggcagcgcaaaagatg

SEQ ID NO: 71599 - DNA, 103 bp, Artificial Sequence
  Synthetic Polynucleotide
taatacgactcactatagggacgagtgatagcgggagagtccttaccttgaacagaggagacaaggtatggactctcccaacctggcggcagcgcaaaagatg

SEQ ID NO: 71600 - DNA, 103 bp, Artificial Sequence
  Synthetic Polynucleotide
taatacgactcactatagggtctgcacgagtgatagcgggagagtccttaaacagaggagataaggaatgtcccgctataacctggcggcagcgcaaaagatg

SEQ ID NO: 71601 - DNA, 103 bp, Artificial Sequence
  Synthetic Polynucleotide
taatacgactcactataggggagcttctgcacgagtgatagcgggagagtaacagaggagaactctcatgctatcactcaacctggcggcagcgcaaaagatg

SEQ ID NO: 71602 - DNA, 103 bp, Artificial Sequence
  Synthetic Polynucleotide
taatacgactcactatagggagccagagcttctgcacgagtgatagcgggaacagaggagacccgctatgactcgtgcaaacctggcggcagcgcaaaagatg

SEQ ID NO: 71603 - DNA, 103 bp, Artificial Sequence
  Synthetic Polynucleotide
taatacgactcactatagggtgtggttgatagtggtaacatacaaacggtaacagaggagaaccgttatgatgttaccaaacctggcggcagcgcaaaagatg

SEQ ID NO: 71604 - DNA, 103 bp, Artificial Sequence
  Synthetic Polynucleotide
taatacgactcactatagggatcatagccagagcttctgcacgagtgataaacagaggagatatcacatgtgcagaagcaacctggcggcagcgcaaaagatg

SEQ ID NO: 71605 - DNA, 103 bp, Artificial Sequence
  Synthetic Polynucleotide
taatacgactcactatagggctttgatcatagccagagcttctgcacgagaacagaggagactcgtgatgaagctctggaacctggcggcagcgcaaaagatg

SEQ ID NO: 71606 - DNA, 103 bp, Artificial Sequence
  Synthetic Polynucleotide
taatacgactcactatagggacagtctttgatcatagccagagcttctgcaacagaggagagcagaaatgctggctatgaacctggcggcagcgcaaaagatg

SEQ ID NO: 71607 - DNA, 103 bp, Artificial Sequence
  Synthetic Polynucleotide
taatacgactcactatagggagctcacagtctttgatcatagccagagctaacagaggagaagctctatgtatgatcaaaacctggcggcagcgcaaaagatg

SEQ ID NO: 71608 - DNA, 103 bp, Artificial Sequence
  Synthetic Polynucleotide
taatacgactcactatagggtagacagctcacagtctttgatcatagccaaacagaggagatggctaatgtcaaagactaacctggcggcagcgcaaaagatg

SEQ ID NO: 71609 - DNA, 103 bp, Artificial Sequence
  Synthetic Polynucleotide
taatacgactcactataggggtcgatagacagctcacagtctttgatcataacagaggagaatgatcatggactgtgagaacctggcggcagcgcaaaagatg

SEQ ID NO: 71610 - DNA, 103 bp, Artificial Sequence
  Synthetic Polynucleotide
taatacgactcactatagggctaatgtcgatagacagctcacagtctttgaacagaggagacaaagaatgtgagctgtcaacctggcggcagcgcaaaagatg

SEQ ID NO: 71611 - DNA, 103 bp, Artificial Sequence
  Synthetic Polynucleotide
taatacgactcactatagggtacatctaatgtcgatagacagctcacagtaacagaggagaactgtgatgtgtctatcgaacctggcggcagcgcaaaagatg

SEQ ID NO: 71612 - DNA, 103 bp, Artificial Sequence
  Synthetic Polynucleotide
taatacgactcactatagggttcgctacatctaatgtcgatagacagctcaacagaggagagagctgatgatcgacattaacctggcggcagcgcaaaagatg

SEQ ID NO: 71613 - DNA, 103 bp, Artificial Sequence
  Synthetic Polynucleotide
taatacgactcactatagggtcttcttcgctacatctaatgtcgatagacaacagaggagagtctatatgcattagatgaacctggcggcagcgcaaaagatg

SEQ ID NO: 71614 - DNA, 103 bp, Artificial Sequence
  Synthetic Polynucleotide
taatacgactcactatagggtattatgtggttgatagtggtaacatacaaaacagaggagattgtatatgaccactatcaacctggcggcagcgcaaaagatg

SEQ ID NO: 71615 - DNA, 103 bp, Artificial Sequence
  Synthetic Polynucleotide
taatacgactcactatagggctttctcttcttcgctacatctaatgtcgaaacagaggagatcgacaatggatgtagcgaacctggcggcagcgcaaaagatg

SEQ ID NO: 71616 - DNA, 103 bp, Artificial Sequence
  Synthetic Polynucleotide
taatacgactcactataggggctgtctttctcttcttcgctacatctaataacagaggagaattagaatgagcgaagaaaacctggcggcagcgcaaaagatg

SEQ ID NO: 71617 - DNA, 103 bp, Artificial Sequence
  Synthetic Polynucleotide
taatacgactcactatagggatgtcgctgtctttctcttcttcgctacataacagaggagaatgtagatgagaagagaaaacctggcggcagcgcaaaagatg

SEQ ID NO: 71618 - DNA, 103 bp, Artificial Sequence
  Synthetic Polynucleotide
taatacgactcactatagggtctggatgtcgctgtctttctcttcttcgcaacagaggagagcgaagatgagaaagacaaacctggcggcagcgcaaaagatg

SEQ ID NO: 71619 - DNA, 103 bp, Artificial Sequence
  Synthetic Polynucleotide
taatacgactcactatagggatgggtctggatgtcgctgtctttctcttcaacagaggagagaagagatggacagcgacaacctggcggcagcgcaaaagatg

SEQ ID NO: 71620 - DNA, 103 bp, Artificial Sequence
  Synthetic Polynucleotide
taatacgactcactatagggactggatgggtctggatgtcgctgtctttcaacagaggagagaaagaatgcgacatccaaacctggcggcagcgcaaaagatg

SEQ ID NO: 71621 - DNA, 103 bp, Artificial Sequence
  Synthetic Polynucleotide
taatacgactcactatagggcgagtactggatgggtctggatgtcgctgtaacagaggagaacagcgatgtccagacccaacctggcggcagcgcaaaagatg

SEQ ID NO: 71622 - DNA, 103 bp, Artificial Sequence
  Synthetic Polynucleotide
taatacgactcactatagggagactcgagtactggatgggtctggatgtcaacagaggagagacatcatgacccatccaaacctggcggcagcgcaaaagatg

SEQ ID NO: 71623 - DNA, 103 bp, Artificial Sequence
  Synthetic Polynucleotide
taatacgactcactatagggatgttagactcgagtactggatgggtctggaacagaggagaccagacatgtccagtactaacctggcggcagcgcaaaagatg

SEQ ID NO: 71624 - DNA, 103 bp, Artificial Sequence
  Synthetic Polynucleotide
taatacgactcactataggggagagatgttagactcgagtactggatgggaacagaggagacccatcatgtactcgagtaacctggcggcagcgcaaaagatg

SEQ ID NO: 71625 - DNA, 103 bp, Artificial Sequence
  Synthetic Polynucleotide
taatacgactcactatagggtattgtattatgtggttgatagtggtaacaaacagaggagatgttacatgtatcaaccaaacctggcggcagcgcaaaagatg

SEQ ID NO: 71626 - DNA, 103 bp, Artificial Sequence
  Synthetic Polynucleotide
taatacgactcactatagggcttatgagagatgttagactcgagtactggaacagaggagaccagtaatggagtctaacaacctggcggcagcgcaaaagatg

SEQ ID NO: 71627 - DNA, 103 bp, Artificial Sequence
  Synthetic Polynucleotide
taatacgactcactatagggactttcttatgagagatgttagactcgagtaacagaggagaactcgaatgtaacatctcaacctggcggcagcgcaaaagatg

SEQ ID NO: 71628 - DNA, 103 bp, Artificial Sequence
  Synthetic Polynucleotide
taatacgactcactatagggaactcactttcttatgagagatgttagactaacagaggagaagtctaatgtctctcataaacctggcggcagcgcaaaagatg

SEQ ID NO: 71629 - DNA, 103 bp, Artificial Sequence
  Synthetic Polynucleotide
taatacgactcactatagggttcgtaactcactttcttatgagagatgttaacagaggagaaacatcatgcataagaaaaacctggcggcagcgcaaaagatg

SEQ ID NO: 71630 - DNA, 103 bp, Artificial Sequence
  Synthetic Polynucleotide
taatacgactcactatagggatatcttcgtaactcactttcttatgagagaacagaggagactctcaatggaaagtgagaacctggcggcagcgcaaaagatg

SEQ ID NO: 71631 - DNA, 103 bp, Artificial Sequence
  Synthetic Polynucleotide
taatacgactcactatagggcgatgatatcttcgtaactcactttcttataacagaggagaataagaatgtgagttacgaacctggcggcagcgcaaaagatg

SEQ ID NO: 71632 - DNA, 103 bp, Artificial Sequence
  Synthetic Polynucleotide
taatacgactcactatagggtgaaccgatgatatcttcgtaactcactttaacagaggagaaaagtgatgtacgaagataacctggcggcagcgcaaaagatg

SEQ ID NO: 71633 - DNA, 103 bp, Artificial Sequence
  Synthetic Polynucleotide
taatacgactcactatagggatcgttgaaccgatgatatcttcgtaactcaacagaggagagagttaatgagatatcataacctggcggcagcgcaaaagatg

SEQ ID NO: 71634 - DNA, 103 bp, Artificial Sequence
  Synthetic Polynucleotide
taatacgactcactatagggcaacgatcgttgaaccgatgatatcttcgtaacagaggagaacgaagatgtcatcggttaacctggcggcagcgcaaaagatg

SEQ ID NO: 71635 - DNA, 103 bp, Artificial Sequence
  Synthetic Polynucleotide
taatacgactcactatagggtgtatcaacgatcgttgaaccgatgatatcaacagaggagagatatcatgggttcaacgaacctggcggcagcgcaaaagatg

SEQ ID NO: 71636 - DNA, 103 bp, Artificial Sequence
  Synthetic Polynucleotide
taatacgactcactatagggcactgtattgtattatgtggttgatagtggaacagaggagaccactaatgaccacataaaacctggcggcagcgcaaaagatg

SEQ ID NO: 71637 - DNA, 103 bp, Artificial Sequence
  Synthetic Polynucleotide
taatacgactcactatagggcattttgtatcaacgatcgttgaaccgatgaacagaggagacatcggatgaacgatcgtaacctggcggcagcgcaaaagatg

SEQ ID NO: 71638 - DNA, 103 bp, Artificial Sequence
  Synthetic Polynucleotide
taatacgactcactatagggtgacgcattttgtatcaacgatcgttgaacaacagaggagagttcaaatgtcgttgataaacctggcggcagcgcaaaagatg

SEQ ID NO: 71639 - DNA, 103 bp, Artificial Sequence
  Synthetic Polynucleotide
taatacgactcactatagggattcttgacgcattttgtatcaacgatcgtaacagaggagaacgatcatggatacaaaaaacctggcggcagcgcaaaagatg

SEQ ID NO: 71640 - DNA, 103 bp, Artificial Sequence
  Synthetic Polynucleotide
taatacgactcactatagggtctagattcttgacgcattttgtatcaacgaacagaggagacgttgaatgaaaatgcgtaacctggcggcagcgcaaaagatg

SEQ ID NO: 71641 - DNA, 103 bp, Artificial Sequence
  Synthetic Polynucleotide
taatacgactcactatagggtaaactctagattcttgacgcattttgtataacagaggagaatacaaatggcgtcaagaaacctggcggcagcgcaaaagatg

SEQ ID NO: 71642 - DNA, 103 bp, Artificial Sequence
  Synthetic Polynucleotide
taatacgactcactatagggaacactaaactctagattcttgacgcatttaacagaggagaaaatgcatgaagaatctaaacctggcggcagcgcaaaagatg

SEQ ID NO: 71643 - DNA, 103 bp, Artificial Sequence
  Synthetic Polynucleotide
taatacgactcactatagggatacgaacactaaactctagattcttgacgaacagaggagacgtcaaatgtctagagttaacctggcggcagcgcaaaagatg

SEQ ID NO: 71644 - DNA, 103 bp, Artificial Sequence
  Synthetic Polynucleotide
taatacgactcactatagggctccgatacgaacactaaactctagattctaacagaggagaagaatcatgagtttagtgaacctggcggcagcgcaaaagatg

SEQ ID NO: 71645 - DNA, 103 bp, Artificial Sequence
  Synthetic Polynucleotide
taatacgactcactatagggcatgtctccgatacgaacactaaactctagaacagaggagactagagatgagtgttcgtaacctggcggcagcgcaaaagatg

SEQ ID NO: 71646 - DNA, 103 bp, Artificial Sequence
  Synthetic Polynucleotide
taatacgactcactatagggttgcacatgtctccgatacgaacactaaacaacagaggagagtttagatgtcgtatcggaacctggcggcagcgcaaaagatg

SEQ ID NO: 71647 - DNA, 103 bp, Artificial Sequence
  Synthetic Polynucleotide
taatacgactcactataggggggaacactgtattgtattatgtggttgataacagaggagaatcaacatgataatacaaaacctggcggcagcgcaaaagatg

SEQ ID NO: 71648 - DNA, 103 bp, Artificial Sequence
  Synthetic Polynucleotide
taatacgactcactatagggattccttgcacatgtctccgatacgaacacaacagaggagagtgttcatgtcggagacaaacctggcggcagcgcaaaagatg

SEQ ID NO: 71649 - DNA, 103 bp, Artificial Sequence
  Synthetic Polynucleotide
taatacgactcactatagggagacgattccttgcacatgtctccgatacgaacagaggagacgtatcatggacatgtgcaacctggcggcagcgcaaaagatg

SEQ ID NO: 71650 - DNA, 103 bp, Artificial Sequence
  Synthetic Polynucleotide
taatacgactcactatagggagatcagacgattccttgcacatgtctccgaacagaggagacggagaatggtgcaaggaaacctggcggcagcgcaaaagatg

SEQ ID NO: 71651 - DNA, 103 bp, Artificial Sequence
  Synthetic Polynucleotide
taatacgactcactatagggcctcaagatcagacgattccttgcacatgtaacagaggagaacatgtatgaggaatcgtaacctggcggcagcgcaaaagatg

SEQ ID NO: 71652 - DNA, 103 bp, Artificial Sequence
  Synthetic Polynucleotide
taatacgactcactatagggcttgacctcaagatcagacgattccttgcaaacagaggagatgcaagatgtcgtctgataacctggcggcagcgcaaaagatg

SEQ ID NO: 71653 - DNA, 103 bp, Artificial Sequence
  Synthetic Polynucleotide
taatacgactcactatagggccatccttgacctcaagatcagacgattccaacagaggagaggaatcatgtgatcttgaaacctggcggcagcgcaaaagatg

SEQ ID NO: 71654 - DNA, 103 bp, Artificial Sequence
  Synthetic Polynucleotide
taatacgactcactatagggtaaatccatccttgacctcaagatcagacgaacagaggagacgtctgatgttgaggtcaaacctggcggcagcgcaaaagatg

SEQ ID NO: 71655 - DNA, 103 bp, Artificial Sequence
  Synthetic Polynucleotide
taatacgactcactatagggatacttaaatccatccttgacctcaagatcaacagaggagagatcttatggtcaaggataacctggcggcagcgcaaaagatg

SEQ ID NO: 71656 - DNA, 103 bp, Artificial Sequence
  Synthetic Polynucleotide
taatacgactcactatagggtcgacatacttaaatccatccttgacctcaaacagaggagatgaggtatgggatggattaacctggcggcagcgcaaaagatg

SEQ ID NO: 71657 - DNA, 103 bp, Artificial Sequence
  Synthetic Polynucleotide
taatacgactcactatagggatccgtcgacatacttaaatccatccttgaaacagaggagatcaaggatggatttaagtaacctggcggcagcgcaaaagatg

SEQ ID NO: 71658 - DNA, 103 bp, Artificial Sequence
  Synthetic Polynucleotide
taatacgactcactataggggacaagggaacactgtattgtattatgtggaacagaggagaccacatatgacaatacagaacctggcggcagcgcaaaagatg

SEQ ID NO: 71659 - DNA, 103 bp, Artificial Sequence
  Synthetic Polynucleotide
taatacgactcactatagggtaccgatccgtcgacatacttaaatccatcaacagaggagagatggaatgaagtatgtcaacctggcggcagcgcaaaagatg

SEQ ID NO: 71660 - DNA, 103 bp, Artificial Sequence
  Synthetic Polynucleotide
taatacgactcactatagggtcagataccgatccgtcgacatacttaaataacagaggagaatttaaatgtgtcgacggaacctggcggcagcgcaaaagatg

SEQ ID NO: 71661 - DNA, 103 bp, Artificial Sequence
  Synthetic Polynucleotide
taatacgactcactatagggcaccttcagataccgatccgtcgacatactaacagaggagaagtatgatgacggatcggaacctggcggcagcgcaaaagatg

SEQ ID NO: 71662 - DNA, 103 bp, Artificial Sequence
  Synthetic Polynucleotide
taatacgactcactatagggggttacaccttcagataccgatccgtcgacaacagaggagagtcgacatgtcggtatctaacctggcggcagcgcaaaagatg

SEQ ID NO: 71663 - DNA, 103 bp, Artificial Sequence
  Synthetic Polynucleotide
taatacgactcactatagggtcatcggttacaccttcagataccgatccgaacagaggagacggatcatgatctgaaggaacctggcggcagcgcaaaagatg

SEQ ID NO: 71664 - DNA, 103 bp, Artificial Sequence
  Synthetic Polynucleotide
taatacgactcactatagggaagtatcatcggttacaccttcagataccgaacagaggagacggtatatgaaggtgtaaaacctggcggcagcgcaaaagatg

SEQ ID NO: 71665 - DNA, 103 bp, Artificial Sequence
  Synthetic Polynucleotide
taatacgactcactataggggagtgaagtatcatcggttacaccttcagaaacagaggagatctgaaatggtaaccgataacctggcggcagcgcaaaagatg

SEQ ID NO: 71666 - DNA, 103 bp, Artificial Sequence
  Synthetic Polynucleotide
taatacgactcactatagggtcgatgagtgaagtatcatcggttacacctaacagaggagaaggtgtatgcgatgatacaacctggcggcagcgcaaaagatg

SEQ ID NO: 71667 - DNA, 103 bp, Artificial Sequence
  Synthetic Polynucleotide
taatacgactcactatagggttgaatcgatgagtgaagtatcatcggttaaacagaggagataaccgatgatacttcacaacctggcggcagcgcaaaagatg

SEQ ID NO: 71668 - DNA, 103 bp, Artificial Sequence
  Synthetic Polynucleotide
taatacgactcactatagggttttgttgaatcgatgagtgaagtatcatcaacagaggagagatgatatgtcactcatcaacctggcggcagcgcaaaagatg

SEQ ID NO: 71669 - DNA, 103 bp, Artificial Sequence
  Synthetic Polynucleotide
taatacgactcactatagggttaatgacaagggaacactgtattgtattaaacagaggagataatacatgacagtgttcaacctggcggcagcgcaaaagatg

SEQ ID NO: 71670 - DNA, 103 bp, Artificial Sequence
  Synthetic Polynucleotide
taatacgactcactatagggttgagttttgttgaatcgatgagtgaagtaaacagaggagatacttcatgcatcgattcaacctggcggcagcgcaaaagatg

SEQ ID NO: 71671 - DNA, 103 bp, Artificial Sequence
  Synthetic Polynucleotide
taatacgactcactatagggacgatttgagttttgttgaatcgatgagtgaacagaggagacactcaatgattcaacaaaacctggcggcagcgcaaaagatg

SEQ ID NO: 71672 - DNA, 103 bp, Artificial Sequence
  Synthetic Polynucleotide
taatacgactcactataggggacacacgatttgagttttgttgaatcgataacagaggagaatcgatatgacaaaactcaacctggcggcagcgcaaaagatg

SEQ ID NO: 71673 - DNA, 103 bp, Artificial Sequence
  Synthetic Polynucleotide
taatacgactcactatagggattcagacacacgatttgagttttgttgaaaacagaggagattcaacatgactcaaatcaacctggcggcagcgcaaaagatg

SEQ ID NO: 71674 - DNA, 103 bp, Artificial Sequence
  Synthetic Polynucleotide
taatacgactcactatagggtatttattcagacacacgatttgagttttgaacagaggagacaaaacatgaatcgtgtgaacctggcggcagcgcaaaagatg

SEQ ID NO: 71675 - DNA, 103 bp, Artificial Sequence
  Synthetic Polynucleotide
taatacgactcactatagggagagttatttattcagacacacgatttgagaacagaggagactcaaaatgtgtgtctgaaacctggcggcagcgcaaaagatg

SEQ ID NO: 71676 - DNA, 103 bp, Artificial Sequence
  Synthetic Polynucleotide
taatacgactcactatagggtgaatagagttatttattcagacacacgataacagaggagaatcgtgatgctgaataaaaacctggcggcagcgcaaaagatg

SEQ ID NO: 71677 - DNA, 103 bp, Artificial Sequence
  Synthetic Polynucleotide
taatacgactcactatagggtcggatgaatagagttatttattcagacacaacagaggagagtgtctatgtaaataactaacctggcggcagcgcaaaagatg

SEQ ID NO: 71678 - DNA, 103 bp, Artificial Sequence
  Synthetic Polynucleotide
taatacgactcactataggggaatctcggatgaatagagttatttattcaaacagaggagatgaataatgaactctattaacctggcggcagcgcaaaagatg

SEQ ID NO: 71679 - DNA, 103 bp, Artificial Sequence
  Synthetic Polynucleotide
taatacgactcactatagggtacccgaatctcggatgaatagagttatttaacagaggagaaaataaatgtattcatccaacctggcggcagcgcaaaagatg

SEQ ID NO: 71680 - DNA, 103 bp, Artificial Sequence
  Synthetic Polynucleotide
taatacgactcactatagggtattggcgaatgatctaattatcatagcagaacagaggagactgctaatgtaattagataacctggcggcagcgcaaaagatg

SEQ ID NO: 71681 - DNA, 103 bp, Artificial Sequence
  Synthetic Polynucleotide
taatacgactcactatagggacaatttaatgacaagggaacactgtattgaacagaggagacaatacatggttcccttgaacctggcggcagcgcaaaagatg

SEQ ID NO: 71682 - DNA, 103 bp, Artificial Sequence
  Synthetic Polynucleotide
taatacgactcactatagggctacttacccgaatctcggatgaatagagtaacagaggagaactctaatgatccgagataacctggcggcagcgcaaaagatg

SEQ ID NO: 71683 - DNA, 103 bp, Artificial Sequence
  Synthetic Polynucleotide
taatacgactcactatagggtaaccctacttacccgaatctcggatgaataacagaggagaattcatatgagattcgggaacctggcggcagcgcaaaagatg

SEQ ID NO: 71684 - DNA, 103 bp, Artificial Sequence
  Synthetic Polynucleotide
taatacgactcactatagggtcgattaaccctacttacccgaatctcggaaacagaggagatccgagatgcgggtaagtaacctggcggcagcgcaaaagatg

SEQ ID NO: 71685 - DNA, 103 bp, Artificial Sequence
  Synthetic Polynucleotide
taatacgactcactatagggatcgttcgattaaccctacttacccgaatcaacagaggagagattcgatgaagtagggtaacctggcggcagcgcaaaagatg

SEQ ID NO: 71686 - DNA, 103 bp, Artificial Sequence
  Synthetic Polynucleotide
taatacgactcactatagggactaaatcgttcgattaaccctacttacccaacagaggagagggtaaatggggttaatcaacctggcggcagcgcaaaagatg

SEQ ID NO: 71687 - DNA, 103 bp, Artificial Sequence
  Synthetic Polynucleotide
taatacgactcactataggggtgtgactaaatcgttcgattaaccctactaacagaggagaagtaggatgaatcgaacgaacctggcggcagcgcaaaagatg

SEQ ID NO: 71688 - DNA, 103 bp, Artificial Sequence
  Synthetic Polynucleotide
taatacgactcactatagggtcgtagtgtgactaaatcgttcgattaaccaacagaggagaggttaaatgaacgatttaaacctggcggcagcgcaaaagatg

SEQ ID NO: 71689 - DNA, 103 bp, Artificial Sequence
  Synthetic Polynucleotide
taatacgactcactatagggttaattcgtagtgtgactaaatcgttcgataacagaggagaatcgaaatgtttagtcacaacctggcggcagcgcaaaagatg

SEQ ID NO: 71690 - DNA, 103 bp, Artificial Sequence
  Synthetic Polynucleotide
taatacgactcactatagggcttttttaattcgtagtgtgactaaatcgtaacagaggagaacgattatgtcacactacaacctggcggcagcgcaaaagatg

SEQ ID NO: 71691 - DNA, 103 bp, Artificial Sequence
  Synthetic Polynucleotide
taatacgactcactataggggtacacttttttaattcgtagtgtgactaaaacagaggagattagtcatgctacgaattaacctggcggcagcgcaaaagatg

SEQ ID NO: 71692 - DNA, 103 bp, Artificial Sequence
  Synthetic Polynucleotide
taatacgactcactataggggattcacaatttaatgacaagggaacactgaacagaggagacagtgtatgcttgtcattaacctggcggcagcgcaaaagatg

SEQ ID NO: 71693 - DNA, 103 bp, Artificial Sequence
  Synthetic Polynucleotide
taatacgactcactataggggtcaggtacacttttttaattcgtagtgtgaacagaggagacacactatgaattaaaaaaacctggcggcagcgcaaaagatg

SEQ ID NO: 71694 - DNA, 103 bp, Artificial Sequence
  Synthetic Polynucleotide
taatacgactcactatagggatagtgtcaggtacacttttttaattcgtaaacagaggagatacgaaatgaaaaagtgtaacctggcggcagcgcaaaagatg

SEQ ID NO: 71695 - DNA, 103 bp, Artificial Sequence
  Synthetic Polynucleotide
taatacgactcactatagggggagtatagtgtcaggtacacttttttaataacagaggagaattaaaatggtgtacctgaacctggcggcagcgcaaaagatg

SEQ ID NO: 71696 - DNA, 103 bp, Artificial Sequence
  Synthetic Polynucleotide
taatacgactcactatagggaaaccggagtatagtgtcaggtacacttttaacagaggagaaaaagtatgcctgacactaacctggcggcagcgcaaaagatg

SEQ ID NO: 71697 - DNA, 103 bp, Artificial Sequence
  Synthetic Polynucleotide
taatacgactcactatagggtttgtaaaccggagtatagtgtcaggtacaaacagaggagatgtaccatgcactatactaacctggcggcagcgcaaaagatg

SEQ ID NO: 71698 - DNA, 103 bp, Artificial Sequence
  Synthetic Polynucleotide
taatacgactcactatagggtttgttttgtaaaccggagtatagtgtcagaacagaggagactgacaatgtactccggtaacctggcggcagcgcaaaagatg

SEQ ID NO: 71699 - DNA, 103 bp, Artificial Sequence
  Synthetic Polynucleotide
taatacgactcactatagggacatttttgttttgtaaaccggagtatagtaacagaggagaactataatgcggtttacaaacctggcggcagcgcaaaagatg

SEQ ID NO: 71700 - DNA, 103 bp, Artificial Sequence
  Synthetic Polynucleotide
taatacgactcactatagggtaagaacatttttgttttgtaaaccggagtaacagaggagaactccgatgtacaaaacaaacctggcggcagcgcaaaagatg

SEQ ID NO: 71701 - DNA, 103 bp, Artificial Sequence
  Synthetic Polynucleotide
taatacgactcactataggggtagttaagaacatttttgttttgtaaaccaacagaggagaggtttaatgaacaaaaataacctggcggcagcgcaaaagatg

SEQ ID NO: 71702 - DNA, 103 bp, Artificial Sequence
  Synthetic Polynucleotide
taatacgactcactatagggttaatgtagttaagaacatttttgttttgtaacagaggagaacaaaaatgaaatgttctaacctggcggcagcgcaaaagatg

SEQ ID NO: 71703 - DNA, 103 bp, Artificial Sequence
  Synthetic Polynucleotide
taatacgactcactatagggtggatgattcacaatttaatgacaagggaaaacagaggagattccctatgcattaaattaacctggcggcagcgcaaaagatg

SEQ ID NO: 71704 - DNA, 103 bp, Artificial Sequence
  Synthetic Polynucleotide
taatacgactcactatagggttttgttaatgtagttaagaacatttttgtaacagaggagaacaaaaatgttcttaactaacctggcggcagcgcaaaagatg

SEQ ID NO: 71705 - DNA, 103 bp, Artificial Sequence
  Synthetic Polynucleotide
taatacgactcactatagggtaactttttgttaatgtagttaagaacattaacagaggagaaatgttatgaactacattaacctggcggcagcgcaaaagatg

SEQ ID NO: 71706 - DNA, 103 bp, Artificial Sequence
  Synthetic Polynucleotide
taatacgactcactatagggagagataactttttgttaatgtagttaagaaacagaggagatcttaaatgcattaacaaaacctggcggcagcgcaaaagatg

SEQ ID NO: 71707 - DNA, 103 bp, Artificial Sequence
  Synthetic Polynucleotide
taatacgactcactatagggtcgcgagagataactttttgttaatgtagtaacagaggagaactacaatgacaaaaagtaacctggcggcagcgcaaaagatg

SEQ ID NO: 71708 - DNA, 103 bp, Artificial Sequence
  Synthetic Polynucleotide
taatacgactcactatagggagaagtcgcgagagataactttttgttaataacagaggagaattaacatgaagttatctaacctggcggcagcgcaaaagatg

SEQ ID NO: 71709 - DNA, 103 bp, Artificial Sequence
  Synthetic Polynucleotide
taatacgactcactatagggaaagaagaagtcgcgagagataactttttgaacagaggagacaaaaaatgatctctcgcaacctggcggcagcgcaaaagatg

SEQ ID NO: 71710 - DNA, 103 bp, Artificial Sequence
  Synthetic Polynucleotide
taatacgactcactatagggcagaaaaagaagaagtcgcgagagataactaacagaggagaagttatatgtcgcgacttaacctggcggcagcgcaaaagatg

SEQ ID NO: 71711 - DNA, 103 bp, Artificial Sequence
  Synthetic Polynucleotide
taatacgactcactatagggtgagacagaaaaagaagaagtcgcgagagaaacagaggagatctctcatgacttcttctaacctggcggcagcgcaaaagatg

SEQ ID NO: 71712 - DNA, 103 bp, Artificial Sequence
  Synthetic Polynucleotide
taatacgactcactatagggactactgagacagaaaaagaagaagtcgcgaacagaggagacgcgacatgttctttttcaacctggcggcagcgcaaaagatg

SEQ ID NO: 71713 - DNA, 103 bp, Artificial Sequence
  Synthetic Polynucleotide
taatacgactcactatagggtacacactactgagacagaaaaagaagaagaacagaggagacttcttatgtttctgtctaacctggcggcagcgcaaaagatg

SEQ ID NO: 71714 - DNA, 103 bp, Artificial Sequence
  Synthetic Polynucleotide
taatacgactcactatagggtggactggatgattcacaatttaatgacaaaacagaggagattgtcaatgaattgtgaaaacctggcggcagcgcaaaagatg

SEQ ID NO: 71715 - DNA, 103 bp, Artificial Sequence
  Synthetic Polynucleotide
taatacgactcactatagggtatcgtacacactactgagacagaaaaagaaacagaggagatcttttatggtctcagtaaacctggcggcagcgcaaaagatg

SEQ ID NO: 71716 - DNA, 103 bp, Artificial Sequence
  Synthetic Polynucleotide
taatacgactcactataggggatcatatcgtacacactactgagacagaaaacagaggagattctgtatgagtagtgtgaacctggcggcagcgcaaaagatg

SEQ ID NO: 71717 - DNA, 103 bp, Artificial Sequence
  Synthetic Polynucleotide
taatacgactcactatagggacagtgatcatatcgtacacactactgagaaacagaggagatctcagatgtgtgtacgaaacctggcggcagcgcaaaagatg

SEQ ID NO: 71718 - DNA, 103 bp, Artificial Sequence
  Synthetic Polynucleotide
taatacgactcactatagggtatgaacagtgatcatatcgtacacactacaacagaggagagtagtgatgacgatatgaaacctggcggcagcgcaaaagatg

SEQ ID NO: 71719 - DNA, 103 bp, Artificial Sequence
  Synthetic Polynucleotide
taatacgactcactatagggaggaatatgaacagtgatcatatcgtacacaacagaggagagtgtacatgatgatcactaacctggcggcagcgcaaaagatg

SEQ ID NO: 71720 - DNA, 103 bp, Artificial Sequence
  Synthetic Polynucleotide
taatacgactcactatagggagaataggaatatgaacagtgatcatatcgaacagaggagacgatatatgcactgttcaaacctggcggcagcgcaaaagatg

SEQ ID NO: 71721 - DNA, 103 bp, Artificial Sequence
  Synthetic Polynucleotide
taatacgactcactatagggaagagagaataggaatatgaacagtgatcaaacagaggagatgatcaatgttcatattcaacctggcggcagcgcaaaagatg

SEQ ID NO: 71722 - DNA, 103 bp, Artificial Sequence
  Synthetic Polynucleotide
taatacgactcactatagggcatcgaagagagaataggaatatgaacagtaacagaggagaactgttatgattcctattaacctggcggcagcgcaaaagatg

SEQ ID NO: 71723 - DNA, 103 bp, Artificial Sequence
  Synthetic Polynucleotide
taatacgactcactataggggagaccatcgaagagagaataggaatatgaaacagaggagatcatatatgtattctctcaacctggcggcagcgcaaaagatg

SEQ ID NO: 71724 - DNA, 103 bp, Artificial Sequence
  Synthetic Polynucleotide
taatacgactcactatagggtttgtgagaccatcgaagagagaataggaaaacagaggagattcctaatgtctcttcgaaacctggcggcagcgcaaaagatg

SEQ ID NO: 71725 - DNA, 103 bp, Artificial Sequence
  Synthetic Polynucleotide
taatacgactcactatagggttcagtggactggatgattcacaatttaataacagaggagaattaaaatgtgaatcatcaacctggcggcagcgcaaaagatg

SEQ ID NO: 71726 - DNA, 103 bp, Artificial Sequence
  Synthetic Polynucleotide
taatacgactcactatagggacttttttgtgagaccatcgaagagagaataacagaggagaattctcatgtcgatggtcaacctggcggcagcgcaaaagatg

SEQ ID NO: 71727 - DNA, 103 bp, Artificial Sequence
  Synthetic Polynucleotide
taatacgactcactataggggtaaaacttttttgtgagaccatcgaagagaacagaggagactcttcatgggtctcacaaacctggcggcagcgcaaaagatg

SEQ ID NO: 71728 - DNA, 103 bp, Artificial Sequence
  Synthetic Polynucleotide
taatacgactcactatagggtttttgtaaaacttttttgtgagaccatcgaacagaggagacgatggatgcacaaaaaaaacctggcggcagcgcaaaagatg

SEQ ID NO: 71729 - DNA, 103 bp, Artificial Sequence
  Synthetic Polynucleotide
taatacgactcactatagggaaatatttttgtaaaacttttttgtgagacaacagaggagagtctcaatgaaaagttttaacctggcggcagcgcaaaagatg

SEQ ID NO: 71730 - DNA, 103 bp, Artificial Sequence
  Synthetic Polynucleotide
taatacgactcactatagggaataaaaatatttttgtaaaacttttttgtaacagaggagaacaaaaatgttttacaaaaacctggcggcagcgcaaaagatg

SEQ ID NO: 71731 - DNA, 103 bp, Artificial Sequence
  Synthetic Polynucleotide
taatacgactcactatagggaagagaataaaaatatttttgtaaaactttaacagaggagaaaagttatgcaaaaatataacctggcggcagcgcaaaagatg

SEQ ID NO: 71732 - DNA, 103 bp, Artificial Sequence
  Synthetic Polynucleotide
taatacgactcactatagggagagaaagagaataaaaatatttttgtaaaaacagaggagatttacaatgatatttttaaacctggcggcagcgcaaaagatg

SEQ ID NO: 71733 - DNA, 103 bp, Artificial Sequence
  Synthetic Polynucleotide
taatacgactcactatagggcgaagagagaaagagaataaaaatatttttaacagaggagaaaaaatatgtttattctcaacctggcggcagcgcaaaagatg

SEQ ID NO: 71734 - DNA, 103 bp, Artificial Sequence
  Synthetic Polynucleotide
taatacgactcactatagggaccatcgaagagagaaagagaataaaaataaacagaggagatattttatgtctctttctaacctggcggcagcgcaaaagatg

SEQ ID NO: 71735 - DNA, 103 bp, Artificial Sequence
  Synthetic Polynucleotide
taatacgactcactataggggtgagaccatcgaagagagaaagagaataaaacagaggagattattcatgttctctcttaacctggcggcagcgcaaaagatg

SEQ ID NO: 71736 - DNA, 103 bp, Artificial Sequence
  Synthetic Polynucleotide
taatacgactcactatagggtgctattcagtggactggatgattcacaataacagaggagaattgtgatgcatccagtcaacctggcggcagcgcaaaagatg

SEQ ID NO: 71737 - DNA, 103 bp, Artificial Sequence
  Synthetic Polynucleotide
taatacgactcactatagggtttttgtgagaccatcgaagagagaaagagaacagaggagactctttatgtcttcgatgaacctggcggcagcgcaaaagatg

SEQ ID NO: 71738 - DNA, 103 bp, Artificial Sequence
  Synthetic Polynucleotide
taatacgactcactatagggaatattttttgtgagaccatcgaagagagaaacagaggagatctctcatggatggtctcaacctggcggcagcgcaaaagatg

SEQ ID NO: 71739 - DNA, 103 bp, Artificial Sequence
  Synthetic Polynucleotide
taatacgactcactatagggggtttaatattttttgtgagaccatcgaagaacagaggagacttcgaatgtctcacaaaaacctggcggcagcgcaaaagatg

SEQ ID NO: 71740 - DNA, 103 bp, Artificial Sequence
  Synthetic Polynucleotide
taatacgactcactatagggaaagaggtttaatattttttgtgagaccataacagaggagaatggtcatgcaaaaaataaacctggcggcagcgcaaaagatg

SEQ ID NO: 71741 - DNA, 103 bp, Artificial Sequence
  Synthetic Polynucleotide
taatacgactcactatagggatcagaaagaggtttaatattttttgtgagaacagaggagactcacaatgaatattaaaaacctggcggcagcgcaaaagatg

SEQ ID NO: 71742 - DNA, 103 bp, Artificial Sequence
  Synthetic Polynucleotide
taatacgactcactatagggactccatcagaaagaggtttaatattttttaacagaggagaaaaaaaatgtaaacctctaacctggcggcagcgcaaaagatg

SEQ ID NO: 71743 - DNA, 103 bp, Artificial Sequence
  Synthetic Polynucleotide
taatacgactcactatagggttacgactccatcagaaagaggtttaatataacagaggagaatattaatgctctttctgaacctggcggcagcgcaaaagatg

SEQ ID NO: 71744 - DNA, 103 bp, Artificial Sequence
  Synthetic Polynucleotide
taatacgactcactatagggactttttacgactccatcagaaagaggtttaacagaggagaaaacctatgtctgatggaaacctggcggcagcgcaaaagatg

SEQ ID NO: 71745 - DNA, 103 bp, Artificial Sequence
  Synthetic Polynucleotide
taatacgactcactatagggataaaactttttacgactccatcagaaagaaacagaggagatctttcatgtggagtcgtaacctggcggcagcgcaaaagatg

SEQ ID NO: 71746 - DNA, 103 bp, Artificial Sequence
  Synthetic Polynucleotide
taatacgactcactatagggaagagataaaactttttacgactccatcagaacagaggagactgatgatgtcgtaaaaaaacctggcggcagcgcaaaagatg

SEQ ID NO: 71747 - DNA, 103 bp, Artificial Sequence
  Synthetic Polynucleotide
taatacgactcactatagggaattttgctattcagtggactggatgattcaacagaggagagaatcaatgagtccactgaacctggcggcagcgcaaaagatg

SEQ ID NO: 71748 - DNA, 103 bp, Artificial Sequence
  Synthetic Polynucleotide
taatacgactcactatagggagagaaagagataaaactttttacgactccaacagaggagaggagtcatgaaaagttttaacctggcggcagcgcaaaagatg

SEQ ID NO: 71749 - DNA, 103 bp, Artificial Sequence
  Synthetic Polynucleotide
taatacgactcactatagggcgaagagagaaagagataaaactttttacgaacagaggagacgtaaaatgttttatctcaacctggcggcagcgcaaaagatg

SEQ ID NO: 71750 - DNA, 103 bp, Artificial Sequence
  Synthetic Polynucleotide
taatacgactcactatagggaccatcgaagagagaaagagataaaactttaacagaggagaaaagttatgtctctttctaacctggcggcagcgcaaaagatg

SEQ ID NO: 71751 - DNA, 103 bp, Artificial Sequence
  Synthetic Polynucleotide
taatacgactcactataggggtgagaccatcgaagagagaaagagataaaaacagaggagatttatcatgttctctcttaacctggcggcagcgcaaaagatg

SEQ ID NO: 71752 - DNA, 103 bp, Artificial Sequence; identical to SEQ ID NO: 71737
  Synthetic Polynucleotide

SEQ ID NO: 71753 - DNA, 103 bp, Artificial Sequence; identical to SEQ ID NO: 71738
  Synthetic Polynucleotide

SEQ ID NO: 71754 - DNA, 103 bp, Artificial Sequence; identical to SEQ ID NO: 71739
  Synthetic Polynucleotide

SEQ ID NO: 71755 - DNA, 103 bp, Artificial Sequence; identical to SEQ ID NO: 71740
  Synthetic Polynucleotide

SEQ ID NO: 71756 - DNA, 103 bp, Artificial Sequence; identical to SEQ ID NO: 71741
  Synthetic Polynucleotide

SEQ ID NO: 71757 - DNA, 103 bp, Artificial Sequence; identical to SEQ ID NO: 71742
  Synthetic Polynucleotide

SEQ ID NO: 71758 - DNA, 103 bp, Artificial Sequence
  Synthetic Polynucleotide
taatacgactcactataggggtaaaaattttgctattcagtggactggataacagaggagaatccagatgactgaatagaacctggcggcagcgcaaaagatg

SEQ ID NO: 71759 - DNA, 103 bp, Artificial Sequence; identical to SEQ ID NO: 71743
  Synthetic Polynucleotide

SEQ ID NO: 71760 - DNA, 103 bp, Artificial Sequence; identical to SEQ ID NO: 71744
  Synthetic Polynucleotide

SEQ ID NO: 71761 - DNA, 103 bp, Artificial Sequence; identical to SEQ ID NO: 71745
  Synthetic Polynucleotide

SEQ ID NO: 71762 - DNA, 103 bp, Artificial Sequence; identical to SEQ ID NO: 71746
  Synthetic Polynucleotide

SEQ ID NO: 71763 - DNA, 103 bp, Artificial Sequence; identical to SEQ ID NO: 71748
  Synthetic Polynucleotide

SEQ ID NO: 71764 - DNA, 103 bp, Artificial Sequence; identical to SEQ ID NO: 71749
  Synthetic Polynucleotide

SEQ ID NO: 71765 - DNA, 103 bp, Artificial Sequence; identical to SEQ ID NO: 71750
  Synthetic Polynucleotide

SEQ ID NO: 71766 - DNA, 103 bp, Artificial Sequence; identical to SEQ ID NO: 71751
  Synthetic Polynucleotide

SEQ ID NO: 71767 - DNA, 103 bp, Artificial Sequence; identical to SEQ ID NO: 71737
  Synthetic Polynucleotide

SEQ ID NO: 71768 - DNA, 103 bp, Artificial Sequence; identical to SEQ ID NO: 71738
  Synthetic Polynucleotide

SEQ ID NO: 71769 - DNA, 103 bp, Artificial Sequence
  Synthetic Polynucleotide
taatacgactcactatagggaaatagtaaaaattttgctattcagtggacaacagaggagagtccacatgatagcaaaaaacctggcggcagcgcaaaagatg

SEQ ID NO: 71770 - DNA, 103 bp, Artificial Sequence; identical to SEQ ID NO: 71739
  Synthetic Polynucleotide

SEQ ID NO: 71771 - DNA, 103 bp, Artificial Sequence; identical to SEQ ID NO: 71740
  Synthetic Polynucleotide

SEQ ID NO: 71772 - DNA, 103 bp, Artificial Sequence; identical to SEQ ID NO: 71741
  Synthetic Polynucleotide

SEQ ID NO: 71773 - DNA, 103 bp, Artificial Sequence; identical to SEQ ID NO: 71742
  Synthetic Polynucleotide

SEQ ID NO: 71774 - DNA, 103 bp, Artificial Sequence; identical to SEQ ID NO: 71743
  Synthetic Polynucleotide

SEQ ID NO: 71775 - DNA, 103 bp, Artificial Sequence; identical to SEQ ID NO: 71744
  Synthetic Polynucleotide

SEQ ID NO: 71776 - DNA, 103 bp, Artificial Sequence; identical to SEQ ID NO: 71745
  Synthetic Polynucleotide

SEQ ID NO: 71777 - DNA, 103 bp, Artificial Sequence; identical to SEQ ID NO: 71746
  Synthetic Polynucleotide

SEQ ID NO: 71778 - DNA, 103 bp, Artificial Sequence; identical to SEQ ID NO: 71748
  Synthetic Polynucleotide

SEQ ID NO: 71779 - DNA, 103 bp, Artificial Sequence; identical to SEQ ID NO: 71749
  Synthetic Polynucleotide

SEQ ID NO: 71780 - DNA, 103 bp, Artificial Sequence
  Synthetic Polynucleotide
taatacgactcactatagggtaccaaaatagtaaaaattttgctattcagaacagaggagactgaatatgaaaatttttaacctggcggcagcgcaaaagatg

SEQ ID NO: 71781 - DNA, 103 bp, Artificial Sequence; identical to SEQ ID NO: 71750
  Synthetic Polynucleotide

SEQ ID NO: 71782 - DNA, 103 bp, Artificial Sequence; identical to SEQ ID NO: 71751
  Synthetic Polynucleotide

SEQ ID NO: 71783 - DNA, 103 bp, Artificial Sequence; identical to SEQ ID NO: 71737
  Synthetic Polynucleotide

SEQ ID NO: 71784 - DNA, 103 bp, Artificial Sequence; identical to SEQ ID NO: 71738
  Synthetic Polynucleotide

SEQ ID NO: 71785 - DNA, 103 bp, Artificial Sequence; identical to SEQ ID NO: 71739
  Synthetic Polynucleotide

SEQ ID NO: 71786 - DNA, 103 bp, Artificial Sequence; identical to SEQ ID NO: 71740
  Synthetic Polynucleotide

SEQ ID NO: 71787 - DNA, 103 bp, Artificial Sequence; identical to SEQ ID NO: 71741
  Synthetic Polynucleotide

SEQ ID NO: 71788 - DNA, 103 bp, Artificial Sequence; identical to SEQ ID NO: 71742
  Synthetic Polynucleotide

SEQ ID NO: 71789 - DNA, 103 bp, Artificial Sequence; identical to SEQ ID NO: 71743
  Synthetic Polynucleotide

SEQ ID NO: 71790 - DNA, 103 bp, Artificial Sequence; identical to SEQ ID NO: 71744
  Synthetic Polynucleotide

SEQ ID NO: 71791 - DNA, 103 bp, Artificial Sequence
  Synthetic Polynucleotide
taatacgactcactatagggagattgcacatgtattctatgtcgtctactaacagaggagaagtagaatgcatagaataaacctggcggcagcgcaaaagatg

SEQ ID NO: 71792 - DNA, 103 bp, Artificial Sequence
  Synthetic Polynucleotide
taatacgactcactatagggaccactattggcgaatgatctaattatcataacagaggagaatgataatgagatcattcaacctggcggcagcgcaaaagatg

SEQ ID NO: 71793 - DNA, 103 bp, Artificial Sequence
  Synthetic Polynucleotide
taatacgactcactataggggaagataccaaaatagtaaaaattttgctaaacagaggagatagcaaatgttttactataacctggcggcagcgcaaaagatg

SEQ ID NO: 71794 - DNA, 103 bp, Artificial Sequence; identical to SEQ ID NO: 71745
  Synthetic Polynucleotide

SEQ ID NO: 71795 - DNA, 103 bp, Artificial Sequence; identical to SEQ ID NO: 71746
  Synthetic Polynucleotide

SEQ ID NO: 71796 - DNA, 103 bp, Artificial Sequence; identical to SEQ ID NO: 71748
  Synthetic Polynucleotide

SEQ ID NO: 71797 - DNA, 103 bp, Artificial Sequence; identical to SEQ ID NO: 71749
  Synthetic Polynucleotide

SEQ ID NO: 71798 - DNA, 103 bp, Artificial Sequence; identical to SEQ ID NO: 71750
  Synthetic Polynucleotide

SEQ ID NO: 71799 - DNA, 103 bp, Artificial Sequence; identical to SEQ ID NO: 71751
  Synthetic Polynucleotide

SEQ ID NO: 71800 - DNA, 103 bp, Artificial Sequence; identical to SEQ ID NO: 71737
  Synthetic Polynucleotide

SEQ ID NO: 71801 - DNA, 103 bp, Artificial Sequence; identical to SEQ ID NO: 71738
  Synthetic Polynucleotide

SEQ ID NO: 71802 - DNA, 103 bp, Artificial Sequence; identical to SEQ ID NO: 71739
  Synthetic Polynucleotide

SEQ ID NO: 71803 - DNA, 103 bp, Artificial Sequence; identical to SEQ ID NO: 71740
  Synthetic Polynucleotide

SEQ ID NO: 71804 - DNA, 103 bp, Artificial Sequence
  Synthetic Polynucleotide
taatacgactcactatagggcattggaagataccaaaatagtaaaaatttaacagaggagaaaatttatgctattttggaacctggcggcagcgcaaaagatg

SEQ ID NO: 71805 - DNA, 103 bp, Artificial Sequence; identical to SEQ ID NO: 71741
  Synthetic Polynucleotide

SEQ ID NO: 71806 - DNA, 103 bp, Artificial Sequence; identical to SEQ ID NO: 71742
  Synthetic Polynucleotide

SEQ ID NO: 71807 - DNA, 103 bp, Artificial Sequence; identical to SEQ ID NO: 71743
  Synthetic Polynucleotide

SEQ ID NO: 71808 - DNA, 103 bp, Artificial Sequence; identical to SEQ ID NO: 71744
  Synthetic Polynucleotide

SEQ ID NO: 71809 - DNA, 103 bp, Artificial Sequence; identical to SEQ ID NO: 71745
  Synthetic Polynucleotide

SEQ ID NO: 71810 - DNA, 103 bp, Artificial Sequence; identical to SEQ ID NO: 71746
  Synthetic Polynucleotide

SEQ ID NO: 71811 - DNA, 103 bp, Artificial Sequence; identical to SEQ ID NO: 71748
  Synthetic Polynucleotide

SEQ ID NO: 71812 - DNA, 103 bp, Artificial Sequence; identical to SEQ ID NO: 71749
  Synthetic Polynucleotide

SEQ ID NO: 71813 - DNA, 103 bp, Artificial Sequence; identical to SEQ ID NO: 71750
  Synthetic Polynucleotide

SEQ ID NO: 71814 - DNA, 103 bp, Artificial Sequence; identical to SEQ ID NO: 71751
  Synthetic Polynucleotide

SEQ ID NO: 71815 - DNA, 103 bp, Artificial Sequence
  Synthetic Polynucleotide
taatacgactcactatagggagccacattggaagataccaaaatagtaaaaacagaggagatttactatgttggtatctaacctggcggcagcgcaaaagatg

SEQ ID NO: 71816 - DNA, 103 bp, Artificial Sequence; identical to SEQ ID NO: 71737
  Synthetic Polynucleotide

SEQ ID NO: 71817 - DNA, 103 bp, Artificial Sequence; identical to SEQ ID NO: 71738
  Synthetic Polynucleotide

SEQ ID NO: 71818 - DNA, 103 bp, Artificial Sequence; identical to SEQ ID NO: 71739
  Synthetic Polynucleotide

SEQ ID NO: 71819 - DNA, 103 bp, Artificial Sequence; identical to SEQ ID NO: 71740
  Synthetic Polynucleotide

SEQ ID NO: 71820 - DNA, 103 bp, Artificial Sequence; identical to SEQ ID NO: 71741
  Synthetic Polynucleotide

SEQ ID NO: 71821 - DNA, 103 bp, Artificial Sequence; identical to SEQ ID NO: 71742
  Synthetic Polynucleotide

SEQ ID NO: 71822 - DNA, 103 bp, Artificial Sequence; identical to SEQ ID NO: 71743
  Synthetic Polynucleotide

SEQ ID NO: 71823 - DNA, 103 bp, Artificial Sequence; identical to SEQ ID NO: 71744
  Synthetic Polynucleotide

SEQ ID NO: 71824 - DNA, 103 bp, Artificial Sequence; identical to SEQ ID NO: 71745
  Synthetic Polynucleotide

SEQ ID NO: 71825 - DNA, 103 bp, Artificial Sequence; identical to SEQ ID NO: 71746
  Synthetic Polynucleotide

SEQ ID NO: 71826 - DNA, 103 bp, Artificial Sequence
  Synthetic Polynucleotide
taatacgactcactatagggtaggcagccacattggaagataccaaaataaacagaggagatattttatgatcttccaaaacctggcggcagcgcaaaagatg

SEQ ID NO: 71827 - DNA, 103 bp, Artificial Sequence; identical to SEQ ID NO: 71748
  Synthetic Polynucleotide

SEQ ID NO: 71828 - DNA, 103 bp, Artificial Sequence; identical to SEQ ID NO: 71749
  Synthetic Polynucleotide

SEQ ID NO: 71829 - DNA, 103 bp, Artificial Sequence; identical to SEQ ID NO: 71750
  Synthetic Polynucleotide

SEQ ID NO: 71830 - DNA, 103 bp, Artificial Sequence; identical to SEQ ID NO: 71751
  Synthetic Polynucleotide

SEQ ID NO: 71831 - DNA, 103 bp, Artificial Sequence; identical to SEQ ID NO: 71737
  Synthetic Polynucleotide

SEQ ID NO: 71832 - DNA, 103 bp, Artificial Sequence; identical to SEQ ID NO: 71738
  Synthetic Polynucleotide

SEQ ID NO: 71833 - DNA, 103 bp, Artificial Sequence; identical to SEQ ID NO: 71739
  Synthetic Polynucleotide

SEQ ID NO: 71834 - DNA, 103 bp, Artificial Sequence; identical to SEQ ID NO: 71740
  Synthetic Polynucleotide

SEQ ID NO: 71835 - DNA, 103 bp, Artificial Sequence; identical to SEQ ID NO: 71741
  Synthetic Polynucleotide

SEQ ID NO: 71836 - DNA, 103 bp, Artificial Sequence; identical to SEQ ID NO: 71742
  Synthetic Polynucleotide

SEQ ID NO: 71837 - DNA, 103 bp, Artificial Sequence
  Synthetic Polynucleotide
taatacgactcactatagggtacattaggcagccacattggaagataccaaacagaggagatggtatatgccaatgtggaacctggcggcagcgcaaaagatg

SEQ ID NO: 71838 - DNA, 103 bp, Artificial Sequence; identical to SEQ ID NO: 71743
  Synthetic Polynucleotide

SEQ ID NO: 71839 - DNA, 103 bp, Artificial Sequence; identical to SEQ ID NO: 71744
  Synthetic Polynucleotide

SEQ ID NO: 71840 - DNA, 103 bp, Artificial Sequence; identical to SEQ ID NO: 71745
  Synthetic Polynucleotide

SEQ ID NO: 71841 - DNA, 103 bp, Artificial Sequence; identical to SEQ ID NO: 71746
  Synthetic Polynucleotide

SEQ ID NO: 71842 - DNA, 103 bp, Artificial Sequence; identical to SEQ ID NO: 71748
  Synthetic Polynucleotide

SEQ ID NO: 71843 - DNA, 103 bp, Artificial Sequence; identical to SEQ ID NO: 71749
  Synthetic Polynucleotide

SEQ ID NO: 71844 - DNA, 103 bp, Artificial Sequence; identical to SEQ ID NO: 71750
  Synthetic Polynucleotide

SEQ ID NO: 71845 - DNA, 103 bp, Artificial Sequence; identical to SEQ ID NO: 71751
  Synthetic Polynucleotide

SEQ ID NO: 71846 - DNA, 103 bp, Artificial Sequence; identical to SEQ ID NO: 71737
  Synthetic Polynucleotide

SEQ ID NO: 71847 - DNA, 103 bp, Artificial Sequence; identical to SEQ ID NO: 71738
  Synthetic Polynucleotide

SEQ ID NO: 71848 - DNA, 103 bp, Artificial Sequence
  Synthetic Polynucleotide
taatacgactcactatagggtccattacattaggcagccacattggaagaaacagaggagatcttccatggtggctgccaacctggcggcagcgcaaaagatg

SEQ ID NO: 71849 - DNA, 103 bp, Artificial Sequence; identical to SEQ ID NO: 71739
  Synthetic Polynucleotide

SEQ ID NO: 71850 - DNA, 103 bp, Artificial Sequence; identical to SEQ ID NO: 71740
  Synthetic Polynucleotide

SEQ ID NO: 71851 - DNA, 103 bp, Artificial Sequence; identical to SEQ ID NO: 71741
  Synthetic Polynucleotide

SEQ ID NO: 71852 - DNA, 103 bp, Artificial Sequence; identical to SEQ ID NO: 71742
  Synthetic Polynucleotide

SEQ ID NO: 71853 - DNA, 103 bp, Artificial Sequence; identical to SEQ ID NO: 71743
  Synthetic Polynucleotide

SEQ ID NO: 71854 - DNA, 103 bp, Artificial Sequence; identical to SEQ ID NO: 71744
  Synthetic Polynucleotide

SEQ ID NO: 71855 - DNA, 103 bp, Artificial Sequence; identical to SEQ ID NO: 71745
  Synthetic Polynucleotide

SEQ ID NO: 71856 - DNA, 103 bp, Artificial Sequence; identical to SEQ ID NO: 71746
  Synthetic Polynucleotide

SEQ ID NO: 71857 - DNA, 103 bp, Artificial Sequence; identical to SEQ ID NO: 71748
  Synthetic Polynucleotide

SEQ ID NO: 71858 - DNA, 103 bp, Artificial Sequence; identical to SEQ ID NO: 71749
  Synthetic Polynucleotide

SEQ ID NO: 71859 - DNA, 103 bp, Artificial Sequence
  Synthetic Polynucleotide
taatacgactcactataggggaatttccattacattaggcagccacattgaacagaggagacaatgtatgtgcctaatgaacctggcggcagcgcaaaagatg

SEQ ID NO: 71860 - DNA, 103 bp, Artificial Sequence; identical to SEQ ID NO: 71750
  Synthetic Polynucleotide

SEQ ID NO: 71861 - DNA, 103 bp, Artificial Sequence; identical to SEQ ID NO: 71751
  Synthetic Polynucleotide

SEQ ID NO: 71862 - DNA, 103 bp, Artificial Sequence; identical to SEQ ID NO: 71737
  Synthetic Polynucleotide

SEQ ID NO: 71863 - DNA, 103 bp, Artificial Sequence; identical to SEQ ID NO: 71738
  Synthetic Polynucleotide

SEQ ID NO: 71864 - DNA, 103 bp, Artificial Sequence; identical to SEQ ID NO: 71739
  Synthetic Polynucleotide

SEQ ID NO: 71865 - DNA, 103 bp, Artificial Sequence; identical to SEQ ID NO: 71740
  Synthetic Polynucleotide

SEQ ID NO: 71866 - DNA, 103 bp, Artificial Sequence; identical to SEQ ID NO: 71741
  Synthetic Polynucleotide

SEQ ID NO: 71867 - DNA, 103 bp, Artificial Sequence; identical to SEQ ID NO: 71742
  Synthetic Polynucleotide

SEQ ID NO: 71868 - DNA, 103 bp, Artificial Sequence; identical to SEQ ID NO: 71743
  Synthetic Polynucleotide

SEQ ID NO: 71869 - DNA, 103 bp, Artificial Sequence; identical to SEQ ID NO: 71744
  Synthetic Polynucleotide

SEQ ID NO: 71870 - DNA, 103 bp, Artificial Sequence
  Synthetic Polynucleotide
taatacgactcactatagggagaatgaatttccattacattaggcagccaaacagaggagatggctgatgaatgtaatgaacctggcggcagcgcaaaagatg

SEQ ID NO: 71871 - DNA, 103 bp, Artificial Sequence; identical to SEQ ID NO: 71745
  Synthetic Polynucleotide

SEQ ID NO: 71872 - DNA, 103 bp, Artificial Sequence; identical to SEQ ID NO: 71746
  Synthetic Polynucleotide

SEQ ID NO: 71873 - DNA, 103 bp, Artificial Sequence; identical to SEQ ID NO: 71748
  Synthetic Polynucleotide

SEQ ID NO: 71874 - DNA, 103 bp, Artificial Sequence; identical to SEQ ID NO: 71749
  Synthetic Polynucleotide

SEQ ID NO: 71875 - DNA, 103 bp, Artificial Sequence; identical to SEQ ID NO: 71750
  Synthetic Polynucleotide

SEQ ID NO: 71876 - DNA, 103 bp, Artificial Sequence; identical to SEQ ID NO: 71751
  Synthetic Polynucleotide

SEQ ID NO: 71877 - DNA, 103 bp, Artificial Sequence; identical to SEQ ID NO: 71737
  Synthetic Polynucleotide

SEQ ID NO: 71878 - DNA, 103 bp, Artificial Sequence; identical to SEQ ID NO: 71738
  Synthetic Polynucleotide

SEQ ID NO: 71879 - DNA, 103 bp, Artificial Sequence; identical to SEQ ID NO: 71739
  Synthetic Polynucleotide

SEQ ID NO: 71880 - DNA, 103 bp, Artificial Sequence; identical to SEQ ID NO: 71740
  Synthetic Polynucleotide

SEQ ID NO: 71881 - DNA, 103 bp, Artificial Sequence
  Synthetic Polynucleotide
taatacgactcactatagggtctagagaatgaatttccattacattaggcaacagaggagagcctaaatgaatggaaataacctggcggcagcgcaaaagatg

SEQ ID NO: 71882 - DNA, 103 bp, Artificial Sequence; identical to SEQ ID NO: 71741
  Synthetic Polynucleotide

SEQ ID NO: 71883 - DNA, 103 bp, Artificial Sequence; identical to SEQ ID NO: 71742
  Synthetic Polynucleotide

SEQ ID NO: 71884 - DNA, 103 bp, Artificial Sequence; identical to SEQ ID NO: 71743
  Synthetic Polynucleotide

SEQ ID NO: 71885 - DNA, 103 bp, Artificial Sequence; identical to SEQ ID NO: 71744
  Synthetic Polynucleotide

SEQ ID NO: 71886 - DNA, 103 bp, Artificial Sequence; identical to SEQ ID NO: 71745
  Synthetic Polynucleotide

SEQ ID NO: 71887 - DNA, 103 bp, Artificial Sequence; identical to SEQ ID NO: 71746
  Synthetic Polynucleotide

SEQ ID NO: 71888 - DNA, 103 bp, Artificial Sequence; identical to SEQ ID NO: 71748
  Synthetic Polynucleotide

SEQ ID NO: 71889 - DNA, 103 bp, Artificial Sequence; identical to SEQ ID NO: 71749
  Synthetic Polynucleotide

SEQ ID NO: 71890 - DNA, 103 bp, Artificial Sequence; identical to SEQ ID NO: 71750
  Synthetic Polynucleotide

SEQ ID NO: 71891 - DNA, 103 bp, Artificial Sequence; identical to SEQ ID NO: 71751
  Synthetic Polynucleotide

SEQ ID NO: 71892 - DNA, 103 bp, Artificial Sequence
  Synthetic Polynucleotide
taatacgactcactatagggaatcttctagagaatgaatttccattacataacagaggagaatgtaaatgaaattcattaacctggcggcagcgcaaaagatg

SEQ ID NO: 71893 - DNA, 103 bp, Artificial Sequence; identical to SEQ ID NO: 71737
  Synthetic Polynucleotide

SEQ ID NO: 71894 - DNA, 103 bp, Artificial Sequence; identical to SEQ ID NO: 71738
  Synthetic Polynucleotide

SEQ ID NO: 71895 - DNA, 103 bp, Artificial Sequence; identical to SEQ ID NO: 71739
  Synthetic Polynucleotide

SEQ ID NO: 71896 - DNA, 103 bp, Artificial Sequence; identical to SEQ ID NO: 71740
  Synthetic Polynucleotide

SEQ ID NO: 71897 - DNA, 103 bp, Artificial Sequence; identical to SEQ ID NO: 71741
  Synthetic Polynucleotide

SEQ ID NO: 71898 - DNA, 103 bp, Artificial Sequence; identical to SEQ ID NO: 71742
  Synthetic Polynucleotide

SEQ ID NO: 71899 - DNA, 103 bp, Artificial Sequence
  Synthetic Polynucleotide
taatacgactcactatagggtagtgactccatcagaaagaggtttaatataacagaggagaatattaatgctctttctgaacctggcggcagcgcaaaagatg

SEQ ID NO: 71900 - DNA, 103 bp, Artificial Sequence
  Synthetic Polynucleotide
taatacgactcactatagggtattttagtgactccatcagaaagaggtttaacagaggagaaaacctatgtctgatggaaacctggcggcagcgcaaaagatg

SEQ ID NO: 71901 - DNA, 103 bp, Artificial Sequence
  Synthetic Polynucleotide
taatacgactcactatagggaaaaatattttagtgactccatcagaaagaaacagaggagatctttcatgtggagtcacaacctggcggcagcgcaaaagatg

SEQ ID NO: 71902 - DNA, 103 bp, Artificial Sequence
  Synthetic Polynucleotide
taatacgactcactatagggagaataaaaatattttagtgactccatcagaacagaggagactgatgatgtcactaaaaaacctggcggcagcgcaaaagatg

SEQ ID NO: 71903 - DNA, 103 bp, Artificial Sequence
  Synthetic Polynucleotide
taatacgactcactataggggcgttaccactattggcgaatgatctaattaacagaggagaaattagatgattcgccaaaacctggcggcagcgcaaaagatg

SEQ ID NO: 71904 - DNA, 103 bp, Artificial Sequence
  Synthetic Polynucleotide
taatacgactcactatagggtaaaaaatcttctagagaatgaatttccataacagaggagaatggaaatgcattctctaaacctggcggcagcgcaaaagatg

SEQ ID NO: 71905 - DNA, 103 bp, Artificial Sequence
  Synthetic Polynucleotide
taatacgactcactataggggaatgagaataaaaatattttagtgactccaacagaggagaggagtcatgaaaatatttaacctggcggcagcgcaaaagatg

SEQ ID NO: 71906 - DNA, 103 bp, Artificial Sequence
  Synthetic Polynucleotide
taatacgactcactatagggcatcagaatgagaataaaaatattttagtgaacagaggagacactaaatgatttttattaacctggcggcagcgcaaaagatg

SEQ ID NO: 71907 - DNA, 103 bp, Artificial Sequence
  Synthetic Polynucleotide
taatacgactcactatagggtgatgcatcagaatgagaataaaaatatttaacagaggagaaaatatatgtattctcataacctggcggcagcgcaaaagatg

SEQ ID NO: 71908 - DNA, 103 bp, Artificial Sequence
  Synthetic Polynucleotide
taatacgactcactatagggatagttgatgcatcagaatgagaataaaaaaacagaggagatttttaatgtcattctgaaacctggcggcagcgcaaaagatg

SEQ ID NO: 71909 - DNA, 103 bp, Artificial Sequence
  Synthetic Polynucleotide
taatacgactcactatagggaagaaatagttgatgcatcagaatgagaataacagaggagaattctcatgctgatgcataacctggcggcagcgcaaaagatg

SEQ ID NO: 71910 - DNA, 103 bp, Artificial Sequence
  Synthetic Polynucleotide
taatacgactcactatagggtgtttaagaaatagttgatgcatcagaatgaacagaggagacattctatggcatcaactaacctggcggcagcgcaaaagatg

SEQ ID NO: 71911 - DNA, 103 bp, Artificial Sequence
  Synthetic Polynucleotide
taatacgactcactataggggttattgtttaagaaatagttgatgcatcaaacagaggagatgatgcatgaactatttcaacctggcggcagcgcaaaagatg

SEQ ID NO: 71912 - DNA, 103 bp, Artificial Sequence
  Synthetic Polynucleotide
taatacgactcactatagggtgaacgttattgtttaagaaatagttgatgaacagaggagacatcaaatgtttcttaaaaacctggcggcagcgcaaaagatg

SEQ ID NO: 71913 - DNA, 103 bp, Artificial Sequence
  Synthetic Polynucleotide
taatacgactcactataggggttgttgaacgttattgtttaagaaatagtaacagaggagaactattatgtaaacaataaacctggcggcagcgcaaaagatg

SEQ ID NO: 71914 - DNA, 103 bp, Artificial Sequence
  Synthetic Polynucleotide
taatacgactcactatagggtatatgttgttgaacgttattgtttaagaaaacagaggagattcttaatgaataacgttaacctggcggcagcgcaaaagatg

SEQ ID NO: 71915 - DNA, 103 bp, Artificial Sequence
  Synthetic Polynucleotide
taatacgactcactatagggagcattaaaaaatcttctagagaatgaattaacagaggagaaattcaatgtctagaagaaacctggcggcagcgcaaaagatg

SEQ ID NO: 71916 - DNA, 103 bp, Artificial Sequence
  Synthetic Polynucleotide
taatacgactcactataggggagagtatatgttgttgaacgttattgtttaacagaggagaaaacaaatgcgttcaacaaacctggcggcagcgcaaaagatg

SEQ ID NO: 71917 - DNA, 103 bp, Artificial Sequence
  Synthetic Polynucleotide
taatacgactcactataggggctggagcattaaaaaatcttctagagaataacagaggagaattctcatgaagatttttaacctggcggcagcgcaaaagatg

SEQ ID NO: 71918 - DNA, 103 bp, Artificial Sequence
  Synthetic Polynucleotide
taatacgactcactatagggtgaacgctggagcattaaaaaatcttctagaacagaggagactagaaatgtttttaatgaacctggcggcagcgcaaaagatg

SEQ ID NO: 71919 - DNA, 103 bp, Artificial Sequence
  Synthetic Polynucleotide
taatacgactcactataggggttgttgaacgctggagcattaaaaaatctaacagaggagaagatttatgaatgctccaaacctggcggcagcgcaaaagatg

SEQ ID NO: 71920 - DNA, 103 bp, Artificial Sequence
  Synthetic Polynucleotide
taatacgactcactatagggtgtacgttgttgaacgctggagcattaaaaaacagaggagattttaaatgtccagcgttaacctggcggcagcgcaaaagatg

SEQ ID NO: 71921 - DNA, 103 bp, Artificial Sequence
  Synthetic Polynucleotide
taatacgactcactatagggtagtatgtacgttgttgaacgctggagcataacagaggagaatgctcatgcgttcaacaaacctggcggcagcgcaaaagatg

SEQ ID NO: 71922 - DNA, 103 bp, Artificial Sequence
  Synthetic Polynucleotide
taatacgactcactataggggcgtctagtatgtacgttgttgaacgctggaacagaggagaccagcgatgaacaacgtaaacctggcggcagcgcaaaagatg

SEQ ID NO: 71923 - DNA, 103 bp, Artificial Sequence
  Synthetic Polynucleotide
taatacgactcactatagggaacatgcgtctagtatgtacgttgttgaacaacagaggagagttcaaatgcgtacatacaacctggcggcagcgcaaaagatg

SEQ ID NO: 71924 - DNA, 103 bp, Artificial Sequence
  Synthetic Polynucleotide
taatacgactcactatagggataataacatgcgtctagtatgtacgttgtaacagaggagaacaacgatgatactagacaacctggcggcagcgcaaaagatg

SEQ ID NO: 71925 - DNA, 103 bp, Artificial Sequence
  Synthetic Polynucleotide
taatacgactcactatagggcgatagcgttaccactattggcgaatgatcaacagaggagagatcatatgccaatagtgaacctggcggcagcgcaaaagatg

SEQ ID NO: 71926 - DNA, 103 bp, Artificial Sequence
  Synthetic Polynucleotide
taatacgactcactatagggagctgataataacatgcgtctagtatgtacaacagaggagagtacatatgagacgcatgaacctggcggcagcgcaaaagatg

SEQ ID NO: 71927 - DNA, 103 bp, Artificial Sequence
  Synthetic Polynucleotide
taatacgactcactataggggcaatagctgataataacatgcgtctagtaaacagaggagatactagatgcatgttattaacctggcggcagcgcaaaagatg

SEQ ID NO: 71928 - DNA, 103 bp, Artificial Sequence
  Synthetic Polynucleotide
taatacgactcactatagggattatgcaatagctgataataacatgcgtcaacagaggagagacgcaatgtattatcagaacctggcggcagcgcaaaagatg

SEQ ID NO: 71929 - DNA, 103 bp, Artificial Sequence
  Synthetic Polynucleotide
taatacgactcactatagggcttgtattatgcaatagctgataataacataacagaggagaatgttaatgtcagctattaacctggcggcagcgcaaaagatg

SEQ ID NO: 71930 - DNA, 103 bp, Artificial Sequence
  Synthetic Polynucleotide
taatacgactcactatagggagtgccttgtattatgcaatagctgataataacagaggagaattatcatgtattgcataaacctggcggcagcgcaaaagatg

SEQ ID NO: 71931 - DNA, 103 bp, Artificial Sequence
  Synthetic Polynucleotide
taatacgactcactataggggacatagtgccttgtattatgcaatagctgaacagaggagacagctaatgcataatacaaacctggcggcagcgcaaaagatg

SEQ ID NO: 71932 - DNA, 103 bp, Artificial Sequence
  Synthetic Polynucleotide
taatacgactcactatagggccatggacatagtgccttgtattatgcaataacagaggagaattgcaatgtacaaggcaaacctggcggcagcgcaaaagatg

SEQ ID NO: 71933 - DNA, 103 bp, Artificial Sequence
  Synthetic Polynucleotide
taatacgactcactataggggatgtccatggacatagtgccttgtattataacagaggagaataataatgggcactatgaacctggcggcagcgcaaaagatg

SEQ ID NO: 71934 - DNA, 103 bp, Artificial Sequence
  Synthetic Polynucleotide
taatacgactcactatagggaggcggatgtccatggacatagtgccttgtaacagaggagaacaaggatgtatgtccataacctggcggcagcgcaaaagatg

SEQ ID NO: 71935 - DNA, 103 bp, Artificial Sequence
  Synthetic Polynucleotide
taatacgactcactatagggatttaaggcggatgtccatggacatagtgcaacagaggagagcactaatgccatggacaaacctggcggcagcgcaaaagatg

SEQ ID NO: 71936 - DNA, 103 bp, Artificial Sequence
  Synthetic Polynucleotide
taatacgactcactatagggcgtttcgatagcgttaccactattggcgaaaacagaggagattcgccatgagtggtaacaacctggcggcagcgcaaaagatg

SEQ ID NO: 71937 - DNA, 103 bp, Artificial Sequence
  Synthetic Polynucleotide
taatacgactcactataggggatacatttaaggcggatgtccatggacataacagaggagaatgtccatggacatccgcaacctggcggcagcgcaaaagatg

SEQ ID NO: 71938 - DNA, 103 bp, Artificial Sequence
  Synthetic Polynucleotide
taatacgactcactataggggtaaagatacatttaaggcggatgtccatgaacagaggagacatggaatgccgccttaaaacctggcggcagcgcaaaagatg

SEQ ID NO: 71939 - DNA, 103 bp, Artificial Sequence
  Synthetic Polynucleotide
taatacgactcactatagggctctagtaaagatacatttaaggcggatgtaacagaggagaacatccatgttaaatgtaaacctggcggcagcgcaaaagatg

SEQ ID NO: 71940 - DNA, 103 bp, Artificial Sequence
  Synthetic Polynucleotide
taatacgactcactatagggtttctctctagtaaagatacatttaaggcgaacagaggagacgccttatgtgtatctttaacctggcggcagcgcaaaagatg

SEQ ID NO: 71941 - DNA, 103 bp, Artificial Sequence
  Synthetic Polynucleotide
taatacgactcactatagggaaagctttctctctagtaaagatacatttaaacagaggagataaatgatgctttactagaacctggcggcagcgcaaaagatg

SEQ ID NO: 71942 - DNA, 103 bp, Artificial Sequence
  Synthetic Polynucleotide
taatacgactcactataggggctgaaaagctttctctctagtaaagatacaacagaggagagtatctatgctagagagaaacctggcggcagcgcaaaagatg

SEQ ID NO: 71943 - DNA, 103 bp, Artificial Sequence
  Synthetic Polynucleotide
taatacgactcactatagggaagcagctgaaaagctttctctctagtaaaaacagaggagatttactatggagaaagctaacctggcggcagcgcaaaagatg

SEQ ID NO: 71944 - DNA, 103 bp, Artificial Sequence
  Synthetic Polynucleotide
taatacgactcactatagggagtctaagcagctgaaaagctttctctctaaacagaggagatagagaatgagcttttcaaacctggcggcagcgcaaaagatg

SEQ ID NO: 71945 - DNA, 103 bp, Artificial Sequence
  Synthetic Polynucleotide
taatacgactcactatagggtcggaagtctaagcagctgaaaagctttctaacagaggagaagaaagatgttcagctgcaacctggcggcagcgcaaaagatg

SEQ ID NO: 71946 - DNA, 103 bp, Artificial Sequence
  Synthetic Polynucleotide
taatacgactcactatagggaatactcggaagtctaagcagctgaaaagcaacagaggagagcttttatgctgcttagaaacctggcggcagcgcaaaagatg

SEQ ID NO: 71947 - DNA, 103 bp, Artificial Sequence
  Synthetic Polynucleotide
taatacgactcactatagggaatgtcgtttcgatagcgttaccactattgaacagaggagacaatagatgtaacgctataacctggcggcagcgcaaaagatg

SEQ ID NO: 71948 - DNA, 103 bp, Artificial Sequence
  Synthetic Polynucleotide
taatacgactcactataggggaattaatactcggaagtctaagcagctgaaacagaggagatcagctatgtagacttccaacctggcggcagcgcaaaagatg

SEQ ID NO: 71949 - DNA, 103 bp, Artificial Sequence
  Synthetic Polynucleotide
taatacgactcactataggggtcacgaattaatactcggaagtctaagcaaacagaggagatgcttaatgttccgagtaaacctggcggcagcgcaaaagatg

SEQ ID NO: 71950 - DNA, 103 bp, Artificial Sequence
  Synthetic Polynucleotide
taatacgactcactataggggatctgtcacgaattaatactcggaagtctaacagaggagaagacttatgagtattaataacctggcggcagcgcaaaagatg

SEQ ID NO: 71951 - DNA, 103 bp, Artificial Sequence
  Synthetic Polynucleotide
taatacgactcactatagggacatggatctgtcacgaattaatactcggaaacagaggagatccgagatgtaattcgtgaacctggcggcagcgcaaaagatg

SEQ ID NO: 71952 - DNA, 103 bp, Artificial Sequence
  Synthetic Polynucleotide
taatacgactcactatagggttcagacatggatctgtcacgaattaatacaacagaggagagtattaatgcgtgacagaaacctggcggcagcgcaaaagatg

SEQ ID NO: 71953 - DNA, 103 bp, Artificial Sequence
  Synthetic Polynucleotide
taatacgactcactatagggctcgtttcagacatggatctgtcacgaattaacagaggagaaattcgatgcagatccataacctggcggcagcgcaaaagatg

SEQ ID NO: 71954 - DNA, 103 bp, Artificial Sequence
  Synthetic Polynucleotide
taatacgactcactatagggagcgtctcgtttcagacatggatctgtcacaacagaggagagtgacaatgccatgtctgaacctggcggcagcgcaaaagatg

SEQ ID NO: 71955 - DNA, 103 bp, Artificial Sequence
  Synthetic Polynucleotide
taatacgactcactatagggtaattagcgtctcgtttcagacatggatctaacagaggagaagatccatgtctgaaacgaacctggcggcagcgcaaaagatg

SEQ ID NO: 71956 - DNA, 103 bp, Artificial Sequence
  Synthetic Polynucleotide
taatacgactcactatagggtacactaattagcgtctcgtttcagacatgaacagaggagacatgtcatgaacgagacgaacctggcggcagcgcaaaagatg

SEQ ID NO: 71957 - DNA, 103 bp, Artificial Sequence
  Synthetic Polynucleotide
taatacgactcactatagggaattatacactaattagcgtctcgtttcagaacagaggagactgaaaatggacgctaataacctggcggcagcgcaaaagatg

SEQ ID NO: 71958 - DNA, 103 bp, Artificial Sequence
  Synthetic Polynucleotide
taatacgactcactatagggctgacaatgtcgtttcgatagcgttaccacaacagaggagagtggtaatgctatcgaaaaacctggcggcagcgcaaaagatg

SEQ ID NO: 71959 - DNA, 103 bp, Artificial Sequence
  Synthetic Polynucleotide
taatacgactcactataggggacaaaattatacactaattagcgtctcgtaacagaggagaacgagaatgtaattagtgaacctggcggcagcgcaaaagatg

SEQ ID NO: 71960 - DNA, 103 bp, Artificial Sequence
  Synthetic Polynucleotide
taatacgactcactatagggagtatgacaaaattatacactaattagcgtaacagaggagaacgctaatgagtgtataaaacctggcggcagcgcaaaagatg

SEQ ID NO: 71961 - DNA, 103 bp, Artificial Sequence
  Synthetic Polynucleotide
taatacgactcactatagggggagcagtatgacaaaattatacactaattaacagaggagaaattagatgataattttgaacctggcggcagcgcaaaagatg

SEQ ID NO: 71962 - DNA, 103 bp, Artificial Sequence
  Synthetic Polynucleotide
taatacgactcactatagggattctggagcagtatgacaaaattatacacaacagaggagagtgtatatgtttgtcataaacctggcggcagcgcaaaagatg

SEQ ID NO: 71963 - DNA, 103 bp, Artificial Sequence
  Synthetic Polynucleotide
taatacgactcactatagggtattaattctggagcagtatgacaaaattaaacagaggagataatttatgcatactgctaacctggcggcagcgcaaaagatg

SEQ ID NO: 71964 - DNA, 103 bp, Artificial Sequence
  Synthetic Polynucleotide
taatacgactcactataggggatattattaattctggagcagtatgacaaaacagaggagattgtcaatgtgctccagaaacctggcggcagcgcaaaagatg

SEQ ID NO: 71965 - DNA, 103 bp, Artificial Sequence
  Synthetic Polynucleotide
taatacgactcactatagggttagagatattattaattctggagcagtataacagaggagaatactgatgcagaattaaaacctggcggcagcgcaaaagatg

SEQ ID NO: 71966 - DNA, 103 bp, Artificial Sequence
  Synthetic Polynucleotide
taatacgactcactatagggatctattagagatattattaattctggagcaacagaggagagctccaatgttaataataaacctggcggcagcgcaaaagatg

SEQ ID NO: 71967 - DNA, 103 bp, Artificial Sequence
  Synthetic Polynucleotide
taatacgactcactatagggatcaaatctattagagatattattaattctaacagaggagaagaattatgaatatctctaacctggcggcagcgcaaaagatg

SEQ ID NO: 71968 - DNA, 103 bp, Artificial Sequence
  Synthetic Polynucleotide
taatacgactcactatagggtactaatcaaatctattagagatattattaaacagaggagataataaatgctctaatagaacctggcggcagcgcaaaagatg

SEQ ID NO: 71969 - DNA, 103 bp, Artificial Sequence
  Synthetic Polynucleotide
taatacgactcactatagggaatttctgacaatgtcgtttcgatagcgttaacagaggagaaacgctatggaaacgacaaacctggcggcagcgcaaaagatg

SEQ ID NO: 71970 - DNA, 103 bp, Artificial Sequence
  Synthetic Polynucleotide
taatacgactcactatagggatatctactaatcaaatctattagagatataacagaggagaatatctatgatagatttgaacctggcggcagcgcaaaagatg

SEQ ID NO: 71971 - DNA, 103 bp, Artificial Sequence
  Synthetic Polynucleotide
taatacgactcactataggggccatatatctactaatcaaatctattagaaacagaggagatctaatatgtttgattagaacctggcggcagcgcaaaagatg

SEQ ID NO: 71972 - DNA, 103 bp, Artificial Sequence
  Synthetic Polynucleotide
taatacgactcactatagggcgatagccatatatctactaatcaaatctaaacagaggagatagattatgttagtagataacctggcggcagcgcaaaagatg

SEQ ID NO: 71973 - DNA, 103 bp, Artificial Sequence
  Synthetic Polynucleotide
taatacgactcactatagggttttgcgatagccatatatctactaatcaaaacagaggagattgattatgagatatatgaacctggcggcagcgcaaaagatg

SEQ ID NO: 71974 - DNA, 103 bp, Artificial Sequence
  Synthetic Polynucleotide
taatacgactcactatagggtgttgttttgcgatagccatatatctactaaacagaggagatagtagatgtatggctataacctggcggcagcgcaaaagatg

SEQ ID NO: 71975 - DNA, 103 bp, Artificial Sequence
  Synthetic Polynucleotide
taatacgactcactataggggtatatgttgttttgcgatagccatatatcaacagaggagagatataatgctatcgcaaaacctggcggcagcgcaaaagatg

SEQ ID NO: 71976 - DNA, 103 bp, Artificial Sequence
  Synthetic Polynucleotide
taatacgactcactatagggaatgtgtatatgttgttttgcgatagccataacagaggagaatggctatggcaaaacaaaacctggcggcagcgcaaaagatg

SEQ ID NO: 71977 - DNA, 103 bp, Artificial Sequence
  Synthetic Polynucleotide
taatacgactcactatagggtattaaatgtgtatatgttgttttgcgataaacagaggagatatcgcatgacaacatataacctggcggcagcgcaaaagatg

SEQ ID NO: 71978 - DNA, 103 bp, Artificial Sequence
  Synthetic Polynucleotide
taatacgactcactatagggatttttattaaatgtgtatatgttgttttgaacagaggagacaaaacatgatatacacaaacctggcggcagcgcaaaagatg

SEQ ID NO: 71979 - DNA, 103 bp, Artificial Sequence
  Synthetic Polynucleotide
taatacgactcactatagggatattatttttattaaatgtgtatatgttgaacagaggagacaacatatgcacatttaaaacctggcggcagcgcaaaagatg

SEQ ID NO: 71980 - DNA, 103 bp, Artificial Sequence
  Synthetic Polynucleotide
taatacgactcactatagggtttgtaatttctgacaatgtcgtttcgataaacagaggagatatcgaatggacattgtcaacctggcggcagcgcaaaagatg

SEQ ID NO: 71981 - DNA, 103 bp, Artificial Sequence
  Synthetic Polynucleotide
taatacgactcactatagggaatgaatattatttttattaaatgtgtataaacagaggagatatacaatgttaataaaaaacctggcggcagcgcaaaagatg

SEQ ID NO: 71982 - DNA, 103 bp, Artificial Sequence
  Synthetic Polynucleotide
taatacgactcactatagggtccttaatgaatattatttttattaaatgtaacagaggagaacatttatgaaaaataataacctggcggcagcgcaaaagatg

SEQ ID NO: 71983 - DNA, 103 bp, Artificial Sequence
  Synthetic Polynucleotide
taatacgactcactataggggaatctccttaatgaatattatttttattaaacagaggagataataaatgtaatattcaaacctggcggcagcgcaaaagatg

SEQ ID NO: 71984 - DNA, 103 bp, Artificial Sequence
  Synthetic Polynucleotide
taatacgactcactatagggaatctgaatctccttaatgaatattattttaacagaggagaaaaataatgttcattaagaacctggcggcagcgcaaaagatg

SEQ ID NO: 71985 - DNA, 103 bp, Artificial Sequence
  Synthetic Polynucleotide
taatacgactcactatagggggcggaatctgaatctccttaatgaatattaacagaggagaaatattatgtaaggagataacctggcggcagcgcaaaagatg

SEQ ID NO: 71986 - DNA, 103 bp, Artificial Sequence
  Synthetic Polynucleotide
taatacgactcactataggggatacggcggaatctgaatctccttaatgaaacagaggagatcattaatgagattcagaaacctggcggcagcgcaaaagatg

SEQ ID NO: 71987 - DNA, 103 bp, Artificial Sequence
  Synthetic Polynucleotide
taatacgactcactatagggttatggatacggcggaatctgaatctccttaacagaggagaaaggagatgcagattccgaacctggcggcagcgcaaaagatg

SEQ ID NO: 71988 - DNA, 103 bp, Artificial Sequence
  Synthetic Polynucleotide
taatacgactcactatagggattgtttatggatacggcggaatctgaatcaacagaggagagattcaatgtccgccgtaaacctggcggcagcgcaaaagatg

SEQ ID NO: 71989 - DNA, 103 bp, Artificial Sequence
  Synthetic Polynucleotide
taatacgactcactatagggttaatattgtttatggatacggcggaatctaacagaggagaagattcatgcgtatccataacctggcggcagcgcaaaagatg

SEQ ID NO: 71990 - DNA, 103 bp, Artificial Sequence
  Synthetic Polynucleotide
taatacgactcactatagggtctccttaatattgtttatggatacggcggaacagaggagaccgccgatgccataaacaaacctggcggcagcgcaaaagatg

SEQ ID NO: 71991 - DNA, 103 bp, Artificial Sequence
  Synthetic Polynucleotide
taatacgactcactatagggtagtgtttgtaatttctgacaatgtcgtttaacagaggagaaaacgaatgtgtcagaaaaacctggcggcagcgcaaaagatg

SEQ ID NO: 71992 - DNA, 103 bp, Artificial Sequence
  Synthetic Polynucleotide
taatacgactcactatagggtagaatctccttaatattgtttatggatacaacagaggagagtatccatgaacaatattaacctggcggcagcgcaaaagatg

SEQ ID NO: 71993 - DNA, 103 bp, Artificial Sequence
  Synthetic Polynucleotide
taatacgactcactatagggtaaggtagaatctccttaatattgtttatgaacagaggagacataaaatgtattaaggaaacctggcggcagcgcaaaagatg

SEQ ID NO: 71994 - DNA, 103 bp, Artificial Sequence
  Synthetic Polynucleotide
taatacgactcactatagggatgggtaaggtagaatctccttaatattgtaacagaggagaacaataatgaggagattcaacctggcggcagcgcaaaagatg

SEQ ID NO: 71995 - DNA, 103 bp, Artificial Sequence
  Synthetic Polynucleotide
taatacgactcactatagggtgtttatgggtaaggtagaatctccttaataacagaggagaattaagatgattctacctaacctggcggcagcgcaaaagatg

SEQ ID NO: 71996 - DNA, 103 bp, Artificial Sequence
  Synthetic Polynucleotide
taatacgactcactatagggtatattgtttatgggtaaggtagaatctccaacagaggagaggagatatgaccttacccaacctggcggcagcgcaaaagatg

SEQ ID NO: 71997 - DNA, 103 bp, Artificial Sequence
  Synthetic Polynucleotide
taatacgactcactatagggggatttatattgtttatgggtaaggtagaaaacagaggagattctacatgacccataaaaacctggcggcagcgcaaaagatg

SEQ ID NO: 71998 - DNA, 103 bp, Artificial Sequence
  Synthetic Polynucleotide
taatacgactcactatagggttactggatttatattgtttatgggtaaggaacagaggagaccttacatgtaaacaataaacctggcggcagcgcaaaagatg

SEQ ID NO: 71999 - DNA, 103 bp, Artificial Sequence
  Synthetic Polynucleotide
taatacgactcactatagggtgatattactggatttatattgtttatgggaacagaggagacccataatgaatataaataacctggcggcagcgcaaaagatg

SEQ ID NO: 72000 - DNA, 103 bp, Artificial Sequence
  Synthetic Polynucleotide
taatacgactcactatagggagacatgatattactggatttatattgtttaacagaggagaaaacaaatgaaatccagtaacctggcggcagcgcaaaagatg

SEQ ID NO: 72001 - DNA, 103 bp, Artificial Sequence
  Synthetic Polynucleotide
taatacgactcactatagggtcattagacatgatattactggatttatataacagaggagaatataaatgcagtaatataacctggcggcagcgcaaaagatg

SEQ ID NO: 72002 - DNA, 103 bp, Artificial Sequence
  Synthetic Polynucleotide
taatacgactcactatagggtgttgtagtgtttgtaatttctgacaatgtaacagaggagaacattgatggaaattacaaacctggcggcagcgcaaaagatg

SEQ ID NO: 72003 - DNA, 103 bp, Artificial Sequence
  Synthetic Polynucleotide
taatacgactcactataggggttcatcattagacatgatattactggattaacagaggagaaatccaatgatatcatgtaacctggcggcagcgcaaaagatg

SEQ ID NO: 72004 - DNA, 103 bp, Artificial Sequence
  Synthetic Polynucleotide
taatacgactcactatagggtttgtgttcatcattagacatgatattactaacagaggagaagtaatatgatgtctaataacctggcggcagcgcaaaagatg

SEQ ID NO: 72005 - DNA, 103 bp, Artificial Sequence
  Synthetic Polynucleotide
taatacgactcactatagggcaccatttgtgttcatcattagacatgataaacagaggagatatcatatgtaatgatgaaacctggcggcagcgcaaaagatg

SEQ ID NO: 72006 - DNA, 103 bp, Artificial Sequence
  Synthetic Polynucleotide
taatacgactcactatagggtaatacaccatttgtgttcatcattagacaaacagaggagatgtctaatgatgaacacaaacctggcggcagcgcaaaagatg

SEQ ID NO: 72007 - DNA, 103 bp, Artificial Sequence
  Synthetic Polynucleotide
taatacgactcactataggggaatttaatacaccatttgtgttcatcattaacagaggagaaatgatatgcacaaatggaacctggcggcagcgcaaaagatg

SEQ ID NO: 72008 - DNA, 103 bp, Artificial Sequence
  Synthetic Polynucleotide
taatacgactcactatagggaactggaatttaatacaccatttgtgttcaaacagaggagatgaacaatgatggtgtataacctggcggcagcgcaaaagatg

SEQ ID NO: 72009 - DNA, 103 bp, Artificial Sequence
  Synthetic Polynucleotide
taatacgactcactatagggtgaagaactggaatttaatacaccatttgtaacagaggagaacaaatatggtattaaataacctggcggcagcgcaaaagatg

SEQ ID NO: 72010 - DNA, 103 bp, Artificial Sequence
  Synthetic Polynucleotide
taatacgactcactatagggtctcctgaagaactggaatttaatacaccaaacagaggagatggtgtatgaaattccagaacctggcggcagcgcaaaagatg

SEQ ID NO: 72011 - DNA, 103 bp, Artificial Sequence
  Synthetic Polynucleotide
taatacgactcactataggggatcatctcctgaagaactggaatttaataaacagaggagatattaaatgccagttcttaacctggcggcagcgcaaaagatg

SEQ ID NO: 72012 - DNA, 103 bp, Artificial Sequence
  Synthetic Polynucleotide
taatacgactcactatagggggtgagatcatctcctgaagaactggaattaacagaggagaaattccatgtcttcaggaaacctggcggcagcgcaaaagatg

SEQ ID NO: 72013 - DNA, 103 bp, Artificial Sequence
  Synthetic Polynucleotide
taatacgactcactatagggggcaaagattgcacatgtattctatgtcgtaacagaggagaacgacaatgaatacatgtaacctggcggcagcgcaaaagatg

SEQ ID NO: 72014 - DNA, 103 bp, Artificial Sequence
  Synthetic Polynucleotide
taatacgactcactatagggatatctgttgtagtgtttgtaatttctgacaacagaggagagtcagaatgtacaaacacaacctggcggcagcgcaaaagatg

SEQ ID NO: 72015 - DNA, 103 bp, Artificial Sequence
  Synthetic Polynucleotide
taatacgactcactataggggctacggtgagatcatctcctgaagaactgaacagaggagacagttcatgaggagatgaaacctggcggcagcgcaaaagatg

SEQ ID NO: 72016 - DNA, 103 bp, Artificial Sequence
  Synthetic Polynucleotide
taatacgactcactatagggtggtagctacggtgagatcatctcctgaagaacagaggagacttcagatgatgatctcaaacctggcggcagcgcaaaagatg

SEQ ID NO: 72017 - DNA, 103 bp, Artificial Sequence
  Synthetic Polynucleotide
taatacgactcactatagggtatcatggtagctacggtgagatcatctccaacagaggagaggagatatgctcaccgtaaacctggcggcagcgcaaaagatg

SEQ ID NO: 72018 - DNA, 103 bp, Artificial Sequence
  Synthetic Polynucleotide
taatacgactcactatagggtctactatcatggtagctacggtgagatcaaacagaggagatgatctatgcgtagctacaacctggcggcagcgcaaaagatg

SEQ ID NO: 72019 - DNA, 103 bp, Artificial Sequence
  Synthetic Polynucleotide
taatacgactcactatagggaggcatctactatcatggtagctacggtgaaacagaggagatcaccgatgctaccatgaaacctggcggcagcgcaaaagatg

SEQ ID NO: 72020 - DNA, 103 bp, Artificial Sequence
  Synthetic Polynucleotide
taatacgactcactatagggagcggaggcatctactatcatggtagctacaacagaggagagtagctatgatgatagtaaacctggcggcagcgcaaaagatg

SEQ ID NO: 72021 - DNA, 103 bp, Artificial Sequence
  Synthetic Polynucleotide
taatacgactcactatagggactgtagcggaggcatctactatcatggtaaacagaggagataccatatgagtagatgcaacctggcggcagcgcaaaagatg

SEQ ID NO: 72022 - DNA, 103 bp, Artificial Sequence
  Synthetic Polynucleotide
taatacgactcactatagggaaggaactgtagcggaggcatctactatcaaacagaggagatgatagatgatgcctccgaacctggcggcagcgcaaaagatg

SEQ ID NO: 72023 - DNA, 103 bp, Artificial Sequence
  Synthetic Polynucleotide
taatacgactcactatagggcgaacaaggaactgtagcggaggcatctacaacagaggagagtagatatgtccgctacaaacctggcggcagcgcaaaagatg

SEQ ID NO: 72024 - DNA, 103 bp, Artificial Sequence
  Synthetic Polynucleotide
taatacgactcactataggggtcaacgaacaaggaactgtagcggaggcaaacagaggagatgcctcatgtacagttccaacctggcggcagcgcaaaagatg

SEQ ID NO: 72025 - DNA, 103 bp, Artificial Sequence
  Synthetic Polynucleotide
taatacgactcactatagggctggaatatctgttgtagtgtttgtaatttaacagaggagaaaattaatgacactacaaaacctggcggcagcgcaaaagatg

SEQ ID NO: 72026 - DNA, 103 bp, Artificial Sequence
  Synthetic Polynucleotide
taatacgactcactatagggtagatgtcaacgaacaaggaactgtagcggaacagaggagaccgctaatgttccttgttaacctggcggcagcgcaaaagatg

SEQ ID NO: 72027 - DNA, 103 bp, Artificial Sequence
  Synthetic Polynucleotide
taatacgactcactatagggaaagatagatgtcaacgaacaaggaactgtaacagaggagaacagttatgtgttcgttgaacctggcggcagcgcaaaagatg

SEQ ID NO: 72028 - DNA, 103 bp, Artificial Sequence
  Synthetic Polynucleotide
taatacgactcactatagggaatgcaaagatagatgtcaacgaacaaggaaacagaggagatccttgatggttgacatcaacctggcggcagcgcaaaagatg

SEQ ID NO: 72029 - DNA, 103 bp, Artificial Sequence
  Synthetic Polynucleotide
taatacgactcactatagggttcagaatgcaaagatagatgtcaacgaacaacagaggagagttcgtatgcatctatctaacctggcggcagcgcaaaagatg

SEQ ID NO: 72030 - DNA, 103 bp, Artificial Sequence
  Synthetic Polynucleotide
taatacgactcactatagggaatgtttcagaatgcaaagatagatgtcaaaacagaggagattgacaatgatctttgcaaacctggcggcagcgcaaaagatg

SEQ ID NO: 72031 - DNA, 103 bp, Artificial Sequence
  Synthetic Polynucleotide
taatacgactcactatagggtataaaatgtttcagaatgcaaagatagataacagaggagaatctatatgtgcattctgaacctggcggcagcgcaaaagatg

SEQ ID NO: 72032 - DNA, 103 bp, Artificial Sequence
  Synthetic Polynucleotide
taatacgactcactatagggatatttataaaatgtttcagaatgcaaagaaacagaggagatctttgatgtctgaaacaaacctggcggcagcgcaaaagatg

SEQ ID NO: 72033 - DNA, 103 bp, Artificial Sequence
  Synthetic Polynucleotide
taatacgactcactatagggattatatatttataaaatgtttcagaatgcaacagaggagagcattcatgaacattttaaacctggcggcagcgcaaaagatg

SEQ ID NO: 72034 - DNA, 103 bp, Artificial Sequence
  Synthetic Polynucleotide
taatacgactcactataggggacccattatatatttataaaatgtttcagaacagaggagactgaaaatgtttataaataacctggcggcagcgcaaaagatg

SEQ ID NO: 72035 - DNA, 103 bp, Artificial Sequence
  Synthetic Polynucleotide
taatacgactcactatagggctagggacccattatatatttataaaatgtaacagaggagaacatttatgaaatatataaacctggcggcagcgcaaaagatg

SEQ ID NO: 72036 - DNA, 103 bp, Artificial Sequence
  Synthetic Polynucleotide
taatacgactcactataggggatagctggaatatctgttgtagtgtttgtaacagaggagaacaaacatgacaacagataacctggcggcagcgcaaaagatg

SEQ ID NO: 72037 - DNA, 103 bp, Artificial Sequence
  Synthetic Polynucleotide
taatacgactcactatagggtatgactagggacccattatatatttataaaacagaggagattataaatgtataatgggaacctggcggcagcgcaaaagatg

SEQ ID NO: 72038 - DNA, 103 bp, Artificial Sequence
  Synthetic Polynucleotide
taatacgactcactatagggaaacatatgactagggacccattatatattaacagaggagaaatataatgtgggtccctaacctggcggcagcgcaaaagatg

SEQ ID NO: 72039 - DNA, 103 bp, Artificial Sequence
  Synthetic Polynucleotide
taatacgactcactatagggcgtttaaacatatgactagggacccattataacagaggagaataatgatgccctagtcaaacctggcggcagcgcaaaagatg

SEQ ID NO: 72040 - DNA, 103 bp, Artificial Sequence
  Synthetic Polynucleotide
taatacgactcactatagggtgcgtcgtttaaacatatgactagggacccaacagaggagagggtccatggtcatatgtaacctggcggcagcgcaaaagatg

SEQ ID NO: 72041 - DNA, 103 bp, Artificial Sequence
  Synthetic Polynucleotide
taatacgactcactataggggataatgcgtcgtttaaacatatgactaggaacagaggagacctagtatgatgtttaaaaacctggcggcagcgcaaaagatg

SEQ ID NO: 72042 - DNA, 103 bp, Artificial Sequence
  Synthetic Polynucleotide
taatacgactcactatagggatccagataatgcgtcgtttaaacatatgaaacagaggagatcatatatgtaaacgacgaacctggcggcagcgcaaaagatg

SEQ ID NO: 72043 - DNA, 103 bp, Artificial Sequence
  Synthetic Polynucleotide
taatacgactcactataggggtttaatccagataatgcgtcgtttaaacaaacagaggagatgtttaatggacgcattaaacctggcggcagcgcaaaagatg

SEQ ID NO: 72044 - DNA, 103 bp, Artificial Sequence
  Synthetic Polynucleotide
taatacgactcactatagggagtatgtttaatccagataatgcgtcgtttaacagaggagaaaacgaatgattatctggaacctggcggcagcgcaaaagatg

SEQ ID NO: 72045 - DNA, 103 bp, Artificial Sequence
  Synthetic Polynucleotide
taatacgactcactatagggctcctagtatgtttaatccagataatgcgtaacagaggagaacgcatatgctggattaaaacctggcggcagcgcaaaagatg

SEQ ID NO: 72046 - DNA, 103 bp, Artificial Sequence
  Synthetic Polynucleotide
taatacgactcactataggggatggctcctagtatgtttaatccagataaaacagaggagattatctatgttaaacataaacctggcggcagcgcaaaagatg

SEQ ID NO: 72047 - DNA, 103 bp, Artificial Sequence
  Synthetic Polynucleotide
taatacgactcactatagggaatctgatagctggaatatctgttgtagtgaacagaggagacactacatgagatattccaacctggcggcagcgcaaaagatg

SEQ ID NO: 72048 - DNA, 103 bp, Artificial Sequence
  Synthetic Polynucleotide
taatacgactcactataggggaaatgatggctcctagtatgtttaatccaaacagaggagatggattatgcatactaggaacctggcggcagcgcaaaagatg

SEQ ID NO: 72049 - DNA, 103 bp, Artificial Sequence
  Synthetic Polynucleotide
taatacgactcactatagggtagccgaaatgatggctcctagtatgtttaaacagaggagataaacaatgtaggagccaaacctggcggcagcgcaaaagatg

SEQ ID NO: 72050 - DNA, 103 bp, Artificial Sequence
  Synthetic Polynucleotide
taatacgactcactataggggtcgatagccgaaatgatggctcctagtataacagaggagaatactaatggccatcattaacctggcggcagcgcaaaagatg

SEQ ID NO: 72051 - DNA, 103 bp, Artificial Sequence
  Synthetic Polynucleotide
taatacgactcactatagggattaagtcgatagccgaaatgatggctcctaacagaggagaaggagcatgcatttcggcaacctggcggcagcgcaaaagatg

SEQ ID NO: 72052 - DNA, 103 bp, Artificial Sequence
  Synthetic Polynucleotide
taatacgactcactataggggggatattaagtcgatagccgaaatgatggaacagaggagaccatcaatgcggctatcgaacctggcggcagcgcaaaagatg

SEQ ID NO: 72053 - DNA, 103 bp, Artificial Sequence
  Synthetic Polynucleotide
taatacgactcactatagggtaagagggatattaagtcgatagccgaaataacagaggagaatttcgatgatcgacttaaacctggcggcagcgcaaaagatg

SEQ ID NO: 72054 - DNA, 103 bp, Artificial Sequence
  Synthetic Polynucleotide
taatacgactcactataggggaaaataagagggatattaagtcgatagccaacagaggagaggctatatgcttaatatcaacctggcggcagcgcaaaagatg

SEQ ID NO: 72055 - DNA, 103 bp, Artificial Sequence
  Synthetic Polynucleotide
taatacgactcactatagggctatcgaaaataagagggatattaagtcgaaacagaggagatcgactatgtatccctctaacctggcggcagcgcaaaagatg

SEQ ID NO: 72056 - DNA, 103 bp, Artificial Sequence
  Synthetic Polynucleotide
taatacgactcactatagggattttctatcgaaaataagagggatattaaaacagaggagattaataatgctcttatttaacctggcggcagcgcaaaagatg

SEQ ID NO: 72057 - DNA, 103 bp, Artificial Sequence
  Synthetic Polynucleotide
taatacgactcactatagggcctagattttctatcgaaaataagagggataacagaggagaatccctatgattttcgataacctggcggcagcgcaaaagatg

SEQ ID NO: 72058 - DNA, 103 bp, Artificial Sequence
  Synthetic Polynucleotide
taatacgactcactatagggcgcataatctgatagctggaatatctgttgaacagaggagacaacagatgttccagctaaacctggcggcagcgcaaaagatg

SEQ ID NO: 72059 - DNA, 103 bp, Artificial Sequence
  Synthetic Polynucleotide
taatacgactcactatagggaactccctagattttctatcgaaaataagaaacagaggagatcttatatgcgatagaaaaacctggcggcagcgcaaaagatg

SEQ ID NO: 72060 - DNA, 103 bp, Artificial Sequence
  Synthetic Polynucleotide
taatacgactcactatagggtcttaaactccctagattttctatcgaaaaaacagaggagattttcgatggaaaatctaaacctggcggcagcgcaaaagatg

SEQ ID NO: 72061 - DNA, 103 bp, Artificial Sequence
  Synthetic Polynucleotide
taatacgactcactatagggtacaatcttaaactccctagattttctatcaacagaggagagatagaatgtctagggagaacctggcggcagcgcaaaagatg

SEQ ID NO: 72062 - DNA, 103 bp, Artificial Sequence
  Synthetic Polynucleotide
taatacgactcactatagggaagtgtacaatcttaaactccctagattttaacagaggagaaaaatcatgggagtttaaaacctggcggcagcgcaaaagatg

SEQ ID NO: 72063 - DNA, 103 bp, Artificial Sequence
  Synthetic Polynucleotide
taatacgactcactataggggaataaagtgtacaatcttaaactccctagaacagaggagactagggatgttaagattgaacctggcggcagcgcaaaagatg

SEQ ID NO: 72064 - DNA, 103 bp, Artificial Sequence
  Synthetic Polynucleotide
taatacgactcactatagggttagggaataaagtgtacaatcttaaactcaacagaggagagagtttatgattgtacacaacctggcggcagcgcaaaagatg

SEQ ID NO: 72065 - DNA, 103 bp, Artificial Sequence
  Synthetic Polynucleotide
taatacgactcactatagggctcaattagggaataaagtgtacaatcttaaacagaggagataagatatgacactttataacctggcggcagcgcaaaagatg

SEQ ID NO: 72066 - DNA, 103 bp, Artificial Sequence
  Synthetic Polynucleotide
taatacgactcactataggggtcgtctcaattagggaataaagtgtacaaaacagaggagattgtacatgttattccctaacctggcggcagcgcaaaagatg

SEQ ID NO: 72067 - DNA, 103 bp, Artificial Sequence
  Synthetic Polynucleotide
taatacgactcactatagggtattggtcgtctcaattagggaataaagtgaacagaggagacactttatgccctaattgaacctggcggcagcgcaaaagatg

SEQ ID NO: 72068 - DNA, 103 bp, Artificial Sequence
  Synthetic Polynucleotide
taatacgactcactatagggtagactattggtcgtctcaattagggaataaacagaggagatattccatgattgagacgaacctggcggcagcgcaaaagatg

SEQ ID NO: 72069 - DNA, 103 bp, Artificial Sequence
  Synthetic Polynucleotide
taatacgactcactatagggtggaccgcataatctgatagctggaatatcaacagaggagagatattatggctatcagaaacctggcggcagcgcaaaagatg

SEQ ID NO: 72070 - DNA, 103 bp, Artificial Sequence
  Synthetic Polynucleotide
taatacgactcactatagggaaaattagactattggtcgtctcaattaggaacagaggagacctaatatggacgaccaaaacctggcggcagcgcaaaagatg

SEQ ID NO: 72071 - DNA, 103 bp, Artificial Sequence
  Synthetic Polynucleotide
taatacgactcactataggggctgcaaaattagactattggtcgtctcaaaacagaggagattgagaatgccaatagtcaacctggcggcagcgcaaaagatg

SEQ ID NO: 72072 - DNA, 103 bp, Artificial Sequence
  Synthetic Polynucleotide
taatacgactcactatagggtcatggctgcaaaattagactattggtcgtaacagaggagaacgaccatgagtctaattaacctggcggcagcgcaaaagatg

SEQ ID NO: 72073 - DNA, 103 bp, Artificial Sequence
  Synthetic Polynucleotide
taatacgactcactatagggttctatcatggctgcaaaattagactattgaacagaggagacaatagatgaattttgcaaacctggcggcagcgcaaaagatg

SEQ ID NO: 72074 - DNA, 103 bp, Artificial Sequence
  Synthetic Polynucleotide
taatacgactcactatagggacagattctatcatggctgcaaaattagacaacagaggagagtctaaatgtgcagccataacctggcggcagcgcaaaagatg

SEQ ID NO: 72075 - DNA, 103 bp, Artificial Sequence
  Synthetic Polynucleotide
taatacgactcactatagggatttcacagattctatcatggctgcaaaataacagaggagaattttgatgccatgatagaacctggcggcagcgcaaaagatg

SEQ ID NO: 72076 - DNA, 103 bp, Artificial Sequence
  Synthetic Polynucleotide
taatacgactcactataggggacccatttcacagattctatcatggctgcaacagaggagagcagccatgatagaatctaacctggcggcagcgcaaaagatg

SEQ ID NO: 72077 - DNA, 103 bp, Artificial Sequence
  Synthetic Polynucleotide
taatacgactcactatagggaatatgacccatttcacagattctatcatgaacagaggagacatgatatgatctgtgaaaacctggcggcagcgcaaaagatg

SEQ ID NO: 72078 - DNA, 103 bp, Artificial Sequence
  Synthetic Polynucleotide
taatacgactcactataggggtgataatatgacccatttcacagattctaaacagaggagatagaatatgtgaaatgggaacctggcggcagcgcaaaagatg

SEQ ID NO: 72079 - DNA, 103 bp, Artificial Sequence
  Synthetic Polynucleotide
taatacgactcactatagggaataggtgataatatgacccatttcacagaaacagaggagatctgtgatgtgggtcataaacctggcggcagcgcaaaagatg

SEQ ID NO: 72080 - DNA, 103 bp, Artificial Sequence
  Synthetic Polynucleotide
taatacgactcactatagggccctctggaccgcataatctgatagctggaaacagaggagatccagcatgcagattatgaacctggcggcagcgcaaaagatg

SEQ ID NO: 72081 - DNA, 103 bp, Artificial Sequence
  Synthetic Polynucleotide
taatacgactcactatagggctggcaataggtgataatatgacccatttcaacagaggagagaaatgatgcatattatcaacctggcggcagcgcaaaagatg

SEQ ID NO: 72082 - DNA, 103 bp, Artificial Sequence
  Synthetic Polynucleotide
taatacgactcactatagggtgtatctggcaataggtgataatatgacccaacagaggagagggtcaatgtatcacctaaacctggcggcagcgcaaaagatg

SEQ ID NO: 72083 - DNA, 103 bp, Artificial Sequence
  Synthetic Polynucleotide
taatacgactcactatagggtagtatgtatctggcaataggtgataatataacagaggagaatattaatgcctattgccaacctggcggcagcgcaaaagatg

SEQ ID NO: 72084 - DNA, 103 bp, Artificial Sequence
  Synthetic Polynucleotide
taatacgactcactatagggaatattagtatgtatctggcaataggtgataacagaggagaatcaccatgtgccagataaacctggcggcagcgcaaaagatg

SEQ ID NO: 72085 - DNA, 103 bp, Artificial Sequence
  Synthetic Polynucleotide
taatacgactcactatagggatgctaatattagtatgtatctggcaatagaacagaggagactattgatggatacatacaacctggcggcagcgcaaaagatg

SEQ ID NO: 72086 - DNA, 103 bp, Artificial Sequence
  Synthetic Polynucleotide
taatacgactcactatagggtaaggatgctaatattagtatgtatctggcaacagaggagagccagaatgatactaataaacctggcggcagcgcaaaagatg

SEQ ID NO: 72087 - DNA, 103 bp, Artificial Sequence
  Synthetic Polynucleotide
taatacgactcactatagggcagtataaggatgctaatattagtatgtataacagaggagaatacatatgaatattagcaacctggcggcagcgcaaaagatg

SEQ ID NO: 72088 - DNA, 103 bp, Artificial Sequence
  Synthetic Polynucleotide
taatacgactcactataggggccttcagtataaggatgctaatattagtaaacagaggagatactaaatgtagcatcctaacctggcggcagcgcaaaagatg

SEQ ID NO: 72089 - DNA, 103 bp, Artificial Sequence
  Synthetic Polynucleotide
taatacgactcactatagggggtgcgccttcagtataaggatgctaatataacagaggagaatattaatgtccttatacaacctggcggcagcgcaaaagatg

SEQ ID NO: 72090 - DNA, 103 bp, Artificial Sequence
  Synthetic Polynucleotide
taatacgactcactataggggatatggtgcgccttcagtataaggatgctaacagaggagaagcatcatgatactgaagaacctggcggcagcgcaaaagatg

SEQ ID NO: 72091 - DNA, 103 bp, Artificial Sequence
  Synthetic Polynucleotide
taatacgactcactatagggtatctccctctggaccgcataatctgatagaacagaggagactatcaatgtatgcggtcaacctggcggcagcgcaaaagatg

SEQ ID NO: 72092 - DNA, 103 bp, Artificial Sequence
  Synthetic Polynucleotide
taatacgactcactatagggaatatgatatggtgcgccttcagtataaggaacagaggagaccttatatggaaggcgcaaacctggcggcagcgcaaaagatg

SEQ ID NO: 72093 - DNA, 103 bp, Artificial Sequence
  Synthetic Polynucleotide
taatacgactcactatagggcgaagaatatgatatggtgcgccttcagtaaacagaggagatactgaatgcgcaccataaacctggcggcagcgcaaaagatg

SEQ ID NO: 72094 - DNA, 103 bp, Artificial Sequence
  Synthetic Polynucleotide
taatacgactcactataggggatgacgaagaatatgatatggtgcgccttaacagaggagaaaggcgatgcatatcataaacctggcggcagcgcaaaagatg

SEQ ID NO: 72095 - DNA, 103 bp, Artificial Sequence
  Synthetic Polynucleotide
taatacgactcactatagggcaatcgatgacgaagaatatgatatggtgcaacagaggagagcaccaatgcatattcttaacctggcggcagcgcaaaagatg

SEQ ID NO: 72096 - DNA, 103 bp, Artificial Sequence
  Synthetic Polynucleotide
taatacgactcactatagggaatcacaatcgatgacgaagaatatgatataacagaggagaatatcaatgtcttcgtcaaacctggcggcagcgcaaaagatg

SEQ ID NO: 72097 - DNA, 103 bp, Artificial Sequence
  Synthetic Polynucleotide
taatacgactcactatagggaatacaatcacaatcgatgacgaagaatataacagaggagaatattcatggtcatcgataacctggcggcagcgcaaaagatg

SEQ ID NO: 72098 - DNA, 103 bp, Artificial Sequence
  Synthetic Polynucleotide
taatacgactcactatagggaaggaaatacaatcacaatcgatgacgaagaacagaggagacttcgtatgcgattgtgaaacctggcggcagcgcaaaagatg

SEQ ID NO: 72099 - DNA, 103 bp, Artificial Sequence
  Synthetic Polynucleotide
taatacgactcactatagggattacaaggaaatacaatcacaatcgatgaaacagaggagatcatcgatggtgattgtaaacctggcggcagcgcaaaagatg

SEQ ID NO: 72100 - DNA, 103 bp, Artificial Sequence
  Synthetic Polynucleotide
taatacgactcactatagggactaaattacaaggaaatacaatcacaatcaacagaggagagattgtatgtgtatttccaacctggcggcagcgcaaaagatg

SEQ ID NO: 72101 - DNA, 103 bp, Artificial Sequence
  Synthetic Polynucleotide
taatacgactcactatagggtagttactaaattacaaggaaatacaatcaaacagaggagatgattgatgttccttgtaaacctggcggcagcgcaaaagatg

SEQ ID NO: 72102 - DNA, 103 bp, Artificial Sequence
  Synthetic Polynucleotide
taatacgactcactatagggatacctatctccctctggaccgcataatctaacagaggagaagattaatgggtccagagaacctggcggcagcgcaaaagatg

SEQ ID NO: 72103 - DNA, 103 bp, Artificial Sequence
  Synthetic Polynucleotide
taatacgactcactataggggagcgtagttactaaattacaaggaaatacaacagaggagagtatttatgtgtaatttaaacctggcggcagcgcaaaagatg

SEQ ID NO: 72104 - DNA, 103 bp, Artificial Sequence
  Synthetic Polynucleotide
taatacgactcactatagggatgatgagcgtagttactaaattacaaggaaacagaggagatccttgatgtttagtaacaacctggcggcagcgcaaaagatg

SEQ ID NO: 72105 - DNA, 103 bp, Artificial Sequence
  Synthetic Polynucleotide
taatacgactcactatagggttcccatgatgagcgtagttactaaattacaacagaggagagtaattatgtaactacgcaacctggcggcagcgcaaaagatg

SEQ ID NO: 72106 - DNA, 103 bp, Artificial Sequence
  Synthetic Polynucleotide
taatacgactcactatagggaacggttcccatgatgagcgtagttactaaaacagaggagattagtaatgacgctcatcaacctggcggcagcgcaaaagatg

SEQ ID NO: 72107 - DNA, 103 bp, Artificial Sequence
  Synthetic Polynucleotide
taatacgactcactatagggacgaaaacggttcccatgatgagcgtagttaacagaggagaaactacatgcatcatgggaacctggcggcagcgcaaaagatg

SEQ ID NO: 72108 - DNA, 103 bp, Artificial Sequence
  Synthetic Polynucleotide
taatacgactcactatagggacggcacgaaaacggttcccatgatgagcgaacagaggagacgctcaatgtgggaaccgaacctggcggcagcgcaaaagatg

SEQ ID NO: 72109 - DNA, 103 bp, Artificial Sequence
  Synthetic Polynucleotide
taatacgactcactatagggtaagtacggcacgaaaacggttcccatgataacagaggagaatcatgatgaccgttttcaacctggcggcagcgcaaaagatg

SEQ ID NO: 72110 - DNA, 103 bp, Artificial Sequence
  Synthetic Polynucleotide
taatacgactcactatagggactaataagtacggcacgaaaacggttcccaacagaggagagggaacatgtttcgtgccaacctggcggcagcgcaaaagatg

SEQ ID NO: 72111 - DNA, 103 bp, Artificial Sequence
  Synthetic Polynucleotide
taatacgactcactataggggttttactaataagtacggcacgaaaacggaacagaggagaccgtttatgtgccgtactaacctggcggcagcgcaaaagatg

SEQ ID NO: 72112 - DNA, 103 bp, Artificial Sequence
  Synthetic Polynucleotide
taatacgactcactatagggtactagttttactaataagtacggcacgaaaacagaggagattcgtgatgtacttattaaacctggcggcagcgcaaaagatg

SEQ ID NO: 72113 - DNA, 103 bp, Artificial Sequence
  Synthetic Polynucleotide
taatacgactcactatagggaaacaatacctatctccctctggaccgcataacagaggagaatgcggatgagagggagaaacctggcggcagcgcaaaagatg

SEQ ID NO: 72114 - DNA, 103 bp, Artificial Sequence
  Synthetic Polynucleotide
taatacgactcactatagggcacaatactagttttactaataagtacggcaacagaggagagccgtaatgattagtaaaaacctggcggcagcgcaaaagatg

SEQ ID NO: 72115 - DNA, 103 bp, Artificial Sequence
  Synthetic Polynucleotide
taatacgactcactatagggaaacacacaatactagttttactaataagtaacagaggagaacttatatgtaaaactagaacctggcggcagcgcaaaagatg

SEQ ID NO: 72116 - DNA, 103 bp, Artificial Sequence
  Synthetic Polynucleotide
taatacgactcactatagggcactaaaacacacaatactagttttactaaaacagaggagattagtaatgctagtattgaacctggcggcagcgcaaaagatg

SEQ ID NO: 72117 - DNA, 103 bp, Artificial Sequence
  Synthetic Polynucleotide
taatacgactcactataggggatatcactaaaacacacaatactagttttaacagaggagaaaaactatgattgtgtgtaacctggcggcagcgcaaaagatg

SEQ ID NO: 72118 - DNA, 103 bp, Artificial Sequence
  Synthetic Polynucleotide
taatacgactcactatagggcatttgatatcactaaaacacacaatactaaacagaggagatagtatatggtgttttagaacctggcggcagcgcaaaagatg

SEQ ID NO: 72119 - DNA, 103 bp, Artificial Sequence
  Synthetic Polynucleotide
taatacgactcactatagggatatccatttgatatcactaaaacacacaaaacagaggagattgtgtatgttagtgataaacctggcggcagcgcaaaagatg

SEQ ID NO: 72120 - DNA, 103 bp, Artificial Sequence
  Synthetic Polynucleotide
taatacgactcactatagggtggcaatatccatttgatatcactaaaacaaacagaggagatgttttatggatatcaaaaacctggcggcagcgcaaaagatg

SEQ ID NO: 72121 - DNA, 103 bp, Artificial Sequence
  Synthetic Polynucleotide
taatacgactcactataggggtacgtggcaatatccatttgatatcactaaacagaggagatagtgaatgcaaatggataacctggcggcagcgcaaaagatg

SEQ ID NO: 72122 - DNA, 103 bp, Artificial Sequence
  Synthetic Polynucleotide
taatacgactcactatagggtaaaggtacgtggcaatatccatttgatataacagaggagaatatcaatgggatattgcaacctggcggcagcgcaaaagatg

SEQ ID NO: 72123 - DNA, 103 bp, Artificial Sequence
  Synthetic Polynucleotide
taatacgactcactatagggtattttaaaggtacgtggcaatatccatttaacagaggagaaaatggatgttgccacgtaacctggcggcagcgcaaaagatg

SEQ ID NO: 72124 - DNA, 103 bp, Artificial Sequence
  Synthetic Polynucleotide
taatacgactcactatagggattgtggcaaagattgcacatgtattctataacagaggagaatagaaatgatgtgcaataacctggcggcagcgcaaaagatg

SEQ ID NO: 72125 - DNA, 103 bp, Artificial Sequence
  Synthetic Polynucleotide
taatacgactcactatagggcgtgaaaacaatacctatctccctctggacaacagaggagagtccagatggagataggtaacctggcggcagcgcaaaagatg

SEQ ID NO: 72126 - DNA, 103 bp, Artificial Sequence
  Synthetic Polynucleotide
taatacgactcactatagggctatatattttaaaggtacgtggcaatatcaacagaggagagatattatgacgtaccttaacctggcggcagcgcaaaagatg

SEQ ID NO: 72127 - DNA, 103 bp, Artificial Sequence
  Synthetic Polynucleotide
taatacgactcactatagggtaatactatatattttaaaggtacgtggcaaacagaggagatgccacatgcctttaaaaaacctggcggcagcgcaaaagatg

SEQ ID NO: 72128 - DNA, 103 bp, Artificial Sequence
  Synthetic Polynucleotide
taatacgactcactatagggatcattaatactatatattttaaaggtacgaacagaggagacgtaccatgaaaatatataacctggcggcagcgcaaaagatg

SEQ ID NO: 72129 - DNA, 103 bp, Artificial Sequence
  Synthetic Polynucleotide
taatacgactcactataggggggcaatcattaatactatatattttaaagaacagaggagactttaaatgatatagtataacctggcggcagcgcaaaagatg

SEQ ID NO: 72130 - DNA, 103 bp, Artificial Sequence
  Synthetic Polynucleotide
taatacgactcactatagggtctatgggcaatcattaatactatatatttaacagaggagaaaatatatggtattaatgaacctggcggcagcgcaaaagatg

SEQ ID NO: 72131 - DNA, 103 bp, Artificial Sequence
  Synthetic Polynucleotide
taatacgactcactatagggaatactctatgggcaatcattaatactataaacagaggagatatagtatgaatgattgcaacctggcggcagcgcaaaagatg

SEQ ID NO: 72132 - DNA, 103 bp, Artificial Sequence
  Synthetic Polynucleotide
taatacgactcactatagggacaataatactctatgggcaatcattaataaacagaggagatattaaatgttgcccataaacctggcggcagcgcaaaagatg

SEQ ID NO: 72133 - DNA, 103 bp, Artificial Sequence
  Synthetic Polynucleotide
taatacgactcactataggggctcgacaataatactctatgggcaatcataacagaggagaatgattatgcatagagtaaacctggcggcagcgcaaaagatg

SEQ ID NO: 72134 - DNA, 103 bp, Artificial Sequence
  Synthetic Polynucleotide
taatacgactcactatagggactatgctcgacaataatactctatgggcaaacagaggagatgcccaatgagtattattaacctggcggcagcgcaaaagatg

SEQ ID NO: 72135 - DNA, 103 bp, Artificial Sequence
  Synthetic Polynucleotide
taatacgactcactatagggattctactatgctcgacaataatactctataacagaggagaatagagatgtattgtcgaaacctggcggcagcgcaaaagatg

SEQ ID NO: 72136 - DNA, 103 bp, Artificial Sequence
  Synthetic Polynucleotide
taatacgactcactataggggataccgtgaaaacaatacctatctccctcaacagaggagagagggaatgaggtattgtaacctggcggcagcgcaaaagatg

SEQ ID NO: 72137 - DNA, 103 bp, Artificial Sequence
  Synthetic Polynucleotide
taatacgactcactatagggagtagattctactatgctcgacaataatacaacagaggagagtattaatgtcgagcataaacctggcggcagcgcaaaagatg

SEQ ID NO: 72138 - DNA, 103 bp, Artificial Sequence
  Synthetic Polynucleotide
taatacgactcactatagggaatgtagtagattctactatgctcgacaataacagaggagaattgtcatgcatagtagaaacctggcggcagcgcaaaagatg

SEQ ID NO: 72139 - DNA, 103 bp, Artificial Sequence
  Synthetic Polynucleotide
taatacgactcactatagggtgtctaatgtagtagattctactatgctcgaacagaggagacgagcaatgtagaatctaaacctggcggcagcgcaaaagatg

SEQ ID NO: 72140 - DNA, 103 bp, Artificial Sequence
  Synthetic Polynucleotide
taatacgactcactatagggaggtatgtctaatgtagtagattctactataacagaggagaatagtaatgtctactacaaacctggcggcagcgcaaaagatg

SEQ ID NO: 72141 - DNA, 103 bp, Artificial Sequence
  Synthetic Polynucleotide
taatacgactcactatagggagatcaggtatgtctaatgtagtagattctaacagaggagaagaatcatgtacattagaaacctggcggcagcgcaaaagatg

SEQ ID NO: 72142 - DNA, 103 bp, Artificial Sequence
  Synthetic Polynucleotide
taatacgactcactatagggaacgtagatcaggtatgtctaatgtagtagaacagaggagactactaatgtagacatacaacctggcggcagcgcaaaagatg

SEQ ID NO: 72143 - DNA, 103 bp, Artificial Sequence
  Synthetic Polynucleotide
taatacgactcactatagggagtagaacgtagatcaggtatgtctaatgtaacagaggagaacattaatgatacctgataacctggcggcagcgcaaaagatg

SEQ ID NO: 72144 - DNA, 103 bp, Artificial Sequence
  Synthetic Polynucleotide
taatacgactcactatagggtccatagtagaacgtagatcaggtatgtctaacagaggagaagacatatgtgatctacgaacctggcggcagcgcaaaagatg

SEQ ID NO: 72145 - DNA, 103 bp, Artificial Sequence
  Synthetic Polynucleotide
taatacgactcactatagggttaattccatagtagaacgtagatcaggtaaacagaggagatacctgatgtacgttctaaacctggcggcagcgcaaaagatg

SEQ ID NO: 72146 - DNA, 103 bp, Artificial Sequence
  Synthetic Polynucleotide
taatacgactcactatagggtaaaattaattccatagtagaacgtagatcaacagaggagagatctaatgtctactatgaacctggcggcagcgcaaaagatg

SEQ ID NO: 72147 - DNA, 103 bp, Artificial Sequence
  Synthetic Polynucleotide
taatacgactcactatagggatacagataccgtgaaaacaatacctatctaacagaggagaagatagatgttgttttcaaacctggcggcagcgcaaaagatg

SEQ ID NO: 72148 - DNA, 103 bp, Artificial Sequence
  Synthetic Polynucleotide
taatacgactcactataggggttaataaaattaattccatagtagaacgtaacagaggagaacgttcatgtatggaattaacctggcggcagcgcaaaagatg

SEQ ID NO: 72149 - DNA, 103 bp, Artificial Sequence
  Synthetic Polynucleotide
taatacgactcactatagggatgcggttaataaaattaattccatagtagaacagaggagactactaatgaattaatttaacctggcggcagcgcaaaagatg

SEQ ID NO: 72150 - DNA, 103 bp, Artificial Sequence
  Synthetic Polynucleotide
taatacgactcactatagggacgagatgcggttaataaaattaattccataacagaggagaatggaaatgattttattaaacctggcggcagcgcaaaagatg

SEQ ID NO: 72151 - DNA, 103 bp, Artificial Sequence
  Synthetic Polynucleotide
taatacgactcactatagggtttagacgagatgcggttaataaaattaataacagaggagaattaatatgattaaccgcaacctggcggcagcgcaaaagatg

SEQ ID NO: 72152 - DNA, 103 bp, Artificial Sequence
  Synthetic Polynucleotide
taatacgactcactatagggtaaactttagacgagatgcggttaataaaaaacagaggagattttatatgccgcatctcaacctggcggcagcgcaaaagatg

SEQ ID NO: 72153 - DNA, 103 bp, Artificial Sequence
  Synthetic Polynucleotide
taatacgactcactatagggtagattaaactttagacgagatgcggttaaaacagaggagattaaccatgtctcgtctaaacctggcggcagcgcaaaagatg

SEQ ID NO: 72154 - DNA, 103 bp, Artificial Sequence
  Synthetic Polynucleotide
taatacgactcactatagggctatatagattaaactttagacgagatgcgaacagaggagacgcatcatgtctaaagttaacctggcggcagcgcaaaagatg

SEQ ID NO: 72155 - DNA, 103 bp, Artificial Sequence
  Synthetic Polynucleotide
taatacgactcactatagggtcggcctatatagattaaactttagacgagaacagaggagactcgtcatgagtttaatcaacctggcggcagcgcaaaagatg

SEQ ID NO: 72156 - DNA, 103 bp, Artificial Sequence
  Synthetic Polynucleotide
taatacgactcactatagggtagattcggcctatatagattaaactttagaacagaggagactaaagatgaatctatataacctggcggcagcgcaaaagatg

SEQ ID NO: 72157 - DNA, 103 bp, Artificial Sequence
  Synthetic Polynucleotide
taatacgactcactatagggtatcatagattcggcctatatagattaaacaacagaggagagtttaaatgatataggccaacctggcggcagcgcaaaagatg

SEQ ID NO: 72158 - DNA, 103 bp, Artificial Sequence
  Synthetic Polynucleotide
taatacgactcactatagggcgtggatacagataccgtgaaaacaataccaacagaggagaggtattatgttcacggtaaacctggcggcagcgcaaaagatg

SEQ ID NO: 72159 - DNA, 103 bp, Artificial Sequence
  Synthetic Polynucleotide
taatacgactcactatagggaacaatatcatagattcggcctatatagataacagaggagaatctatatgggccgaatcaacctggcggcagcgcaaaagatg

SEQ ID NO: 72160 - DNA, 103 bp, Artificial Sequence
  Synthetic Polynucleotide
taatacgactcactatagggttatcaacaatatcatagattcggcctataaacagaggagatataggatgaatctatgaaacctggcggcagcgcaaaagatg

SEQ ID NO: 72161 - DNA, 103 bp, Artificial Sequence
  Synthetic Polynucleotide
taatacgactcactatagggtcgtattatcaacaatatcatagattcggcaacagaggagagccgaaatgatgatattgaacctggcggcagcgcaaaagatg

SEQ ID NO: 72162 - DNA, 103 bp, Artificial Sequence
  Synthetic Polynucleotide
taatacgactcactatagggaaccgtcgtattatcaacaatatcatagataacagaggagaatctatatgattgttgataacctggcggcagcgcaaaagatg

SEQ ID NO: 72163 - DNA, 103 bp, Artificial Sequence
  Synthetic Polynucleotide
taatacgactcactatagggtattaaaccgtcgtattatcaacaatatcaaacagaggagatgatatatgtgataatacaacctggcggcagcgcaaaagatg

SEQ ID NO: 72164 - DNA, 103 bp, Artificial Sequence
  Synthetic Polynucleotide
taatacgactcactataggggtgtgtattaaaccgtcgtattatcaacaaaacagaggagattgttgatgatacgacggaacctggcggcagcgcaaaagatg

SEQ ID NO: 72165 - DNA, 103 bp, Artificial Sequence
  Synthetic Polynucleotide
taatacgactcactatagggatactgtgtgtattaaaccgtcgtattatcaacagaggagagataatatgacggtttaaaacctggcggcagcgcaaaagatg

SEQ ID NO: 72166 - DNA, 103 bp, Artificial Sequence
  Synthetic Polynucleotide
taatacgactcactatagggagataatactgtgtgtattaaaccgtcgtaaacagaggagatacgacatgttaatacacaacctggcggcagcgcaaaagatg

SEQ ID NO: 72167 - DNA, 103 bp, Artificial Sequence
  Synthetic Polynucleotide
taatacgactcactatagggttcgtagataatactgtgtgtattaaaccgaacagaggagacggtttatgacacacagtaacctggcggcagcgcaaaagatg

SEQ ID NO: 72168 - DNA, 103 bp, Artificial Sequence
  Synthetic Polynucleotide
taatacgactcactatagggaaagtttcgtagataatactgtgtgtattaaacagaggagataatacatgcagtattataacctggcggcagcgcaaaagatg

SEQ ID NO: 72169 - DNA, 103 bp, Artificial Sequence
  Synthetic Polynucleotide
taatacgactcactatagggtctagcgtggatacagataccgtgaaaacaaacagaggagatgttttatgggtatctgtaacctggcggcagcgcaaaagatg

SEQ ID NO: 72170 - DNA, 103 bp, Artificial Sequence
  Synthetic Polynucleotide
taatacgactcactatagggttatcaaagtttcgtagataatactgtgtgaacagaggagacacacaatgttatctacgaacctggcggcagcgcaaaagatg

SEQ ID NO: 72171 - DNA, 103 bp, Artificial Sequence
  Synthetic Polynucleotide
taatacgactcactatagggctaacttatcaaagtttcgtagataatactaacagaggagaagtattatgtacgaaactaacctggcggcagcgcaaaagatg

SEQ ID NO: 72172 - DNA, 103 bp, Artificial Sequence
  Synthetic Polynucleotide
taatacgactcactatagggctgatctaacttatcaaagtttcgtagataaacagaggagatatctaatgaactttgataacctggcggcagcgcaaaagatg

SEQ ID NO: 72173 - DNA, 103 bp, Artificial Sequence
  Synthetic Polynucleotide
taatacgactcactataggggtacactgatctaacttatcaaagtttcgtaacagaggagaacgaaaatgtgataagttaacctggcggcagcgcaaaagatg

SEQ ID NO: 72174 - DNA, 103 bp, Artificial Sequence
  Synthetic Polynucleotide
taatacgactcactatagggtatacgtacactgatctaacttatcaaagtaacagaggagaactttgatgagttagatcaacctggcggcagcgcaaaagatg

SEQ ID NO: 72175 - DNA, 103 bp, Artificial Sequence
  Synthetic Polynucleotide
taatacgactcactatagggctaaatatacgtacactgatctaacttatcaacagaggagagataagatggatcagtgtaacctggcggcagcgcaaaagatg

SEQ ID NO: 72176 - DNA, 103 bp, Artificial Sequence
  Synthetic Polynucleotide
taatacgactcactatagggaacatctaaatatacgtacactgatctaacaacagaggagagttagaatggtgtacgtaaacctggcggcagcgcaaaagatg

SEQ ID NO: 72177 - DNA, 103 bp, Artificial Sequence
  Synthetic Polynucleotide
taatacgactcactatagggccaaaaacatctaaatatacgtacactgataacagaggagaatcagtatgcgtatatttaacctggcggcagcgcaaaagatg

SEQ ID NO: 72178 - DNA, 103 bp, Artificial Sequence
  Synthetic Polynucleotide
taatacgactcactatagggctaagccaaaaacatctaaatatacgtacaaacagaggagatgtacgatgatttagatgaacctggcggcagcgcaaaagatg

SEQ ID NO: 72179 - DNA, 103 bp, Artificial Sequence
  Synthetic Polynucleotide
taatacgactcactatagggattagctaagccaaaaacatctaaatatacaacagaggagagtatatatggatgtttttaacctggcggcagcgcaaaagatg

SEQ ID NO: 72180 - DNA, 103 bp, Artificial Sequence
  Synthetic Polynucleotide
taatacgactcactatagggatatctctagcgtggatacagataccgtgaaacagaggagatcacggatgctgtatccaaacctggcggcagcgcaaaagatg

SEQ ID NO: 72181 - DNA, 103 bp, Artificial Sequence
  Synthetic Polynucleotide
taatacgactcactatagggtcaggattagctaagccaaaaacatctaaaaacagaggagatttagaatgttttggcttaacctggcggcagcgcaaaagatg

SEQ ID NO: 72182 - DNA, 103 bp, Artificial Sequence
  Synthetic Polynucleotide
taatacgactcactatagggtaatatcaggattagctaagccaaaaacataacagaggagaatgtttatggcttagctaaacctggcggcagcgcaaaagatg

SEQ ID NO: 72183 - DNA, 103 bp, Artificial Sequence
  Synthetic Polynucleotide
taatacgactcactatagggagaattaatatcaggattagctaagccaaaaacagaggagatttggcatggctaatcctaacctggcggcagcgcaaaagatg

SEQ ID NO: 72184 - DNA, 103 bp, Artificial Sequence
  Synthetic Polynucleotide
taatacgactcactatagggtttacagaattaatatcaggattagctaagaacagaggagacttagcatgtcctgatataacctggcggcagcgcaaaagatg

SEQ ID NO: 72185 - DNA, 103 bp, Artificial Sequence
  Synthetic Polynucleotide
taatacgactcactatagggcagcatttacagaattaatatcaggattagaacagaggagactaatcatgatattaattaacctggcggcagcgcaaaagatg

SEQ ID NO: 72186 - DNA, 103 bp, Artificial Sequence
  Synthetic Polynucleotide
taatacgactcactataggggggtccagcatttacagaattaatatcaggaacagaggagacctgatatgaattctgtaaacctggcggcagcgcaaaagatg

SEQ ID NO: 72187 - DNA, 103 bp, Artificial Sequence
  Synthetic Polynucleotide
taatacgactcactataggggatctgggtccagcatttacagaattaataaacagaggagatattaaatgtgtaaatgcaacctggcggcagcgcaaaagatg

SEQ ID NO: 72188 - DNA, 103 bp, Artificial Sequence
  Synthetic Polynucleotide
taatacgactcactatagggaaatagatctgggtccagcatttacagaataacagaggagaattctgatgatgctggacaacctggcggcagcgcaaaagatg

SEQ ID NO: 72189 - DNA, 103 bp, Artificial Sequence
  Synthetic Polynucleotide
taatacgactcactataggggagaaaaatagatctgggtccagcatttacaacagaggagagtaaatatgggacccagaaacctggcggcagcgcaaaagatg

SEQ ID NO: 72190 - DNA, 103 bp, Artificial Sequence
  Synthetic Polynucleotide
taatacgactcactataggggatttgagaaaaatagatctgggtccagcaaacagaggagatgctggatgcagatctataacctggcggcagcgcaaaagatg

SEQ ID NO: 72191 - DNA, 103 bp, Artificial Sequence
  Synthetic Polynucleotide
taatacgactcactatagggcgtcaatatctctagcgtggatacagatacaacagaggagagtatctatgtccacgctaaacctggcggcagcgcaaaagatg

SEQ ID NO: 72192 - DNA, 103 bp, Artificial Sequence
  Synthetic Polynucleotide
taatacgactcactatagggctatggatttgagaaaaatagatctgggtcaacagaggagagacccaatgctatttttcaacctggcggcagcgcaaaagatg

SEQ ID NO: 72193 - DNA, 103 bp, Artificial Sequence
  Synthetic Polynucleotide
taatacgactcactataggggaagactatggatttgagaaaaatagatctaacagaggagaagatctatgtttctcaaaaacctggcggcagcgcaaaagatg

SEQ ID NO: 72194 - DNA, 103 bp, Artificial Sequence
  Synthetic Polynucleotide
taatacgactcactatagggttattgaagactatggatttgagaaaaataaacagaggagatattttatgcaaatccataacctggcggcagcgcaaaagatg

SEQ ID NO: 72195 - DNA, 103 bp, Artificial Sequence
  Synthetic Polynucleotide
taatacgactcactatagggtagaattattgaagactatggatttgagaaaacagaggagattctcaatgccatagtctaacctggcggcagcgcaaaagatg

SEQ ID NO: 72196 - DNA, 103 bp, Artificial Sequence
  Synthetic Polynucleotide
taatacgactcactatagggtaaagtagaattattgaagactatggatttaacagaggagaaaatccatggtcttcaataacctggcggcagcgcaaaagatg

SEQ ID NO: 72197 - DNA, 103 bp, Artificial Sequence
  Synthetic Polynucleotide
taatacgactcactatagggaatactaaagtagaattattgaagactatgaacagaggagacatagtatgcaataattcaacctggcggcagcgcaaaagatg

SEQ ID NO: 72198 - DNA, 103 bp, Artificial Sequence
  Synthetic Polynucleotide
taatacgactcactatagggcaggtaatactaaagtagaattattgaagaaacagaggagatcttcaatgattctacttaacctggcggcagcgcaaaagatg

SEQ ID NO: 72199 - DNA, 103 bp, Artificial Sequence
  Synthetic Polynucleotide
taatacgactcactatagggtgcatcaggtaatactaaagtagaattattaacagaggagaaataatatgactttagtaaacctggcggcagcgcaaaagatg

SEQ ID NO: 72200 - DNA, 103 bp, Artificial Sequence
  Synthetic Polynucleotide
taatacgactcactatagggttgcctgcatcaggtaatactaaagtagaaaacagaggagattctacatgagtattaccaacctggcggcagcgcaaaagatg

SEQ ID NO: 72201 - DNA, 103 bp, Artificial Sequence
  Synthetic Polynucleotide
taatacgactcactatagggcactattgcctgcatcaggtaatactaaagaacagaggagactttagatgtacctgatgaacctggcggcagcgcaaaagatg

SEQ ID NO: 72202 - DNA, 103 bp, Artificial Sequence
  Synthetic Polynucleotide
taatacgactcactatagggcataccgtcaatatctctagcgtggatacaaacagaggagatgtatcatggctagagataacctggcggcagcgcaaaagatg

SEQ ID NO: 72203 - DNA, 103 bp, Artificial Sequence
  Synthetic Polynucleotide
taatacgactcactatagggtatgtcactattgcctgcatcaggtaatacaacagaggagagtattaatggatgcaggcaacctggcggcagcgcaaaagatg

SEQ ID NO: 72204 - DNA, 103 bp, Artificial Sequence
  Synthetic Polynucleotide
taatacgactcactatagggatgtttatgtcactattgcctgcatcaggtaacagaggagaacctgaatgaggcaatagaacctggcggcagcgcaaaagatg

SEQ ID NO: 72205 - DNA, 103 bp, Artificial Sequence
  Synthetic Polynucleotide
taatacgactcactatagggtttctatgtttatgtcactattgcctgcataacagaggagaatgcagatgatagtgacaaacctggcggcagcgcaaaagatg

SEQ ID NO: 72206 - DNA, 103 bp, Artificial Sequence
  Synthetic Polynucleotide
taatacgactcactatagggttcgttttctatgtttatgtcactattgccaacagaggagaggcaatatggacataaacaacctggcggcagcgcaaaagatg

SEQ ID NO: 72207 - DNA, 103 bp, Artificial Sequence
  Synthetic Polynucleotide
taatacgactcactatagggggctattcgttttctatgtttatgtcactaaacagaggagatagtgaatgaaacatagaaacctggcggcagcgcaaaagatg

SEQ ID NO: 72208 - DNA, 103 bp, Artificial Sequence
  Synthetic Polynucleotide
taatacgactcactatagggcgtttggctattcgttttctatgtttatgtaacagaggagaacataaatgtagaaaacgaacctggcggcagcgcaaaagatg

SEQ ID NO: 72209 - DNA, 103 bp, Artificial Sequence
  Synthetic Polynucleotide
taatacgactcactatagggctcgccgtttggctattcgttttctatgttaacagaggagaaacataatgaacgaatagaacctggcggcagcgcaaaagatg

SEQ ID NO: 72210 - DNA, 103 bp, Artificial Sequence
  Synthetic Polynucleotide
taatacgactcactataggggtcttctcgccgtttggctattcgttttctaacagaggagaagaaaaatgatagccaaaaacctggcggcagcgcaaaagatg

SEQ ID NO: 72211 - DNA, 103 bp, Artificial Sequence
  Synthetic Polynucleotide
taatacgactcactatagggatattgtcttctcgccgtttggctattcgtaacagaggagaacgaatatgcaaacggcgaacctggcggcagcgcaaaagatg

SEQ ID NO: 72212 - DNA, 103 bp, Artificial Sequence
  Synthetic Polynucleotide
taatacgactcactatagggtgataatattgtcttctcgccgtttggctaaacagaggagatagccaatgggcgagaagaacctggcggcagcgcaaaagatg

SEQ ID NO: 72213 - DNA, 103 bp, Artificial Sequence
  Synthetic Polynucleotide
taatacgactcactatagggcaatacataccgtcaatatctctagcgtggaacagaggagaccacgcatgagatattgaaacctggcggcagcgcaaaagatg

SEQ ID NO: 72214 - DNA, 103 bp, Artificial Sequence
  Synthetic Polynucleotide
taatacgactcactataggggaggatgataatattgtcttctcgccgtttaacagaggagaaaacggatggaagacaataacctggcggcagcgcaaaagatg

SEQ ID NO: 72215 - DNA, 103 bp, Artificial Sequence
  Synthetic Polynucleotide
taatacgactcactatagggggaatgaggatgataatattgtcttctcgcaacagaggagagcgagaatgcaatattataacctggcggcagcgcaaaagatg

SEQ ID NO: 72216 - DNA, 103 bp, Artificial Sequence
  Synthetic Polynucleotide
taatacgactcactatagggagatgggaatgaggatgataatattgtcttaacagaggagaaagacaatgttatcatccaacctggcggcagcgcaaaagatg

SEQ ID NO: 72217 - DNA, 103 bp, Artificial Sequence
  Synthetic Polynucleotide
taatacgactcactatagggattcaagatgggaatgaggatgataatattaacagaggagaaatattatgatcctcattaacctggcggcagcgcaaaagatg

SEQ ID NO: 72218 - DNA, 103 bp, Artificial Sequence
  Synthetic Polynucleotide
taatacgactcactatagggaaaatattcaagatgggaatgaggatgataaacagaggagatatcatatgcattcccataacctggcggcagcgcaaaagatg

SEQ ID NO: 72219 - DNA, 103 bp, Artificial Sequence
  Synthetic Polynucleotide
taatacgactcactataggggtataaaaatattcaagatgggaatgaggaaacagaggagatcctcaatgccatcttgaaacctggcggcagcgcaaaagatg

SEQ ID NO: 72220 - DNA, 103 bp, Artificial Sequence
  Synthetic Polynucleotide
taatacgactcactataggggtagcgtataaaaatattcaagatgggaataacagaggagaattcccatgttgaatattaacctggcggcagcgcaaaagatg

SEQ ID NO: 72221 - DNA, 103 bp, Artificial Sequence
  Synthetic Polynucleotide
taatacgactcactataggggtatagtagcgtataaaaatattcaagatgaacagaggagacatcttatgtatttttataacctggcggcagcgcaaaagatg

SEQ ID NO: 72222 - DNA, 103 bp, Artificial Sequence
  Synthetic Polynucleotide
taatacgactcactatagggtgccggtatagtagcgtataaaaatattcaaacagaggagatgaataatgttatacgctaacctggcggcagcgcaaaagatg

SEQ ID NO: 72223 - DNA, 103 bp, Artificial Sequence
  Synthetic Polynucleotide
taatacgactcactatagggaccaatgccggtatagtagcgtataaaaataacagaggagaatttttatgcgctactataacctggcggcagcgcaaaagatg

SEQ ID NO: 72224 - DNA, 103 bp, Artificial Sequence
  Synthetic Polynucleotide
taatacgactcactatagggatctacaatacataccgtcaatatctctagaacagaggagactagagatgttgacggtaaacctggcggcagcgcaaaagatg

SEQ ID NO: 72225 - DNA, 103 bp, Artificial Sequence
  Synthetic Polynucleotide
taatacgactcactataggggatttaccaatgccggtatagtagcgtataaacagaggagatatacgatgctataccggaacctggcggcagcgcaaaagatg

SEQ ID NO: 72226 - DNA, 103 bp, Artificial Sequence
  Synthetic Polynucleotide
taatacgactcactataggggcaaggatttaccaatgccggtatagtagcaacagaggagagctactatgccggcattgaacctggcggcagcgcaaaagatg

SEQ ID NO: 72227 - DNA, 103 bp, Artificial Sequence
  Synthetic Polynucleotide
taatacgactcactatagggcgcctgcaaggatttaccaatgccggtataaacagaggagatataccatgattggtaaaaacctggcggcagcgcaaaagatg

SEQ ID NO: 72228 - DNA, 103 bp, Artificial Sequence
  Synthetic Polynucleotide
taatacgactcactatagggcctatcgcctgcaaggatttaccaatgccgaacagaggagacggcatatgtaaatccttaacctggcggcagcgcaaaagatg

SEQ ID NO: 72229 - DNA, 103 bp, Artificial Sequence
  Synthetic Polynucleotide
taatacgactcactataggggttcacctatcgcctgcaaggatttaccaaaacagaggagattggtaatgccttgcaggaacctggcggcagcgcaaaagatg

SEQ ID NO: 72230 - DNA, 103 bp, Artificial Sequence
  Synthetic Polynucleotide
taatacgactcactatagggacagcgttcacctatcgcctgcaaggatttaacagaggagaaaatccatgcaggcgataaacctggcggcagcgcaaaagatg

SEQ ID NO: 72231 - DNA, 103 bp, Artificial Sequence
  Synthetic Polynucleotide
taatacgactcactatagggcgtgtacagcgttcacctatcgcctgcaagaacagaggagacttgcaatggataggtgaaacctggcggcagcgcaaaagatg

SEQ ID NO: 72232 - DNA, 103 bp, Artificial Sequence
  Synthetic Polynucleotide
taatacgactcactataggggttagcgtgtacagcgttcacctatcgcctaacagaggagaaggcgaatggtgaacgctaacctggcggcagcgcaaaagatg

SEQ ID NO: 72233 - DNA, 103 bp, Artificial Sequence
  Synthetic Polynucleotide
taatacgactcactatagggctatcgttagcgtgtacagcgttcacctataacagaggagaataggtatgcgctgtacaaacctggcggcagcgcaaaagatg

SEQ ID NO: 72234 - DNA, 103 bp, Artificial Sequence
  Synthetic Polynucleotide
taatacgactcactatagggtgatactatcgttagcgtgtacagcgttcaaacagaggagatgaacgatgtacacgctaaacctggcggcagcgcaaaagatg

SEQ ID NO: 72235 - DNA, 103 bp, Artificial Sequence
  Synthetic Polynucleotide
taatacgactcactatagggcaactatttctcaaacaataacgttcaacaaacagaggagatgttgaatgttattgtttaacctggcggcagcgcaaaagatg

SEQ ID NO: 72236 - DNA, 103 bp, Artificial Sequence
  Synthetic Polynucleotide
taatacgactcactatagggtatggattgtggcaaagattgcacatgtataacagaggagaatacatatgcaatctttgaacctggcggcagcgcaaaagatg

SEQ ID NO: 72237 - DNA, 103 bp, Artificial Sequence
  Synthetic Polynucleotide
taatacgactcactatagggagagcatctacaatacataccgtcaatatcaacagaggagagatattatgggtatgtataacctggcggcagcgcaaaagatg

SEQ ID NO: 72238 - DNA, 103 bp, Artificial Sequence
  Synthetic Polynucleotide
taatacgactcactataggggttattgatactatcgttagcgtgtacagcaacagaggagagctgtaatggctaacgataacctggcggcagcgcaaaagatg

SEQ ID NO: 72239 - DNA, 103 bp, Artificial Sequence
  Synthetic Polynucleotide
taatacgactcactatagggattgtgttattgatactatcgttagcgtgtaacagaggagaacacgcatgcgatagtataacctggcggcagcgcaaaagatg

SEQ ID NO: 72240 - DNA, 103 bp, Artificial Sequence
  Synthetic Polynucleotide
taatacgactcactatagggtcatgattgtgttattgatactatcgttagaacagaggagactaacgatggtatcaataaacctggcggcagcgcaaaagatg

SEQ ID NO: 72241 - DNA, 103 bp, Artificial Sequence
  Synthetic Polynucleotide
taatacgactcactatagggtaaaatcatgattgtgttattgatactatcaacagaggagagatagtatgaataacacaaacctggcggcagcgcaaaagatg

SEQ ID NO: 72242 - DNA, 103 bp, Artificial Sequence
  Synthetic Polynucleotide
taatacgactcactatagggtaccataaaatcatgattgtgttattgataaacagaggagatatcaaatgcacaatcataacctggcggcagcgcaaaagatg

SEQ ID NO: 72243 - DNA, 103 bp, Artificial Sequence
  Synthetic Polynucleotide
taatacgactcactatagggattaataccataaaatcatgattgtgttataacagaggagaataacaatgtcatgatttaacctggcggcagcgcaaaagatg

SEQ ID NO: 72244 - DNA, 103 bp, Artificial Sequence
  Synthetic Polynucleotide
taatacgactcactatagggaaaatattaataccataaaatcatgattgtaacagaggagaacaatcatgattttatggaacctggcggcagcgcaaaagatg

SEQ ID NO: 72245 - DNA, 103 bp, Artificial Sequence
  Synthetic Polynucleotide
taatacgactcactatagggaaggtaaaatattaataccataaaatcatgaacagaggagacatgatatgatggtattaaacctggcggcagcgcaaaagatg

SEQ ID NO: 72246 - DNA, 103 bp, Artificial Sequence
  Synthetic Polynucleotide
taatacgactcactatagggaaaataaggtaaaatattaataccataaaaaacagaggagattttatatgattaatattaacctggcggcagcgcaaaagatg

SEQ ID NO: 72247 - DNA, 103 bp, Artificial Sequence
  Synthetic Polynucleotide
taatacgactcactatagggtataaaaaataaggtaaaatattaataccaaacagaggagatggtatatgtattttaccaacctggcggcagcgcaaaagatg

SEQ ID NO: 72248 - DNA, 103 bp, Artificial Sequence
  Synthetic Polynucleotide
taatacgactcactatagggccatgagagcatctacaatacataccgtcaaacagaggagatgacggatggtattgtagaacctggcggcagcgcaaaagatg

SEQ ID NO: 72249 - DNA, 103 bp, Artificial Sequence
  Synthetic Polynucleotide
taatacgactcactatagggccaaatataaaaaataaggtaaaatattaaaacagaggagattaataatgtaccttattaacctggcggcagcgcaaaagatg

SEQ ID NO: 72250 - DNA, 103 bp, Artificial Sequence
  Synthetic Polynucleotide
taatacgactcactatagggttataccaaatataaaaaataaggtaaaataacagaggagaattttaatgtattttttaaacctggcggcagcgcaaaagatg

SEQ ID NO: 72251 - DNA, 103 bp, Artificial Sequence
  Synthetic Polynucleotide
taatacgactcactatagggaatttttataccaaatataaaaaataaggtaacagaggagaaccttaatgtttatatttaacctggcggcagcgcaaaagatg

SEQ ID NO: 72252 - DNA, 103 bp, Artificial Sequence
  Synthetic Polynucleotide
taatacgactcactatagggtcaataatttttataccaaatataaaaaataacagaggagaatttttatgatttggtataacctggcggcagcgcaaaagatg

SEQ ID NO: 72253 - DNA, 103 bp, Artificial Sequence
  Synthetic Polynucleotide
taatacgactcactatagggagacatcaataatttttataccaaatataaaacagaggagattatatatggtataaaaaaacctggcggcagcgcaaaagatg

SEQ ID NO: 72254 - DNA, 103 bp, Artificial Sequence
  Synthetic Polynucleotide
taatacgactcactatagggtgtgtagacatcaataatttttataccaaaaacagaggagatttggtatgaaaattattaacctggcggcagcgcaaaagatg

SEQ ID NO: 72255 - DNA, 103 bp, Artificial Sequence
  Synthetic Polynucleotide
taatacgactcactatagggaaggatgtgtagacatcaataatttttataaacagaggagatataaaatgtattgatgtaacctggcggcagcgcaaaagatg

SEQ ID NO: 72256 - DNA, 103 bp, Artificial Sequence
  Synthetic Polynucleotide
taatacgactcactatagggtacaaaaggatgtgtagacatcaataatttaacagaggagaaaattaatgatgtctacaaacctggcggcagcgcaaaagatg

SEQ ID NO: 72257 - DNA, 103 bp, Artificial Sequence
  Synthetic Polynucleotide
taatacgactcactatagggtcaattacaaaaggatgtgtagacatcaataacagaggagaattgatatgtacacatccaacctggcggcagcgcaaaagatg

SEQ ID NO: 72258 - DNA, 103 bp, Artificial Sequence
  Synthetic Polynucleotide
taatacgactcactatagggagatgtcaattacaaaaggatgtgtagacaaacagaggagatgtctaatgatccttttgaacctggcggcagcgcaaaagatg

SEQ ID NO: 72259 - DNA, 103 bp, Artificial Sequence
  Synthetic Polynucleotide
taatacgactcactatagggtataaccatgagagcatctacaatacatacaacagaggagagtatgtatggtagatgctaacctggcggcagcgcaaaagatg

SEQ ID NO: 72260 - DNA, 103 bp, Artificial Sequence
  Synthetic Polynucleotide
taatacgactcactatagggtatatagatgtcaattacaaaaggatgtgtaacagaggagaacacatatgtttgtaattaacctggcggcagcgcaaaagatg

SEQ ID NO: 72261 - DNA, 103 bp, Artificial Sequence
  Synthetic Polynucleotide
taatacgactcactatagggaaggatatatagatgtcaattacaaaaggaaacagaggagatcctttatgaattgacataacctggcggcagcgcaaaagatg

SEQ ID NO: 72262 - DNA, 103 bp, Artificial Sequence
  Synthetic Polynucleotide
taatacgactcactatagggtacaaaaggatatatagatgtcaattacaaaacagaggagattgtaaatgacatctataaacctggcggcagcgcaaaagatg

SEQ ID NO: 72263 - DNA, 103 bp, Artificial Sequence
  Synthetic Polynucleotide
taatacgactcactataggggattatacaaaaggatatatagatgtcaataacagaggagaattgacatgtatatatccaacctggcggcagcgcaaaagatg

SEQ ID NO: 72264 - DNA, 103 bp, Artificial Sequence
  Synthetic Polynucleotide
taatacgactcactataggggaattgattatacaaaaggatatatagatgaacagaggagacatctaatgatccttttgaacctggcggcagcgcaaaagatg

SEQ ID NO: 72265 - DNA, 103 bp, Artificial Sequence
  Synthetic Polynucleotide
taatacgactcactataggggattagaattgattatacaaaaggatatataacagaggagaatatatatgtttgtataaaacctggcggcagcgcaaaagatg

SEQ ID NO: 72266 - DNA, 103 bp, Artificial Sequence
  Synthetic Polynucleotide
taatacgactcactatagggaaagtgattagaattgattatacaaaaggaaacagaggagatcctttatgataatcaataacctggcggcagcgcaaaagatg

SEQ ID NO: 72267 - DNA, 103 bp, Artificial Sequence
  Synthetic Polynucleotide
taatacgactcactatagggaagttaaagtgattagaattgattatacaaaacagaggagattgtatatgcaattctaaaacctggcggcagcgcaaaagatg

SEQ ID NO: 72268 - DNA, 103 bp, Artificial Sequence
  Synthetic Polynucleotide
taatacgactcactatagggtgtaaaagttaaagtgattagaattgattaaacagaggagataatcaatgctaatcactaacctggcggcagcgcaaaagatg

SEQ ID NO: 72269 - DNA, 103 bp, Artificial Sequence
  Synthetic Polynucleotide
taatacgactcactatagggaaaactgtaaaagttaaagtgattagaattaacagaggagaaattctatgcactttaacaacctggcggcagcgcaaaagatg

SEQ ID NO: 72270 - DNA, 103 bp, Artificial Sequence
  Synthetic Polynucleotide
taatacgactcactataggggcctgtataaccatgagagcatctacaataaacagaggagatattgtatgtgctctcataacctggcggcagcgcaaaagatg

SEQ ID NO: 72271 - DNA, 103 bp, Artificial Sequence
  Synthetic Polynucleotide
taatacgactcactatagggtagggaaaactgtaaaagttaaagtgattaaacagaggagataatcaatgtaacttttaaacctggcggcagcgcaaaagatg

SEQ ID NO: 72272 - DNA, 103 bp, Artificial Sequence
  Synthetic Polynucleotide
taatacgactcactatagggactggtagggaaaactgtaaaagttaaagtaacagaggagaactttaatgtttacagttaacctggcggcagcgcaaaagatg

SEQ ID NO: 72273 - DNA, 103 bp, Artificial Sequence
  Synthetic Polynucleotide
taatacgactcactataggggataaactggtagggaaaactgtaaaagttaacagaggagaaactttatgagttttcccaacctggcggcagcgcaaaagatg

SEQ ID NO: 72274 - DNA, 103 bp, Artificial Sequence
  Synthetic Polynucleotide
taatacgactcactatagggatagggataaactggtagggaaaactgtaaaacagaggagattacagatgtccctaccaaacctggcggcagcgcaaaagatg

SEQ ID NO: 72275 - DNA, 103 bp, Artificial Sequence
  Synthetic Polynucleotide
taatacgactcactatagggtaaatatagggataaactggtagggaaaacaacagaggagagttttcatgaccagtttaaacctggcggcagcgcaaaagatg

SEQ ID NO: 72276 - DNA, 103 bp, Artificial Sequence
  Synthetic Polynucleotide
taatacgactcactatagggtattttaaatatagggataaactggtagggaacagaggagaccctacatgtttatccctaacctggcggcagcgcaaaagatg

SEQ ID NO: 72277 - DNA, 103 bp, Artificial Sequence
  Synthetic Polynucleotide
taatacgactcactatagggatagatattttaaatatagggataaactggaacagaggagaccagttatgccctatattaacctggcggcagcgcaaaagatg

SEQ ID NO: 72278 - DNA, 103 bp, Artificial Sequence
  Synthetic Polynucleotide
taatacgactcactatagggtatgaatagatattttaaatatagggataaaacagaggagattatccatgtatttaaaaaacctggcggcagcgcaaaagatg

SEQ ID NO: 72279 - DNA, 103 bp, Artificial Sequence
  Synthetic Polynucleotide
taatacgactcactatagggatgcatatgaatagatattttaaatataggaacagaggagacctataatgaaaatatctaacctggcggcagcgcaaaagatg

SEQ ID NO: 72280 - DNA, 103 bp, Artificial Sequence
  Synthetic Polynucleotide
taatacgactcactatagggctcagatgcatatgaatagatattttaaataacagaggagaatttaaatgatctattcaaacctggcggcagcgcaaaagatg

SEQ ID NO: 72281 - DNA, 103 bp, Artificial Sequence
  Synthetic Polynucleotide
taatacgactcactatagggctaatgcctgtataaccatgagagcatctaaacagaggagatagatgatgtcatggttaaacctggcggcagcgcaaaagatg

SEQ ID NO: 72282 - DNA, 103 bp, Artificial Sequence
  Synthetic Polynucleotide
taatacgactcactataggggagtactcagatgcatatgaatagatatttaacagaggagaaaatatatgttcatatgcaacctggcggcagcgcaaaagatg

SEQ ID NO: 72283 - DNA, 103 bp, Artificial Sequence
  Synthetic Polynucleotide
taatacgactcactataggggtagagagtactcagatgcatatgaatagaaacagaggagatctattatgatgcatctgaacctggcggcagcgcaaaagatg

SEQ ID NO: 72284 - DNA, 103 bp, Artificial Sequence
  Synthetic Polynucleotide
taatacgactcactatagggtcttggtagagagtactcagatgcatatgaaacagaggagatcatatatgtctgagtacaacctggcggcagcgcaaaagatg

SEQ ID NO: 72285 - DNA, 103 bp, Artificial Sequence
  Synthetic Polynucleotide
taatacgactcactatagggagctatcttggtagagagtactcagatgcaaacagaggagatgcatcatggtactctctaacctggcggcagcgcaaaagatg

SEQ ID NO: 72286 - DNA, 103 bp, Artificial Sequence
  Synthetic Polynucleotide
taatacgactcactatagggtctgaagctatcttggtagagagtactcagaacagaggagactgagtatgctctaccaaaacctggcggcagcgcaaaagatg

SEQ ID NO: 72287 - DNA, 103 bp, Artificial Sequence
  Synthetic Polynucleotide
taatacgactcactatagggctcactctgaagctatcttggtagagagtaaacagaggagatactctatgccaagatagaacctggcggcagcgcaaaagatg

SEQ ID NO: 72288 - DNA, 103 bp, Artificial Sequence
  Synthetic Polynucleotide
taatacgactcactatagggctatcctcactctgaagctatcttggtagaaacagaggagatctaccatgatagcttcaaacctggcggcagcgcaaaagatg

SEQ ID NO: 72289 - DNA, 103 bp, Artificial Sequence
  Synthetic Polynucleotide
taatacgactcactatagggtttgactatcctcactctgaagctatcttgaacagaggagacaagatatgttcagagtgaacctggcggcagcgcaaaagatg

SEQ ID NO: 72290 - DNA, 103 bp, Artificial Sequence
  Synthetic Polynucleotide
taatacgactcactatagggatctttttgactatcctcactctgaagctaaacagaggagatagcttatgagtgaggataacctggcggcagcgcaaaagatg

SEQ ID NO: 72291 - DNA, 103 bp, Artificial Sequence
  Synthetic Polynucleotide
taatacgactcactatagggtgttgatctttttgactatcctcactctgaaacagaggagatcagagatgggatagtcaaacctggcggcagcgcaaaagatg

SEQ ID NO: 72292 - DNA, 103 bp, Artificial Sequence
  Synthetic Polynucleotide
taatacgactcactataggggacatctaatgcctgtataaccatgagagcaacagaggagagctctcatggttatacagaacctggcggcagcgcaaaagatg

SEQ ID NO: 72293 - DNA, 103 bp, Artificial Sequence
  Synthetic Polynucleotide
taatacgactcactatagggctatatgttgatctttttgactatcctcacaacagaggagagtgaggatggtcaaaaagaacctggcggcagcgcaaaagatg

SEQ ID NO: 72294 - DNA, 103 bp, Artificial Sequence
  Synthetic Polynucleotide
taatacgactcactatagggatgttctatatgttgatctttttgactatcaacagaggagagatagtatgaaagatcaaaacctggcggcagcgcaaaagatg

SEQ ID NO: 72295 - DNA, 103 bp, Artificial Sequence
  Synthetic Polynucleotide
taatacgactcactatagggtggttatgttctatatgttgatctttttgaaacagaggagatcaaaaatgtcaacatataacctggcggcagcgcaaaagatg

SEQ ID NO: 72296 - DNA, 103 bp, Artificial Sequence
  Synthetic Polynucleotide
taatacgactcactataggggagaatggttatgttctatatgttgatcttaacagaggagaaagatcatgatatagaacaacctggcggcagcgcaaaagatg

SEQ ID NO: 72297 - DNA, 103 bp, Artificial Sequence
  Synthetic Polynucleotide
taatacgactcactatagggtatacgagaatggttatgttctatatgttgaacagaggagacaacatatggaacataacaacctggcggcagcgcaaaagatg

SEQ ID NO: 72298 - DNA, 103 bp, Artificial Sequence
  Synthetic Polynucleotide
taatacgactcactatagggcaaagtatacgagaatggttatgttctataaacagaggagatatagaatgtaaccattcaacctggcggcagcgcaaaagatg

SEQ ID NO: 72299 - DNA, 103 bp, Artificial Sequence
  Synthetic Polynucleotide
taatacgactcactatagggaagggcaaagtatacgagaatggttatgttaacagaggagaaacataatgattctcgtaaacctggcggcagcgcaaaagatg

SEQ ID NO: 72300 - DNA, 103 bp, Artificial Sequence
  Synthetic Polynucleotide
taatacgactcactatagggtattaaagggcaaagtatacgagaatggttaacagaggagaaaccatatgcgtatacttaacctggcggcagcgcaaaagatg

SEQ ID NO: 72301 - DNA, 103 bp, Artificial Sequence
  Synthetic Polynucleotide
taatacgactcactatagggtgatgtattaaagggcaaagtatacgagaaaacagaggagattctcgatgactttgcccaacctggcggcagcgcaaaagatg

SEQ ID NO: 72302 - DNA, 103 bp, Artificial Sequence
  Synthetic Polynucleotide
taatacgactcactataggggtgggtgatgtattaaagggcaaagtatacaacagaggagagtatacatggccctttaaaacctggcggcagcgcaaaagatg

SEQ ID NO: 72303 - DNA, 103 bp, Artificial Sequence
  Synthetic Polynucleotide
taatacgactcactatagggatgctgacatctaatgcctgtataaccatgaacagaggagacatggtatgacaggcattaacctggcggcagcgcaaaagatg

SEQ ID NO: 72304 - DNA, 103 bp, Artificial Sequence
  Synthetic Polynucleotide
taatacgactcactatagggccaatgtgggtgatgtattaaagggcaaagaacagaggagactttgcatgttaatacataacctggcggcagcgcaaaagatg

SEQ ID NO: 72305 - DNA, 103 bp, Artificial Sequence
  Synthetic Polynucleotide
taatacgactcactataggggttgcccaatgtgggtgatgtattaaagggaacagaggagaccctttatgacatcacccaacctggcggcagcgcaaaagatg

SEQ ID NO: 72306 - DNA, 103 bp, Artificial Sequence
  Synthetic Polynucleotide
taatacgactcactatagggtattcgttgcccaatgtgggtgatgtattaaacagaggagataatacatgacccacattaacctggcggcagcgcaaaagatg

SEQ ID NO: 72307 - DNA, 103 bp, Artificial Sequence
  Synthetic Polynucleotide
taatacgactcactatagggtttgttattcgttgcccaatgtgggtgatgaacagaggagacatcacatgcattgggcaaacctggcggcagcgcaaaagatg

SEQ ID NO: 72308 - DNA, 103 bp, Artificial Sequence
  Synthetic Polynucleotide
taatacgactcactatagggtgtattttgttattcgttgcccaatgtgggaacagaggagacccacaatgggcaacgaaaacctggcggcagcgcaaaagatg

SEQ ID NO: 72309 - DNA, 103 bp, Artificial Sequence
  Synthetic Polynucleotide
taatacgactcactatagggatgcttgtattttgttattcgttgcccaataacagaggagaattgggatgcgaataacaaacctggcggcagcgcaaaagatg

SEQ ID NO: 72310 - DNA, 103 bp, Artificial Sequence
  Synthetic Polynucleotide
taatacgactcactatagggacaagatgcttgtattttgttattcgttgcaacagaggagagcaacgatgaacaaaataaacctggcggcagcgcaaaagatg

SEQ ID NO: 72311 - DNA, 103 bp, Artificial Sequence
  Synthetic Polynucleotide
taatacgactcactatagggcgttaacaagatgcttgtattttgttattcaacagaggagagaataaatgaatacaagcaacctggcggcagcgcaaaagatg

SEQ ID NO: 72312 - DNA, 103 bp, Artificial Sequence
  Synthetic Polynucleotide
taatacgactcactataggggagcccgttaacaagatgcttgtattttgtaacagaggagaacaaaaatgaagcatcttaacctggcggcagcgcaaaagatg

SEQ ID NO: 72313 - DNA, 103 bp, Artificial Sequence
  Synthetic Polynucleotide
taatacgactcactatagggtttacgagcccgttaacaagatgcttgtataacagaggagaatacaaatgtcttgttaaaacctggcggcagcgcaaaagatg

SEQ ID NO: 72314 - DNA, 103 bp, Artificial Sequence
  Synthetic Polynucleotide
taatacgactcactatagggactacatgctgacatctaatgcctgtataaaacagaggagattatacatgcattagatgaacctggcggcagcgcaaaagatg

SEQ ID NO: 72315 - DNA, 103 bp, Artificial Sequence
  Synthetic Polynucleotide
taatacgactcactatagggcccaatttacgagcccgttaacaagatgctaacagaggagaagcatcatgttaacgggcaacctggcggcagcgcaaaagatg

SEQ ID NO: 72316 - DNA, 103 bp, Artificial Sequence
  Synthetic Polynucleotide
taatacgactcactatagggtttatcccaatttacgagcccgttaacaagaacagaggagacttgttatggggctcgtaaacctggcggcagcgcaaaagatg

SEQ ID NO: 72317 - DNA, 103 bp, Artificial Sequence
  Synthetic Polynucleotide
taatacgactcactatagggtaatttttatcccaatttacgagcccgttaaacagaggagataacggatgcgtaaattgaacctggcggcagcgcaaaagatg

SEQ ID NO: 72318 - DNA, 103 bp, Artificial Sequence
  Synthetic Polynucleotide
taatacgactcactatagggaaacataatttttatcccaatttacgagccaacagaggagaggctcgatgattgggataaacctggcggcagcgcaaaagatg

SEQ ID NO: 72319 - DNA, 103 bp, Artificial Sequence
  Synthetic Polynucleotide
taatacgactcactatagggaataaaaacataatttttatcccaatttacaacagaggagagtaaatatggataaaaataacctggcggcagcgcaaaagatg

SEQ ID NO: 72320 - DNA, 103 bp, Artificial Sequence
  Synthetic Polynucleotide
taatacgactcactatagggaaaataataaaaacataatttttatcccaaaacagaggagattgggaatgaaattatgtaacctggcggcagcgcaaaagatg

SEQ ID NO: 72321 - DNA, 103 bp, Artificial Sequence
  Synthetic Polynucleotide
taatacgactcactatagggaatataaaataataaaaacataatttttataacagaggagaataaaaatgatgtttttaaacctggcggcagcgcaaaagatg

SEQ ID NO: 72322 - DNA, 103 bp, Artificial Sequence
  Synthetic Polynucleotide
taatacgactcactatagggaaatgaatataaaataataaaaacataattaacagaggagaaattatatgtttattattaacctggcggcagcgcaaaagatg

SEQ ID NO: 72323 - DNA, 103 bp, Artificial Sequence
  Synthetic Polynucleotide
taatacgactcactatagggatattaaatgaatataaaataataaaaacaaacagaggagatgttttatgtattttataaacctggcggcagcgcaaaagatg

SEQ ID NO: 72324 - DNA, 103 bp, Artificial Sequence
  Synthetic Polynucleotide
taatacgactcactatagggaatgaatattaaatgaatataaaataataaaacagaggagattattaatgtatattcataacctggcggcagcgcaaaagatg

SEQ ID NO: 72325 - DNA, 103 bp, Artificial Sequence
  Synthetic Polynucleotide
taatacgactcactatagggctaatactacatgctgacatctaatgcctgaacagaggagacaggcaatggatgtcagcaacctggcggcagcgcaaaagatg

SEQ ID NO: 72326 - DNA, 103 bp, Artificial Sequence
  Synthetic Polynucleotide
taatacgactcactatagggtattgaatgaatattaaatgaatataaaataacagaggagaattttaatgtcatttaataacctggcggcagcgcaaaagatg

SEQ ID NO: 72327 - DNA, 103 bp, Artificial Sequence
  Synthetic Polynucleotide
taatacgactcactataggggtaaatattgaatgaatattaaatgaatataacagaggagaatattcatgtaatattcaaacctggcggcagcgcaaaagatg

SEQ ID NO: 72328 - DNA, 103 bp, Artificial Sequence
  Synthetic Polynucleotide
taatacgactcactatagggatattgtaaatattgaatgaatattaaatgaacagaggagacatttaatgttcattcaaaacctggcggcagcgcaaaagatg

SEQ ID NO: 72329 - DNA, 103 bp, Artificial Sequence
  Synthetic Polynucleotide
taatacgactcactatagggtacatatattgtaaatattgaatgaatattaacagaggagaaatattatgtcaatatttaacctggcggcagcgcaaaagatg

SEQ ID NO: 72330 - DNA, 103 bp, Artificial Sequence
  Synthetic Polynucleotide
taatacgactcactatagggatgattacatatattgtaaatattgaatgaaacagaggagatcattcatgatttacaataacctggcggcagcgcaaaagatg

SEQ ID NO: 72331 - DNA, 103 bp, Artificial Sequence
  Synthetic Polynucleotide
taatacgactcactatagggggataatgattacatatattgtaaatattgaacagaggagacaatatatgcaatatatgaacctggcggcagcgcaaaagatg

SEQ ID NO: 72332 - DNA, 103 bp, Artificial Sequence
  Synthetic Polynucleotide
taatacgactcactatagggaatctggataatgattacatatattgtaaaaacagaggagatttacaatgtatgtaatcaacctggcggcagcgcaaaagatg

SEQ ID NO: 72333 - DNA, 103 bp, Artificial Sequence
  Synthetic Polynucleotide
taatacgactcactatagggtgttcaatctggataatgattacatatattaacagaggagaaatataatgaatcattataacctggcggcagcgcaaaagatg

SEQ ID NO: 72334 - DNA, 103 bp, Artificial Sequence
  Synthetic Polynucleotide
taatacgactcactatagggctgtatgttcaatctggataatgattacataacagaggagaatgtaaatgttatccagaaacctggcggcagcgcaaaagatg

SEQ ID NO: 72335 - DNA, 103 bp, Artificial Sequence
  Synthetic Polynucleotide
taatacgactcactataggggcaaactgtatgttcaatctggataatgataacagaggagaatcattatgcagattgaaaacctggcggcagcgcaaaagatg

SEQ ID NO: 72336 - DNA, 103 bp, Artificial Sequence
  Synthetic Polynucleotide
taatacgactcactataggggtctactaatactacatgctgacatctaataacagaggagaattagaatgcagcatgtaaacctggcggcagcgcaaaagatg

SEQ ID NO: 72337 - DNA, 103 bp, Artificial Sequence
  Synthetic Polynucleotide
taatacgactcactatagggcaagtgcaaactgtatgttcaatctggataaacagaggagatatccaatgtgaacatacaacctggcggcagcgcaaaagatg

SEQ ID NO: 72338 - DNA, 103 bp, Artificial Sequence
  Synthetic Polynucleotide
taatacgactcactatagggcatggcaagtgcaaactgtatgttcaatctaacagaggagaagattgatgatacagtttaacctggcggcagcgcaaaagatg

SEQ ID NO: 72339 - DNA, 103 bp, Artificial Sequence
  Synthetic Polynucleotide
taatacgactcactatagggcgaatcatggcaagtgcaaactgtatgttcaacagaggagagaacatatggtttgcactaacctggcggcagcgcaaaagatg

SEQ ID NO: 72340 - DNA, 103 bp, Artificial Sequence
  Synthetic Polynucleotide
taatacgactcactatagggtataacgaatcatggcaagtgcaaactgtaaacagaggagatacagtatgcacttgccaaacctggcggcagcgcaaaagatg

SEQ ID NO: 72341 - DNA, 103 bp, Artificial Sequence
  Synthetic Polynucleotide
taatacgactcactatagggagttatataacgaatcatggcaagtgcaaaaacagaggagatttgcaatggccatgattaacctggcggcagcgcaaaagatg

SEQ ID NO: 72342 - DNA, 103 bp, Artificial Sequence
  Synthetic Polynucleotide
taatacgactcactatagggttaatagttatataacgaatcatggcaagtaacagaggagaacttgcatggattcgttaaacctggcggcagcgcaaaagatg

SEQ ID NO: 72343 - DNA, 103 bp, Artificial Sequence
  Synthetic Polynucleotide
taatacgactcactatagggtaatattaatagttatataacgaatcatggaacagaggagaccatgaatggttatataaaacctggcggcagcgcaaaagatg

SEQ ID NO: 72344 - DNA, 103 bp, Artificial Sequence
  Synthetic Polynucleotide
taatacgactcactatagggactgttaatattaatagttatataacgaataacagaggagaattcgtatgataactattaacctggcggcagcgcaaaagatg

SEQ ID NO: 72345 - DNA, 103 bp, Artificial Sequence
  Synthetic Polynucleotide
taatacgactcactatagggaacgaactgttaatattaatagttatataaaacagaggagattatatatgtattaatataacctggcggcagcgcaaaagatg

SEQ ID NO: 72346 - DNA, 103 bp, Artificial Sequence
  Synthetic Polynucleotide
taatacgactcactatagggcgttaaacgaactgttaatattaatagttaaacagaggagataactaatgatattaacaaacctggcggcagcgcaaaagatg

SEQ ID NO: 72347 - DNA, 103 bp, Artificial Sequence
  Synthetic Polynucleotide
taatacgactcactatagggatagctatggattgtggcaaagattgcacaaacagaggagatgtgcaatgtttgccacaaacctggcggcagcgcaaaagatg

SEQ ID NO: 72348 - DNA, 103 bp, Artificial Sequence
  Synthetic Polynucleotide
taatacgactcactatagggtgatagtctactaatactacatgctgacataacagaggagaatgtcaatgtgtagtattaacctggcggcagcgcaaaagatg

SEQ ID NO: 72349 - DNA, 103 bp, Artificial Sequence
  Synthetic Polynucleotide
taatacgactcactatagggatgatcgttaaacgaactgttaatattaataacagaggagaattaatatgaacagttcgaacctggcggcagcgcaaaagatg

SEQ ID NO: 72350 - DNA, 103 bp, Artificial Sequence
  Synthetic Polynucleotide
taatacgactcactatagggataatatgatcgttaaacgaactgttaataaacagaggagatattaaatgttcgtttaaaacctggcggcagcgcaaaagatg

SEQ ID NO: 72351 - DNA, 103 bp, Artificial Sequence
  Synthetic Polynucleotide
taatacgactcactatagggtaaaaataatatgatcgttaaacgaactgtaacagaggagaacagttatgttaacgatcaacctggcggcagcgcaaaagatg

SEQ ID NO: 72352 - DNA, 103 bp, Artificial Sequence
  Synthetic Polynucleotide
taatacgactcactatagggaaacataaaaataatatgatcgttaaacgaaacagaggagatcgtttatggatcatattaacctggcggcagcgcaaaagatg

SEQ ID NO: 72353 - DNA, 103 bp, Artificial Sequence
  Synthetic Polynucleotide
taatacgactcactatagggtaataaaacataaaaataatatgatcgttaaacagaggagataacgaatgtattattttaacctggcggcagcgcaaaagatg

SEQ ID NO: 72354 - DNA, 103 bp, Artificial Sequence
  Synthetic Polynucleotide
taatacgactcactatagggattattaataaaacataaaaataatatgataacagaggagaatcataatgtttttatgtaacctggcggcagcgcaaaagatg

SEQ ID NO: 72355 - DNA, 103 bp, Artificial Sequence
  Synthetic Polynucleotide
taatacgactcactatagggttacaattattaataaaacataaaaataataacagaggagaattattatgatgttttataacctggcggcagcgcaaaagatg

SEQ ID NO: 72356 - DNA, 103 bp, Artificial Sequence
  Synthetic Polynucleotide
taatacgactcactatagggatgttttacaattattaataaaacataaaaaacagaggagattttatatgttattaataaacctggcggcagcgcaaaagatg

SEQ ID NO: 72357 - DNA, 103 bp, Artificial Sequence
  Synthetic Polynucleotide
taatacgactcactatagggattgtatgttttacaattattaataaaacaaacagaggagatgttttatgaataattgtaacctggcggcagcgcaaaagatg

SEQ ID NO: 72358 - DNA, 103 bp, Artificial Sequence
  Synthetic Polynucleotide
taatacgactcactatagggatttaattgtatgttttacaattattaataaacagaggagatattaaatgttgtaaaacaacctggcggcagcgcaaaagatg

SEQ ID NO: 72359 - DNA, 103 bp, Artificial Sequence
  Synthetic Polynucleotide
taatacgactcactatagggaacgttgatagtctactaatactacatgctaacagaggagaagcatgatgtattagtagaacctggcggcagcgcaaaagatg

SEQ ID NO: 72360 - DNA, 103 bp, Artificial Sequence
  Synthetic Polynucleotide
taatacgactcactatagggtattgatttaattgtatgttttacaattataacagaggagaataattatgaaacatacaaacctggcggcagcgcaaaagatg

SEQ ID NO: 72361 - DNA, 103 bp, Artificial Sequence
  Synthetic Polynucleotide
taatacgactcactatagggctctatattgatttaattgtatgttttacaaacagaggagatgtaaaatgtacaattaaaacctggcggcagcgcaaaagatg

SEQ ID NO: 72362 - DNA, 103 bp, Artificial Sequence
  Synthetic Polynucleotide
taatacgactcactatagggccttcctctatattgatttaattgtatgttaacagaggagaaacataatgttaaatcaaaacctggcggcagcgcaaaagatg

SEQ ID NO: 72363 - DNA, 103 bp, Artificial Sequence
  Synthetic Polynucleotide
taatacgactcactatagggccgtcccttcctctatattgatttaattgtaacagaggagaacaattatgtcaatatagaacctggcggcagcgcaaaagatg

SEQ ID NO: 72364 - DNA, 103 bp, Artificial Sequence
  Synthetic Polynucleotide
taatacgactcactatagggagtatccgtcccttcctctatattgatttaaacagaggagataaatcatgatagaggaaaacctggcggcagcgcaaaagatg

SEQ ID NO: 72365 - DNA, 103 bp, Artificial Sequence
  Synthetic Polynucleotide
taatacgactcactatagggaagacagtatccgtcccttcctctatattgaacagaggagacaatatatgggaagggacaacctggcggcagcgcaaaagatg

SEQ ID NO: 72366 - DNA, 103 bp, Artificial Sequence
  Synthetic Polynucleotide
taatacgactcactatagggcacaaaagacagtatccgtcccttcctctaaacagaggagatagaggatgggacggataaacctggcggcagcgcaaaagatg

SEQ ID NO: 72367 - DNA, 103 bp, Artificial Sequence
  Synthetic Polynucleotide
taatacgactcactatagggtatctcacaaaagacagtatccgtcccttcaacagaggagagaagggatggatactgtcaacctggcggcagcgcaaaagatg

SEQ ID NO: 72368 - DNA, 103 bp, Artificial Sequence
  Synthetic Polynucleotide
taatacgactcactatagggaactatatctcacaaaagacagtatccgtcaacagaggagagacggaatgtgtcttttgaacctggcggcagcgcaaaagatg

SEQ ID NO: 72369 - DNA, 103 bp, Artificial Sequence
  Synthetic Polynucleotide
taatacgactcactataggggccataactatatctcacaaaagacagtataacagaggagaatactgatgtttgtgagaaacctggcggcagcgcaaaagatg

SEQ ID NO: 72370 - DNA, 103 bp, Artificial Sequence
  Synthetic Polynucleotide
taatacgactcactatagggttctgaacgttgatagtctactaatactacaacagaggagagtagtaatggtagactataacctggcggcagcgcaaaagatg

SEQ ID NO: 72371 - DNA, 103 bp, Artificial Sequence
  Synthetic Polynucleotide
taatacgactcactatagggtagtcgccataactatatctcacaaaagacaacagaggagagtctttatggagatatagaacctggcggcagcgcaaaagatg

SEQ ID NO: 72372 - DNA, 103 bp, Artificial Sequence
  Synthetic Polynucleotide
taatacgactcactatagggtgatttagtcgccataactatatctcacaaaacagaggagattgtgaatgatagttatgaacctggcggcagcgcaaaagatg

SEQ ID NO: 72373 - DNA, 103 bp, Artificial Sequence
  Synthetic Polynucleotide
taatacgactcactatagggtaatctgatttagtcgccataactatatctaacagaggagaagatatatgtatggcgacaacctggcggcagcgcaaaagatg

SEQ ID NO: 72374 - DNA, 103 bp, Artificial Sequence
  Synthetic Polynucleotide
taatacgactcactatagggcctcataatctgatttagtcgccataactaaacagaggagatagttaatgcgactaaataacctggcggcagcgcaaaagatg

SEQ ID NO: 72375 - DNA, 103 bp, Artificial Sequence
  Synthetic Polynucleotide
taatacgactcactatagggagcatcctcataatctgatttagtcgccataacagaggagaatggcgatgaaatcagataacctggcggcagcgcaaaagatg

SEQ ID NO: 72376 - DNA, 103 bp, Artificial Sequence
  Synthetic Polynucleotide
taatacgactcactatagggaaaacagcatcctcataatctgatttagtcaacagaggagagactaaatgagattatgaaacctggcggcagcgcaaaagatg

SEQ ID NO: 72377 - DNA, 103 bp, Artificial Sequence
  Synthetic Polynucleotide
taatacgactcactatagggagtaaaaaacagcatcctcataatctgattaacagaggagaaatcagatgatgaggatgaacctggcggcagcgcaaaagatg

SEQ ID NO: 72378 - DNA, 103 bp, Artificial Sequence
  Synthetic Polynucleotide
taatacgactcactatagggcacaaagtaaaaaacagcatcctcataatcaacagaggagagattatatggatgctgttaacctggcggcagcgcaaaagatg

SEQ ID NO: 72379 - DNA, 103 bp, Artificial Sequence
  Synthetic Polynucleotide
taatacgactcactatagggtcatccacaaagtaaaaaacagcatcctcaaacagaggagatgaggaatgtgttttttaaacctggcggcagcgcaaaagatg

SEQ ID NO: 72380 - DNA, 103 bp, Artificial Sequence
  Synthetic Polynucleotide
taatacgactcactatagggcatcatcatccacaaagtaaaaaacagcataacagaggagaatgctgatgtttactttgaacctggcggcagcgcaaaagatg

SEQ ID NO: 72381 - DNA, 103 bp, Artificial Sequence
  Synthetic Polynucleotide
taatacgactcactatagggggtttttctgaacgttgatagtctactaataacagaggagaattagtatgctatcaacgaacctggcggcagcgcaaaagatg

SEQ ID NO: 72382 - DNA, 103 bp, Artificial Sequence
  Synthetic Polynucleotide
taatacgactcactatagggtatttcatcatcatccacaaagtaaaaaacaacagaggagagtttttatgtttgtggataacctggcggcagcgcaaaagatg

SEQ ID NO: 72383 - DNA, 103 bp, Artificial Sequence
  Synthetic Polynucleotide
taatacgactcactatagggctacatatttcatcatcatccacaaagtaaaacagaggagattacttatgggatgatgaaacctggcggcagcgcaaaagatg

SEQ ID NO: 72384 - DNA, 103 bp, Artificial Sequence
  Synthetic Polynucleotide
taatacgactcactatagggcacgactacatatttcatcatcatccacaaaacagaggagattgtggatgatgatgaaaaacctggcggcagcgcaaaagatg

SEQ ID NO: 72385 - DNA, 103 bp, Artificial Sequence
  Synthetic Polynucleotide
taatacgactcactatagggggagtcacgactacatatttcatcatcatcaacagaggagagatgatatggaaatatgtaacctggcggcagcgcaaaagatg

SEQ ID NO: 72386 - DNA, 103 bp, Artificial Sequence
  Synthetic Polynucleotide
taatacgactcactatagggatgatggagtcacgactacatatttcatcaaacagaggagatgatgaatgatgtagtcgaacctggcggcagcgcaaaagatg

SEQ ID NO: 72387 - DNA, 103 bp, Artificial Sequence
  Synthetic Polynucleotide
taatacgactcactataggggatcgatgatggagtcacgactacatatttaacagaggagaaaatatatggtcgtgactaacctggcggcagcgcaaaagatg

SEQ ID NO: 72388 - DNA, 103 bp, Artificial Sequence
  Synthetic Polynucleotide
taatacgactcactatagggtattagatcgatgatggagtcacgactacaaacagaggagatgtagtatggactccatcaacctggcggcagcgcaaaagatg

SEQ ID NO: 72389 - DNA, 103 bp, Artificial Sequence
  Synthetic Polynucleotide
taatacgactcactatagggtcatctattagatcgatgatggagtcacgaaacagaggagatcgtgaatgcatcatcgaaacctggcggcagcgcaaaagatg

SEQ ID NO: 72390 - DNA, 103 bp, Artificial Sequence
  Synthetic Polynucleotide
taatacgactcactatagggtatattcatctattagatcgatgatggagtaacagaggagaactccaatgtcgatctaaaacctggcggcagcgcaaaagatg

SEQ ID NO: 72391 - DNA, 103 bp, Artificial Sequence
  Synthetic Polynucleotide
taatacgactcactatagggcgtgatatattcatctattagatcgatgataacagaggagaatcatcatgctaatagataacctggcggcagcgcaaaagatg

SEQ ID NO: 72392 - DNA, 103 bp, Artificial Sequence
  Synthetic Polynucleotide
taatacgactcactatagggtgtttggtttttctgaacgttgatagtctaaacagaggagatagactatgaacgttcagaacctggcggcagcgcaaaagatg

SEQ ID NO: 72393 - DNA, 103 bp, Artificial Sequence
  Synthetic Polynucleotide
taatacgactcactatagggctccacgtgatatattcatctattagatcgaacagaggagacgatctatgagatgaataaacctggcggcagcgcaaaagatg

SEQ ID NO: 72394 - DNA, 103 bp, Artificial Sequence
  Synthetic Polynucleotide
taatacgactcactataggggatttctccacgtgatatattcatctattaaacagaggagataatagatgaatatatcaaacctggcggcagcgcaaaagatg

SEQ ID NO: 72395 - DNA, 103 bp, Artificial Sequence
  Synthetic Polynucleotide
taatacgactcactatagggaacatgatttctccacgtgatatattcatcaacagaggagagatgaaatgatcacgtggaacctggcggcagcgcaaaagatg

SEQ ID NO: 72396 - DNA, 103 bp, Artificial Sequence
  Synthetic Polynucleotide
taatacgactcactatagggactataacatgatttctccacgtgatatataacagaggagaatatatatggtggagaaaaacctggcggcagcgcaaaagatg

SEQ ID NO: 72397 - DNA, 103 bp, Artificial Sequence
  Synthetic Polynucleotide
taatacgactcactatagggtaaacactataacatgatttctccacgtgaaacagaggagatcacgtatggaaatcatgaacctggcggcagcgcaaaagatg

SEQ ID NO: 72398 - DNA, 103 bp, Artificial Sequence
  Synthetic Polynucleotide
taatacgactcactatagggtttgttaaacactataacatgatttctccaaacagaggagatggagaatgcatgttataaacctggcggcagcgcaaaagatg

SEQ ID NO: 72399 - DNA, 103 bp, Artificial Sequence
  Synthetic Polynucleotide
taatacgactcactatagggatatctttgttaaacactataacatgatttaacagaggagaaaatcaatgtatagtgttaacctggcggcagcgcaaaagatg

SEQ ID NO: 72400 - DNA, 103 bp, Artificial Sequence
  Synthetic Polynucleotide
taatacgactcactatagggtggtaatatctttgttaaacactataacataacagaggagaatgttaatgtgtttaacaaacctggcggcagcgcaaaagatg

SEQ ID NO: 72401 - DNA, 103 bp, Artificial Sequence
  Synthetic Polynucleotide
taatacgactcactatagggacaactggtaatatctttgttaaacactataacagaggagaatagtgatgaacaaagataacctggcggcagcgcaaaagatg

SEQ ID NO: 72402 - DNA, 103 bp, Artificial Sequence
  Synthetic Polynucleotide
taatacgactcactatagggcttccacaactggtaatatctttgttaaacaacagaggagagtttaaatgagatattacaacctggcggcagcgcaaaagatg

SEQ ID NO: 72403 - DNA, 103 bp, Artificial Sequence
  Synthetic Polynucleotide
taatacgactcactatagggtgtagtgtttggtttttctgaacgttgataaacagaggagatatcaaatgtcagaaaaaaacctggcggcagcgcaaaagatg

SEQ ID NO: 72404 - DNA, 103 bp, Artificial Sequence
  Synthetic Polynucleotide
taatacgactcactatagggagagtcttccacaactggtaatatctttgtaacagaggagaacaaagatgttaccagttaacctggcggcagcgcaaaagatg

SEQ ID NO: 72405 - DNA, 103 bp, Artificial Sequence
  Synthetic Polynucleotide
taatacgactcactatagggcttgtagagtcttccacaactggtaatatcaacagaggagagatattatgagttgtggaaacctggcggcagcgcaaaagatg

SEQ ID NO: 72406 - DNA, 103 bp, Artificial Sequence
  Synthetic Polynucleotide
taatacgactcactatagggaattccttgtagagtcttccacaactggtaaacagaggagataccagatgtggaagactaacctggcggcagcgcaaaagatg

SEQ ID NO: 72407 - DNA, 103 bp, Artificial Sequence
  Synthetic Polynucleotide
taatacgactcactatagggtcatcaattccttgtagagtcttccacaacaacagaggagagttgtgatggactctacaaacctggcggcagcgcaaaagatg

SEQ ID NO: 72408 - DNA, 103 bp, Artificial Sequence
  Synthetic Polynucleotide
taatacgactcactataggggaacttcatcaattccttgtagagtcttccaacagaggagaggaagaatgtacaaggaaaacctggcggcagcgcaaaagatg

SEQ ID NO: 72409 - DNA, 103 bp, Artificial Sequence
  Synthetic Polynucleotide
taatacgactcactatagggtcatcgaacttcatcaattccttgtagagtaacagaggagaactctaatgggaattgataacctggcggcagcgcaaaagatg

SEQ ID NO: 72410 - DNA, 103 bp, Artificial Sequence
  Synthetic Polynucleotide
taatacgactcactatagggcagcatcatcgaacttcatcaattccttgtaacagaggagaacaaggatgtgatgaagtaacctggcggcagcgcaaaagatg

SEQ ID NO: 72411 - DNA, 103 bp, Artificial Sequence
  Synthetic Polynucleotide
taatacgactcactatagggtatagcagcatcatcgaacttcatcaattcaacagaggagagaattgatgaagttcgataacctggcggcagcgcaaaagatg

SEQ ID NO: 72412 - DNA, 103 bp, Artificial Sequence
  Synthetic Polynucleotide
taatacgactcactatagggtatcgtatagcagcatcatcgaacttcatcaacagaggagagatgaaatgcgatgatgcaacctggcggcagcgcaaaagatg

SEQ ID NO: 72413 - DNA, 103 bp, Artificial Sequence
  Synthetic Polynucleotide
taatacgactcactatagggcatagtatcgtatagcagcatcatcgaactaacagaggagaagttcgatgatgctgctaaacctggcggcagcgcaaaagatg

SEQ ID NO: 72414 - DNA, 103 bp, Artificial Sequence
  Synthetic Polynucleotide
taatacgactcactataggggacgttgtagtgtttggtttttctgaacgtaacagaggagaacgttcatgaaaaccaaaaacctggcggcagcgcaaaagatg

SEQ ID NO: 72415 - DNA, 103 bp, Artificial Sequence
  Synthetic Polynucleotide
taatacgactcactatagggaataccatagtatcgtatagcagcatcatcaacagaggagagatgatatggctatacgaaacctggcggcagcgcaaaagatg

SEQ ID NO: 72416 - DNA, 103 bp, Artificial Sequence
  Synthetic Polynucleotide
taatacgactcactatagggttatcaataccatagtatcgtatagcagcaaacagaggagatgctgcatgacgatactaaacctggcggcagcgcaaaagatg

SEQ ID NO: 72417 - DNA, 103 bp, Artificial Sequence
  Synthetic Polynucleotide
taatacgactcactatagggtaattttatcaataccatagtatcgtatagaacagaggagactatacatgactatggtaaacctggcggcagcgcaaaagatg

SEQ ID NO: 72418 - DNA, 103 bp, Artificial Sequence
  Synthetic Polynucleotide
taatacgactcactatagggctcattaattttatcaataccatagtatcgaacagaggagacgatacatgggtattgataacctggcggcagcgcaaaagatg

SEQ ID NO: 72419 - DNA, 103 bp, Artificial Sequence
  Synthetic Polynucleotide
taatacgactcactatagggacaatctcattaattttatcaataccatagaacagaggagactatggatgtgataaaataacctggcggcagcgcaaaagatg

SEQ ID NO: 72420 - DNA, 103 bp, Artificial Sequence
  Synthetic Polynucleotide
taatacgactcactatagggcctcgacaatctcattaattttatcaatacaacagaggagagtattgatgaaattaatgaacctggcggcagcgcaaaagatg

SEQ ID NO: 72421 - DNA, 103 bp, Artificial Sequence
  Synthetic Polynucleotide
taatacgactcactatagggcatagcctcgacaatctcattaattttatcaacagaggagagataaaatgaatgagattaacctggcggcagcgcaaaagatg

SEQ ID NO: 72422 - DNA, 103 bp, Artificial Sequence
  Synthetic Polynucleotide
taatacgactcactatagggtcactcatagcctcgacaatctcattaattaacagaggagaaattaaatggattgtcgaaacctggcggcagcgcaaaagatg

SEQ ID NO: 72423 - DNA, 103 bp, Artificial Sequence
  Synthetic Polynucleotide
taatacgactcactatagggctccttcactcatagcctcgacaatctcataacagaggagaatgagaatgtcgaggctaaacctggcggcagcgcaaaagatg

SEQ ID NO: 72424 - DNA, 103 bp, Artificial Sequence
  Synthetic Polynucleotide
taatacgactcactataggggtggtctccttcactcatagcctcgacaataacagaggagaattgtcatggctatgagtaacctggcggcagcgcaaaagatg

SEQ ID NO: 72425 - DNA, 103 bp, Artificial Sequence
  Synthetic Polynucleotide
taatacgactcactatagggtatatgacgttgtagtgtttggtttttctgaacagaggagacagaaaatgcaaacactaaacctggcggcagcgcaaaagatg

SEQ ID NO: 72426 - DNA, 103 bp, Artificial Sequence
  Synthetic Polynucleotide
taatacgactcactatagggatgtagtggtctccttcactcatagcctcgaacagaggagacgaggcatggagtgaaggaacctggcggcagcgcaaaagatg

SEQ ID NO: 72427 - DNA, 103 bp, Artificial Sequence
  Synthetic Polynucleotide
taatacgactcactataggggattgatgtagtggtctccttcactcatagaacagaggagactatgaatgaaggagaccaacctggcggcagcgcaaaagatg

SEQ ID NO: 72428 - DNA, 103 bp, Artificial Sequence
  Synthetic Polynucleotide
taatacgactcactatagggtgtaagattgatgtagtggtctccttcactaacagaggagaagtgaaatggaccactacaacctggcggcagcgcaaaagatg

SEQ ID NO: 72429 - DNA, 103 bp, Artificial Sequence
  Synthetic Polynucleotide
taatacgactcactatagggacttctgtaagattgatgtagtggtctcctaacagaggagaaggagaatgctacatcaaaacctggcggcagcgcaaaagatg

SEQ ID NO: 72430 - DNA, 103 bp, Artificial Sequence
  Synthetic Polynucleotide
taatacgactcactatagggcatgaacttctgtaagattgatgtagtggtaacagaggagaaccactatgtcaatcttaaacctggcggcagcgcaaaagatg

SEQ ID NO: 72431 - DNA, 103 bp, Artificial Sequence
  Synthetic Polynucleotide
taatacgactcactatagggctgatcatgaacttctgtaagattgatgtaaacagaggagatacatcatgcttacagaaaacctggcggcagcgcaaaagatg

SEQ ID NO: 72432 - DNA, 103 bp, Artificial Sequence
  Synthetic Polynucleotide
taatacgactcactatagggctttcctgatcatgaacttctgtaagattgaacagaggagacaatctatgagaagttcaaacctggcggcagcgcaaaagatg

SEQ ID NO: 72433 - DNA, 103 bp, Artificial Sequence
  Synthetic Polynucleotide
taatacgactcactatagggatagactttcctgatcatgaacttctgtaaaacagaggagattacagatgttcatgatcaacctggcggcagcgcaaaagatg

SEQ ID NO: 72434 - DNA, 103 bp, Artificial Sequence
  Synthetic Polynucleotide
taatacgactcactatagggagcgaatagactttcctgatcatgaacttcaacagaggagagaagttatggatcaggaaaacctggcggcagcgcaaaagatg

SEQ ID NO: 72435 - DNA, 103 bp, Artificial Sequence
  Synthetic Polynucleotide
taatacgactcactatagggatggtagcgaatagactttcctgatcatgaaacagaggagatcatgaatgggaaagtctaacctggcggcagcgcaaaagatg

SEQ ID NO: 72436 - DNA, 103 bp, Artificial Sequence
  Synthetic Polynucleotide
taatacgactcactatagggtgggatatatgacgttgtagtgtttggtttaacagaggagaaaaccaatgactacaacgaacctggcggcagcgcaaaagatg

SEQ ID NO: 72437 - DNA, 103 bp, Artificial Sequence
  Synthetic Polynucleotide
taatacgactcactatagggttcctatggtagcgaatagactttcctgataacagaggagaatcaggatggtctattcgaacctggcggcagcgcaaaagatg

SEQ ID NO: 72438 - DNA, 103 bp, Artificial Sequence
  Synthetic Polynucleotide
taatacgactcactatagggacatattcctatggtagcgaatagactttcaacagaggagagaaagtatgttcgctaccaacctggcggcagcgcaaaagatg

SEQ ID NO: 72439 - DNA, 103 bp, Artificial Sequence
  Synthetic Polynucleotide
taatacgactcactatagggttagcacatattcctatggtagcgaatagaaacagaggagatctattatgtaccataggaacctggcggcagcgcaaaagatg

SEQ ID NO: 72440 - DNA, 103 bp, Artificial Sequence
  Synthetic Polynucleotide
taatacgactcactatagggtgattttagcacatattcctatggtagcgaaacagaggagatcgctaatgtaggaatataacctggcggcagcgcaaaagatg

SEQ ID NO: 72441 - DNA, 103 bp, Artificial Sequence
  Synthetic Polynucleotide
taatacgactcactatagggttcagtgattttagcacatattcctatggtaacagaggagaaccataatgatatgtgctaacctggcggcagcgcaaaagatg

SEQ ID NO: 72442 - DNA, 103 bp, Artificial Sequence
  Synthetic Polynucleotide
taatacgactcactatagggcaatgttcagtgattttagcacatattcctaacagaggagaaggaatatgtgctaaaataacctggcggcagcgcaaaagatg

SEQ ID NO: 72443 - DNA, 103 bp, Artificial Sequence
  Synthetic Polynucleotide
taatacgactcactatagggatccccaatgttcagtgattttagcacataaacagaggagatatgtgatgaaatcactgaacctggcggcagcgcaaaagatg

SEQ ID NO: 72444 - DNA, 103 bp, Artificial Sequence
  Synthetic Polynucleotide
taatacgactcactatagggtttgtatccccaatgttcagtgattttagcaacagaggagagctaaaatgactgaacataacctggcggcagcgcaaaagatg

SEQ ID NO: 72445 - DNA, 103 bp, Artificial Sequence
  Synthetic Polynucleotide
taatacgactcactatagggatctttttgtatccccaatgttcagtgattaacagaggagaaatcacatgacattggggaacctggcggcagcgcaaaagatg

SEQ ID NO: 72446 - DNA, 103 bp, Artificial Sequence
  Synthetic Polynucleotide
taatacgactcactatagggctgaaatctttttgtatccccaatgttcagaacagaggagactgaacatgggggatacaaacctggcggcagcgcaaaagatg

SEQ ID NO: 72447 - DNA, 103 bp, Artificial Sequence
  Synthetic Polynucleotide
taatacgactcactatagggggagatgggatatatgacgttgtagtgtttaacagaggagaaaacacatgaacgtcataaacctggcggcagcgcaaaagatg

SEQ ID NO: 72448 - DNA, 103 bp, Artificial Sequence
  Synthetic Polynucleotide
taatacgactcactatagggagattctgaaatctttttgtatccccaatgaacagaggagacattggatgtacaaaaagaacctggcggcagcgcaaaagatg

SEQ ID NO: 72449 - DNA, 103 bp, Artificial Sequence
  Synthetic Polynucleotide
taatacgactcactatagggaatctagattctgaaatctttttgtatcccaacagaggagagggataatgaaagatttcaacctggcggcagcgcaaaagatg

SEQ ID NO: 72450 - DNA, 103 bp, Artificial Sequence
  Synthetic Polynucleotide
taatacgactcactatagggattggaatctagattctgaaatctttttgtaacagaggagaacaaaaatgtttcagaataacctggcggcagcgcaaaagatg

SEQ ID NO: 72451 - DNA, 103 bp, Artificial Sequence
  Synthetic Polynucleotide
taatacgactcactatagggcaatgattggaatctagattctgaaatcttaacagaggagaaagattatggaatctagaaacctggcggcagcgcaaaagatg

SEQ ID NO: 72452 - DNA, 103 bp, Artificial Sequence
  Synthetic Polynucleotide
taatacgactcactatagggtttcccaatgattggaatctagattctgaaaacagaggagattcagaatgtagattccaaacctggcggcagcgcaaaagatg

SEQ ID NO: 72453 - DNA, 103 bp, Artificial Sequence
  Synthetic Polynucleotide
taatacgactcactatagggtaatgtttcccaatgattggaatctagattaacagaggagaaatctaatgtccaatcataacctggcggcagcgcaaaagatg

SEQ ID NO: 72454 - DNA, 103 bp, Artificial Sequence
  Synthetic Polynucleotide
taatacgactcactatagggatctgtaatgtttcccaatgattggaatctaacagaggagaagattcatgtcattgggaaacctggcggcagcgcaaaagatg

SEQ ID NO: 72455 - DNA, 103 bp, Artificial Sequence
  Synthetic Polynucleotide
taatacgactcactatagggattagatctgtaatgtttcccaatgattggaacagaggagaccaatcatggggaaacataacctggcggcagcgcaaaagatg

SEQ ID NO: 72456 - DNA, 103 bp, Artificial Sequence
  Synthetic Polynucleotide
taatacgactcactatagggcggtcattagatctgtaatgtttcccaatgaacagaggagacattggatgacattacagaacctggcggcagcgcaaaagatg

SEQ ID NO: 72457 - DNA, 103 bp, Artificial Sequence
  Synthetic Polynucleotide
taatacgactcactatagggatcgtcggtcattagatctgtaatgtttccaacagaggagaggaaacatgacagatctaaacctggcggcagcgcaaaagatg

SEQ ID NO: 72458 - DNA, 103 bp, Artificial Sequence
  Synthetic Polynucleotide
taatacgactcactatagggccaaaatagctatggattgtggcaaagattaacagaggagaaatcttatgcacaatccaaacctggcggcagcgcaaaagatg

SEQ ID NO: 72459 - DNA, 103 bp, Artificial Sequence
  Synthetic Polynucleotide
taatacgactcactatagggtaccgggagatgggatatatgacgttgtagaacagaggagactacaaatgcatatatccaacctggcggcagcgcaaaagatg

SEQ ID NO: 72460 - DNA, 103 bp, Artificial Sequence
  Synthetic Polynucleotide
taatacgactcactatagggatattatcgtcggtcattagatctgtaatgaacagaggagacattacatgtctaatgacaacctggcggcagcgcaaaagatg

SEQ ID NO: 72461 - DNA, 103 bp, Artificial Sequence
  Synthetic Polynucleotide
taatacgactcactatagggtgtttatattatcgtcggtcattagatctgaacagaggagacagatcatgtgaccgacgaacctggcggcagcgcaaaagatg

SEQ ID NO: 72462 - DNA, 103 bp, Artificial Sequence
  Synthetic Polynucleotide
taatacgactcactatagggcaagatgtttatattatcgtcggtcattagaacagaggagactaatgatggacgataataacctggcggcagcgcaaaagatg

SEQ ID NO: 72463 - DNA, 103 bp, Artificial Sequence
  Synthetic Polynucleotide
taatacgactcactatagggagtatcaagatgtttatattatcgtcggtcaacagaggagagaccgaatgtaatataaaaacctggcggcagcgcaaaagatg

SEQ ID NO: 72464 - DNA, 103 bp, Artificial Sequence
  Synthetic Polynucleotide
taatacgactcactataggggaaaaagtatcaagatgtttatattatcgtaacagaggagaacgataatgtaaacatctaacctggcggcagcgcaaaagatg

SEQ ID NO: 72465 - DNA, 103 bp, Artificial Sequence
  Synthetic Polynucleotide
taatacgactcactatagggttctagaaaaagtatcaagatgtttatattaacagaggagaaatataatgatcttgataaacctggcggcagcgcaaaagatg

SEQ ID NO: 72466 - DNA, 103 bp, Artificial Sequence
  Synthetic Polynucleotide
taatacgactcactatagggtttttttctagaaaaagtatcaagatgtttaacagaggagaaaacatatggatacttttaacctggcggcagcgcaaaagatg

SEQ ID NO: 72467 - DNA, 103 bp, Artificial Sequence
  Synthetic Polynucleotide
taatacgactcactatagggtcaattttttttctagaaaaagtatcaagaaacagaggagatcttgaatgtttttctagaacctggcggcagcgcaaaagatg

SEQ ID NO: 72468 - DNA, 103 bp, Artificial Sequence
  Synthetic Polynucleotide
taatacgactcactatagggtcaattcaattttttttctagaaaaagtataacagaggagaatacttatgctagaaaaaaacctggcggcagcgcaaaagatg

SEQ ID NO: 72469 - DNA, 103 bp, Artificial Sequence
  Synthetic Polynucleotide
taatacgactcactatagggtatcatcaattcaattttttttctagaaaaaacagaggagattttctatgaaaaaaattaacctggcggcagcgcaaaagatg

SEQ ID NO: 72470 - DNA, 103 bp, Artificial Sequence
  Synthetic Polynucleotide
taatacgactcactatagggcacaataccgggagatgggatatatgacgtaacagaggagaacgtcaatgatcccatctaacctggcggcagcgcaaaagatg

SEQ ID NO: 72471 - DNA, 103 bp, Artificial Sequence
  Synthetic Polynucleotide
taatacgactcactatagggccctatatcatcaattcaattttttttctaaacagaggagatagaaaatgaattgaattaacctggcggcagcgcaaaagatg

SEQ ID NO: 72472 - DNA, 103 bp, Artificial Sequence
  Synthetic Polynucleotide
taatacgactcactatagggaagaaccctatatcatcaattcaattttttaacagaggagaaaaaaaatgaattgatgaaacctggcggcagcgcaaaagatg

SEQ ID NO: 72473 - DNA, 103 bp, Artificial Sequence
  Synthetic Polynucleotide
taatacgactcactatagggttataaagaaccctatatcatcaattcaataacagaggagaattgaaatgatgatatagaacctggcggcagcgcaaaagatg

SEQ ID NO: 72474 - DNA, 103 bp, Artificial Sequence
  Synthetic Polynucleotide
taatacgactcactatagggatgcattataaagaaccctatatcatcaataacagaggagaattgatatgatagggttcaacctggcggcagcgcaaaagatg

SEQ ID NO: 72475 - DNA, 103 bp, Artificial Sequence
  Synthetic Polynucleotide
taatacgactcactatagggtacgaatgcattataaagaaccctatatcaaacagaggagatgatatatggttctttataacctggcggcagcgcaaaagatg

SEQ ID NO: 72476 - DNA, 103 bp, Artificial Sequence
  Synthetic Polynucleotide
taatacgactcactatagggtagaatacgaatgcattataaagaaccctaaacagaggagatagggtatgttataatgcaacctggcggcagcgcaaaagatg

SEQ ID NO: 72477 - DNA, 103 bp, Artificial Sequence
  Synthetic Polynucleotide
taatacgactcactatagggggatatagaatacgaatgcattataaagaaaacagaggagattctttatgatgcattcgaacctggcggcagcgcaaaagatg

SEQ ID NO: 72478 - DNA, 103 bp, Artificial Sequence
  Synthetic Polynucleotide
taatacgactcactatagggacaccggatatagaatacgaatgcattataaacagaggagatataatatgttcgtattcaacctggcggcagcgcaaaagatg

SEQ ID NO: 72479 - DNA, 103 bp, Artificial Sequence
  Synthetic Polynucleotide
taatacgactcactatagggttttaacaccggatatagaatacgaatgcaaacagaggagatgcattatgattctatataacctggcggcagcgcaaaagatg

SEQ ID NO: 72480 - DNA, 103 bp, Artificial Sequence
  Synthetic Polynucleotide
taatacgactcactatagggaatttttttaacaccggatatagaatacgaaacagaggagatcgtatatgatatccggtaacctggcggcagcgcaaaagatg

SEQ ID NO: 72481 - DNA, 103 bp, Artificial Sequence
  Synthetic Polynucleotide
taatacgactcactatagggacaagcacaataccgggagatgggatatataacagaggagaatatatatgatctcccggaacctggcggcagcgcaaaagatg

SEQ ID NO: 72482 - DNA, 103 bp, Artificial Sequence
  Synthetic Polynucleotide
taatacgactcactatagggaggataatttttttaacaccggatatagaaaacagaggagattctatatgcggtgttaaaacctggcggcagcgcaaaagatg

SEQ ID NO: 72483 - DNA, 103 bp, Artificial Sequence
  Synthetic Polynucleotide
taatacgactcactatagggatgataggataatttttttaacaccggataaacagaggagatatccgatgttaaaaaaaaacctggcggcagcgcaaaagatg

SEQ ID NO: 72484 - DNA, 103 bp, Artificial Sequence
  Synthetic Polynucleotide
taatacgactcactatagggaatacatgataggataatttttttaacaccaacagaggagaggtgttatgaaaattatcaacctggcggcagcgcaaaagatg

SEQ ID NO: 72485 - DNA, 103 bp, Artificial Sequence
  Synthetic Polynucleotide
taatacgactcactatagggtctcaaatacatgataggataatttttttaaacagaggagataaaaaatgtatcctatcaacctggcggcagcgcaaaagatg

SEQ ID NO: 72486 - DNA, 103 bp, Artificial Sequence
  Synthetic Polynucleotide
taatacgactcactatagggaagactctcaaatacatgataggataatttaacagaggagaaaattaatgtatcatgtaaacctggcggcagcgcaaaagatg

SEQ ID NO: 72487 - DNA, 103 bp, Artificial Sequence
  Synthetic Polynucleotide
taatacgactcactatagggcatataagactctcaaatacatgataggataacagaggagaatcctaatgtgtatttgaaacctggcggcagcgcaaaagatg

SEQ ID NO: 72488 - DNA, 103 bp, Artificial Sequence
  Synthetic Polynucleotide
taatacgactcactatagggtgctacatataagactctcaaatacatgataacagaggagaatcatgatgttgagagtcaacctggcggcagcgcaaaagatg

SEQ ID NO: 72489 - DNA, 103 bp, Artificial Sequence
  Synthetic Polynucleotide
taatacgactcactatagggatgtttgctacatataagactctcaaatacaacagaggagagtatttatgagtcttataaacctggcggcagcgcaaaagatg

SEQ ID NO: 72490 - DNA, 103 bp, Artificial Sequence
  Synthetic Polynucleotide
taatacgactcactatagggctatcatgtttgctacatataagactctcaaacagaggagatgagagatgtatatgtagaacctggcggcagcgcaaaagatg

SEQ ID NO: 72491 - DNA, 103 bp, Artificial Sequence
  Synthetic Polynucleotide
taatacgactcactatagggcacagctatcatgtttgctacatataagacaacagaggagagtcttaatggtagcaaacaacctggcggcagcgcaaaagatg

SEQ ID NO: 72492 - DNA, 103 bp, Artificial Sequence
  Synthetic Polynucleotide
taatacgactcactatagggataatacaagcacaataccgggagatgggaaacagaggagatcccatatgccggtattgaacctggcggcagcgcaaaagatg

SEQ ID NO: 72493 - DNA, 103 bp, Artificial Sequence
  Synthetic Polynucleotide
taatacgactcactatagggggtatcacagctatcatgtttgctacatataacagaggagaatatgtatgaaacatgataacctggcggcagcgcaaaagatg

SEQ ID NO: 72494 - DNA, 103 bp, Artificial Sequence
  Synthetic Polynucleotide
taatacgactcactatagggttattggtatcacagctatcatgtttgctaaacagaggagatagcaaatgtgatagctgaacctggcggcagcgcaaaagatg

SEQ ID NO: 72495 - DNA, 103 bp, Artificial Sequence
  Synthetic Polynucleotide
taatacgactcactatagggaaaacttattggtatcacagctatcatgttaacagaggagaaacatgatggctgtgataaacctggcggcagcgcaaaagatg

SEQ ID NO: 72496 - DNA, 103 bp, Artificial Sequence
  Synthetic Polynucleotide
taatacgactcactatagggtatctaaaacttattggtatcacagctatcaacagaggagagatagcatggataccaataacctggcggcagcgcaaaagatg

SEQ ID NO: 72497 - DNA, 103 bp, Artificial Sequence
  Synthetic Polynucleotide
taatacgactcactataggggtgaatatctaaaacttattggtatcacagaacagaggagactgtgaatgcaataagttaacctggcggcagcgcaaaagatg

SEQ ID NO: 72498 - DNA, 103 bp, Artificial Sequence
  Synthetic Polynucleotide
taatacgactcactatagggcacgcgtgaatatctaaaacttattggtataacagaggagaataccaatgagttttagaaacctggcggcagcgcaaaagatg

SEQ ID NO: 72499 - DNA, 103 bp, Artificial Sequence
  Synthetic Polynucleotide
taatacgactcactatagggattagcacgcgtgaatatctaaaacttattaacagaggagaaataagatgtagatattcaacctggcggcagcgcaaaagatg

SEQ ID NO: 72500 - DNA, 103 bp, Artificial Sequence
  Synthetic Polynucleotide
taatacgactcactatagggccaacattagcacgcgtgaatatctaaaacaacagaggagagttttaatgattcacgcgaacctggcggcagcgcaaaagatg

SEQ ID NO: 72501 - DNA, 103 bp, Artificial Sequence
  Synthetic Polynucleotide
taatacgactcactatagggcatccccaacattagcacgcgtgaatatctaacagaggagaagatatatgcgcgtgctaaacctggcggcagcgcaaaagatg

SEQ ID NO: 72502 - DNA, 103 bp, Artificial Sequence
  Synthetic Polynucleotide
taatacgactcactatagggaataccatccccaacattagcacgcgtgaaaacagaggagattcacgatggctaatgttaacctggcggcagcgcaaaagatg

SEQ ID NO: 72503 - DNA, 103 bp, Artificial Sequence
  Synthetic Polynucleotide
taatacgactcactatagggtactaataatacaagcacaataccgggagaaacagaggagatctcccatgattgtgcttaacctggcggcagcgcaaaagatg

SEQ ID NO: 72504 - DNA, 103 bp, Artificial Sequence
  Synthetic Polynucleotide
taatacgactcactatagggcagataataccatccccaacattagcacgcaacagaggagagcgtgcatgtgttggggaaacctggcggcagcgcaaaagatg

SEQ ID NO: 72505 - DNA, 103 bp, Artificial Sequence
  Synthetic Polynucleotide
taatacgactcactatagggaccgccagataataccatccccaacattagaacagaggagactaatgatggggatggtaaacctggcggcagcgcaaaagatg

SEQ ID NO: 72506 - DNA, 103 bp, Artificial Sequence
  Synthetic Polynucleotide
taatacgactcactatagggatttcaccgccagataataccatccccaacaacagaggagagttgggatgggtattatcaacctggcggcagcgcaaaagatg

SEQ ID NO: 72507 - DNA, 103 bp, Artificial Sequence
  Synthetic Polynucleotide
taatacgactcactatagggcggacatttcaccgccagataataccatccaacagaggagaggatggatgtatctggcgaacctggcggcagcgcaaaagatg

SEQ ID NO: 72508 - DNA, 103 bp, Artificial Sequence
  Synthetic Polynucleotide
taatacgactcactatagggtataacggacatttcaccgccagataatacaacagaggagagtattaatgggcggtgaaaacctggcggcagcgcaaaagatg

SEQ ID NO: 72509 - DNA, 103 bp, Artificial Sequence
  Synthetic Polynucleotide
taatacgactcactataggggattatataacggacatttcaccgccagataacagaggagaatctggatgtgaaatgtcaacctggcggcagcgcaaaagatg

SEQ ID NO: 72510 - DNA, 103 bp, Artificial Sequence
  Synthetic Polynucleotide
taatacgactcactatagggttatagattatataacggacatttcaccgcaacagaggagagcggtgatgtgtccgttaaacctggcggcagcgcaaaagatg

SEQ ID NO: 72511 - DNA, 103 bp, Artificial Sequence
  Synthetic Polynucleotide
taatacgactcactatagggttgttttatagattatataacggacatttcaacagaggagagaaatgatggttatataaaacctggcggcagcgcaaaagatg

SEQ ID NO: 72512 - DNA, 103 bp, Artificial Sequence
  Synthetic Polynucleotide
taatacgactcactataggggatgattgttttatagattatataacggacaacagaggagagtccgtatgataatctataacctggcggcagcgcaaaagatg

SEQ ID NO: 72513 - DNA, 103 bp, Artificial Sequence
  Synthetic Polynucleotide
taatacgactcactatagggtatgcgatgattgttttatagattatataaaacagaggagattatatatgctataaaacaacctggcggcagcgcaaaagatg

SEQ ID NO: 72514 - DNA, 103 bp, Artificial Sequence
  Synthetic Polynucleotide
taatacgactcactatagggatgcttactaataatacaagcacaataccgaacagaggagacggtatatggcttgtattaacctggcggcagcgcaaaagatg

SEQ ID NO: 72515 - DNA, 103 bp, Artificial Sequence
  Synthetic Polynucleotide
taatacgactcactatagggtactatatgcgatgattgttttatagattaaacagaggagataatctatgaaacaatcaaacctggcggcagcgcaaaagatg

SEQ ID NO: 72516 - DNA, 103 bp, Artificial Sequence
  Synthetic Polynucleotide
taatacgactcactatagggtcgcatactatatgcgatgattgttttataaacagaggagatataaaatgatcatcgcaaacctggcggcagcgcaaaagatg

SEQ ID NO: 72517 - DNA, 103 bp, Artificial Sequence
  Synthetic Polynucleotide
taatacgactcactatagggtactatcgcatactatatgcgatgattgttaacagaggagaaacaatatgcgcatatagaacctggcggcagcgcaaaagatg

SEQ ID NO: 72518 - DNA, 103 bp, Artificial Sequence
  Synthetic Polynucleotide
taatacgactcactatagggtactctactatcgcatactatatgcgatgaaacagaggagatcatcgatgatagtatgcaacctggcggcagcgcaaaagatg

SEQ ID NO: 72519 - DNA, 103 bp, Artificial Sequence
  Synthetic Polynucleotide
taatacgactcactatagggatgtttactctactatcgcatactatatgcaacagaggagagcatatatgatgcgatagaacctggcggcagcgcaaaagatg

SEQ ID NO: 72520 - DNA, 103 bp, Artificial Sequence
  Synthetic Polynucleotide
taatacgactcactatagggtaaaaatgtttactctactatcgcatactaaacagaggagatagtatatgatagtagagaacctggcggcagcgcaaaagatg

SEQ ID NO: 72521 - DNA, 103 bp, Artificial Sequence
  Synthetic Polynucleotide
taatacgactcactatagggaactataaaaatgtttactctactatcgcaaacagaggagatgcgatatgagagtaaacaacctggcggcagcgcaaaagatg

SEQ ID NO: 72522 - DNA, 103 bp, Artificial Sequence
  Synthetic Polynucleotide
taatacgactcactataggggtagaaactataaaaatgtttactctactaaacagaggagatagtagatgaaacattttaacctggcggcagcgcaaaagatg

SEQ ID NO: 72523 - DNA, 103 bp, Artificial Sequence
  Synthetic Polynucleotide
taatacgactcactatagggatccagtagaaactataaaaatgtttactcaacagaggagagagtaaatgtttttatagaacctggcggcagcgcaaaagatg

SEQ ID NO: 72524 - DNA, 103 bp, Artificial Sequence
  Synthetic Polynucleotide
taatacgactcactatagggtatgaatccagtagaaactataaaaatgttaacagaggagaaacattatgatagtttctaacctggcggcagcgcaaaagatg

SEQ ID NO: 72525 - DNA, 103 bp, Artificial Sequence
  Synthetic Polynucleotide
taatacgactcactatagggcaataatgcttactaataatacaagcacaaaacagaggagattgtgcatgtattattagaacctggcggcagcgcaaaagatg

SEQ ID NO: 72526 - DNA, 103 bp, Artificial Sequence
  Synthetic Polynucleotide
taatacgactcactatagggcgatgtatgaatccagtagaaactataaaaaacagaggagattttatatgttctactggaacctggcggcagcgcaaaagatg

SEQ ID NO: 72527 - DNA, 103 bp, Artificial Sequence
  Synthetic Polynucleotide
taatacgactcactataggggtaaacgatgtatgaatccagtagaaactaaacagaggagatagtttatgctggattcaaacctggcggcagcgcaaaagatg

SEQ ID NO: 72528 - DNA, 103 bp, Artificial Sequence
  Synthetic Polynucleotide
taatacgactcactatagggattgggtaaacgatgtatgaatccagtagaaacagaggagatctactatgttcatacataacctggcggcagcgcaaaagatg

SEQ ID NO: 72529 - DNA, 103 bp, Artificial Sequence
  Synthetic Polynucleotide
taatacgactcactatagggaccgaattgggtaaacgatgtatgaatccaaacagaggagatggattatgacatcgtttaacctggcggcagcgcaaaagatg

SEQ ID NO: 72530 - DNA, 103 bp, Artificial Sequence
  Synthetic Polynucleotide
taatacgactcactatagggtcataaccgaattgggtaaacgatgtatgaaacagaggagatcatacatggtttacccaaacctggcggcagcgcaaaagatg

SEQ ID NO: 72531 - DNA, 103 bp, Artificial Sequence
  Synthetic Polynucleotide
taatacgactcactatagggttcattcataaccgaattgggtaaacgatgaacagaggagacatcgtatgcccaattcgaacctggcggcagcgcaaaagatg

SEQ ID NO: 72532 - DNA, 103 bp, Artificial Sequence
  Synthetic Polynucleotide
taatacgactcactatagggacaatttcattcataaccgaattgggtaaaaacagaggagatttaccatgttcggttataacctggcggcagcgcaaaagatg

SEQ ID NO: 72533 - DNA, 103 bp, Artificial Sequence
  Synthetic Polynucleotide
taatacgactcactatagggtggcgacaatttcattcataaccgaattggaacagaggagaccaattatgttatgaatgaacctggcggcagcgcaaaagatg

SEQ ID NO: 72534 - DNA, 103 bp, Artificial Sequence
  Synthetic Polynucleotide
taatacgactcactatagggaagattggcgacaatttcattcataaccgaaacagaggagatcggttatgaatgaaattaacctggcggcagcgcaaaagatg

SEQ ID NO: 72535 - DNA, 103 bp, Artificial Sequence
  Synthetic Polynucleotide
taatacgactcactatagggggtgtaagattggcgacaatttcattcataaacagaggagatatgaaatgaattgtcgcaacctggcggcagcgcaaaagatg

SEQ ID NO: 72536 - DNA, 103 bp, Artificial Sequence
  Synthetic Polynucleotide
taatacgactcactatagggacacacaataatgcttactaataatacaagaacagaggagacttgtaatgttagtaagcaacctggcggcagcgcaaaagatg

SEQ ID NO: 72537 - DNA, 103 bp, Artificial Sequence
  Synthetic Polynucleotide
taatacgactcactatagggggttgggtgtaagattggcgacaatttcataacagaggagaatgaaaatgtcgccaatcaacctggcggcagcgcaaaagatg

SEQ ID NO: 72538 - DNA, 103 bp, Artificial Sequence
  Synthetic Polynucleotide
taatacgactcactatagggcaaggggttgggtgtaagattggcgacaataacagaggagaattgtcatgaatcttacaaacctggcggcagcgcaaaagatg

SEQ ID NO: 72539 - DNA, 103 bp, Artificial Sequence
  Synthetic Polynucleotide
taatacgactcactataggggataacaaggggttgggtgtaagattggcgaacagaggagacgccaaatgtacacccaaaacctggcggcagcgcaaaagatg

SEQ ID NO: 72540 - DNA, 103 bp, Artificial Sequence
  Synthetic Polynucleotide
taatacgactcactatagggtaatggataacaaggggttgggtgtaagataacagaggagaatcttaatgccaacccctaacctggcggcagcgcaaaagatg

SEQ ID NO: 72541 - DNA, 103 bp, Artificial Sequence
  Synthetic Polynucleotide
taatacgactcactatagggtatactaatggataacaaggggttgggtgtaacagaggagaacacccatgcccttgttaaacctggcggcagcgcaaaagatg

SEQ ID NO: 72542 - DNA, 103 bp, Artificial Sequence
  Synthetic Polynucleotide
taatacgactcactatagggaatactatactaatggataacaaggggttgaacagaggagacaacccatggttatccataacctggcggcagcgcaaaagatg

SEQ ID NO: 72543 - DNA, 103 bp, Artificial Sequence
  Synthetic Polynucleotide
taatacgactcactatagggaagttaatactatactaatggataacaaggaacagaggagaccttgtatgccattagtaaacctggcggcagcgcaaaagatg

SEQ ID NO: 72544 - DNA, 103 bp, Artificial Sequence
  Synthetic Polynucleotide
taatacgactcactatagggtaacgaagttaatactatactaatggataaaacagaggagattatccatgagtatagtaaacctggcggcagcgcaaaagatg

SEQ ID NO: 72545 - DNA, 103 bp, Artificial Sequence
  Synthetic Polynucleotide
taatacgactcactatagggataaataacgaagttaatactatactaatgaacagaggagacattagatgagtattaacaacctggcggcagcgcaaaagatg

SEQ ID NO: 72546 - DNA, 103 bp, Artificial Sequence
  Synthetic Polynucleotide
taatacgactcactatagggatgacataaataacgaagttaatactatacaacagaggagagtatagatgtaacttcgtaacctggcggcagcgcaaaagatg

SEQ ID NO: 72547 - DNA, 103 bp, Artificial Sequence
  Synthetic Polynucleotide
taatacgactcactatagggagacaacacacaataatgcttactaataataacagaggagaattattatgaagcattataacctggcggcagcgcaaaagatg

SEQ ID NO: 72548 - DNA, 103 bp, Artificial Sequence
  Synthetic Polynucleotide
taatacgactcactatagggagtttatgacataaataacgaagttaatacaacagaggagagtattaatgtcgttatttaacctggcggcagcgcaaaagatg

SEQ ID NO: 72549 - DNA, 103 bp, Artificial Sequence
  Synthetic Polynucleotide
taatacgactcactatagggtttacagtttatgacataaataacgaagttaacagaggagaaacttcatgatttatgtcaacctggcggcagcgcaaaagatg

SEQ ID NO: 72550 - DNA, 103 bp, Artificial Sequence
  Synthetic Polynucleotide
taatacgactcactatagggaatcatttacagtttatgacataaataacgaacagaggagacgttatatgtgtcataaaaacctggcggcagcgcaaaagatg

SEQ ID NO: 72551 - DNA, 103 bp, Artificial Sequence
  Synthetic Polynucleotide
taatacgactcactatagggtacagaatcatttacagtttatgacataaaaacagaggagatttatgatgtaaactgtaaacctggcggcagcgcaaaagatg

SEQ ID NO: 72552 - DNA, 103 bp, Artificial Sequence
  Synthetic Polynucleotide
taatacgactcactataggggcatctacagaatcatttacagtttatgacaacagaggagagtcataatgtgtaaatgaaacctggcggcagcgcaaaagatg

SEQ ID NO: 72553 - DNA, 103 bp, Artificial Sequence
  Synthetic Polynucleotide
taatacgactcactatagggatatggcatctacagaatcatttacagtttaacagaggagaaaactgatgatgattctgaacctggcggcagcgcaaaagatg

SEQ ID NO: 72554 - DNA, 103 bp, Artificial Sequence
  Synthetic Polynucleotide
taatacgactcactataggggtatgatatggcatctacagaatcatttacaacagaggagagtaaatatgtctgtagataacctggcggcagcgcaaaagatg

SEQ ID NO: 72555 - DNA, 103 bp, Artificial Sequence
  Synthetic Polynucleotide
taatacgactcactatagggatcatgtatgatatggcatctacagaatcaaacagaggagatgattcatgagatgccataacctggcggcagcgcaaaagatg

SEQ ID NO: 72556 - DNA, 103 bp, Artificial Sequence
  Synthetic Polynucleotide
taatacgactcactatagggtgaatatcatgtatgatatggcatctacagaacagaggagactgtagatgccatatcataacctggcggcagcgcaaaagatg

SEQ ID NO: 72557 - DNA, 103 bp, Artificial Sequence
  Synthetic Polynucleotide
taatacgactcactatagggggacatgaatatcatgtatgatatggcatcaacagaggagagatgccatgtcatacatgaacctggcggcagcgcaaaagatg

SEQ ID NO: 72558 - DNA, 103 bp, Artificial Sequence
  Synthetic Polynucleotide
taatacgactcactatagggataatagacaacacacaataatgcttactaaacagaggagatagtaaatgttattgtgtaacctggcggcagcgcaaaagatg

SEQ ID NO: 72559 - DNA, 103 bp, Artificial Sequence
  Synthetic Polynucleotide
taatacgactcactatagggaatagggacatgaatatcatgtatgatatgaacagaggagacatatcatgcatgatattaacctggcggcagcgcaaaagatg

SEQ ID NO: 72560 - DNA, 103 bp, Artificial Sequence
  Synthetic Polynucleotide
taatacgactcactatagggattataatagggacatgaatatcatgtatgaacagaggagacatacaatgtattcatgtaacctggcggcagcgcaaaagatg

SEQ ID NO: 72561 - DNA, 103 bp, Artificial Sequence
  Synthetic Polynucleotide
taatacgactcactatagggtaatgattataatagggacatgaatatcataacagaggagaatgataatgatgtccctaaacctggcggcagcgcaaaagatg

SEQ ID NO: 72562 - DNA, 103 bp, Artificial Sequence
  Synthetic Polynucleotide
taatacgactcactataggggttaataatgattataatagggacatgaataacagaggagaattcatatgcctattataaacctggcggcagcgcaaaagatg

SEQ ID NO: 72563 - DNA, 103 bp, Artificial Sequence
  Synthetic Polynucleotide
taatacgactcactatagggataaagttaataatgattataatagggacaaacagaggagatgtcccatgtataatcataacctggcggcagcgcaaaagatg

SEQ ID NO: 72564 - DNA, 103 bp, Artificial Sequence
  Synthetic Polynucleotide
taatacgactcactatagggttgtgataaagttaataatgattataatagaacagaggagactattaatgtcattattaaacctggcggcagcgcaaaagatg

SEQ ID NO: 72565 - DNA, 103 bp, Artificial Sequence
  Synthetic Polynucleotide
taatacgactcactatagggacgtattgtgataaagttaataatgattataacagaggagaataatcatgattaactttaacctggcggcagcgcaaaagatg

SEQ ID NO: 72566 - DNA, 103 bp, Artificial Sequence
  Synthetic Polynucleotide
taatacgactcactatagggtcaacacgtattgtgataaagttaataatgaacagaggagacattatatgctttatcacaacctggcggcagcgcaaaagatg

SEQ ID NO: 72567 - DNA, 103 bp, Artificial Sequence
  Synthetic Polynucleotide
taatacgactcactatagggtattatcaacacgtattgtgataaagttaaaacagaggagattaactatgtcacaatacaacctggcggcagcgcaaaagatg

SEQ ID NO: 72568 - DNA, 103 bp, Artificial Sequence
  Synthetic Polynucleotide
taatacgactcactatagggatagatattatcaacacgtattgtgataaaaacagaggagatttatcatgatacgtgttaacctggcggcagcgcaaaagatg

SEQ ID NO: 72569 - DNA, 103 bp, Artificial Sequence
  Synthetic Polynucleotide
taatacgactcactatagggtagcaccaaaatagctatggattgtggcaaaacagaggagattgccaatgtccatagctaacctggcggcagcgcaaaagatg

SEQ ID NO: 72570 - DNA, 103 bp, Artificial Sequence
  Synthetic Polynucleotide
taatacgactcactatagggaacaaataatagacaacacacaataatgctaacagaggagaagcattatggtgtgttgtaacctggcggcagcgcaaaagatg

SEQ ID NO: 72571 - DNA, 103 bp, Artificial Sequence
  Synthetic Polynucleotide
taatacgactcactatagggcatatatagatattatcaacacgtattgtgaacagaggagacacaatatgtgttgataaaacctggcggcagcgcaaaagatg

SEQ ID NO: 72572 - DNA, 103 bp, Artificial Sequence
  Synthetic Polynucleotide
taatacgactcactatagggtagatcatatatagatattatcaacacgtaaacagaggagatacgtgatgataatatctaacctggcggcagcgcaaaagatg

SEQ ID NO: 72573 - DNA, 103 bp, Artificial Sequence
  Synthetic Polynucleotide
taatacgactcactatagggaaaactagatcatatatagatattatcaacaacagaggagagttgatatgatctatataaacctggcggcagcgcaaaagatg

SEQ ID NO: 72574 - DNA, 103 bp, Artificial Sequence
  Synthetic Polynucleotide
taatacgactcactatagggccacaaaaactagatcatatatagatattaaacagaggagataatatatgtatatgatcaacctggcggcagcgcaaaagatg

SEQ ID NO: 72575 - DNA, 103 bp, Artificial Sequence
  Synthetic Polynucleotide
taatacgactcactatagggattgcccacaaaaactagatcatatatagaaacagaggagatctataatggatctagttaacctggcggcagcgcaaaagatg

SEQ ID NO: 72576 - DNA, 103 bp, Artificial Sequence
  Synthetic Polynucleotide
taatacgactcactatagggagacaattgcccacaaaaactagatcatataacagaggagaatatgaatgagtttttgtaacctggcggcagcgcaaaagatg

SEQ ID NO: 72577 - DNA, 103 bp, Artificial Sequence
  Synthetic Polynucleotide
taatacgactcactatagggtgtatagacaattgcccacaaaaactagataacagaggagaatctagatgttgtgggcaaacctggcggcagcgcaaaagatg

SEQ ID NO: 72578 - DNA, 103 bp, Artificial Sequence
  Synthetic Polynucleotide
taatacgactcactatagggcgacttgtatagacaattgcccacaaaaacaacagaggagagtttttatgggcaattgtaacctggcggcagcgcaaaagatg

SEQ ID NO: 72579 - DNA, 103 bp, Artificial Sequence
  Synthetic Polynucleotide
taatacgactcactatagggttagacgacttgtatagacaattgcccacaaacagaggagatgtgggatgttgtctataaacctggcggcagcgcaaaagatg

SEQ ID NO: 72580 - DNA, 103 bp, Artificial Sequence
  Synthetic Polynucleotide
taatacgactcactatagggaacgtttagacgacttgtatagacaattgcaacagaggagagcaattatgtatacaagtaacctggcggcagcgcaaaagatg

SEQ ID NO: 72581 - DNA, 103 bp, Artificial Sequence
  Synthetic Polynucleotide
taatacgactcactatagggctataaacaaataatagacaacacacaataaacagaggagatattgtatgttgtctattaacctggcggcagcgcaaaagatg

SEQ ID NO: 72582 - DNA, 103 bp, Artificial Sequence
  Synthetic Polynucleotide
taatacgactcactatagggtaaacaacgtttagacgacttgtatagacaaacagaggagatgtctaatgaagtcgtctaacctggcggcagcgcaaaagatg

SEQ ID NO: 72583 - DNA, 103 bp, Artificial Sequence
  Synthetic Polynucleotide
taatacgactcactatagggatgagtaaacaacgtttagacgacttgtataacagaggagaatacaaatggtctaaacgaacctggcggcagcgcaaaagatg

SEQ ID NO: 72584 - DNA, 103 bp, Artificial Sequence
  Synthetic Polynucleotide
taatacgactcactatagggactatatgagtaaacaacgtttagacgactaacagaggagaagtcgtatgaacgttgttaacctggcggcagcgcaaaagatg

SEQ ID NO: 72585 - DNA, 103 bp, Artificial Sequence
  Synthetic Polynucleotide
taatacgactcactatagggtcaatactatatgagtaaacaacgtttagaaacagaggagatctaaaatgtgtttactcaacctggcggcagcgcaaaagatg

SEQ ID NO: 72586 - DNA, 103 bp, Artificial Sequence
  Synthetic Polynucleotide
taatacgactcactataggggctgttcaatactatatgagtaaacaacgtaacagaggagaacgttgatgactcatataaacctggcggcagcgcaaaagatg

SEQ ID NO: 72587 - DNA, 103 bp, Artificial Sequence
  Synthetic Polynucleotide
taatacgactcactatagggtgatggctgttcaatactatatgagtaaacaacagaggagagtttacatgtatagtattaacctggcggcagcgcaaaagatg

SEQ ID NO: 72588 - DNA, 103 bp, Artificial Sequence
  Synthetic Polynucleotide
taatacgactcactatagggtgtaatgatggctgttcaatactatatgagaacagaggagactcataatgtattgaacaaacctggcggcagcgcaaaagatg

SEQ ID NO: 72589 - DNA, 103 bp, Artificial Sequence
  Synthetic Polynucleotide
taatacgactcactataggggaccatgtaatgatggctgttcaatactataacagaggagaatagtaatgaacagccataacctggcggcagcgcaaaagatg

SEQ ID NO: 72590 - DNA, 103 bp, Artificial Sequence
  Synthetic Polynucleotide
taatacgactcactatagggaacgggaccatgtaatgatggctgttcaataacagaggagaattgaaatgccatcattaaacctggcggcagcgcaaaagatg

SEQ ID NO: 72591 - DNA, 103 bp, Artificial Sequence
  Synthetic Polynucleotide
taatacgactcactatagggaacggaacgggaccatgtaatgatggctgtaacagaggagaacagccatgattacatggaacctggcggcagcgcaaaagatg

SEQ ID NO: 72592 - DNA, 103 bp, Artificial Sequence
  Synthetic Polynucleotide
taatacgactcactatagggtgaacctataaacaaataatagacaacacaaacagaggagatgtgttatgtattatttgaacctggcggcagcgcaaaagatg

SEQ ID NO: 72593 - DNA, 103 bp, Artificial Sequence
  Synthetic Polynucleotide
taatacgactcactatagggctatcaacggaacgggaccatgtaatgatgaacagaggagacatcatatgatggtcccgaacctggcggcagcgcaaaagatg

SEQ ID NO: 72594 - DNA, 103 bp, Artificial Sequence
  Synthetic Polynucleotide
taatacgactcactatagggattatctatcaacggaacgggaccatgtaaaacagaggagattacatatgcccgttccgaacctggcggcagcgcaaaagatg

SEQ ID NO: 72595 - DNA, 103 bp, Artificial Sequence
  Synthetic Polynucleotide
taatacgactcactatagggactcgattatctatcaacggaacgggaccaaacagaggagatggtccatgtccgttgataacctggcggcagcgcaaaagatg

SEQ ID NO: 72596 - DNA, 103 bp, Artificial Sequence
  Synthetic Polynucleotide
taatacgactcactatagggaacatactcgattatctatcaacggaacggaacagaggagaccgttcatgtgatagataaacctggcggcagcgcaaaagatg

SEQ ID NO: 72597 - DNA, 103 bp, Artificial Sequence
  Synthetic Polynucleotide
taatacgactcactatagggccactaacatactcgattatctatcaacggaacagaggagaccgttgatggataatcgaaacctggcggcagcgcaaaagatg

SEQ ID NO: 72598 - DNA, 103 bp, Artificial Sequence
  Synthetic Polynucleotide
taatacgactcactatagggcaagtccactaacatactcgattatctatcaacagaggagagatagaatgtcgagtatgaacctggcggcagcgcaaaagatg

SEQ ID NO: 72599 - DNA, 103 bp, Artificial Sequence
  Synthetic Polynucleotide
taatacgactcactatagggtttaacaagtccactaacatactcgattataacagaggagaataatcatgtatgttagtaacctggcggcagcgcaaaagatg

SEQ ID NO: 72600 - DNA, 103 bp, Artificial Sequence
  Synthetic Polynucleotide
taatacgactcactatagggatagatttaacaagtccactaacatactcgaacagaggagacgagtaatgtagtggactaacctggcggcagcgcaaaagatg

SEQ ID NO: 72601 - DNA, 103 bp, Artificial Sequence
  Synthetic Polynucleotide
taatacgactcactatagggggtatatagatttaacaagtccactaacataacagaggagaatgttaatggacttgttaaacctggcggcagcgcaaaagatg

SEQ ID NO: 72602 - DNA, 103 bp, Artificial Sequence
  Synthetic Polynucleotide
taatacgactcactatagggaatatggtatatagatttaacaagtccactaacagaggagaagtggaatggttaaatctaacctggcggcagcgcaaaagatg

SEQ ID NO: 72603 - DNA, 103 bp, Artificial Sequence
  Synthetic Polynucleotide
taatacgactcactatagggtcgagtgaacctataaacaaataatagacaaacagaggagatgtctaatgtttgtttataacctggcggcagcgcaaaagatg

SEQ ID NO: 72604 - DNA, 103 bp, Artificial Sequence
  Synthetic Polynucleotide
taatacgactcactatagggcagaaaatatggtatatagatttaacaagtaacagaggagaacttgtatgatctatataaacctggcggcagcgcaaaagatg

SEQ ID NO: 72605 - DNA, 103 bp, Artificial Sequence
  Synthetic Polynucleotide
taatacgactcactatagggacttccagaaaatatggtatatagatttaaaacagaggagattaaatatgtataccataaacctggcggcagcgcaaaagatg

SEQ ID NO: 72606 - DNA, 103 bp, Artificial Sequence
  Synthetic Polynucleotide
taatacgactcactatagggtatccacttccagaaaatatggtatatagaaacagaggagatctataatgcatattttcaacctggcggcagcgcaaaagatg

SEQ ID NO: 72607 - DNA, 103 bp, Artificial Sequence
  Synthetic Polynucleotide
taatacgactcactatagggatgtatatccacttccagaaaatatggtataacagaggagaataccaatgtttctggaaaacctggcggcagcgcaaaagatg

SEQ ID NO: 72608 - DNA, 103 bp, Artificial Sequence
  Synthetic Polynucleotide
taatacgactcactatagggcaactatgtatatccacttccagaaaatataacagaggagaatatttatgggaagtggaaacctggcggcagcgcaaaagatg

SEQ ID NO: 72609 - DNA, 103 bp, Artificial Sequence
  Synthetic Polynucleotide
taatacgactcactataggggatcacaactatgtatatccacttccagaaaacagaggagattctggatgtggatatacaacctggcggcagcgcaaaagatg

SEQ ID NO: 72610 - DNA, 103 bp, Artificial Sequence
  Synthetic Polynucleotide
taatacgactcactatagggataatgatcacaactatgtatatccacttcaacagaggagagaagtgatgatacatagtaacctggcggcagcgcaaaagatg

SEQ ID NO: 72611 - DNA, 103 bp, Artificial Sequence
  Synthetic Polynucleotide
taatacgactcactatagggtagcaataatgatcacaactatgtatatccaacagaggagaggatatatgtagttgtgaaacctggcggcagcgcaaaagatg

SEQ ID NO: 72612 - DNA, 103 bp, Artificial Sequence
  Synthetic Polynucleotide
taatacgactcactatagggaaggctagcaataatgatcacaactatgtaaacagaggagatacataatggtgatcattaacctggcggcagcgcaaaagatg

SEQ ID NO: 72613 - DNA, 103 bp, Artificial Sequence
  Synthetic Polynucleotide
taatacgactcactatagggaagataaggctagcaataatgatcacaactaacagaggagaagttgtatgcattattgcaacctggcggcagcgcaaaagatg

SEQ ID NO: 72614 - DNA, 103 bp, Artificial Sequence
  Synthetic Polynucleotide
taatacgactcactataggggttcttcgagtgaacctataaacaaataataacagaggagaattattatgttataggttaacctggcggcagcgcaaaagatg

SEQ ID NO: 72615 - DNA, 103 bp, Artificial Sequence
  Synthetic Polynucleotide
taatacgactcactatagggtatagaagataaggctagcaataatgatcaaacagaggagatgatcaatgttgctagccaacctggcggcagcgcaaaagatg

SEQ ID NO: 72616 - DNA, 103 bp, Artificial Sequence
  Synthetic Polynucleotide
taatacgactcactataggggatgatatagaagataaggctagcaataataacagaggagaattattatgagccttatcaacctggcggcagcgcaaaagatg

SEQ ID NO: 72617 - DNA, 103 bp, Artificial Sequence
  Synthetic Polynucleotide
taatacgactcactatagggatatagatgatatagaagataaggctagcaaacagaggagatgctagatgtatcttctaaacctggcggcagcgcaaaagatg

SEQ ID NO: 72618 - DNA, 103 bp, Artificial Sequence
  Synthetic Polynucleotide
taatacgactcactatagggagatgatatagatgatatagaagataaggcaacagaggagagccttaatgtctatatcaaacctggcggcagcgcaaaagatg

SEQ ID NO: 72619 - DNA, 103 bp, Artificial Sequence
  Synthetic Polynucleotide
taatacgactcactataggggatatagatgatatagatgatatagaagataacagaggagaatcttcatgatcatctataacctggcggcagcgcaaaagatg

SEQ ID NO: 72620 - DNA, 103 bp, Artificial Sequence
  Synthetic Polynucleotide
taatacgactcactatagggtagatgatatagatgatatagatgatatagaacagaggagactatatatgctatatcataacctggcggcagcgcaaaagatg

SEQ ID NO: 72621 - DNA, 103 bp, Artificial Sequence
  Synthetic Polynucleotide
taatacgactcactatagggtgatatagatgatatagatgatatagatgaaacagaggagatcatctatgtcatctataaacctggcggcagcgcaaaagatg

SEQ ID NO: 72622 - DNA, 103 bp, Artificial Sequence
  Synthetic Polynucleotide
taatacgactcactatagggatagatgatatagatgatatagatgatataaacagaggagatatatcatgtatatcatcaacctggcggcagcgcaaaagatg

SEQ ID NO: 72623 - DNA, 103 bp, Artificial Sequence
  Synthetic Polynucleotide
taatacgactcactatagggatgatatagatgatatagatgatatagatgaacagaggagacatctaatgcatctatataacctggcggcagcgcaaaagatg

SEQ ID NO: 72624 - DNA, 103 bp, Artificial Sequence
  Synthetic Polynucleotide
taatacgactcactatagggtatagatgatatagatgatatagatgatataacagaggagaatatcaatgatatcatctaacctggcggcagcgcaaaagatg

SEQ ID NO: 72625 - DNA, 103 bp, Artificial Sequence
  Synthetic Polynucleotide
taatacgactcactatagggtattagttcttcgagtgaacctataaacaaaacagaggagattgtttatgggttcactcaacctggcggcagcgcaaaagatg

SEQ ID NO: 72626 - DNA, 103 bp, Artificial Sequence
  Synthetic Polynucleotide
taatacgactcactataggggatgatatagatgatatagatgatatagataacagaggagaatctatatgatctatatcaacctggcggcagcgcaaaagatg

SEQ ID NO: 72627 - DNA, 103 bp, Artificial Sequence
  Synthetic Polynucleotide
taatacgactcactatagggatatagatgatatagatgatatagatgataaacagaggagatatcatatgtatcatctaaacctggcggcagcgcaaaagatg

SEQ ID NO: 72628 - DNA, 103 bp, Artificial Sequence
  Synthetic Polynucleotide
taatacgactcactatagggagatgatatagatgatatagatgatatagaaacagaggagatctataatgtctatatcaaacctggcggcagcgcaaaagatg

SEQ ID NO: 72629 - DNA, 103 bp, Artificial Sequence
  Synthetic Polynucleotide
taatacgactcactataggggatatagatgatatagatgatatagatgataacagaggagaatcatcatgatcatctataacctggcggcagcgcaaaagatg

SEQ ID NO: 72630 - DNA, 103 bp, Artificial Sequence; identical to SEQ ID NO: 72620
  Synthetic Polynucleotide

SEQ ID NO: 72631 - DNA, 103 bp, Artificial Sequence; identical to SEQ ID NO: 72621
  Synthetic Polynucleotide

SEQ ID NO: 72632 - DNA, 103 bp, Artificial Sequence; identical to SEQ ID NO: 72622
  Synthetic Polynucleotide

SEQ ID NO: 72633 - DNA, 103 bp, Artificial Sequence; identical to SEQ ID NO: 72623
  Synthetic Polynucleotide

SEQ ID NO: 72634 - DNA, 103 bp, Artificial Sequence; identical to SEQ ID NO: 72624
  Synthetic Polynucleotide

SEQ ID NO: 72635 - DNA, 103 bp, Artificial Sequence; identical to SEQ ID NO: 72626
  Synthetic Polynucleotide

SEQ ID NO: 72636 - DNA, 103 bp, Artificial Sequence
  Synthetic Polynucleotide
taatacgactcactatagggtaatttattagttcttcgagtgaacctataaacagaggagatataggatgactcgaagaaacctggcggcagcgcaaaagatg

SEQ ID NO: 72637 - DNA, 103 bp, Artificial Sequence; identical to SEQ ID NO: 72627
  Synthetic Polynucleotide

SEQ ID NO: 72638 - DNA, 103 bp, Artificial Sequence; identical to SEQ ID NO: 72628
  Synthetic Polynucleotide

SEQ ID NO: 72639 - DNA, 103 bp, Artificial Sequence
  Synthetic Polynucleotide
taatacgactcactatagggatcgtagatgatatagatgatatagatgataacagaggagaatcatcatgatcatctataacctggcggcagcgcaaaagatg

SEQ ID NO: 72640 - DNA, 103 bp, Artificial Sequence
  Synthetic Polynucleotide
taatacgactcactatagggataatatcgtagatgatatagatgatatagaacagaggagactatatatgctatatcataacctggcggcagcgcaaaagatg

SEQ ID NO: 72641 - DNA, 103 bp, Artificial Sequence
  Synthetic Polynucleotide
taatacgactcactataggggtgtaataatatcgtagatgatatagatgaaacagaggagatcatctatgtcatctacgaacctggcggcagcgcaaaagatg

SEQ ID NO: 72642 - DNA, 103 bp, Artificial Sequence
  Synthetic Polynucleotide
taatacgactcactatagggtttatgtgtaataatatcgtagatgatataaacagaggagatatatcatgtacgatattaacctggcggcagcgcaaaagatg

SEQ ID NO: 72643 - DNA, 103 bp, Artificial Sequence
  Synthetic Polynucleotide
taatacgactcactatagggcgatgtttatgtgtaataatatcgtagatgaacagaggagacatctaatgtattattacaacctggcggcagcgcaaaagatg

SEQ ID NO: 72644 - DNA, 103 bp, Artificial Sequence
  Synthetic Polynucleotide
taatacgactcactataggggttgccgatgtttatgtgtaataatatcgtaacagaggagaacgataatgttacacataaacctggcggcagcgcaaaagatg

SEQ ID NO: 72645 - DNA, 103 bp, Artificial Sequence
  Synthetic Polynucleotide
taatacgactcactatagggagtatgttgccgatgtttatgtgtaataataacagaggagaattattatgcataaacataacctggcggcagcgcaaaagatg

SEQ ID NO: 72646 - DNA, 103 bp, Artificial Sequence
  Synthetic Polynucleotide
taatacgactcactatagggacaatagtatgttgccgatgtttatgtgtaaacagaggagatacacaatgacatcggcaaacctggcggcagcgcaaaagatg

SEQ ID NO: 72647 - DNA, 103 bp, Artificial Sequence
  Synthetic Polynucleotide
taatacgactcactatagggaaaggtaatttattagttcttcgagtgaacaacagaggagagttcacatgaagaactaaaacctggcggcagcgcaaaagatg

SEQ ID NO: 72648 - DNA, 103 bp, Artificial Sequence
  Synthetic Polynucleotide
taatacgactcactatagggaatgtacaatagtatgttgccgatgtttataacagaggagaataaacatgggcaacataaacctggcggcagcgcaaaagatg

SEQ ID NO: 72649 - DNA, 103 bp, Artificial Sequence
  Synthetic Polynucleotide
taatacgactcactatagggtagataatgtacaatagtatgttgccgatgaacagaggagacatcggatgcatactattaacctggcggcagcgcaaaagatg

SEQ ID NO: 72650 - DNA, 103 bp, Artificial Sequence
  Synthetic Polynucleotide
taatacgactcactatagggggacttagataatgtacaatagtatgttgcaacagaggagagcaacaatgtattgtacaaacctggcggcagcgcaaaagatg

SEQ ID NO: 72651 - DNA, 103 bp, Artificial Sequence
  Synthetic Polynucleotide
taatacgactcactatagggcaaccggacttagataatgtacaatagtataacagaggagaatactaatgtacattatcaacctggcggcagcgcaaaagatg

SEQ ID NO: 72652 - DNA, 103 bp, Artificial Sequence
  Synthetic Polynucleotide
taatacgactcactatagggtggatcaaccggacttagataatgtacaataacagaggagaattgtaatgtatctaagtaacctggcggcagcgcaaaagatg

SEQ ID NO: 72653 - DNA, 103 bp, Artificial Sequence
  Synthetic Polynucleotide
taatacgactcactataggggggtttggatcaaccggacttagataatgtaacagaggagaacattaatgaagtccggtaacctggcggcagcgcaaaagatg

SEQ ID NO: 72654 - DNA, 103 bp, Artificial Sequence
  Synthetic Polynucleotide
taatacgactcactatagggatcaagggtttggatcaaccggacttagataacagaggagaatctaaatgcggttgatcaacctggcggcagcgcaaaagatg

SEQ ID NO: 72655 - DNA, 103 bp, Artificial Sequence
  Synthetic Polynucleotide
taatacgactcactatagggaggagatcaagggtttggatcaaccggactaacagaggagaagtccgatggatccaaacaacctggcggcagcgcaaaagatg

SEQ ID NO: 72656 - DNA, 103 bp, Artificial Sequence
  Synthetic Polynucleotide
taatacgactcactataggggatagaggagatcaagggtttggatcaaccaacagaggagaggttgaatgaaacccttgaacctggcggcagcgcaaaagatg

SEQ ID NO: 72657 - DNA, 103 bp, Artificial Sequence
  Synthetic Polynucleotide
taatacgactcactataggggtacagatagaggagatcaagggtttggataacagaggagaatccaaatgcttgatctcaacctggcggcagcgcaaaagatg

SEQ ID NO: 72658 - DNA, 103 bp, Artificial Sequence
  Synthetic Polynucleotide
taatacgactcactatagggcttgtaaaggtaatttattagttcttcgagaacagaggagactcgaaatgctaataaataacctggcggcagcgcaaaagatg

SEQ ID NO: 72659 - DNA, 103 bp, Artificial Sequence
  Synthetic Polynucleotide
taatacgactcactatagggagatagtacagatagaggagatcaagggttaacagaggagaaaccctatgtctcctctaaacctggcggcagcgcaaaagatg

SEQ ID NO: 72660 - DNA, 103 bp, Artificial Sequence
  Synthetic Polynucleotide
taatacgactcactatagggtctctagatagtacagatagaggagatcaaaacagaggagattgatcatgtctatctgtaacctggcggcagcgcaaaagatg

SEQ ID NO: 72661 - DNA, 103 bp, Artificial Sequence
  Synthetic Polynucleotide
taatacgactcactatagggtacaatctctagatagtacagatagaggagaacagaggagactcctcatgctgtactataacctggcggcagcgcaaaagatg

SEQ ID NO: 72662 - DNA, 103 bp, Artificial Sequence
  Synthetic Polynucleotide
taatacgactcactatagggagaagtacaatctctagatagtacagatagaacagaggagactatctatgctatctagaaacctggcggcagcgcaaaagatg

SEQ ID NO: 72663 - DNA, 103 bp, Artificial Sequence
  Synthetic Polynucleotide
taatacgactcactatagggctgaaagaagtacaatctctagatagtacaaacagaggagatgtactatgtagagattgaacctggcggcagcgcaaaagatg

SEQ ID NO: 72664 - DNA, 103 bp, Artificial Sequence
  Synthetic Polynucleotide
taatacgactcactatagggcagaactgaaagaagtacaatctctagataaacagaggagatatctaatgattgtacttaacctggcggcagcgcaaaagatg

SEQ ID NO: 72665 - DNA, 103 bp, Artificial Sequence
  Synthetic Polynucleotide
taatacgactcactatagggttatccagaactgaaagaagtacaatctctaacagaggagaagagatatgacttctttcaacctggcggcagcgcaaaagatg

SEQ ID NO: 72666 - DNA, 103 bp, Artificial Sequence
  Synthetic Polynucleotide
taatacgactcactatagggatatattatccagaactgaaagaagtacaaaacagaggagattgtacatgtttcagttcaacctggcggcagcgcaaaagatg

SEQ ID NO: 72667 - DNA, 103 bp, Artificial Sequence
  Synthetic Polynucleotide
taatacgactcactatagggaacgtatatattatccagaactgaaagaagaacagaggagacttcttatggttctggataacctggcggcagcgcaaaagatg

SEQ ID NO: 72668 - DNA, 103 bp, Artificial Sequence
  Synthetic Polynucleotide
taatacgactcactatagggctatcaacgtatatattatccagaactgaaaacagaggagattcagtatgggataatataacctggcggcagcgcaaaagatg

SEQ ID NO: 72669 - DNA, 103 bp, Artificial Sequence
  Synthetic Polynucleotide
taatacgactcactatagggcatatcttgtaaaggtaatttattagttctaacagaggagaagaactatgaaattacctaacctggcggcagcgcaaaagatg

SEQ ID NO: 72670 - DNA, 103 bp, Artificial Sequence
  Synthetic Polynucleotide
taatacgactcactatagggctaatctatcaacgtatatattatccagaaaacagaggagattctggatgatatatacgaacctggcggcagcgcaaaagatg

SEQ ID NO: 72671 - DNA, 103 bp, Artificial Sequence
  Synthetic Polynucleotide
taatacgactcactatagggctcagctaatctatcaacgtatatattatcaacagaggagagataatatgtacgttgataacctggcggcagcgcaaaagatg

SEQ ID NO: 72672 - DNA, 103 bp, Artificial Sequence
  Synthetic Polynucleotide
taatacgactcactatagggaatagctcagctaatctatcaacgtatataaacagaggagatatataatgtgatagattaacctggcggcagcgcaaaagatg

SEQ ID NO: 72673 - DNA, 103 bp, Artificial Sequence
  Synthetic Polynucleotide
taatacgactcactataggggatagaatagctcagctaatctatcaacgtaacagaggagaacgttgatggattagctgaacctggcggcagcgcaaaagatg

SEQ ID NO: 72674 - DNA, 103 bp, Artificial Sequence
  Synthetic Polynucleotide
taatacgactcactatagggcgggggatagaatagctcagctaatctatcaacagaggagagatagaatggctgagctaaacctggcggcagcgcaaaagatg

SEQ ID NO: 72675 - DNA, 103 bp, Artificial Sequence
  Synthetic Polynucleotide
taatacgactcactatagggaaatacgggggatagaatagctcagctaataacagaggagaattagcatggctattctaaacctggcggcagcgcaaaagatg

SEQ ID NO: 72676 - DNA, 103 bp, Artificial Sequence
  Synthetic Polynucleotide
taatacgactcactatagggaatgtaaatacgggggatagaatagctcagaacagaggagactgagcatgtctatccccaacctggcggcagcgcaaaagatg

SEQ ID NO: 72677 - DNA, 103 bp, Artificial Sequence
  Synthetic Polynucleotide
taatacgactcactatagggcatttaatgtaaatacgggggatagaatagaacagaggagactattcatgcccccgtataacctggcggcagcgcaaaagatg

SEQ ID NO: 72678 - DNA, 103 bp, Artificial Sequence
  Synthetic Polynucleotide
taatacgactcactatagggatatacatttaatgtaaatacgggggatagaacagaggagactatccatggtatttacaaacctggcggcagcgcaaaagatg

SEQ ID NO: 72679 - DNA, 103 bp, Artificial Sequence
  Synthetic Polynucleotide
taatacgactcactatagggggaaaatatacatttaatgtaaatacggggaacagaggagaccccgtatgtacattaaaaacctggcggcagcgcaaaagatg

SEQ ID NO: 72680 - DNA, 103 bp, Artificial Sequence
  Synthetic Polynucleotide
taatacgactcactatagggataattagcaccaaaatagctatggattgtaacagaggagaacaatcatgagctattttaacctggcggcagcgcaaaagatg

SEQ ID NO: 72681 - DNA, 103 bp, Artificial Sequence
  Synthetic Polynucleotide
taatacgactcactatagggacaaccatatcttgtaaaggtaatttattaaacagaggagataataaatgacctttacaaacctggcggcagcgcaaaagatg

SEQ ID NO: 72682 - DNA, 103 bp, Artificial Sequence
  Synthetic Polynucleotide
taatacgactcactatagggataatggaaaatatacatttaatgtaaataaacagaggagatatttaatgtaaatgtataacctggcggcagcgcaaaagatg

SEQ ID NO: 72683 - DNA, 103 bp, Artificial Sequence
  Synthetic Polynucleotide
taatacgactcactatagggtattaataatggaaaatatacatttaatgtaacagaggagaacattaatggtatattttaacctggcggcagcgcaaaagatg

SEQ ID NO: 72684 - DNA, 103 bp, Artificial Sequence
  Synthetic Polynucleotide
taatacgactcactatagggattcttattaataatggaaaatatacatttaacagaggagaaaatgtatgttttccattaacctggcggcagcgcaaaagatg

SEQ ID NO: 72685 - DNA, 103 bp, Artificial Sequence
  Synthetic Polynucleotide
taatacgactcactataggggagtcattcttattaataatggaaaatataaacagaggagatatattatgcattattaaaacctggcggcagcgcaaaagatg

SEQ ID NO: 72686 - DNA, 103 bp, Artificial Sequence
  Synthetic Polynucleotide
taatacgactcactatagggtataggagtcattcttattaataatggaaaaacagaggagatttccaatgttaataagaaacctggcggcagcgcaaaagatg

SEQ ID NO: 72687 - DNA, 103 bp, Artificial Sequence
  Synthetic Polynucleotide
taatacgactcactatagggggaaatataggagtcattcttattaataataacagaggagaattattatgaagaatgacaacctggcggcagcgcaaaagatg

SEQ ID NO: 72688 - DNA, 103 bp, Artificial Sequence
  Synthetic Polynucleotide
taatacgactcactatagggataggggaaatataggagtcattcttattaaacagaggagataataaatgtgactcctaaacctggcggcagcgcaaaagatg

SEQ ID NO: 72689 - DNA, 103 bp, Artificial Sequence
  Synthetic Polynucleotide
taatacgactcactatagggagattataggggaaatataggagtcattctaacagaggagaagaatgatgcctatatttaacctggcggcagcgcaaaagatg

SEQ ID NO: 72690 - DNA, 103 bp, Artificial Sequence
  Synthetic Polynucleotide
taatacgactcactataggggacgaagattataggggaaatataggagtcaacagaggagagactccatgatttcccctaacctggcggcagcgcaaaagatg

SEQ ID NO: 72691 - DNA, 103 bp, Artificial Sequence
  Synthetic Polynucleotide
taatacgactcactatagggtaatagacgaagattataggggaaatatagaacagaggagactatatatgccctataataacctggcggcagcgcaaaagatg

SEQ ID NO: 72692 - DNA, 103 bp, Artificial Sequence
  Synthetic Polynucleotide
taatacgactcactatagggatggcacaaccatatcttgtaaaggtaattaacagaggagaaattacatgtacaagataaacctggcggcagcgcaaaagatg

SEQ ID NO: 72693 - DNA, 103 bp, Artificial Sequence
  Synthetic Polynucleotide
taatacgactcactatagggcggtgtaatagacgaagattataggggaaaaacagaggagatttcccatgtaatcttcgaacctggcggcagcgcaaaagatg

SEQ ID NO: 72694 - DNA, 103 bp, Artificial Sequence
  Synthetic Polynucleotide
taatacgactcactatagggggaggcggtgtaatagacgaagattataggaacagaggagacctataatgttcgtctataacctggcggcagcgcaaaagatg

SEQ ID NO: 72695 - DNA, 103 bp, Artificial Sequence
  Synthetic Polynucleotide
taatacgactcactatagggatataggaggcggtgtaatagacgaagattaacagaggagaaatcttatgctattacacaacctggcggcagcgcaaaagatg

SEQ ID NO: 72696 - DNA, 103 bp, Artificial Sequence
  Synthetic Polynucleotide
taatacgactcactatagggcattgatataggaggcggtgtaatagacgaaacagaggagatcgtctatgacaccgcctaacctggcggcagcgcaaaagatg

SEQ ID NO: 72697 - DNA, 103 bp, Artificial Sequence
  Synthetic Polynucleotide
taatacgactcactatagggaaaggcattgatataggaggcggtgtaataaacagaggagatattacatggcctcctataacctggcggcagcgcaaaagatg

SEQ ID NO: 72698 - DNA, 103 bp, Artificial Sequence
  Synthetic Polynucleotide
taatacgactcactatagggccctaaaaggcattgatataggaggcggtgaacagaggagacaccgcatgctatatcaaaacctggcggcagcgcaaaagatg

SEQ ID NO: 72699 - DNA, 103 bp, Artificial Sequence
  Synthetic Polynucleotide
taatacgactcactatagggtctgtccctaaaaggcattgatataggaggaacagaggagacctcctatgtcaatgcctaacctggcggcagcgcaaaagatg

SEQ ID NO: 72700 - DNA, 103 bp, Artificial Sequence
  Synthetic Polynucleotide
taatacgactcactatagggtctggtctgtccctaaaaggcattgatataaacagaggagatatatcatggccttttagaacctggcggcagcgcaaaagatg

SEQ ID NO: 72701 - DNA, 103 bp, Artificial Sequence
  Synthetic Polynucleotide
taatacgactcactatagggctaggtctggtctgtccctaaaaggcattgaacagaggagacaatgcatgttagggacaaacctggcggcagcgcaaaagatg

SEQ ID NO: 72702 - DNA, 103 bp, Artificial Sequence
  Synthetic Polynucleotide
taatacgactcactatagggagctcctaggtctggtctgtccctaaaaggaacagaggagaccttttatggacagaccaaacctggcggcagcgcaaaagatg

SEQ ID NO: 72703 - DNA, 103 bp, Artificial Sequence
  Synthetic Polynucleotide
taatacgactcactatagggaaattatggcacaaccatatcttgtaaaggaacagaggagacctttaatggatatggttaacctggcggcagcgcaaaagatg

SEQ ID NO: 72704 - DNA, 103 bp, Artificial Sequence
  Synthetic Polynucleotide
taatacgactcactatagggagaatagctcctaggtctggtctgtccctaaacagaggagatagggaatgaccagacctaacctggcggcagcgcaaaagatg

SEQ ID NO: 72705 - DNA, 103 bp, Artificial Sequence
  Synthetic Polynucleotide
taatacgactcactatagggatggtagaatagctcctaggtctggtctgtaacagaggagaacagacatgacctaggagaacctggcggcagcgcaaaagatg

SEQ ID NO: 72706 - DNA, 103 bp, Artificial Sequence
  Synthetic Polynucleotide
taatacgactcactatagggctgctatggtagaatagctcctaggtctggaacagaggagaccagacatgggagctattaacctggcggcagcgcaaaagatg

SEQ ID NO: 72707 - DNA, 103 bp, Artificial Sequence
  Synthetic Polynucleotide
taatacgactcactatagggaagttctgctatggtagaatagctcctaggaacagaggagacctaggatgtattctaccaacctggcggcagcgcaaaagatg

SEQ ID NO: 72708 - DNA, 103 bp, Artificial Sequence
  Synthetic Polynucleotide
taatacgactcactatagggtgcctaagttctgctatggtagaatagctcaacagaggagagagctaatgtaccatagcaacctggcggcagcgcaaaagatg

SEQ ID NO: 72709 - DNA, 103 bp, Artificial Sequence
  Synthetic Polynucleotide
taatacgactcactataggggtccatgcctaagttctgctatggtagaataacagaggagaattctaatgtagcagaacaacctggcggcagcgcaaaagatg

SEQ ID NO: 72710 - DNA, 103 bp, Artificial Sequence
  Synthetic Polynucleotide
taatacgactcactatagggagtatgtccatgcctaagttctgctatggtaacagaggagaaccataatggaacttaggaacctggcggcagcgcaaaagatg

SEQ ID NO: 72711 - DNA, 103 bp, Artificial Sequence
  Synthetic Polynucleotide
taatacgactcactatagggatattagtatgtccatgcctaagttctgctaacagaggagaagcagaatgtaggcatggaacctggcggcagcgcaaaagatg

SEQ ID NO: 72712 - DNA, 103 bp, Artificial Sequence
  Synthetic Polynucleotide
taatacgactcactataggggacagatattagtatgtccatgcctaagttaacagaggagaaacttaatgatggacataaacctggcggcagcgcaaaagatg

SEQ ID NO: 72713 - DNA, 103 bp, Artificial Sequence
  Synthetic Polynucleotide
taatacgactcactatagggattaagacagatattagtatgtccatgcctaacagaggagaaggcatatgcatactaataacctggcggcagcgcaaaagatg

SEQ ID NO: 72714 - DNA, 103 bp, Artificial Sequence
  Synthetic Polynucleotide
taatacgactcactatagggtataaaaattatggcacaaccatatcttgtaacagaggagaacaagaatgggttgtgccaacctggcggcagcgcaaaagatg

SEQ ID NO: 72715 - DNA, 103 bp, Artificial Sequence
  Synthetic Polynucleotide
taatacgactcactatagggaattaattaagacagatattagtatgtccaaacagaggagatggacaatgtaatatctgaacctggcggcagcgcaaaagatg

SEQ ID NO: 72716 - DNA, 103 bp, Artificial Sequence
  Synthetic Polynucleotide
taatacgactcactatagggaagacaattaattaagacagatattagtataacagaggagaatactaatgtctgtcttaaacctggcggcagcgcaaaagatg

SEQ ID NO: 72717 - DNA, 103 bp, Artificial Sequence
  Synthetic Polynucleotide
taatacgactcactatagggggagaaagacaattaattaagacagatattaacagaggagaaatatcatgcttaattaaaacctggcggcagcgcaaaagatg

SEQ ID NO: 72718 - DNA, 103 bp, Artificial Sequence
  Synthetic Polynucleotide
taatacgactcactatagggctccaggagaaagacaattaattaagacagaacagaggagactgtctatgttaattgtcaacctggcggcagcgcaaaagatg

SEQ ID NO: 72719 - DNA, 103 bp, Artificial Sequence
  Synthetic Polynucleotide
taatacgactcactatagggtatccctccaggagaaagacaattaattaaaacagaggagattaattatgtgtctttctaacctggcggcagcgcaaaagatg

SEQ ID NO: 72720 - DNA, 103 bp, Artificial Sequence
  Synthetic Polynucleotide
taatacgactcactatagggtatactatccctccaggagaaagacaattaaacagaggagataattgatgttctcctggaacctggcggcagcgcaaaagatg

SEQ ID NO: 72721 - DNA, 103 bp, Artificial Sequence
  Synthetic Polynucleotide
taatacgactcactatagggatgattatactatccctccaggagaaagacaacagaggagagtctttatgctggagggaaacctggcggcagcgcaaaagatg

SEQ ID NO: 72722 - DNA, 103 bp, Artificial Sequence
  Synthetic Polynucleotide
taatacgactcactatagggcgcttatgattatactatccctccaggagaaacagaggagatctcctatggggatagtaaacctggcggcagcgcaaaagatg

SEQ ID NO: 72723 - DNA, 103 bp, Artificial Sequence
  Synthetic Polynucleotide
taatacgactcactatagggtatagcgcttatgattatactatccctccaaacagaggagatggaggatgagtataatcaacctggcggcagcgcaaaagatg

SEQ ID NO: 72724 - DNA, 103 bp, Artificial Sequence
  Synthetic Polynucleotide
taatacgactcactatagggatttatatagcgcttatgattatactatccaacagaggagaggatagatgaatcataagaacctggcggcagcgcaaaagatg

SEQ ID NO: 72725 - DNA, 103 bp, Artificial Sequence
  Synthetic Polynucleotide
taatacgactcactatagggaaatttataaaaattatggcacaaccatataacagaggagaatatggatgtgccataataacctggcggcagcgcaaaagatg

SEQ ID NO: 72726 - DNA, 103 bp, Artificial Sequence
  Synthetic Polynucleotide
taatacgactcactatagggatatgatttatatagcgcttatgattatacaacagaggagagtataaatgtaagcgctaaacctggcggcagcgcaaaagatg

SEQ ID NO: 72727 - DNA, 103 bp, Artificial Sequence
  Synthetic Polynucleotide
taatacgactcactataggggccggatatgatttatatagcgcttatgataacagaggagaatcataatggctatataaaacctggcggcagcgcaaaagatg

SEQ ID NO: 72728 - DNA, 103 bp, Artificial Sequence
  Synthetic Polynucleotide
taatacgactcactatagggacgccgccggatatgatttatatagcgcttaacagaggagaaagcgcatgataaatcataacctggcggcagcgcaaaagatg

SEQ ID NO: 72729 - DNA, 103 bp, Artificial Sequence
  Synthetic Polynucleotide
taatacgactcactatagggaccgtacgccgccggatatgatttatatagaacagaggagactatatatgtcatatccgaacctggcggcagcgcaaaagatg

SEQ ID NO: 72730 - DNA, 103 bp, Artificial Sequence
  Synthetic Polynucleotide
taatacgactcactatagggcaatcaccgtacgccgccggatatgatttaaacagaggagataaatcatgtccggcggcaacctggcggcagcgcaaaagatg

SEQ ID NO: 72731 - DNA, 103 bp, Artificial Sequence
  Synthetic Polynucleotide
taatacgactcactatagggctagacaatcaccgtacgccgccggatatgaacagaggagacatatcatgcggcgtacgaacctggcggcagcgcaaaagatg

SEQ ID NO: 72732 - DNA, 103 bp, Artificial Sequence
  Synthetic Polynucleotide
taatacgactcactatagggtcctactagacaatcaccgtacgccgccggaacagaggagaccggcgatgtacggtgataacctggcggcagcgcaaaagatg

SEQ ID NO: 72733 - DNA, 103 bp, Artificial Sequence
  Synthetic Polynucleotide
taatacgactcactatagggaaatctcctactagacaatcaccgtacgccaacagaggagaggcgtaatgtgattgtctaacctggcggcagcgcaaaagatg

SEQ ID NO: 72734 - DNA, 103 bp, Artificial Sequence
  Synthetic Polynucleotide
taatacgactcactataggggagctaaatctcctactagacaatcaccgtaacagaggagaacggtgatggtctagtagaacctggcggcagcgcaaaagatg

SEQ ID NO: 72735 - DNA, 103 bp, Artificial Sequence
  Synthetic Polynucleotide
taatacgactcactatagggtaacagagctaaatctcctactagacaatcaacagaggagagattgtatggtaggagataacctggcggcagcgcaaaagatg

SEQ ID NO: 72736 - DNA, 103 bp, Artificial Sequence
  Synthetic Polynucleotide
taatacgactcactatagggtaaaaaaatttataaaaattatggcacaacaacagaggagagttgtgatgtaatttttaaacctggcggcagcgcaaaagatg

SEQ ID NO: 72737 - DNA, 103 bp, Artificial Sequence
  Synthetic Polynucleotide
taatacgactcactataggggaaactaacagagctaaatctcctactagaaacagaggagatctagtatgagatttagcaacctggcggcagcgcaaaagatg

SEQ ID NO: 72738 - DNA, 103 bp, Artificial Sequence
  Synthetic Polynucleotide
taatacgactcactatagggttaaggaaactaacagagctaaatctcctaaacagaggagataggagatgtagctctgtaacctggcggcagcgcaaaagatg

SEQ ID NO: 72739 - DNA, 103 bp, Artificial Sequence
  Synthetic Polynucleotide
taatacgactcactatagggatttgttaaggaaactaacagagctaaatcaacagaggagagatttaatgctgttagttaacctggcggcagcgcaaaagatg

SEQ ID NO: 72740 - DNA, 103 bp, Artificial Sequence
  Synthetic Polynucleotide
taatacgactcactataggggttagatttgttaaggaaactaacagagctaacagaggagaagctctatgagtttccttaacctggcggcagcgcaaaagatg

SEQ ID NO: 72741 - DNA, 103 bp, Artificial Sequence
  Synthetic Polynucleotide
taatacgactcactatagggcaccagttagatttgttaaggaaactaacaaacagaggagatgttagatgccttaacaaaacctggcggcagcgcaaaagatg

SEQ ID NO: 72742 - DNA, 103 bp, Artificial Sequence
  Synthetic Polynucleotide
taatacgactcactatagggtaactcaccagttagatttgttaaggaaacaacagaggagagtttccatgacaaatctaaacctggcggcagcgcaaaagatg

SEQ ID NO: 72743 - DNA, 103 bp, Artificial Sequence
  Synthetic Polynucleotide
taatacgactcactatagggaatattaactcaccagttagatttgttaagaacagaggagacttaacatgtctaactggaacctggcggcagcgcaaaagatg

SEQ ID NO: 72744 - DNA, 103 bp, Artificial Sequence
  Synthetic Polynucleotide
taatacgactcactatagggacatgaatattaactcaccagttagatttgaacagaggagacaaatcatgctggtgagtaacctggcggcagcgcaaaagatg

SEQ ID NO: 72745 - DNA, 103 bp, Artificial Sequence
  Synthetic Polynucleotide
taatacgactcactataggggttcaacatgaatattaactcaccagttagaacagaggagactaactatggagttaataaacctggcggcagcgcaaaagatg

SEQ ID NO: 72746 - DNA, 103 bp, Artificial Sequence
  Synthetic Polynucleotide
taatacgactcactatagggtttatgttcaacatgaatattaactcaccaaacagaggagatggtgaatgaatattcataacctggcggcagcgcaaaagatg

SEQ ID NO: 72747 - DNA, 103 bp, Artificial Sequence
  Synthetic Polynucleotide
taatacgactcactatagggactcataaaaaaatttataaaaattatggcaacagaggagagccataatgtttataaataacctggcggcagcgcaaaagatg

SEQ ID NO: 72748 - DNA, 103 bp, Artificial Sequence
  Synthetic Polynucleotide
taatacgactcactatagggttagttttatgttcaacatgaatattaactaacagaggagaagttaaatgtcatgttgaaacctggcggcagcgcaaaagatg

SEQ ID NO: 72749 - DNA, 103 bp, Artificial Sequence
  Synthetic Polynucleotide
taatacgactcactatagggaaatattagttttatgttcaacatgaatataacagaggagaatattcatgttgaacataaacctggcggcagcgcaaaagatg

SEQ ID NO: 72750 - DNA, 103 bp, Artificial Sequence
  Synthetic Polynucleotide
taatacgactcactatagggaaataaaatattagttttatgttcaacatgaacagaggagacatgttatgcataaaactaacctggcggcagcgcaaaagatg

SEQ ID NO: 72751 - DNA, 103 bp, Artificial Sequence
  Synthetic Polynucleotide
taatacgactcactatagggttttgaaataaaatattagttttatgttcaaacagaggagatgaacaatgaactaatataacctggcggcagcgcaaaagatg

SEQ ID NO: 72752 - DNA, 103 bp, Artificial Sequence
  Synthetic Polynucleotide
taatacgactcactatagggaataattttgaaataaaatattagttttataacagaggagaataaaaatgatattttataacctggcggcagcgcaaaagatg

SEQ ID NO: 72753 - DNA, 103 bp, Artificial Sequence
  Synthetic Polynucleotide
taatacgactcactatagggtggtaaataattttgaaataaaatattagtaacagaggagaactaatatgttatttcaaaacctggcggcagcgcaaaagatg

SEQ ID NO: 72754 - DNA, 103 bp, Artificial Sequence
  Synthetic Polynucleotide
taatacgactcactatagggtgggatggtaaataattttgaaataaaataaacagaggagatattttatgtcaaaattaaacctggcggcagcgcaaaagatg

SEQ ID NO: 72755 - DNA, 103 bp, Artificial Sequence
  Synthetic Polynucleotide
taatacgactcactatagggatatatgggatggtaaataattttgaaataaacagaggagatatttcatgattatttacaacctggcggcagcgcaaaagatg

SEQ ID NO: 72756 - DNA, 103 bp, Artificial Sequence
  Synthetic Polynucleotide
taatacgactcactatagggatggaatatatgggatggtaaataattttgaacagaggagacaaaatatgttaccatccaacctggcggcagcgcaaaagatg

SEQ ID NO: 72757 - DNA, 103 bp, Artificial Sequence
  Synthetic Polynucleotide
taatacgactcactatagggtattcatggaatatatgggatggtaaataaaacagaggagattatttatgatcccatataacctggcggcagcgcaaaagatg

SEQ ID NO: 72758 - DNA, 103 bp, Artificial Sequence
  Synthetic Polynucleotide
taatacgactcactatagggaaaatactcataaaaaaatttataaaaattaacagaggagaaattttatgaaattttttaacctggcggcagcgcaaaagatg

SEQ ID NO: 72759 - DNA, 103 bp, Artificial Sequence
  Synthetic Polynucleotide
taatacgactcactataggggcacttattcatggaatatatgggatggtaaacagaggagataccatatgatatattccaacctggcggcagcgcaaaagatg

SEQ ID NO: 72760 - DNA, 103 bp, Artificial Sequence
  Synthetic Polynucleotide
taatacgactcactatagggtcatcgcacttattcatggaatatatgggaaacagaggagatcccatatgttccatgaaaacctggcggcagcgcaaaagatg

SEQ ID NO: 72761 - DNA, 103 bp, Artificial Sequence
  Synthetic Polynucleotide
taatacgactcactatagggtacaatcatcgcacttattcatggaatataaacagaggagatatattatgtgaataagtaacctggcggcagcgcaaaagatg

SEQ ID NO: 72762 - DNA, 103 bp, Artificial Sequence
  Synthetic Polynucleotide
taatacgactcactatagggaagtgtacaatcatcgcacttattcatggaaacagaggagatccatgatgaagtgcgataacctggcggcagcgcaaaagatg

SEQ ID NO: 72763 - DNA, 103 bp, Artificial Sequence
  Synthetic Polynucleotide
taatacgactcactatagggtatagaagtgtacaatcatcgcacttattcaacagaggagagaataaatgcgatgattgaacctggcggcagcgcaaaagatg

SEQ ID NO: 72764 - DNA, 103 bp, Artificial Sequence
  Synthetic Polynucleotide
taatacgactcactataggggatactatagaagtgtacaatcatcgcactaacagaggagaagtgcgatgattgtacacaacctggcggcagcgcaaaagatg

SEQ ID NO: 72765 - DNA, 103 bp, Artificial Sequence
  Synthetic Polynucleotide
taatacgactcactatagggtaatagatactatagaagtgtacaatcatcaacagaggagagatgatatgacacttctaaacctggcggcagcgcaaaagatg

SEQ ID NO: 72766 - DNA, 103 bp, Artificial Sequence
  Synthetic Polynucleotide
taatacgactcactataggggttcgtaatagatactatagaagtgtacaaaacagaggagattgtacatgtctatagtaaacctggcggcagcgcaaaagatg

SEQ ID NO: 72767 - DNA, 103 bp, Artificial Sequence
  Synthetic Polynucleotide
taatacgactcactatagggtcgtggttcgtaatagatactatagaagtgaacagaggagacacttcatgagtatctataacctggcggcagcgcaaaagatg

SEQ ID NO: 72768 - DNA, 103 bp, Artificial Sequence
  Synthetic Polynucleotide
taatacgactcactatagggttttatcgtggttcgtaatagatactatagaacagaggagactatagatgctattacgaaacctggcggcagcgcaaaagatg

SEQ ID NO: 72769 - DNA, 103 bp, Artificial Sequence
  Synthetic Polynucleotide
taatacgactcactatagggtcataaaaatactcataaaaaaatttataaaacagaggagattataaatgtttttatgaaacctggcggcagcgcaaaagatg

SEQ ID NO: 72770 - DNA, 103 bp, Artificial Sequence
  Synthetic Polynucleotide
taatacgactcactataggggaggattttatcgtggttcgtaatagatacaacagaggagagtatctatgacgaaccacaacctggcggcagcgcaaaagatg

SEQ ID NO: 72771 - DNA, 103 bp, Artificial Sequence
  Synthetic Polynucleotide
taatacgactcactataggggataggaggattttatcgtggttcgtaataaacagaggagatattacatgccacgataaaacctggcggcagcgcaaaagatg

SEQ ID NO: 72772 - DNA, 103 bp, Artificial Sequence
  Synthetic Polynucleotide
taatacgactcactatagggctattgataggaggattttatcgtggttcgaacagaggagacgaaccatgataaaatccaacctggcggcagcgcaaaagatg

SEQ ID NO: 72773 - DNA, 103 bp, Artificial Sequence
  Synthetic Polynucleotide
taatacgactcactatagggaactgctattgataggaggattttatcgtgaacagaggagacacgatatgatcctcctaaacctggcggcagcgcaaaagatg

SEQ ID NO: 72774 - DNA, 103 bp, Artificial Sequence
  Synthetic Polynucleotide
taatacgactcactatagggtaataaactgctattgataggaggattttaaacagaggagataaaatatgcctatcaataacctggcggcagcgcaaaagatg

SEQ ID NO: 72775 - DNA, 103 bp, Artificial Sequence
  Synthetic Polynucleotide
taatacgactcactataggggtggataataaactgctattgataggaggaaacagaggagatcctccatgcaatagcagaacctggcggcagcgcaaaagatg

SEQ ID NO: 72776 - DNA, 103 bp, Artificial Sequence
  Synthetic Polynucleotide
taatacgactcactatagggtaatagtggataataaactgctattgatagaacagaggagactatcaatggcagtttataacctggcggcagcgcaaaagatg

SEQ ID NO: 72777 - DNA, 103 bp, Artificial Sequence
  Synthetic Polynucleotide
taatacgactcactatagggattgataatagtggataataaactgctattaacagaggagaaatagcatgttattatccaacctggcggcagcgcaaaagatg

SEQ ID NO: 72778 - DNA, 103 bp, Artificial Sequence
  Synthetic Polynucleotide
taatacgactcactatagggccagaattgataatagtggataataaactgaacagaggagacagtttatgatccactataacctggcggcagcgcaaaagatg

SEQ ID NO: 72779 - DNA, 103 bp, Artificial Sequence
  Synthetic Polynucleotide
taatacgactcactatagggataatccagaattgataatagtggataataaacagaggagatattatatgctattatcaaacctggcggcagcgcaaaagatg

SEQ ID NO: 72780 - DNA, 103 bp, Artificial Sequence
  Synthetic Polynucleotide
taatacgactcactatagggaatactcataaaaatactcataaaaaaattaacagaggagaaattttatgatgagtattaacctggcggcagcgcaaaagatg

SEQ ID NO: 72781 - DNA, 103 bp, Artificial Sequence
  Synthetic Polynucleotide
taatacgactcactatagggaagggataatccagaattgataatagtggaaacagaggagatccactatgatcaattctaacctggcggcagcgcaaaagatg

SEQ ID NO: 72782 - DNA, 103 bp, Artificial Sequence
  Synthetic Polynucleotide
taatacgactcactatagggtatcaaagggataatccagaattgataataaacagaggagatattatatgttctggattaacctggcggcagcgcaaaagatg

SEQ ID NO: 72783 - DNA, 103 bp, Artificial Sequence
  Synthetic Polynucleotide
taatacgactcactatagggctatttatcaaagggataatccagaattgaaacagaggagatcaattatggattatcccaacctggcggcagcgcaaaagatg

SEQ ID NO: 72784 - DNA, 103 bp, Artificial Sequence
  Synthetic Polynucleotide
taatacgactcactatagggtgatactatttatcaaagggataatccagaaacagaggagatctggaatgtccctttgaaacctggcggcagcgcaaaagatg

SEQ ID NO: 72785 - DNA, 103 bp, Artificial Sequence
  Synthetic Polynucleotide
taatacgactcactatagggatagatgatactatttatcaaagggataataacagaggagaattatcatgttgataaataacctggcggcagcgcaaaagatg

SEQ ID NO: 72786 - DNA, 103 bp, Artificial Sequence
  Synthetic Polynucleotide
taatacgactcactatagggctctgatagatgatactatttatcaaagggaacagaggagaccctttatgaaatagtataacctggcggcagcgcaaaagatg

SEQ ID NO: 72787 - DNA, 103 bp, Artificial Sequence
  Synthetic Polynucleotide
taatacgactcactatagggatggtctctgatagatgatactatttatcaaacagaggagatgataaatggtatcatctaacctggcggcagcgcaaaagatg

SEQ ID NO: 72788 - DNA, 103 bp, Artificial Sequence
  Synthetic Polynucleotide
taatacgactcactatagggaatacatggtctctgatagatgatactattaacagaggagaaatagtatgatctatcagaacctggcggcagcgcaaaagatg

SEQ ID NO: 72789 - DNA, 103 bp, Artificial Sequence
  Synthetic Polynucleotide
taatacgactcactatagggacagcaatacatggtctctgatagatgataaacagaggagatatcatatgtcagagaccaacctggcggcagcgcaaaagatg

SEQ ID NO: 72790 - DNA, 103 bp, Artificial Sequence
  Synthetic Polynucleotide
taatacgactcactatagggcaaatacagcaatacatggtctctgatagaaacagaggagatctatcatggaccatgtaaacctggcggcagcgcaaaagatg

SEQ ID NO: 72791 - DNA, 103 bp, Artificial Sequence
  Synthetic Polynucleotide
taatacgactcactatagggtaggaataattagcaccaaaatagctatggaacagaggagaccatagatgttttggtgcaacctggcggcagcgcaaaagatg

SEQ ID NO: 72792 - DNA, 103 bp, Artificial Sequence
  Synthetic Polynucleotide
taatacgactcactatagggtgaaaaatactcataaaaatactcataaaaaacagaggagattttatatgtatttttataacctggcggcagcgcaaaagatg

SEQ ID NO: 72793 - DNA, 103 bp, Artificial Sequence
  Synthetic Polynucleotide
taatacgactcactatagggtattacaaatacagcaatacatggtctctgaacagaggagacagagaatgtgtattgctaacctggcggcagcgcaaaagatg

SEQ ID NO: 72794 - DNA, 103 bp, Artificial Sequence
  Synthetic Polynucleotide
taatacgactcactatagggaattttattacaaatacagcaatacatggtaacagaggagaaccatgatgtgctgtattaacctggcggcagcgcaaaagatg

SEQ ID NO: 72795 - DNA, 103 bp, Artificial Sequence
  Synthetic Polynucleotide
taatacgactcactatagggtgctaaattttattacaaatacagcaatacaacagaggagagtattgatgtatttgtaaaacctggcggcagcgcaaaagatg

SEQ ID NO: 72796 - DNA, 103 bp, Artificial Sequence
  Synthetic Polynucleotide
taatacgactcactatagggagaaatgctaaattttattacaaatacagcaacagaggagagctgtaatggtaataaaaaacctggcggcagcgcaaaagatg

SEQ ID NO: 72797 - DNA, 103 bp, Artificial Sequence
  Synthetic Polynucleotide
taatacgactcactatagggttggtagaaatgctaaattttattacaaataacagaggagaatttgtatgaaaatttagaacctggcggcagcgcaaaagatg

SEQ ID NO: 72798 - DNA, 103 bp, Artificial Sequence
  Synthetic Polynucleotide
taatacgactcactatagggcttggttggtagaaatgctaaattttattaaacagaggagataataaatgttagcatttaacctggcggcagcgcaaaagatg

SEQ ID NO: 72799 - DNA, 103 bp, Artificial Sequence
  Synthetic Polynucleotide
taatacgactcactatagggttattcttggttggtagaaatgctaaatttaacagaggagaaaatttatgatttctaccaacctggcggcagcgcaaaagatg

SEQ ID NO: 72800 - DNA, 103 bp, Artificial Sequence
  Synthetic Polynucleotide
taatacgactcactataggggaaggttattcttggttggtagaaatgctaaacagaggagatagcatatgtaccaaccaaacctggcggcagcgcaaaagatg

SEQ ID NO: 72801 - DNA, 103 bp, Artificial Sequence
  Synthetic Polynucleotide
taatacgactcactatagggcggtagaaggttattcttggttggtagaaaaacagaggagatttctaatgaccaagaataacctggcggcagcgcaaaagatg

SEQ ID NO: 72802 - DNA, 103 bp, Artificial Sequence
  Synthetic Polynucleotide
taatacgactcactataggggtgttcggtagaaggttattcttggttggtaacagaggagaaccaacatggaataacctaacctggcggcagcgcaaaagatg

SEQ ID NO: 72803 - DNA, 103 bp, Artificial Sequence
  Synthetic Polynucleotide
taatacgactcactatagggttttttgaaaaatactcataaaaatactcaaacagaggagatgagtaatgttatgagtaaacctggcggcagcgcaaaagatg

SEQ ID NO: 72804 - DNA, 103 bp, Artificial Sequence
  Synthetic Polynucleotide
taatacgactcactatagggcgttagtgttcggtagaaggttattcttggaacagaggagaccaagaatgaccttctacaacctggcggcagcgcaaaagatg

SEQ ID NO: 72805 - DNA, 103 bp, Artificial Sequence
  Synthetic Polynucleotide
taatacgactcactatagggatgcgcgttagtgttcggtagaaggttattaacagaggagaaataacatgctaccgaacaacctggcggcagcgcaaaagatg

SEQ ID NO: 72806 - DNA, 103 bp, Artificial Sequence
  Synthetic Polynucleotide
taatacgactcactatagggaaatcatgcgcgttagtgttcggtagaaggaacagaggagaccttctatggaacactaaaacctggcggcagcgcaaaagatg

SEQ ID NO: 72807 - DNA, 103 bp, Artificial Sequence
  Synthetic Polynucleotide
taatacgactcactatagggattataaatcatgcgcgttagtgttcggtaaacagaggagataccgaatgctaacgcgcaacctggcggcagcgcaaaagatg

SEQ ID NO: 72808 - DNA, 103 bp, Artificial Sequence
  Synthetic Polynucleotide
taatacgactcactatagggtccacattataaatcatgcgcgttagtgttaacagaggagaaacactatggcgcatgataacctggcggcagcgcaaaagatg

SEQ ID NO: 72809 - DNA, 103 bp, Artificial Sequence
  Synthetic Polynucleotide
taatacgactcactatagggtattatccacattataaatcatgcgcgttaaacagaggagataacgcatgtgatttataaacctggcggcagcgcaaaagatg

SEQ ID NO: 72810 - DNA, 103 bp, Artificial Sequence
  Synthetic Polynucleotide
taatacgactcactatagggcaacttattatccacattataaatcatgcgaacagaggagacgcatgatgtataatgtgaacctggcggcagcgcaaaagatg

SEQ ID NO: 72811 - DNA, 103 bp, Artificial Sequence
  Synthetic Polynucleotide
taatacgactcactatagggaccgtcaacttattatccacattataaatcaacagaggagagatttaatgtgtggataaaacctggcggcagcgcaaaagatg

SEQ ID NO: 72812 - DNA, 103 bp, Artificial Sequence
  Synthetic Polynucleotide
taatacgactcactatagggtttggaccgtcaacttattatccacattataacagaggagaataatgatgataataagtaacctggcggcagcgcaaaagatg

SEQ ID NO: 72813 - DNA, 103 bp, Artificial Sequence
  Synthetic Polynucleotide
taatacgactcactatagggggcagtttggaccgtcaacttattatccacaacagaggagagtggatatgaagttgacgaacctggcggcagcgcaaaagatg

SEQ ID NO: 72814 - DNA, 103 bp, Artificial Sequence
  Synthetic Polynucleotide
taatacgactcactatagggatacattttttgaaaaatactcataaaaataacagaggagaatttttatgagtatttttaacctggcggcagcgcaaaagatg

SEQ ID NO: 72815 - DNA, 103 bp, Artificial Sequence
  Synthetic Polynucleotide
taatacgactcactatagggtcagtggcagtttggaccgtcaacttattaaacagaggagataataaatggacggtccaaacctggcggcagcgcaaaagatg

SEQ ID NO: 72816 - DNA, 103 bp, Artificial Sequence
  Synthetic Polynucleotide
taatacgactcactatagggcatgatcagtggcagtttggaccgtcaactaacagaggagaagttgaatgtccaaactgaacctggcggcagcgcaaaagatg

SEQ ID NO: 72817 - DNA, 103 bp, Artificial Sequence
  Synthetic Polynucleotide
taatacgactcactatagggccaatcatgatcagtggcagtttggaccgtaacagaggagaacggtcatgactgccactaacctggcggcagcgcaaaagatg

SEQ ID NO: 72818 - DNA, 103 bp, Artificial Sequence
  Synthetic Polynucleotide
taatacgactcactataggggctacccaatcatgatcagtggcagtttggaacagaggagaccaaacatgcactgatcaaacctggcggcagcgcaaaagatg

SEQ ID NO: 72819 - DNA, 103 bp, Artificial Sequence
  Synthetic Polynucleotide
taatacgactcactatagggtatttgctacccaatcatgatcagtggcagaacagaggagactgccaatgatcatgattaacctggcggcagcgcaaaagatg

SEQ ID NO: 72820 - DNA, 103 bp, Artificial Sequence
  Synthetic Polynucleotide
taatacgactcactatagggcagaatatttgctacccaatcatgatcagtaacagaggagaactgatatggattgggtaaacctggcggcagcgcaaaagatg

SEQ ID NO: 72821 - DNA, 103 bp, Artificial Sequence
  Synthetic Polynucleotide
taatacgactcactatagggaactacagaatatttgctacccaatcatgaaacagaggagatcatgaatgggtagcaaaaacctggcggcagcgcaaaagatg

SEQ ID NO: 72822 - DNA, 103 bp, Artificial Sequence
  Synthetic Polynucleotide
taatacgactcactataggggatacaactacagaatatttgctacccaataacagaggagaattgggatgcaaatattcaacctggcggcagcgcaaaagatg

SEQ ID NO: 72823 - DNA, 103 bp, Artificial Sequence
  Synthetic Polynucleotide
taatacgactcactatagggaaacggatacaactacagaatatttgctacaacagaggagagtagcaatgattctgtagaacctggcggcagcgcaaaagatg

SEQ ID NO: 72824 - DNA, 103 bp, Artificial Sequence
  Synthetic Polynucleotide
taatacgactcactatagggttctgaaacggatacaactacagaatatttaacagaggagaaaatatatggtagttgtaaacctggcggcagcgcaaaagatg

SEQ ID NO: 72825 - DNA, 103 bp, Artificial Sequence
  Synthetic Polynucleotide
taatacgactcactatagggactttatacattttttgaaaaatactcataaacagaggagatatgagatgttttcaaaaaacctggcggcagcgcaaaagatg

SEQ ID NO: 72826 - DNA, 103 bp, Artificial Sequence
  Synthetic Polynucleotide
taatacgactcactatagggggacattctgaaacggatacaactacagaaaacagaggagattctgtatgtgtatccgtaacctggcggcagcgcaaaagatg

SEQ ID NO: 72827 - DNA, 103 bp, Artificial Sequence
  Synthetic Polynucleotide
taatacgactcactatagggtaggaggacattctgaaacggatacaactaaacagaggagatagttgatgccgtttcagaacctggcggcagcgcaaaagatg

SEQ ID NO: 72828 - DNA, 103 bp, Artificial Sequence
  Synthetic Polynucleotide
taatacgactcactatagggcgtaataggaggacattctgaaacggatacaacagaggagagtatccatgtcagaatgtaacctggcggcagcgcaaaagatg

SEQ ID NO: 72829 - DNA, 103 bp, Artificial Sequence
  Synthetic Polynucleotide
taatacgactcactatagggatgtacgtaataggaggacattctgaaacgaacagaggagacgtttcatgatgtcctccaacctggcggcagcgcaaaagatg

SEQ ID NO: 72830 - DNA, 103 bp, Artificial Sequence
  Synthetic Polynucleotide
taatacgactcactatagggatgttatgtacgtaataggaggacattctgaacagaggagacagaatatgctcctattaaacctggcggcagcgcaaaagatg

SEQ ID NO: 72831 - DNA, 103 bp, Artificial Sequence
  Synthetic Polynucleotide
taatacgactcactatagggaaacaatgttatgtacgtaataggaggacaaacagaggagatgtcctatgattacgtacaacctggcggcagcgcaaaagatg

SEQ ID NO: 72832 - DNA, 103 bp, Artificial Sequence
  Synthetic Polynucleotide
taatacgactcactatagggtccataaacaatgttatgtacgtaataggaaacagaggagatcctatatggtacataacaacctggcggcagcgcaaaagatg

SEQ ID NO: 72833 - DNA, 103 bp, Artificial Sequence
  Synthetic Polynucleotide
taatacgactcactatagggtggcatccataaacaatgttatgtacgtaaaacagaggagattacgtatgtaacattgtaacctggcggcagcgcaaaagatg

SEQ ID NO: 72834 - DNA, 103 bp, Artificial Sequence
  Synthetic Polynucleotide
taatacgactcactatagggagcaatggcatccataaacaatgttatgtaaacagaggagatacataatgttgtttatgaacctggcggcagcgcaaaagatg

SEQ ID NO: 72835 - DNA, 103 bp, Artificial Sequence
  Synthetic Polynucleotide
taatacgactcactatagggaatccagcaatggcatccataaacaatgttaacagaggagaaacattatgtatggatgcaacctggcggcagcgcaaaagatg

SEQ ID NO: 72836 - DNA, 103 bp, Artificial Sequence
  Synthetic Polynucleotide
taatacgactcactatagggcatacactttatacattttttgaaaaatacaacagaggagagtatttatgaaaaaatgtaacctggcggcagcgcaaaagatg

SEQ ID NO: 72837 - DNA, 103 bp, Artificial Sequence
  Synthetic Polynucleotide
taatacgactcactataggggatgtaatccagcaatggcatccataaacaaacagaggagatgtttaatgatgccattgaacctggcggcagcgcaaaagatg

SEQ ID NO: 72838 - DNA, 103 bp, Artificial Sequence
  Synthetic Polynucleotide
taatacgactcactatagggacctagatgtaatccagcaatggcatccataacagaggagaatggatatgattgctggaaacctggcggcagcgcaaaagatg

SEQ ID NO: 72839 - DNA, 103 bp, Artificial Sequence
  Synthetic Polynucleotide
taatacgactcactatagggttgaaacctagatgtaatccagcaatggcaaacagaggagatgccatatgtggattacaaacctggcggcagcgcaaaagatg

SEQ ID NO: 72840 - DNA, 103 bp, Artificial Sequence
  Synthetic Polynucleotide
taatacgactcactataggggtcttttgaaacctagatgtaatccagcaaaacagaggagattgctgatgtacatctagaacctggcggcagcgcaaaagatg

SEQ ID NO: 72841 - DNA, 103 bp, Artificial Sequence
  Synthetic Polynucleotide
taatacgactcactataggggccgagtcttttgaaacctagatgtaatccaacagaggagaggattaatgctaggtttcaacctggcggcagcgcaaaagatg

SEQ ID NO: 72842 - DNA, 103 bp, Artificial Sequence
  Synthetic Polynucleotide
taatacgactcactatagggaatatgccgagtcttttgaaacctagatgtaacagaggagaacatctatgtttcaaaagaacctggcggcagcgcaaaagatg

SEQ ID NO: 72843 - DNA, 103 bp, Artificial Sequence
  Synthetic Polynucleotide
taatacgactcactataggggggttaatatgccgagtcttttgaaacctaaacagaggagataggttatgaaagactcgaacctggcggcagcgcaaaagatg

SEQ ID NO: 72844 - DNA, 103 bp, Artificial Sequence
  Synthetic Polynucleotide
taatacgactcactatagggtgcttgggttaatatgccgagtcttttgaaaacagaggagattcaaaatgctcggcataaacctggcggcagcgcaaaagatg

SEQ ID NO: 72845 - DNA, 103 bp, Artificial Sequence
  Synthetic Polynucleotide
taatacgactcactatagggaatgctgcttgggttaatatgccgagtcttaacagaggagaaagactatgcatattaacaacctggcggcagcgcaaaagatg

SEQ ID NO: 72846 - DNA, 103 bp, Artificial Sequence
  Synthetic Polynucleotide
taatacgactcactatagggacgggaatgctgcttgggttaatatgccgaaacagaggagatcggcaatgtaacccaagaacctggcggcagcgcaaaagatg

SEQ ID NO: 72847 - DNA, 103 bp, Artificial Sequence
  Synthetic Polynucleotide
taatacgactcactatagggtaagacatacactttatacattttttgaaaaacagaggagatttcaaatgatgtataaaaacctggcggcagcgcaaaagatg

SEQ ID NO: 72848 - DNA, 103 bp, Artificial Sequence
  Synthetic Polynucleotide
taatacgactcactataggggttccacgggaatgctgcttgggttaatataacagaggagaatattaatgcaagcagcaaacctggcggcagcgcaaaagatg

SEQ ID NO: 72849 - DNA, 103 bp, Artificial Sequence
  Synthetic Polynucleotide
taatacgactcactatagggcgttggttccacgggaatgctgcttgggttaacagaggagaaacccaatgagcattcccaacctggcggcagcgcaaaagatg

SEQ ID NO: 72850 - DNA, 103 bp, Artificial Sequence
  Synthetic Polynucleotide
taatacgactcactatagggttgagcgttggttccacgggaatgctgcttaacagaggagaaagcagatgtcccgtggaaacctggcggcagcgcaaaagatg

SEQ ID NO: 72851 - DNA, 103 bp, Artificial Sequence
  Synthetic Polynucleotide
taatacgactcactatagggatctgttgagcgttggttccacgggaatgcaacagaggagagcattcatgtggaaccaaaacctggcggcagcgcaaaagatg

SEQ ID NO: 72852 - DNA, 103 bp, Artificial Sequence
  Synthetic Polynucleotide
taatacgactcactatagggcccacatctgttgagcgttggttccacgggaacagaggagacccgtgatgccaacgctcaacctggcggcagcgcaaaagatg

SEQ ID NO: 72853 - DNA, 103 bp, Artificial Sequence
  Synthetic Polynucleotide
taatacgactcactatagggcaaatcccacatctgttgagcgttggttccaacagaggagaggaaccatggctcaacagaacctggcggcagcgcaaaagatg

SEQ ID NO: 72854 - DNA, 103 bp, Artificial Sequence
  Synthetic Polynucleotide
taatacgactcactatagggtctaccaaatcccacatctgttgagcgttgaacagaggagacaacgcatgacagatgtgaacctggcggcagcgcaaaagatg

SEQ ID NO: 72855 - DNA, 103 bp, Artificial Sequence
  Synthetic Polynucleotide
taatacgactcactatagggggaggtctaccaaatcccacatctgttgagaacagaggagactcaacatgtgtgggattaacctggcggcagcgcaaaagatg

SEQ ID NO: 72856 - DNA, 103 bp, Artificial Sequence
  Synthetic Polynucleotide
taatacgactcactatagggtagtaggaggtctaccaaatcccacatctgaacagaggagacagatgatggatttggtaaacctggcggcagcgcaaaagatg

SEQ ID NO: 72857 - DNA, 103 bp, Artificial Sequence
  Synthetic Polynucleotide
taatacgactcactatagggatacgtagtaggaggtctaccaaatcccacaacagaggagagtgggaatgggtagacctaacctggcggcagcgcaaaagatg

SEQ ID NO: 72858 - DNA, 103 bp, Artificial Sequence
  Synthetic Polynucleotide
taatacgactcactatagggatacataagacatacactttatacatttttaacagaggagaaaaaatatgtaaagtgtaaacctggcggcagcgcaaaagatg

SEQ ID NO: 72859 - DNA, 103 bp, Artificial Sequence
  Synthetic Polynucleotide
taatacgactcactatagggaaattatacgtagtaggaggtctaccaaataacagaggagaatttggatgacctcctacaacctggcggcagcgcaaaagatg

SEQ ID NO: 72860 - DNA, 103 bp, Artificial Sequence
  Synthetic Polynucleotide
taatacgactcactatagggacaataaattatacgtagtaggaggtctacaacagaggagagtagacatgctactacgtaacctggcggcagcgcaaaagatg

SEQ ID NO: 72861 - DNA, 103 bp, Artificial Sequence
  Synthetic Polynucleotide
taatacgactcactatagggcgctaacaataaattatacgtagtaggaggaacagaggagacctcctatgacgtataataacctggcggcagcgcaaaagatg

SEQ ID NO: 72862 - DNA, 103 bp, Artificial Sequence
  Synthetic Polynucleotide
taatacgactcactatagggatacccgctaacaataaattatacgtagtaaacagaggagatactacatgtaatttattaacctggcggcagcgcaaaagatg

SEQ ID NO: 72863 - DNA, 103 bp, Artificial Sequence
  Synthetic Polynucleotide
taatacgactcactataggggcgggatacccgctaacaataaattatacgaacagaggagacgtataatgtattgttagaacctggcggcagcgcaaaagatg

SEQ ID NO: 72864 - DNA, 103 bp, Artificial Sequence
  Synthetic Polynucleotide
taatacgactcactatagggtgctagcgggatacccgctaacaataaattaacagaggagaaatttaatgttagcgggtaacctggcggcagcgcaaaagatg

SEQ ID NO: 72865 - DNA, 103 bp, Artificial Sequence
  Synthetic Polynucleotide
taatacgactcactatagggctgtatgctagcgggatacccgctaacaataacagaggagaattgttatggggtatcccaacctggcggcagcgcaaaagatg

SEQ ID NO: 72866 - DNA, 103 bp, Artificial Sequence
  Synthetic Polynucleotide
taatacgactcactatagggccaaactgtatgctagcgggatacccgctaaacagaggagatagcggatgtcccgctagaacctggcggcagcgcaaaagatg

SEQ ID NO: 72867 - DNA, 103 bp, Artificial Sequence
  Synthetic Polynucleotide
taatacgactcactatagggtagccccaaactgtatgctagcgggataccaacagaggagaggtatcatgctagcatacaacctggcggcagcgcaaaagatg

SEQ ID NO: 72868 - DNA, 103 bp, Artificial Sequence
  Synthetic Polynucleotide
taatacgactcactatagggatgaatagccccaaactgtatgctagcgggaacagaggagacccgctatgatacagtttaacctggcggcagcgcaaaagatg

SEQ ID NO: 72869 - DNA, 103 bp, Artificial Sequence
  Synthetic Polynucleotide
taatacgactcactatagggtaaatatacataagacatacactttatacaaacagaggagatgtataatgtgtatgtctaacctggcggcagcgcaaaagatg

SEQ ID NO: 72870 - DNA, 103 bp, Artificial Sequence
  Synthetic Polynucleotide
taatacgactcactatagggctccgatgaatagccccaaactgtatgctaaacagaggagatagcatatggtttggggcaacctggcggcagcgcaaaagatg

SEQ ID NO: 72871 - DNA, 103 bp, Artificial Sequence
  Synthetic Polynucleotide
taatacgactcactatagggaattcctccgatgaatagccccaaactgtaaacagaggagatacagtatggggctattcaacctggcggcagcgcaaaagatg

SEQ ID NO: 72872 - DNA, 103 bp, Artificial Sequence
  Synthetic Polynucleotide
taatacgactcactatagggattccaattcctccgatgaatagccccaaaaacagaggagatttgggatgattcatcggaacctggcggcagcgcaaaagatg

SEQ ID NO: 72873 - DNA, 103 bp, Artificial Sequence
  Synthetic Polynucleotide
taatacgactcactatagggattggattccaattcctccgatgaatagccaacagaggagaggctatatgtcggaggaaaacctggcggcagcgcaaaagatg

SEQ ID NO: 72874 - DNA, 103 bp, Artificial Sequence
  Synthetic Polynucleotide
taatacgactcactatagggaaacaattggattccaattcctccgatgaaaacagaggagattcatcatgggaattggaaacctggcggcagcgcaaaagatg

SEQ ID NO: 72875 - DNA, 103 bp, Artificial Sequence
  Synthetic Polynucleotide
taatacgactcactatagggatatcaaacaattggattccaattcctccgaacagaggagacggaggatgtggaatccaaacctggcggcagcgcaaaagatg

SEQ ID NO: 72876 - DNA, 103 bp, Artificial Sequence
  Synthetic Polynucleotide
taatacgactcactatagggattatatatcaaacaattggattccaattcaacagaggagagaattgatgtccaattgtaacctggcggcagcgcaaaagatg

SEQ ID NO: 72877 - DNA, 103 bp, Artificial Sequence
  Synthetic Polynucleotide
taatacgactcactatagggggtaaattatatatcaaacaattggattccaacagaggagaggaatcatgttgtttgataacctggcggcagcgcaaaagatg

SEQ ID NO: 72878 - DNA, 103 bp, Artificial Sequence
  Synthetic Polynucleotide
taatacgactcactatagggatagcggtaaattatatatcaaacaattggaacagaggagaccaattatgtgatatataaacctggcggcagcgcaaaagatg

SEQ ID NO: 72879 - DNA, 103 bp, Artificial Sequence
  Synthetic Polynucleotide
taatacgactcactatagggatgctatagcggtaaattatatatcaaacaaacagaggagatgtttgatgtataatttaaacctggcggcagcgcaaaagatg

SEQ ID NO: 72880 - DNA, 103 bp, Artificial Sequence
  Synthetic Polynucleotide
taatacgactcactatagggttttataaatatacataagacatacactttaacagaggagaaaagtgatggtcttatgtaacctggcggcagcgcaaaagatg

SEQ ID NO: 72881 - DNA, 103 bp, Artificial Sequence
  Synthetic Polynucleotide
taatacgactcactatagggtaacaatgctatagcggtaaattatatatcaacagaggagagatataatgtttaccgctaacctggcggcagcgcaaaagatg

SEQ ID NO: 72882 - DNA, 103 bp, Artificial Sequence
  Synthetic Polynucleotide
taatacgactcactatagggatacataacaatgctatagcggtaaattataacagaggagaataattatgcgctatagcaacctggcggcagcgcaaaagatg

SEQ ID NO: 72883 - DNA, 103 bp, Artificial Sequence
  Synthetic Polynucleotide
taatacgactcactatagggatgaaatacataacaatgctatagcggtaaaacagaggagattaccgatgtagcattgtaacctggcggcagcgcaaaagatg

SEQ ID NO: 72884 - DNA, 103 bp, Artificial Sequence
  Synthetic Polynucleotide
taatacgactcactataggggaacaatgaaatacataacaatgctatagcaacagaggagagctataatgttgttatgtaacctggcggcagcgcaaaagatg

SEQ ID NO: 72885 - DNA, 103 bp, Artificial Sequence
  Synthetic Polynucleotide
taatacgactcactatagggtggatgaacaatgaaatacataacaatgctaacagaggagaagcattatgatgtatttcaacctggcggcagcgcaaaagatg

SEQ ID NO: 72886 - DNA, 103 bp, Artificial Sequence
  Synthetic Polynucleotide
taatacgactcactatagggggtgatggatgaacaatgaaatacataacaaacagaggagatgttatatgtttcattgtaacctggcggcagcgcaaaagatg

SEQ ID NO: 72887 - DNA, 103 bp, Artificial Sequence
  Synthetic Polynucleotide
taatacgactcactatagggtcatcggtgatggatgaacaatgaaatacaaacagaggagatgtattatgttgttcatcaacctggcggcagcgcaaaagatg

SEQ ID NO: 72888 - DNA, 103 bp, Artificial Sequence
  Synthetic Polynucleotide
taatacgactcactatagggatatctcatcggtgatggatgaacaatgaaaacagaggagattcattatgcatccatcaaacctggcggcagcgcaaaagatg

SEQ ID NO: 72889 - DNA, 103 bp, Artificial Sequence
  Synthetic Polynucleotide
taatacgactcactataggggtagtatatctcatcggtgatggatgaacaaacagaggagatgttcaatgatcaccgataacctggcggcagcgcaaaagatg

SEQ ID NO: 72890 - DNA, 103 bp, Artificial Sequence
  Synthetic Polynucleotide
taatacgactcactataggggagaagtagtatatctcatcggtgatggataacagaggagaatccatatgcgatgagataacctggcggcagcgcaaaagatg

SEQ ID NO: 72891 - DNA, 103 bp, Artificial Sequence
  Synthetic Polynucleotide
taatacgactcactatagggagcatttttataaatatacataagacatacaacagaggagagtatgtatgatgtatattaacctggcggcagcgcaaaagatg

SEQ ID NO: 72892 - DNA, 103 bp, Artificial Sequence
  Synthetic Polynucleotide
taatacgactcactatagggtgttggagaagtagtatatctcatcggtgaaacagaggagatcaccgatgagatatactaacctggcggcagcgcaaaagatg

SEQ ID NO: 72893 - DNA, 103 bp, Artificial Sequence
  Synthetic Polynucleotide
taatacgactcactatagggacacatgttggagaagtagtatatctcatcaacagaggagagatgagatgtactacttcaacctggcggcagcgcaaaagatg

SEQ ID NO: 72894 - DNA, 103 bp, Artificial Sequence
  Synthetic Polynucleotide
taatacgactcactatagggcaagtacacatgttggagaagtagtatatcaacagaggagagatataatgcttctccaaaacctggcggcagcgcaaaagatg

SEQ ID NO: 72895 - DNA, 103 bp, Artificial Sequence
  Synthetic Polynucleotide
taatacgactcactataggggtgtacaagtacacatgttggagaagtagtaacagaggagaactactatgccaacatgtaacctggcggcagcgcaaaagatg

SEQ ID NO: 72896 - DNA, 103 bp, Artificial Sequence
  Synthetic Polynucleotide
taatacgactcactatagggcatatgtgtacaagtacacatgttggagaaaacagaggagattctccatgatgtgtactaacctggcggcagcgcaaaagatg

SEQ ID NO: 72897 - DNA, 103 bp, Artificial Sequence
  Synthetic Polynucleotide
taatacgactcactatagggtattccatatgtgtacaagtacacatgttgaacagaggagacaacatatgtacttgtacaacctggcggcagcgcaaaagatg

SEQ ID NO: 72898 - DNA, 103 bp, Artificial Sequence
  Synthetic Polynucleotide
taatacgactcactatagggagatatattccatatgtgtacaagtacacaaacagaggagatgtgtaatggtacacataaacctggcggcagcgcaaaagatg

SEQ ID NO: 72899 - DNA, 103 bp, Artificial Sequence
  Synthetic Polynucleotide
taatacgactcactatagggattatagatatattccatatgtgtacaagtaacagaggagaacttgtatgcatatggaaaacctggcggcagcgcaaaagatg

SEQ ID NO: 72900 - DNA, 103 bp, Artificial Sequence
  Synthetic Polynucleotide
taatacgactcactatagggatcaaattatagatatattccatatgtgtaaacagaggagatacacaatgggaatatataacctggcggcagcgcaaaagatg

SEQ ID NO: 72901 - DNA, 103 bp, Artificial Sequence
  Synthetic Polynucleotide
taatacgactcactatagggcatggatcaaattatagatatattccatataacagaggagaatatggatgatatctataaacctggcggcagcgcaaaagatg

SEQ ID NO: 72902 - DNA, 103 bp, Artificial Sequence
  Synthetic Polynucleotide
taatacgactcactatagggtaatataggaataattagcaccaaaatagcaacagaggagagctattatggtgctaattaacctggcggcagcgcaaaagatg

SEQ ID NO: 72903 - DNA, 103 bp, Artificial Sequence
  Synthetic Polynucleotide
taatacgactcactatagggcatttagcatttttataaatatacataagaaacagaggagatcttatatgtatttataaaacctggcggcagcgcaaaagatg

SEQ ID NO: 72904 - DNA, 103 bp, Artificial Sequence
  Synthetic Polynucleotide
taatacgactcactatagggatgaacatggatcaaattatagatatattcaacagaggagagaatatatgtataatttgaacctggcggcagcgcaaaagatg

SEQ ID NO: 72905 - DNA, 103 bp, Artificial Sequence
  Synthetic Polynucleotide
taatacgactcactatagggatcctatgaacatggatcaaattatagataaacagaggagatatctaatgtttgatccaaacctggcggcagcgcaaaagatg

SEQ ID NO: 72906 - DNA, 103 bp, Artificial Sequence
  Synthetic Polynucleotide
taatacgactcactatagggaaagtatcctatgaacatggatcaaattataacagaggagaataattatgtccatgttcaacctggcggcagcgcaaaagatg

SEQ ID NO: 72907 - DNA, 103 bp, Artificial Sequence
  Synthetic Polynucleotide
taatacgactcactatagggttcataaagtatcctatgaacatggatcaaaacagaggagattgatcatggttcataggaacctggcggcagcgcaaaagatg

SEQ ID NO: 72908 - DNA, 103 bp, Artificial Sequence
  Synthetic Polynucleotide
taatacgactcactatagggatccattcataaagtatcctatgaacatggaacagaggagaccatgtatgtaggatactaacctggcggcagcgcaaaagatg

SEQ ID NO: 72909 - DNA, 103 bp, Artificial Sequence
  Synthetic Polynucleotide
taatacgactcactatagggcaggtatccattcataaagtatcctatgaaaacagaggagattcataatgtactttatgaacctggcggcagcgcaaaagatg

SEQ ID NO: 72910 - DNA, 103 bp, Artificial Sequence
  Synthetic Polynucleotide
taatacgactcactatagggtaatacaggtatccattcataaagtatcctaacagaggagaaggataatgtatgaatggaacctggcggcagcgcaaaagatg

SEQ ID NO: 72911 - DNA, 103 bp, Artificial Sequence
  Synthetic Polynucleotide
taatacgactcactataggggcaaataatacaggtatccattcataaagtaacagaggagaactttaatgatggataccaacctggcggcagcgcaaaagatg

SEQ ID NO: 72912 - DNA, 103 bp, Artificial Sequence
  Synthetic Polynucleotide
taatacgactcactatagggaccacgcaaataatacaggtatccattcataacagaggagaatgaatatgtacctgtataacctggcggcagcgcaaaagatg

SEQ ID NO: 72913 - DNA, 103 bp, Artificial Sequence
  Synthetic Polynucleotide
taatacgactcactatagggaaacaaccacgcaaataatacaggtatccaaacagaggagatggataatggtattatttaacctggcggcagcgcaaaagatg

SEQ ID NO: 72914 - DNA, 103 bp, Artificial Sequence
  Synthetic Polynucleotide
taatacgactcactatagggcatcacatttagcatttttataaatatacaaacagaggagatgtataatgataaaaatgaacctggcggcagcgcaaaagatg

SEQ ID NO: 72915 - DNA, 103 bp, Artificial Sequence
  Synthetic Polynucleotide
taatacgactcactataggggtgataaacaaccacgcaaataatacaggtaacagaggagaacctgtatgatttgcgtgaacctggcggcagcgcaaaagatg

SEQ ID NO: 72916 - DNA, 103 bp, Artificial Sequence
  Synthetic Polynucleotide
taatacgactcactatagggtcattgtgataaacaaccacgcaaataataaacagaggagatattatatgcgtggttgtaacctggcggcagcgcaaaagatg

SEQ ID NO: 72917 - DNA, 103 bp, Artificial Sequence
  Synthetic Polynucleotide
taatacgactcactatagggatatttcattgtgataaacaaccacgcaaaaacagaggagatttgcgatgttgtttatcaacctggcggcagcgcaaaagatg

SEQ ID NO: 72918 - DNA, 103 bp, Artificial Sequence
  Synthetic Polynucleotide
taatacgactcactatagggccaaaatatttcattgtgataaacaaccacaacagaggagagtggttatgtatcacaataacctggcggcagcgcaaaagatg

SEQ ID NO: 72919 - DNA, 103 bp, Artificial Sequence
  Synthetic Polynucleotide
taatacgactcactatagggctgtaccaaaatatttcattgtgataaacaaacagaggagatgtttaatgcaatgaaataacctggcggcagcgcaaaagatg

SEQ ID NO: 72920 - DNA, 103 bp, Artificial Sequence
  Synthetic Polynucleotide
taatacgactcactatagggttagactgtaccaaaatatttcattgtgataacagaggagaatcacaatgaaatattttaacctggcggcagcgcaaaagatg

SEQ ID NO: 72921 - DNA, 103 bp, Artificial Sequence
  Synthetic Polynucleotide
taatacgactcactatagggggatattagactgtaccaaaatatttcattaacagaggagaaatgaaatgttttggtacaacctggcggcagcgcaaaagatg

SEQ ID NO: 72922 - DNA, 103 bp, Artificial Sequence
  Synthetic Polynucleotide
taatacgactcactatagggaaaatggatattagactgtaccaaaatattaacagaggagaaatattatggtacagtctaacctggcggcagcgcaaaagatg

SEQ ID NO: 72923 - DNA, 103 bp, Artificial Sequence
  Synthetic Polynucleotide
taatacgactcactatagggaatgtaaaatggatattagactgtaccaaaaacagaggagatttggtatggtctaatataacctggcggcagcgcaaaagatg

SEQ ID NO: 72924 - DNA, 103 bp, Artificial Sequence
  Synthetic Polynucleotide
taatacgactcactatagggtaaataatgtaaaatggatattagactgtaaacagaggagatacagtatgatatccattaacctggcggcagcgcaaaagatg

SEQ ID NO: 72925 - DNA, 103 bp, Artificial Sequence
  Synthetic Polynucleotide
taatacgactcactatagggagatacatcacatttagcatttttataaataacagaggagaatttatatgaatgctaaaaacctggcggcagcgcaaaagatg

SEQ ID NO: 72926 - DNA, 103 bp, Artificial Sequence
  Synthetic Polynucleotide
taatacgactcactatagggaggtataaataatgtaaaatggatattagaaacagaggagatctaatatgcattttacaaacctggcggcagcgcaaaagatg

SEQ ID NO: 72927 - DNA, 103 bp, Artificial Sequence
  Synthetic Polynucleotide
taatacgactcactatagggcccagaggtataaataatgtaaaatggataaacagaggagatatccaatgtacattattaacctggcggcagcgcaaaagatg

SEQ ID NO: 72928 - DNA, 103 bp, Artificial Sequence
  Synthetic Polynucleotide
taatacgactcactatagggtttcacccagaggtataaataatgtaaaataacagaggagaattttaatgtatttatacaacctggcggcagcgcaaaagatg

SEQ ID NO: 72929 - DNA, 103 bp, Artificial Sequence
  Synthetic Polynucleotide
taatacgactcactatagggttatctttcacccagaggtataaataatgtaacagaggagaacattaatgatacctctgaacctggcggcagcgcaaaagatg

SEQ ID NO: 72930 - DNA, 103 bp, Artificial Sequence
  Synthetic Polynucleotide
taatacgactcactatagggtcaaattatctttcacccagaggtataaataacagaggagaatttatatgtctgggtgaaacctggcggcagcgcaaaagatg

SEQ ID NO: 72931 - DNA, 103 bp, Artificial Sequence
  Synthetic Polynucleotide
taatacgactcactatagggtcaggtcaaattatctttcacccagaggtaaacagaggagatacctcatggtgaaagataacctggcggcagcgcaaaagatg

SEQ ID NO: 72932 - DNA, 103 bp, Artificial Sequence
  Synthetic Polynucleotide
taatacgactcactatagggtgtaatcaggtcaaattatctttcacccagaacagaggagactgggtatgagataatttaacctggcggcagcgcaaaagatg

SEQ ID NO: 72933 - DNA, 103 bp, Artificial Sequence
  Synthetic Polynucleotide
taatacgactcactatagggaaaaatgtaatcaggtcaaattatctttcaaacagaggagatgaaagatgatttgacctaacctggcggcagcgcaaaagatg

SEQ ID NO: 72934 - DNA, 103 bp, Artificial Sequence
  Synthetic Polynucleotide
taatacgactcactatagggttatcaaaaatgtaatcaggtcaaattatcaacagaggagagataatatgacctgattaaacctggcggcagcgcaaaagatg

SEQ ID NO: 72935 - DNA, 103 bp, Artificial Sequence
  Synthetic Polynucleotide
taatacgactcactatagggactccttatcaaaaatgtaatcaggtcaaaaacagaggagatttgacatgattacatttaacctggcggcagcgcaaaagatg

SEQ ID NO: 72936 - DNA, 103 bp, Artificial Sequence
  Synthetic Polynucleotide
taatacgactcactatagggaacatagatacatcacatttagcatttttaaacagaggagataaaaaatgtaaatgtgaaacctggcggcagcgcaaaagatg

SEQ ID NO: 72937 - DNA, 103 bp, Artificial Sequence
  Synthetic Polynucleotide
taatacgactcactatagggttgctactccttatcaaaaatgtaatcaggaacagaggagacctgatatgatttttgataacctggcggcagcgcaaaagatg

SEQ ID NO: 72938 - DNA, 103 bp, Artificial Sequence
  Synthetic Polynucleotide
taatacgactcactataggggaaatttgctactccttatcaaaaatgtaaaacagaggagattacatatgtgataaggaaacctggcggcagcgcaaaagatg

SEQ ID NO: 72939 - DNA, 103 bp, Artificial Sequence
  Synthetic Polynucleotide
taatacgactcactatagggattaggaaatttgctactccttatcaaaaaaacagaggagatttttgatgaggagtagcaacctggcggcagcgcaaaagatg

SEQ ID NO: 72940 - DNA, 103 bp, Artificial Sequence
  Synthetic Polynucleotide
taatacgactcactatagggaataaattaggaaatttgctactccttatcaacagaggagagataagatgtagcaaattaacctggcggcagcgcaaaagatg

SEQ ID NO: 72941 - DNA, 103 bp, Artificial Sequence
  Synthetic Polynucleotide
taatacgactcactataggggaagaaataaattaggaaatttgctactccaacagaggagaggagtaatgaatttcctaaacctggcggcagcgcaaaagatg

SEQ ID NO: 72942 - DNA, 103 bp, Artificial Sequence
  Synthetic Polynucleotide
taatacgactcactataggggaagagaagaaataaattaggaaatttgctaacagaggagaagcaaaatgcctaatttaaacctggcggcagcgcaaaagatg

SEQ ID NO: 72943 - DNA, 103 bp, Artificial Sequence
  Synthetic Polynucleotide
taatacgactcactatagggtatacgaagagaagaaataaattaggaaataacagaggagaatttccatgtttatttctaacctggcggcagcgcaaaagatg

SEQ ID NO: 72944 - DNA, 103 bp, Artificial Sequence
  Synthetic Polynucleotide
taatacgactcactatagggagtggtatacgaagagaagaaataaattagaacagaggagactaattatgttcttctctaacctggcggcagcgcaaaagatg

SEQ ID NO: 72945 - DNA, 103 bp, Artificial Sequence
  Synthetic Polynucleotide
taatacgactcactatagggcattaagtggtatacgaagagaagaaataaaacagaggagattatttatgctcttcgtaaacctggcggcagcgcaaaagatg

SEQ ID NO: 72946 - DNA, 103 bp, Artificial Sequence
  Synthetic Polynucleotide
taatacgactcactatagggtttgtcattaagtggtatacgaagagaagaaacagaggagatcttctatgcgtataccaaacctggcggcagcgcaaaagatg

SEQ ID NO: 72947 - DNA, 103 bp, Artificial Sequence
  Synthetic Polynucleotide
taatacgactcactatagggcaaataacatagatacatcacatttagcataacagaggagaatgctaatggtgatgtataacctggcggcagcgcaaaagatg

SEQ ID NO: 72948 - DNA, 103 bp, Artificial Sequence
  Synthetic Polynucleotide
taatacgactcactatagggttgattttgtcattaagtggtatacgaagaaacagaggagatcttcgatgaccacttaaaacctggcggcagcgcaaaagatg

SEQ ID NO: 72949 - DNA, 103 bp, Artificial Sequence
  Synthetic Polynucleotide
taatacgactcactatagggtgtagttgattttgtcattaagtggtatacaacagaggagagtatacatgttaatgacaaacctggcggcagcgcaaaagatg

SEQ ID NO: 72950 - DNA, 103 bp, Artificial Sequence
  Synthetic Polynucleotide
taatacgactcactataggggattatgtagttgattttgtcattaagtggaacagaggagaccacttatggacaaaatcaacctggcggcagcgcaaaagatg

SEQ ID NO: 72951 - DNA, 103 bp, Artificial Sequence
  Synthetic Polynucleotide
taatacgactcactatagggacgaagattatgtagttgattttgtcattaaacagaggagataatgaatgaatcaactaaacctggcggcagcgcaaaagatg

SEQ ID NO: 72952 - DNA, 103 bp, Artificial Sequence
  Synthetic Polynucleotide
taatacgactcactatagggtccagacgaagattatgtagttgattttgtaacagaggagaacaaaaatgactacataaaacctggcggcagcgcaaaagatg

SEQ ID NO: 72953 - DNA, 103 bp, Artificial Sequence
  Synthetic Polynucleotide
taatacgactcactatagggaatgttccagacgaagattatgtagttgataacagaggagaatcaacatgataatcttcaacctggcggcagcgcaaaagatg

SEQ ID NO: 72954 - DNA, 103 bp, Artificial Sequence
  Synthetic Polynucleotide
taatacgactcactatagggagttaaatgttccagacgaagattatgtagaacagaggagactacatatgcttcgtctgaacctggcggcagcgcaaaagatg

SEQ ID NO: 72955 - DNA, 103 bp, Artificial Sequence
  Synthetic Polynucleotide
taatacgactcactatagggcaatgagttaaatgttccagacgaagattaaacagaggagataatctatgtctggaacaaacctggcggcagcgcaaaagatg

SEQ ID NO: 72956 - DNA, 103 bp, Artificial Sequence
  Synthetic Polynucleotide
taatacgactcactataggggaaagcaatgagttaaatgttccagacgaaaacagaggagattcgtcatgaacatttaaaacctggcggcagcgcaaaagatg

SEQ ID NO: 72957 - DNA, 103 bp, Artificial Sequence
  Synthetic Polynucleotide
taatacgactcactatagggttctagaaagcaatgagttaaatgttccagaacagaggagactggaaatgttaactcataacctggcggcagcgcaaaagatg

SEQ ID NO: 72958 - DNA, 103 bp, Artificial Sequence
  Synthetic Polynucleotide
taatacgactcactatagggaaatacaaataacatagatacatcacatttaacagaggagaaaatgtatggtatctatgaacctggcggcagcgcaaaagatg

SEQ ID NO: 72959 - DNA, 103 bp, Artificial Sequence
  Synthetic Polynucleotide
taatacgactcactatagggacttattctagaaagcaatgagttaaatgtaacagaggagaacatttatgtcattgcttaacctggcggcagcgcaaaagatg

SEQ ID NO: 72960 - DNA, 103 bp, Artificial Sequence
  Synthetic Polynucleotide
taatacgactcactatagggttgaaacttattctagaaagcaatgagttaaacagaggagataactcatggctttctagaacctggcggcagcgcaaaagatg

SEQ ID NO: 72961 - DNA, 103 bp, Artificial Sequence
  Synthetic Polynucleotide
taatacgactcactatagggttatcttgaaacttattctagaaagcaatgaacagaggagacattgcatgctagaataaaacctggcggcagcgcaaaagatg

SEQ ID NO: 72962 - DNA, 103 bp, Artificial Sequence
  Synthetic Polynucleotide
taatacgactcactatagggattatttatcttgaaacttattctagaaagaacagaggagactttctatgataagtttcaacctggcggcagcgcaaaagatg

SEQ ID NO: 72963 - DNA, 103 bp, Artificial Sequence
  Synthetic Polynucleotide
taatacgactcactatagggttttgattatttatcttgaaacttattctaaacagaggagatagaatatgtttcaagataacctggcggcagcgcaaaagatg

SEQ ID NO: 72964 - DNA, 103 bp, Artificial Sequence
  Synthetic Polynucleotide
taatacgactcactataggggacaattttgattatttatcttgaaacttaaacagaggagataagttatgagataaataaacctggcggcagcgcaaaagatg

SEQ ID NO: 72965 - DNA, 103 bp, Artificial Sequence
  Synthetic Polynucleotide
taatacgactcactatagggtcatagacaattttgattatttatcttgaaaacagaggagattcaagatgaataatcaaaacctggcggcagcgcaaaagatg

SEQ ID NO: 72966 - DNA, 103 bp, Artificial Sequence
  Synthetic Polynucleotide
taatacgactcactatagggggatatcatagacaattttgattatttatcaacagaggagagataaaatgtcaaaattgaacctggcggcagcgcaaaagatg

SEQ ID NO: 72967 - DNA, 103 bp, Artificial Sequence
  Synthetic Polynucleotide
taatacgactcactataggggaagaggatatcatagacaattttgattataacagaggagaataatcatgattgtctataacctggcggcagcgcaaaagatg

SEQ ID NO: 72968 - DNA, 103 bp, Artificial Sequence
  Synthetic Polynucleotide
taatacgactcactatagggaactggaagaggatatcatagacaattttgaacagaggagacaaaatatgctatgatataacctggcggcagcgcaaaagatg

SEQ ID NO: 72969 - DNA, 103 bp, Artificial Sequence
  Synthetic Polynucleotide
taatacgactcactatagggtagataaatacaaataacatagatacatcaaacagaggagatgatgtatgtatgttattaacctggcggcagcgcaaaagatg

SEQ ID NO: 72970 - DNA, 103 bp, Artificial Sequence
  Synthetic Polynucleotide
taatacgactcactatagggtttggaactggaagaggatatcatagacaaaacagaggagattgtctatgatatcctctaacctggcggcagcgcaaaagatg

SEQ ID NO: 72971 - DNA, 103 bp, Artificial Sequence
  Synthetic Polynucleotide
taatacgactcactatagggcactttttggaactggaagaggatatcataaacagaggagatatgatatgctcttccagaacctggcggcagcgcaaaagatg

SEQ ID NO: 72972 - DNA, 103 bp, Artificial Sequence
  Synthetic Polynucleotide
taatacgactcactatagggccaaacactttttggaactggaagaggataaacagaggagatatcctatgccagttccaaacctggcggcagcgcaaaagatg

SEQ ID NO: 72973 - DNA, 103 bp, Artificial Sequence
  Synthetic Polynucleotide
taatacgactcactatagggtattgccaaacactttttggaactggaagaaacagaggagatcttccatgtccaaaaagaacctggcggcagcgcaaaagatg

SEQ ID NO: 72974 - DNA, 103 bp, Artificial Sequence
  Synthetic Polynucleotide
taatacgactcactataggggactttattgccaaacactttttggaactgaacagaggagacagttcatgaaagtgtttaacctggcggcagcgcaaaagatg

SEQ ID NO: 72975 - DNA, 103 bp, Artificial Sequence
  Synthetic Polynucleotide
taatacgactcactatagggctaaagactttattgccaaacactttttggaacagaggagaccaaaaatggtttggcaaaacctggcggcagcgcaaaagatg

SEQ ID NO: 72976 - DNA, 103 bp, Artificial Sequence
  Synthetic Polynucleotide
taatacgactcactatagggtcatactaaagactttattgccaaacacttaacagaggagaaagtgtatggcaataaagaacctggcggcagcgcaaaagatg

SEQ ID NO: 72977 - DNA, 103 bp, Artificial Sequence
  Synthetic Polynucleotide
taatacgactcactatagggttatgtcatactaaagactttattgccaaaaacagaggagatttggcatgaaagtctttaacctggcggcagcgcaaaagatg

SEQ ID NO: 72978 - DNA, 103 bp, Artificial Sequence
  Synthetic Polynucleotide
taatacgactcactatagggatctcttatgtcatactaaagactttattgaacagaggagacaataaatgctttagtataacctggcggcagcgcaaaagatg

SEQ ID NO: 72979 - DNA, 103 bp, Artificial Sequence
  Synthetic Polynucleotide
taatacgactcactatagggatccaatctcttatgtcatactaaagacttaacagaggagaaagtctatggtatgacataacctggcggcagcgcaaaagatg

SEQ ID NO: 72980 - DNA, 103 bp, Artificial Sequence
  Synthetic Polynucleotide
taatacgactcactatagggttgtttagataaatacaaataacatagataaacagaggagatatctaatgtatttgtataacctggcggcagcgcaaaagatg

SEQ ID NO: 72981 - DNA, 103 bp, Artificial Sequence
  Synthetic Polynucleotide
taatacgactcactatagggggactatccaatctcttatgtcatactaaaaacagaggagatttagtatgacataagagaacctggcggcagcgcaaaagatg

SEQ ID NO: 72982 - DNA, 103 bp, Artificial Sequence
  Synthetic Polynucleotide
taatacgactcactatagggaatacggactatccaatctcttatgtcataaacagaggagatatgacatgagagattggaacctggcggcagcgcaaaagatg

SEQ ID NO: 72983 - DNA, 103 bp, Artificial Sequence
  Synthetic Polynucleotide
taatacgactcactatagggtatagaatacggactatccaatctcttatgaacagaggagacataagatgttggatagtaacctggcggcagcgcaaaagatg

SEQ ID NO: 72984 - DNA, 103 bp, Artificial Sequence
  Synthetic Polynucleotide
taatacgactcactatagggatgggtatagaatacggactatccaatctcaacagaggagagagattatgtagtccgtaaacctggcggcagcgcaaaagatg

SEQ ID NO: 72985 - DNA, 103 bp, Artificial Sequence
  Synthetic Polynucleotide
taatacgactcactatagggacataatgggtatagaatacggactatccaaacagaggagatggataatgcgtattctaaacctggcggcagcgcaaaagatg

SEQ ID NO: 72986 - DNA, 103 bp, Artificial Sequence
  Synthetic Polynucleotide
taatacgactcactataggggtgttacataatgggtatagaatacggactaacagaggagaagtccgatgtctatacccaacctggcggcagcgcaaaagatg

SEQ ID NO: 72987 - DNA, 103 bp, Artificial Sequence
  Synthetic Polynucleotide
taatacgactcactataggggtcgagtgttacataatgggtatagaatacaacagaggagagtattcatgacccattataacctggcggcagcgcaaaagatg

SEQ ID NO: 72988 - DNA, 103 bp, Artificial Sequence
  Synthetic Polynucleotide
taatacgactcactatagggattgtgtcgagtgttacataatgggtatagaacagaggagactatacatgttatgtaacaacctggcggcagcgcaaaagatg

SEQ ID NO: 72989 - DNA, 103 bp, Artificial Sequence
  Synthetic Polynucleotide
taatacgactcactatagggggaatattgtgtcgagtgttacataatgggaacagaggagacccattatgtaacactcgaacctggcggcagcgcaaaagatg

SEQ ID NO: 72990 - DNA, 103 bp, Artificial Sequence
  Synthetic Polynucleotide
taatacgactcactatagggagaaaggaatattgtgtcgagtgttacataaacagaggagatatgtaatgctcgacacaaacctggcggcagcgcaaaagatg

SEQ ID NO: 72991 - DNA, 103 bp, Artificial Sequence
  Synthetic Polynucleotide
taatacgactcactatagggaggtattgtttagataaatacaaataacataacagaggagaatgttaatggtatttatcaacctggcggcagcgcaaaagatg

SEQ ID NO: 72992 - DNA, 103 bp, Artificial Sequence
  Synthetic Polynucleotide
taatacgactcactatagggattttagaaaggaatattgtgtcgagtgttaacagaggagaaacactatgcacaatattaacctggcggcagcgcaaaagatg

SEQ ID NO: 72993 - DNA, 103 bp, Artificial Sequence
  Synthetic Polynucleotide
taatacgactcactatagggacgagattttagaaaggaatattgtgtcgaaacagaggagatcgacaatgtattcctttaacctggcggcagcgcaaaagatg

SEQ ID NO: 72994 - DNA, 103 bp, Artificial Sequence
  Synthetic Polynucleotide
taatacgactcactatagggatactacgagattttagaaaggaatattgtaacagaggagaacaataatgctttctaaaaacctggcggcagcgcaaaagatg

SEQ ID NO: 72995 - DNA, 103 bp, Artificial Sequence
  Synthetic Polynucleotide
taatacgactcactatagggactttatactacgagattttagaaaggaataacagaggagaattcctatgtaaaatctcaacctggcggcagcgcaaaagatg

SEQ ID NO: 72996 - DNA, 103 bp, Artificial Sequence
  Synthetic Polynucleotide
taatacgactcactatagggtataaactttatactacgagattttagaaaaacagaggagatttctaatgtctcgtagtaacctggcggcagcgcaaaagatg

SEQ ID NO: 72997 - DNA, 103 bp, Artificial Sequence
  Synthetic Polynucleotide
taatacgactcactatagggacttgtataaactttatactacgagattttaacagaggagaaaaatcatgtagtataaaaacctggcggcagcgcaaaagatg

SEQ ID NO: 72998 - DNA, 103 bp, Artificial Sequence
  Synthetic Polynucleotide
taatacgactcactatagggtctacacttgtataaactttatactacgagaacagaggagactcgtaatgtaaagtttaaacctggcggcagcgcaaaagatg

SEQ ID NO: 72999 - DNA, 103 bp, Artificial Sequence
  Synthetic Polynucleotide
taatacgactcactatagggtatcatctacacttgtataaactttatactaacagaggagaagtataatgtttatacaaaacctggcggcagcgcaaaagatg

SEQ ID NO: 73000 - DNA, 103 bp, Artificial Sequence
  Synthetic Polynucleotide
taatacgactcactataggggaatttatcatctacacttgtataaactttaacagaggagaaaagttatgacaagtgtaaacctggcggcagcgcaaaagatg

SEQ ID NO: 73001 - DNA, 103 bp, Artificial Sequence
  Synthetic Polynucleotide
taatacgactcactatagggctgtagaatttatcatctacacttgtataaaacagaggagattatacatgtgtagatgaaacctggcggcagcgcaaaagatg

SEQ ID NO: 73002 - DNA, 103 bp, Artificial Sequence
  Synthetic Polynucleotide
taatacgactcactatagggggtagaggtattgtttagataaatacaaataacagaggagaatttgtatgtatctaaacaacctggcggcagcgcaaaagatg

SEQ ID NO: 73003 - DNA, 103 bp, Artificial Sequence
  Synthetic Polynucleotide
taatacgactcactatagggaacgtctgtagaatttatcatctacacttgaacagaggagacaagtgatgatgataaataacctggcggcagcgcaaaagatg

SEQ ID NO: 73004 - DNA, 103 bp, Artificial Sequence
  Synthetic Polynucleotide
taatacgactcactatagggatattaacgtctgtagaatttatcatctacaacagaggagagtagatatgaaattctacaacctggcggcagcgcaaaagatg

SEQ ID NO: 73005 - DNA, 103 bp, Artificial Sequence
  Synthetic Polynucleotide
taatacgactcactatagggtgtctatattaacgtctgtagaatttatcaaacagaggagatgataaatgctacagacgaacctggcggcagcgcaaaagatg

SEQ ID NO: 73006 - DNA, 103 bp, Artificial Sequence
  Synthetic Polynucleotide
taatacgactcactatagggacgcgtgtctatattaacgtctgtagaattaacagaggagaaattctatggacgttaataacctggcggcagcgcaaaagatg

SEQ ID NO: 73007 - DNA, 103 bp, Artificial Sequence
  Synthetic Polynucleotide
taatacgactcactatagggttattacgcgtgtctatattaacgtctgtaaacagaggagatacagaatgtaatatagaaacctggcggcagcgcaaaagatg

SEQ ID NO: 73008 - DNA, 103 bp, Artificial Sequence
  Synthetic Polynucleotide
taatacgactcactatagggtcaatttattacgcgtgtctatattaacgtaacagaggagaacgttaatgtagacacgcaacctggcggcagcgcaaaagatg

SEQ ID NO: 73009 - DNA, 103 bp, Artificial Sequence
  Synthetic Polynucleotide
taatacgactcactatagggcgtcatcaatttattacgcgtgtctatattaacagaggagaaatataatgacgcgtaataacctggcggcagcgcaaaagatg

SEQ ID NO: 73010 - DNA, 103 bp, Artificial Sequence
  Synthetic Polynucleotide
taatacgactcactatagggcatgacgtcatcaatttattacgcgtgtctaacagaggagaagacacatgtaataaattaacctggcggcagcgcaaaagatg

SEQ ID NO: 73011 - DNA, 103 bp, Artificial Sequence
  Synthetic Polynucleotide
taatacgactcactatagggatagacatgacgtcatcaatttattacgcgaacagaggagacgcgtaatgaattgatgaaacctggcggcagcgcaaaagatg

SEQ ID NO: 73012 - DNA, 103 bp, Artificial Sequence
  Synthetic Polynucleotide
taatacgactcactatagggacataatagacatgacgtcatcaatttattaacagaggagaaataaaatgatgacgtcaaacctggcggcagcgcaaaagatg

SEQ ID NO: 73013 - DNA, 103 bp, Artificial Sequence
  Synthetic Polynucleotide
taatacgactcactatagggaaatataatataggaataattagcaccaaaaacagaggagatttggtatgaattattccaacctggcggcagcgcaaaagatg

SEQ ID NO: 73014 - DNA, 103 bp, Artificial Sequence
  Synthetic Polynucleotide
taatacgactcactatagggctagaggtagaggtattgtttagataaataaacagaggagatatttaatgaaacaatacaacctggcggcagcgcaaaagatg

SEQ ID NO: 73015 - DNA, 103 bp, Artificial Sequence
  Synthetic Polynucleotide
taatacgactcactatagggggtatacataatagacatgacgtcatcaataacagaggagaattgatatggtcatgtctaacctggcggcagcgcaaaagatg

SEQ ID NO: 73016 - DNA, 103 bp, Artificial Sequence
  Synthetic Polynucleotide
taatacgactcactatagggggaaaggtatacataatagacatgacgtcaaacagaggagatgacgtatggtctattataacctggcggcagcgcaaaagatg

SEQ ID NO: 73017 - DNA, 103 bp, Artificial Sequence
  Synthetic Polynucleotide
taatacgactcactatagggatactggaaaggtatacataatagacatgaaacagaggagatcatgtatgttatgtataaacctggcggcagcgcaaaagatg

SEQ ID NO: 73018 - DNA, 103 bp, Artificial Sequence
  Synthetic Polynucleotide
taatacgactcactatagggctcatatactggaaaggtatacataatagaaacagaggagatctattatgtatacctttaacctggcggcagcgcaaaagatg

SEQ ID NO: 73019 - DNA, 103 bp, Artificial Sequence
  Synthetic Polynucleotide
taatacgactcactatagggatttactcatatactggaaaggtatacataaacagaggagatatgtaatgctttccagtaacctggcggcagcgcaaaagatg

SEQ ID NO: 73020 - DNA, 103 bp, Artificial Sequence
  Synthetic Polynucleotide
taatacgactcactatagggtagttatttactcatatactggaaaggtataacagaggagaatacctatgcagtatatgaacctggcggcagcgcaaaagatg

SEQ ID NO: 73021 - DNA, 103 bp, Artificial Sequence
  Synthetic Polynucleotide
taatacgactcactatagggttctatagttatttactcatatactggaaaaacagaggagatttccaatgtatgagtaaaacctggcggcagcgcaaaagatg

SEQ ID NO: 73022 - DNA, 103 bp, Artificial Sequence
  Synthetic Polynucleotide
taatacgactcactatagggttaacttctatagttatttactcatatactaacagaggagaagtataatggtaaataacaacctggcggcagcgcaaaagatg

SEQ ID NO: 73023 - DNA, 103 bp, Artificial Sequence
  Synthetic Polynucleotide
taatacgactcactatagggacagtttaacttctatagttatttactcataacagaggagaatgagtatgtaactatagaacctggcggcagcgcaaaagatg

SEQ ID NO: 73024 - DNA, 103 bp, Artificial Sequence
  Synthetic Polynucleotide
taatacgactcactatagggcattcacagtttaacttctatagttatttaaacagaggagataaataatgatagaagttaacctggcggcagcgcaaaagatg

SEQ ID NO: 73025 - DNA, 103 bp, Artificial Sequence
  Synthetic Polynucleotide
taatacgactcactatagggaatatctagaggtagaggtattgtttagataacagaggagaatctaaatgatacctctaaacctggcggcagcgcaaaagatg

SEQ ID NO: 73026 - DNA, 103 bp, Artificial Sequence
  Synthetic Polynucleotide
taatacgactcactatagggcttgacattcacagtttaacttctatagttaacagaggagaaactatatgagttaaactaacctggcggcagcgcaaaagatg

SEQ ID NO: 73027 - DNA, 103 bp, Artificial Sequence
  Synthetic Polynucleotide
taatacgactcactatagggtagaccttgacattcacagtttaacttctaaacagaggagatagaagatgaactgtgaaaacctggcggcagcgcaaaagatg

SEQ ID NO: 73028 - DNA, 103 bp, Artificial Sequence
  Synthetic Polynucleotide
taatacgactcactatagggttgcctagaccttgacattcacagtttaacaacagaggagagttaaaatgtgaatgtcaaacctggcggcagcgcaaaagatg

SEQ ID NO: 73029 - DNA, 103 bp, Artificial Sequence
  Synthetic Polynucleotide
taatacgactcactatagggagggtttgcctagaccttgacattcacagtaacagaggagaactgtgatggtcaaggtcaacctggcggcagcgcaaaagatg

SEQ ID NO: 73030 - DNA, 103 bp, Artificial Sequence
  Synthetic Polynucleotide
taatacgactcactatagggttacgagggtttgcctagaccttgacattcaacagaggagagaatgtatgggtctaggcaacctggcggcagcgcaaaagatg

SEQ ID NO: 73031 - DNA, 103 bp, Artificial Sequence
  Synthetic Polynucleotide
taatacgactcactatagggtcaagttacgagggtttgcctagaccttgaaacagaggagatcaaggatgaggcaaaccaacctggcggcagcgcaaaagatg

SEQ ID NO: 73032 - DNA, 103 bp, Artificial Sequence
  Synthetic Polynucleotide
taatacgactcactatagggaaagatcaagttacgagggtttgcctagacaacagaggagagtctagatgaaccctcgtaacctggcggcagcgcaaaagatg

SEQ ID NO: 73033 - DNA, 103 bp, Artificial Sequence
  Synthetic Polynucleotide
taatacgactcactatagggaaaataaagatcaagttacgagggtttgccaacagaggagaggcaaaatgtcgtaacttaacctggcggcagcgcaaaagatg

SEQ ID NO: 73034 - DNA, 103 bp, Artificial Sequence
  Synthetic Polynucleotide
taatacgactcactatagggcacaaaaaataaagatcaagttacgagggtaacagaggagaaccctcatgacttgatctaacctggcggcagcgcaaaagatg

SEQ ID NO: 73035 - DNA, 103 bp, Artificial Sequence
  Synthetic Polynucleotide
taatacgactcactatagggaaatacacaaaaaataaagatcaagttacgaacagaggagacgtaacatgatctttattaacctggcggcagcgcaaaagatg

SEQ ID NO: 73036 - DNA, 103 bp, Artificial Sequence
  Synthetic Polynucleotide
taatacgactcactatagggtgtataatatctagaggtagaggtattgttaacagaggagaaacaatatgtctacctctaacctggcggcagcgcaaaagatg

SEQ ID NO: 73037 - DNA, 103 bp, Artificial Sequence
  Synthetic Polynucleotide
taatacgactcactataggggtcaaaaatacacaaaaaataaagatcaagaacagaggagacttgatatgtattttttgaacctggcggcagcgcaaaagatg

SEQ ID NO: 73038 - DNA, 103 bp, Artificial Sequence
  Synthetic Polynucleotide
taatacgactcactatagggtttacgtcaaaaatacacaaaaaataaagaaacagaggagatctttaatgtttgtgtataacctggcggcagcgcaaaagatg

SEQ ID NO: 73039 - DNA, 103 bp, Artificial Sequence
  Synthetic Polynucleotide
taatacgactcactatagggacacatttacgtcaaaaatacacaaaaaataacagaggagaatttttatggtatttttgaacctggcggcagcgcaaaagatg

SEQ ID NO: 73040 - DNA, 103 bp, Artificial Sequence
  Synthetic Polynucleotide
taatacgactcactatagggttcgcacacatttacgtcaaaaatacacaaaacagaggagattgtgtatgtttgacgtaaacctggcggcagcgcaaaagatg

SEQ ID NO: 73041 - DNA, 103 bp, Artificial Sequence
  Synthetic Polynucleotide
taatacgactcactataggggtattttcgcacacatttacgtcaaaaataaacagaggagatattttatgcgtaaatgtaacctggcggcagcgcaaaagatg

SEQ ID NO: 73042 - DNA, 103 bp, Artificial Sequence
  Synthetic Polynucleotide
taatacgactcactatagggtctccgtattttcgcacacatttacgtcaaaacagaggagattgacgatgatgtgtgcgaacctggcggcagcgcaaaagatg

SEQ ID NO: 73043 - DNA, 103 bp, Artificial Sequence
  Synthetic Polynucleotide
taatacgactcactatagggagttatctccgtattttcgcacacatttacaacagaggagagtaaatatgtgcgaaaataacctggcggcagcgcaaaagatg

SEQ ID NO: 73044 - DNA, 103 bp, Artificial Sequence
  Synthetic Polynucleotide
taatacgactcactataggggaaaaagttatctccgtattttcgcacacaaacagaggagatgtgtgatgaaatacggaaacctggcggcagcgcaaaagatg

SEQ ID NO: 73045 - DNA, 103 bp, Artificial Sequence
  Synthetic Polynucleotide
taatacgactcactatagggatattgaaaaagttatctccgtattttcgcaacagaggagagcgaaaatgcggagataaaacctggcggcagcgcaaaagatg

SEQ ID NO: 73046 - DNA, 103 bp, Artificial Sequence
  Synthetic Polynucleotide
taatacgactcactatagggctacaatattgaaaaagttatctccgtattaacagaggagaaatacgatgataacttttaacctggcggcagcgcaaaagatg

SEQ ID NO: 73047 - DNA, 103 bp, Artificial Sequence
  Synthetic Polynucleotide
taatacgactcactatagggatttttgtataatatctagaggtagaggtaaacagaggagatacctcatgctctagataaacctggcggcagcgcaaaagatg

SEQ ID NO: 73048 - DNA, 103 bp, Artificial Sequence
  Synthetic Polynucleotide
taatacgactcactatagggcaattctacaatattgaaaaagttatctccaacagaggagaggagatatgtttttcaataacctggcggcagcgcaaaagatg

SEQ ID NO: 73049 - DNA, 103 bp, Artificial Sequence
  Synthetic Polynucleotide
taatacgactcactatagggatagtcaattctacaatattgaaaaagttaaacagaggagataacttatgcaatattgtaacctggcggcagcgcaaaagatg

SEQ ID NO: 73050 - DNA, 103 bp, Artificial Sequence
  Synthetic Polynucleotide
taatacgactcactatagggatataatagtcaattctacaatattgaaaaaacagaggagattttcaatgttgtagaataacctggcggcagcgcaaaagatg

SEQ ID NO: 73051 - DNA, 103 bp, Artificial Sequence
  Synthetic Polynucleotide
taatacgactcactatagggaggcaatataatagtcaattctacaatattaacagaggagaaatattatggaattgactaacctggcggcagcgcaaaagatg

SEQ ID NO: 73052 - DNA, 103 bp, Artificial Sequence
  Synthetic Polynucleotide
taatacgactcactatagggtatggaggcaatataatagtcaattctacaaacagaggagatgtagaatggactattataacctggcggcagcgcaaaagatg

SEQ ID NO: 73053 - DNA, 103 bp, Artificial Sequence
  Synthetic Polynucleotide
taatacgactcactatagggaatgctatggaggcaatataatagtcaattaacagaggagaaattgaatgttatattgcaacctggcggcagcgcaaaagatg

SEQ ID NO: 73054 - DNA, 103 bp, Artificial Sequence
  Synthetic Polynucleotide
taatacgactcactatagggttattaatgctatggaggcaatataatagtaacagaggagaactattatgttgcctccaaacctggcggcagcgcaaaagatg

SEQ ID NO: 73055 - DNA, 103 bp, Artificial Sequence
  Synthetic Polynucleotide
taatacgactcactatagggaacaattattaatgctatggaggcaatataaacagaggagatatattatgtccatagcaaacctggcggcagcgcaaaagatg

SEQ ID NO: 73056 - DNA, 103 bp, Artificial Sequence
  Synthetic Polynucleotide
taatacgactcactatagggttcaaaacaattattaatgctatggaggcaaacagaggagatgcctcatgagcattaataacctggcggcagcgcaaaagatg

SEQ ID NO: 73057 - DNA, 103 bp, Artificial Sequence
  Synthetic Polynucleotide
taatacgactcactatagggagaaattcaaaacaattattaatgctatggaacagaggagaccatagatgtaataattgaacctggcggcagcgcaaaagatg

SEQ ID NO: 73058 - DNA, 103 bp, Artificial Sequence
  Synthetic Polynucleotide
taatacgactcactatagggaaaaaatttttgtataatatctagaggtagaacagaggagactacctatggatattataaacctggcggcagcgcaaaagatg

SEQ ID NO: 73059 - DNA, 103 bp, Artificial Sequence
  Synthetic Polynucleotide
taatacgactcactataggggactaagaaattcaaaacaattattaatgcaacagaggagagcattaatgattgttttgaacctggcggcagcgcaaaagatg

SEQ ID NO: 73060 - DNA, 103 bp, Artificial Sequence
  Synthetic Polynucleotide
taatacgactcactatagggtctatgactaagaaattcaaaacaattattaacagaggagaaataatatgtttgaatttaacctggcggcagcgcaaaagatg

SEQ ID NO: 73061 - DNA, 103 bp, Artificial Sequence
  Synthetic Polynucleotide
taatacgactcactatagggcattgtctatgactaagaaattcaaaacaaaacagaggagattgtttatgatttcttagaacctggcggcagcgcaaaagatg

SEQ ID NO: 73062 - DNA, 103 bp, Artificial Sequence
  Synthetic Polynucleotide
taatacgactcactatagggattagcattgtctatgactaagaaattcaaaacagaggagattgaatatgttagtcataaacctggcggcagcgcaaaagatg

SEQ ID NO: 73063 - DNA, 103 bp, Artificial Sequence
  Synthetic Polynucleotide
taatacgactcactatagggaatatattagcattgtctatgactaagaaaaacagaggagatttcttatgcatagacaaaacctggcggcagcgcaaaagatg

SEQ ID NO: 73064 - DNA, 103 bp, Artificial Sequence
  Synthetic Polynucleotide
taatacgactcactataggggtaagaatatattagcattgtctatgactaaacagaggagatagtcaatgacaatgctaaacctggcggcagcgcaaaagatg

SEQ ID NO: 73065 - DNA, 103 bp, Artificial Sequence
  Synthetic Polynucleotide
taatacgactcactataggggtactgtaagaatatattagcattgtctataacagaggagaatagacatggctaatataaacctggcggcagcgcaaaagatg

SEQ ID NO: 73066 - DNA, 103 bp, Artificial Sequence
  Synthetic Polynucleotide
taatacgactcactatagggactatgtactgtaagaatatattagcattgaacagaggagacaatgcatgtatattcttaacctggcggcagcgcaaaagatg

SEQ ID NO: 73067 - DNA, 103 bp, Artificial Sequence
  Synthetic Polynucleotide
taatacgactcactatagggtcaatactatgtactgtaagaatatattagaacagaggagactaataatgtcttacagtaacctggcggcagcgcaaaagatg

SEQ ID NO: 73068 - DNA, 103 bp, Artificial Sequence
  Synthetic Polynucleotide
taatacgactcactatagggatttgtcaatactatgtactgtaagaatataacagaggagaatattcatgcagtacataaacctggcggcagcgcaaaagatg

SEQ ID NO: 73069 - DNA, 103 bp, Artificial Sequence
  Synthetic Polynucleotide
taatacgactcactataggggaaataaaaaatttttgtataatatctagaaacagaggagatctagaatgtatacaaaaaacctggcggcagcgcaaaagatg

SEQ ID NO: 73070 - DNA, 103 bp, Artificial Sequence
  Synthetic Polynucleotide
taatacgactcactatagggccgatatttgtcaatactatgtactgtaagaacagaggagacttacaatgcatagtattaacctggcggcagcgcaaaagatg

SEQ ID NO: 73071 - DNA, 103 bp, Artificial Sequence
  Synthetic Polynucleotide
taatacgactcactatagggaaatgccgatatttgtcaatactatgtactaacagaggagaagtacaatgtattgacaaaacctggcggcagcgcaaaagatg

SEQ ID NO: 73072 - DNA, 103 bp, Artificial Sequence
  Synthetic Polynucleotide
taatacgactcactatagggaacataaatgccgatatttgtcaatactataacagaggagaatagtaatgacaaatatcaacctggcggcagcgcaaaagatg

SEQ ID NO: 73073 - DNA, 103 bp, Artificial Sequence
  Synthetic Polynucleotide
taatacgactcactatagggaaagaaacataaatgccgatatttgtcaataacagaggagaattgacatgtatcggcataacctggcggcagcgcaaaagatg

SEQ ID NO: 73074 - DNA, 103 bp, Artificial Sequence
  Synthetic Polynucleotide
taatacgactcactatagggcttttaaagaaacataaatgccgatatttgaacagaggagacaaataatggcatttatgaacctggcggcagcgcaaaagatg

SEQ ID NO: 73075 - DNA, 103 bp, Artificial Sequence
  Synthetic Polynucleotide
taatacgactcactataggggttgacttttaaagaaacataaatgccgataacagaggagaatcggcatgtatgtttctaacctggcggcagcgcaaaagatg

SEQ ID NO: 73076 - DNA, 103 bp, Artificial Sequence
  Synthetic Polynucleotide
taatacgactcactatagggtagatgttgacttttaaagaaacataaatgaacagaggagacatttaatgttctttaaaaacctggcggcagcgcaaaagatg

SEQ ID NO: 73077 - DNA, 103 bp, Artificial Sequence
  Synthetic Polynucleotide
taatacgactcactatagggttctttagatgttgacttttaaagaaacataacagaggagaatgtttatgtaaaagtcaaacctggcggcagcgcaaaagatg

SEQ ID NO: 73078 - DNA, 103 bp, Artificial Sequence
  Synthetic Polynucleotide
taatacgactcactatagggcatttttctttagatgttgacttttaaagaaacagaggagatctttaatggtcaacatcaacctggcggcagcgcaaaagatg

SEQ ID NO: 73079 - DNA, 103 bp, Artificial Sequence
  Synthetic Polynucleotide
taatacgactcactatagggacaatcatttttctttagatgttgacttttaacagaggagaaaaagtatgcatctaaagaacctggcggcagcgcaaaagatg

SEQ ID NO: 73080 - DNA, 103 bp, Artificial Sequence
  Synthetic Polynucleotide
taatacgactcactatagggatactgaaataaaaaatttttgtataatataacagaggagaatattaatgaaaaattttaacctggcggcagcgcaaaagatg

SEQ ID NO: 73081 - DNA, 103 bp, Artificial Sequence
  Synthetic Polynucleotide
taatacgactcactatagggagaagacaatcatttttctttagatgttgaaacagaggagatcaacaatgaaagaaaaaaacctggcggcagcgcaaaagatg

SEQ ID NO: 73082 - DNA, 103 bp, Artificial Sequence
  Synthetic Polynucleotide
taatacgactcactatagggtctcaagaagacaatcatttttctttagataacagaggagaatctaaatgaaaatgattaacctggcggcagcgcaaaagatg

SEQ ID NO: 73083 - DNA, 103 bp, Artificial Sequence
  Synthetic Polynucleotide
taatacgactcactatagggttatgtctcaagaagacaatcatttttcttaacagaggagaaagaaaatggattgtcttaacctggcggcagcgcaaaagatg

SEQ ID NO: 73084 - DNA, 103 bp, Artificial Sequence
  Synthetic Polynucleotide
taatacgactcactataggggggagttatgtctcaagaagacaatcatttaacagaggagaaaatgaatgtcttcttgaaacctggcggcagcgcaaaagatg

SEQ ID NO: 73085 - DNA, 103 bp, Artificial Sequence
  Synthetic Polynucleotide
taatacgactcactatagggaaaatgggagttatgtctcaagaagacaataacagaggagaattgtcatgttgagacataacctggcggcagcgcaaaagatg

SEQ ID NO: 73086 - DNA, 103 bp, Artificial Sequence
  Synthetic Polynucleotide
taatacgactcactatagggaccaaaaaatgggagttatgtctcaagaagaacagaggagacttcttatgacataactcaacctggcggcagcgcaaaagatg

SEQ ID NO: 73087 - DNA, 103 bp, Artificial Sequence
  Synthetic Polynucleotide
taatacgactcactatagggtgaataccaaaaaatgggagttatgtctcaaacagaggagatgagacatgactcccattaacctggcggcagcgcaaaagatg

SEQ ID NO: 73088 - DNA, 103 bp, Artificial Sequence
  Synthetic Polynucleotide
taatacgactcactataggggtgggtgaataccaaaaaatgggagttatgaacagaggagacataacatgcattttttgaacctggcggcagcgcaaaagatg

SEQ ID NO: 73089 - DNA, 103 bp, Artificial Sequence
  Synthetic Polynucleotide
taatacgactcactatagggaacgtgtgggtgaataccaaaaaatgggagaacagaggagactcccaatgtttggtattaacctggcggcagcgcaaaagatg

SEQ ID NO: 73090 - DNA, 103 bp, Artificial Sequence
  Synthetic Polynucleotide
taatacgactcactatagggcgaaaaacgtgtgggtgaataccaaaaaataacagaggagaatttttatgtattcacccaacctggcggcagcgcaaaagatg

SEQ ID NO: 73091 - DNA, 103 bp, Artificial Sequence
  Synthetic Polynucleotide
taatacgactcactatagggttaatatactgaaataaaaaatttttgtataacagaggagaatacaaatgttttttattaacctggcggcagcgcaaaagatg

SEQ ID NO: 73092 - DNA, 103 bp, Artificial Sequence
  Synthetic Polynucleotide
taatacgactcactatagggtttttcgaaaaacgtgtgggtgaataccaaaacagaggagattggtaatgacccacacgaacctggcggcagcgcaaaagatg

SEQ ID NO: 73093 - DNA, 103 bp, Artificial Sequence
  Synthetic Polynucleotide
taatacgactcactatagggctaattttttcgaaaaacgtgtgggtgaataacagaggagaattcacatgcacgtttttaacctggcggcagcgcaaaagatg

SEQ ID NO: 73094 - DNA, 103 bp, Artificial Sequence
  Synthetic Polynucleotide
taatacgactcactatagggtaaaactaattttttcgaaaaacgtgtgggaacagaggagacccacaatgttttcgaaaaacctggcggcagcgcaaaagatg

SEQ ID NO: 73095 - DNA, 103 bp, Artificial Sequence
  Synthetic Polynucleotide
taatacgactcactataggggaaggtaaaactaattttttcgaaaaacgtaacagaggagaacgtttatggaaaaaattaacctggcggcagcgcaaaagatg

SEQ ID NO: 73096 - DNA, 103 bp, Artificial Sequence
  Synthetic Polynucleotide
taatacgactcactatagggcattagaaggtaaaactaattttttcgaaaaacagaggagatttcgaatgaattagtttaacctggcggcagcgcaaaagatg

SEQ ID NO: 73097 - DNA, 103 bp, Artificial Sequence
  Synthetic Polynucleotide
taatacgactcactatagggtatatcattagaaggtaaaactaattttttaacagaggagaaaaaaaatggttttacctaacctggcggcagcgcaaaagatg

SEQ ID NO: 73098 - DNA, 103 bp, Artificial Sequence
  Synthetic Polynucleotide
taatacgactcactataggggaaaatatatcattagaaggtaaaactaataacagaggagaattagtatgaccttctaaaacctggcggcagcgcaaaagatg

SEQ ID NO: 73099 - DNA, 103 bp, Artificial Sequence
  Synthetic Polynucleotide
taatacgactcactatagggtcatggaaaatatatcattagaaggtaaaaaacagaggagattttacatgctaatgataaacctggcggcagcgcaaaagatg

SEQ ID NO: 73100 - DNA, 103 bp, Artificial Sequence
  Synthetic Polynucleotide
taatacgactcactatagggcgatttcatggaaaatatatcattagaaggaacagaggagaccttctatggatatatttaacctggcggcagcgcaaaagatg

SEQ ID NO: 73101 - DNA, 103 bp, Artificial Sequence
  Synthetic Polynucleotide
taatacgactcactatagggccatccgatttcatggaaaatatatcattaaacagaggagataatgaatgattttccataacctggcggcagcgcaaaagatg

SEQ ID NO: 73102 - DNA, 103 bp, Artificial Sequence
  Synthetic Polynucleotide
taatacgactcactatagggttactttaatatactgaaataaaaaattttaacagaggagaaaaattatgtatttcagtaacctggcggcagcgcaaaagatg

SEQ ID NO: 73103 - DNA, 103 bp, Artificial Sequence
  Synthetic Polynucleotide
taatacgactcactatagggccaatccatccgatttcatggaaaatatataacagaggagaatatatatgccatgaaataacctggcggcagcgcaaaagatg

SEQ ID NO: 73104 - DNA, 103 bp, Artificial Sequence
  Synthetic Polynucleotide
taatacgactcactatagggtgttaccaatccatccgatttcatggaaaaaacagaggagattttccatgaaatcggataacctggcggcagcgcaaaagatg

SEQ ID NO: 73105 - DNA, 103 bp, Artificial Sequence
  Synthetic Polynucleotide
taatacgactcactatagggtataatgttaccaatccatccgatttcatgaacagaggagacatgaaatgggatggattaacctggcggcagcgcaaaagatg

SEQ ID NO: 73106 - DNA, 103 bp, Artificial Sequence
  Synthetic Polynucleotide
taatacgactcactataggggaatctataatgttaccaatccatccgattaacagaggagaaatcggatggattggtaaaacctggcggcagcgcaaaagatg

SEQ ID NO: 73107 - DNA, 103 bp, Artificial Sequence
  Synthetic Polynucleotide
taatacgactcactatagggtaaaagaatctataatgttaccaatccatcaacagaggagagatggaatggtaacattaaacctggcggcagcgcaaaagatg

SEQ ID NO: 73108 - DNA, 103 bp, Artificial Sequence
  Synthetic Polynucleotide
taatacgactcactatagggggatttaaaagaatctataatgttaccaataacagaggagaattggtatgattatagataacctggcggcagcgcaaaagatg

SEQ ID NO: 73109 - DNA, 103 bp, Artificial Sequence
  Synthetic Polynucleotide
taatacgactcactatagggaattgggatttaaaagaatctataatgttaaacagaggagataacatatgagattctttaacctggcggcagcgcaaaagatg

SEQ ID NO: 73110 - DNA, 103 bp, Artificial Sequence
  Synthetic Polynucleotide
taatacgactcactatagggttctgaattgggatttaaaagaatctataaaacagaggagattatagatgcttttaaataacctggcggcagcgcaaaagatg

SEQ ID NO: 73111 - DNA, 103 bp, Artificial Sequence
  Synthetic Polynucleotide
taatacgactcactatagggttgatttctgaattgggatttaaaagaatcaacagaggagagattctatgaaatcccaaaacctggcggcagcgcaaaagatg

SEQ ID NO: 73112 - DNA, 103 bp, Artificial Sequence
  Synthetic Polynucleotide
taatacgactcactatagggatagattgatttctgaattgggatttaaaaaacagaggagattttaaatgccaattcagaacctggcggcagcgcaaaagatg

SEQ ID NO: 73113 - DNA, 103 bp, Artificial Sequence
  Synthetic Polynucleotide
taatacgactcactatagggagattttactttaatatactgaaataaaaaaacagaggagatttttaatgcagtatattaacctggcggcagcgcaaaagatg

SEQ ID NO: 73114 - DNA, 103 bp, Artificial Sequence
  Synthetic Polynucleotide
taatacgactcactatagggcgcagatagattgatttctgaattgggattaacagaggagaaatcccatgtcagaaatcaacctggcggcagcgcaaaagatg

SEQ ID NO: 73115 - DNA, 103 bp, Artificial Sequence
  Synthetic Polynucleotide
taatacgactcactatagggtttgtcgcagatagattgatttctgaattgaacagaggagacaattcatgaatcaatctaacctggcggcagcgcaaaagatg

SEQ ID NO: 73116 - DNA, 103 bp, Artificial Sequence
  Synthetic Polynucleotide
taatacgactcactatagggtggagtttgtcgcagatagattgatttctgaacagaggagacagaaaatgatctatctgaacctggcggcagcgcaaaagatg

SEQ ID NO: 73117 - DNA, 103 bp, Artificial Sequence
  Synthetic Polynucleotide
taatacgactcactatagggatatatggagtttgtcgcagatagattgataacagaggagaatcaatatgtctgcgacaaacctggcggcagcgcaaaagatg

SEQ ID NO: 73118 - DNA, 103 bp, Artificial Sequence
  Synthetic Polynucleotide
taatacgactcactatagggaaaacatatatggagtttgtcgcagatagaaacagaggagatctatcatggacaaactcaacctggcggcagcgcaaaagatg

SEQ ID NO: 73119 - DNA, 103 bp, Artificial Sequence
  Synthetic Polynucleotide
taatacgactcactatagggtgatgaaaacatatatggagtttgtcgcagaacagaggagactgcgaatgactccatataacctggcggcagcgcaaaagatg

SEQ ID NO: 73120 - DNA, 103 bp, Artificial Sequence
  Synthetic Polynucleotide
taatacgactcactatagggtgaaatgatgaaaacatatatggagtttgtaacagaggagaacaaacatgatatatgttaacctggcggcagcgcaaaagatg

SEQ ID NO: 73121 - DNA, 103 bp, Artificial Sequence
  Synthetic Polynucleotide
taatacgactcactatagggaattgtgaaatgatgaaaacatatatggagaacagaggagactccatatgtgttttcataacctggcggcagcgcaaaagatg

SEQ ID NO: 73122 - DNA, 103 bp, Artificial Sequence
  Synthetic Polynucleotide
taatacgactcactataggggaatgaattgtgaaatgatgaaaacatataaacagaggagatatatgatgtcatcatttaacctggcggcagcgcaaaagatg

SEQ ID NO: 73123 - DNA, 103 bp, Artificial Sequence
  Synthetic Polynucleotide
taatacgactcactatagggtataggaatgaattgtgaaatgatgaaaacaacagaggagagttttcatgatttcacaaaacctggcggcagcgcaaaagatg

SEQ ID NO: 73124 - DNA, 103 bp, Artificial Sequence
  Synthetic Polynucleotide
taatacgactcactatagggttgtgaaatataatataggaataattagcaaacagaggagatgctaaatgttcctatataacctggcggcagcgcaaaagatg

SEQ ID NO: 73125 - DNA, 103 bp, Artificial Sequence
  Synthetic Polynucleotide
taatacgactcactatagggtaactagattttactttaatatactgaaataacagaggagaatttcaatgtattaaagtaacctggcggcagcgcaaaagatg

SEQ ID NO: 73126 - DNA, 103 bp, Artificial Sequence
  Synthetic Polynucleotide
taatacgactcactatagggaaacttataggaatgaattgtgaaatgatgaacagaggagacatcatatgacaattcataacctggcggcagcgcaaaagatg

SEQ ID NO: 73127 - DNA, 103 bp, Artificial Sequence
  Synthetic Polynucleotide
taatacgactcactatagggcagttaaacttataggaatgaattgtgaaaaacagaggagatttcacatgtcattcctaaacctggcggcagcgcaaaagatg

SEQ ID NO: 73128 - DNA, 103 bp, Artificial Sequence
  Synthetic Polynucleotide
taatacgactcactatagggtcttccagttaaacttataggaatgaattgaacagaggagacaattcatgcctataagtaacctggcggcagcgcaaaagatg

SEQ ID NO: 73129 - DNA, 103 bp, Artificial Sequence
  Synthetic Polynucleotide
taatacgactcactataggggtggctcttccagttaaacttataggaatgaacagaggagacattccatgaagtttaacaacctggcggcagcgcaaaagatg

SEQ ID NO: 73130 - DNA, 103 bp, Artificial Sequence
  Synthetic Polynucleotide
taatacgactcactatagggttactgtggctcttccagttaaacttatagaacagaggagactataaatgtaactggaaaacctggcggcagcgcaaaagatg

SEQ ID NO: 73131 - DNA, 103 bp, Artificial Sequence
  Synthetic Polynucleotide
taatacgactcactatagggatttcttactgtggctcttccagttaaactaacagaggagaagtttaatgggaagagccaacctggcggcagcgcaaaagatg

SEQ ID NO: 73132 - DNA, 103 bp, Artificial Sequence
  Synthetic Polynucleotide
taatacgactcactatagggcaagaatttcttactgtggctcttccagttaacagaggagaaactggatgagccacagtaacctggcggcagcgcaaaagatg

SEQ ID NO: 73133 - DNA, 103 bp, Artificial Sequence
  Synthetic Polynucleotide
taatacgactcactatagggttgaacaagaatttcttactgtggctcttcaacagaggagagaagagatgcagtaagaaaacctggcggcagcgcaaaagatg

SEQ ID NO: 73134 - DNA, 103 bp, Artificial Sequence
  Synthetic Polynucleotide
taatacgactcactatagggctctattgaacaagaatttcttactgtggcaacagaggagagccacaatgagaaattctaacctggcggcagcgcaaaagatg

SEQ ID NO: 73135 - DNA, 103 bp, Artificial Sequence
  Synthetic Polynucleotide
taatacgactcactataggggcggtctctattgaacaagaatttcttactaacagaggagaagtaagatgttcttgttcaacctggcggcagcgcaaaagatg

SEQ ID NO: 73136 - DNA, 103 bp, Artificial Sequence
  Synthetic Polynucleotide
taatacgactcactatagggcaaggtaactagattttactttaatatactaacagaggagaagtataatgaagtaaaataacctggcggcagcgcaaaagatg

SEQ ID NO: 73137 - DNA, 103 bp, Artificial Sequence
  Synthetic Polynucleotide
taatacgactcactatagggcagacgcggtctctattgaacaagaatttcaacagaggagagaaattatggttcaatagaacctggcggcagcgcaaaagatg

SEQ ID NO: 73138 - DNA, 103 bp, Artificial Sequence
  Synthetic Polynucleotide
taatacgactcactatagggtataacagacgcggtctctattgaacaagaaacagaggagatcttgtatgatagagaccaacctggcggcagcgcaaaagatg

SEQ ID NO: 73139 - DNA, 103 bp, Artificial Sequence
  Synthetic Polynucleotide
taatacgactcactatagggtctattataacagacgcggtctctattgaaaacagaggagattcaatatggaccgcgtcaacctggcggcagcgcaaaagatg

SEQ ID NO: 73140 - DNA, 103 bp, Artificial Sequence
  Synthetic Polynucleotide
taatacgactcactatagggtaagatctattataacagacgcggtctctaaacagaggagatagagaatgcgtctgttaaacctggcggcagcgcaaaagatg

SEQ ID NO: 73141 - DNA, 103 bp, Artificial Sequence
  Synthetic Polynucleotide
taatacgactcactatagggaacagtaagatctattataacagacgcggtaacagaggagaaccgcgatggttataataaacctggcggcagcgcaaaagatg

SEQ ID NO: 73142 - DNA, 103 bp, Artificial Sequence
  Synthetic Polynucleotide
taatacgactcactataggggaagaaacagtaagatctattataacagacaacagaggagagtctgtatgaatagatctaacctggcggcagcgcaaaagatg

SEQ ID NO: 73143 - DNA, 103 bp, Artificial Sequence
  Synthetic Polynucleotide
taatacgactcactatagggcgagtgaagaaacagtaagatctattataaaacagaggagattataaatgatcttactgaacctggcggcagcgcaaaagatg

SEQ ID NO: 73144 - DNA, 103 bp, Artificial Sequence
  Synthetic Polynucleotide
taatacgactcactatagggtccaccgagtgaagaaacagtaagatctataacagaggagaatagatatgactgtttctaacctggcggcagcgcaaaagatg

SEQ ID NO: 73145 - DNA, 103 bp, Artificial Sequence
  Synthetic Polynucleotide
taatacgactcactatagggttgtatccaccgagtgaagaaacagtaagaaacagaggagatcttacatgttcttcactaacctggcggcagcgcaaaagatg

SEQ ID NO: 73146 - DNA, 103 bp, Artificial Sequence
  Synthetic Polynucleotide
taatacgactcactatagggatttattgtatccaccgagtgaagaaacagaacagaggagactgtttatgcactcggtgaacctggcggcagcgcaaaagatg

SEQ ID NO: 73147 - DNA, 103 bp, Artificial Sequence
  Synthetic Polynucleotide
taatacgactcactatagggattttcaaggtaactagattttactttaataacagaggagaattaaaatgaaatctagtaacctggcggcagcgcaaaagatg

SEQ ID NO: 73148 - DNA, 103 bp, Artificial Sequence
  Synthetic Polynucleotide
taatacgactcactatagggtaaacatttattgtatccaccgagtgaagaaacagaggagatcttcaatgggtggatacaacctggcggcagcgcaaaagatg

SEQ ID NO: 73149 - DNA, 103 bp, Artificial Sequence
  Synthetic Polynucleotide
taatacgactcactatagggatgtttaaacatttattgtatccaccgagtaacagaggagaactcggatgatacaataaaacctggcggcagcgcaaaagatg

SEQ ID NO: 73150 - DNA, 103 bp, Artificial Sequence
  Synthetic Polynucleotide
taatacgactcactataggggtttgatgtttaaacatttattgtatccacaacagaggagagtggatatgataaatgttaacctggcggcagcgcaaaagatg

SEQ ID NO: 73151 - DNA, 103 bp, Artificial Sequence
  Synthetic Polynucleotide
taatacgactcactatagggcgcatgtttgatgtttaaacatttattgtaaacagaggagatacaatatgtgtttaaacaacctggcggcagcgcaaaagatg

SEQ ID NO: 73152 - DNA, 103 bp, Artificial Sequence
  Synthetic Polynucleotide
taatacgactcactataggggatttcgcatgtttgatgtttaaacatttaaacagaggagataaatgatgaaacatcaaaacctggcggcagcgcaaaagatg

SEQ ID NO: 73153 - DNA, 103 bp, Artificial Sequence
  Synthetic Polynucleotide
taatacgactcactatagggactgcgatttcgcatgtttgatgtttaaacaacagaggagagtttaaatgtcaaacatgaacctggcggcagcgcaaaagatg

SEQ ID NO: 73154 - DNA, 103 bp, Artificial Sequence
  Synthetic Polynucleotide
taatacgactcactatagggtctacactgcgatttcgcatgtttgatgttaacagaggagaaacatcatgcatgcgaaaaacctggcggcagcgcaaaagatg

SEQ ID NO: 73155 - DNA, 103 bp, Artificial Sequence
  Synthetic Polynucleotide
taatacgactcactataggggagggtctacactgcgatttcgcatgtttgaacagaggagacaaacaatggaaatcgcaaacctggcggcagcgcaaaagatg

SEQ ID NO: 73156 - DNA, 103 bp, Artificial Sequence
  Synthetic Polynucleotide
taatacgactcactataggggagacgagggtctacactgcgatttcgcataacagaggagaatgcgaatgcgcagtgtaaacctggcggcagcgcaaaagatg

SEQ ID NO: 73157 - DNA, 103 bp, Artificial Sequence
  Synthetic Polynucleotide
taatacgactcactatagggtagtagagacgagggtctacactgcgatttaacagaggagaaaatcgatgtgtagacccaacctggcggcagcgcaaaagatg

SEQ ID NO: 73158 - DNA, 103 bp, Artificial Sequence
  Synthetic Polynucleotide
taatacgactcactatagggtatttattttcaaggtaactagattttactaacagaggagaagtaaaatgtagttacctaacctggcggcagcgcaaaagatg

SEQ ID NO: 73159 - DNA, 103 bp, Artificial Sequence
  Synthetic Polynucleotide
taatacgactcactatagggttaattagtagagacgagggtctacactgcaacagaggagagcagtgatgaccctcgtcaacctggcggcagcgcaaaagatg

SEQ ID NO: 73160 - DNA, 103 bp, Artificial Sequence
  Synthetic Polynucleotide
taatacgactcactatagggacgaattaattagtagagacgagggtctacaacagaggagagtagacatgcgtctctacaacctggcggcagcgcaaaagatg

SEQ ID NO: 73161 - DNA, 103 bp, Artificial Sequence
  Synthetic Polynucleotide
taatacgactcactatagggttccaacgaattaattagtagagacgagggaacagaggagaccctcgatgctactaattaacctggcggcagcgcaaaagatg

SEQ ID NO: 73162 - DNA, 103 bp, Artificial Sequence
  Synthetic Polynucleotide
taatacgactcactatagggacgttttccaacgaattaattagtagagacaacagaggagagtctctatgaattaattcaacctggcggcagcgcaaaagatg

SEQ ID NO: 73163 - DNA, 103 bp, Artificial Sequence
  Synthetic Polynucleotide
taatacgactcactataggggactcacgttttccaacgaattaattagtaaacagaggagatactaaatgattcgttggaacctggcggcagcgcaaaagatg

SEQ ID NO: 73164 - DNA, 103 bp, Artificial Sequence
  Synthetic Polynucleotide
taatacgactcactataggggcccggactcacgttttccaacgaattaataacagaggagaattaatatgttggaaaacaacctggcggcagcgcaaaagatg

SEQ ID NO: 73165 - DNA, 103 bp, Artificial Sequence
  Synthetic Polynucleotide
taatacgactcactatagggctaatgcccggactcacgttttccaacgaaaacagaggagattcgttatgaaacgtgagaacctggcggcagcgcaaaagatg

SEQ ID NO: 73166 - DNA, 103 bp, Artificial Sequence
  Synthetic Polynucleotide
taatacgactcactataggggtggcctaatgcccggactcacgttttccaaacagaggagatggaaaatgtgagtccggaacctggcggcagcgcaaaagatg

SEQ ID NO: 73167 - DNA, 103 bp, Artificial Sequence
  Synthetic Polynucleotide
taatacgactcactatagggaaagcgtggcctaatgcccggactcacgttaacagaggagaaacgtgatgccgggcattaacctggcggcagcgcaaaagatg

SEQ ID NO: 73168 - DNA, 103 bp, Artificial Sequence
  Synthetic Polynucleotide
taatacgactcactatagggcttaaaaagcgtggcctaatgcccggactcaacagaggagagagtccatgcattaggccaacctggcggcagcgcaaaagatg

SEQ ID NO: 73169 - DNA, 103 bp, Artificial Sequence
  Synthetic Polynucleotide
taatacgactcactatagggcactgtatttattttcaaggtaactagattaacagaggagaaatctaatgaccttgaaaaacctggcggcagcgcaaaagatg

SEQ ID NO: 73170 - DNA, 103 bp, Artificial Sequence
  Synthetic Polynucleotide
taatacgactcactatagggtttggcttaaaaagcgtggcctaatgcccgaacagaggagacgggcaatgggccacgctaacctggcggcagcgcaaaagatg

SEQ ID NO: 73171 - DNA, 103 bp, Artificial Sequence
  Synthetic Polynucleotide
taatacgactcactatagggcatattttggcttaaaaagcgtggcctaataacagaggagaattaggatgcgctttttaaacctggcggcagcgcaaaagatg

SEQ ID NO: 73172 - DNA, 103 bp, Artificial Sequence
  Synthetic Polynucleotide
taatacgactcactataggggcgtccatattttggcttaaaaagcgtggcaacagaggagagccacgatgtttaagccaaacctggcggcagcgcaaaagatg

SEQ ID NO: 73173 - DNA, 103 bp, Artificial Sequence
  Synthetic Polynucleotide
taatacgactcactatagggcatttgcgtccatattttggcttaaaaagcaacagaggagagcttttatggccaaaataaacctggcggcagcgcaaaagatg

SEQ ID NO: 73174 - DNA, 103 bp, Artificial Sequence
  Synthetic Polynucleotide
taatacgactcactatagggtggatcatttgcgtccatattttggcttaaaacagaggagattaagcatgaatatggacaacctggcggcagcgcaaaagatg

SEQ ID NO: 73175 - DNA, 103 bp, Artificial Sequence
  Synthetic Polynucleotide
taatacgactcactatagggttttctggatcatttgcgtccatattttggaacagaggagaccaaaaatgggacgcaaaaacctggcggcagcgcaaaagatg

SEQ ID NO: 73176 - DNA, 103 bp, Artificial Sequence
  Synthetic Polynucleotide
taatacgactcactatagggttttcttttctggatcatttgcgtccatataacagaggagaatatggatgcaaatgatcaacctggcggcagcgcaaaagatg

SEQ ID NO: 73177 - DNA, 103 bp, Artificial Sequence
  Synthetic Polynucleotide
taatacgactcactatagggaggaattttcttttctggatcatttgcgtcaacagaggagagacgcaatggatccagaaaacctggcggcagcgcaaaagatg

SEQ ID NO: 73178 - DNA, 103 bp, Artificial Sequence
  Synthetic Polynucleotide
taatacgactcactataggggtagaaggaattttcttttctggatcatttaacagaggagaaaatgaatgagaaaagaaaacctggcggcagcgcaaaagatg

SEQ ID NO: 73179 - DNA, 103 bp, Artificial Sequence
  Synthetic Polynucleotide
taatacgactcactatagggcggcagtagaaggaattttcttttctggataacagaggagaatccagatgagaaaattcaacctggcggcagcgcaaaagatg

SEQ ID NO: 73180 - DNA, 103 bp, Artificial Sequence
  Synthetic Polynucleotide
taatacgactcactatagggccacccactgtatttattttcaaggtaactaacagaggagaagttacatggaaaataaaaacctggcggcagcgcaaaagatg

SEQ ID NO: 73181 - DNA, 103 bp, Artificial Sequence
  Synthetic Polynucleotide
taatacgactcactatagggctttgcggcagtagaaggaattttcttttcaacagaggagagaaaagatgattccttctaacctggcggcagcgcaaaagatg

SEQ ID NO: 73182 - DNA, 103 bp, Artificial Sequence
  Synthetic Polynucleotide
taatacgactcactatagggattgcctttgcggcagtagaaggaattttcaacagaggagagaaaatatgttctactgcaacctggcggcagcgcaaaagatg

SEQ ID NO: 73183 - DNA, 103 bp, Artificial Sequence
  Synthetic Polynucleotide
taatacgactcactataggggacttattgcctttgcggcagtagaaggaaaacagaggagattccttatgctgccgcaaaacctggcggcagcgcaaaagatg

SEQ ID NO: 73184 - DNA, 103 bp, Artificial Sequence
  Synthetic Polynucleotide
taatacgactcactatagggagaaagacttattgcctttgcggcagtagaaacagaggagatctactatggcaaaggcaaacctggcggcagcgcaaaagatg

SEQ ID NO: 73185 - DNA, 103 bp, Artificial Sequence
  Synthetic Polynucleotide
taatacgactcactatagggtatggagaaagacttattgcctttgcggcaaacagaggagatgccgcatgggcaataagaacctggcggcagcgcaaaagatg

SEQ ID NO: 73186 - DNA, 103 bp, Artificial Sequence
  Synthetic Polynucleotide
taatacgactcactatagggccggttatggagaaagacttattgcctttgaacagaggagacaaaggatgtaagtctttaacctggcggcagcgcaaaagatg

SEQ ID NO: 73187 - DNA, 103 bp, Artificial Sequence
  Synthetic Polynucleotide
taatacgactcactatagggcagcgccggttatggagaaagacttattgcaacagaggagagcaataatgctttctccaaacctggcggcagcgcaaaagatg

SEQ ID NO: 73188 - DNA, 103 bp, Artificial Sequence
  Synthetic Polynucleotide
taatacgactcactatagggcatgacagcgccggttatggagaaagacttaacagaggagaaagtctatgtccataaccaacctggcggcagcgcaaaagatg

SEQ ID NO: 73189 - DNA, 103 bp, Artificial Sequence
  Synthetic Polynucleotide
taatacgactcactatagggggatacatgacagcgccggttatggagaaaaacagaggagatttctcatgaaccggcgcaacctggcggcagcgcaaaagatg

SEQ ID NO: 73190 - DNA, 103 bp, Artificial Sequence
  Synthetic Polynucleotide
taatacgactcactatagggaaagtggatacatgacagcgccggttatggaacagaggagaccataaatggcgctgtcaaacctggcggcagcgcaaaagatg

SEQ ID NO: 73191 - DNA, 103 bp, Artificial Sequence
  Synthetic Polynucleotide
taatacgactcactatagggcagaaccacccactgtatttattttcaaggaacagaggagaccttgaatgtaaatacagaacctggcggcagcgcaaaagatg

SEQ ID NO: 73192 - DNA, 103 bp, Artificial Sequence
  Synthetic Polynucleotide
taatacgactcactataggggctcaaaagtggatacatgacagcgccggtaacagaggagaaccggcatggtcatgtataacctggcggcagcgcaaaagatg

SEQ ID NO: 73193 - DNA, 103 bp, Artificial Sequence
  Synthetic Polynucleotide
taatacgactcactatagggattgggctcaaaagtggatacatgacagcgaacagaggagacgctgtatggtatccactaacctggcggcagcgcaaaagatg

SEQ ID NO: 73194 - DNA, 103 bp, Artificial Sequence
  Synthetic Polynucleotide
taatacgactcactatagggggccgattgggctcaaaagtggatacatgaaacagaggagatcatgtatgcacttttgaaacctggcggcagcgcaaaagatg

SEQ ID NO: 73195 - DNA, 103 bp, Artificial Sequence
  Synthetic Polynucleotide
taatacgactcactatagggaagaaggccgattgggctcaaaagtggataaacagaggagatatccaatgttgagcccaaacctggcggcagcgcaaaagatg

SEQ ID NO: 73196 - DNA, 103 bp, Artificial Sequence
  Synthetic Polynucleotide
taatacgactcactatagggtaaaaaagaaggccgattgggctcaaaagtaacagaggagaacttttatgcccaatcggaacctggcggcagcgcaaaagatg

SEQ ID NO: 73197 - DNA, 103 bp, Artificial Sequence
  Synthetic Polynucleotide
taatacgactcactatagggttgtgtaaaaaagaaggccgattgggctcaaacagaggagatgagccatgtcggccttcaacctggcggcagcgcaaaagatg

SEQ ID NO: 73198 - DNA, 103 bp, Artificial Sequence
  Synthetic Polynucleotide
taatacgactcactatagggatgccttgtgtaaaaaagaaggccgattggaacagaggagaccaatcatgcttctttttaacctggcggcagcgcaaaagatg

SEQ ID NO: 73199 - DNA, 103 bp, Artificial Sequence
  Synthetic Polynucleotide
taatacgactcactatagggagacaatgccttgtgtaaaaaagaaggccgaacagaggagacggcctatgtttttacacaacctggcggcagcgcaaaagatg

SEQ ID NO: 73200 - DNA, 103 bp, Artificial Sequence
  Synthetic Polynucleotide
taatacgactcactatagggtatagagacaatgccttgtgtaaaaaagaaaacagaggagattctttatgacacaaggcaacctggcggcagcgcaaaagatg

SEQ ID NO: 73201 - DNA, 103 bp, Artificial Sequence
  Synthetic Polynucleotide
taatacgactcactatagggaatgctatagagacaatgccttgtgtaaaaaacagaggagattttacatgaggcattgtaacctggcggcagcgcaaaagatg

SEQ ID NO: 73202 - DNA, 103 bp, Artificial Sequence
  Synthetic Polynucleotide
taatacgactcactatagggtgatacagaaccacccactgtatttattttaacagaggagaaaaataatgacagtgggtaacctggcggcagcgcaaaagatg

SEQ ID NO: 73203 - DNA, 103 bp, Artificial Sequence
  Synthetic Polynucleotide
taatacgactcactatagggtctttaatgctatagagacaatgccttgtgaacagaggagacacaagatgttgtctctaaacctggcggcagcgcaaaagatg

SEQ ID NO: 73204 - DNA, 103 bp, Artificial Sequence
  Synthetic Polynucleotide
taatacgactcactatagggctatctctttaatgctatagagacaatgccaacagaggagaggcattatgtctatagcaaacctggcggcagcgcaaaagatg

SEQ ID NO: 73205 - DNA, 103 bp, Artificial Sequence
  Synthetic Polynucleotide
taatacgactcactatagggaaaaactatctctttaatgctatagagacaaacagaggagatgtctcatgagcattaaaaacctggcggcagcgcaaaagatg

SEQ ID NO: 73206 - DNA, 103 bp, Artificial Sequence
  Synthetic Polynucleotide
taatacgactcactatagggatgaaaaaaactatctctttaatgctatagaacagaggagactatagatgtaaagagataacctggcggcagcgcaaaagatg

SEQ ID NO: 73207 - DNA, 103 bp, Artificial Sequence
  Synthetic Polynucleotide
taatacgactcactatagggtagtaatgaaaaaaactatctctttaatgcaacagaggagagcattaatgagatagtttaacctggcggcagcgcaaaagatg

SEQ ID NO: 73208 - DNA, 103 bp, Artificial Sequence
  Synthetic Polynucleotide
taatacgactcactatagggaaagatagtaatgaaaaaaactatctctttaacagaggagaaaagagatggtttttttcaacctggcggcagcgcaaaagatg

SEQ ID NO: 73209 - DNA, 103 bp, Artificial Sequence
  Synthetic Polynucleotide
taatacgactcactatagggatgttaaagatagtaatgaaaaaaactatcaacagaggagagatagtatgtttcattacaacctggcggcagcgcaaaagatg

SEQ ID NO: 73210 - DNA, 103 bp, Artificial Sequence
  Synthetic Polynucleotide
taatacgactcactatagggtacatatgttaaagatagtaatgaaaaaaaaacagaggagattttttatgttactatctaacctggcggcagcgcaaaagatg

SEQ ID NO: 73211 - DNA, 103 bp, Artificial Sequence
  Synthetic Polynucleotide
taatacgactcactatagggattgatacatatgttaaagatagtaatgaaaacagaggagattcattatgatctttaacaacctggcggcagcgcaaaagatg

SEQ ID NO: 73212 - DNA, 103 bp, Artificial Sequence
  Synthetic Polynucleotide
taatacgactcactatagggttttgattgatacatatgttaaagatagtaaacagaggagatactatatgtaacatatgaacctggcggcagcgcaaaagatg

SEQ ID NO: 73213 - DNA, 103 bp, Artificial Sequence
  Synthetic Polynucleotide
taatacgactcactatagggactggtgatacagaaccacccactgtatttaacagaggagaaaatacatggggtggttcaacctggcggcagcgcaaaagatg

SEQ ID NO: 73214 - DNA, 103 bp, Artificial Sequence
  Synthetic Polynucleotide
taatacgactcactatagggtagtcttttgattgatacatatgttaaagaaacagaggagatctttaatgtatgtatcaaacctggcggcagcgcaaaagatg

SEQ ID NO: 73215 - DNA, 103 bp, Artificial Sequence
  Synthetic Polynucleotide
taatacgactcactatagggatgtatagtcttttgattgatacatatgttaacagaggagaaacataatgatcaatcaaaacctggcggcagcgcaaaagatg

SEQ ID NO: 73216 - DNA, 103 bp, Artificial Sequence
  Synthetic Polynucleotide
taatacgactcactatagggcggaaatgtatagtcttttgattgatacataacagaggagaatgtatatgtcaaaagacaacctggcggcagcgcaaaagatg

SEQ ID NO: 73217 - DNA, 103 bp, Artificial Sequence
  Synthetic Polynucleotide
taatacgactcactatagggtcattcggaaatgtatagtcttttgattgaaacagaggagatcaatcatgagactatacaacctggcggcagcgcaaaagatg

SEQ ID NO: 73218 - DNA, 103 bp, Artificial Sequence
  Synthetic Polynucleotide
taatacgactcactatagggaacattcattcggaaatgtatagtcttttgaacagaggagacaaaagatgatacatttcaacctggcggcagcgcaaaagatg

SEQ ID NO: 73219 - DNA, 103 bp, Artificial Sequence
  Synthetic Polynucleotide
taatacgactcactatagggttgaaaacattcattcggaaatgtatagtcaacagaggagagactatatgtttccgaataacctggcggcagcgcaaaagatg

SEQ ID NO: 73220 - DNA, 103 bp, Artificial Sequence
  Synthetic Polynucleotide
taatacgactcactatagggggccattgaaaacattcattcggaaatgtaaacagaggagatacattatggaatgaatgaacctggcggcagcgcaaaagatg

SEQ ID NO: 73221 - DNA, 103 bp, Artificial Sequence
  Synthetic Polynucleotide
taatacgactcactatagggcaaatggccattgaaaacattcattcggaaaacagaggagattccgaatgaatgttttcaacctggcggcagcgcaaaagatg

SEQ ID NO: 73222 - DNA, 103 bp, Artificial Sequence
  Synthetic Polynucleotide
taatacgactcactataggggatttcaaatggccattgaaaacattcattaacagaggagaaatgaaatgtttcaatggaacctggcggcagcgcaaaagatg

SEQ ID NO: 73223 - DNA, 103 bp, Artificial Sequence
  Synthetic Polynucleotide
taatacgactcactatagggctacggatttcaaatggccattgaaaacataacagaggagaatgtttatgatggccattaacctggcggcagcgcaaaagatg

SEQ ID NO: 73224 - DNA, 103 bp, Artificial Sequence
  Synthetic Polynucleotide
taatacgactcactatagggttcttactggtgatacagaaccacccactgaacagaggagacagtggatggttctgtataacctggcggcagcgcaaaagatg

SEQ ID NO: 73225 - DNA, 103 bp, Artificial Sequence
  Synthetic Polynucleotide
taatacgactcactatagggtgtttctacggatttcaaatggccattgaaaacagaggagattcaatatgcatttgaaaaacctggcggcagcgcaaaagatg

SEQ ID NO: 73226 - DNA, 103 bp, Artificial Sequence
  Synthetic Polynucleotide
taatacgactcactatagggctagatgtttctacggatttcaaatggccaaacagaggagatggccaatggaaatccgtaacctggcggcagcgcaaaagatg

SEQ ID NO: 73227 - DNA, 103 bp, Artificial Sequence
  Synthetic Polynucleotide
taatacgactcactatagggcgaggctagatgtttctacggatttcaaataacagaggagaatttgaatgccgtagaaaaacctggcggcagcgcaaaagatg

SEQ ID NO: 73228 - DNA, 103 bp, Artificial Sequence
  Synthetic Polynucleotide
taatacgactcactatagggattaccgaggctagatgtttctacggatttaacagaggagaaaatccatggaaacatctaacctggcggcagcgcaaaagatg

SEQ ID NO: 73229 - DNA, 103 bp, Artificial Sequence
  Synthetic Polynucleotide
taatacgactcactatagggtacagattaccgaggctagatgtttctacgaacagaggagacgtagaatgatctagcctaacctggcggcagcgcaaaagatg

SEQ ID NO: 73230 - DNA, 103 bp, Artificial Sequence
  Synthetic Polynucleotide
taatacgactcactatagggagaagtacagattaccgaggctagatgtttaacagaggagaaaacatatggcctcggtaaacctggcggcagcgcaaaagatg

SEQ ID NO: 73231 - DNA, 103 bp, Artificial Sequence
  Synthetic Polynucleotide
taatacgactcactatagggtgtatagaagtacagattaccgaggctagaaacagaggagatctagcatgggtaatctgaacctggcggcagcgcaaaagatg

SEQ ID NO: 73232 - DNA, 103 bp, Artificial Sequence
  Synthetic Polynucleotide
taatacgactcactataggggattttgtatagaagtacagattaccgaggaacagaggagacctcggatgtctgtacttaacctggcggcagcgcaaaagatg

SEQ ID NO: 73233 - DNA, 103 bp, Artificial Sequence
  Synthetic Polynucleotide
taatacgactcactatagggagaacgattttgtatagaagtacagattacaacagaggagagtaatcatgacttctataaacctggcggcagcgcaaaagatg

SEQ ID NO: 73234 - DNA, 103 bp, Artificial Sequence
  Synthetic Polynucleotide
taatacgactcactatagggttagcagaacgattttgtatagaagtacagaacagaggagactgtacatgtatacaaaaaacctggcggcagcgcaaaagatg

SEQ ID NO: 73235 - DNA, 103 bp, Artificial Sequence
  Synthetic Polynucleotide
taatacgactcactatagggattttttgtgaaatataatataggaataataacagaggagaattattatgatattatataacctggcggcagcgcaaaagatg

SEQ ID NO: 73236 - DNA, 103 bp, Artificial Sequence
  Synthetic Polynucleotide
taatacgactcactatagggttatgttcttactggtgatacagaaccaccaacagaggagaggtggtatggtatcaccaaacctggcggcagcgcaaaagatg

SEQ ID NO: 73237 - DNA, 103 bp, Artificial Sequence
  Synthetic Polynucleotide
taatacgactcactatagggaaaatttagcagaacgattttgtatagaagaacagaggagacttctaatgaaaatcgttaacctggcggcagcgcaaaagatg

SEQ ID NO: 73238 - DNA, 103 bp, Artificial Sequence
  Synthetic Polynucleotide
taatacgactcactataggggaatgaaaatttagcagaacgattttgtataacagaggagaatacaaatgcgttctgctaacctggcggcagcgcaaaagatg

SEQ ID NO: 73239 - DNA, 103 bp, Artificial Sequence
  Synthetic Polynucleotide
taatacgactcactatagggatagtgaatgaaaatttagcagaacgatttaacagaggagaaaatcgatgtgctaaattaacctggcggcagcgcaaaagatg

SEQ ID NO: 73240 - DNA, 103 bp, Artificial Sequence
  Synthetic Polynucleotide
taatacgactcactatagggacggaatagtgaatgaaaatttagcagaacaacagaggagagttctgatgaattttcataacctggcggcagcgcaaaagatg

SEQ ID NO: 73241 - DNA, 103 bp, Artificial Sequence
  Synthetic Polynucleotide
taatacgactcactatagggcagtgacggaatagtgaatgaaaatttagcaacagaggagagctaaaatgtcattcactaacctggcggcagcgcaaaagatg

SEQ ID NO: 73242 - DNA, 103 bp, Artificial Sequence
  Synthetic Polynucleotide
taatacgactcactataggggcagccagtgacggaatagtgaatgaaaataacagaggagaattttcatgcactattccaacctggcggcagcgcaaaagatg

SEQ ID NO: 73243 - DNA, 103 bp, Artificial Sequence
  Synthetic Polynucleotide
taatacgactcactatagggtttttgcagccagtgacggaatagtgaatgaacagaggagacattcaatgttccgtcacaacctggcggcagcgcaaaagatg

SEQ ID NO: 73244 - DNA, 103 bp, Artificial Sequence
  Synthetic Polynucleotide
taatacgactcactatagggggcgttttttgcagccagtgacggaatagtaacagaggagaactattatgtcactggctaacctggcggcagcgcaaaagatg

SEQ ID NO: 73245 - DNA, 103 bp, Artificial Sequence
  Synthetic Polynucleotide
taatacgactcactataggggtattggcgttttttgcagccagtgacggaaacagaggagatccgtcatgggctgcaaaaacctggcggcagcgcaaaagatg

SEQ ID NO: 73246 - DNA, 103 bp, Artificial Sequence
  Synthetic Polynucleotide
taatacgactcactatagggaacatgtattggcgttttttgcagccagtgaacagaggagacactggatgcaaaaaacgaacctggcggcagcgcaaaagatg

SEQ ID NO: 73247 - DNA, 103 bp, Artificial Sequence
  Synthetic Polynucleotide
taatacgactcactataggggaccattatgttcttactggtgatacagaaaacagaggagattctgtatgaccagtaagaacctggcggcagcgcaaaagatg

SEQ ID NO: 73248 - DNA, 103 bp, Artificial Sequence
  Synthetic Polynucleotide
taatacgactcactatagggtataaaacatgtattggcgttttttgcagcaacagaggagagctgcaatgaacgccaataacctggcggcagcgcaaaagatg

SEQ ID NO: 73249 - DNA, 103 bp, Artificial Sequence
  Synthetic Polynucleotide
taatacgactcactatagggtattttataaaacatgtattggcgttttttaacagaggagaaaaaaaatgcaatacatgaacctggcggcagcgcaaaagatg

SEQ ID NO: 73250 - DNA, 103 bp, Artificial Sequence
  Synthetic Polynucleotide
taatacgactcactatagggaaaaatattttataaaacatgtattggcgtaacagaggagaacgccaatgcatgttttaaacctggcggcagcgcaaaagatg

SEQ ID NO: 73251 - DNA, 103 bp, Artificial Sequence
  Synthetic Polynucleotide
taatacgactcactatagggagacgaaaaatattttataaaacatgtattaacagaggagaaatacaatgtttataaaaaacctggcggcagcgcaaaagatg

SEQ ID NO: 73252 - DNA, 103 bp, Artificial Sequence
  Synthetic Polynucleotide
taatacgactcactatagggacaccagacgaaaaatattttataaaacataacagaggagaatgtttatgaaaatatttaacctggcggcagcgcaaaagatg

SEQ ID NO: 73253 - DNA, 103 bp, Artificial Sequence
  Synthetic Polynucleotide
taatacgactcactatagggaactaacaccagacgaaaaatattttataaaacagaggagattataaatgatttttcgtaacctggcggcagcgcaaaagatg

SEQ ID NO: 73254 - DNA, 103 bp, Artificial Sequence
  Synthetic Polynucleotide
taatacgactcactataggggaataaactaacaccagacgaaaaatatttaacagaggagaaaatatatgtcgtctggtaacctggcggcagcgcaaaagatg

SEQ ID NO: 73255 - DNA, 103 bp, Artificial Sequence
  Synthetic Polynucleotide
taatacgactcactataggggattggaataaactaacaccagacgaaaaaaacagaggagatttttcatgtggtgttagaacctggcggcagcgcaaaagatg

SEQ ID NO: 73256 - DNA, 103 bp, Artificial Sequence
  Synthetic Polynucleotide
taatacgactcactatagggtcaatgattggaataaactaacaccagacgaacagaggagacgtctgatgttagtttataacctggcggcagcgcaaaagatg

SEQ ID NO: 73257 - DNA, 103 bp, Artificial Sequence
  Synthetic Polynucleotide
taatacgactcactatagggagatatcaatgattggaataaactaacaccaacagaggagaggtgttatgttattccaaaacctggcggcagcgcaaaagatg

SEQ ID NO: 73258 - DNA, 103 bp, Artificial Sequence
  Synthetic Polynucleotide
taatacgactcactatagggtgttcgaccattatgttcttactggtgataaacagaggagatatcacatgtaagaacataacctggcggcagcgcaaaagatg

SEQ ID NO: 73259 - DNA, 103 bp, Artificial Sequence
  Synthetic Polynucleotide
taatacgactcactatagggtctaaagatatcaatgattggaataaactaaacagaggagatagtttatgccaatcattaacctggcggcagcgcaaaagatg

SEQ ID NO: 73260 - DNA, 103 bp, Artificial Sequence
  Synthetic Polynucleotide
taatacgactcactatagggatatatctaaagatatcaatgattggaataaacagaggagatattccatgcattgatataacctggcggcagcgcaaaagatg

SEQ ID NO: 73261 - DNA, 103 bp, Artificial Sequence
  Synthetic Polynucleotide
taatacgactcactatagggagtggatatatctaaagatatcaatgattgaacagaggagacaatcaatgatatctttaaacctggcggcagcgcaaaagatg

SEQ ID NO: 73262 - DNA, 103 bp, Artificial Sequence
  Synthetic Polynucleotide
taatacgactcactataggggaagaagtggatatatctaaagatatcaataacagaggagaattgatatgtttagatataacctggcggcagcgcaaaagatg

SEQ ID NO: 73263 - DNA, 103 bp, Artificial Sequence
  Synthetic Polynucleotide
taatacgactcactatagggcagtggaagaagtggatatatctaaagataaacagaggagatatcttatgatatatccaaacctggcggcagcgcaaaagatg

SEQ ID NO: 73264 - DNA, 103 bp, Artificial Sequence
  Synthetic Polynucleotide
taatacgactcactatagggttggacagtggaagaagtggatatatctaaaacagaggagattagatatgtccacttctaacctggcggcagcgcaaaagatg

SEQ ID NO: 73265 - DNA, 103 bp, Artificial Sequence
  Synthetic Polynucleotide
taatacgactcactatagggtcattttggacagtggaagaagtggatataaacagaggagatatatcatgttcttccacaacctggcggcagcgcaaaagatg

SEQ ID NO: 73266 - DNA, 103 bp, Artificial Sequence
  Synthetic Polynucleotide
taatacgactcactatagggaggcatcattttggacagtggaagaagtggaacagaggagaccacttatgccactgtccaacctggcggcagcgcaaaagatg

SEQ ID NO: 73267 - DNA, 103 bp, Artificial Sequence
  Synthetic Polynucleotide
taatacgactcactatagggggcagaggcatcattttggacagtggaagaaacagaggagatcttccatggtccaaaataacctggcggcagcgcaaaagatg

SEQ ID NO: 73268 - DNA, 103 bp, Artificial Sequence
  Synthetic Polynucleotide
taatacgactcactatagggaaaaaggcagaggcatcattttggacagtgaacagaggagacactgtatgaaatgatgcaacctggcggcagcgcaaaagatg

SEQ ID NO: 73269 - DNA, 103 bp, Artificial Sequence
  Synthetic Polynucleotide
taatacgactcactatagggtactgtgttcgaccattatgttcttactggaacagaggagaccagtaatgacataatggaacctggcggcagcgcaaaagatg

SEQ ID NO: 73270 - DNA, 103 bp, Artificial Sequence
  Synthetic Polynucleotide
taatacgactcactatagggtgtataaaaaggcagaggcatcattttggaaacagaggagatccaaaatgatgcctctgaacctggcggcagcgcaaaagatg

SEQ ID NO: 73271 - DNA, 103 bp, Artificial Sequence
  Synthetic Polynucleotide
taatacgactcactataggggaatatgtataaaaaggcagaggcatcattaacagaggagaaatgatatgtctgcctttaacctggcggcagcgcaaaagatg

SEQ ID NO: 73272 - DNA, 103 bp, Artificial Sequence
  Synthetic Polynucleotide
taatacgactcactatagggatctggaatatgtataaaaaggcagaggcaaacagaggagatgcctcatgctttttataaacctggcggcagcgcaaaagatg

SEQ ID NO: 73273 - DNA, 103 bp, Artificial Sequence
  Synthetic Polynucleotide
taatacgactcactatagggatgacatctggaatatgtataaaaaggcagaacagaggagactgcctatgtatacatataacctggcggcagcgcaaaagatg

SEQ ID NO: 73274 - DNA, 103 bp, Artificial Sequence
  Synthetic Polynucleotide
taatacgactcactatagggatatcatgacatctggaatatgtataaaaaaacagaggagatttttaatgatattccagaacctggcggcagcgcaaaagatg

SEQ ID NO: 73275 - DNA, 103 bp, Artificial Sequence
  Synthetic Polynucleotide
taatacgactcactatagggattcaatatcatgacatctggaatatgtataacagaggagaatacatatgccagatgtcaacctggcggcagcgcaaaagatg

SEQ ID NO: 73276 - DNA, 103 bp, Artificial Sequence
  Synthetic Polynucleotide
taatacgactcactatagggttccaattcaatatcatgacatctggaataaacagaggagatattccatgtgtcatgataacctggcggcagcgcaaaagatg

SEQ ID NO: 73277 - DNA, 103 bp, Artificial Sequence
  Synthetic Polynucleotide
taatacgactcactatagggtatttttccaattcaatatcatgacatctgaacagaggagacagatgatgtgatattgaaacctggcggcagcgcaaaagatg

SEQ ID NO: 73278 - DNA, 103 bp, Artificial Sequence
  Synthetic Polynucleotide
taatacgactcactatagggtttgttatttttccaattcaatatcatgacaacagaggagagtcatgatgttgaattggaacctggcggcagcgcaaaagatg

SEQ ID NO: 73279 - DNA, 103 bp, Artificial Sequence
  Synthetic Polynucleotide
taatacgactcactatagggatagatttgttatttttccaattcaatatcaacagaggagagatattatgttggaaaaaaacctggcggcagcgcaaaagatg

SEQ ID NO: 73280 - DNA, 103 bp, Artificial Sequence
  Synthetic Polynucleotide
taatacgactcactatagggtcggatactgtgttcgaccattatgttcttaacagaggagaaagaacatgatggtcgaaaacctggcggcagcgcaaaagatg

SEQ ID NO: 73281 - DNA, 103 bp, Artificial Sequence
  Synthetic Polynucleotide
taatacgactcactatagggtccaaatagatttgttatttttccaattcaaacagaggagatgaattatgaaaataacaaacctggcggcagcgcaaaagatg

SEQ ID NO: 73282 - DNA, 103 bp, Artificial Sequence
  Synthetic Polynucleotide
taatacgactcactatagggaaaaatccaaatagatttgttatttttccaaacagaggagatggaaaatgaacaaatctaacctggcggcagcgcaaaagatg

SEQ ID NO: 73283 - DNA, 103 bp, Artificial Sequence
  Synthetic Polynucleotide
taatacgactcactatagggttgcaaaaaatccaaatagatttgttatttaacagaggagaaaataaatgatctatttgaacctggcggcagcgcaaaagatg

SEQ ID NO: 73284 - DNA, 103 bp, Artificial Sequence
  Synthetic Polynucleotide
taatacgactcactatagggaatccttgcaaaaaatccaaatagatttgtaacagaggagaacaaatatgtttggatttaacctggcggcagcgcaaaagatg

SEQ ID NO: 73285 - DNA, 103 bp, Artificial Sequence
  Synthetic Polynucleotide
taatacgactcactataggggaaccaatccttgcaaaaaatccaaatagaaacagaggagatctattatgattttttgcaacctggcggcagcgcaaaagatg

SEQ ID NO: 73286 - DNA, 103 bp, Artificial Sequence
  Synthetic Polynucleotide
taatacgactcactatagggttatggaaccaatccttgcaaaaaatccaaaacagaggagattggatatgttgcaaggaaacctggcggcagcgcaaaagatg

SEQ ID NO: 73287 - DNA, 103 bp, Artificial Sequence
  Synthetic Polynucleotide
taatacgactcactatagggtttagttatggaaccaatccttgcaaaaaaaacagaggagattttttatgaggattggtaacctggcggcagcgcaaaagatg

SEQ ID NO: 73288 - DNA, 103 bp, Artificial Sequence
  Synthetic Polynucleotide
taatacgactcactataggggttaatttagttatggaaccaatccttgcaaacagaggagatgcaagatgtggttccataacctggcggcagcgcaaaagatg

SEQ ID NO: 73289 - DNA, 103 bp, Artificial Sequence
  Synthetic Polynucleotide
taatacgactcactatagggctattgttaatttagttatggaaccaatccaacagaggagaggattgatgccataactaaacctggcggcagcgcaaaagatg

SEQ ID NO: 73290 - DNA, 103 bp, Artificial Sequence
  Synthetic Polynucleotide
taatacgactcactatagggtactactattgttaatttagttatggaaccaacagaggagaggttccatgactaaattaaacctggcggcagcgcaaaagatg

SEQ ID NO: 73291 - DNA, 103 bp, Artificial Sequence
  Synthetic Polynucleotide
taatacgactcactatagggctcaatcggatactgtgttcgaccattatgaacagaggagacataatatgcgaacacagaacctggcggcagcgcaaaagatg

SEQ ID NO: 73292 - DNA, 103 bp, Artificial Sequence
  Synthetic Polynucleotide
taatacgactcactatagggaaaattactactattgttaatttagttatgaacagaggagacataacatgattaacaataacctggcggcagcgcaaaagatg

SEQ ID NO: 73293 - DNA, 103 bp, Artificial Sequence
  Synthetic Polynucleotide
taatacgactcactatagggaaaaaaaaattactactattgttaatttagaacagaggagactaaatatgcaatagtagaacctggcggcagcgcaaaagatg

SEQ ID NO: 73294 - DNA, 103 bp, Artificial Sequence
  Synthetic Polynucleotide
taatacgactcactatagggaactgaaaaaaaaattactactattgttaaaacagaggagattaacaatggtagtaattaacctggcggcagcgcaaaagatg

SEQ ID NO: 73295 - DNA, 103 bp, Artificial Sequence
  Synthetic Polynucleotide
taatacgactcactatagggatgataactgaaaaaaaaattactactattaacagaggagaaatagtatgaatttttttaacctggcggcagcgcaaaagatg

SEQ ID NO: 73296 - DNA, 103 bp, Artificial Sequence
  Synthetic Polynucleotide
taatacgactcactatagggtatagatgataactgaaaaaaaaattactaaacagaggagatagtaaatgttttttcagaacctggcggcagcgcaaaagatg

SEQ ID NO: 73297 - DNA, 103 bp, Artificial Sequence
  Synthetic Polynucleotide
taatacgactcactatagggagtcatatagatgataactgaaaaaaaaataacagaggagaatttttatgtcagttatcaacctggcggcagcgcaaaagatg

SEQ ID NO: 73298 - DNA, 103 bp, Artificial Sequence
  Synthetic Polynucleotide
taatacgactcactatagggaatacagtcatatagatgataactgaaaaaaacagaggagatttttcatgtatcatctaaacctggcggcagcgcaaaagatg

SEQ ID NO: 73299 - DNA, 103 bp, Artificial Sequence
  Synthetic Polynucleotide
taatacgactcactatagggatccaaatacagtcatatagatgataactgaacagaggagacagttaatgtctatatgaaacctggcggcagcgcaaaagatg

SEQ ID NO: 73300 - DNA, 103 bp, Artificial Sequence
  Synthetic Polynucleotide
taatacgactcactatagggaaaagatccaaatacagtcatatagatgataacagaggagaatcatcatgatgactgtaaacctggcggcagcgcaaaagatg

SEQ ID NO: 73301 - DNA, 103 bp, Artificial Sequence
  Synthetic Polynucleotide
taatacgactcactatagggtgtacaaaagatccaaatacagtcatatagaacagaggagactatatatgtgtatttggaacctggcggcagcgcaaaagatg

SEQ ID NO: 73302 - DNA, 103 bp, Artificial Sequence
  Synthetic Polynucleotide
taatacgactcactatagggaaaatctcaatcggatactgtgttcgaccaaacagaggagatggtcgatgacagtatccaacctggcggcagcgcaaaagatg

SEQ ID NO: 73303 - DNA, 103 bp, Artificial Sequence
  Synthetic Polynucleotide
taatacgactcactatagggagcgatgtacaaaagatccaaatacagtcaaacagaggagatgactgatgttggatcttaacctggcggcagcgcaaaagatg

SEQ ID NO: 73304 - DNA, 103 bp, Artificial Sequence
  Synthetic Polynucleotide
taatacgactcactatagggataatagcgatgtacaaaagatccaaatacaacagaggagagtatttatgtcttttgtaaacctggcggcagcgcaaaagatg

SEQ ID NO: 73305 - DNA, 103 bp, Artificial Sequence
  Synthetic Polynucleotide
taatacgactcactatagggttgcgataatagcgatgtacaaaagatccaaacagaggagatggatcatgtgtacatcgaacctggcggcagcgcaaaagatg

SEQ ID NO: 73306 - DNA, 103 bp, Artificial Sequence
  Synthetic Polynucleotide
taatacgactcactatagggagtgattgcgataatagcgatgtacaaaagaacagaggagacttttgatgatcgctattaacctggcggcagcgcaaaagatg

SEQ ID NO: 73307 - DNA, 103 bp, Artificial Sequence
  Synthetic Polynucleotide
taatacgactcactatagggattgtagtgattgcgataatagcgatgtacaacagaggagagtacatatgtattatcgcaacctggcggcagcgcaaaagatg

SEQ ID NO: 73308 - DNA, 103 bp, Artificial Sequence
  Synthetic Polynucleotide
taatacgactcactatagggtaattattgtagtgattgcgataatagcgaaacagaggagatcgctaatgtcgcaatcaaacctggcggcagcgcaaaagatg

SEQ ID NO: 73309 - DNA, 103 bp, Artificial Sequence
  Synthetic Polynucleotide
taatacgactcactatagggaattataattattgtagtgattgcgataataacagaggagaattatcatgatcactacaaacctggcggcagcgcaaaagatg

SEQ ID NO: 73310 - DNA, 103 bp, Artificial Sequence
  Synthetic Polynucleotide
taatacgactcactatagggataataattataattattgtagtgattgcgaacagaggagacgcaatatgtacaataataacctggcggcagcgcaaaagatg

SEQ ID NO: 73311 - DNA, 103 bp, Artificial Sequence
  Synthetic Polynucleotide
taatacgactcactatagggtatcaataataattataattattgtagtgaaacagaggagatcactaatgtaattataaaacctggcggcagcgcaaaagatg

SEQ ID NO: 73312 - DNA, 103 bp, Artificial Sequence
  Synthetic Polynucleotide
taatacgactcactatagggaatgctatcaataataattataattattgtaacagaggagaacaataatgataattattaacctggcggcagcgcaaaagatg

SEQ ID NO: 73313 - DNA, 103 bp, Artificial Sequence
  Synthetic Polynucleotide
taatacgactcactatagggtatgcaaaatctcaatcggatactgtgttcaacagaggagagaacacatgatccgattgaacctggcggcagcgcaaaagatg

SEQ ID NO: 73314 - DNA, 103 bp, Artificial Sequence
  Synthetic Polynucleotide
taatacgactcactatagggataacaatgctatcaataataattataattaacagaggagaaattatatgtattattgaaacctggcggcagcgcaaaagatg

SEQ ID NO: 73315 - DNA, 103 bp, Artificial Sequence
  Synthetic Polynucleotide
taatacgactcactatagggtgctaataacaatgctatcaataataattaaacagaggagataattaatgttgatagcaaacctggcggcagcgcaaaagatg

SEQ ID NO: 73316 - DNA, 103 bp, Artificial Sequence
  Synthetic Polynucleotide
taatacgactcactataggggatagtgctaataacaatgctatcaataataacagaggagaattattatgagcattgttaacctggcggcagcgcaaaagatg

SEQ ID NO: 73317 - DNA, 103 bp, Artificial Sequence
  Synthetic Polynucleotide
taatacgactcactatagggattatgatagtgctaataacaatgctatcaaacagaggagatgatagatgtgttattagaacctggcggcagcgcaaaagatg

SEQ ID NO: 73318 - DNA, 103 bp, Artificial Sequence
  Synthetic Polynucleotide
taatacgactcactatagggatttaattatgatagtgctaataacaatgcaacagaggagagcattgatgttagcactaaacctggcggcagcgcaaaagatg

SEQ ID NO: 73319 - DNA, 103 bp, Artificial Sequence
  Synthetic Polynucleotide
taatacgactcactatagggcaataatttaattatgatagtgctaataacaacagaggagagttattatgactatcataaacctggcggcagcgcaaaagatg

SEQ ID NO: 73320 - DNA, 103 bp, Artificial Sequence
  Synthetic Polynucleotide
taatacgactcactatagggaatatcaataatttaattatgatagtgctaaacagaggagatagcacatgcataattaaaacctggcggcagcgcaaaagatg

SEQ ID NO: 73321 - DNA, 103 bp, Artificial Sequence
  Synthetic Polynucleotide
taatacgactcactatagggccatgaatatcaataatttaattatgatagaacagaggagactatcaatgttaaattataacctggcggcagcgcaaaagatg

SEQ ID NO: 73322 - DNA, 103 bp, Artificial Sequence
  Synthetic Polynucleotide
taatacgactcactatagggagcacccatgaatatcaataatttaattataacagaggagaataattatgttattgataaacctggcggcagcgcaaaagatg

SEQ ID NO: 73323 - DNA, 103 bp, Artificial Sequence
  Synthetic Polynucleotide
taatacgactcactatagggtattcagcacccatgaatatcaataatttaaacagaggagataaattatggatattcataacctggcggcagcgcaaaagatg

SEQ ID NO: 73324 - DNA, 103 bp, Artificial Sequence
  Synthetic Polynucleotide
taatacgactcactatagggtattgtatgcaaaatctcaatcggatactgaacagaggagacagtatatgattgagattaacctggcggcagcgcaaaagatg

SEQ ID NO: 73325 - DNA, 103 bp, Artificial Sequence
  Synthetic Polynucleotide
taatacgactcactatagggacgattattcagcacccatgaatatcaataaacagaggagatattgaatgtcatgggtgaacctggcggcagcgcaaaagatg

SEQ ID NO: 73326 - DNA, 103 bp, Artificial Sequence
  Synthetic Polynucleotide
taatacgactcactatagggtaataacgattattcagcacccatgaatataacagaggagaatattcatgggtgctgaaaacctggcggcagcgcaaaagatg

SEQ ID NO: 73327 - DNA, 103 bp, Artificial Sequence
  Synthetic Polynucleotide
taatacgactcactataggggatgataataacgattattcagcacccatgaacagaggagacatgggatgtgaataatcaacctggcggcagcgcaaaagatg

SEQ ID NO: 73328 - DNA, 103 bp, Artificial Sequence
  Synthetic Polynucleotide
taatacgactcactatagggataatgatgataataacgattattcagcacaacagaggagagtgctgatgaatcgttataacctggcggcagcgcaaaagatg

SEQ ID NO: 73329 - DNA, 103 bp, Artificial Sequence
  Synthetic Polynucleotide
taatacgactcactatagggaaatgataatgatgataataacgattattcaacagaggagagaataaatgttattatcaaacctggcggcagcgcaaaagatg

SEQ ID NO: 73330 - DNA, 103 bp, Artificial Sequence
  Synthetic Polynucleotide
taatacgactcactatagggttacaaaatgataatgatgataataacgataacagaggagaatcgttatgatcatcattaacctggcggcagcgcaaaagatg

SEQ ID NO: 73331 - DNA, 103 bp, Artificial Sequence
  Synthetic Polynucleotide
taatacgactcactatagggcacaattacaaaatgataatgatgataataaacagaggagatattatatgcattatcataacctggcggcagcgcaaaagatg

SEQ ID NO: 73332 - DNA, 103 bp, Artificial Sequence
  Synthetic Polynucleotide
taatacgactcactataggggatgtcacaattacaaaatgataatgatgaaacagaggagatcatcaatgtcattttgtaacctggcggcagcgcaaaagatg

SEQ ID NO: 73333 - DNA, 103 bp, Artificial Sequence
  Synthetic Polynucleotide
taatacgactcactatagggagtatgatgtcacaattacaaaatgataataacagaggagaattatcatgttgtaattgaacctggcggcagcgcaaaagatg

SEQ ID NO: 73334 - DNA, 103 bp, Artificial Sequence
  Synthetic Polynucleotide
taatacgactcactatagggtatctagtatgatgtcacaattacaaaatgaacagaggagacattttatgattgtgacaaacctggcggcagcgcaaaagatg

SEQ ID NO: 73335 - DNA, 103 bp, Artificial Sequence
  Synthetic Polynucleotide
taatacgactcactatagggactagtattgtatgcaaaatctcaatcggaaacagaggagatccgatatggattttgcaaacctggcggcagcgcaaaagatg

SEQ ID NO: 73336 - DNA, 103 bp, Artificial Sequence
  Synthetic Polynucleotide
taatacgactcactatagggcgatttatctagtatgatgtcacaattacaaacagaggagatgtaatatggacatcataaacctggcggcagcgcaaaagatg

SEQ ID NO: 73337 - DNA, 103 bp, Artificial Sequence
  Synthetic Polynucleotide
taatacgactcactataggggcaaacgatttatctagtatgatgtcacaaaacagaggagattgtgaatgcatactagaaacctggcggcagcgcaaaagatg

SEQ ID NO: 73338 - DNA, 103 bp, Artificial Sequence
  Synthetic Polynucleotide
taatacgactcactatagggatcgcgcaaacgatttatctagtatgatgtaacagaggagaacatcaatgtagataaataacctggcggcagcgcaaaagatg

SEQ ID NO: 73339 - DNA, 103 bp, Artificial Sequence
  Synthetic Polynucleotide
taatacgactcactatagggcaacaatcgcgcaaacgatttatctagtataacagaggagaatactaatgaaatcgtttaacctggcggcagcgcaaaagatg

SEQ ID NO: 73340 - DNA, 103 bp, Artificial Sequence
  Synthetic Polynucleotide
taatacgactcactatagggtcccacaacaatcgcgcaaacgatttatctaacagaggagaagataaatggtttgcgcgaacctggcggcagcgcaaaagatg

SEQ ID NO: 73341 - DNA, 103 bp, Artificial Sequence
  Synthetic Polynucleotide
taatacgactcactatagggccgtttcccacaacaatcgcgcaaacgattaacagaggagaaatcgtatgcgcgattgtaacctggcggcagcgcaaaagatg

SEQ ID NO: 73342 - DNA, 103 bp, Artificial Sequence
  Synthetic Polynucleotide
taatacgactcactatagggcatgcccgtttcccacaacaatcgcgcaaaaacagaggagatttgcgatgttgttgtggaacctggcggcagcgcaaaagatg

SEQ ID NO: 73343 - DNA, 103 bp, Artificial Sequence
  Synthetic Polynucleotide
taatacgactcactatagggtcctccatgcccgtttcccacaacaatcgcaacagaggagagcgattatggtgggaaacaacctggcggcagcgcaaaagatg

SEQ ID NO: 73344 - DNA, 103 bp, Artificial Sequence
  Synthetic Polynucleotide
taatacgactcactatagggattcatcctccatgcccgtttcccacaacaaacagaggagatgttgtatgaaacgggcaaacctggcggcagcgcaaaagatg

SEQ ID NO: 73345 - DNA, 103 bp, Artificial Sequence
  Synthetic Polynucleotide
taatacgactcactatagggcgataattcatcctccatgcccgtttcccaaacagaggagatgggaaatgggcatggagaacctggcggcagcgcaaaagatg

SEQ ID NO: 73346 - DNA, 103 bp, Artificial Sequence
  Synthetic Polynucleotide
taatacgactcactatagggtgcatcaactatttctcaaacaataacgttaacagaggagaaacgttatggtttgagaaaacctggcggcagcgcaaaagatg

SEQ ID NO: 73347 - DNA, 103 bp, Artificial Sequence
  Synthetic Polynucleotide
taatacgactcactatagggtcatcattttttgtgaaatataatataggaaacagaggagatcctatatgatatttcacaacctggcggcagcgcaaaagatg

SEQ ID NO: 73348 - DNA, 103 bp, Artificial Sequence
  Synthetic Polynucleotide
taatacgactcactatagggtctagactagtattgtatgcaaaatctcaaaacagaggagattgagaatgtgcatacaaaacctggcggcagcgcaaaagatg

SEQ ID NO: 73349 - DNA, 103 bp, Artificial Sequence
  Synthetic Polynucleotide
taatacgactcactatagggaataacgataattcatcctccatgcccgttaacagaggagaaacgggatgggaggatgaaacctggcggcagcgcaaaagatg

SEQ ID NO: 73350 - DNA, 103 bp, Artificial Sequence
  Synthetic Polynucleotide
taatacgactcactatagggataataataacgataattcatcctccatgcaacagaggagagcatggatgatgaattataacctggcggcagcgcaaaagatg

SEQ ID NO: 73351 - DNA, 103 bp, Artificial Sequence
  Synthetic Polynucleotide
taatacgactcactatagggtttaaataataataacgataattcatcctcaacagaggagagaggatatgttatcgttaaacctggcggcagcgcaaaagatg

SEQ ID NO: 73352 - DNA, 103 bp, Artificial Sequence
  Synthetic Polynucleotide
taatacgactcactataggggaggctttaaataataataacgataattcaaacagaggagatgaattatggttattattaacctggcggcagcgcaaaagatg

SEQ ID NO: 73353 - DNA, 103 bp, Artificial Sequence
  Synthetic Polynucleotide
taatacgactcactatagggaatgggaggctttaaataataataacgataaacagaggagatatcgtatgtattatttaaacctggcggcagcgcaaaagatg

SEQ ID NO: 73354 - DNA, 103 bp, Artificial Sequence
  Synthetic Polynucleotide
taatacgactcactatagggatccgaatgggaggctttaaataataataaaacagaggagattattaatgtttaaagccaacctggcggcagcgcaaaagatg

SEQ ID NO: 73355 - DNA, 103 bp, Artificial Sequence
  Synthetic Polynucleotide
taatacgactcactatagggtgtgaatccgaatgggaggctttaaataataacagaggagaattattatgagcctcccaaacctggcggcagcgcaaaagatg

SEQ ID NO: 73356 - DNA, 103 bp, Artificial Sequence
  Synthetic Polynucleotide
taatacgactcactatagggatatttgtgaatccgaatgggaggctttaaaacagaggagattaaagatgcccattcggaacctggcggcagcgcaaaagatg

SEQ ID NO: 73357 - DNA, 103 bp, Artificial Sequence
  Synthetic Polynucleotide
taatacgactcactataggggcgtcatatttgtgaatccgaatgggaggcaacagaggagagcctccatgtcggattcaaacctggcggcagcgcaaaagatg

SEQ ID NO: 73358 - DNA, 103 bp, Artificial Sequence
  Synthetic Polynucleotide
taatacgactcactatagggaacgcgcgtcatatttgtgaatccgaatggaacagaggagaccattcatgttcacaaataacctggcggcagcgcaaaagatg

SEQ ID NO: 73359 - DNA, 103 bp, Artificial Sequence
  Synthetic Polynucleotide
taatacgactcactatagggttctttctagactagtattgtatgcaaaataacagaggagaattttgatgacaatactaaacctggcggcagcgcaaaagatg

SEQ ID NO: 73360 - DNA, 103 bp, Artificial Sequence
  Synthetic Polynucleotide
taatacgactcactatagggtgttgaacgcgcgtcatatttgtgaatccgaacagaggagacggattatgaaatatgacaacctggcggcagcgcaaaagatg

SEQ ID NO: 73361 - DNA, 103 bp, Artificial Sequence
  Synthetic Polynucleotide
taatacgactcactatagggtaaaatgttgaacgcgcgtcatatttgtgaaacagaggagatcacaaatgtgacgcgcgaacctggcggcagcgcaaaagatg

SEQ ID NO: 73362 - DNA, 103 bp, Artificial Sequence
  Synthetic Polynucleotide
taatacgactcactatagggttccataaaatgttgaacgcgcgtcatattaacagaggagaaatatgatgcgcgttcaaaacctggcggcagcgcaaaagatg

SEQ ID NO: 73363 - DNA, 103 bp, Artificial Sequence
  Synthetic Polynucleotide
taatacgactcactatagggatagtttccataaaatgttgaacgcgcgtcaacagaggagagacgcgatgtcaacatttaacctggcggcagcgcaaaagatg

SEQ ID NO: 73364 - DNA, 103 bp, Artificial Sequence
  Synthetic Polynucleotide
taatacgactcactatagggaaattatagtttccataaaatgttgaacgcaacagaggagagcgttcatgattttatggaacctggcggcagcgcaaaagatg

SEQ ID NO: 73365 - DNA, 103 bp, Artificial Sequence
  Synthetic Polynucleotide
taatacgactcactatagggtcacaaaattatagtttccataaaatgttgaacagaggagacaacatatgatggaaactaacctggcggcagcgcaaaagatg

SEQ ID NO: 73366 - DNA, 103 bp, Artificial Sequence
  Synthetic Polynucleotide
taatacgactcactatagggtgttttcacaaaattatagtttccataaaaaacagaggagattttatatgaactataataacctggcggcagcgcaaaagatg

SEQ ID NO: 73367 - DNA, 103 bp, Artificial Sequence
  Synthetic Polynucleotide
taatacgactcactatagggttacctgttttcacaaaattatagtttccaaacagaggagatggaaaatgtaattttgtaacctggcggcagcgcaaaagatg

SEQ ID NO: 73368 - DNA, 103 bp, Artificial Sequence
  Synthetic Polynucleotide
taatacgactcactatagggtcttgttacctgttttcacaaaattatagtaacagaggagaactataatgttgtgaaaaaacctggcggcagcgcaaaagatg

SEQ ID NO: 73369 - DNA, 103 bp, Artificial Sequence
  Synthetic Polynucleotide
taatacgactcactatagggagttttcttgttacctgttttcacaaaattaacagaggagaaattttatgaaaacaggtaacctggcggcagcgcaaaagatg

SEQ ID NO: 73370 - DNA, 103 bp, Artificial Sequence
  Synthetic Polynucleotide
taatacgactcactatagggcaaatttctttctagactagtattgtatgcaacagaggagagcatacatgactagtctaaacctggcggcagcgcaaaagatg

SEQ ID NO: 73371 - DNA, 103 bp, Artificial Sequence
  Synthetic Polynucleotide
taatacgactcactatagggtgacgagttttcttgttacctgttttcacaaacagaggagatgtgaaatgaggtaacaaaacctggcggcagcgcaaaagatg

SEQ ID NO: 73372 - DNA, 103 bp, Artificial Sequence
  Synthetic Polynucleotide
taatacgactcactatagggaacgatgacgagttttcttgttacctgtttaacagaggagaaaacagatgacaagaaaaaacctggcggcagcgcaaaagatg

SEQ ID NO: 73373 - DNA, 103 bp, Artificial Sequence
  Synthetic Polynucleotide
taatacgactcactatagggaaaataacgatgacgagttttcttgttaccaacagaggagaggtaacatgaaaactcgtaacctggcggcagcgcaaaagatg

SEQ ID NO: 73374 - DNA, 103 bp, Artificial Sequence
  Synthetic Polynucleotide
taatacgactcactatagggcgttaaaaataacgatgacgagttttcttgaacagaggagacaagaaatgtcgtcatcgaacctggcggcagcgcaaaagatg

SEQ ID NO: 73375 - DNA, 103 bp, Artificial Sequence
  Synthetic Polynucleotide
taatacgactcactatagggactatcgttaaaaataacgatgacgagtttaacagaggagaaaactcatgatcgttattaacctggcggcagcgcaaaagatg

SEQ ID NO: 73376 - DNA, 103 bp, Artificial Sequence
  Synthetic Polynucleotide
taatacgactcactatagggggtttactatcgttaaaaataacgatgacgaacagaggagacgtcatatgtatttttaaaacctggcggcagcgcaaaagatg

SEQ ID NO: 73377 - DNA, 103 bp, Artificial Sequence
  Synthetic Polynucleotide
taatacgactcactatagggtaatcggtttactatcgttaaaaataacgaaacagaggagatcgttaatgttaacgataaacctggcggcagcgcaaaagatg

SEQ ID NO: 73378 - DNA, 103 bp, Artificial Sequence
  Synthetic Polynucleotide
taatacgactcactatagggacgtttaatcggtttactatcgttaaaaataacagaggagaatttttatggatagtaaaaacctggcggcagcgcaaaagatg

SEQ ID NO: 73379 - DNA, 103 bp, Artificial Sequence
  Synthetic Polynucleotide
taatacgactcactataggggcgcgacgtttaatcggtttactatcgttaaacagaggagataacgaatgtaaaccgataacctggcggcagcgcaaaagatg

SEQ ID NO: 73380 - DNA, 103 bp, Artificial Sequence
  Synthetic Polynucleotide
taatacgactcactatagggaattagcgcgacgtttaatcggtttactataacagaggagaatagtaatgcgattaaacaacctggcggcagcgcaaaagatg

SEQ ID NO: 73381 - DNA, 103 bp, Artificial Sequence
  Synthetic Polynucleotide
taatacgactcactataggggattacaaatttctttctagactagtattgaacagaggagacaatacatgtctagaaagaacctggcggcagcgcaaaagatg

SEQ ID NO: 73382 - DNA, 103 bp, Artificial Sequence
  Synthetic Polynucleotide
taatacgactcactatagggttagaaattagcgcgacgtttaatcggtttaacagaggagaaaaccgatgaaacgtcgcaacctggcggcagcgcaaaagatg

SEQ ID NO: 73383 - DNA, 103 bp, Artificial Sequence
  Synthetic Polynucleotide
taatacgactcactatagggtagcgttagaaattagcgcgacgtttaatcaacagaggagagattaaatgtcgcgctaaaacctggcggcagcgcaaaagatg

SEQ ID NO: 73384 - DNA, 103 bp, Artificial Sequence
  Synthetic Polynucleotide
taatacgactcactataggggtcgctagcgttagaaattagcgcgacgttaacagaggagaaacgtcatgctaatttctaacctggcggcagcgcaaaagatg

SEQ ID NO: 73385 - DNA, 103 bp, Artificial Sequence
  Synthetic Polynucleotide
taatacgactcactatagggatagagtcgctagcgttagaaattagcgcgaacagaggagacgcgctatgttctaacgcaacctggcggcagcgcaaaagatg

SEQ ID NO: 73386 - DNA, 103 bp, Artificial Sequence
  Synthetic Polynucleotide
taatacgactcactatagggatccaatagagtcgctagcgttagaaattaaacagaggagataatttatgacgctagcgaacctggcggcagcgcaaaagatg

SEQ ID NO: 73387 - DNA, 103 bp, Artificial Sequence
  Synthetic Polynucleotide
taatacgactcactatagggtccatatccaatagagtcgctagcgttagaaacagaggagatctaacatgagcgactctaacctggcggcagcgcaaaagatg

SEQ ID NO: 73388 - DNA, 103 bp, Artificial Sequence
  Synthetic Polynucleotide
taatacgactcactatagggggaaatccatatccaatagagtcgctagcgaacagaggagacgctagatgctctattggaacctggcggcagcgcaaaagatg

SEQ ID NO: 73389 - DNA, 103 bp, Artificial Sequence
  Synthetic Polynucleotide
taatacgactcactatagggtatctggaaatccatatccaatagagtcgcaacagaggagagcgactatgttggatatgaacctggcggcagcgcaaaagatg

SEQ ID NO: 73390 - DNA, 103 bp, Artificial Sequence
  Synthetic Polynucleotide
taatacgactcactatagggatatatatctggaaatccatatccaatagaaacagaggagatctattatgtatggatttaacctggcggcagcgcaaaagatg

SEQ ID NO: 73391 - DNA, 103 bp, Artificial Sequence
  Synthetic Polynucleotide
taatacgactcactatagggaaaagatatatatctggaaatccatatccaaacagaggagatggataatgatttccagaaacctggcggcagcgcaaaagatg

SEQ ID NO: 73392 - DNA, 103 bp, Artificial Sequence
  Synthetic Polynucleotide
taatacgactcactatagggaagatgattacaaatttctttctagactagaacagaggagactagtcatgaaagaaattaacctggcggcagcgcaaaagatg

SEQ ID NO: 73393 - DNA, 103 bp, Artificial Sequence
  Synthetic Polynucleotide
taatacgactcactatagggagctgaaaagatatatatctggaaatccataacagaggagaatggatatgcagatatataacctggcggcagcgcaaaagatg

SEQ ID NO: 73394 - DNA, 103 bp, Artificial Sequence
  Synthetic Polynucleotide
taatacgactcactatagggaggggagctgaaaagatatatatctggaaaaacagaggagatttccaatgatatatcttaacctggcggcagcgcaaaagatg

SEQ ID NO: 73395 - DNA, 103 bp, Artificial Sequence
  Synthetic Polynucleotide
taatacgactcactatagggtacgtaggggagctgaaaagatatatatctaacagaggagaagatatatgtcttttcagaacctggcggcagcgcaaaagatg

SEQ ID NO: 73396 - DNA, 103 bp, Artificial Sequence
  Synthetic Polynucleotide
taatacgactcactatagggatagatacgtaggggagctgaaaagatataaacagaggagatatatcatgtcagctcccaacctggcggcagcgcaaaagatg

SEQ ID NO: 73397 - DNA, 103 bp, Artificial Sequence
  Synthetic Polynucleotide
taatacgactcactatagggtgattatagatacgtaggggagctgaaaagaacagaggagacttttcatgtcccctacgaacctggcggcagcgcaaaagatg

SEQ ID NO: 73398 - DNA, 103 bp, Artificial Sequence
  Synthetic Polynucleotide
taatacgactcactatagggacagatgattatagatacgtaggggagctgaacagaggagacagctcatgtacgtatctaacctggcggcagcgcaaaagatg

SEQ ID NO: 73399 - DNA, 103 bp, Artificial Sequence
  Synthetic Polynucleotide
taatacgactcactatagggttcccacagatgattatagatacgtaggggaacagaggagacccctaatgatctataataacctggcggcagcgcaaaagatg

SEQ ID NO: 73400 - DNA, 103 bp, Artificial Sequence
  Synthetic Polynucleotide
taatacgactcactatagggtccatttcccacagatgattatagatacgtaacagaggagaacgtatatgtaatcatctaacctggcggcagcgcaaaagatg

SEQ ID NO: 73401 - DNA, 103 bp, Artificial Sequence
  Synthetic Polynucleotide
taatacgactcactatagggtaccttccatttcccacagatgattatagaaacagaggagatctataatgatctgtgggaacctggcggcagcgcaaaagatg

SEQ ID NO: 73402 - DNA, 103 bp, Artificial Sequence
  Synthetic Polynucleotide
taatacgactcactatagggggaaataccttccatttcccacagatgattaacagaggagaaatcatatgtgggaaatgaacctggcggcagcgcaaaagatg

SEQ ID NO: 73403 - DNA, 103 bp, Artificial Sequence
  Synthetic Polynucleotide
taatacgactcactatagggcacagaagatgattacaaatttctttctagaacagaggagactagaaatgaatttgtaaaacctggcggcagcgcaaaagatg

SEQ ID NO: 73404 - DNA, 103 bp, Artificial Sequence
  Synthetic Polynucleotide
taatacgactcactatagggtagatggaaataccttccatttcccacagaaacagaggagatctgtgatgaatggaaggaacctggcggcagcgcaaaagatg

SEQ ID NO: 73405 - DNA, 103 bp, Artificial Sequence
  Synthetic Polynucleotide
taatacgactcactatagggctagatagatggaaataccttccatttcccaacagaggagagggaaaatgaaggtatttaacctggcggcagcgcaaaagatg

SEQ ID NO: 73406 - DNA, 103 bp, Artificial Sequence
  Synthetic Polynucleotide
taatacgactcactataggggaacactagatagatggaaataccttccataacagaggagaatggaaatgatttccatcaacctggcggcagcgcaaaagatg

SEQ ID NO: 73407 - DNA, 103 bp, Artificial Sequence
  Synthetic Polynucleotide
taatacgactcactatagggattaggaacactagatagatggaaatacctaacagaggagaaggtatatgcatctatctaacctggcggcagcgcaaaagatg

SEQ ID NO: 73408 - DNA, 103 bp, Artificial Sequence
  Synthetic Polynucleotide
taatacgactcactatagggatgatattaggaacactagatagatggaaaaacagaggagatttccaatgatctagtgtaacctggcggcagcgcaaaagatg

SEQ ID NO: 73409 - DNA, 103 bp, Artificial Sequence
  Synthetic Polynucleotide
taatacgactcactatagggtacatatgatattaggaacactagatagataacagaggagaatctatatggtgttcctaaacctggcggcagcgcaaaagatg

SEQ ID NO: 73410 - DNA, 103 bp, Artificial Sequence
  Synthetic Polynucleotide
taatacgactcactatagggaccactacatatgatattaggaacactagaaacagaggagatctagtatgcctaatatcaacctggcggcagcgcaaaagatg

SEQ ID NO: 73411 - DNA, 103 bp, Artificial Sequence
  Synthetic Polynucleotide
taatacgactcactatagggattacaccactacatatgatattaggaacaaacagaggagatgttccatgtatcatatgaacctggcggcagcgcaaaagatg

SEQ ID NO: 73412 - DNA, 103 bp, Artificial Sequence
  Synthetic Polynucleotide
taatacgactcactataggggttctattacaccactacatatgatattagaacagaggagactaataatgtatgtagtgaacctggcggcagcgcaaaagatg

SEQ ID NO: 73413 - DNA, 103 bp, Artificial Sequence
  Synthetic Polynucleotide
taatacgactcactatagggtaatggttctattacaccactacatatgataacagaggagaatcataatgagtggtgtaaacctggcggcagcgcaaaagatg

SEQ ID NO: 73414 - DNA, 103 bp, Artificial Sequence
  Synthetic Polynucleotide
taatacgactcactatagggcccgtcacagaagatgattacaaatttcttaacagaggagaaagaaaatggtaatcatcaacctggcggcagcgcaaaagatg

SEQ ID NO: 73415 - DNA, 103 bp, Artificial Sequence
  Synthetic Polynucleotide
taatacgactcactataggggcgcttaatggttctattacaccactacataacagaggagaatgtagatgtgtaatagaaacctggcggcagcgcaaaagatg

SEQ ID NO: 73416 - DNA, 103 bp, Artificial Sequence
  Synthetic Polynucleotide
taatacgactcactatagggctttcgcgcttaatggttctattacaccacaacagaggagagtggtgatgtagaaccataacctggcggcagcgcaaaagatg

SEQ ID NO: 73417 - DNA, 103 bp, Artificial Sequence
  Synthetic Polynucleotide
taatacgactcactatagggaaaatctttcgcgcttaatggttctattacaacagaggagagtaataatgccattaagcaacctggcggcagcgcaaaagatg

SEQ ID NO: 73418 - DNA, 103 bp, Artificial Sequence
  Synthetic Polynucleotide
taatacgactcactataggggaaataaaatctttcgcgcttaatggttctaacagaggagaagaaccatgaagcgcgaaaacctggcggcagcgcaaaagatg

SEQ ID NO: 73419 - DNA, 103 bp, Artificial Sequence
  Synthetic Polynucleotide
taatacgactcactataggggatgtgaaataaaatctttcgcgcttaatgaacagaggagacattaaatgcgaaagattaacctggcggcagcgcaaaagatg

SEQ ID NO: 73420 - DNA, 103 bp, Artificial Sequence
  Synthetic Polynucleotide
taatacgactcactatagggaatacgatgtgaaataaaatctttcgcgctaacagaggagaagcgcgatggattttattaacctggcggcagcgcaaaagatg

SEQ ID NO: 73421 - DNA, 103 bp, Artificial Sequence
  Synthetic Polynucleotide
taatacgactcactataggggttaaaatacgatgtgaaataaaatctttcaacagaggagagaaagaatgtatttcacaaacctggcggcagcgcaaaagatg

SEQ ID NO: 73422 - DNA, 103 bp, Artificial Sequence
  Synthetic Polynucleotide
taatacgactcactataggggcgaagttaaaatacgatgtgaaataaaataacagaggagaattttaatgcacatcgtaaacctggcggcagcgcaaaagatg

SEQ ID NO: 73423 - DNA, 103 bp, Artificial Sequence
  Synthetic Polynucleotide
taatacgactcactatagggttattgcgaagttaaaatacgatgtgaaataacagaggagaatttcaatgcgtattttaaacctggcggcagcgcaaaagatg

SEQ ID NO: 73424 - DNA, 103 bp, Artificial Sequence
  Synthetic Polynucleotide
taatacgactcactatagggagaaattattgcgaagttaaaatacgatgtaacagaggagaacatcgatgtttaacttcaacctggcggcagcgcaaaagatg

SEQ ID NO: 73425 - DNA, 103 bp, Artificial Sequence
  Synthetic Polynucleotide
taatacgactcactatagggggactcccgtcacagaagatgattacaaataacagaggagaatttgtatgcatcttctgaacctggcggcagcgcaaaagatg

SEQ ID NO: 73426 - DNA, 103 bp, Artificial Sequence
  Synthetic Polynucleotide
taatacgactcactatagggtaaccagaaattattgcgaagttaaaatacaacagaggagagtatttatgcttcgcaataacctggcggcagcgcaaaagatg

SEQ ID NO: 73427 - DNA, 103 bp, Artificial Sequence
  Synthetic Polynucleotide
taatacgactcactatagggttatctaaccagaaattattgcgaagttaaaacagaggagattaactatgcaataatttaacctggcggcagcgcaaaagatg

SEQ ID NO: 73428 - DNA, 103 bp, Artificial Sequence
  Synthetic Polynucleotide
taatacgactcactataggggtgtgttatctaaccagaaattattgcgaaaacagaggagattcgcaatgatttctggtaacctggcggcagcgcaaaagatg

SEQ ID NO: 73429 - DNA, 103 bp, Artificial Sequence
  Synthetic Polynucleotide
taatacgactcactataggggtagagtgtgttatctaaccagaaattattaacagaggagaaataatatgtggttagataacctggcggcagcgcaaaagatg

SEQ ID NO: 73430 - DNA, 103 bp, Artificial Sequence
  Synthetic Polynucleotide
taatacgactcactatagggaactggtagagtgtgttatctaaccagaaaaacagaggagatttctgatgagataacacaacctggcggcagcgcaaaagatg

SEQ ID NO: 73431 - DNA, 103 bp, Artificial Sequence
  Synthetic Polynucleotide
taatacgactcactataggggacttaactggtagagtgtgttatctaaccaacagaggagaggttagatgacacactctaacctggcggcagcgcaaaagatg

SEQ ID NO: 73432 - DNA, 103 bp, Artificial Sequence
  Synthetic Polynucleotide
taatacgactcactatagggttattgacttaactggtagagtgtgttatcaacagaggagagataacatgctctaccagaacctggcggcagcgcaaaagatg

SEQ ID NO: 73433 - DNA, 103 bp, Artificial Sequence
  Synthetic Polynucleotide
taatacgactcactatagggtaatattattgacttaactggtagagtgtgaacagaggagacacactatgccagttaagaacctggcggcagcgcaaaagatg

SEQ ID NO: 73434 - DNA, 103 bp, Artificial Sequence
  Synthetic Polynucleotide
taatacgactcactatagggaaggctaatattattgacttaactggtagaaacagaggagatctaccatgtaagtcaataacctggcggcagcgcaaaagatg

SEQ ID NO: 73435 - DNA, 103 bp, Artificial Sequence
  Synthetic Polynucleotide
taatacgactcactatagggctgtaaaggctaatattattgacttaactgaacagaggagacagttaatgcaataatataacctggcggcagcgcaaaagatg

SEQ ID NO: 73436 - DNA, 103 bp, Artificial Sequence
  Synthetic Polynucleotide
taatacgactcactatagggtatatggactcccgtcacagaagatgattaaacagaggagataatcaatgtctgtgacgaacctggcggcagcgcaaaagatg

SEQ ID NO: 73437 - DNA, 103 bp, Artificial Sequence
  Synthetic Polynucleotide
taatacgactcactatagggtatatctgtaaaggctaatattattgacttaacagaggagaaagtcaatgatattagccaacctggcggcagcgcaaaagatg

SEQ ID NO: 73438 - DNA, 103 bp, Artificial Sequence
  Synthetic Polynucleotide
taatacgactcactatagggatgaatatatctgtaaaggctaatattattaacagaggagaaataatatgagcctttacaacctggcggcagcgcaaaagatg

SEQ ID NO: 73439 - DNA, 103 bp, Artificial Sequence
  Synthetic Polynucleotide
taatacgactcactatagggctactatgaatatatctgtaaaggctaataaacagaggagatattagatgttacagataaacctggcggcagcgcaaaagatg

SEQ ID NO: 73440 - DNA, 103 bp, Artificial Sequence
  Synthetic Polynucleotide
taatacgactcactatagggcacaactactatgaatatatctgtaaaggcaacagaggagagcctttatggatatattcaacctggcggcagcgcaaaagatg

SEQ ID NO: 73441 - DNA, 103 bp, Artificial Sequence
  Synthetic Polynucleotide
taatacgactcactatagggattgtcacaactactatgaatatatctgtaaacagaggagatacagaatgattcatagtaacctggcggcagcgcaaaagatg

SEQ ID NO: 73442 - DNA, 103 bp, Artificial Sequence
  Synthetic Polynucleotide
taatacgactcactataggggagtcattgtcacaactactatgaatatataacagaggagaatatatatgtagtagttgaacctggcggcagcgcaaaagatg

SEQ ID NO: 73443 - DNA, 103 bp, Artificial Sequence
  Synthetic Polynucleotide
taatacgactcactatagggagatggagtcattgtcacaactactatgaaaacagaggagattcataatggttgtgacaaacctggcggcagcgcaaaagatg

SEQ ID NO: 73444 - DNA, 103 bp, Artificial Sequence
  Synthetic Polynucleotide
taatacgactcactatagggctaaaagatggagtcattgtcacaactactaacagaggagaagtagtatggacaatgacaacctggcggcagcgcaaaagatg

SEQ ID NO: 73445 - DNA, 103 bp, Artificial Sequence
  Synthetic Polynucleotide
taatacgactcactatagggcgcatctaaaagatggagtcattgtcacaaaacagaggagattgtgaatgtgactccataacctggcggcagcgcaaaagatg

SEQ ID NO: 73446 - DNA, 103 bp, Artificial Sequence
  Synthetic Polynucleotide
taatacgactcactatagggagtatcgcatctaaaagatggagtcattgtaacagaggagaacaatgatgccatcttttaacctggcggcagcgcaaaagatg

SEQ ID NO: 73447 - DNA, 103 bp, Artificial Sequence
  Synthetic Polynucleotide
taatacgactcactatagggacagatatatggactcccgtcacagaagataacagaggagaatcttcatggacgggagtaacctggcggcagcgcaaaagatg

SEQ ID NO: 73448 - DNA, 103 bp, Artificial Sequence
  Synthetic Polynucleotide
taatacgactcactatagggaaaggagtatcgcatctaaaagatggagtcaacagaggagagactccatgttttagatgaacctggcggcagcgcaaaagatg

SEQ ID NO: 73449 - DNA, 103 bp, Artificial Sequence
  Synthetic Polynucleotide
taatacgactcactatagggcatataaaggagtatcgcatctaaaagatgaacagaggagacatcttatggatgcgataaacctggcggcagcgcaaaagatg

SEQ ID NO: 73450 - DNA, 103 bp, Artificial Sequence
  Synthetic Polynucleotide
taatacgactcactatagggtggctcatataaaggagtatcgcatctaaaaacagaggagatttagaatggatactcctaacctggcggcagcgcaaaagatg

SEQ ID NO: 73451 - DNA, 103 bp, Artificial Sequence
  Synthetic Polynucleotide
taatacgactcactataggggattctggctcatataaaggagtatcgcataacagaggagaatgcgaatgtcctttataaacctggcggcagcgcaaaagatg

SEQ ID NO: 73452 - DNA, 103 bp, Artificial Sequence
  Synthetic Polynucleotide
taatacgactcactatagggacgaagattctggctcatataaaggagtataacagaggagaatactcatgtatatgagcaacctggcggcagcgcaaaagatg

SEQ ID NO: 73453 - DNA, 103 bp, Artificial Sequence
  Synthetic Polynucleotide
taatacgactcactataggggaggtacgaagattctggctcatataaaggaacagaggagacctttaatggagccagaaaacctggcggcagcgcaaaagatg

SEQ ID NO: 73454 - DNA, 103 bp, Artificial Sequence
  Synthetic Polynucleotide
taatacgactcactatagggagtttgaggtacgaagattctggctcatataacagaggagaatatgaatgagaatcttcaacctggcggcagcgcaaaagatg

SEQ ID NO: 73455 - DNA, 103 bp, Artificial Sequence
  Synthetic Polynucleotide
taatacgactcactatagggtatcgagtttgaggtacgaagattctggctaacagaggagaagccagatgcttcgtaccaacctggcggcagcgcaaaagatg

SEQ ID NO: 73456 - DNA, 103 bp, Artificial Sequence
  Synthetic Polynucleotide
taatacgactcactataggggaatatatcgagtttgaggtacgaagattcaacagaggagagaatctatgtacctcaaaaacctggcggcagcgcaaaagatg

SEQ ID NO: 73457 - DNA, 103 bp, Artificial Sequence
  Synthetic Polynucleotide
taatacgactcactatagggtgtttgaatatatcgagtttgaggtacgaaaacagaggagattcgtaatgcaaactcgaaacctggcggcagcgcaaaagatg

SEQ ID NO: 73458 - DNA, 103 bp, Artificial Sequence
  Synthetic Polynucleotide
taatacgactcactatagggtgccttcatcattttttgtgaaatataataaacagaggagatattatatgtcacaaaaaaacctggcggcagcgcaaaagatg

SEQ ID NO: 73459 - DNA, 103 bp, Artificial Sequence
  Synthetic Polynucleotide
taatacgactcactatagggatgatacagatatatggactcccgtcacagaacagaggagactgtgaatggagtccataaacctggcggcagcgcaaaagatg

SEQ ID NO: 73460 - DNA, 103 bp, Artificial Sequence
  Synthetic Polynucleotide
taatacgactcactatagggtaacttgtttgaatatatcgagtttgaggtaacagaggagaacctcaatgtcgatatataacctggcggcagcgcaaaagatg

SEQ ID NO: 73461 - DNA, 103 bp, Artificial Sequence
  Synthetic Polynucleotide
taatacgactcactatagggctcattaacttgtttgaatatatcgagtttaacagaggagaaaactcatgatattcaaaaacctggcggcagcgcaaaagatg

SEQ ID NO: 73462 - DNA, 103 bp, Artificial Sequence
  Synthetic Polynucleotide
taatacgactcactatagggaatatctcattaacttgtttgaatatatcgaacagaggagacgatatatgcaaacaagtaacctggcggcagcgcaaaagatg

SEQ ID NO: 73463 - DNA, 103 bp, Artificial Sequence
  Synthetic Polynucleotide
taatacgactcactataggggcgttaatatctcattaacttgtttgaataaacagaggagatattcaatgaagttaatgaacctggcggcagcgcaaaagatg

SEQ ID NO: 73464 - DNA, 103 bp, Artificial Sequence
  Synthetic Polynucleotide
taatacgactcactatagggaaaacgcgttaatatctcattaacttgtttaacagaggagaaaacaaatgaatgagataaacctggcggcagcgcaaaagatg

SEQ ID NO: 73465 - DNA, 103 bp, Artificial Sequence
  Synthetic Polynucleotide
taatacgactcactatagggttcataaaacgcgttaatatctcattaactaacagaggagaagttaaatggatattaacaacctggcggcagcgcaaaagatg

SEQ ID NO: 73466 - DNA, 103 bp, Artificial Sequence
  Synthetic Polynucleotide
taatacgactcactatagggcatcgttcataaaacgcgttaatatctcataacagaggagaatgagaatgtaacgcgttaacctggcggcagcgcaaaagatg

SEQ ID NO: 73467 - DNA, 103 bp, Artificial Sequence
  Synthetic Polynucleotide
taatacgactcactatagggcatatcatcgttcataaaacgcgttaatataacagaggagaatattaatgcgttttatgaacctggcggcagcgcaaaagatg

SEQ ID NO: 73468 - DNA, 103 bp, Artificial Sequence
  Synthetic Polynucleotide
taatacgactcactatagggggatacatatcatcgttcataaaacgcgttaacagaggagaaacgcgatgtatgaacgaaacctggcggcagcgcaaaagatg

SEQ ID NO: 73469 - DNA, 103 bp, Artificial Sequence
  Synthetic Polynucleotide
taatacgactcactatagggcttctggatacatatcatcgttcataaaacaacagaggagagttttaatgacgatgataaacctggcggcagcgcaaaagatg

SEQ ID NO: 73470 - DNA, 103 bp, Artificial Sequence
  Synthetic Polynucleotide
taatacgactcactatagggagacgatgatacagatatatggactcccgtaacagaggagaacgggaatgcatatatctaacctggcggcagcgcaaaagatg

SEQ ID NO: 73471 - DNA, 103 bp, Artificial Sequence
  Synthetic Polynucleotide
taatacgactcactatagggtagaacttctggatacatatcatcgttcataacagaggagaatgaacatggatatgtataacctggcggcagcgcaaaagatg

SEQ ID NO: 73472 - DNA, 103 bp, Artificial Sequence
  Synthetic Polynucleotide
taatacgactcactataggggaggatagaacttctggatacatatcatcgaacagaggagacgatgaatggtatccagaaacctggcggcagcgcaaaagatg

SEQ ID NO: 73473 - DNA, 103 bp, Artificial Sequence
  Synthetic Polynucleotide
taatacgactcactatagggccacggaggatagaacttctggatacatataacagaggagaatatgtatgcagaagttcaacctggcggcagcgcaaaagatg

SEQ ID NO: 73474 - DNA, 103 bp, Artificial Sequence
  Synthetic Polynucleotide
taatacgactcactataggggttagccacggaggatagaacttctggataaacagaggagatatccaatggttctatccaacctggcggcagcgcaaaagatg

SEQ ID NO: 73475 - DNA, 103 bp, Artificial Sequence
  Synthetic Polynucleotide
taatacgactcactatagggatagcgttagccacggaggatagaacttctaacagaggagaagaagtatgatcctccgtaacctggcggcagcgcaaaagatg

SEQ ID NO: 73476 - DNA, 103 bp, Artificial Sequence
  Synthetic Polynucleotide
taatacgactcactatagggaggttatagcgttagccacggaggatagaaaacagaggagattctatatgccgtggctaaacctggcggcagcgcaaaagatg

SEQ ID NO: 73477 - DNA, 103 bp, Artificial Sequence
  Synthetic Polynucleotide
taatacgactcactatagggtaataaggttatagcgttagccacggaggaaacagaggagatcctccatggctaacgctaacctggcggcagcgcaaaagatg

SEQ ID NO: 73478 - DNA, 103 bp, Artificial Sequence
  Synthetic Polynucleotide
taatacgactcactatagggtataataataaggttatagcgttagccacgaacagaggagacgtggcatgcgctataacaacctggcggcagcgcaaaagatg

SEQ ID NO: 73479 - DNA, 103 bp, Artificial Sequence
  Synthetic Polynucleotide
taatacgactcactatagggggtactataataataaggttatagcgttagaacagaggagactaacgatgtaaccttataacctggcggcagcgcaaaagatg

SEQ ID NO: 73480 - DNA, 103 bp, Artificial Sequence
  Synthetic Polynucleotide
taatacgactcactatagggtttttggtactataataataaggttatagcaacagaggagagctataatgttattattaaacctggcggcagcgcaaaagatg

SEQ ID NO: 73481 - DNA, 103 bp, Artificial Sequence
  Synthetic Polynucleotide
taatacgactcactatagggaaactagacgatgatacagatatatggactaacagaggagaagtccaatgatctgtatcaacctggcggcagcgcaaaagatg

SEQ ID NO: 73482 - DNA, 103 bp, Artificial Sequence
  Synthetic Polynucleotide
taatacgactcactatagggcacactttttggtactataataataaggttaacagaggagaaaccttatgattatagtaaacctggcggcagcgcaaaagatg

SEQ ID NO: 73483 - DNA, 103 bp, Artificial Sequence
  Synthetic Polynucleotide
taatacgactcactatagggttaatcacactttttggtactataataataaacagaggagatattatatgagtaccaaaaacctggcggcagcgcaaaagatg

SEQ ID NO: 73484 - DNA, 103 bp, Artificial Sequence
  Synthetic Polynucleotide
taatacgactcactatagggacacattaatcacactttttggtactataaaacagaggagattatagatgcaaaaagtgaacctggcggcagcgcaaaagatg

SEQ ID NO: 73485 - DNA, 103 bp, Artificial Sequence
  Synthetic Polynucleotide
taatacgactcactataggggtgtcacacattaatcacactttttggtacaacagaggagagtaccaatgagtgtgattaacctggcggcagcgcaaaagatg

SEQ ID NO: 73486 - DNA, 103 bp, Artificial Sequence
  Synthetic Polynucleotide
taatacgactcactatagggctaatgtgtcacacattaatcacactttttaacagaggagaaaaaagatggattaatgtaacctggcggcagcgcaaaagatg

SEQ ID NO: 73487 - DNA, 103 bp, Artificial Sequence
  Synthetic Polynucleotide
taatacgactcactatagggatgcgctaatgtgtcacacattaatcacacaacagaggagagtgtgaatgatgtgtgacaacctggcggcagcgcaaaagatg

SEQ ID NO: 73488 - DNA, 103 bp, Artificial Sequence
  Synthetic Polynucleotide
taatacgactcactatagggtgtacatgcgctaatgtgtcacacattaataacagaggagaattaatatgtgacacattaacctggcggcagcgcaaaagatg

SEQ ID NO: 73489 - DNA, 103 bp, Artificial Sequence
  Synthetic Polynucleotide
taatacgactcactatagggaaatatgtacatgcgctaatgtgtcacacaaacagaggagatgtgtgatgcattagcgcaacctggcggcagcgcaaaagatg

SEQ ID NO: 73490 - DNA, 103 bp, Artificial Sequence
  Synthetic Polynucleotide
taatacgactcactatagggtgtacaaatatgtacatgcgctaatgtgtcaacagaggagagacacaatggcgcatgtaaacctggcggcagcgcaaaagatg

SEQ ID NO: 73491 - DNA, 103 bp, Artificial Sequence
  Synthetic Polynucleotide
taatacgactcactatagggaataatgtacaaatatgtacatgcgctaataacagaggagaattagcatgtgtacatataacctggcggcagcgcaaaagatg

SEQ ID NO: 73492 - DNA, 103 bp, Artificial Sequence
  Synthetic Polynucleotide
taatacgactcactatagggctgataaactagacgatgatacagatatataacagaggagaatatatatgtatcatcgtaacctggcggcagcgcaaaagatg

SEQ ID NO: 73493 - DNA, 103 bp, Artificial Sequence
  Synthetic Polynucleotide
taatacgactcactatagggtagacaataatgtacaaatatgtacatgcgaacagaggagacgcatgatgatatttgtaaacctggcggcagcgcaaaagatg

SEQ ID NO: 73494 - DNA, 103 bp, Artificial Sequence
  Synthetic Polynucleotide
taatacgactcactatagggcgacgtagacaataatgtacaaatatgtacaacagaggagagtacatatgtgtacattaaacctggcggcagcgcaaaagatg

SEQ ID NO: 73495 - DNA, 103 bp, Artificial Sequence
  Synthetic Polynucleotide
taatacgactcactataggggaatacgacgtagacaataatgtacaaataaacagaggagatatttgatgattattgtcaacctggcggcagcgcaaaagatg

SEQ ID NO: 73496 - DNA, 103 bp, Artificial Sequence
  Synthetic Polynucleotide
taatacgactcactataggggtgtcgaatacgacgtagacaataatgtacaacagaggagagtacatatgtgtctacgtaacctggcggcagcgcaaaagatg

SEQ ID NO: 73497 - DNA, 103 bp, Artificial Sequence
  Synthetic Polynucleotide
taatacgactcactatagggtggatgtgtcgaatacgacgtagacaataaaacagaggagattattgatgacgtcgtataacctggcggcagcgcaaaagatg

SEQ ID NO: 73498 - DNA, 103 bp, Artificial Sequence
  Synthetic Polynucleotide
taatacgactcactataggggtatgtggatgtgtcgaatacgacgtagacaacagaggagagtctacatggtattcgacaacctggcggcagcgcaaaagatg

SEQ ID NO: 73499 - DNA, 103 bp, Artificial Sequence
  Synthetic Polynucleotide
taatacgactcactatagggtggctgtatgtggatgtgtcgaatacgacgaacagaggagacgtcgtatgcgacacatcaacctggcggcagcgcaaaagatg

SEQ ID NO: 73500 - DNA, 103 bp, Artificial Sequence
  Synthetic Polynucleotide
taatacgactcactatagggtttgttggctgtatgtggatgtgtcgaataaacagaggagatattcgatgcatccacataacctggcggcagcgcaaaagatg

SEQ ID NO: 73501 - DNA, 103 bp, Artificial Sequence
  Synthetic Polynucleotide
taatacgactcactatagggttatatttgttggctgtatgtggatgtgtcaacagaggagagacacaatgacatacagcaacctggcggcagcgcaaaagatg

SEQ ID NO: 73502 - DNA, 103 bp, Artificial Sequence
  Synthetic Polynucleotide
taatacgactcactatagggtcattttatatttgttggctgtatgtggataacagaggagaatccacatgcagccaacaaacctggcggcagcgcaaaagatg

SEQ ID NO: 73503 - DNA, 103 bp, Artificial Sequence
  Synthetic Polynucleotide
taatacgactcactatagggggacactgataaactagacgatgatacagaaacagaggagatctgtaatgtcgtctagtaacctggcggcagcgcaaaagatg

SEQ ID NO: 73504 - DNA, 103 bp, Artificial Sequence
  Synthetic Polynucleotide
taatacgactcactatagggatttatcattttatatttgttggctgtatgaacagaggagacatacaatgaacaaatataacctggcggcagcgcaaaagatg

SEQ ID NO: 73505 - DNA, 103 bp, Artificial Sequence
  Synthetic Polynucleotide
taatacgactcactatagggagagcatttatcattttatatttgttggctaacagaggagaagccaaatgatataaaataacctggcggcagcgcaaaagatg

SEQ ID NO: 73506 - DNA, 103 bp, Artificial Sequence
  Synthetic Polynucleotide
taatacgactcactatagggccattagagcatttatcattttatatttgtaacagaggagaacaaatatgaaatgataaaacctggcggcagcgcaaaagatg

SEQ ID NO: 73507 - DNA, 103 bp, Artificial Sequence
  Synthetic Polynucleotide
taatacgactcactataggggaacaccattagagcatttatcattttataaacagaggagatataaaatgataaatgctaacctggcggcagcgcaaaagatg

SEQ ID NO: 73508 - DNA, 103 bp, Artificial Sequence
  Synthetic Polynucleotide
taatacgactcactatagggggtacgaacaccattagagcatttatcattaacagaggagaaatgatatgtgctctaataacctggcggcagcgcaaaagatg

SEQ ID NO: 73509 - DNA, 103 bp, Artificial Sequence
  Synthetic Polynucleotide
taatacgactcactatagggagatgggtacgaacaccattagagcatttaaacagaggagataaatgatgtaatggtgtaacctggcggcagcgcaaaagatg

SEQ ID NO: 73510 - DNA, 103 bp, Artificial Sequence
  Synthetic Polynucleotide
taatacgactcactatagggcattaagatgggtacgaacaccattagagcaacagaggagagctctaatggtgttcgtaaacctggcggcagcgcaaaagatg

SEQ ID NO: 73511 - DNA, 103 bp, Artificial Sequence
  Synthetic Polynucleotide
taatacgactcactatagggagccgcattaagatgggtacgaacaccattaacagaggagaaatggtatgcgtacccataacctggcggcagcgcaaaagatg

SEQ ID NO: 73512 - DNA, 103 bp, Artificial Sequence
  Synthetic Polynucleotide
taatacgactcactatagggtattaagccgcattaagatgggtacgaacaaacagaggagatgttcgatgccatcttaaaacctggcggcagcgcaaaagatg

SEQ ID NO: 73513 - DNA, 103 bp, Artificial Sequence
  Synthetic Polynucleotide
taatacgactcactatagggacatttattaagccgcattaagatgggtacaacagaggagagtacccatgttaatgcggaacctggcggcagcgcaaaagatg

SEQ ID NO: 73514 - DNA, 103 bp, Artificial Sequence
  Synthetic Polynucleotide
taatacgactcactataggggcatgggacactgataaactagacgatgataacagaggagaatcatcatgtagtttatcaacctggcggcagcgcaaaagatg

SEQ ID NO: 73515 - DNA, 103 bp, Artificial Sequence
  Synthetic Polynucleotide
taatacgactcactatagggtcgaaacatttattaagccgcattaagatgaacagaggagacatcttatggcggcttaaaacctggcggcagcgcaaaagatg

SEQ ID NO: 73516 - DNA, 103 bp, Artificial Sequence
  Synthetic Polynucleotide
taatacgactcactatagggtgaaatcgaaacatttattaagccgcattaaacagaggagataatgcatgttaataaataacctggcggcagcgcaaaagatg

SEQ ID NO: 73517 - DNA, 103 bp, Artificial Sequence
  Synthetic Polynucleotide
taatacgactcactatagggtaaattgaaatcgaaacatttattaagccgaacagaggagacggcttatgaaatgtttcaacctggcggcagcgcaaaagatg

SEQ ID NO: 73518 - DNA, 103 bp, Artificial Sequence
  Synthetic Polynucleotide
taatacgactcactatagggtacaataaattgaaatcgaaacatttattaaacagaggagataataaatgtttcgatttaacctggcggcagcgcaaaagatg

SEQ ID NO: 73519 - DNA, 103 bp, Artificial Sequence
  Synthetic Polynucleotide
taatacgactcactatagggttttttacaataaattgaaatcgaaacattaacagaggagaaatgttatgatttcaattaacctggcggcagcgcaaaagatg

SEQ ID NO: 73520 - DNA, 103 bp, Artificial Sequence
  Synthetic Polynucleotide
taatacgactcactataggggattcttttttacaataaattgaaatcgaaaacagaggagattcgatatgaatttattgaacctggcggcagcgcaaaagatg

SEQ ID NO: 73521 - DNA, 103 bp, Artificial Sequence
  Synthetic Polynucleotide
taatacgactcactatagggaaaccgattcttttttacaataaattgaaaaacagaggagatttcaaatgattgtaaaaaacctggcggcagcgcaaaagatg

SEQ ID NO: 73522 - DNA, 103 bp, Artificial Sequence
  Synthetic Polynucleotide
taatacgactcactataggggtataaaaccgattcttttttacaataaataacagaggagaatttatatgaaaaaagaaaacctggcggcagcgcaaaagatg

SEQ ID NO: 73523 - DNA, 103 bp, Artificial Sequence
  Synthetic Polynucleotide
taatacgactcactataggggaacagtataaaaccgattcttttttacaaaacagaggagattgtaaatgagaatcggtaacctggcggcagcgcaaaagatg

SEQ ID NO: 73524 - DNA, 103 bp, Artificial Sequence
  Synthetic Polynucleotide
taatacgactcactatagggatctcgaacagtataaaaccgattctttttaacagaggagaaaaaagatgcggttttataacctggcggcagcgcaaaagatg

SEQ ID NO: 73525 - DNA, 103 bp, Artificial Sequence
  Synthetic Polynucleotide
taatacgactcactatagggatatagcatgggacactgataaactagacgaacagaggagacgtctaatgtatcagtgtaacctggcggcagcgcaaaagatg

SEQ ID NO: 73526 - DNA, 103 bp, Artificial Sequence
  Synthetic Polynucleotide
taatacgactcactatagggtgagaatctcgaacagtataaaaccgattcaacagaggagagaatcgatgttatactgtaacctggcggcagcgcaaaagatg

SEQ ID NO: 73527 - DNA, 103 bp, Artificial Sequence
  Synthetic Polynucleotide
taatacgactcactatagggatcaatgagaatctcgaacagtataaaaccaacagaggagaggttttatgctgttcgagaacctggcggcagcgcaaaagatg

SEQ ID NO: 73528 - DNA, 103 bp, Artificial Sequence
  Synthetic Polynucleotide
taatacgactcactatagggatataatcaatgagaatctcgaacagtataaacagaggagatatactatgcgagattctaacctggcggcagcgcaaaagatg

SEQ ID NO: 73529 - DNA, 103 bp, Artificial Sequence
  Synthetic Polynucleotide
taatacgactcactatagggtgagaatataatcaatgagaatctcgaacaaacagaggagatgttcgatgttctcattgaacctggcggcagcgcaaaagatg

SEQ ID NO: 73530 - DNA, 103 bp, Artificial Sequence
  Synthetic Polynucleotide
taatacgactcactatagggatagatgagaatataatcaatgagaatctcaacagaggagagagattatgattgattataacctggcggcagcgcaaaagatg

SEQ ID NO: 73531 - DNA, 103 bp, Artificial Sequence
  Synthetic Polynucleotide
taatacgactcactatagggagatgatagatgagaatataatcaatgagaaacagaggagatctcatatgttatattctaacctggcggcagcgcaaaagatg

SEQ ID NO: 73532 - DNA, 103 bp, Artificial Sequence
  Synthetic Polynucleotide
taatacgactcactatagggtgtggagatgatagatgagaatataatcaaaacagaggagattgattatgttctcatctaacctggcggcagcgcaaaagatg

SEQ ID NO: 73533 - DNA, 103 bp, Artificial Sequence
  Synthetic Polynucleotide
taatacgactcactataggggactgtgtggagatgatagatgagaatataaacagaggagatatattatgatctatcataacctggcggcagcgcaaaagatg

SEQ ID NO: 73534 - DNA, 103 bp, Artificial Sequence
  Synthetic Polynucleotide
taatacgactcactataggggatttgactgtgtggagatgatagatgagaaacagaggagatctcatatgtcatctccaaacctggcggcagcgcaaaagatg

SEQ ID NO: 73535 - DNA, 103 bp, Artificial Sequence
  Synthetic Polynucleotide
taatacgactcactatagggccacggatttgactgtgtggagatgatagaaacagaggagatctatcatgtccacacagaacctggcggcagcgcaaaagatg

SEQ ID NO: 73536 - DNA, 103 bp, Artificial Sequence
  Synthetic Polynucleotide
taatacgactcactatagggcaggaatatagcatgggacactgataaactaacagaggagaagtttaatggtgtcccataacctggcggcagcgcaaaagatg

SEQ ID NO: 73537 - DNA, 103 bp, Artificial Sequence
  Synthetic Polynucleotide
taatacgactcactataggggctaaccacggatttgactgtgtggagatgaacagaggagacatctcatgacagtcaaaaacctggcggcagcgcaaaagatg

SEQ ID NO: 73538 - DNA, 103 bp, Artificial Sequence
  Synthetic Polynucleotide
taatacgactcactatagggtatatgctaaccacggatttgactgtgtggaacagaggagaccacacatgcaaatccgtaacctggcggcagcgcaaaagatg

SEQ ID NO: 73539 - DNA, 103 bp, Artificial Sequence
  Synthetic Polynucleotide
taatacgactcactatagggtgaggtatatgctaaccacggatttgactgaacagaggagacagtcaatgccgtggttaaacctggcggcagcgcaaaagatg

SEQ ID NO: 73540 - DNA, 103 bp, Artificial Sequence
  Synthetic Polynucleotide
taatacgactcactataggggttaatgaggtatatgctaaccacggatttaacagaggagaaaatccatggttagcataaacctggcggcagcgcaaaagatg

SEQ ID NO: 73541 - DNA, 103 bp, Artificial Sequence
  Synthetic Polynucleotide
taatacgactcactatagggtatcggttaatgaggtatatgctaaccacgaacagaggagacgtggtatgcatatacctaacctggcggcagcgcaaaagatg

SEQ ID NO: 73542 - DNA, 103 bp, Artificial Sequence
  Synthetic Polynucleotide
taatacgactcactatagggtctattatcggttaatgaggtatatgctaaaacagaggagattagcaatgacctcattaaacctggcggcagcgcaaaagatg

SEQ ID NO: 73543 - DNA, 103 bp, Artificial Sequence
  Synthetic Polynucleotide
taatacgactcactataggggatagtctattatcggttaatgaggtatataacagaggagaatatacatgattaaccgaaacctggcggcagcgcaaaagatg

SEQ ID NO: 73544 - DNA, 103 bp, Artificial Sequence
  Synthetic Polynucleotide
taatacgactcactatagggagtctgatagtctattatcggttaatgaggaacagaggagacctcatatgccgataataaacctggcggcagcgcaaaagatg

SEQ ID NO: 73545 - DNA, 103 bp, Artificial Sequence
  Synthetic Polynucleotide
taatacgactcactatagggagaagagtctgatagtctattatcggttaaaacagaggagattaaccatgaatagactaaacctggcggcagcgcaaaagatg

SEQ ID NO: 73546 - DNA, 103 bp, Artificial Sequence
  Synthetic Polynucleotide
taatacgactcactatagggacgatagaagagtctgatagtctattatcgaacagaggagacgataaatgactatcagaaacctggcggcagcgcaaaagatg

SEQ ID NO: 73547 - DNA, 103 bp, Artificial Sequence
  Synthetic Polynucleotide
taatacgactcactataggggataacaggaatatagcatgggacactgataacagaggagaatcagtatgccatgctataacctggcggcagcgcaaaagatg

SEQ ID NO: 73548 - DNA, 103 bp, Artificial Sequence
  Synthetic Polynucleotide
taatacgactcactatagggttataacgatagaagagtctgatagtctataacagaggagaatagacatgcagactcttaacctggcggcagcgcaaaagatg

SEQ ID NO: 73549 - DNA, 103 bp, Artificial Sequence
  Synthetic Polynucleotide
taatacgactcactatagggtcgagttataacgatagaagagtctgatagaacagaggagactatcaatgtcttctatcaacctggcggcagcgcaaaagatg

SEQ ID NO: 73550 - DNA, 103 bp, Artificial Sequence
  Synthetic Polynucleotide
taatacgactcactatagggtattctcgagttataacgatagaagagtctaacagaggagaagactcatgtatcgttataacctggcggcagcgcaaaagatg

SEQ ID NO: 73551 - DNA, 103 bp, Artificial Sequence
  Synthetic Polynucleotide
taatacgactcactatagggttaaatattctcgagttataacgatagaagaacagaggagacttctaatgttataactcaacctggcggcagcgcaaaagatg

SEQ ID NO: 73552 - DNA, 103 bp, Artificial Sequence
  Synthetic Polynucleotide
taatacgactcactatagggccaaattaaatattctcgagttataacgataacagaggagaatcgttatgactcgagaaaacctggcggcagcgcaaaagatg

SEQ ID NO: 73553 - DNA, 103 bp, Artificial Sequence
  Synthetic Polynucleotide
taatacgactcactatagggaatgaccaaattaaatattctcgagttataaacagaggagatataacatgagaatatttaacctggcggcagcgcaaaagatg

SEQ ID NO: 73554 - DNA, 103 bp, Artificial Sequence
  Synthetic Polynucleotide
taatacgactcactatagggttaagaatgaccaaattaaatattctcgagaacagaggagactcgagatgatttaatttaacctggcggcagcgcaaaagatg

SEQ ID NO: 73555 - DNA, 103 bp, Artificial Sequence
  Synthetic Polynucleotide
taatacgactcactatagggcttgattaagaatgaccaaattaaatattcaacagaggagagaatatatgatttggtcaaacctggcggcagcgcaaaagatg

SEQ ID NO: 73556 - DNA, 103 bp, Artificial Sequence
  Synthetic Polynucleotide
taatacgactcactatagggattgacttgattaagaatgaccaaattaaaaacagaggagatttaatatggtcattcttaacctggcggcagcgcaaaagatg

SEQ ID NO: 73557 - DNA, 103 bp, Artificial Sequence
  Synthetic Polynucleotide
taatacgactcactatagggagataattgacttgattaagaatgaccaaaaacagaggagatttggtatgtcttaatcaaacctggcggcagcgcaaaagatg

SEQ ID NO: 73558 - DNA, 103 bp, Artificial Sequence
  Synthetic Polynucleotide
taatacgactcactatagggatgatgataacaggaatatagcatgggacaaacagaggagatgtcccatgctatattccaacctggcggcagcgcaaaagatg

SEQ ID NO: 73559 - DNA, 103 bp, Artificial Sequence
  Synthetic Polynucleotide
taatacgactcactatagggaaataagataattgacttgattaagaatgaaacagaggagatcattcatgatcaagtcaaacctggcggcagcgcaaaagatg

SEQ ID NO: 73560 - DNA, 103 bp, Artificial Sequence
  Synthetic Polynucleotide
taatacgactcactataggggttaaaaataagataattgacttgattaagaacagaggagacttaatatggtcaattataacctggcggcagcgcaaaagatg

SEQ ID NO: 73561 - DNA, 103 bp, Artificial Sequence
  Synthetic Polynucleotide
taatacgactcactatagggcatttgttaaaaataagataattgacttgaaacagaggagatcaagtatgttatcttataacctggcggcagcgcaaaagatg

SEQ ID NO: 73562 - DNA, 103 bp, Artificial Sequence
  Synthetic Polynucleotide
taatacgactcactatagggactcacatttgttaaaaataagataattgaaacagaggagatcaattatgttatttttaaacctggcggcagcgcaaaagatg

SEQ ID NO: 73563 - DNA, 103 bp, Artificial Sequence
  Synthetic Polynucleotide
taatacgactcactatagggaaaatactcacatttgttaaaaataagataaacagaggagatatcttatgtttaacaaaaacctggcggcagcgcaaaagatg

SEQ ID NO: 73564 - DNA, 103 bp, Artificial Sequence
  Synthetic Polynucleotide
taatacgactcactatagggtgagtaaaatactcacatttgttaaaaataaacagaggagatattttatgcaaatgtgaaacctggcggcagcgcaaaagatg

SEQ ID NO: 73565 - DNA, 103 bp, Artificial Sequence
  Synthetic Polynucleotide
taatacgactcactatagggaaaaatgagtaaaatactcacatttgttaaaacagaggagattaacaatggtgagtattaacctggcggcagcgcaaaagatg

SEQ ID NO: 73566 - DNA, 103 bp, Artificial Sequence
  Synthetic Polynucleotide
taatacgactcactatagggttataaaaaatgagtaaaatactcacatttaacagaggagaaaatgtatgtattttactaacctggcggcagcgcaaaagatg

SEQ ID NO: 73567 - DNA, 103 bp, Artificial Sequence
  Synthetic Polynucleotide
taatacgactcactataggggttttttataaaaaatgagtaaaatactcaaacagaggagatgagtaatgtactcatttaacctggcggcagcgcaaaagatg

SEQ ID NO: 73568 - DNA, 103 bp, Artificial Sequence
  Synthetic Polynucleotide
taatacgactcactatagggtaaaagttttttataaaaaatgagtaaaataacagaggagaattttaatgattttttataacctggcggcagcgcaaaagatg

SEQ ID NO: 73569 - DNA, 103 bp, Artificial Sequence
  Synthetic Polynucleotide
taatacgactcactatagggatgattgccttcatcattttttgtgaaataaacagaggagatatttcatgaaaaatgataacctggcggcagcgcaaaagatg

SEQ ID NO: 73570 - DNA, 103 bp, Artificial Sequence
  Synthetic Polynucleotide
taatacgactcactatagggaactaatgatgataacaggaatatagcatgaacagaggagacatgctatgttcctgttaaacctggcggcagcgcaaaagatg

SEQ ID NO: 73571 - DNA, 103 bp, Artificial Sequence
  Synthetic Polynucleotide
taatacgactcactatagggatttctaaaagttttttataaaaaatgagtaacagaggagaactcatatgttataaaaaaacctggcggcagcgcaaaagatg

SEQ ID NO: 73572 - DNA, 103 bp, Artificial Sequence
  Synthetic Polynucleotide
taatacgactcactatagggtgtatatttctaaaagttttttataaaaaaaacagaggagattttttatgaaaaactttaacctggcggcagcgcaaaagatg

SEQ ID NO: 73573 - DNA, 103 bp, Artificial Sequence
  Synthetic Polynucleotide
taatacgactcactataggggagtctgtatatttctaaaagttttttataaacagaggagatataaaatgcttttagaaaacctggcggcagcgcaaaagatg

SEQ ID NO: 73574 - DNA, 103 bp, Artificial Sequence
  Synthetic Polynucleotide
taatacgactcactatagggcgatagagtctgtatatttctaaaagttttaacagaggagaaaaactatgagaaatataaacctggcggcagcgcaaaagatg

SEQ ID NO: 73575 - DNA, 103 bp, Artificial Sequence
  Synthetic Polynucleotide
taatacgactcactatagggacacgcgatagagtctgtatatttctaaaaaacagaggagattttagatgtatacagacaacctggcggcagcgcaaaagatg

SEQ ID NO: 73576 - DNA, 103 bp, Artificial Sequence
  Synthetic Polynucleotide
taatacgactcactatagggtatagacacgcgatagagtctgtatatttcaacagaggagagaaataatgagactctataacctggcggcagcgcaaaagatg

SEQ ID NO: 73577 - DNA, 103 bp, Artificial Sequence
  Synthetic Polynucleotide
taatacgactcactataggggaagatatagacacgcgatagagtctgtataacagaggagaatacagatgctatcgcgtaacctggcggcagcgcaaaagatg

SEQ ID NO: 73578 - DNA, 103 bp, Artificial Sequence
  Synthetic Polynucleotide
taatacgactcactatagggaaaaagaagatatagacacgcgatagagtcaacagaggagagactctatggcgtgtctaaacctggcggcagcgcaaaagatg

SEQ ID NO: 73579 - DNA, 103 bp, Artificial Sequence
  Synthetic Polynucleotide
taatacgactcactataggggatataaaaagaagatatagacacgcgataaacagaggagatatcgcatgtctatatctaacctggcggcagcgcaaaagatg

SEQ ID NO: 73580 - DNA, 103 bp, Artificial Sequence
  Synthetic Polynucleotide
taatacgactcactatagggcattggatataaaaagaagatatagacacgaacagaggagacgtgtcatgatcttctttaacctggcggcagcgcaaaagatg

SEQ ID NO: 73581 - DNA, 103 bp, Artificial Sequence
  Synthetic Polynucleotide
taatacgactcactatagggtcattaactaatgatgataacaggaatataaacagaggagatatattatggttatcatcaacctggcggcagcgcaaaagatg

SEQ ID NO: 73582 - DNA, 103 bp, Artificial Sequence
  Synthetic Polynucleotide
taatacgactcactatagggaaatacattggatataaaaagaagatatagaacagaggagactatatatgctttttataaacctggcggcagcgcaaaagatg

SEQ ID NO: 73583 - DNA, 103 bp, Artificial Sequence
  Synthetic Polynucleotide
taatacgactcactataggggatataaatacattggatataaaaagaagaaacagaggagatcttctatgtatatccaaaacctggcggcagcgcaaaagatg

SEQ ID NO: 73584 - DNA, 103 bp, Artificial Sequence
  Synthetic Polynucleotide
taatacgactcactatagggaatcagatataaatacattggatataaaaaaacagaggagatttttaatgccaatgtataacctggcggcagcgcaaaagatg

SEQ ID NO: 73585 - DNA, 103 bp, Artificial Sequence
  Synthetic Polynucleotide
taatacgactcactatagggagaaaaatcagatataaatacattggatataacagaggagaatatccatggtatttataaacctggcggcagcgcaaaagatg

SEQ ID NO: 73586 - DNA, 103 bp, Artificial Sequence
  Synthetic Polynucleotide
taatacgactcactatagggaatgaagaaaaatcagatataaatacattgaacagaggagacaatgtatgtatatctgaaacctggcggcagcgcaaaagatg

SEQ ID NO: 73587 - DNA, 103 bp, Artificial Sequence
  Synthetic Polynucleotide
taatacgactcactatagggtaataaatgaagaaaaatcagatataaataaacagaggagatatttaatgctgatttttaacctggcggcagcgcaaaagatg

SEQ ID NO: 73588 - DNA, 103 bp, Artificial Sequence
  Synthetic Polynucleotide
taatacgactcactatagggatatataataaatgaagaaaaatcagatataacagaggagaatatctatgttttcttcaaacctggcggcagcgcaaaagatg

SEQ ID NO: 73589 - DNA, 103 bp, Artificial Sequence
  Synthetic Polynucleotide
taatacgactcactatagggccattatatataataaatgaagaaaaatcaaacagaggagatgatttatgttcatttataacctggcggcagcgcaaaagatg

SEQ ID NO: 73590 - DNA, 103 bp, Artificial Sequence
  Synthetic Polynucleotide
taatacgactcactatagggttggaccattatatataataaatgaagaaaaacagaggagatttcttatgttattatataacctggcggcagcgcaaaagatg

SEQ ID NO: 73591 - DNA, 103 bp, Artificial Sequence
  Synthetic Polynucleotide
taatacgactcactatagggagaatttggaccattatatataataaatgaaacagaggagatcatttatgatatataataacctggcggcagcgcaaaagatg

SEQ ID NO: 73592 - DNA, 103 bp, Artificial Sequence
  Synthetic Polynucleotide
taatacgactcactatagggtattttcattaactaatgatgataacaggaaacagaggagatcctgtatgcatcattagaacctggcggcagcgcaaaagatg

SEQ ID NO: 73593 - DNA, 103 bp, Artificial Sequence
  Synthetic Polynucleotide
taatacgactcactatagggcgtatagaatttggaccattatatataataaacagaggagatattatatgtaatggtccaacctggcggcagcgcaaaagatg

SEQ ID NO: 73594 - DNA, 103 bp, Artificial Sequence
  Synthetic Polynucleotide
taatacgactcactatagggcaacacgtatagaatttggaccattatataaacagaggagatatataatggtccaaattaacctggcggcagcgcaaaagatg

SEQ ID NO: 73595 - DNA, 103 bp, Artificial Sequence
  Synthetic Polynucleotide
taatacgactcactatagggtgaagcaacacgtatagaatttggaccattaacagaggagaaatggtatgaattctataaacctggcggcagcgcaaaagatg

SEQ ID NO: 73596 - DNA, 103 bp, Artificial Sequence
  Synthetic Polynucleotide
taatacgactcactatagggctggatgaagcaacacgtatagaatttggaaacagaggagatccaaaatgtatacgtgtaacctggcggcagcgcaaaagatg

SEQ ID NO: 73597 - DNA, 103 bp, Artificial Sequence
  Synthetic Polynucleotide
taatacgactcactatagggatgatctggatgaagcaacacgtatagaataacagaggagaattctaatggtgttgcttaacctggcggcagcgcaaaagatg

SEQ ID NO: 73598 - DNA, 103 bp, Artificial Sequence
  Synthetic Polynucleotide
taatacgactcactatagggccttaatgatctggatgaagcaacacgtataacagaggagaatacgtatggcttcatccaacctggcggcagcgcaaaagatg

SEQ ID NO: 73599 - DNA, 103 bp, Artificial Sequence
  Synthetic Polynucleotide
taatacgactcactatagggaagaaccttaatgatctggatgaagcaacaaacagaggagatgttgcatgatccagatcaacctggcggcagcgcaaaagatg

SEQ ID NO: 73600 - DNA, 103 bp, Artificial Sequence
  Synthetic Polynucleotide
taatacgactcactatagggattataagaaccttaatgatctggatgaagaacagaggagacttcatatggatcattaaaacctggcggcagcgcaaaagatg

SEQ ID NO: 73601 - DNA, 103 bp, Artificial Sequence
  Synthetic Polynucleotide
taatacgactcactatagggttgcgattataagaaccttaatgatctggaaacagaggagatccagaatgttaaggttcaacctggcggcagcgcaaaagatg

SEQ ID NO: 73602 - DNA, 103 bp, Artificial Sequence
  Synthetic Polynucleotide
taatacgactcactatagggggatattgcgattataagaaccttaatgataacagaggagaatcattatggttcttataaacctggcggcagcgcaaaagatg

SEQ ID NO: 73603 - DNA, 103 bp, Artificial Sequence
  Synthetic Polynucleotide
taatacgactcactatagggagagttattttcattaactaatgatgataaaacagaggagattatcaatgttagttaataacctggcggcagcgcaaaagatg

SEQ ID NO: 73604 - DNA, 103 bp, Artificial Sequence
  Synthetic Polynucleotide
taatacgactcactataggggagaaggatattgcgattataagaaccttaaacagaggagataaggtatgtataatcgcaacctggcggcagcgcaaaagatg

SEQ ID NO: 73605 - DNA, 103 bp, Artificial Sequence
  Synthetic Polynucleotide
taatacgactcactatagggggaaggagaaggatattgcgattataagaaaacagaggagattcttaatgtcgcaatataacctggcggcagcgcaaaagatg

SEQ ID NO: 73606 - DNA, 103 bp, Artificial Sequence
  Synthetic Polynucleotide
taatacgactcactataggggaagaggaaggagaaggatattgcgattataacagaggagaataatcatgatatccttcaacctggcggcagcgcaaaagatg

SEQ ID NO: 73607 - DNA, 103 bp, Artificial Sequence
  Synthetic Polynucleotide
taatacgactcactatagggatatagaagaggaaggagaaggatattgcgaacagaggagacgcaatatgcttctccttaacctggcggcagcgcaaaagatg

SEQ ID NO: 73608 - DNA, 103 bp, Artificial Sequence
  Synthetic Polynucleotide
taatacgactcactatagggggacgatatagaagaggaaggagaaggataaacagaggagatatcctatgccttcctctaacctggcggcagcgcaaaagatg

SEQ ID NO: 73609 - DNA, 103 bp, Artificial Sequence
  Synthetic Polynucleotide
taatacgactcactatagggaagaaggacgatatagaagaggaaggagaaaacagaggagattctccatgctcttctataacctggcggcagcgcaaaagatg

SEQ ID NO: 73610 - DNA, 103 bp, Artificial Sequence
  Synthetic Polynucleotide
taatacgactcactatagggagtttaagaaggacgatatagaagaggaagaacagaggagacttcctatgctatatcgtaacctggcggcagcgcaaaagatg

SEQ ID NO: 73611 - DNA, 103 bp, Artificial Sequence
  Synthetic Polynucleotide
taatacgactcactataggggaataagtttaagaaggacgatatagaagaaacagaggagatcttctatgtcgtccttcaacctggcggcagcgcaaaagatg

SEQ ID NO: 73612 - DNA, 103 bp, Artificial Sequence
  Synthetic Polynucleotide
taatacgactcactataggggctaagaataagtttaagaaggacgatataaacagaggagatatatcatgcttcttaaaaacctggcggcagcgcaaaagatg

SEQ ID NO: 73613 - DNA, 103 bp, Artificial Sequence
  Synthetic Polynucleotide
taatacgactcactataggggtgacgctaagaataagtttaagaaggacgaacagaggagacgtcctatgtaaacttataacctggcggcagcgcaaaagatg

SEQ ID NO: 73614 - DNA, 103 bp, Artificial Sequence
  Synthetic Polynucleotide
taatacgactcactataggggcacgagagttattttcattaactaatgataacagaggagaatcattatgtaatgaaaaaacctggcggcagcgcaaaagatg

SEQ ID NO: 73615 - DNA, 103 bp, Artificial Sequence
  Synthetic Polynucleotide
taatacgactcactatagggattctgtgacgctaagaataagtttaagaaaacagaggagattcttaatgttattcttaaacctggcggcagcgcaaaagatg

SEQ ID NO: 73616 - DNA, 103 bp, Artificial Sequence
  Synthetic Polynucleotide
taatacgactcactatagggggtcgattctgtgacgctaagaataagtttaacagaggagaaaacttatgcttagcgtcaacctggcggcagcgcaaaagatg

SEQ ID NO: 73617 - DNA, 103 bp, Artificial Sequence
  Synthetic Polynucleotide
taatacgactcactataggggctgtggtcgattctgtgacgctaagaataaacagaggagatattctatgcgtcacagaaacctggcggcagcgcaaaagatg

SEQ ID NO: 73618 - DNA, 103 bp, Artificial Sequence
  Synthetic Polynucleotide
taatacgactcactatagggatcctgctgtggtcgattctgtgacgctaaaacagaggagattagcgatgcagaatcgaaacctggcggcagcgcaaaagatg

SEQ ID NO: 73619 - DNA, 103 bp, Artificial Sequence
  Synthetic Polynucleotide
taatacgactcactatagggatgggatcctgctgtggtcgattctgtgacaacagaggagagtcacaatgtcgaccacaaacctggcggcagcgcaaaagatg

SEQ ID NO: 73620 - DNA, 103 bp, Artificial Sequence
  Synthetic Polynucleotide
taatacgactcactatagggttgtcatgggatcctgctgtggtcgattctaacagaggagaagaatcatgcacagcaggaacctggcggcagcgcaaaagatg

SEQ ID NO: 73621 - DNA, 103 bp, Artificial Sequence
  Synthetic Polynucleotide
taatacgactcactataggggacgcttgtcatgggatcctgctgtggtcgaacagaggagacgaccaatgcaggatcccaacctggcggcagcgcaaaagatg

SEQ ID NO: 73622 - DNA, 103 bp, Artificial Sequence
  Synthetic Polynucleotide
taatacgactcactatagggaatatgacgcttgtcatgggatcctgctgtaacagaggagaacagcaatgtcccatgacaacctggcggcagcgcaaaagatg

SEQ ID NO: 73623 - DNA, 103 bp, Artificial Sequence
  Synthetic Polynucleotide
taatacgactcactatagggagtttaatatgacgcttgtcatgggatcctaacagaggagaaggatcatgtgacaagcgaacctggcggcagcgcaaaagatg

SEQ ID NO: 73624 - DNA, 103 bp, Artificial Sequence
  Synthetic Polynucleotide
taatacgactcactataggggaattagtttaatatgacgcttgtcatgggaacagaggagacccatgatgagcgtcataaacctggcggcagcgcaaaagatg

SEQ ID NO: 73625 - DNA, 103 bp, Artificial Sequence
  Synthetic Polynucleotide
taatacgactcactatagggctgaagcacgagagttattttcattaactaaacagaggagatagttaatgaaaataactaacctggcggcagcgcaaaagatg

SEQ ID NO: 73626 - DNA, 103 bp, Artificial Sequence
  Synthetic Polynucleotide
taatacgactcactatagggaaaatgaattagtttaatatgacgcttgtcaacagaggagagacaagatgcatattaaaaacctggcggcagcgcaaaagatg

SEQ ID NO: 73627 - DNA, 103 bp, Artificial Sequence
  Synthetic Polynucleotide
taatacgactcactatagggtattgaaaatgaattagtttaatatgacgcaacagaggagagcgtcaatgtaaactaataacctggcggcagcgcaaaagatg

SEQ ID NO: 73628 - DNA, 103 bp, Artificial Sequence
  Synthetic Polynucleotide
taatacgactcactatagggtatattattgaaaatgaattagtttaatataacagaggagaatattaatgtaattcattaacctggcggcagcgcaaaagatg

SEQ ID NO: 73629 - DNA, 103 bp, Artificial Sequence
  Synthetic Polynucleotide
taatacgactcactatagggattagtatattattgaaaatgaattagtttaacagaggagaaaactaatgcattttcaaaacctggcggcagcgcaaaagatg

SEQ ID NO: 73630 - DNA, 103 bp, Artificial Sequence
  Synthetic Polynucleotide
taatacgactcactatagggtactaattagtatattattgaaaatgaattaacagaggagaaattcaatgtcaataataaacctggcggcagcgcaaaagatg

SEQ ID NO: 73631 - DNA, 103 bp, Artificial Sequence
  Synthetic Polynucleotide
taatacgactcactataggggtcgttactaattagtatattattgaaaataacagaggagaattttcatgaatatactaaacctggcggcagcgcaaaagatg

SEQ ID NO: 73632 - DNA, 103 bp, Artificial Sequence
  Synthetic Polynucleotide
taatacgactcactatagggtaatagtcgttactaattagtatattattgaacagaggagacaataaatgactaattagaacctggcggcagcgcaaaagatg

SEQ ID NO: 73633 - DNA, 103 bp, Artificial Sequence
  Synthetic Polynucleotide
taatacgactcactatagggtattttaatagtcgttactaattagtatataacagaggagaatatacatgttagtaacgaacctggcggcagcgcaaaagatg

SEQ ID NO: 73634 - DNA, 103 bp, Artificial Sequence
  Synthetic Polynucleotide
taatacgactcactatagggatatttattttaatagtcgttactaattagaacagaggagactaattatgaacgactataacctggcggcagcgcaaaagatg

SEQ ID NO: 73635 - DNA, 103 bp, Artificial Sequence
  Synthetic Polynucleotide
taatacgactcactataggggaagaatatttattttaatagtcgttactaaacagaggagatagtaaatgctattaaaaaacctggcggcagcgcaaaagatg

SEQ ID NO: 73636 - DNA, 103 bp, Artificial Sequence
  Synthetic Polynucleotide
taatacgactcactatagggcttttctgaagcacgagagttattttcattaacagaggagaaatgaaatgaactctcgtaacctggcggcagcgcaaaagatg

SEQ ID NO: 73637 - DNA, 103 bp, Artificial Sequence
  Synthetic Polynucleotide
taatacgactcactataggggttatgaagaatatttattttaatagtcgtaacagaggagaacgactatgaaaataaataacctggcggcagcgcaaaagatg

SEQ ID NO: 73638 - DNA, 103 bp, Artificial Sequence
  Synthetic Polynucleotide
taatacgactcactatagggtaccggttatgaagaatatttattttaataaacagaggagatattaaatgaaatattctaacctggcggcagcgcaaaagatg

SEQ ID NO: 73639 - DNA, 103 bp, Artificial Sequence
  Synthetic Polynucleotide
taatacgactcactatagggattcttaccggttatgaagaatatttatttaacagaggagaaaataaatgttcttcataaacctggcggcagcgcaaaagatg

SEQ ID NO: 73640 - DNA, 103 bp, Artificial Sequence
  Synthetic Polynucleotide
taatacgactcactatagggttactattcttaccggttatgaagaatattaacagaggagaaatattatgcataaccggaacctggcggcagcgcaaaagatg

SEQ ID NO: 73641 - DNA, 103 bp, Artificial Sequence
  Synthetic Polynucleotide
taatacgactcactatagggtctttttactattcttaccggttatgaagaaacagaggagatcttcaatgccggtaagaaacctggcggcagcgcaaaagatg

SEQ ID NO: 73642 - DNA, 103 bp, Artificial Sequence
  Synthetic Polynucleotide
taatacgactcactatagggtttagtctttttactattcttaccggttataacagaggagaataaccatgaagaatagtaacctggcggcagcgcaaaagatg

SEQ ID NO: 73643 - DNA, 103 bp, Artificial Sequence
  Synthetic Polynucleotide
taatacgactcactataggggaagatttagtctttttactattcttaccgaacagaggagacggtaaatgtagtaaaaaaacctggcggcagcgcaaaagatg

SEQ ID NO: 73644 - DNA, 103 bp, Artificial Sequence
  Synthetic Polynucleotide
taatacgactcactatagggaatgtgaagatttagtctttttactattctaacagaggagaagaataatgaaaagactaaacctggcggcagcgcaaaagatg

SEQ ID NO: 73645 - DNA, 103 bp, Artificial Sequence
  Synthetic Polynucleotide
taatacgactcactataggggttacaatgtgaagatttagtctttttactaacagaggagaagtaaaatgactaaatctaacctggcggcagcgcaaaagatg

SEQ ID NO: 73646 - DNA, 103 bp, Artificial Sequence
  Synthetic Polynucleotide
taatacgactcactataggggaatagttacaatgtgaagatttagtctttaacagaggagaaaagacatgatcttcacaaacctggcggcagcgcaaaagatg

SEQ ID NO: 73647 - DNA, 103 bp, Artificial Sequence
  Synthetic Polynucleotide
taatacgactcactatagggtttgacttttctgaagcacgagagttatttaacagaggagaaaataaatgtcgtgcttcaacctggcggcagcgcaaaagatg

SEQ ID NO: 73648 - DNA, 103 bp, Artificial Sequence
  Synthetic Polynucleotide
taatacgactcactatagggctactgaatagttacaatgtgaagatttagaacagaggagactaaatatgcacattgtaaacctggcggcagcgcaaaagatg

SEQ ID NO: 73649 - DNA, 103 bp, Artificial Sequence
  Synthetic Polynucleotide
taatacgactcactatagggaaacactactgaatagttacaatgtgaagaaacagaggagatcttcaatgtgtaactataacctggcggcagcgcaaaagatg

SEQ ID NO: 73650 - DNA, 103 bp, Artificial Sequence
  Synthetic Polynucleotide
taatacgactcactatagggtatgtaaacactactgaatagttacaatgtaacagaggagaacattgatgctattcagtaacctggcggcagcgcaaaagatg

SEQ ID NO: 73651 - DNA, 103 bp, Artificial Sequence
  Synthetic Polynucleotide
taatacgactcactatagggtcatttatgtaaacactactgaatagttacaacagaggagagtaactatgcagtagtgtaacctggcggcagcgcaaaagatg

SEQ ID NO: 73652 - DNA, 103 bp, Artificial Sequence
  Synthetic Polynucleotide
taatacgactcactatagggtcatctcatttatgtaaacactactgaataaacagaggagatattcaatggtgtttacaaacctggcggcagcgcaaaagatg

SEQ ID NO: 73653 - DNA, 103 bp, Artificial Sequence
  Synthetic Polynucleotide
taatacgactcactatagggtcttctcatctcatttatgtaaacactactaacagaggagaagtagtatgtacataaataacctggcggcagcgcaaaagatg

SEQ ID NO: 73654 - DNA, 103 bp, Artificial Sequence
  Synthetic Polynucleotide
taatacgactcactataggggaatatcttctcatctcatttatgtaaacaaacagaggagatgtttaatgaaatgagataacctggcggcagcgcaaaagatg

SEQ ID NO: 73655 - DNA, 103 bp, Artificial Sequence
  Synthetic Polynucleotide
taatacgactcactatagggatagagaatatcttctcatctcatttatgtaacagaggagaacataaatgagatgagaaaacctggcggcagcgcaaaagatg

SEQ ID NO: 73656 - DNA, 103 bp, Artificial Sequence
  Synthetic Polynucleotide
taatacgactcactatagggccaaaatagagaatatcttctcatctcattaacagaggagaaatgagatgagaagatataacctggcggcagcgcaaaagatg

SEQ ID NO: 73657 - DNA, 103 bp, Artificial Sequence
  Synthetic Polynucleotide
taatacgactcactatagggctccaccaaaatagagaatatcttctcatcaacagaggagagatgagatgatattctctaacctggcggcagcgcaaaagatg

SEQ ID NO: 73658 - DNA, 103 bp, Artificial Sequence
  Synthetic Polynucleotide
taatacgactcactatagggcaatatttgacttttctgaagcacgagagtaacagaggagaactctcatgcttcagaaaaacctggcggcagcgcaaaagatg

SEQ ID NO: 73659 - DNA, 103 bp, Artificial Sequence
  Synthetic Polynucleotide
taatacgactcactatagggtaatcctccaccaaaatagagaatatcttcaacagaggagagaagatatgctctattttaacctggcggcagcgcaaaagatg

SEQ ID NO: 73660 - DNA, 103 bp, Artificial Sequence
  Synthetic Polynucleotide
taatacgactcactatagggtcatataatcctccaccaaaatagagaataaacagaggagatattctatgttttggtggaacctggcggcagcgcaaaagatg

SEQ ID NO: 73661 - DNA, 103 bp, Artificial Sequence
  Synthetic Polynucleotide
taatacgactcactatagggttatatcatataatcctccaccaaaatagaaacagaggagatctattatggtggaggataacctggcggcagcgcaaaagatg

SEQ ID NO: 73662 - DNA, 103 bp, Artificial Sequence
  Synthetic Polynucleotide
taatacgactcactatagggacgaattatatcatataatcctccaccaaaaacagaggagatttggtatgggattatataacctggcggcagcgcaaaagatg

SEQ ID NO: 73663 - DNA, 103 bp, Artificial Sequence
  Synthetic Polynucleotide
taatacgactcactatagggtatccacgaattatatcatataatcctccaaacagaggagatggaggatgatatgatataacctggcggcagcgcaaaagatg

SEQ ID NO: 73664 - DNA, 103 bp, Artificial Sequence
  Synthetic Polynucleotide
taatacgactcactatagggatgattatccacgaattatatcatataatcaacagaggagagattatatgatataattcaacctggcggcagcgcaaaagatg

SEQ ID NO: 73665 - DNA, 103 bp, Artificial Sequence
  Synthetic Polynucleotide
taatacgactcactatagggtaagaatgattatccacgaattatatcataaacagaggagatatgatatgattcgtggaaacctggcggcagcgcaaaagatg

SEQ ID NO: 73666 - DNA, 103 bp, Artificial Sequence
  Synthetic Polynucleotide
taatacgactcactatagggtgtcttaagaatgattatccacgaattataaacagaggagatataatatgtggataatcaacctggcggcagcgcaaaagatg

SEQ ID NO: 73667 - DNA, 103 bp, Artificial Sequence
  Synthetic Polynucleotide
taatacgactcactatagggaaatgtgtcttaagaatgattatccacgaaaacagaggagattcgtgatgaatcattctaacctggcggcagcgcaaaagatg

SEQ ID NO: 73668 - DNA, 103 bp, Artificial Sequence
  Synthetic Polynucleotide
taatacgactcactatagggtgaagaaatgtgtcttaagaatgattatccaacagaggagaggataaatgttcttaagaaacctggcggcagcgcaaaagatg

SEQ ID NO: 73669 - DNA, 103 bp, Artificial Sequence
  Synthetic Polynucleotide
taatacgactcactatagggggatacaatatttgacttttctgaagcacgaacagaggagacgtgctatggaaaagtcaaacctggcggcagcgcaaaagatg

SEQ ID NO: 73670 - DNA, 103 bp, Artificial Sequence
  Synthetic Polynucleotide
taatacgactcactatagggacgaatgaagaaatgtgtcttaagaatgataacagaggagaatcattatgaagacacataacctggcggcagcgcaaaagatg

SEQ ID NO: 73671 - DNA, 103 bp, Artificial Sequence
  Synthetic Polynucleotide
taatacgactcactataggggatttacgaatgaagaaatgtgtcttaagaaacagaggagatcttaaatgacatttcttaacctggcggcagcgcaaaagatg

SEQ ID NO: 73672 - DNA, 103 bp, Artificial Sequence
  Synthetic Polynucleotide
taatacgactcactataggggaaaagatttacgaatgaagaaatgtgtctaacagaggagaagacacatgtcttcattcaacctggcggcagcgcaaaagatg

SEQ ID NO: 73673 - DNA, 103 bp, Artificial Sequence
  Synthetic Polynucleotide
taatacgactcactatagggaacgtgaaaagatttacgaatgaagaaatgaacagaggagacatttcatgattcgtaaaaacctggcggcagcgcaaaagatg

SEQ ID NO: 73674 - DNA, 103 bp, Artificial Sequence
  Synthetic Polynucleotide
taatacgactcactatagggcatttaacgtgaaaagatttacgaatgaagaacagaggagacttcatatgtaaatctttaacctggcggcagcgcaaaagatg

SEQ ID NO: 73675 - DNA, 103 bp, Artificial Sequence
  Synthetic Polynucleotide
taatacgactcactatagggacactcatttaacgtgaaaagatttacgaaaacagaggagattcgtaatgcttttcacgaacctggcggcagcgcaaaagatg

SEQ ID NO: 73676 - DNA, 103 bp, Artificial Sequence
  Synthetic Polynucleotide
taatacgactcactatagggtatggacactcatttaacgtgaaaagatttaacagaggagaaaatctatgcacgttaaaaacctggcggcagcgcaaaagatg

SEQ ID NO: 73677 - DNA, 103 bp, Artificial Sequence
  Synthetic Polynucleotide
taatacgactcactatagggcaaaatatggacactcatttaacgtgaaaaaacagaggagattttcaatgtaaatgagtaacctggcggcagcgcaaaagatg

SEQ ID NO: 73678 - DNA, 103 bp, Artificial Sequence
  Synthetic Polynucleotide
taatacgactcactatagggaattgcaaaatatggacactcatttaacgtaacagaggagaacgttaatggagtgtccaaacctggcggcagcgcaaaagatg

SEQ ID NO: 73679 - DNA, 103 bp, Artificial Sequence
  Synthetic Polynucleotide
taatacgactcactataggggaagaaattgcaaaatatggacactcatttaacagaggagaaaatgaatgtccatatttaacctggcggcagcgcaaaagatg

SEQ ID NO: 73680 - DNA, 103 bp, Artificial Sequence
  Synthetic Polynucleotide
taatacgactcactataggggaggaatgattgccttcatcattttttgtgaacagaggagacacaaaatgtgatgaaggaacctggcggcagcgcaaaagatg

SEQ ID NO: 73681 - DNA, 103 bp, Artificial Sequence
  Synthetic Polynucleotide
taatacgactcactatagggtgtatggatacaatatttgacttttctgaaaacagaggagattcagaatggtcaaatataacctggcggcagcgcaaaagatg

SEQ ID NO: 73682 - DNA, 103 bp, Artificial Sequence
  Synthetic Polynucleotide
taatacgactcactatagggcctatgaagaaattgcaaaatatggacactaacagaggagaagtgtcatgattttgcaaaacctggcggcagcgcaaaagatg

SEQ ID NO: 73683 - DNA, 103 bp, Artificial Sequence
  Synthetic Polynucleotide
taatacgactcactataggggccatcctatgaagaaattgcaaaatatggaacagaggagaccatatatggcaatttctaacctggcggcagcgcaaaagatg

SEQ ID NO: 73684 - DNA, 103 bp, Artificial Sequence
  Synthetic Polynucleotide
taatacgactcactatagggacaccgccatcctatgaagaaattgcaaaaaacagaggagattttgcatgttcttcataaacctggcggcagcgcaaaagatg

SEQ ID NO: 73685 - DNA, 103 bp, Artificial Sequence
  Synthetic Polynucleotide
taatacgactcactatagggcacgtacaccgccatcctatgaagaaattgaacagaggagacaatttatgcataggatgaacctggcggcagcgcaaaagatg

SEQ ID NO: 73686 - DNA, 103 bp, Artificial Sequence
  Synthetic Polynucleotide
taatacgactcactatagggccgtccacgtacaccgccatcctatgaagaaacagaggagatcttcaatggatggcggtaacctggcggcagcgcaaaagatg

SEQ ID NO: 73687 - DNA, 103 bp, Artificial Sequence
  Synthetic Polynucleotide
taatacgactcactatagggcagcaccgtccacgtacaccgccatcctataacagaggagaataggaatgcggtgtacgaacctggcggcagcgcaaaagatg

SEQ ID NO: 73688 - DNA, 103 bp, Artificial Sequence
  Synthetic Polynucleotide
taatacgactcactatagggaggaacagcaccgtccacgtacaccgccataacagaggagaatggcgatgtacgtggacaacctggcggcagcgcaaaagatg

SEQ ID NO: 73689 - DNA, 103 bp, Artificial Sequence
  Synthetic Polynucleotide
taatacgactcactatagggagaacaggaacagcaccgtccacgtacaccaacagaggagaggtgtaatgggacggtgcaacctggcggcagcgcaaaagatg

SEQ ID NO: 73690 - DNA, 103 bp, Artificial Sequence
  Synthetic Polynucleotide
taatacgactcactatagggcaacaagaacaggaacagcaccgtccacgtaacagaggagaacgtggatggtgctgttcaacctggcggcagcgcaaaagatg

SEQ ID NO: 73691 - DNA, 103 bp, Artificial Sequence
  Synthetic Polynucleotide
taatacgactcactataggggaccacaacaagaacaggaacagcaccgtcaacagaggagagacggtatggttcctgttaacctggcggcagcgcaaaagatg

SEQ ID NO: 73692 - DNA, 103 bp, Artificial Sequence
  Synthetic Polynucleotide
taatacgactcactatagggatgtatgtatggatacaatatttgacttttaacagaggagaaaaagtatgatattgtataacctggcggcagcgcaaaagatg

SEQ ID NO: 73693 - DNA, 103 bp, Artificial Sequence
  Synthetic Polynucleotide
taatacgactcactatagggtcggagaccacaacaagaacaggaacagcaaacagaggagatgctgtatgtgttcttgtaacctggcggcagcgcaaaagatg

SEQ ID NO: 73694 - DNA, 103 bp, Artificial Sequence
  Synthetic Polynucleotide
taatacgactcactataggggaaagtcggagaccacaacaagaacaggaaaacagaggagattcctgatgttgttgtggaacctggcggcagcgcaaaagatg

SEQ ID NO: 73695 - DNA, 103 bp, Artificial Sequence
  Synthetic Polynucleotide
taatacgactcactatagggaacacgaaagtcggagaccacaacaagaacaacagaggagagttcttatggtggtctccaacctggcggcagcgcaaaagatg

SEQ ID NO: 73696 - DNA, 103 bp, Artificial Sequence
  Synthetic Polynucleotide
taatacgactcactatagggacgcaaacacgaaagtcggagaccacaacaaacagaggagatgttgtatgctccgacttaacctggcggcagcgcaaaagatg

SEQ ID NO: 73697 - DNA, 103 bp, Artificial Sequence
  Synthetic Polynucleotide
taatacgactcactatagggtctaaacgcaaacacgaaagtcggagaccaaacagaggagatggtctatgactttcgtgaacctggcggcagcgcaaaagatg

SEQ ID NO: 73698 - DNA, 103 bp, Artificial Sequence
  Synthetic Polynucleotide
taatacgactcactatagggagggatctaaacgcaaacacgaaagtcggaaacagaggagatccgacatgcgtgtttgcaacctggcggcagcgcaaaagatg

SEQ ID NO: 73699 - DNA, 103 bp, Artificial Sequence
  Synthetic Polynucleotide
taatacgactcactatagggaatggagggatctaaacgcaaacacgaaagaacagaggagactttcgatgttgcgtttaaacctggcggcagcgcaaaagatg

SEQ ID NO: 73700 - DNA, 103 bp, Artificial Sequence
  Synthetic Polynucleotide
taatacgactcactataggggcgataatggagggatctaaacgcaaacacaacagaggagagtgtttatgtttagatccaacctggcggcagcgcaaaagatg

SEQ ID NO: 73701 - DNA, 103 bp, Artificial Sequence
  Synthetic Polynucleotide
taatacgactcactatagggcaatcgcgataatggagggatctaaacgcaaacagaggagatgcgttatgatccctccaaacctggcggcagcgcaaaagatg

SEQ ID NO: 73702 - DNA, 103 bp, Artificial Sequence
  Synthetic Polynucleotide
taatacgactcactatagggctatgcaatcgcgataatggagggatctaaaacagaggagattagatatgtccattatcaacctggcggcagcgcaaaagatg

SEQ ID NO: 73703 - DNA, 103 bp, Artificial Sequence
  Synthetic Polynucleotide
taatacgactcactatagggtggagatgtatgtatggatacaatatttgaaacagaggagatcaaatatggtatccataaacctggcggcagcgcaaaagatg

SEQ ID NO: 73704 - DNA, 103 bp, Artificial Sequence
  Synthetic Polynucleotide
taatacgactcactatagggctcatctatgcaatcgcgataatggagggaaacagaggagatccctcatgtatcgcgataacctggcggcagcgcaaaagatg

SEQ ID NO: 73705 - DNA, 103 bp, Artificial Sequence
  Synthetic Polynucleotide
taatacgactcactatagggagtacctcatctatgcaatcgcgataatggaacagaggagaccattaatgcgattgcataacctggcggcagcgcaaaagatg

SEQ ID NO: 73706 - DNA, 103 bp, Artificial Sequence
  Synthetic Polynucleotide
taatacgactcactatagggaaaatagtacctcatctatgcaatcgcgataacagaggagaatcgcgatggcatagatgaacctggcggcagcgcaaaagatg

SEQ ID NO: 73707 - DNA, 103 bp, Artificial Sequence
  Synthetic Polynucleotide
taatacgactcactatagggggtataaaatagtacctcatctatgcaatcaacagaggagagattgcatggatgaggtaaacctggcggcagcgcaaaagatg

SEQ ID NO: 73708 - DNA, 103 bp, Artificial Sequence
  Synthetic Polynucleotide
taatacgactcactatagggtacaaggtataaaatagtacctcatctatgaacagaggagacatagaatgggtactattaacctggcggcagcgcaaaagatg

SEQ ID NO: 73709 - DNA, 103 bp, Artificial Sequence
  Synthetic Polynucleotide
taatacgactcactatagggttaattacaaggtataaaatagtacctcataacagaggagaatgaggatgtattttataaacctggcggcagcgcaaaagatg

SEQ ID NO: 73710 - DNA, 103 bp, Artificial Sequence
  Synthetic Polynucleotide
taatacgactcactatagggaaaatttaattacaaggtataaaatagtacaacagaggagagtactaatgtataccttgaacctggcggcagcgcaaaagatg

SEQ ID NO: 73711 - DNA, 103 bp, Artificial Sequence
  Synthetic Polynucleotide
taatacgactcactatagggataaaaaaatttaattacaaggtataaaataacagaggagaattttaatgcttgtaattaacctggcggcagcgcaaaagatg

SEQ ID NO: 73712 - DNA, 103 bp, Artificial Sequence
  Synthetic Polynucleotide
taatacgactcactatagggaattaataaaaaaatttaattacaaggtataacagaggagaatacctatgaattaaattaacctggcggcagcgcaaaagatg

SEQ ID NO: 73713 - DNA, 103 bp, Artificial Sequence
  Synthetic Polynucleotide
taatacgactcactatagggtaattaattaataaaaaaatttaattacaaaacagaggagattgtaaatgaatttttttaacctggcggcagcgcaaaagatg

SEQ ID NO: 73714 - DNA, 103 bp, Artificial Sequence
  Synthetic Polynucleotide
taatacgactcactatagggagttttggagatgtatgtatggatacaataaacagaggagatattgtatgcatacatacaacctggcggcagcgcaaaagatg

SEQ ID NO: 73715 - DNA, 103 bp, Artificial Sequence
  Synthetic Polynucleotide
taatacgactcactatagggttaattaattaattaataaaaaaatttaataacagaggagaattaaaatgttttattaaaacctggcggcagcgcaaaagatg

SEQ ID NO: 73716 - DNA, 103 bp, Artificial Sequence
  Synthetic Polynucleotide
taatacgactcactatagggtacgtttaattaattaattaataaaaaaataacagaggagaatttttatgttaattaataacctggcggcagcgcaaaagatg

SEQ ID NO: 73717 - DNA, 103 bp, Artificial Sequence
  Synthetic Polynucleotide
taatacgactcactatagggttttatacgtttaattaattaattaataaaaacagaggagatttattatgtaattaattaacctggcggcagcgcaaaagatg

SEQ ID NO: 73718 - DNA, 103 bp, Artificial Sequence
  Synthetic Polynucleotide
taatacgactcactatagggaacgtttttatacgtttaattaattaattaaacagaggagataattaatgaattaaacgaacctggcggcagcgcaaaagatg

SEQ ID NO: 73719 - DNA, 103 bp, Artificial Sequence
  Synthetic Polynucleotide
taatacgactcactatagggtacggaacgtttttatacgtttaattaattaacagaggagaaattaaatgaacgtataaaacctggcggcagcgcaaaagatg

SEQ ID NO: 73720 - DNA, 103 bp, Artificial Sequence
  Synthetic Polynucleotide
taatacgactcactatagggacagatacggaacgtttttatacgtttaataacagaggagaattaaaatgataaaaacgaacctggcggcagcgcaaaagatg

SEQ ID NO: 73721 - DNA, 103 bp, Artificial Sequence
  Synthetic Polynucleotide
taatacgactcactatagggtaaatacagatacggaacgtttttatacgtaacagaggagaacgtatatgaacgttccgaacctggcggcagcgcaaaagatg

SEQ ID NO: 73722 - DNA, 103 bp, Artificial Sequence
  Synthetic Polynucleotide
taatacgactcactataggggctcttaaatacagatacggaacgtttttaaacagaggagataaaaaatgtccgtatctaacctggcggcagcgcaaaagatg

SEQ ID NO: 73723 - DNA, 103 bp, Artificial Sequence
  Synthetic Polynucleotide
taatacgactcactatagggatctggctcttaaatacagatacggaacgtaacagaggagaacgttcatgatctgtattaacctggcggcagcgcaaaagatg

SEQ ID NO: 73724 - DNA, 103 bp, Artificial Sequence
  Synthetic Polynucleotide
taatacgactcactatagggacgaaatctggctcttaaatacagatacggaacagaggagaccgtatatgtatttaagaaacctggcggcagcgcaaaagatg

SEQ ID NO: 73725 - DNA, 103 bp, Artificial Sequence
  Synthetic Polynucleotide
taatacgactcactataggggtgatagttttggagatgtatgtatggataaacagaggagatatccaatgatacatctcaacctggcggcagcgcaaaagatg

SEQ ID NO: 73726 - DNA, 103 bp, Artificial Sequence
  Synthetic Polynucleotide
taatacgactcactatagggattagacgaaatctggctcttaaatacagaaacagaggagatctgtaatgaagagccagaacctggcggcagcgcaaaagatg

SEQ ID NO: 73727 - DNA, 103 bp, Artificial Sequence
  Synthetic Polynucleotide
taatacgactcactataggggttctattagacgaaatctggctcttaaataacagaggagaatttaaatgccagatttcaacctggcggcagcgcaaaagatg

SEQ ID NO: 73728 - DNA, 103 bp, Artificial Sequence
  Synthetic Polynucleotide
taatacgactcactatagggtatttgttctattagacgaaatctggctctaacagaggagaagagccatgtttcgtctaaacctggcggcagcgcaaaagatg

SEQ ID NO: 73729 - DNA, 103 bp, Artificial Sequence
  Synthetic Polynucleotide
taatacgactcactataggggtagctatttgttctattagacgaaatctgaacagaggagacagattatgtctaatagaaacctggcggcagcgcaaaagatg

SEQ ID NO: 73730 - DNA, 103 bp, Artificial Sequence
  Synthetic Polynucleotide
taatacgactcactatagggttactgtagctatttgttctattagacgaaaacagaggagattcgtcatgtagaacaaaaacctggcggcagcgcaaaagatg

SEQ ID NO: 73731 - DNA, 103 bp, Artificial Sequence
  Synthetic Polynucleotide
taatacgactcactatagggtatttttactgtagctatttgttctattagaacagaggagactaataatgcaaatagctaacctggcggcagcgcaaaagatg

SEQ ID NO: 73732 - DNA, 103 bp, Artificial Sequence
  Synthetic Polynucleotide
taatacgactcactatagggctagttatttttactgtagctatttgttctaacagaggagaagaacaatgagctacagtaacctggcggcagcgcaaaagatg

SEQ ID NO: 73733 - DNA, 103 bp, Artificial Sequence
  Synthetic Polynucleotide
taatacgactcactatagggttattctagttatttttactgtagctatttaacagaggagaaaatagatgcagtaaaaaaacctggcggcagcgcaaaagatg

SEQ ID NO: 73734 - DNA, 103 bp, Artificial Sequence
  Synthetic Polynucleotide
taatacgactcactatagggagcgattattctagttatttttactgtagcaacagaggagagctacaatgaaaataactaacctggcggcagcgcaaaagatg

SEQ ID NO: 73735 - DNA, 103 bp, Artificial Sequence
  Synthetic Polynucleotide
taatacgactcactatagggggtgtagcgattattctagttatttttactaacagaggagaagtaaaatgaactagaataacctggcggcagcgcaaaagatg

SEQ ID NO: 73736 - DNA, 103 bp, Artificial Sequence
  Synthetic Polynucleotide
taatacgactcactatagggtataagtgatagttttggagatgtatgtataacagaggagaatacatatgtctccaaaaaacctggcggcagcgcaaaagatg

SEQ ID NO: 73737 - DNA, 103 bp, Artificial Sequence
  Synthetic Polynucleotide
taatacgactcactatagggtagtgggtgtagcgattattctagttatttaacagaggagaaaataaatggaataatcgaacctggcggcagcgcaaaagatg

SEQ ID NO: 73738 - DNA, 103 bp, Artificial Sequence
  Synthetic Polynucleotide
taatacgactcactataggggtttctagtgggtgtagcgattattctagtaacagaggagaactagaatgatcgctacaaacctggcggcagcgcaaaagatg

SEQ ID NO: 73739 - DNA, 103 bp, Artificial Sequence
  Synthetic Polynucleotide
taatacgactcactatagggccgtggtttctagtgggtgtagcgattattaacagaggagaaataatatgtacacccacaacctggcggcagcgcaaaagatg

SEQ ID NO: 73740 - DNA, 103 bp, Artificial Sequence
  Synthetic Polynucleotide
taatacgactcactatagggacgatccgtggtttctagtgggtgtagcgaaacagaggagatcgctaatgccactagaaaacctggcggcagcgcaaaagatg

SEQ ID NO: 73741 - DNA, 103 bp, Artificial Sequence
  Synthetic Polynucleotide
taatacgactcactataggggtattacgatccgtggtttctagtgggtgtaacagaggagaacacccatgagaaaccacaacctggcggcagcgcaaaagatg

SEQ ID NO: 73742 - DNA, 103 bp, Artificial Sequence
  Synthetic Polynucleotide
taatacgactcactatagggttgccgtattacgatccgtggtttctagtgaacagaggagacactagatgccacggatcaacctggcggcagcgcaaaagatg

SEQ ID NO: 73743 - DNA, 103 bp, Artificial Sequence
  Synthetic Polynucleotide
taatacgactcactatagggaccgattgccgtattacgatccgtggtttcaacagaggagagaaaccatggatcgtaataacctggcggcagcgcaaaagatg

SEQ ID NO: 73744 - DNA, 103 bp, Artificial Sequence
  Synthetic Polynucleotide
taatacgactcactatagggcgaaaaccgattgccgtattacgatccgtgaacagaggagacacggaatgtaatacggcaacctggcggcagcgcaaaagatg

SEQ ID NO: 73745 - DNA, 103 bp, Artificial Sequence
  Synthetic Polynucleotide
taatacgactcactatagggattatcgaaaaccgattgccgtattacgataacagaggagaatcgtaatgcggcaatcgaacctggcggcagcgcaaaagatg

SEQ ID NO: 73746 - DNA, 103 bp, Artificial Sequence
  Synthetic Polynucleotide
taatacgactcactatagggcacctattatcgaaaaccgattgccgtattaacagaggagaaatacgatgatcggttttaacctggcggcagcgcaaaagatg

SEQ ID NO: 73747 - DNA, 103 bp, Artificial Sequence
  Synthetic Polynucleotide
taatacgactcactatagggaaacgtataagtgatagttttggagatgtaaacagaggagatacatcatgaaaactatcaacctggcggcagcgcaaaagatg

SEQ ID NO: 73748 - DNA, 103 bp, Artificial Sequence
  Synthetic Polynucleotide
taatacgactcactatagggcgttccacctattatcgaaaaccgattgccaacagaggagaggcaatatgttttcgataaacctggcggcagcgcaaaagatg

SEQ ID NO: 73749 - DNA, 103 bp, Artificial Sequence
  Synthetic Polynucleotide
taatacgactcactatagggatatacgttccacctattatcgaaaaccgaaacagaggagatcggttatggataataggaacctggcggcagcgcaaaagatg

SEQ ID NO: 73750 - DNA, 103 bp, Artificial Sequence
  Synthetic Polynucleotide
taatacgactcactatagggataaaatatacgttccacctattatcgaaaaacagaggagatttcgaatgtaggtggaaaacctggcggcagcgcaaaagatg

SEQ ID NO: 73751 - DNA, 103 bp, Artificial Sequence
  Synthetic Polynucleotide
taatacgactcactatagggcttaaataaaatatacgttccacctattataacagaggagaataataatgggaacgtataacctggcggcagcgcaaaagatg

SEQ ID NO: 73752 - DNA, 103 bp, Artificial Sequence
  Synthetic Polynucleotide
taatacgactcactatagggaagtccttaaataaaatatacgttccacctaacagaggagaaggtggatggtatattttaacctggcggcagcgcaaaagatg

SEQ ID NO: 73753 - DNA, 103 bp, Artificial Sequence
  Synthetic Polynucleotide
taatacgactcactatagggttcttaagtccttaaataaaatatacgttcaacagaggagagaacgtatgttttatttaaacctggcggcagcgcaaaagatg

SEQ ID NO: 73754 - DNA, 103 bp, Artificial Sequence
  Synthetic Polynucleotide
taatacgactcactataggggacaattcttaagtccttaaataaaatataaacagaggagatatattatgtttaaggacaacctggcggcagcgcaaaagatg

SEQ ID NO: 73755 - DNA, 103 bp, Artificial Sequence
  Synthetic Polynucleotide
taatacgactcactatagggttacagacaattcttaagtccttaaataaaaacagaggagatttattatgggacttaagaacctggcggcagcgcaaaagatg

SEQ ID NO: 73756 - DNA, 103 bp, Artificial Sequence
  Synthetic Polynucleotide
taatacgactcactataggggtggtttacagacaattcttaagtccttaaaacagaggagattaaggatgtaagaattgaacctggcggcagcgcaaaagatg

SEQ ID NO: 73757 - DNA, 103 bp, Artificial Sequence
  Synthetic Polynucleotide
taatacgactcactatagggaaattgtggtttacagacaattcttaagtcaacagaggagagacttaatgattgtctgtaacctggcggcagcgcaaaagatg

SEQ ID NO: 73758 - DNA, 103 bp, Artificial Sequence
  Synthetic Polynucleotide
taatacgactcactatagggaagataaacgtataagtgatagttttggagaacagaggagactccaaatgtatcacttaaacctggcggcagcgcaaaagatg

SEQ ID NO: 73759 - DNA, 103 bp, Artificial Sequence
  Synthetic Polynucleotide
taatacgactcactatagggggagcaaattgtggtttacagacaattcttaacagaggagaaagaatatgctgtaaaccaacctggcggcagcgcaaaagatg

SEQ ID NO: 73760 - DNA, 103 bp, Artificial Sequence
  Synthetic Polynucleotide
taatacgactcactatagggcggcgggagcaaattgtggtttacagacaaaacagaggagattgtctatgaaccacaataacctggcggcagcgcaaaagatg

SEQ ID NO: 73761 - DNA, 103 bp, Artificial Sequence
  Synthetic Polynucleotide
taatacgactcactatagggaggatcggcgggagcaaattgtggtttacaaacagaggagatgtaaaatgcaatttgctaacctggcggcagcgcaaaagatg

SEQ ID NO: 73762 - DNA, 103 bp, Artificial Sequence
  Synthetic Polynucleotide
taatacgactcactatagggaatacaggatcggcgggagcaaattgtggtaacagaggagaaccacaatgtgctcccgcaacctggcggcagcgcaaaagatg

SEQ ID NO: 73763 - DNA, 103 bp, Artificial Sequence
  Synthetic Polynucleotide
taatacgactcactatagggtagttaatacaggatcggcgggagcaaattaacagaggagaaatttgatgccgccgatcaacctggcggcagcgcaaaagatg

SEQ ID NO: 73764 - DNA, 103 bp, Artificial Sequence
  Synthetic Polynucleotide
taatacgactcactatagggacagatagttaatacaggatcggcgggagcaacagaggagagctcccatggatcctgtaaacctggcggcagcgcaaaagatg

SEQ ID NO: 73765 - DNA, 103 bp, Artificial Sequence
  Synthetic Polynucleotide
taatacgactcactatagggcttttacagatagttaatacaggatcggcgaacagaggagacgccgaatgtgtattaacaacctggcggcagcgcaaaagatg

SEQ ID NO: 73766 - DNA, 103 bp, Artificial Sequence
  Synthetic Polynucleotide
taatacgactcactatagggatatgcttttacagatagttaatacaggataacagaggagaatcctgatgtaactatctaacctggcggcagcgcaaaagatg

SEQ ID NO: 73767 - DNA, 103 bp, Artificial Sequence
  Synthetic Polynucleotide
taatacgactcactatagggccaacatatgcttttacagatagttaatacaacagaggagagtattaatgatctgtaaaaacctggcggcagcgcaaaagatg

SEQ ID NO: 73768 - DNA, 103 bp, Artificial Sequence
  Synthetic Polynucleotide
taatacgactcactatagggcccggccaacatatgcttttacagatagttaacagaggagaaactatatgtaaaagcataacctggcggcagcgcaaaagatg

SEQ ID NO: 73769 - DNA, 103 bp, Artificial Sequence
  Synthetic Polynucleotide
taatacgactcactatagggcgttaaagataaacgtataagtgatagtttaacagaggagaaaactaatgcttatacgtaacctggcggcagcgcaaaagatg

SEQ ID NO: 73770 - DNA, 103 bp, Artificial Sequence
  Synthetic Polynucleotide
taatacgactcactatagggctccgcccggccaacatatgcttttacagaaacagaggagatctgtaatggcatatgttaacctggcggcagcgcaaaagatg

SEQ ID NO: 73771 - DNA, 103 bp, Artificial Sequence
  Synthetic Polynucleotide
taatacgactcactatagggttcggctccgcccggccaacatatgcttttaacagaggagaaaaagcatgtgttggccgaacctggcggcagcgcaaaagatg

SEQ ID NO: 73772 - DNA, 103 bp, Artificial Sequence
  Synthetic Polynucleotide
taatacgactcactataggggaatgttcggctccgcccggccaacatatgaacagaggagacatatgatggccgggcggaacctggcggcagcgcaaaagatg

SEQ ID NO: 73773 - DNA, 103 bp, Artificial Sequence
  Synthetic Polynucleotide
taatacgactcactatagggtcggagaatgttcggctccgcccggccaacaacagaggagagttggcatggcggagccgaacctggcggcagcgcaaaagatg

SEQ ID NO: 73774 - DNA, 103 bp, Artificial Sequence
  Synthetic Polynucleotide
taatacgactcactataggggaatatcggagaatgttcggctccgcccggaacagaggagaccgggcatggccgaacataacctggcggcagcgcaaaagatg

SEQ ID NO: 73775 - DNA, 103 bp, Artificial Sequence
  Synthetic Polynucleotide
taatacgactcactatagggaaattgaatatcggagaatgttcggctccgaacagaggagacggagcatgacattctccaacctggcggcagcgcaaaagatg

SEQ ID NO: 73776 - DNA, 103 bp, Artificial Sequence
  Synthetic Polynucleotide
taatacgactcactatagggtacaaaaattgaatatcggagaatgttcggaacagaggagaccgaacatgctccgatataacctggcggcagcgcaaaagatg

SEQ ID NO: 73777 - DNA, 103 bp, Artificial Sequence
  Synthetic Polynucleotide
taatacgactcactatagggagatatacaaaaattgaatatcggagaatgaacagaggagacattctatgatattcaataacctggcggcagcgcaaaagatg

SEQ ID NO: 73778 - DNA, 103 bp, Artificial Sequence
  Synthetic Polynucleotide
taatacgactcactatagggattatagatatacaaaaattgaatatcggaaacagaggagatccgatatgcaatttttgaacctggcggcagcgcaaaagatg

SEQ ID NO: 73779 - DNA, 103 bp, Artificial Sequence
  Synthetic Polynucleotide
taatacgactcactatagggataacattatagatatacaaaaattgaataaacagaggagatattcaatgtttgtatataacctggcggcagcgcaaaagatg

SEQ ID NO: 73780 - DNA, 103 bp, Artificial Sequence
  Synthetic Polynucleotide
taatacgactcactatagggggtatcgttaaagataaacgtataagtgataacagaggagaatcactatgacgtttatcaacctggcggcagcgcaaaagatg

SEQ ID NO: 73781 - DNA, 103 bp, Artificial Sequence
  Synthetic Polynucleotide
taatacgactcactatagggggttaataacattatagatatacaaaaattaacagaggagaaattttatgatatctataaacctggcggcagcgcaaaagatg

SEQ ID NO: 73782 - DNA, 103 bp, Artificial Sequence
  Synthetic Polynucleotide
taatacgactcactataggggcggaggttaataacattatagatatacaaaacagaggagattgtatatgtataatgttaacctggcggcagcgcaaaagatg

SEQ ID NO: 73783 - DNA, 103 bp, Artificial Sequence
  Synthetic Polynucleotide
taatacgactcactatagggcgtatgcggaggttaataacattatagataaacagaggagatatctaatgtgttattaaaacctggcggcagcgcaaaagatg

SEQ ID NO: 73784 - DNA, 103 bp, Artificial Sequence
  Synthetic Polynucleotide
taatacgactcactatagggtaatgcgtatgcggaggttaataacattataacagaggagaataatgatgttaacctccaacctggcggcagcgcaaaagatg

SEQ ID NO: 73785 - DNA, 103 bp, Artificial Sequence
  Synthetic Polynucleotide
taatacgactcactatagggaactgtaatgcgtatgcggaggttaataacaacagaggagagttattatgctccgcataaacctggcggcagcgcaaaagatg

SEQ ID NO: 73786 - DNA, 103 bp, Artificial Sequence
  Synthetic Polynucleotide
taatacgactcactatagggaaaaaaactgtaatgcgtatgcggaggttaaacagaggagataacctatgcatacgcataacctggcggcagcgcaaaagatg

SEQ ID NO: 73787 - DNA, 103 bp, Artificial Sequence
  Synthetic Polynucleotide
taatacgactcactataggggctagaaaaaaactgtaatgcgtatgcggaaacagaggagatccgcaatggcattacagaacctggcggcagcgcaaaagatg

SEQ ID NO: 73788 - DNA, 103 bp, Artificial Sequence
  Synthetic Polynucleotide
taatacgactcactatagggtccaagctagaaaaaaactgtaatgcgtataacagaggagaatacgcatgacagtttttaacctggcggcagcgcaaaagatg

SEQ ID NO: 73789 - DNA, 103 bp, Artificial Sequence
  Synthetic Polynucleotide
taatacgactcactatagggccgtatccaagctagaaaaaaactgtaatgaacagaggagacattacatgttttttctaaacctggcggcagcgcaaaagatg

SEQ ID NO: 73790 - DNA, 103 bp, Artificial Sequence
  Synthetic Polynucleotide
taatacgactcactatagggtagtgccgtatccaagctagaaaaaaactgaacagaggagacagtttatgtctagcttgaacctggcggcagcgcaaaagatg

SEQ ID NO: 73791 - DNA, 103 bp, Artificial Sequence
  Synthetic Polynucleotide
taatacgactcactatagggcttatgaggaatgattgccttcatcattttaacagaggagaaaaatgatgaaggcaatcaacctggcggcagcgcaaaagatg

SEQ ID NO: 73792 - DNA, 103 bp, Artificial Sequence
  Synthetic Polynucleotide
taatacgactcactataggggtataggtatcgttaaagataaacgtataaaacagaggagattatacatgtatctttaaaacctggcggcagcgcaaaagatg

SEQ ID NO: 73793 - DNA, 103 bp, Artificial Sequence
  Synthetic Polynucleotide
taatacgactcactataggggtacctagtgccgtatccaagctagaaaaaaacagaggagatttttcatgcttggatacaacctggcggcagcgcaaaagatg

SEQ ID NO: 73794 - DNA, 103 bp, Artificial Sequence
  Synthetic Polynucleotide
taatacgactcactatagggatgatgtacctagtgccgtatccaagctagaacagaggagactagctatgatacggcacaacctggcggcagcgcaaaagatg

SEQ ID NO: 73795 - DNA, 103 bp, Artificial Sequence
  Synthetic Polynucleotide
taatacgactcactatagggtctaaatgatgtacctagtgccgtatccaaaacagaggagattggatatggcactaggtaacctggcggcagcgcaaaagatg

SEQ ID NO: 73796 - DNA, 103 bp, Artificial Sequence
  Synthetic Polynucleotide
taatacgactcactatagggatagatctaaatgatgtacctagtgccgtaaacagaggagatacggcatgaggtacatcaacctggcggcagcgcaaaagatg

SEQ ID NO: 73797 - DNA, 103 bp, Artificial Sequence
  Synthetic Polynucleotide
taatacgactcactatagggtaggaatagatctaaatgatgtacctagtgaacagaggagacactagatgcatcatttaaacctggcggcagcgcaaaagatg

SEQ ID NO: 73798 - DNA, 103 bp, Artificial Sequence
  Synthetic Polynucleotide
taatacgactcactatagggggaaataggaatagatctaaatgatgtaccaacagaggagaggtacaatgtttagatctaacctggcggcagcgcaaaagatg

SEQ ID NO: 73799 - DNA, 103 bp, Artificial Sequence
  Synthetic Polynucleotide
taatacgactcactataggggctgaggaaataggaatagatctaaatgataacagaggagaatcattatgatctattccaacctggcggcagcgcaaaagatg

SEQ ID NO: 73800 - DNA, 103 bp, Artificial Sequence
  Synthetic Polynucleotide
taatacgactcactatagggctatcgctgaggaaataggaatagatctaaaacagaggagattagatatgttcctatttaacctggcggcagcgcaaaagatg

SEQ ID NO: 73801 - DNA, 103 bp, Artificial Sequence
  Synthetic Polynucleotide
taatacgactcactatagggaagagctatcgctgaggaaataggaatagaaacagaggagatctattatgatttcctcaaacctggcggcagcgcaaaagatg

SEQ ID NO: 73802 - DNA, 103 bp, Artificial Sequence
  Synthetic Polynucleotide
taatacgactcactataggggatagaagagctatcgctgaggaaataggaaacagaggagatcctatatgctcagcgataacctggcggcagcgcaaaagatg

SEQ ID NO: 73803 - DNA, 103 bp, Artificial Sequence
  Synthetic Polynucleotide
taatacgactcactatagggtctaggtataggtatcgttaaagataaacgaacagaggagacgtttaatgttaacgataaacctggcggcagcgcaaaagatg

SEQ ID NO: 73804 - DNA, 103 bp, Artificial Sequence
  Synthetic Polynucleotide
taatacgactcactatagggaaaaggatagaagagctatcgctgaggaaaaacagaggagatttcctatgcgatagctcaacctggcggcagcgcaaaagatg

SEQ ID NO: 73805 - DNA, 103 bp, Artificial Sequence
  Synthetic Polynucleotide
taatacgactcactatagggtccggaaaaggatagaagagctatcgctgaaacagaggagatcagcgatggctcttctaaacctggcggcagcgcaaaagatg

SEQ ID NO: 73806 - DNA, 103 bp, Artificial Sequence
  Synthetic Polynucleotide
taatacgactcactatagggttgcttccggaaaaggatagaagagctatcaacagaggagagatagcatgtctatccttaacctggcggcagcgcaaaagatg

SEQ ID NO: 73807 - DNA, 103 bp, Artificial Sequence
  Synthetic Polynucleotide
taatacgactcactatagggtttcattgcttccggaaaaggatagaagagaacagaggagactcttcatgccttttccgaacctggcggcagcgcaaaagatg

SEQ ID NO: 73808 - DNA, 103 bp, Artificial Sequence
  Synthetic Polynucleotide
taatacgactcactatagggagtgatttcattgcttccggaaaaggatagaacagaggagactatccatgtccggaagcaacctggcggcagcgcaaaagatg

SEQ ID NO: 73809 - DNA, 103 bp, Artificial Sequence
  Synthetic Polynucleotide
taatacgactcactatagggattgaagtgatttcattgcttccggaaaagaacagaggagacttttcatgaagcaatgaaacctggcggcagcgcaaaagatg

SEQ ID NO: 73810 - DNA, 103 bp, Artificial Sequence
  Synthetic Polynucleotide
taatacgactcactatagggcatttattgaagtgatttcattgcttccggaacagaggagaccggaaatgatgaaatcaaacctggcggcagcgcaaaagatg

SEQ ID NO: 73811 - DNA, 103 bp, Artificial Sequence
  Synthetic Polynucleotide
taatacgactcactatagggtgaatcatttattgaagtgatttcattgctaacagaggagaagcaatatgatcacttcaaacctggcggcagcgcaaaagatg

SEQ ID NO: 73812 - DNA, 103 bp, Artificial Sequence
  Synthetic Polynucleotide
taatacgactcactatagggatggttgaatcatttattgaagtgatttcaaacagaggagatgaaatatgttcaataaaaacctggcggcagcgcaaaagatg

SEQ ID NO: 73813 - DNA, 103 bp, Artificial Sequence
  Synthetic Polynucleotide
taatacgactcactatagggcactcatggttgaatcatttattgaagtgaaacagaggagatcacttatgtaaatgattaacctggcggcagcgcaaaagatg

SEQ ID NO: 73814 - DNA, 103 bp, Artificial Sequence
  Synthetic Polynucleotide
taatacgactcactatagggaaccatctaggtataggtatcgttaaagataacagaggagaatctttatggatacctataacctggcggcagcgcaaaagatg

SEQ ID NO: 73815 - DNA, 103 bp, Artificial Sequence
  Synthetic Polynucleotide
taatacgactcactatagggtttcacactcatggttgaatcatttattgaaacagaggagatcaataatggattcaaccaacctggcggcagcgcaaaagatg

SEQ ID NO: 73816 - DNA, 103 bp, Artificial Sequence
  Synthetic Polynucleotide
taatacgactcactatagggcttagtttcacactcatggttgaatcatttaacagaggagaaaatgaatgaaccatgagaacctggcggcagcgcaaaagatg

SEQ ID NO: 73817 - DNA, 103 bp, Artificial Sequence
  Synthetic Polynucleotide
taatacgactcactatagggctagacttagtttcacactcatggttgaataacagaggagaattcaaatgtgagtgtgaaacctggcggcagcgcaaaagatg

SEQ ID NO: 73818 - DNA, 103 bp, Artificial Sequence
  Synthetic Polynucleotide
taatacgactcactatagggtaatactagacttagtttcacactcatggtaacagaggagaaccatgatggtgaaactaaacctggcggcagcgcaaaagatg

SEQ ID NO: 73819 - DNA, 103 bp, Artificial Sequence
  Synthetic Polynucleotide
taatacgactcactatagggatgagtaatactagacttagtttcacactcaacagaggagagagtgtatgactaagtctaacctggcggcagcgcaaaagatg

SEQ ID NO: 73820 - DNA, 103 bp, Artificial Sequence
  Synthetic Polynucleotide
taatacgactcactatagggaatgcatgagtaatactagacttagtttcaaacagaggagatgaaacatggtctagtataacctggcggcagcgcaaaagatg

SEQ ID NO: 73821 - DNA, 103 bp, Artificial Sequence
  Synthetic Polynucleotide
taatacgactcactatagggtaacaaatgcatgagtaatactagacttagaacagaggagactaagtatggtattactcaacctggcggcagcgcaaaagatg

SEQ ID NO: 73822 - DNA, 103 bp, Artificial Sequence
  Synthetic Polynucleotide
taatacgactcactatagggataactaacaaatgcatgagtaatactagaaacagaggagatctagtatgactcatgcaaacctggcggcagcgcaaaagatg

SEQ ID NO: 73823 - DNA, 103 bp, Artificial Sequence
  Synthetic Polynucleotide
taatacgactcactatagggtccgaataactaacaaatgcatgagtaataaacagaggagatattacatgtgcatttgtaacctggcggcagcgcaaaagatg

SEQ ID NO: 73824 - DNA, 103 bp, Artificial Sequence
  Synthetic Polynucleotide
taatacgactcactatagggcgcgctccgaataactaacaaatgcatgagaacagaggagactcatgatgttgttagttaacctggcggcagcgcaaaagatg

SEQ ID NO: 73825 - DNA, 103 bp, Artificial Sequence
  Synthetic Polynucleotide
taatacgactcactatagggtaaataaccatctaggtataggtatcgttaaacagaggagataacgaatgctatacctaaacctggcggcagcgcaaaagatg

SEQ ID NO: 73826 - DNA, 103 bp, Artificial Sequence
  Synthetic Polynucleotide
taatacgactcactatagggaattgcgcgctccgaataactaacaaatgcaacagaggagagcatttatgagttattcgaacctggcggcagcgcaaaagatg

SEQ ID NO: 73827 - DNA, 103 bp, Artificial Sequence
  Synthetic Polynucleotide
taatacgactcactatagggttaaaaattgcgcgctccgaataactaacaaacagaggagatgttagatgttcggagcgaacctggcggcagcgcaaaagatg

SEQ ID NO: 73828 - DNA, 103 bp, Artificial Sequence
  Synthetic Polynucleotide
taatacgactcactatagggacagtttaaaaattgcgcgctccgaataacaacagaggagagttattatgagcgcgcaaaacctggcggcagcgcaaaagatg

SEQ ID NO: 73829 - DNA, 103 bp, Artificial Sequence
  Synthetic Polynucleotide
taatacgactcactatagggataggacagtttaaaaattgcgcgctccgaaacagaggagatcggagatggcaatttttaacctggcggcagcgcaaaagatg

SEQ ID NO: 73830 - DNA, 103 bp, Artificial Sequence
  Synthetic Polynucleotide
taatacgactcactatagggaggttataggacagtttaaaaattgcgcgcaacagaggagagcgcgcatgttttaaactaacctggcggcagcgcaaaagatg

SEQ ID NO: 73831 - DNA, 103 bp, Artificial Sequence
  Synthetic Polynucleotide
taatacgactcactatagggaggagaggttataggacagtttaaaaattgaacagaggagacaatttatgaactgtcctaacctggcggcagcgcaaaagatg

SEQ ID NO: 73832 - DNA, 103 bp, Artificial Sequence
  Synthetic Polynucleotide
taatacgactcactatagggcatataggagaggttataggacagtttaaaaacagaggagatttaaaatgtcctataacaacctggcggcagcgcaaaagatg

SEQ ID NO: 73833 - DNA, 103 bp, Artificial Sequence
  Synthetic Polynucleotide
taatacgactcactatagggctattcatataggagaggttataggacagtaacagaggagaactgtcatgtaacctctcaacctggcggcagcgcaaaagatg

SEQ ID NO: 73834 - DNA, 103 bp, Artificial Sequence
  Synthetic Polynucleotide
taatacgactcactatagggttgtgctattcatataggagaggttataggaacagaggagacctataatgtctcctataaacctggcggcagcgcaaaagatg

SEQ ID NO: 73835 - DNA, 103 bp, Artificial Sequence
  Synthetic Polynucleotide
taatacgactcactataggggtcacttgtgctattcatataggagaggttaacagaggagaaacctcatgtatatgaataacctggcggcagcgcaaaagatg

SEQ ID NO: 73836 - DNA, 103 bp, Artificial Sequence
  Synthetic Polynucleotide
taatacgactcactataggggttagtaaataaccatctaggtataggtataacagaggagaatacctatgcctagatggaacctggcggcagcgcaaaagatg

SEQ ID NO: 73837 - DNA, 103 bp, Artificial Sequence
  Synthetic Polynucleotide
taatacgactcactatagggctaatgtcacttgtgctattcatataggagaacagaggagactcctaatggaatagcacaacctggcggcagcgcaaaagatg

SEQ ID NO: 73838 - DNA, 103 bp, Artificial Sequence
  Synthetic Polynucleotide
taatacgactcactatagggccctactaatgtcacttgtgctattcatataacagaggagaatatgaatggcacaagtgaacctggcggcagcgcaaaagatg

SEQ ID NO: 73839 - DNA, 103 bp, Artificial Sequence
  Synthetic Polynucleotide
taatacgactcactatagggtctatccctactaatgtcacttgtgctattaacagaggagaaatagcatgagtgacattaacctggcggcagcgcaaaagatg

SEQ ID NO: 73840 - DNA, 103 bp, Artificial Sequence
  Synthetic Polynucleotide
taatacgactcactatagggaacattctatccctactaatgtcacttgtgaacagaggagacacaagatgcattagtagaacctggcggcagcgcaaaagatg

SEQ ID NO: 73841 - DNA, 103 bp, Artificial Sequence
  Synthetic Polynucleotide
taatacgactcactatagggagctcaacattctatccctactaatgtcacaacagaggagagtgacaatggtagggataaacctggcggcagcgcaaaagatg

SEQ ID NO: 73842 - DNA, 103 bp, Artificial Sequence
  Synthetic Polynucleotide
taatacgactcactatagggaaattagctcaacattctatccctactaataacagaggagaattagtatggatagaatgaacctggcggcagcgcaaaagatg

SEQ ID NO: 73843 - DNA, 103 bp, Artificial Sequence
  Synthetic Polynucleotide
taatacgactcactatagggtacaaaaattagctcaacattctatccctaaacagaggagatagggaatgaatgttgagaacctggcggcagcgcaaaagatg

SEQ ID NO: 73844 - DNA, 103 bp, Artificial Sequence
  Synthetic Polynucleotide
taatacgactcactatagggttatttacaaaaattagctcaacattctataacagaggagaatagaaatgtgagctaataacctggcggcagcgcaaaagatg

SEQ ID NO: 73845 - DNA, 103 bp, Artificial Sequence
  Synthetic Polynucleotide
taatacgactcactataggggatagttatttacaaaaattagctcaacataacagaggagaatgttgatgtaatttttgaacctggcggcagcgcaaaagatg

SEQ ID NO: 73846 - DNA, 103 bp, Artificial Sequence
  Synthetic Polynucleotide
taatacgactcactatagggttatagatagttatttacaaaaattagctcaacagaggagagagctaatgtttgtaaataacctggcggcagcgcaaaagatg

SEQ ID NO: 73847 - DNA, 103 bp, Artificial Sequence
  Synthetic Polynucleotide
taatacgactcactatagggtgtctgttagtaaataaccatctaggtataaacagaggagatataccatgatggttattaacctggcggcagcgcaaaagatg

SEQ ID NO: 73848 - DNA, 103 bp, Artificial Sequence
  Synthetic Polynucleotide
taatacgactcactatagggtctttttatagatagttatttacaaaaattaacagaggagaaattttatgaaataactaaacctggcggcagcgcaaaagatg

SEQ ID NO: 73849 - DNA, 103 bp, Artificial Sequence
  Synthetic Polynucleotide
taatacgactcactatagggtataatctttttatagatagttatttacaaaacagaggagattgtaaatgactatctataacctggcggcagcgcaaaagatg

SEQ ID NO: 73850 - DNA, 103 bp, Artificial Sequence
  Synthetic Polynucleotide
taatacgactcactatagggctttgtataatctttttatagatagttattaacagaggagaaataacatgctataaaaaaacctggcggcagcgcaaaagatg

SEQ ID NO: 73851 - DNA, 103 bp, Artificial Sequence
  Synthetic Polynucleotide
taatacgactcactatagggtaaaactttgtataatctttttatagatagaacagaggagactatctatgaaaagattaaacctggcggcagcgcaaaagatg

SEQ ID NO: 73852 - DNA, 103 bp, Artificial Sequence
  Synthetic Polynucleotide
taatacgactcactataggggagtttaaaactttgtataatctttttataaacagaggagatataaaatgattatacaaaacctggcggcagcgcaaaagatg

SEQ ID NO: 73853 - DNA, 103 bp, Artificial Sequence
  Synthetic Polynucleotide
taatacgactcactatagggctaaagagtttaaaactttgtataatctttaacagaggagaaaagatatgacaaagtttaacctggcggcagcgcaaaagatg

SEQ ID NO: 73854 - DNA, 103 bp, Artificial Sequence
  Synthetic Polynucleotide
taatacgactcactatagggagaaactaaagagtttaaaactttgtataaaacagaggagattatacatggttttaaacaacctggcggcagcgcaaaagatg

SEQ ID NO: 73855 - DNA, 103 bp, Artificial Sequence
  Synthetic Polynucleotide
taatacgactcactatagggatggcagaaactaaagagtttaaaactttgaacagaggagacaaagtatgaaactctttaacctggcggcagcgcaaaagatg

SEQ ID NO: 73856 - DNA, 103 bp, Artificial Sequence
  Synthetic Polynucleotide
taatacgactcactataggggataaatggcagaaactaaagagtttaaaaaacagaggagattttaaatgctttagtttaacctggcggcagcgcaaaagatg

SEQ ID NO: 73857 - DNA, 103 bp, Artificial Sequence
  Synthetic Polynucleotide
taatacgactcactataggggactggataaatggcagaaactaaagagttaacagaggagaaactctatggtttctgccaacctggcggcagcgcaaaagatg

SEQ ID NO: 73858 - DNA, 103 bp, Artificial Sequence
  Synthetic Polynucleotide
taatacgactcactataggggaaaatgtctgttagtaaataaccatctagaacagaggagactagatatgtatttactaaacctggcggcagcgcaaaagatg

SEQ ID NO: 73859 - DNA, 103 bp, Artificial Sequence
  Synthetic Polynucleotide
taatacgactcactatagggtctcagactggataaatggcagaaactaaaaacagaggagatttagtatgtgccatttaaacctggcggcagcgcaaaagatg

SEQ ID NO: 73860 - DNA, 103 bp, Artificial Sequence
  Synthetic Polynucleotide
taatacgactcactatagggcattttctcagactggataaatggcagaaaaacagaggagatttctgatgtttatccagaacctggcggcagcgcaaaagatg

SEQ ID NO: 73861 - DNA, 103 bp, Artificial Sequence
  Synthetic Polynucleotide
taatacgactcactatagggagggacattttctcagactggataaatggcaacagaggagagccattatgccagtctgaaacctggcggcagcgcaaaagatg

SEQ ID NO: 73862 - DNA, 103 bp, Artificial Sequence
  Synthetic Polynucleotide
taatacgactcactatagggttatgagggacattttctcagactggataaaacagaggagattatccatgctgagaaaaaacctggcggcagcgcaaaagatg

SEQ ID NO: 73863 - DNA, 103 bp, Artificial Sequence
  Synthetic Polynucleotide
taatacgactcactatagggatttattatgagggacattttctcagactgaacagaggagacagtctatgaaaatgtccaacctggcggcagcgcaaaagatg

SEQ ID NO: 73864 - DNA, 103 bp, Artificial Sequence
  Synthetic Polynucleotide
taatacgactcactataggggaaaaatttattatgagggacattttctcaaacagaggagatgagaaatggtccctcataacctggcggcagcgcaaaagatg

SEQ ID NO: 73865 - DNA, 103 bp, Artificial Sequence
  Synthetic Polynucleotide
taatacgactcactatagggtcttggaaaaatttattatgagggacatttaacagaggagaaaatgtatgtcataataaaacctggcggcagcgcaaaagatg

SEQ ID NO: 73866 - DNA, 103 bp, Artificial Sequence
  Synthetic Polynucleotide
taatacgactcactatagggtagtttcttggaaaaatttattatgagggaaacagaggagatccctcatgataaattttaacctggcggcagcgcaaaagatg

SEQ ID NO: 73867 - DNA, 103 bp, Artificial Sequence
  Synthetic Polynucleotide
taatacgactcactatagggccaattagtttcttggaaaaatttattatgaacagaggagacataatatgtttttccaaaacctggcggcagcgcaaaagatg

SEQ ID NO: 73868 - DNA, 103 bp, Artificial Sequence
  Synthetic Polynucleotide
taatacgactcactatagggttcacccaattagtttcttggaaaaatttaaacagaggagataaattatgccaagaaacaacctggcggcagcgcaaaagatg

SEQ ID NO: 73869 - DNA, 103 bp, Artificial Sequence
  Synthetic Polynucleotide
taatacgactcactatagggatctggaaaatgtctgttagtaaataaccaaacagaggagatggttaatgactaacagaaacctggcggcagcgcaaaagatg

SEQ ID NO: 73870 - DNA, 103 bp, Artificial Sequence
  Synthetic Polynucleotide
taatacgactcactatagggcattcttcacccaattagtttcttggaaaaaacagaggagattttccatgaaactaattaacctggcggcagcgcaaaagatg

SEQ ID NO: 73871 - DNA, 103 bp, Artificial Sequence
  Synthetic Polynucleotide
taatacgactcactataggggtttccattcttcacccaattagtttcttgaacagaggagacaagaaatgaattgggtgaacctggcggcagcgcaaaagatg

SEQ ID NO: 73872 - DNA, 103 bp, Artificial Sequence
  Synthetic Polynucleotide
taatacgactcactatagggtaaaggtttccattcttcacccaattagttaacagaggagaaactaaatgggtgaagaaaacctggcggcagcgcaaaagatg

SEQ ID NO: 73873 - DNA, 103 bp, Artificial Sequence
  Synthetic Polynucleotide
taatacgactcactatagggtagattaaaggtttccattcttcacccaataacagaggagaattgggatgagaatggaaaacctggcggcagcgcaaaagatg

SEQ ID NO: 73874 - DNA, 103 bp, Artificial Sequence
  Synthetic Polynucleotide
taatacgactcactatagggaaatatagattaaaggtttccattcttcacaacagaggagagtgaagatgggaaaccttaacctggcggcagcgcaaaagatg

SEQ ID NO: 73875 - DNA, 103 bp, Artificial Sequence
  Synthetic Polynucleotide
taatacgactcactataggggtgataaatatagattaaaggtttccattcaacagaggagagaatggatgcctttaatcaacctggcggcagcgcaaaagatg

SEQ ID NO: 73876 - DNA, 103 bp, Artificial Sequence
  Synthetic Polynucleotide
taatacgactcactatagggagactgtgataaatatagattaaaggtttcaacagaggagagaaaccatgaatctatataacctggcggcagcgcaaaagatg

SEQ ID NO: 73877 - DNA, 103 bp, Artificial Sequence
  Synthetic Polynucleotide
taatacgactcactatagggaaaacagactgtgataaatatagattaaagaacagaggagactttaaatgatatttatcaacctggcggcagcgcaaaagatg

SEQ ID NO: 73878 - DNA, 103 bp, Artificial Sequence
  Synthetic Polynucleotide
taatacgactcactataggggtaccaaaacagactgtgataaatatagataacagaggagaatctatatgtatcacagtaacctggcggcagcgcaaaagatg

SEQ ID NO: 73879 - DNA, 103 bp, Artificial Sequence
  Synthetic Polynucleotide
taatacgactcactatagggcatgtgtaccaaaacagactgtgataaataaacagaggagatatttaatgcagtctgttaacctggcggcagcgcaaaagatg

SEQ ID NO: 73880 - DNA, 103 bp, Artificial Sequence
  Synthetic Polynucleotide
taatacgactcactatagggaatagatctggaaaatgtctgttagtaaataacagaggagaatttacatgcagacatttaacctggcggcagcgcaaaagatg

SEQ ID NO: 73881 - DNA, 103 bp, Artificial Sequence
  Synthetic Polynucleotide
taatacgactcactatagggttcatcatgtgtaccaaaacagactgtgataacagaggagaatcacaatgtgttttggtaacctggcggcagcgcaaaagatg

SEQ ID NO: 73882 - DNA, 103 bp, Artificial Sequence
  Synthetic Polynucleotide
taatacgactcactatagggaagaattcatcatgtgtaccaaaacagactaacagaggagaagtctgatgtggtacacaaacctggcggcagcgcaaaagatg

SEQ ID NO: 73883 - DNA, 103 bp, Artificial Sequence
  Synthetic Polynucleotide
taatacgactcactatagggattagaagaattcatcatgtgtaccaaaacaacagaggagagttttgatgcacatgatgaacctggcggcagcgcaaaagatg

SEQ ID NO: 73884 - DNA, 103 bp, Artificial Sequence
  Synthetic Polynucleotide
taatacgactcactatagggacagcattagaagaattcatcatgtgtaccaacagaggagaggtacaatggatgaattcaacctggcggcagcgcaaaagatg

SEQ ID NO: 73885 - DNA, 103 bp, Artificial Sequence
  Synthetic Polynucleotide
taatacgactcactatagggttagtacagcattagaagaattcatcatgtaacagaggagaacatgaatgattcttctaaacctggcggcagcgcaaaagatg

SEQ ID NO: 73886 - DNA, 103 bp, Artificial Sequence
  Synthetic Polynucleotide
taatacgactcactatagggtgaatttagtacagcattagaagaattcataacagaggagaatgaatatgtctaatgctaacctggcggcagcgcaaaagatg

SEQ ID NO: 73887 - DNA, 103 bp, Artificial Sequence
  Synthetic Polynucleotide
taatacgactcactataggggatattgaatttagtacagcattagaagaaaacagaggagattcttcatgtgctgtactaacctggcggcagcgcaaaagatg

SEQ ID NO: 73888 - DNA, 103 bp, Artificial Sequence
  Synthetic Polynucleotide
taatacgactcactatagggaaaaagatattgaatttagtacagcattagaacagaggagactaatgatgtactaaattaacctggcggcagcgcaaaagatg

SEQ ID NO: 73889 - DNA, 103 bp, Artificial Sequence
  Synthetic Polynucleotide
taatacgactcactatagggaatcgaaaaagatattgaatttagtacagcaacagaggagagctgtaatgaattcaataaacctggcggcagcgcaaaagatg

SEQ ID NO: 73890 - DNA, 103 bp, Artificial Sequence
  Synthetic Polynucleotide
taatacgactcactatagggccagaaatcgaaaaagatattgaatttagtaacagaggagaactaaaatgaatatctttaacctggcggcagcgcaaaagatg

SEQ ID NO: 73891 - DNA, 103 bp, Artificial Sequence
  Synthetic Polynucleotide
taatacgactcactatagggtagtcaatagatctggaaaatgtctgttagaacagaggagactaacaatgattttccagaacctggcggcagcgcaaaagatg

SEQ ID NO: 73892 - DNA, 103 bp, Artificial Sequence
  Synthetic Polynucleotide
taatacgactcactatagggcatatccagaaatcgaaaaagatattgaataacagaggagaattcaaatgctttttcgaaacctggcggcagcgcaaaagatg

SEQ ID NO: 73893 - DNA, 103 bp, Artificial Sequence
  Synthetic Polynucleotide
taatacgactcactatagggaaaaacatatccagaaatcgaaaaagatataacagaggagaatatctatgtcgatttctaacctggcggcagcgcaaaagatg

SEQ ID NO: 73894 - DNA, 103 bp, Artificial Sequence
  Synthetic Polynucleotide
taatacgactcactatagggttattaaaaacatatccagaaatcgaaaaaaacagaggagatttttcatgttctggataaacctggcggcagcgcaaaagatg

SEQ ID NO: 73895 - DNA, 103 bp, Artificial Sequence
  Synthetic Polynucleotide
taatacgactcactatagggatactttattaaaaacatatccagaaatcgaacagaggagacgatttatggatatgtttaacctggcggcagcgcaaaagatg

SEQ ID NO: 73896 - DNA, 103 bp, Artificial Sequence
  Synthetic Polynucleotide
taatacgactcactatagggtgttcatactttattaaaaacatatccagaaacagaggagatctggaatggtttttaataacctggcggcagcgcaaaagatg

SEQ ID NO: 73897 - DNA, 103 bp, Artificial Sequence
  Synthetic Polynucleotide
taatacgactcactatagggttctttgttcatactttattaaaaacatataacagaggagaatatgtatgtaataaagtaacctggcggcagcgcaaaagatg

SEQ ID NO: 73898 - DNA, 103 bp, Artificial Sequence
  Synthetic Polynucleotide
taatacgactcactatagggtccatttctttgttcatactttattaaaaaaacagaggagatttttaatgaagtatgaaaacctggcggcagcgcaaaagatg

SEQ ID NO: 73899 - DNA, 103 bp, Artificial Sequence
  Synthetic Polynucleotide
taatacgactcactatagggcgatttccatttctttgttcatactttattaacagaggagaaataaaatgtgaacaaagaacctggcggcagcgcaaaagatg

SEQ ID NO: 73900 - DNA, 103 bp, Artificial Sequence
  Synthetic Polynucleotide
taatacgactcactatagggtattacgatttccatttctttgttcatactaacagaggagaagtatgatgaaagaaatgaacctggcggcagcgcaaaagatg

SEQ ID NO: 73901 - DNA, 103 bp, Artificial Sequence
  Synthetic Polynucleotide
taatacgactcactatagggactggtattacgatttccatttctttgttcaacagaggagagaacaaatgaatggaaataacctggcggcagcgcaaaagatg

SEQ ID NO: 73902 - DNA, 103 bp, Artificial Sequence
  Synthetic Polynucleotide
taatacgactcactatagggattatcttatgaggaatgattgccttcatcaacagaggagagatgaaatgaatcattccaacctggcggcagcgcaaaagatg

SEQ ID NO: 73903 - DNA, 103 bp, Artificial Sequence
  Synthetic Polynucleotide
taatacgactcactatagggagttatagtcaatagatctggaaaatgtctaacagaggagaagacatatgccagatctaaacctggcggcagcgcaaaagatg

SEQ ID NO: 73904 - DNA, 103 bp, Artificial Sequence
  Synthetic Polynucleotide
taatacgactcactatagggacataactggtattacgatttccatttcttaacagaggagaaagaaaatgaaatcgtaaaacctggcggcagcgcaaaagatg

SEQ ID NO: 73905 - DNA, 103 bp, Artificial Sequence
  Synthetic Polynucleotide
taatacgactcactataggggttgaacataactggtattacgatttccataacagaggagaatggaaatggtaataccaaacctggcggcagcgcaaaagatg

SEQ ID NO: 73906 - DNA, 103 bp, Artificial Sequence
  Synthetic Polynucleotide
taatacgactcactatagggtcaaagttgaacataactggtattacgattaacagaggagaaatcgtatgaccagttataacctggcggcagcgcaaaagatg

SEQ ID NO: 73907 - DNA, 103 bp, Artificial Sequence
  Synthetic Polynucleotide
taatacgactcactatagggcaatttcaaagttgaacataactggtattaaacagaggagataatacatgttatgttcaaacctggcggcagcgcaaaagatg

SEQ ID NO: 73908 - DNA, 103 bp, Artificial Sequence
  Synthetic Polynucleotide
taatacgactcactatagggaaaaacaatttcaaagttgaacataactggaacagaggagaccagttatgttcaactttaacctggcggcagcgcaaaagatg

SEQ ID NO: 73909 - DNA, 103 bp, Artificial Sequence
  Synthetic Polynucleotide
taatacgactcactatagggaaataaaaaacaatttcaaagttgaacataaacagaggagatatgttatgctttgaaataacctggcggcagcgcaaaagatg

SEQ ID NO: 73910 - DNA, 103 bp, Artificial Sequence
  Synthetic Polynucleotide
taatacgactcactatagggcaagaaaataaaaaacaatttcaaagttgaaacagaggagatcaactatgaaattgtttaacctggcggcagcgcaaaagatg

SEQ ID NO: 73911 - DNA, 103 bp, Artificial Sequence
  Synthetic Polynucleotide
taatacgactcactatagggattaacaagaaaataaaaaacaatttcaaaaacagaggagatttgaaatggttttttataacctggcggcagcgcaaaagatg

SEQ ID NO: 73912 - DNA, 103 bp, Artificial Sequence
  Synthetic Polynucleotide
taatacgactcactataggggaatcattaacaagaaaataaaaaacaattaacagaggagaaattgtatgttattttctaacctggcggcagcgcaaaagatg

SEQ ID NO: 73913 - DNA, 103 bp, Artificial Sequence
  Synthetic Polynucleotide
taatacgactcactatagggggctggaatcattaacaagaaaataaaaaaaacagaggagattttttatgttcttgttaaacctggcggcagcgcaaaagatg

SEQ ID NO: 73914 - DNA, 103 bp, Artificial Sequence
  Synthetic Polynucleotide
taatacgactcactatagggataggagttatagtcaatagatctggaaaaaacagaggagattttccatgtctattgacaacctggcggcagcgcaaaagatg

SEQ ID NO: 73915 - DNA, 103 bp, Artificial Sequence
  Synthetic Polynucleotide
taatacgactcactatagggcaagtggctggaatcattaacaagaaaataaacagaggagatattttatggttaatgataacctggcggcagcgcaaaagatg

SEQ ID NO: 73916 - DNA, 103 bp, Artificial Sequence
  Synthetic Polynucleotide
taatacgactcactatagggtttcccaagtggctggaatcattaacaagaaacagaggagatcttgtatgtgattccagaacctggcggcagcgcaaaagatg

SEQ ID NO: 73917 - DNA, 103 bp, Artificial Sequence
  Synthetic Polynucleotide
taatacgactcactatagggtgacttttcccaagtggctggaatcattaaaacagaggagattaatgatgccagccactaacctggcggcagcgcaaaagatg

SEQ ID NO: 73918 - DNA, 103 bp, Artificial Sequence
  Synthetic Polynucleotide
taatacgactcactataggggactttgacttttcccaagtggctggaatcaacagaggagagattccatgcacttgggaaacctggcggcagcgcaaaagatg

SEQ ID NO: 73919 - DNA, 103 bp, Artificial Sequence
  Synthetic Polynucleotide
taatacgactcactatagggtaaacgactttgacttttcccaagtggctgaacagaggagacagccaatggggaaaagtaacctggcggcagcgcaaaagatg

SEQ ID NO: 73920 - DNA, 103 bp, Artificial Sequence
  Synthetic Polynucleotide
taatacgactcactatagggggcattaaacgactttgacttttcccaagtaacagaggagaacttggatgaagtcaaagaacctggcggcagcgcaaaagatg

SEQ ID NO: 73921 - DNA, 103 bp, Artificial Sequence
  Synthetic Polynucleotide
taatacgactcactatagggaaatcggcattaaacgactttgacttttccaacagaggagaggaaaaatgaaagtcgttaacctggcggcagcgcaaaagatg

SEQ ID NO: 73922 - DNA, 103 bp, Artificial Sequence
  Synthetic Polynucleotide
taatacgactcactataggggtattaaatcggcattaaacgactttgactaacagaggagaagtcaaatgcgtttaatgaacctggcggcagcgcaaaagatg

SEQ ID NO: 73923 - DNA, 103 bp, Artificial Sequence
  Synthetic Polynucleotide
taatacgactcactatagggtgaacgtattaaatcggcattaaacgacttaacagaggagaaagtcgatgaatgccgataacctggcggcagcgcaaaagatg

SEQ ID NO: 73924 - DNA, 103 bp, Artificial Sequence
  Synthetic Polynucleotide
taatacgactcactatagggtttaatgaacgtattaaatcggcattaaacaacagaggagagtttaaatgcgatttaataacctggcggcagcgcaaaagatg

SEQ ID NO: 73925 - DNA, 103 bp, Artificial Sequence
  Synthetic Polynucleotide
taatacgactcactatagggaaactataggagttatagtcaatagatctgaacagaggagacagatcatgtgactataaaacctggcggcagcgcaaaagatg

SEQ ID NO: 73926 - DNA, 103 bp, Artificial Sequence
  Synthetic Polynucleotide
taatacgactcactatagggttgtttttaatgaacgtattaaatcggcataacagaggagaatgccgatgtaatacgttaacctggcggcagcgcaaaagatg

SEQ ID NO: 73927 - DNA, 103 bp, Artificial Sequence
  Synthetic Polynucleotide
taatacgactcactatagggaaagtttgtttttaatgaacgtattaaatcaacagaggagagatttaatgcgttcattaaacctggcggcagcgcaaaagatg

SEQ ID NO: 73928 - DNA, 103 bp, Artificial Sequence
  Synthetic Polynucleotide
taatacgactcactataggggataaaaagtttgtttttaatgaacgtattaacagaggagaaatacgatgattaaaaacaacctggcggcagcgcaaaagatg

SEQ ID NO: 73929 - DNA, 103 bp, Artificial Sequence
  Synthetic Polynucleotide
taatacgactcactatagggtaaaggataaaaagtttgtttttaatgaacaacagaggagagttcatatgaaacaaactaacctggcggcagcgcaaaagatg

SEQ ID NO: 73930 - DNA, 103 bp, Artificial Sequence
  Synthetic Polynucleotide
taatacgactcactatagggtcatctaaaggataaaaagtttgtttttaaaacagaggagattaaaaatgaactttttaaacctggcggcagcgcaaaagatg

SEQ ID NO: 73931 - DNA, 103 bp, Artificial Sequence
  Synthetic Polynucleotide
taatacgactcactatagggataattcatctaaaggataaaaagtttgttaacagaggagaaacaaaatgtttatccttaacctggcggcagcgcaaaagatg

SEQ ID NO: 73932 - DNA, 103 bp, Artificial Sequence
  Synthetic Polynucleotide
taatacgactcactatagggcaataataattcatctaaaggataaaaagtaacagaggagaacttttatgcctttagataacctggcggcagcgcaaaagatg

SEQ ID NO: 73933 - DNA, 103 bp, Artificial Sequence
  Synthetic Polynucleotide
taatacgactcactatagggtgaaccaataataattcatctaaaggataaaacagaggagattatccatgagatgaattaacctggcggcagcgcaaaagatg

SEQ ID NO: 73934 - DNA, 103 bp, Artificial Sequence
  Synthetic Polynucleotide
taatacgactcactatagggtccaatgaaccaataataattcatctaaagaacagaggagactttagatgaattattataacctggcggcagcgcaaaagatg

SEQ ID NO: 73935 - DNA, 103 bp, Artificial Sequence
  Synthetic Polynucleotide
taatacgactcactatagggttgattccaatgaaccaataataattcatcaacagaggagagatgaaatgttattggttaacctggcggcagcgcaaaagatg

SEQ ID NO: 73936 - DNA, 103 bp, Artificial Sequence
  Synthetic Polynucleotide
taatacgactcactatagggtgtggaaactataggagttatagtcaatagaacagaggagactattgatgataactcctaacctggcggcagcgcaaaagatg

SEQ ID NO: 73937 - DNA, 103 bp, Artificial Sequence
  Synthetic Polynucleotide
taatacgactcactatagggactttttgattccaatgaaccaataataataacagaggagaattattatgggttcattgaacctggcggcagcgcaaaagatg

SEQ ID NO: 73938 - DNA, 103 bp, Artificial Sequence
  Synthetic Polynucleotide
taatacgactcactatagggatcttactttttgattccaatgaaccaataaacagaggagatattggatgattggaatcaacctggcggcagcgcaaaagatg

SEQ ID NO: 73939 - DNA, 103 bp, Artificial Sequence
  Synthetic Polynucleotide
taatacgactcactatagggataatatcttactttttgattccaatgaacaacagaggagagttcatatgaatcaaaaaaacctggcggcagcgcaaaagatg

SEQ ID NO: 73940 - DNA, 103 bp, Artificial Sequence
  Synthetic Polynucleotide
taatacgactcactatagggacccgataatatcttactttttgattccaaaacagaggagattggaaatgaaaagtaagaacctggcggcagcgcaaaagatg

SEQ ID NO: 73941 - DNA, 103 bp, Artificial Sequence
  Synthetic Polynucleotide
taatacgactcactatagggcttaaacccgataatatcttactttttgataacagaggagaatcaaaatgtaagatattaacctggcggcagcgcaaaagatg

SEQ ID NO: 73942 - DNA, 103 bp, Artificial Sequence
  Synthetic Polynucleotide
taatacgactcactatagggcagatcttaaacccgataatatcttactttaacagaggagaaaagtaatgtattatcggaacctggcggcagcgcaaaagatg

SEQ ID NO: 73943 - DNA, 103 bp, Artificial Sequence
  Synthetic Polynucleotide
taatacgactcactatagggacacgcagatcttaaacccgataatatcttaacagaggagaaagataatgtcgggtttaaacctggcggcagcgcaaaagatg

SEQ ID NO: 73944 - DNA, 103 bp, Artificial Sequence
  Synthetic Polynucleotide
taatacgactcactatagggtttttacacgcagatcttaaacccgataataacagaggagaattatcatgtttaagatcaacctggcggcagcgcaaaagatg

SEQ ID NO: 73945 - DNA, 103 bp, Artificial Sequence
  Synthetic Polynucleotide
taatacgactcactatagggacaactttttacacgcagatcttaaacccgaacagaggagacgggttatggatctgcgtaacctggcggcagcgcaaaagatg

SEQ ID NO: 73946 - DNA, 103 bp, Artificial Sequence
  Synthetic Polynucleotide
taatacgactcactatagggttgcgacaactttttacacgcagatcttaaaacagaggagattaagaatggcgtgtaaaaacctggcggcagcgcaaaagatg

SEQ ID NO: 73947 - DNA, 103 bp, Artificial Sequence
  Synthetic Polynucleotide
taatacgactcactataggggttaatgtggaaactataggagttatagtcaacagaggagagactatatgtcctatagtaacctggcggcagcgcaaaagatg

SEQ ID NO: 73948 - DNA, 103 bp, Artificial Sequence
  Synthetic Polynucleotide
taatacgactcactatagggccccgttgcgacaactttttacacgcagataacagaggagaatctgcatgtaaaaagttaacctggcggcagcgcaaaagatg

SEQ ID NO: 73949 - DNA, 103 bp, Artificial Sequence
  Synthetic Polynucleotide
taatacgactcactatagggaactaccccgttgcgacaactttttacacgaacagaggagacgtgtaatgagttgtcgcaacctggcggcagcgcaaaagatg

SEQ ID NO: 73950 - DNA, 103 bp, Artificial Sequence
  Synthetic Polynucleotide
taatacgactcactatagggctacgaactaccccgttgcgacaactttttaacagaggagaaaaaagatgtcgcaacggaacctggcggcagcgcaaaagatg

SEQ ID NO: 73951 - DNA, 103 bp, Artificial Sequence
  Synthetic Polynucleotide
taatacgactcactatagggaaaatctacgaactaccccgttgcgacaacaacagaggagagttgtcatgacggggtagaacctggcggcagcgcaaaagatg

SEQ ID NO: 73952 - DNA, 103 bp, Artificial Sequence
  Synthetic Polynucleotide
taatacgactcactatagggacattaaaatctacgaactaccccgttgcgaacagaggagacgcaacatggtagttcgtaacctggcggcagcgcaaaagatg

SEQ ID NO: 73953 - DNA, 103 bp, Artificial Sequence
  Synthetic Polynucleotide
taatacgactcactataggggttatacattaaaatctacgaactaccccgaacagaggagacggggtatgtcgtagattaacctggcggcagcgcaaaagatg

SEQ ID NO: 73954 - DNA, 103 bp, Artificial Sequence
  Synthetic Polynucleotide
taatacgactcactataggggctctgttatacattaaaatctacgaactaaacagaggagatagttcatggattttaataacctggcggcagcgcaaaagatg

SEQ ID NO: 73955 - DNA, 103 bp, Artificial Sequence
  Synthetic Polynucleotide
taatacgactcactatagggagatggctctgttatacattaaaatctacgaacagaggagacgtagaatgtaatgtataaacctggcggcagcgcaaaagatg

SEQ ID NO: 73956 - DNA, 103 bp, Artificial Sequence
  Synthetic Polynucleotide
taatacgactcactatagggtttacagatggctctgttatacattaaaataacagaggagaattttaatgtataacagaaacctggcggcagcgcaaaagatg

SEQ ID NO: 73957 - DNA, 103 bp, Artificial Sequence
  Synthetic Polynucleotide
taatacgactcactatagggatctttttacagatggctctgttatacattaacagaggagaaatgtaatgcagagccataacctggcggcagcgcaaaagatg

SEQ ID NO: 73958 - DNA, 103 bp, Artificial Sequence
  Synthetic Polynucleotide
taatacgactcactatagggacttggttaatgtggaaactataggagttaaacagaggagataactcatgtagtttccaaacctggcggcagcgcaaaagatg

SEQ ID NO: 73959 - DNA, 103 bp, Artificial Sequence
  Synthetic Polynucleotide
taatacgactcactatagggagtttatctttttacagatggctctgttataacagaggagaataacaatgccatctgtaaacctggcggcagcgcaaaagatg

SEQ ID NO: 73960 - DNA, 103 bp, Artificial Sequence
  Synthetic Polynucleotide
taatacgactcactatagggcataaagtttatctttttacagatggctctaacagaggagaagagccatgtgtaaaaagaacctggcggcagcgcaaaagatg

SEQ ID NO: 73961 - DNA, 103 bp, Artificial Sequence
  Synthetic Polynucleotide
taatacgactcactatagggcaatacataaagtttatctttttacagatgaacagaggagacatctgatgaaagataaaaacctggcggcagcgcaaaagatg

SEQ ID NO: 73962 - DNA, 103 bp, Artificial Sequence
  Synthetic Polynucleotide
taatacgactcactatagggtggtacaatacataaagtttatctttttacaacagaggagagtaaaaatgtaaactttaaacctggcggcagcgcaaaagatg

SEQ ID NO: 73963 - DNA, 103 bp, Artificial Sequence
  Synthetic Polynucleotide
taatacgactcactatagggatctttggtacaatacataaagtttatcttaacagaggagaaagataatgtttatgtataacctggcggcagcgcaaaagatg

SEQ ID NO: 73964 - DNA, 103 bp, Artificial Sequence
  Synthetic Polynucleotide
taatacgactcactatagggtttaaatctttggtacaatacataaagtttaacagaggagaaaacttatggtattgtacaacctggcggcagcgcaaaagatg

SEQ ID NO: 73965 - DNA, 103 bp, Artificial Sequence
  Synthetic Polynucleotide
taatacgactcactatagggtaggatttaaatctttggtacaatacataaaacagaggagattatgtatggtaccaaagaacctggcggcagcgcaaaagatg

SEQ ID NO: 73966 - DNA, 103 bp, Artificial Sequence
  Synthetic Polynucleotide
taatacgactcactatagggtaaattaggatttaaatctttggtacaataaacagaggagatattgtatgaaagatttaaacctggcggcagcgcaaaagatg

SEQ ID NO: 73967 - DNA, 103 bp, Artificial Sequence
  Synthetic Polynucleotide
taatacgactcactataggggctattaaattaggatttaaatctttggtaaacagaggagataccaaatgtttaaatccaacctggcggcagcgcaaaagatg

SEQ ID NO: 73968 - DNA, 103 bp, Artificial Sequence
  Synthetic Polynucleotide
taatacgactcactatagggagttagctattaaattaggatttaaatcttaacagaggagaaagattatgatcctaattaacctggcggcagcgcaaaagatg

SEQ ID NO: 73969 - DNA, 103 bp, Artificial Sequence
  Synthetic Polynucleotide
taatacgactcactatagggtcattacttggttaatgtggaaactataggaacagaggagacctataatgtccacattaaacctggcggcagcgcaaaagatg

SEQ ID NO: 73970 - DNA, 103 bp, Artificial Sequence
  Synthetic Polynucleotide
taatacgactcactatagggtaccgagttagctattaaattaggatttaaaacagaggagattaaatatgaatttaataaacctggcggcagcgcaaaagatg

SEQ ID NO: 73971 - DNA, 103 bp, Artificial Sequence
  Synthetic Polynucleotide
taatacgactcactataggggtagataccgagttagctattaaattaggaaacagaggagatcctaaatgaatagctaaaacctggcggcagcgcaaaagatg

SEQ ID NO: 73972 - DNA, 103 bp, Artificial Sequence
  Synthetic Polynucleotide
taatacgactcactatagggataaagtagataccgagttagctattaaataacagaggagaatttaaatgctaactcggaacctggcggcagcgcaaaagatg

SEQ ID NO: 73973 - DNA, 103 bp, Artificial Sequence
  Synthetic Polynucleotide
taatacgactcactatagggggcagataaagtagataccgagttagctataacagaggagaatagctatgtcggtatctaacctggcggcagcgcaaaagatg

SEQ ID NO: 73974 - DNA, 103 bp, Artificial Sequence
  Synthetic Polynucleotide
taatacgactcactatagggtattcggcagataaagtagataccgagttaaacagaggagataactcatgatctactttaacctggcggcagcgcaaaagatg

SEQ ID NO: 73975 - DNA, 103 bp, Artificial Sequence
  Synthetic Polynucleotide
taatacgactcactatagggcactgtattcggcagataaagtagataccgaacagaggagacggtatatgctttatctgaacctggcggcagcgcaaaagatg

SEQ ID NO: 73976 - DNA, 103 bp, Artificial Sequence
  Synthetic Polynucleotide
taatacgactcactatagggcctagcactgtattcggcagataaagtagaaacagaggagatctactatgtctgccgaaaacctggcggcagcgcaaaagatg

SEQ ID NO: 73977 - DNA, 103 bp, Artificial Sequence
  Synthetic Polynucleotide
taatacgactcactatagggtttcccctagcactgtattcggcagataaaaacagaggagatttatcatgcgaatacagaacctggcggcagcgcaaaagatg

SEQ ID NO: 73978 - DNA, 103 bp, Artificial Sequence
  Synthetic Polynucleotide
taatacgactcactatagggtaatttttcccctagcactgtattcggcagaacagaggagactgccgatgacagtgctaaacctggcggcagcgcaaaagatg

SEQ ID NO: 73979 - DNA, 103 bp, Artificial Sequence
  Synthetic Polynucleotide
taatacgactcactatagggtattataatttttcccctagcactgtattcaacagaggagagaatacatggctaggggaaacctggcggcagcgcaaaagatg

SEQ ID NO: 73980 - DNA, 103 bp, Artificial Sequence
  Synthetic Polynucleotide
taatacgactcactataggggatgatcattacttggttaatgtggaaactaacagaggagaagtttcatgattaaccaaaacctggcggcagcgcaaaagatg

SEQ ID NO: 73981 - DNA, 103 bp, Artificial Sequence
  Synthetic Polynucleotide
taatacgactcactatagggggaaatattataatttttcccctagcactgaacagaggagacagtgcatggggaaaaataacctggcggcagcgcaaaagatg

SEQ ID NO: 73982 - DNA, 103 bp, Artificial Sequence
  Synthetic Polynucleotide
taatacgactcactatagggaaagaggaaatattataatttttcccctagaacagaggagactagggatgaaattataaaacctggcggcagcgcaaaagatg

SEQ ID NO: 73983 - DNA, 103 bp, Artificial Sequence
  Synthetic Polynucleotide
taatacgactcactatagggatacgaaagaggaaatattataatttttccaacagaggagaggaaaaatgataatatttaacctggcggcagcgcaaaagatg

SEQ ID NO: 73984 - DNA, 103 bp, Artificial Sequence
  Synthetic Polynucleotide
taatacgactcactatagggtacgaatacgaaagaggaaatattataattaacagaggagaaattatatgatttcctctaacctggcggcagcgcaaaagatg

SEQ ID NO: 73985 - DNA, 103 bp, Artificial Sequence
  Synthetic Polynucleotide
taatacgactcactatagggctaactacgaatacgaaagaggaaatattaaacagaggagataatatatgctctttcgtaacctggcggcagcgcaaaagatg

SEQ ID NO: 73986 - DNA, 103 bp, Artificial Sequence
  Synthetic Polynucleotide
taatacgactcactataggggcgaactaactacgaatacgaaagaggaaaaacagaggagatttcctatgtcgtattcgaacctggcggcagcgcaaaagatg

SEQ ID NO: 73987 - DNA, 103 bp, Artificial Sequence
  Synthetic Polynucleotide
taatacgactcactataggggaaaagcgaactaactacgaatacgaaagaaacagaggagatctttcatgttcgtagttaacctggcggcagcgcaaaagatg

SEQ ID NO: 73988 - DNA, 103 bp, Artificial Sequence
  Synthetic Polynucleotide
taatacgactcactatagggaacatgaaaagcgaactaactacgaatacgaacagaggagacgtattatgagttagttcaacctggcggcagcgcaaaagatg

SEQ ID NO: 73989 - DNA, 103 bp, Artificial Sequence
  Synthetic Polynucleotide
taatacgactcactatagggtttcgaacatgaaaagcgaactaactacgaaacagaggagatcgtagatggttcgctttaacctggcggcagcgcaaaagatg

SEQ ID NO: 73990 - DNA, 103 bp, Artificial Sequence
  Synthetic Polynucleotide
taatacgactcactatagggcactttttcgaacatgaaaagcgaactaacaacagaggagagttagtatgcttttcatgaacctggcggcagcgcaaaagatg

SEQ ID NO: 73991 - DNA, 103 bp, Artificial Sequence
  Synthetic Polynucleotide
taatacgactcactatagggcaatagatgatcattacttggttaatgtggaacagaggagaccacatatgccaagtaataacctggcggcagcgcaaaagatg

SEQ ID NO: 73992 - DNA, 103 bp, Artificial Sequence
  Synthetic Polynucleotide
taatacgactcactatagggtgtttcactttttcgaacatgaaaagcgaaaacagaggagattcgctatgcatgttcgaaacctggcggcagcgcaaaagatg

SEQ ID NO: 73993 - DNA, 103 bp, Artificial Sequence
  Synthetic Polynucleotide
taatacgactcactatagggccgcatgtttcactttttcgaacatgaaaaaacagaggagattttcaatgtcgaaaaagaacctggcggcagcgcaaaagatg

SEQ ID NO: 73994 - DNA, 103 bp, Artificial Sequence
  Synthetic Polynucleotide
taatacgactcactatagggtttaaccgcatgtttcactttttcgaacataacagaggagaatgttcatgaaagtgaaaaacctggcggcagcgcaaaagatg

SEQ ID NO: 73995 - DNA, 103 bp, Artificial Sequence
  Synthetic Polynucleotide
taatacgactcactatagggactattttaaccgcatgtttcactttttcgaacagaggagacgaaaaatggaaacatgcaacctggcggcagcgcaaaagatg

SEQ ID NO: 73996 - DNA, 103 bp, Artificial Sequence
  Synthetic Polynucleotide
taatacgactcactatagggtataaactattttaaccgcatgtttcacttaacagaggagaaagtgaatgatgcggttaaacctggcggcagcgcaaaagatg

SEQ ID NO: 73997 - DNA, 103 bp, Artificial Sequence
  Synthetic Polynucleotide
taatacgactcactatagggaatgttataaactattttaaccgcatgtttaacagaggagaaaacatatggttaaaataaacctggcggcagcgcaaaagatg

SEQ ID NO: 73998 - DNA, 103 bp, Artificial Sequence
  Synthetic Polynucleotide
taatacgactcactatagggatattaatgttataaactattttaaccgcaaacagaggagatgcggtatgaatagtttaaacctggcggcagcgcaaaagatg

SEQ ID NO: 73999 - DNA, 103 bp, Artificial Sequence
  Synthetic Polynucleotide
taatacgactcactatagggcagtaatattaatgttataaactattttaaaacagaggagattaaaaatgtttataacaaacctggcggcagcgcaaaagatg

SEQ ID NO: 74000 - DNA, 103 bp, Artificial Sequence
  Synthetic Polynucleotide
taatacgactcactatagggattaacagtaatattaatgttataaactataacagaggagaatagttatgaacattaataacctggcggcagcgcaaaagatg

SEQ ID NO: 74001 - DNA, 103 bp, Artificial Sequence
  Synthetic Polynucleotide
taatacgactcactatagggcagttattaacagtaatattaatgttataaaacagaggagattataaatgtaatattacaacctggcggcagcgcaaaagatg

SEQ ID NO: 74002 - DNA, 103 bp, Artificial Sequence
  Synthetic Polynucleotide
taatacgactcactatagggtataacaatagatgatcattacttggttaaaacagaggagattaaccatgtaatgatcaaacctggcggcagcgcaaaagatg

SEQ ID NO: 74003 - DNA, 103 bp, Artificial Sequence
  Synthetic Polynucleotide
taatacgactcactatagggtccggcagttattaacagtaatattaatgtaacagaggagaacattaatgttactgttaaacctggcggcagcgcaaaagatg

SEQ ID NO: 74004 - DNA, 103 bp, Artificial Sequence
  Synthetic Polynucleotide
taatacgactcactatagggttttatccggcagttattaacagtaatattaacagaggagaaatattatggttaataacaacctggcggcagcgcaaaagatg

SEQ ID NO: 74005 - DNA, 103 bp, Artificial Sequence
  Synthetic Polynucleotide
taatacgactcactatagggcccacttttatccggcagttattaacagtaaacagaggagatactgtatgtaactgccgaacctggcggcagcgcaaaagatg

SEQ ID NO: 74006 - DNA, 103 bp, Artificial Sequence
  Synthetic Polynucleotide
taatacgactcactatagggactatcccacttttatccggcagttattaaaacagaggagattaataatggccggataaaacctggcggcagcgcaaaagatg

SEQ ID NO: 74007 - DNA, 103 bp, Artificial Sequence
  Synthetic Polynucleotide
taatacgactcactatagggaaattactatcccacttttatccggcagttaacagaggagaaactgcatgataaaagtgaacctggcggcagcgcaaaagatg

SEQ ID NO: 74008 - DNA, 103 bp, Artificial Sequence
  Synthetic Polynucleotide
taatacgactcactatagggtcgtgaaattactatcccacttttatccggaacagaggagaccggatatgagtgggataaacctggcggcagcgcaaaagatg

SEQ ID NO: 74009 - DNA, 103 bp, Artificial Sequence
  Synthetic Polynucleotide
taatacgactcactatagggcaaattcgtgaaattactatcccacttttaaacagaggagataaaagatggatagtaataacctggcggcagcgcaaaagatg

SEQ ID NO: 74010 - DNA, 103 bp, Artificial Sequence
  Synthetic Polynucleotide
taatacgactcactatagggagtatcaaattcgtgaaattactatcccacaacagaggagagtgggaatgtaatttcacaacctggcggcagcgcaaaagatg

SEQ ID NO: 74011 - DNA, 103 bp, Artificial Sequence
  Synthetic Polynucleotide
taatacgactcactatagggaggacagtatcaaattcgtgaaattactataacagaggagaatagtaatgtcacgaattaacctggcggcagcgcaaaagatg

SEQ ID NO: 74012 - DNA, 103 bp, Artificial Sequence
  Synthetic Polynucleotide
taatacgactcactataggggagaaaggacagtatcaaattcgtgaaattaacagaggagaaatttcatgaatttgataaacctggcggcagcgcaaaagatg

SEQ ID NO: 74013 - DNA, 103 bp, Artificial Sequence
  Synthetic Polynucleotide
taatacgactcactatagggtttttattatcttatgaggaatgattgcctaacagaggagaaggcaaatgttcctcataaacctggcggcagcgcaaaagatg

SEQ ID NO: 74014 - DNA, 103 bp, Artificial Sequence
  Synthetic Polynucleotide
taatacgactcactatagggtgttatataacaatagatgatcattacttgaacagaggagacaagtaatgatcatctataacctggcggcagcgcaaaagatg

SEQ ID NO: 74015 - DNA, 103 bp, Artificial Sequence
  Synthetic Polynucleotide
taatacgactcactatagggaacgagagaaaggacagtatcaaattcgtgaacagaggagacacgaaatggatactgtcaacctggcggcagcgcaaaagatg

SEQ ID NO: 74016 - DNA, 103 bp, Artificial Sequence
  Synthetic Polynucleotide
taatacgactcactatagggcgtttaacgagagaaaggacagtatcaaataacagaggagaatttgaatgtgtcctttcaacctggcggcagcgcaaaagatg

SEQ ID NO: 74017 - DNA, 103 bp, Artificial Sequence
  Synthetic Polynucleotide
taatacgactcactatagggaaaggcgtttaacgagagaaaggacagtataacagaggagaatactgatgtttctctcgaacctggcggcagcgcaaaagatg

SEQ ID NO: 74018 - DNA, 103 bp, Artificial Sequence
  Synthetic Polynucleotide
taatacgactcactatagggtttctaaaggcgtttaacgagagaaaggacaacagaggagagtccttatgctcgttaaaaacctggcggcagcgcaaaagatg

SEQ ID NO: 74019 - DNA, 103 bp, Artificial Sequence
  Synthetic Polynucleotide
taatacgactcactatagggaagtttttctaaaggcgtttaacgagagaaaacagaggagattctctatgtaaacgcctaacctggcggcagcgcaaaagatg

SEQ ID NO: 74020 - DNA, 103 bp, Artificial Sequence
  Synthetic Polynucleotide
taatacgactcactatagggttctaaagtttttctaaaggcgtttaacgaaacagaggagatcgttaatggcctttagaaacctggcggcagcgcaaaagatg

SEQ ID NO: 74021 - DNA, 103 bp, Artificial Sequence
  Synthetic Polynucleotide
taatacgactcactatagggtattcttctaaagtttttctaaaggcgtttaacagaggagaaaacgcatgtagaaaaacaacctggcggcagcgcaaaagatg

SEQ ID NO: 74022 - DNA, 103 bp, Artificial Sequence
  Synthetic Polynucleotide
taatacgactcactatagggtgagatattcttctaaagtttttctaaaggaacagaggagacctttaatgaaactttagaacctggcggcagcgcaaaagatg

SEQ ID NO: 74023 - DNA, 103 bp, Artificial Sequence
  Synthetic Polynucleotide
taatacgactcactatagggctcattgagatattcttctaaagtttttctaacagaggagaagaaaaatgttagaagaaaacctggcggcagcgcaaaagatg

SEQ ID NO: 74024 - DNA, 103 bp, Artificial Sequence
  Synthetic Polynucleotide
taatacgactcactataggggaactctcattgagatattcttctaaagttaacagaggagaaactttatgagaatatctaacctggcggcagcgcaaaagatg

SEQ ID NO: 74025 - DNA, 103 bp, Artificial Sequence
  Synthetic Polynucleotide
taatacgactcactataggggttattgttatataacaatagatgatcattaacagaggagaaatgatatgctattgttaaacctggcggcagcgcaaaagatg

SEQ ID NO: 74026 - DNA, 103 bp, Artificial Sequence
  Synthetic Polynucleotide
taatacgactcactataggggtcaggaactctcattgagatattcttctaaacagaggagatagaagatgatctcaatgaacctggcggcagcgcaaaagatg

SEQ ID NO: 74027 - DNA, 103 bp, Artificial Sequence
  Synthetic Polynucleotide
taatacgactcactatagggggacggtcaggaactctcattgagatattcaacagaggagagaatatatgaatgagagtaacctggcggcagcgcaaaagatg

SEQ ID NO: 74028 - DNA, 103 bp, Artificial Sequence
  Synthetic Polynucleotide
taatacgactcactatagggactatggacggtcaggaactctcattgagaaacagaggagatctcaaatggagttcctgaacctggcggcagcgcaaaagatg

SEQ ID NO: 74029 - DNA, 103 bp, Artificial Sequence
  Synthetic Polynucleotide
taatacgactcactatagggtacaaactatggacggtcaggaactctcataacagaggagaatgagaatgcctgaccgtaacctggcggcagcgcaaaagatg

SEQ ID NO: 74030 - DNA, 103 bp, Artificial Sequence
  Synthetic Polynucleotide
taatacgactcactatagggattgatacaaactatggacggtcaggaactaacagaggagaagttccatgccgtccataaacctggcggcagcgcaaaagatg

SEQ ID NO: 74031 - DNA, 103 bp, Artificial Sequence
  Synthetic Polynucleotide
taatacgactcactatagggctattattgatacaaactatggacggtcagaacagaggagactgaccatgcatagtttgaacctggcggcagcgcaaaagatg

SEQ ID NO: 74032 - DNA, 103 bp, Artificial Sequence
  Synthetic Polynucleotide
taatacgactcactatagggtgttactattattgatacaaactatggacgaacagaggagacgtccaatgtttgtatcaaacctggcggcagcgcaaaagatg

SEQ ID NO: 74033 - DNA, 103 bp, Artificial Sequence
  Synthetic Polynucleotide
taatacgactcactatagggtaatatgttactattattgatacaaactataacagaggagaatagttatgatcaataataacctggcggcagcgcaaaagatg

SEQ ID NO: 74034 - DNA, 103 bp, Artificial Sequence
  Synthetic Polynucleotide
taatacgactcactataggggttcttaatatgttactattattgatacaaaacagaggagattgtatatgtaatagtaaaacctggcggcagcgcaaaagatg

SEQ ID NO: 74035 - DNA, 103 bp, Artificial Sequence
  Synthetic Polynucleotide
taatacgactcactatagggaacgggttcttaatatgttactattattgaaacagaggagatcaataatggtaacatataacctggcggcagcgcaaaagatg

SEQ ID NO: 74036 - DNA, 103 bp, Artificial Sequence
  Synthetic Polynucleotide
taatacgactcactataggggttatgttattgttatataacaatagatgaaacagaggagatcatctatggttatataaaacctggcggcagcgcaaaagatg

SEQ ID NO: 74037 - DNA, 103 bp, Artificial Sequence
  Synthetic Polynucleotide
taatacgactcactataggggtataaacgggttcttaatatgttactattaacagaggagaaatagtatgatattaagaaacctggcggcagcgcaaaagatg

SEQ ID NO: 74038 - DNA, 103 bp, Artificial Sequence
  Synthetic Polynucleotide
taatacgactcactatagggacactgtataaacgggttcttaatatgttaaacagaggagataacatatgaagaacccgaacctggcggcagcgcaaaagatg

SEQ ID NO: 74039 - DNA, 103 bp, Artificial Sequence
  Synthetic Polynucleotide
taatacgactcactatagggtacatacactgtataaacgggttcttaataaacagaggagatattaaatgcccgtttataacctggcggcagcgcaaaagatg

SEQ ID NO: 74040 - DNA, 103 bp, Artificial Sequence
  Synthetic Polynucleotide
taatacgactcactatagggatttttacatacactgtataaacgggttctaacagaggagaagaaccatgttatacagtaacctggcggcagcgcaaaagatg

SEQ ID NO: 74041 - DNA, 103 bp, Artificial Sequence
  Synthetic Polynucleotide
taatacgactcactatagggttaacatttttacatacactgtataaacggaacagaggagaccgtttatgcagtgtatgaacctggcggcagcgcaaaagatg

SEQ ID NO: 74042 - DNA, 103 bp, Artificial Sequence
  Synthetic Polynucleotide
taatacgactcactatagggataaattaacatttttacatacactgtataaacagaggagatatacaatgtatgtaaaaaacctggcggcagcgcaaaagatg

SEQ ID NO: 74043 - DNA, 103 bp, Artificial Sequence
  Synthetic Polynucleotide
taatacgactcactatagggaaactataaattaacatttttacatacactaacagaggagaagtgtaatgaaaaatgttaacctggcggcagcgcaaaagatg

SEQ ID NO: 74044 - DNA, 103 bp, Artificial Sequence
  Synthetic Polynucleotide
taatacgactcactatagggggattaaactataaattaacatttttacataacagaggagaatgtaaatgtgttaatttaacctggcggcagcgcaaaagatg

SEQ ID NO: 74045 - DNA, 103 bp, Artificial Sequence
  Synthetic Polynucleotide
taatacgactcactatagggccatgggattaaactataaattaacattttaacagaggagaaaaatgatgatttatagtaacctggcggcagcgcaaaagatg

SEQ ID NO: 74046 - DNA, 103 bp, Artificial Sequence
  Synthetic Polynucleotide
taatacgactcactatagggattggccatgggattaaactataaattaacaacagaggagagttaatatgtagtttaataacctggcggcagcgcaaaagatg

SEQ ID NO: 74047 - DNA, 103 bp, Artificial Sequence
  Synthetic Polynucleotide
taatacgactcactatagggaaagagttatgttattgttatataacaataaacagaggagatattgtatgataacaataaacctggcggcagcgcaaaagatg

SEQ ID NO: 74048 - DNA, 103 bp, Artificial Sequence
  Synthetic Polynucleotide
taatacgactcactatagggtgtgcattggccatgggattaaactataaaaacagaggagatttataatgtaatcccataacctggcggcagcgcaaaagatg

SEQ ID NO: 74049 - DNA, 103 bp, Artificial Sequence
  Synthetic Polynucleotide
taatacgactcactatagggtcgtgtgtgcattggccatgggattaaactaacagaggagaagtttaatgccatggccaaacctggcggcagcgcaaaagatg

SEQ ID NO: 74050 - DNA, 103 bp, Artificial Sequence
  Synthetic Polynucleotide
taatacgactcactatagggattaatcgtgtgtgcattggccatgggattaacagaggagaaatcccatggccaatgcaaacctggcggcagcgcaaaagatg

SEQ ID NO: 74051 - DNA, 103 bp, Artificial Sequence
  Synthetic Polynucleotide
taatacgactcactatagggaaaaaattaatcgtgtgtgcattggccatgaacagaggagacatggcatgtgcacacacaacctggcggcagcgcaaaagatg

SEQ ID NO: 74052 - DNA, 103 bp, Artificial Sequence
  Synthetic Polynucleotide
taatacgactcactatagggacgaaaaaaaattaatcgtgtgtgcattggaacagaggagaccaatgatgacacgattaaacctggcggcagcgcaaaagatg

SEQ ID NO: 74053 - DNA, 103 bp, Artificial Sequence
  Synthetic Polynucleotide
taatacgactcactataggggggagacgaaaaaaaattaatcgtgtgtgcaacagaggagagcacacatgattaattttaacctggcggcagcgcaaaagatg

SEQ ID NO: 74054 - DNA, 103 bp, Artificial Sequence
  Synthetic Polynucleotide
taatacgactcactatagggctaaagggagacgaaaaaaaattaatcgtgaacagaggagacacgatatgttttttttcaacctggcggcagcgcaaaagatg

SEQ ID NO: 74055 - DNA, 103 bp, Artificial Sequence
  Synthetic Polynucleotide
taatacgactcactatagggacaatctaaagggagacgaaaaaaaattaaaacagaggagattaattatgtttcgtctcaacctggcggcagcgcaaaagatg

SEQ ID NO: 74056 - DNA, 103 bp, Artificial Sequence
  Synthetic Polynucleotide
taatacgactcactatagggatacaacaatctaaagggagacgaaaaaaaaacagaggagattttttatgtctccctttaacctggcggcagcgcaaaagatg

SEQ ID NO: 74057 - DNA, 103 bp, Artificial Sequence
  Synthetic Polynucleotide
taatacgactcactatagggtttctatacaacaatctaaagggagacgaaaacagaggagattcgtcatgctttagattaacctggcggcagcgcaaaagatg

SEQ ID NO: 74058 - DNA, 103 bp, Artificial Sequence
  Synthetic Polynucleotide
taatacgactcactatagggatggaaaagagttatgttattgttatataaaacagaggagattatatatgaataacataaacctggcggcagcgcaaaagatg

SEQ ID NO: 74059 - DNA, 103 bp, Artificial Sequence
  Synthetic Polynucleotide
taatacgactcactatagggcaaaatttctatacaacaatctaaagggagaacagaggagactccctatggattgttgtaacctggcggcagcgcaaaagatg

SEQ ID NO: 74060 - DNA, 103 bp, Artificial Sequence
  Synthetic Polynucleotide
taatacgactcactatagggggtaccaaaatttctatacaacaatctaaaaacagaggagatttagaatgttgtatagaaacctggcggcagcgcaaaagatg

SEQ ID NO: 74061 - DNA, 103 bp, Artificial Sequence
  Synthetic Polynucleotide
taatacgactcactatagggttcacggtaccaaaatttctatacaacaataacagaggagaattgttatgtagaaatttaacctggcggcagcgcaaaagatg

SEQ ID NO: 74062 - DNA, 103 bp, Artificial Sequence
  Synthetic Polynucleotide
taatacgactcactatagggcggagttcacggtaccaaaatttctatacaaacagaggagatgtataatgattttggtaaacctggcggcagcgcaaaagatg

SEQ ID NO: 74063 - DNA, 103 bp, Artificial Sequence
  Synthetic Polynucleotide
taatacgactcactatagggtacggcggagttcacggtaccaaaatttctaacagaggagaagaaatatgggtaccgtgaacctggcggcagcgcaaaagatg

SEQ ID NO: 74064 - DNA, 103 bp, Artificial Sequence
  Synthetic Polynucleotide
taatacgactcactataggggaaactacggcggagttcacggtaccaaaaaacagaggagattttggatgcgtgaactcaacctggcggcagcgcaaaagatg

SEQ ID NO: 74065 - DNA, 103 bp, Artificial Sequence
  Synthetic Polynucleotide
taatacgactcactatagggccatggaaactacggcggagttcacggtacaacagaggagagtaccgatgactccgccgaacctggcggcagcgcaaaagatg

SEQ ID NO: 74066 - DNA, 103 bp, Artificial Sequence
  Synthetic Polynucleotide
taatacgactcactatagggtagtcccatggaaactacggcggagttcacaacagaggagagtgaacatggccgtagttaacctggcggcagcgcaaaagatg

SEQ ID NO: 74067 - DNA, 103 bp, Artificial Sequence
  Synthetic Polynucleotide
taatacgactcactatagggttatatagtcccatggaaactacggcggagaacagaggagactccgcatgagtttccataacctggcggcagcgcaaaagatg

SEQ ID NO: 74068 - DNA, 103 bp, Artificial Sequence
  Synthetic Polynucleotide
taatacgactcactatagggcaaaattatatagtcccatggaaactacggaacagaggagaccgtagatgccatgggacaacctggcggcagcgcaaaagatg

SEQ ID NO: 74069 - DNA, 103 bp, Artificial Sequence
  Synthetic Polynucleotide
taatacgactcactatagggtaaaaatggaaaagagttatgttattgttaaacagaggagataacaaatgcataactctaacctggcggcagcgcaaaagatg

SEQ ID NO: 74070 - DNA, 103 bp, Artificial Sequence
  Synthetic Polynucleotide
taatacgactcactatagggggccacaaaattatatagtcccatggaaacaacagaggagagtttccatgggactatataacctggcggcagcgcaaaagatg

SEQ ID NO: 74071 - DNA, 103 bp, Artificial Sequence
  Synthetic Polynucleotide
taatacgactcactatagggttcgaggccacaaaattatatagtcccatgaacagaggagacatgggatgatataatttaacctggcggcagcgcaaaagatg

SEQ ID NO: 74072 - DNA, 103 bp, Artificial Sequence
  Synthetic Polynucleotide
taatacgactcactatagggttgtattcgaggccacaaaattatatagtcaacagaggagagactatatgattttgtggaacctggcggcagcgcaaaagatg

SEQ ID NO: 74073 - DNA, 103 bp, Artificial Sequence
  Synthetic Polynucleotide
taatacgactcactatagggaaaatttgtattcgaggccacaaaattataaacagaggagatataatatggtggcctcgaacctggcggcagcgcaaaagatg

SEQ ID NO: 74074 - DNA, 103 bp, Artificial Sequence
  Synthetic Polynucleotide
taatacgactcactataggggtagtaaaatttgtattcgaggccacaaaaaacagaggagattttgtatgctcgaatacaacctggcggcagcgcaaaagatg

SEQ ID NO: 74075 - DNA, 103 bp, Artificial Sequence
  Synthetic Polynucleotide
taatacgactcactatagggactatgtagtaaaatttgtattcgaggccaaacagaggagatggcctatgatacaaattaacctggcggcagcgcaaaagatg

SEQ ID NO: 74076 - DNA, 103 bp, Artificial Sequence
  Synthetic Polynucleotide
taatacgactcactatagggagataactatgtagtaaaatttgtattcgaaacagaggagatcgaatatgaattttactaacctggcggcagcgcaaaagatg

SEQ ID NO: 74077 - DNA, 103 bp, Artificial Sequence
  Synthetic Polynucleotide
taatacgactcactatagggaagatagataactatgtagtaaaatttgtaaacagaggagatacaaaatgtactacataaacctggcggcagcgcaaaagatg

SEQ ID NO: 74078 - DNA, 103 bp, Artificial Sequence
  Synthetic Polynucleotide
taatacgactcactatagggtctttaagatagataactatgtagtaaaataacagaggagaattttaatgcatagttataacctggcggcagcgcaaaagatg

SEQ ID NO: 74079 - DNA, 103 bp, Artificial Sequence
  Synthetic Polynucleotide
taatacgactcactatagggtatagtctttaagatagataactatgtagtaacagaggagaactacaatgttatctatcaacctggcggcagcgcaaaagatg

SEQ ID NO: 74080 - DNA, 103 bp, Artificial Sequence
  Synthetic Polynucleotide
taatacgactcactatagggactgataaaaatggaaaagagttatgttataacagaggagaataacaatgctcttttccaacctggcggcagcgcaaaagatg

SEQ ID NO: 74081 - DNA, 103 bp, Artificial Sequence
  Synthetic Polynucleotide
taatacgactcactatagggtatggtatagtctttaagatagataactataacagaggagaatagttatgtatcttaaaaacctggcggcagcgcaaaagatg

SEQ ID NO: 74082 - DNA, 103 bp, Artificial Sequence
  Synthetic Polynucleotide
taatacgactcactataggggaggatatggtatagtctttaagatagataaacagaggagatatctaatgtaaagactaaacctggcggcagcgcaaaagatg

SEQ ID NO: 74083 - DNA, 103 bp, Artificial Sequence
  Synthetic Polynucleotide
taatacgactcactatagggtacaggaggatatggtatagtctttaagataacagaggagaatcttaatgactataccaaacctggcggcagcgcaaaagatg

SEQ ID NO: 74084 - DNA, 103 bp, Artificial Sequence
  Synthetic Polynucleotide
taatacgactcactatagggatatctacaggaggatatggtatagtctttaacagaggagaaaagacatgaccatatccaacctggcggcagcgcaaaagatg

SEQ ID NO: 74085 - DNA, 103 bp, Artificial Sequence
  Synthetic Polynucleotide
taatacgactcactatagggatcacatatctacaggaggatatggtatagaacagaggagactatacatgatcctcctgaacctggcggcagcgcaaaagatg

SEQ ID NO: 74086 - DNA, 103 bp, Artificial Sequence
  Synthetic Polynucleotide
taatacgactcactatagggtttttatcacatatctacaggaggatatggaacagaggagaccatatatgcctgtagataacctggcggcagcgcaaaagatg

SEQ ID NO: 74087 - DNA, 103 bp, Artificial Sequence
  Synthetic Polynucleotide
taatacgactcactataggggacgatttttatcacatatctacaggaggaaacagaggagatcctccatgagatatgtgaacctggcggcagcgcaaaagatg

SEQ ID NO: 74088 - DNA, 103 bp, Artificial Sequence
  Synthetic Polynucleotide
taatacgactcactatagggtaaacgacgatttttatcacatatctacagaacagaggagactgtagatgtgtgataaaaacctggcggcagcgcaaaagatg

SEQ ID NO: 74089 - DNA, 103 bp, Artificial Sequence
  Synthetic Polynucleotide
taatacgactcactatagggtcctataaacgacgatttttatcacatatcaacagaggagagatatgatgtaaaaatcgaacctggcggcagcgcaaaagatg

SEQ ID NO: 74090 - DNA, 103 bp, Artificial Sequence
  Synthetic Polynucleotide
taatacgactcactatagggttttatcctataaacgacgatttttatcacaacagaggagagtgataatgatcgtcgttaacctggcggcagcgcaaaagatg

SEQ ID NO: 74091 - DNA, 103 bp, Artificial Sequence
  Synthetic Polynucleotide
taatacgactcactatagggtacatactgataaaaatggaaaagagttataacagaggagaataactatgttccattttaacctggcggcagcgcaaaagatg

SEQ ID NO: 74092 - DNA, 103 bp, Artificial Sequence
  Synthetic Polynucleotide
taatacgactcactatagggaacgattttatcctataaacgacgatttttaacagaggagaaaaaatatgcgtttatagaacctggcggcagcgcaaaagatg

SEQ ID NO: 74093 - DNA, 103 bp, Artificial Sequence
  Synthetic Polynucleotide
taatacgactcactatagggagataaacgattttatcctataaacgacgaaacagaggagatcgtcgatgataggataaaacctggcggcagcgcaaaagatg

SEQ ID NO: 74094 - DNA, 103 bp, Artificial Sequence
  Synthetic Polynucleotide
taatacgactcactatagggcaaaaagataaacgattttatcctataaacaacagaggagagtttatatgataaaatcgaacctggcggcagcgcaaaagatg

SEQ ID NO: 74095 - DNA, 103 bp, Artificial Sequence
  Synthetic Polynucleotide
taatacgactcactatagggtccaacaaaaagataaacgattttatcctaaacagaggagataggatatgatcgtttataacctggcggcagcgcaaaagatg

SEQ ID NO: 74096 - DNA, 103 bp, Artificial Sequence
  Synthetic Polynucleotide
taatacgactcactatagggatttttccaacaaaaagataaacgattttaaacagaggagataaaatatgttatcttttaacctggcggcagcgcaaaagatg

SEQ ID NO: 74097 - DNA, 103 bp, Artificial Sequence
  Synthetic Polynucleotide
taatacgactcactatagggtcatcatttttccaacaaaaagataaacgaaacagaggagatcgtttatgtttttgttgaacctggcggcagcgcaaaagatg

SEQ ID NO: 74098 - DNA, 103 bp, Artificial Sequence
  Synthetic Polynucleotide
taatacgactcactatagggttaattcatcatttttccaacaaaaagataaacagaggagatatcttatggttggaaaaaacctggcggcagcgcaaaagatg

SEQ ID NO: 74099 - DNA, 103 bp, Artificial Sequence
  Synthetic Polynucleotide
taatacgactcactatagggttacattaattcatcatttttccaacaaaaaacagaggagattttgtatgaaaaatgataacctggcggcagcgcaaaagatg

SEQ ID NO: 74100 - DNA, 103 bp, Artificial Sequence
  Synthetic Polynucleotide
taatacgactcactatagggaatgattacattaattcatcatttttccaaaacagaggagattggaaatgtgatgaattaacctggcggcagcgcaaaagatg

SEQ ID NO: 74101 - DNA, 103 bp, Artificial Sequence
  Synthetic Polynucleotide
taatacgactcactatagggaagagaatgattacattaattcatcattttaacagaggagaaaaatgatgaattaatgtaacctggcggcagcgcaaaagatg

SEQ ID NO: 74102 - DNA, 103 bp, Artificial Sequence
  Synthetic Polynucleotide
taatacgactcactatagggagatatacatactgataaaaatggaaaagaaacagaggagatcttttatgtttttatcaaacctggcggcagcgcaaaagatg

SEQ ID NO: 74103 - DNA, 103 bp, Artificial Sequence
  Synthetic Polynucleotide
taatacgactcactataggggatagaagagaatgattacattaattcatcaacagaggagagatgaaatgatgtaatcaaacctggcggcagcgcaaaagatg

SEQ ID NO: 74104 - DNA, 103 bp, Artificial Sequence
  Synthetic Polynucleotide
taatacgactcactatagggctaaagatagaagagaatgattacattaataacagaggagaattaatatgatcattctcaacctggcggcagcgcaaaagatg

SEQ ID NO: 74105 - DNA, 103 bp, Artificial Sequence
  Synthetic Polynucleotide
taatacgactcactatagggcactactaaagatagaagagaatgattacaaacagaggagatgtaatatgtctcttctaaacctggcggcagcgcaaaagatg

SEQ ID NO: 74106 - DNA, 103 bp, Artificial Sequence
  Synthetic Polynucleotide
taatacgactcactatagggggaaacactactaaagatagaagagaatgaaacagaggagatcattcatgtctatctttaacctggcggcagcgcaaaagatg

SEQ ID NO: 74107 - DNA, 103 bp, Artificial Sequence
  Synthetic Polynucleotide
taatacgactcactatagggaatagggaaacactactaaagatagaagagaacagaggagactcttcatgctttagtagaacctggcggcagcgcaaaagatg

SEQ ID NO: 74108 - DNA, 103 bp, Artificial Sequence
  Synthetic Polynucleotide
taatacgactcactatagggattttaatagggaaacactactaaagatagaacagaggagactatctatggtagtgtttaacctggcggcagcgcaaaagatg

SEQ ID NO: 74109 - DNA, 103 bp, Artificial Sequence
  Synthetic Polynucleotide
taatacgactcactatagggtaagaattttaatagggaaacactactaaaaacagaggagatttagtatggtttccctaaacctggcggcagcgcaaaagatg

SEQ ID NO: 74110 - DNA, 103 bp, Artificial Sequence
  Synthetic Polynucleotide
taatacgactcactatagggtattttaagaattttaatagggaaacactaaacagaggagatagtgtatgcctattaaaaacctggcggcagcgcaaaagatg

SEQ ID NO: 74111 - DNA, 103 bp, Artificial Sequence
  Synthetic Polynucleotide
taatacgactcactatagggtaaattattttaagaattttaatagggaaaaacagaggagatttcccatgtaaaattctaacctggcggcagcgcaaaagatg

SEQ ID NO: 74112 - DNA, 103 bp, Artificial Sequence
  Synthetic Polynucleotide
taatacgactcactatagggattgttaaattattttaagaattttaatagaacagaggagactattaatgttcttaaaaaacctggcggcagcgcaaaagatg

SEQ ID NO: 74113 - DNA, 103 bp, Artificial Sequence
  Synthetic Polynucleotide
taatacgactcactataggggatatagatatacatactgataaaaatggaaacagaggagatccattatgatcagtatgaacctggcggcagcgcaaaagatg

SEQ ID NO: 74114 - DNA, 103 bp, Artificial Sequence
  Synthetic Polynucleotide
taatacgactcactataggggttagattgttaaattattttaagaattttaacagaggagaaaaattatgaaaataattaacctggcggcagcgcaaaagatg

SEQ ID NO: 74115 - DNA, 103 bp, Artificial Sequence
  Synthetic Polynucleotide
taatacgactcactatagggcgtcagttagattgttaaattattttaagaaacagaggagatcttaaatgaatttaacaaacctggcggcagcgcaaaagatg

SEQ ID NO: 74116 - DNA, 103 bp, Artificial Sequence
  Synthetic Polynucleotide
taatacgactcactatagggggctccgtcagttagattgttaaattatttaacagaggagaaaataaatgaacaatctaaacctggcggcagcgcaaaagatg

SEQ ID NO: 74117 - DNA, 103 bp, Artificial Sequence
  Synthetic Polynucleotide
taatacgactcactatagggaattgggctccgtcagttagattgttaaataacagaggagaatttaaatgtctaactgaaacctggcggcagcgcaaaagatg

SEQ ID NO: 74118 - DNA, 103 bp, Artificial Sequence
  Synthetic Polynucleotide
taatacgactcactatagggaccaaaattgggctccgtcagttagattgtaacagaggagaacaatcatgctgacggagaacctggcggcagcgcaaaagatg

SEQ ID NO: 74119 - DNA, 103 bp, Artificial Sequence
  Synthetic Polynucleotide
taatacgactcactatagggtttacaccaaaattgggctccgtcagttagaacagaggagactaactatgggagcccaaaacctggcggcagcgcaaaagatg

SEQ ID NO: 74120 - DNA, 103 bp, Artificial Sequence
  Synthetic Polynucleotide
taatacgactcactatagggttagatttacaccaaaattgggctccgtcaaacagaggagatgacggatgccaattttgaacctggcggcagcgcaaaagatg

SEQ ID NO: 74121 - DNA, 103 bp, Artificial Sequence
  Synthetic Polynucleotide
taatacgactcactatagggcacaattagatttacaccaaaattgggctcaacagaggagagagcccatgtttggtgtaaacctggcggcagcgcaaaagatg

SEQ ID NO: 74122 - DNA, 103 bp, Artificial Sequence
  Synthetic Polynucleotide
taatacgactcactatagggaatgtcacaattagatttacaccaaaattgaacagaggagacaatttatgtgtaaatctaacctggcggcagcgcaaaagatg

SEQ ID NO: 74123 - DNA, 103 bp, Artificial Sequence
  Synthetic Polynucleotide
taatacgactcactatagggaacataatgtcacaattagatttacaccaaaacagaggagattggtgatgatctaattgaacctggcggcagcgcaaaagatg

SEQ ID NO: 74124 - DNA, 103 bp, Artificial Sequence
  Synthetic Polynucleotide
taatacgactcactatagggtacactttttattatcttatgaggaatgataacagaggagaatcattatgcataagataaacctggcggcagcgcaaaagatg

SEQ ID NO: 74125 - DNA, 103 bp, Artificial Sequence
  Synthetic Polynucleotide
taatacgactcactatagggacgttgatatagatatacatactgataaaaaacagaggagattttatatgtatgtatataacctggcggcagcgcaaaagatg

SEQ ID NO: 74126 - DNA, 103 bp, Artificial Sequence
  Synthetic Polynucleotide
taatacgactcactatagggttaacaacataatgtcacaattagatttacaacagaggagagtaaatatgattgtgacaaacctggcggcagcgcaaaagatg

SEQ ID NO: 74127 - DNA, 103 bp, Artificial Sequence
  Synthetic Polynucleotide
taatacgactcactatagggatattttaacaacataatgtcacaattagaaacagaggagatctaatatggacattatgaacctggcggcagcgcaaaagatg

SEQ ID NO: 74128 - DNA, 103 bp, Artificial Sequence
  Synthetic Polynucleotide
taatacgactcactatagggtgtttatattttaacaacataatgtcacaaaacagaggagattgtgaatgtatgttgttaacctggcggcagcgcaaaagatg

SEQ ID NO: 74129 - DNA, 103 bp, Artificial Sequence
  Synthetic Polynucleotide
taatacgactcactataggggagactgtttatattttaacaacataatgtaacagaggagaacattaatgtgttaaaataacctggcggcagcgcaaaagatg

SEQ ID NO: 74130 - DNA, 103 bp, Artificial Sequence
  Synthetic Polynucleotide
taatacgactcactatagggattaggagactgtttatattttaacaacataacagaggagaatgttgatgaaatataaaaacctggcggcagcgcaaaagatg

SEQ ID NO: 74131 - DNA, 103 bp, Artificial Sequence
  Synthetic Polynucleotide
taatacgactcactataggggttatattaggagactgtttatattttaacaacagaggagagttaaaatgtaaacagtcaacctggcggcagcgcaaaagatg

SEQ ID NO: 74132 - DNA, 103 bp, Artificial Sequence
  Synthetic Polynucleotide
taatacgactcactatagggatactgttatattaggagactgtttatattaacagaggagaaatataatgagtctcctaaacctggcggcagcgcaaaagatg

SEQ ID NO: 74133 - DNA, 103 bp, Artificial Sequence
  Synthetic Polynucleotide
taatacgactcactatagggatctgatactgttatattaggagactgtttaacagaggagaaaacagatgcctaatataaacctggcggcagcgcaaaagatg

SEQ ID NO: 74134 - DNA, 103 bp, Artificial Sequence
  Synthetic Polynucleotide
taatacgactcactatagggagattatctgatactgttatattaggagacaacagaggagagtctccatgtataacagtaacctggcggcagcgcaaaagatg

SEQ ID NO: 74135 - DNA, 103 bp, Artificial Sequence
  Synthetic Polynucleotide
taatacgactcactatagggcacatagattatctgatactgttatattagaacagaggagactaataatgcagtatcagaacctggcggcagcgcaaaagatg

SEQ ID NO: 74136 - DNA, 103 bp, Artificial Sequence
  Synthetic Polynucleotide
taatacgactcactatagggcggcgacgttgatatagatatacatactgaaacagaggagatcagtaatgatatctataaacctggcggcagcgcaaaagatg

SEQ ID NO: 74137 - DNA, 103 bp, Artificial Sequence
  Synthetic Polynucleotide
taatacgactcactataggggtctccacatagattatctgatactgttataacagaggagaataacaatgtcagataataacctggcggcagcgcaaaagatg

SEQ ID NO: 74138 - DNA, 103 bp, Artificial Sequence
  Synthetic Polynucleotide
taatacgactcactatagggtggatgtctccacatagattatctgatactaacagaggagaagtatcatgtaatctatgaacctggcggcagcgcaaaagatg

SEQ ID NO: 74139 - DNA, 103 bp, Artificial Sequence
  Synthetic Polynucleotide
taatacgactcactatagggatcaatggatgtctccacatagattatctgaacagaggagacagataatgtatgtggagaacctggcggcagcgcaaaagatg

SEQ ID NO: 74140 - DNA, 103 bp, Artificial Sequence
  Synthetic Polynucleotide
taatacgactcactatagggtgaatatcaatggatgtctccacatagattaacagaggagaaatctaatgggagacatcaacctggcggcagcgcaaaagatg

SEQ ID NO: 74141 - DNA, 103 bp, Artificial Sequence
  Synthetic Polynucleotide
taatacgactcactatagggtcccctgaatatcaatggatgtctccacataacagaggagaatgtggatgcatccattgaacctggcggcagcgcaaaagatg

SEQ ID NO: 74142 - DNA, 103 bp, Artificial Sequence
  Synthetic Polynucleotide
taatacgactcactatagggattcatcccctgaatatcaatggatgtctcaacagaggagagagacaatgattgatattaacctggcggcagcgcaaaagatg

SEQ ID NO: 74143 - DNA, 103 bp, Artificial Sequence
  Synthetic Polynucleotide
taatacgactcactatagggcaatgattcatcccctgaatatcaatggataacagaggagaatccatatgtattcagggaacctggcggcagcgcaaaagatg

SEQ ID NO: 74144 - DNA, 103 bp, Artificial Sequence
  Synthetic Polynucleotide
taatacgactcactataggggttgccaatgattcatcccctgaatatcaaaacagaggagattgataatgaggggatgaaacctggcggcagcgcaaaagatg

SEQ ID NO: 74145 - DNA, 103 bp, Artificial Sequence
  Synthetic Polynucleotide
taatacgactcactatagggtgggtgttgccaatgattcatcccctgaataacagaggagaattcagatgatgaatcataacctggcggcagcgcaaaagatg

SEQ ID NO: 74146 - DNA, 103 bp, Artificial Sequence
  Synthetic Polynucleotide
taatacgactcactatagggataaatgggtgttgccaatgattcatccccaacagaggagaggggatatgtcattggcaaacctggcggcagcgcaaaagatg

SEQ ID NO: 74147 - DNA, 103 bp, Artificial Sequence
  Synthetic Polynucleotide
taatacgactcactatagggcactacggcgacgttgatatagatatacataacagaggagaatgtatatgtatatcaacaacctggcggcagcgcaaaagatg

SEQ ID NO: 74148 - DNA, 103 bp, Artificial Sequence
  Synthetic Polynucleotide
taatacgactcactataggggtacaataaatgggtgttgccaatgattcaaacagaggagatgaatcatgggcaacaccaacctggcggcagcgcaaaagatg

SEQ ID NO: 74149 - DNA, 103 bp, Artificial Sequence
  Synthetic Polynucleotide
taatacgactcactatagggtttttgtacaataaatgggtgttgccaatgaacagaggagacattggatgcacccatttaacctggcggcagcgcaaaagatg

SEQ ID NO: 74150 - DNA, 103 bp, Artificial Sequence
  Synthetic Polynucleotide
taatacgactcactatagggggggctttttgtacaataaatgggtgttgcaacagaggagagcaacaatgatttattgtaacctggcggcagcgcaaaagatg

SEQ ID NO: 74151 - DNA, 103 bp, Artificial Sequence
  Synthetic Polynucleotide
taatacgactcactatagggaaattggggctttttgtacaataaatgggtaacagaggagaacccatatgttgtacaaaaacctggcggcagcgcaaaagatg

SEQ ID NO: 74152 - DNA, 103 bp, Artificial Sequence
  Synthetic Polynucleotide
taatacgactcactatagggtttgtaaattggggctttttgtacaataaaaacagaggagatttattatgcaaaaagccaacctggcggcagcgcaaaagatg

SEQ ID NO: 74153 - DNA, 103 bp, Artificial Sequence
  Synthetic Polynucleotide
taatacgactcactatagggttttatttgtaaattggggctttttgtacaaacagaggagatgtacaatgagccccaataacctggcggcagcgcaaaagatg

SEQ ID NO: 74154 - DNA, 103 bp, Artificial Sequence
  Synthetic Polynucleotide
taatacgactcactatagggtggacttttatttgtaaattggggctttttaacagaggagaaaaaagatgcaatttacaaacctggcggcagcgcaaaagatg

SEQ ID NO: 74155 - DNA, 103 bp, Artificial Sequence
  Synthetic Polynucleotide
taatacgactcactatagggaaacctggacttttatttgtaaattggggcaacagaggagagccccaatgtacaaataaaacctggcggcagcgcaaaagatg

SEQ ID NO: 74156 - DNA, 103 bp, Artificial Sequence
  Synthetic Polynucleotide
taatacgactcactatagggctatcaaacctggacttttatttgtaaattaacagaggagaaatttaatgataaaagtcaacctggcggcagcgcaaaagatg

SEQ ID NO: 74157 - DNA, 103 bp, Artificial Sequence
  Synthetic Polynucleotide
taatacgactcactatagggtgtctctatcaaacctggacttttatttgtaacagaggagaacaaatatgagtccaggtaacctggcggcagcgcaaaagatg

SEQ ID NO: 74158 - DNA, 103 bp, Artificial Sequence
  Synthetic Polynucleotide
taatacgactcactatagggctattcactacggcgacgttgatatagataaacagaggagatatctaatgcaacgtcgcaacctggcggcagcgcaaaagatg

SEQ ID NO: 74159 - DNA, 103 bp, Artificial Sequence
  Synthetic Polynucleotide
taatacgactcactatagggtagtttgtctctatcaaacctggacttttaaacagaggagataaaagatgaggtttgataacctggcggcagcgcaaaagatg

SEQ ID NO: 74160 - DNA, 103 bp, Artificial Sequence
  Synthetic Polynucleotide
taatacgactcactataggggttaatagtttgtctctatcaaacctggacaacagaggagagtccagatgtgatagagaaacctggcggcagcgcaaaagatg

SEQ ID NO: 74161 - DNA, 103 bp, Artificial Sequence
  Synthetic Polynucleotide
taatacgactcactatagggcgatagttaatagtttgtctctatcaaaccaacagaggagaggtttgatggagacaaacaacctggcggcagcgcaaaagatg

SEQ ID NO: 74162 - DNA, 103 bp, Artificial Sequence
  Synthetic Polynucleotide
taatacgactcactatagggagacacgatagttaatagtttgtctctatcaacagaggagagatagaatgaaactattaaacctggcggcagcgcaaaagatg

SEQ ID NO: 74163 - DNA, 103 bp, Artificial Sequence
  Synthetic Polynucleotide
taatacgactcactatagggaacagagacacgatagttaatagtttgtctaacagaggagaagacaaatgattaactataacctggcggcagcgcaaaagatg

SEQ ID NO: 74164 - DNA, 103 bp, Artificial Sequence
  Synthetic Polynucleotide
taatacgactcactatagggttaaaaacagagacacgatagttaatagttaacagaggagaaactatatgctatcgtgtaacctggcggcagcgcaaaagatg

SEQ ID NO: 74165 - DNA, 103 bp, Artificial Sequence
  Synthetic Polynucleotide
taatacgactcactatagggaggtgttaaaaacagagacacgatagttaaaacagaggagattaactatggtgtctctgaacctggcggcagcgcaaaagatg

SEQ ID NO: 74166 - DNA, 103 bp, Artificial Sequence
  Synthetic Polynucleotide
taatacgactcactatagggtgtggaggtgttaaaaacagagacacgataaacagaggagatatcgtatgtctgtttttaacctggcggcagcgcaaaagatg

SEQ ID NO: 74167 - DNA, 103 bp, Artificial Sequence
  Synthetic Polynucleotide
taatacgactcactatagggaaaactgtggaggtgttaaaaacagagacaaacagaggagatgtctcatgttttaacacaacctggcggcagcgcaaaagatg

SEQ ID NO: 74168 - DNA, 103 bp, Artificial Sequence
  Synthetic Polynucleotide
taatacgactcactatagggaattaaaaactgtggaggtgttaaaaacagaacagaggagactgtttatgacacctccaaacctggcggcagcgcaaaagatg

SEQ ID NO: 74169 - DNA, 103 bp, Artificial Sequence
  Synthetic Polynucleotide
taatacgactcactataggggactactattcactacggcgacgttgatataacagaggagaatatcaatgtcgccgtagaacctggcggcagcgcaaaagatg

SEQ ID NO: 74170 - DNA, 103 bp, Artificial Sequence
  Synthetic Polynucleotide
taatacgactcactatagggaaagaaattaaaaactgtggaggtgttaaaaacagaggagatttaacatgtccacagttaacctggcggcagcgcaaaagatg

SEQ ID NO: 74171 - DNA, 103 bp, Artificial Sequence
  Synthetic Polynucleotide
taatacgactcactatagggttaccaaagaaattaaaaactgtggaggtgaacagaggagacacctcatgagtttttaaaacctggcggcagcgcaaaagatg

SEQ ID NO: 74172 - DNA, 103 bp, Artificial Sequence
  Synthetic Polynucleotide
taatacgactcactatagggttttattaccaaagaaattaaaaactgtggaacagaggagaccacagatgttaatttctaacctggcggcagcgcaaaagatg

SEQ ID NO: 74173 - DNA, 103 bp, Artificial Sequence
  Synthetic Polynucleotide
taatacgactcactatagggaataattttattaccaaagaaattaaaaacaacagaggagagtttttatgttctttggtaacctggcggcagcgcaaaagatg

SEQ ID NO: 74174 - DNA, 103 bp, Artificial Sequence
  Synthetic Polynucleotide
taatacgactcactatagggtagtgaataattttattaccaaagaaattaaacagaggagataatttatgtggtaataaaacctggcggcagcgcaaaagatg

SEQ ID NO: 74175 - DNA, 103 bp, Artificial Sequence
  Synthetic Polynucleotide
taatacgactcactatagggtgatatagtgaataattttattaccaaagaaacagaggagatctttgatgataaaattaaacctggcggcagcgcaaaagatg

SEQ ID NO: 74176 - DNA, 103 bp, Artificial Sequence
  Synthetic Polynucleotide
taatacgactcactataggggatactgatatagtgaataattttattaccaacagaggagaggtaatatgattattcacaacctggcggcagcgcaaaagatg

SEQ ID NO: 74177 - DNA, 103 bp, Artificial Sequence
  Synthetic Polynucleotide
taatacgactcactatagggaagaagatactgatatagtgaataattttaaacagaggagataaaatatgtcactatataacctggcggcagcgcaaaagatg

SEQ ID NO: 74178 - DNA, 103 bp, Artificial Sequence
  Synthetic Polynucleotide
taatacgactcactatagggagataaagaagatactgatatagtgaataaaacagaggagattattcatgatatcagtaaacctggcggcagcgcaaaagatg

SEQ ID NO: 74179 - DNA, 103 bp, Artificial Sequence
  Synthetic Polynucleotide
taatacgactcactatagggctggtagataaagaagatactgatatagtgaacagaggagacactatatgagtatcttcaacctggcggcagcgcaaaagatg

SEQ ID NO: 74180 - DNA, 103 bp, Artificial Sequence
  Synthetic Polynucleotide
taatacgactcactatagggtcaatgactactattcactacggcgacgttaacagaggagaaacgtcatggtagtgaataacctggcggcagcgcaaaagatg

SEQ ID NO: 74181 - DNA, 103 bp, Artificial Sequence
  Synthetic Polynucleotide
taatacgactcactatagggaatctctggtagataaagaagatactgataaacagaggagatatcagatgcttctttataacctggcggcagcgcaaaagatg

SEQ ID NO: 74182 - DNA, 103 bp, Artificial Sequence
  Synthetic Polynucleotide
taatacgactcactatagggagtaaaatctctggtagataaagaagatacaacagaggagagtatctatgttatctaccaacctggcggcagcgcaaaagatg

SEQ ID NO: 74183 - DNA, 103 bp, Artificial Sequence
  Synthetic Polynucleotide
taatacgactcactatagggaagttagtaaaatctctggtagataaagaaaacagaggagattctttatgtaccagagaaacctggcggcagcgcaaaagatg

SEQ ID NO: 74184 - DNA, 103 bp, Artificial Sequence
  Synthetic Polynucleotide
taatacgactcactatagggttatcaagttagtaaaatctctggtagataaacagaggagatatctaatggagattttaaacctggcggcagcgcaaaagatg

SEQ ID NO: 74185 - DNA, 103 bp, Artificial Sequence
  Synthetic Polynucleotide
taatacgactcactatagggcaaggttatcaagttagtaaaatctctggtaacagaggagaaccagaatgtttactaacaacctggcggcagcgcaaaagatg

SEQ ID NO: 74186 - DNA, 103 bp, Artificial Sequence
  Synthetic Polynucleotide
taatacgactcactatagggacagccaaggttatcaagttagtaaaatctaacagaggagaagatttatgtaacttgataacctggcggcagcgcaaaagatg

SEQ ID NO: 74187 - DNA, 103 bp, Artificial Sequence
  Synthetic Polynucleotide
taatacgactcactatagggatgagacagccaaggttatcaagttagtaaaacagaggagattactaatgtgataacctaacctggcggcagcgcaaaagatg

SEQ ID NO: 74188 - DNA, 103 bp, Artificial Sequence
  Synthetic Polynucleotide
taatacgactcactatagggattgaatgagacagccaaggttatcaagttaacagaggagaaacttgatgaccttggctaacctggcggcagcgcaaaagatg

SEQ ID NO: 74189 - DNA, 103 bp, Artificial Sequence
  Synthetic Polynucleotide
taatacgactcactatagggaccctattgaatgagacagccaaggttatcaacagaggagagataacatgggctgtctcaacctggcggcagcgcaaaagatg

SEQ ID NO: 74190 - DNA, 103 bp, Artificial Sequence
  Synthetic Polynucleotide
taatacgactcactatagggtcactaccctattgaatgagacagccaaggaacagaggagaccttggatgtctcattcaaacctggcggcagcgcaaaagatg

SEQ ID NO: 74191 - DNA, 103 bp, Artificial Sequence
  Synthetic Polynucleotide
taatacgactcactatagggatagatcaatgactactattcactacggcgaacagaggagacgccgtatggaatagtagaacctggcggcagcgcaaaagatg

SEQ ID NO: 74192 - DNA, 103 bp, Artificial Sequence
  Synthetic Polynucleotide
taatacgactcactatagggaaatatcactaccctattgaatgagacagcaacagaggagagctgtcatgttcaataggaacctggcggcagcgcaaaagatg

SEQ ID NO: 74193 - DNA, 103 bp, Artificial Sequence
  Synthetic Polynucleotide
taatacgactcactatagggcatacaaatatcactaccctattgaatgagaacagaggagactcattatgtagggtagtaacctggcggcagcgcaaaagatg

SEQ ID NO: 74194 - DNA, 103 bp, Artificial Sequence
  Synthetic Polynucleotide
taatacgactcactatagggtcactcatacaaatatcactaccctattgaaacagaggagatcaataatgtagtgatataacctggcggcagcgcaaaagatg

SEQ ID NO: 74195 - DNA, 103 bp, Artificial Sequence
  Synthetic Polynucleotide
taatacgactcactatagggcaatatcactcatacaaatatcactaccctaacagaggagaagggtaatgatatttgtaaacctggcggcagcgcaaaagatg

SEQ ID NO: 74196 - DNA, 103 bp, Artificial Sequence
  Synthetic Polynucleotide
taatacgactcactataggggatatcaatatcactcatacaaatatcactaacagaggagaagtgatatgtgtatgagtaacctggcggcagcgcaaaagatg

SEQ ID NO: 74197 - DNA, 103 bp, Artificial Sequence
  Synthetic Polynucleotide
taatacgactcactatagggaaaaagatatcaatatcactcatacaaataaacagaggagatatttgatggagtgatataacctggcggcagcgcaaaagatg

SEQ ID NO: 74198 - DNA, 103 bp, Artificial Sequence
  Synthetic Polynucleotide
taatacgactcactatagggaattcaaaaagatatcaatatcactcatacaacagaggagagtatgaatgatattgataaacctggcggcagcgcaaaagatg

SEQ ID NO: 74199 - DNA, 103 bp, Artificial Sequence
  Synthetic Polynucleotide
taatacgactcactataggggaaacaattcaaaaagatatcaatatcactaacagaggagaagtgatatggatatctttaacctggcggcagcgcaaaagatg

SEQ ID NO: 74200 - DNA, 103 bp, Artificial Sequence
  Synthetic Polynucleotide
taatacgactcactatagggtaaaagaaacaattcaaaaagatatcaataaacagaggagatattgaatgctttttgaaaacctggcggcagcgcaaaagatg

SEQ ID NO: 74201 - DNA, 103 bp, Artificial Sequence
  Synthetic Polynucleotide
taatacgactcactatagggacttctaaaagaaacaattcaaaaagatataacagaggagaatatctatgtgaattgttaacctggcggcagcgcaaaagatg

SEQ ID NO: 74202 - DNA, 103 bp, Artificial Sequence
  Synthetic Polynucleotide
taatacgactcactatagggatataatagatcaatgactactattcactaaacagaggagatagtgaatggtagtcattaacctggcggcagcgcaaaagatg

SEQ ID NO: 74203 - DNA, 103 bp, Artificial Sequence
  Synthetic Polynucleotide
taatacgactcactataggggaatcacttctaaaagaaacaattcaaaaaaacagaggagatttttgatgtgtttctttaacctggcggcagcgcaaaagatg

SEQ ID NO: 74204 - DNA, 103 bp, Artificial Sequence
  Synthetic Polynucleotide
taatacgactcactatagggtcaaagaatcacttctaaaagaaacaattcaacagaggagagaattgatgcttttagaaaacctggcggcagcgcaaaagatg

SEQ ID NO: 74205 - DNA, 103 bp, Artificial Sequence
  Synthetic Polynucleotide
taatacgactcactatagggcaccatcaaagaatcacttctaaaagaaacaacagaggagagtttctatgagaagtgataacctggcggcagcgcaaaagatg

SEQ ID NO: 74206 - DNA, 103 bp, Artificial Sequence
  Synthetic Polynucleotide
taatacgactcactataggggctaacaccatcaaagaatcacttctaaaaaacagaggagattttagatgtgattctttaacctggcggcagcgcaaaagatg

SEQ ID NO: 74207 - DNA, 103 bp, Artificial Sequence
  Synthetic Polynucleotide
taatacgactcactatagggtgtatgctaacaccatcaaagaatcacttcaacagaggagagaagtgatgctttgatggaacctggcggcagcgcaaaagatg

SEQ ID NO: 74208 - DNA, 103 bp, Artificial Sequence
  Synthetic Polynucleotide
taatacgactcactatagggtaatttgtatgctaacaccatcaaagaatcaacagaggagagattctatgatggtgttaaacctggcggcagcgcaaaagatg

SEQ ID NO: 74209 - DNA, 103 bp, Artificial Sequence
  Synthetic Polynucleotide
taatacgactcactatagggtattgtaatttgtatgctaacaccatcaaaaacagaggagatttgatatggttagcataaacctggcggcagcgcaaaagatg

SEQ ID NO: 74210 - DNA, 103 bp, Artificial Sequence
  Synthetic Polynucleotide
taatacgactcactatagggtgcattattgtaatttgtatgctaacaccaaacagaggagatggtgtatgcatacaaataacctggcggcagcgcaaaagatg

SEQ ID NO: 74211 - DNA, 103 bp, Artificial Sequence
  Synthetic Polynucleotide
taatacgactcactataggggtttctgcattattgtaatttgtatgctaaaacagaggagattagcaatgaaattacaaaacctggcggcagcgcaaaagatg

SEQ ID NO: 74212 - DNA, 103 bp, Artificial Sequence
  Synthetic Polynucleotide
taatacgactcactatagggactgagtttctgcattattgtaatttgtataacagaggagaatacaaatgacaataatgaacctggcggcagcgcaaaagatg

SEQ ID NO: 74213 - DNA, 103 bp, Artificial Sequence
  Synthetic Polynucleotide
taatacgactcactataggggtttcatataatagatcaatgactactattaacagaggagaaatagtatgcattgatctaacctggcggcagcgcaaaagatg

SEQ ID NO: 74214 - DNA, 103 bp, Artificial Sequence
  Synthetic Polynucleotide
taatacgactcactatagggtgttaactgagtttctgcattattgtaattaacagaggagaaattacatgaatgcagaaaacctggcggcagcgcaaaagatg

SEQ ID NO: 74215 - DNA, 103 bp, Artificial Sequence
  Synthetic Polynucleotide
taatacgactcactatagggctgtatgttaactgagtttctgcattattgaacagaggagacaataaatgagaaactcaaacctggcggcagcgcaaaagatg

SEQ ID NO: 74216 - DNA, 103 bp, Artificial Sequence
  Synthetic Polynucleotide
taatacgactcactatagggaattcctgtatgttaactgagtttctgcataacagaggagaatgcagatgctcagttaaaacctggcggcagcgcaaaagatg

SEQ ID NO: 74217 - DNA, 103 bp, Artificial Sequence
  Synthetic Polynucleotide
taatacgactcactatagggactataattcctgtatgttaactgagtttcaacagaggagagaaactatgttaacatacaacctggcggcagcgcaaaagatg

SEQ ID NO: 74218 - DNA, 103 bp, Artificial Sequence
  Synthetic Polynucleotide
taatacgactcactatagggggcttactataattcctgtatgttaactgaaacagaggagatcagttatgatacaggaaaacctggcggcagcgcaaaagatg

SEQ ID NO: 74219 - DNA, 103 bp, Artificial Sequence
  Synthetic Polynucleotide
taatacgactcactataggggaattggcttactataattcctgtatgttaaacagaggagataacatatgggaattataaacctggcggcagcgcaaaagatg

SEQ ID NO: 74220 - DNA, 103 bp, Artificial Sequence
  Synthetic Polynucleotide
taatacgactcactatagggaattggaattggcttactataattcctgtaaacagaggagatacaggatgtatagtaagaacctggcggcagcgcaaaagatg

SEQ ID NO: 74221 - DNA, 103 bp, Artificial Sequence
  Synthetic Polynucleotide
taatacgactcactatagggacagcaattggaattggcttactataattcaacagaggagagaattaatgtaagccaataacctggcggcagcgcaaaagatg

SEQ ID NO: 74222 - DNA, 103 bp, Artificial Sequence
  Synthetic Polynucleotide
taatacgactcactatagggtacggacagcaattggaattggcttactataacagaggagaatagtaatgcaattccaaaacctggcggcagcgcaaaagatg

SEQ ID NO: 74223 - DNA, 103 bp, Artificial Sequence
  Synthetic Polynucleotide
taatacgactcactatagggtacaatacggacagcaattggaattggcttaacagaggagaaagccaatgccaattgctaacctggcggcagcgcaaaagatg

SEQ ID NO: 74224 - DNA, 103 bp, Artificial Sequence
  Synthetic Polynucleotide
taatacgactcactatagggtatccgtttcatataatagatcaatgactaaacagaggagatagtcaatgatctattataacctggcggcagcgcaaaagatg

SEQ ID NO: 74225 - DNA, 103 bp, Artificial Sequence
  Synthetic Polynucleotide
taatacgactcactatagggtctaatacaatacggacagcaattggaattaacagaggagaaattccatgtgctgtccgaacctggcggcagcgcaaaagatg

SEQ ID NO: 74226 - DNA, 103 bp, Artificial Sequence
  Synthetic Polynucleotide
taatacgactcactataggggatactctaatacaatacggacagcaattgaacagaggagacaattgatgtccgtattgaacctggcggcagcgcaaaagatg

SEQ ID NO: 74227 - DNA, 103 bp, Artificial Sequence
  Synthetic Polynucleotide
taatacgactcactatagggatatcgatactctaatacaatacggacagcaacagaggagagctgtcatgattgtattaaacctggcggcagcgcaaaagatg

SEQ ID NO: 74228 - DNA, 103 bp, Artificial Sequence
  Synthetic Polynucleotide
taatacgactcactatagggtactcatatcgatactctaatacaatacggaacagaggagaccgtatatgattagagtaaacctggcggcagcgcaaaagatg

SEQ ID NO: 74229 - DNA, 103 bp, Artificial Sequence
  Synthetic Polynucleotide
taatacgactcactatagggaccattactcatatcgatactctaatacaaaacagaggagattgtatatgagtatcgataacctggcggcagcgcaaaagatg

SEQ ID NO: 74230 - DNA, 103 bp, Artificial Sequence
  Synthetic Polynucleotide
taatacgactcactatagggaggacaccattactcatatcgatactctaaaacagaggagattagagatgcgatatgagaacctggcggcagcgcaaaagatg

SEQ ID NO: 74231 - DNA, 103 bp, Artificial Sequence
  Synthetic Polynucleotide
taatacgactcactatagggacgcaaggacaccattactcatatcgatacaacagaggagagtatcgatgtgagtaatgaacctggcggcagcgcaaaagatg

SEQ ID NO: 74232 - DNA, 103 bp, Artificial Sequence
  Synthetic Polynucleotide
taatacgactcactataggggaaaaacgcaaggacaccattactcatatcaacagaggagagatatgatgaatggtgtcaacctggcggcagcgcaaaagatg

SEQ ID NO: 74233 - DNA, 103 bp, Artificial Sequence
  Synthetic Polynucleotide
taatacgactcactatagggtatcagaaaaacgcaaggacaccattactcaacagaggagagagtaaatgtgtccttgcaacctggcggcagcgcaaaagatg

SEQ ID NO: 74234 - DNA, 103 bp, Artificial Sequence
  Synthetic Polynucleotide
taatacgactcactatagggcattctatcagaaaaacgcaaggacaccataacagaggagaatggtgatgttgcgttttaacctggcggcagcgcaaaagatg

SEQ ID NO: 74235 - DNA, 103 bp, Artificial Sequence
  Synthetic Polynucleotide
taatacgactcactatagggctcaatacactttttattatcttatgaggaaacagaggagatcctcaatggataataaaaacctggcggcagcgcaaaagatg

SEQ ID NO: 74236 - DNA, 103 bp, Artificial Sequence
  Synthetic Polynucleotide
taatacgactcactatagggagacatatccgtttcatataatagatcaataacagaggagaattgatatgttatatgaaaacctggcggcagcgcaaaagatg

SEQ ID NO: 74237 - DNA, 103 bp, Artificial Sequence
  Synthetic Polynucleotide
taatacgactcactataggggctcgcattctatcagaaaaacgcaaggacaacagaggagagtccttatgtttttctgaaacctggcggcagcgcaaaagatg

SEQ ID NO: 74238 - DNA, 103 bp, Artificial Sequence
  Synthetic Polynucleotide
taatacgactcactatagggtcgctgctcgcattctatcagaaaaacgcaaacagaggagatgcgttatgctgatagaaaacctggcggcagcgcaaaagatg

SEQ ID NO: 74239 - DNA, 103 bp, Artificial Sequence
  Synthetic Polynucleotide
taatacgactcactatagggcaaaatcgctgctcgcattctatcagaaaaaacagaggagattttctatgagaatgcgaaacctggcggcagcgcaaaagatg

SEQ ID NO: 74240 - DNA, 103 bp, Artificial Sequence
  Synthetic Polynucleotide
taatacgactcactatagggaacgccaaaatcgctgctcgcattctatcaaacagaggagatgatagatggcgagcagcaacctggcggcagcgcaaaagatg

SEQ ID NO: 74241 - DNA, 103 bp, Artificial Sequence
  Synthetic Polynucleotide
taatacgactcactatagggatgataacgccaaaatcgctgctcgcattcaacagaggagagaatgcatgcagcgatttaacctggcggcagcgcaaaagatg

SEQ ID NO: 74242 - DNA, 103 bp, Artificial Sequence
  Synthetic Polynucleotide
taatacgactcactatagggatcaaatgataacgccaaaatcgctgctcgaacagaggagacgagcaatgattttggcgaacctggcggcagcgcaaaagatg

SEQ ID NO: 74243 - DNA, 103 bp, Artificial Sequence
  Synthetic Polynucleotide
taatacgactcactatagggatatcatcaaatgataacgccaaaatcgctaacagaggagaagcgatatgggcgttatcaacctggcggcagcgcaaaagatg

SEQ ID NO: 74244 - DNA, 103 bp, Artificial Sequence
  Synthetic Polynucleotide
taatacgactcactatagggcaaacatatcatcaaatgataacgccaaaaaacagaggagattttggatgtatcatttgaacctggcggcagcgcaaaagatg

SEQ ID NO: 74245 - DNA, 103 bp, Artificial Sequence
  Synthetic Polynucleotide
taatacgactcactatagggcattccaaacatatcatcaaatgataacgcaacagaggagagcgttaatgtttgatgataacctggcggcagcgcaaaagatg

SEQ ID NO: 74246 - DNA, 103 bp, Artificial Sequence
  Synthetic Polynucleotide
taatacgactcactatagggttcgtcattccaaacatatcatcaaatgataacagaggagaatcattatgtgatatgttaacctggcggcagcgcaaaagatg

SEQ ID NO: 74247 - DNA, 103 bp, Artificial Sequence
  Synthetic Polynucleotide
taatacgactcactataggggttctagacatatccgtttcatataatagaaacagaggagatctattatgtgaaacggaaacctggcggcagcgcaaaagatg

SEQ ID NO: 74248 - DNA, 103 bp, Artificial Sequence
  Synthetic Polynucleotide
taatacgactcactatagggcaggattcgtcattccaaacatatcatcaaaacagaggagattgatgatgtgtttggaaaacctggcggcagcgcaaaagatg

SEQ ID NO: 74249 - DNA, 103 bp, Artificial Sequence
  Synthetic Polynucleotide
taatacgactcactatagggagaaacaggattcgtcattccaaacatatcaacagaggagagatatgatgggaatgacgaacctggcggcagcgcaaaagatg

SEQ ID NO: 74250 - DNA, 103 bp, Artificial Sequence
  Synthetic Polynucleotide
taatacgactcactatagggttagtagaaacaggattcgtcattccaaacaacagaggagagtttggatggacgaatccaacctggcggcagcgcaaaagatg

SEQ ID NO: 74251 - DNA, 103 bp, Artificial Sequence
  Synthetic Polynucleotide
taatacgactcactatagggaaaagttagtagaaacaggattcgtcattcaacagaggagagaatgaatgatcctgtttaacctggcggcagcgcaaaagatg

SEQ ID NO: 74252 - DNA, 103 bp, Artificial Sequence
  Synthetic Polynucleotide
taatacgactcactatagggtaccaaaaagttagtagaaacaggattcgtaacagaggagaacgaatatggtttctactaacctggcggcagcgcaaaagatg

SEQ ID NO: 74253 - DNA, 103 bp, Artificial Sequence
  Synthetic Polynucleotide
taatacgactcactatagggtgtcctaccaaaaagttagtagaaacaggaaacagaggagatcctgtatgtactaacttaacctggcggcagcgcaaaagatg

SEQ ID NO: 74254 - DNA, 103 bp, Artificial Sequence
  Synthetic Polynucleotide
taatacgactcactatagggcactttgtcctaccaaaaagttagtagaaaaacagaggagatttctaatgactttttggaacctggcggcagcgcaaaagatg

SEQ ID NO: 74255 - DNA, 103 bp, Artificial Sequence
  Synthetic Polynucleotide
taatacgactcactatagggtgtttcactttgtcctaccaaaaagttagtaacagaggagaactaacatgttggtaggaaacctggcggcagcgcaaaagatg

SEQ ID NO: 74256 - DNA, 103 bp, Artificial Sequence
  Synthetic Polynucleotide
taatacgactcactatagggttgattgtttcactttgtcctaccaaaaagaacagaggagactttttatgaggacaaagaacctggcggcagcgcaaaagatg

SEQ ID NO: 74257 - DNA, 103 bp, Artificial Sequence
  Synthetic Polynucleotide
taatacgactcactatagggtcttcttgattgtttcactttgtcctaccaaacagaggagatggtagatgaaagtgaaaaacctggcggcagcgcaaaagatg

SEQ ID NO: 74258 - DNA, 103 bp, Artificial Sequence
  Synthetic Polynucleotide
taatacgactcactatagggttgccgttctagacatatccgtttcatataaacagaggagatatatgatgcggatatgtaacctggcggcagcgcaaaagatg

SEQ ID NO: 74259 - DNA, 103 bp, Artificial Sequence
  Synthetic Polynucleotide
taatacgactcactatagggagctatcttcttgattgtttcactttgtccaacagaggagaggacaaatggaaacaatcaacctggcggcagcgcaaaagatg

SEQ ID NO: 74260 - DNA, 103 bp, Artificial Sequence
  Synthetic Polynucleotide
taatacgactcactatagggggagaagctatcttcttgattgtttcacttaacagaggagaaagtgaatgaatcaagaaaacctggcggcagcgcaaaagatg

SEQ ID NO: 74261 - DNA, 103 bp, Artificial Sequence
  Synthetic Polynucleotide
taatacgactcactatagggtaggaggagaagctatcttcttgattgtttaacagaggagaaaacaaatgagaagatagaacctggcggcagcgcaaaagatg

SEQ ID NO: 74262 - DNA, 103 bp, Artificial Sequence
  Synthetic Polynucleotide
taatacgactcactatagggacaaataggaggagaagctatcttcttgataacagaggagaatcaagatgatagcttctaacctggcggcagcgcaaaagatg

SEQ ID NO: 74263 - DNA, 103 bp, Artificial Sequence
  Synthetic Polynucleotide
taatacgactcactatagggcttctacaaataggaggagaagctatcttcaacagaggagagaagatatgttctcctccaacctggcggcagcgcaaaagatg

SEQ ID NO: 74264 - DNA, 103 bp, Artificial Sequence
  Synthetic Polynucleotide
taatacgactcactatagggaatttcttctacaaataggaggagaagctaaacagaggagatagcttatgctcctatttaacctggcggcagcgcaaaagatg

SEQ ID NO: 74265 - DNA, 103 bp, Artificial Sequence
  Synthetic Polynucleotide
taatacgactcactatagggagttcaatttcttctacaaataggaggagaaacagaggagatctcctatgatttgtagaaacctggcggcagcgcaaaagatg

SEQ ID NO: 74266 - DNA, 103 bp, Artificial Sequence
  Synthetic Polynucleotide
taatacgactcactatagggagaggagttcaatttcttctacaaataggaaacagaggagatcctatatgtagaagaaaaacctggcggcagcgcaaaagatg

SEQ ID NO: 74267 - DNA, 103 bp, Artificial Sequence
  Synthetic Polynucleotide
taatacgactcactatagggcatctagaggagttcaatttcttctacaaaaacagaggagatttgtaatggaaattgaaaacctggcggcagcgcaaaagatg

SEQ ID NO: 74268 - DNA, 103 bp, Artificial Sequence
  Synthetic Polynucleotide
taatacgactcactatagggtagatcatctagaggagttcaatttcttctaacagaggagaagaagaatgtgaactcctaacctggcggcagcgcaaaagatg

SEQ ID NO: 74269 - DNA, 103 bp, Artificial Sequence
  Synthetic Polynucleotide
taatacgactcactataggggacaattgccgttctagacatatccgtttcaacagaggagagaaacgatgatgtctagaaacctggcggcagcgcaaaagatg

SEQ ID NO: 74270 - DNA, 103 bp, Artificial Sequence
  Synthetic Polynucleotide
taatacgactcactataggggtcagtagatcatctagaggagttcaatttaacagaggagaaaattgatgtcctctagaaacctggcggcagcgcaaaagatg

SEQ ID NO: 74271 - DNA, 103 bp, Artificial Sequence
  Synthetic Polynucleotide
taatacgactcactatagggctatcgtcagtagatcatctagaggagttcaacagaggagagaactcatgtagatgatcaacctggcggcagcgcaaaagatg

SEQ ID NO: 74272 - DNA, 103 bp, Artificial Sequence
  Synthetic Polynucleotide
taatacgactcactatagggagatactatcgtcagtagatcatctagaggaacagaggagacctctaatggatctactgaacctggcggcagcgcaaaagatg

SEQ ID NO: 74273 - DNA, 103 bp, Artificial Sequence
  Synthetic Polynucleotide
taatacgactcactatagggcaaggagatactatcgtcagtagatcatctaacagaggagaagatgaatgactgacgataacctggcggcagcgcaaaagatg

SEQ ID NO: 74274 - DNA, 103 bp, Artificial Sequence
  Synthetic Polynucleotide
taatacgactcactatagggtctgtcaaggagatactatcgtcagtagataacagaggagaatctacatgcgatagtataacctggcggcagcgcaaaagatg

SEQ ID NO: 74275 - DNA, 103 bp, Artificial Sequence
  Synthetic Polynucleotide
taatacgactcactatagggcaatatctgtcaaggagatactatcgtcagaacagaggagactgacgatggtatctcctaacctggcggcagcgcaaaagatg

SEQ ID NO: 74276 - DNA, 103 bp, Artificial Sequence
  Synthetic Polynucleotide
taatacgactcactatagggcggaccaatatctgtcaaggagatactatcaacagaggagagatagtatgtccttgacaaacctggcggcagcgcaaaagatg

SEQ ID NO: 74277 - DNA, 103 bp, Artificial Sequence
  Synthetic Polynucleotide
taatacgactcactatagggtaattcggaccaatatctgtcaaggagataaacagaggagatatctcatggacagatataacctggcggcagcgcaaaagatg

SEQ ID NO: 74278 - DNA, 103 bp, Artificial Sequence
  Synthetic Polynucleotide
taatacgactcactatagggttctgtaattcggaccaatatctgtcaaggaacagaggagaccttgaatgatattggtcaacctggcggcagcgcaaaagatg

SEQ ID NO: 74279 - DNA, 103 bp, Artificial Sequence
  Synthetic Polynucleotide
taatacgactcactatagggggtacttctgtaattcggaccaatatctgtaacagaggagaacagatatgggtccgaataacctggcggcagcgcaaaagatg

SEQ ID NO: 74280 - DNA, 103 bp, Artificial Sequence
  Synthetic Polynucleotide
taatacgactcactatagggcgtaagacaattgccgttctagacatatccaacagaggagaggatatatgtagaacggcaacctggcggcagcgcaaaagatg

SEQ ID NO: 74281 - DNA, 103 bp, Artificial Sequence
  Synthetic Polynucleotide
taatacgactcactatagggttccaggtacttctgtaattcggaccaataaacagaggagatattggatggaattacagaacctggcggcagcgcaaaagatg

SEQ ID NO: 74282 - DNA, 103 bp, Artificial Sequence
  Synthetic Polynucleotide
taatacgactcactatagggttacattccaggtacttctgtaattcggacaacagaggagagtccgaatgacagaagtaaacctggcggcagcgcaaaagatg

SEQ ID NO: 74283 - DNA, 103 bp, Artificial Sequence
  Synthetic Polynucleotide
taatacgactcactataggggggctttacattccaggtacttctgtaattaacagaggagaaattacatgagtacctggaacctggcggcagcgcaaaagatg

SEQ ID NO: 74284 - DNA, 103 bp, Artificial Sequence
  Synthetic Polynucleotide
taatacgactcactatagggtttcagggctttacattccaggtacttctgaacagaggagacagaagatgctggaatgtaacctggcggcagcgcaaaagatg

SEQ ID NO: 74285 - DNA, 103 bp, Artificial Sequence
  Synthetic Polynucleotide
taatacgactcactataggggggggtttcagggctttacattccaggtacaacagaggagagtacctatgatgtaaagcaacctggcggcagcgcaaaagatg

SEQ ID NO: 74286 - DNA, 103 bp, Artificial Sequence
  Synthetic Polynucleotide
taatacgactcactatagggaatgagggggtttcagggctttacattccaaacagaggagatggaatatgaagccctgaaacctggcggcagcgcaaaagatg

SEQ ID NO: 74287 - DNA, 103 bp, Artificial Sequence
  Synthetic Polynucleotide
taatacgactcactatagggtaaaaaatgagggggtttcagggctttacaaacagaggagatgtaaaatgctgaaacccaacctggcggcagcgcaaaagatg

SEQ ID NO: 74288 - DNA, 103 bp, Artificial Sequence
  Synthetic Polynucleotide
taatacgactcactatagggctgcttaaaaaatgagggggtttcagggctaacagaggagaagccctatgaccccctcaaacctggcggcagcgcaaaagatg

SEQ ID NO: 74289 - DNA, 103 bp, Artificial Sequence
  Synthetic Polynucleotide
taatacgactcactatagggacaatctgcttaaaaaatgagggggtttcaaacagaggagatgaaacatgctcatttttaacctggcggcagcgcaaaagatg

SEQ ID NO: 74290 - DNA, 103 bp, Artificial Sequence
  Synthetic Polynucleotide
taatacgactcactatagggcggcaacaatctgcttaaaaaatgagggggaacagaggagaccccctatgtttttaagcaacctggcggcagcgcaaaagatg

SEQ ID NO: 74291 - DNA, 103 bp, Artificial Sequence
  Synthetic Polynucleotide
taatacgactcactatagggctggacgtaagacaattgccgttctagacaaacagaggagatgtctaatgcggcaattgaacctggcggcagcgcaaaagatg

SEQ ID NO: 74292 - DNA, 103 bp, Artificial Sequence
  Synthetic Polynucleotide
taatacgactcactatagggatttacggcaacaatctgcttaaaaaatgaaacagaggagatcatttatgaagcagattaacctggcggcagcgcaaaagatg

SEQ ID NO: 74293 - DNA, 103 bp, Artificial Sequence
  Synthetic Polynucleotide
taatacgactcactataggggcaggatttacggcaacaatctgcttaaaaaacagaggagattttaaatggattgttgcaacctggcggcagcgcaaaagatg

SEQ ID NO: 74294 - DNA, 103 bp, Artificial Sequence
  Synthetic Polynucleotide
taatacgactcactatagggatagtgcaggatttacggcaacaatctgctaacagaggagaagcagaatgttgccgtaaaacctggcggcagcgcaaaagatg

SEQ ID NO: 74295 - DNA, 103 bp, Artificial Sequence
  Synthetic Polynucleotide
taatacgactcactatagggtggacatagtgcaggatttacggcaacaataacagaggagaattgttatggtaaatcctaacctggcggcagcgcaaaagatg

SEQ ID NO: 74296 - DNA, 103 bp, Artificial Sequence
  Synthetic Polynucleotide
taatacgactcactatagggtatcttggacatagtgcaggatttacggcaaacagaggagatgccgtatgtcctgcactaacctggcggcagcgcaaaagatg

SEQ ID NO: 74297 - DNA, 103 bp, Artificial Sequence
  Synthetic Polynucleotide
taatacgactcactatagggctctctatcttggacatagtgcaggatttaaacagaggagataaatcatgcactatgtcaacctggcggcagcgcaaaagatg

SEQ ID NO: 74298 - DNA, 103 bp, Artificial Sequence
  Synthetic Polynucleotide
taatacgactcactatagggaggagctctctatcttggacatagtgcaggaacagaggagacctgcaatgtgtccaagaaacctggcggcagcgcaaaagatg

SEQ ID NO: 74299 - DNA, 103 bp, Artificial Sequence
  Synthetic Polynucleotide
taatacgactcactatagggaccaaaggagctctctatcttggacatagtaacagaggagaactatgatgaagatagagaacctggcggcagcgcaaaagatg

SEQ ID NO: 74300 - DNA, 103 bp, Artificial Sequence
  Synthetic Polynucleotide
taatacgactcactataggggattcaccaaaggagctctctatcttggacaacagaggagagtccaaatgagagagctcaacctggcggcagcgcaaaagatg

SEQ ID NO: 74301 - DNA, 103 bp, Artificial Sequence
  Synthetic Polynucleotide
taatacgactcactatagggagatggattcaccaaaggagctctctatctaacagaggagaagatagatggctcctttgaacctggcggcagcgcaaaagatg

SEQ ID NO: 74302 - DNA, 103 bp, Artificial Sequence
  Synthetic Polynucleotide
taatacgactcactataggggttaactggacgtaagacaattgccgttctaacagaggagaagaacgatgattgtcttaaacctggcggcagcgcaaaagatg

SEQ ID NO: 74303 - DNA, 103 bp, Artificial Sequence
  Synthetic Polynucleotide
taatacgactcactatagggcatagagatggattcaccaaaggagctctcaacagaggagagagagcatgtttggtgaaaacctggcggcagcgcaaaagatg

SEQ ID NO: 74304 - DNA, 103 bp, Artificial Sequence
  Synthetic Polynucleotide
taatacgactcactatagggtgaaacatagagatggattcaccaaaggagaacagaggagactccttatgtgaatccataacctggcggcagcgcaaaagatg

SEQ ID NO: 74305 - DNA, 103 bp, Artificial Sequence
  Synthetic Polynucleotide
taatacgactcactatagggtaaactgaaacatagagatggattcaccaaaacagaggagattggtgatgccatctctaaacctggcggcagcgcaaaagatg

SEQ ID NO: 74306 - DNA, 103 bp, Artificial Sequence
  Synthetic Polynucleotide
taatacgactcactatagggttggttaaactgaaacatagagatggattcaacagaggagagaatccatgtctatgtttaacctggcggcagcgcaaaagatg

SEQ ID NO: 74307 - DNA, 103 bp, Artificial Sequence
  Synthetic Polynucleotide
taatacgactcactataggggtttcttggttaaactgaaacatagagatgaacagaggagacatctcatggtttcagttaacctggcggcagcgcaaaagatg

SEQ ID NO: 74308 - DNA, 103 bp, Artificial Sequence
  Synthetic Polynucleotide
taatacgactcactatagggtgactgtttcttggttaaactgaaacatagaacagaggagactatgtatgagtttaaccaacctggcggcagcgcaaaagatg

SEQ ID NO: 74309 - DNA, 103 bp, Artificial Sequence
  Synthetic Polynucleotide
taatacgactcactatagggccagctgactgtttcttggttaaactgaaaaacagaggagatttcagatgaaccaagaaaacctggcggcagcgcaaaagatg

SEQ ID NO: 74310 - DNA, 103 bp, Artificial Sequence
  Synthetic Polynucleotide
taatacgactcactatagggttagaccagctgactgtttcttggttaaacaacagaggagagtttaaatgagaaacagtaacctggcggcagcgcaaaagatg

SEQ ID NO: 74311 - DNA, 103 bp, Artificial Sequence
  Synthetic Polynucleotide
taatacgactcactatagggaaattttagaccagctgactgtttcttggtaacagaggagaaccaagatgcagtcagctaacctggcggcagcgcaaaagatg

SEQ ID NO: 74312 - DNA, 103 bp, Artificial Sequence
  Synthetic Polynucleotide
taatacgactcactataggggatggaaattttagaccagctgactgtttcaacagaggagagaaacaatgagctggtctaacctggcggcagcgcaaaagatg

SEQ ID NO: 74313 - DNA, 103 bp, Artificial Sequence
  Synthetic Polynucleotide
taatacgactcactatagggaaagtgttaactggacgtaagacaattgccaacagaggagaggcaatatgcttacgtccaacctggcggcagcgcaaaagatg

SEQ ID NO: 74314 - DNA, 103 bp, Artificial Sequence
  Synthetic Polynucleotide
taatacgactcactatagggatagagatggaaattttagaccagctgactaacagaggagaagtcagatggtctaaaataacctggcggcagcgcaaaagatg

SEQ ID NO: 74315 - DNA, 103 bp, Artificial Sequence
  Synthetic Polynucleotide
taatacgactcactatagggattagatagagatggaaattttagaccagcaacagaggagagctggtatgaaatttccaaacctggcggcagcgcaaaagatg

SEQ ID NO: 74316 - DNA, 103 bp, Artificial Sequence
  Synthetic Polynucleotide
taatacgactcactataggggctgtattagatagagatggaaattttagaaacagaggagatctaaaatgtccatctctaacctggcggcagcgcaaaagatg

SEQ ID NO: 74317 - DNA, 103 bp, Artificial Sequence
  Synthetic Polynucleotide
taatacgactcactatagggtggatgctgtattagatagagatggaaattaacagaggagaaatttcatgctctatctaaacctggcggcagcgcaaaagatg

SEQ ID NO: 74318 - DNA, 103 bp, Artificial Sequence
  Synthetic Polynucleotide
taatacgactcactatagggcaagttggatgctgtattagatagagatggaacagaggagaccatctatgtctaatacaaacctggcggcagcgcaaaagatg

SEQ ID NO: 74319 - DNA, 103 bp, Artificial Sequence
  Synthetic Polynucleotide
taatacgactcactataggggacatcaagttggatgctgtattagatagaaacagaggagatctatcatgtacagcatcaacctggcggcagcgcaaaagatg

SEQ ID NO: 74320 - DNA, 103 bp, Artificial Sequence
  Synthetic Polynucleotide
taatacgactcactatagggttcctgacatcaagttggatgctgtattagaacagaggagactaataatgcatccaactaacctggcggcagcgcaaaagatg

SEQ ID NO: 74321 - DNA, 103 bp, Artificial Sequence
  Synthetic Polynucleotide
taatacgactcactatagggcatagttcctgacatcaagttggatgctgtaacagaggagaacagcaatgaacttgatgaacctggcggcagcgcaaaagatg

SEQ ID NO: 74322 - DNA, 103 bp, Artificial Sequence
  Synthetic Polynucleotide
taatacgactcactatagggccggtcatagttcctgacatcaagttggataacagaggagaatccaaatggatgtcaggaacctggcggcagcgcaaaagatg

SEQ ID NO: 74323 - DNA, 103 bp, Artificial Sequence
  Synthetic Polynucleotide
taatacgactcactatagggttaaaccggtcatagttcctgacatcaagtaacagaggagaacttgaatgcaggaactaaacctggcggcagcgcaaaagatg

SEQ ID NO: 74324 - DNA, 103 bp, Artificial Sequence
  Synthetic Polynucleotide
taatacgactcactatagggcaaagaaagtgttaactggacgtaagacaaaacagaggagattgtctatggtccagttaaacctggcggcagcgcaaaagatg

SEQ ID NO: 74325 - DNA, 103 bp, Artificial Sequence
  Synthetic Polynucleotide
taatacgactcactatagggtaacattaaaccggtcatagttcctgacataacagaggagaatgtcaatgactatgaccaacctggcggcagcgcaaaagatg

SEQ ID NO: 74326 - DNA, 103 bp, Artificial Sequence
  Synthetic Polynucleotide
taatacgactcactatagggacatataacattaaaccggtcatagttcctaacagaggagaaggaacatggaccggtttaacctggcggcagcgcaaaagatg

SEQ ID NO: 74327 - DNA, 103 bp, Artificial Sequence
  Synthetic Polynucleotide
taatacgactcactatagggatgttacatataacattaaaccggtcatagaacagaggagactatgaatggtttaatgtaacctggcggcagcgcaaaagatg

SEQ ID NO: 74328 - DNA, 103 bp, Artificial Sequence
  Synthetic Polynucleotide
taatacgactcactatagggacttaatgttacatataacattaaaccggtaacagaggagaaccggtatgatgttatataacctggcggcagcgcaaaagatg

SEQ ID NO: 74329 - DNA, 103 bp, Artificial Sequence
  Synthetic Polynucleotide
taatacgactcactataggggatttacttaatgttacatataacattaaaaacagaggagatttaatatgatatgtaacaacctggcggcagcgcaaaagatg

SEQ ID NO: 74330 - DNA, 103 bp, Artificial Sequence
  Synthetic Polynucleotide
taatacgactcactatagggttaaggatttacttaatgttacatataacaaacagaggagatgttatatgtaacattaaaacctggcggcagcgcaaaagatg

SEQ ID NO: 74331 - DNA, 103 bp, Artificial Sequence
  Synthetic Polynucleotide
taatacgactcactatagggtgaacttaaggatttacttaatgttacataaacagaggagatatgtaatgttaagtaaaaacctggcggcagcgcaaaagatg

SEQ ID NO: 74332 - DNA, 103 bp, Artificial Sequence
  Synthetic Polynucleotide
taatacgactcactataggggattatgaacttaaggatttacttaatgttaacagaggagaaacattatgtaaatccttaacctggcggcagcgcaaaagatg

SEQ ID NO: 74333 - DNA, 103 bp, Artificial Sequence
  Synthetic Polynucleotide
taatacgactcactataggggtgatgattatgaacttaaggatttacttaaacagaggagataagtaatgccttaagttaacctggcggcagcgcaaaagatg

SEQ ID NO: 74334 - DNA, 103 bp, Artificial Sequence
  Synthetic Polynucleotide
taatacgactcactatagggtgacagtgatgattatgaacttaaggatttaacagaggagaaaatccatgagttcataaaacctggcggcagcgcaaaagatg

SEQ ID NO: 74335 - DNA, 103 bp, Artificial Sequence
  Synthetic Polynucleotide
taatacgactcactatagggtaaatcaaagaaagtgttaactggacgtaaaacagaggagattacgtatggttaacactaacctggcggcagcgcaaaagatg

SEQ ID NO: 74336 - DNA, 103 bp, Artificial Sequence
  Synthetic Polynucleotide
taatacgactcactatagggactgatgacagtgatgattatgaacttaagaacagaggagacttaagatgataatcatcaacctggcggcagcgcaaaagatg

SEQ ID NO: 74337 - DNA, 103 bp, Artificial Sequence
  Synthetic Polynucleotide
taatacgactcactatagggacataactgatgacagtgatgattatgaacaacagaggagagttcatatgcatcactgtaacctggcggcagcgcaaaagatg

SEQ ID NO: 74338 - DNA, 103 bp, Artificial Sequence
  Synthetic Polynucleotide
taatacgactcactatagggatcgtacataactgatgacagtgatgattaaacagaggagataatcaatgctgtcatcaaacctggcggcagcgcaaaagatg

SEQ ID NO: 74339 - DNA, 103 bp, Artificial Sequence
  Synthetic Polynucleotide
taatacgactcactatagggtttggatcgtacataactgatgacagtgataacagaggagaatcactatgatcagttataacctggcggcagcgcaaaagatg

SEQ ID NO: 74340 - DNA, 103 bp, Artificial Sequence
  Synthetic Polynucleotide
taatacgactcactatagggcattgtttggatcgtacataactgatgacaaacagaggagatgtcatatgttatgtacgaacctggcggcagcgcaaaagatg

SEQ ID NO: 74341 - DNA, 103 bp, Artificial Sequence
  Synthetic Polynucleotide
taatacgactcactatagggagaaacattgtttggatcgtacataactgaaacagaggagatcagttatgtacgatccaaacctggcggcagcgcaaaagatg

SEQ ID NO: 74342 - DNA, 103 bp, Artificial Sequence
  Synthetic Polynucleotide
taatacgactcactatagggtcggtagaaacattgtttggatcgtacataaacagaggagatatgtaatgtccaaacaaaacctggcggcagcgcaaaagatg

SEQ ID NO: 74343 - DNA, 103 bp, Artificial Sequence
  Synthetic Polynucleotide
taatacgactcactatagggctatgtcggtagaaacattgtttggatcgtaacagaggagaacgatcatgacaatgtttaacctggcggcagcgcaaaagatg

SEQ ID NO: 74344 - DNA, 103 bp, Artificial Sequence
  Synthetic Polynucleotide
taatacgactcactatagggatccactatgtcggtagaaacattgtttggaacagaggagaccaaacatggtttctaccaacctggcggcagcgcaaaagatg

SEQ ID NO: 74345 - DNA, 103 bp, Artificial Sequence
  Synthetic Polynucleotide
taatacgactcactatagggttcgtatccactatgtcggtagaaacattgaacagaggagacaatgtatgtaccgacataacctggcggcagcgcaaaagatg

SEQ ID NO: 74346 - DNA, 103 bp, Artificial Sequence
  Synthetic Polynucleotide
taatacgactcactatagggtcactctcaatacactttttattatcttataacagaggagaataagaatgtaaaaagtgaacctggcggcagcgcaaaagatg

SEQ ID NO: 74347 - DNA, 103 bp, Artificial Sequence
  Synthetic Polynucleotide
taatacgactcactataggggactttaaatcaaagaaagtgttaactggaaacagaggagatccagtatgcactttcttaacctggcggcagcgcaaaagatg

SEQ ID NO: 74348 - DNA, 103 bp, Artificial Sequence
  Synthetic Polynucleotide
taatacgactcactataggggtatcttcgtatccactatgtcggtagaaaaacagaggagatttctaatgacatagtggaacctggcggcagcgcaaaagatg

SEQ ID NO: 74349 - DNA, 103 bp, Artificial Sequence
  Synthetic Polynucleotide
taatacgactcactatagggggatagtatcttcgtatccactatgtcggtaacagaggagaaccgacatggtggatacgaacctggcggcagcgcaaaagatg

SEQ ID NO: 74350 - DNA, 103 bp, Artificial Sequence
  Synthetic Polynucleotide
taatacgactcactatagggctgatggatagtatcttcgtatccactatgaacagaggagacatagtatgtacgaagataacctggcggcagcgcaaaagatg

SEQ ID NO: 74351 - DNA, 103 bp, Artificial Sequence
  Synthetic Polynucleotide
taatacgactcactatagggacattctgatggatagtatcttcgtatccaaacagaggagatggataatgagatactataacctggcggcagcgcaaaagatg

SEQ ID NO: 74352 - DNA, 103 bp, Artificial Sequence
  Synthetic Polynucleotide
taatacgactcactataggggggaaacattctgatggatagtatcttcgtaacagaggagaacgaagatgctatccatcaacctggcggcagcgcaaaagatg

SEQ ID NO: 74353 - DNA, 103 bp, Artificial Sequence
  Synthetic Polynucleotide
taatacgactcactatagggaatcagggaaacattctgatggatagtatcaacagaggagagatactatgcatcagaataacctggcggcagcgcaaaagatg

SEQ ID NO: 74354 - DNA, 103 bp, Artificial Sequence
  Synthetic Polynucleotide
taatacgactcactatagggatactaatcagggaaacattctgatggataaacagaggagatatccaatggaatgtttcaacctggcggcagcgcaaaagatg

SEQ ID NO: 74355 - DNA, 103 bp, Artificial Sequence
  Synthetic Polynucleotide
taatacgactcactatagggagaaaatactaatcagggaaacattctgataacagaggagaatcagaatgtttccctgaaacctggcggcagcgcaaaagatg

SEQ ID NO: 74356 - DNA, 103 bp, Artificial Sequence
  Synthetic Polynucleotide
taatacgactcactatagggtatatagaaaatactaatcagggaaacattaacagaggagaaatgttatgctgattagtaacctggcggcagcgcaaaagatg

SEQ ID NO: 74357 - DNA, 103 bp, Artificial Sequence
  Synthetic Polynucleotide
taatacgactcactatagggatagctatatagaaaatactaatcagggaaaacagaggagattccctatgtagtattttaacctggcggcagcgcaaaagatg

SEQ ID NO: 74358 - DNA, 103 bp, Artificial Sequence
  Synthetic Polynucleotide
taatacgactcactatagggctctagactttaaatcaaagaaagtgttaaaacagaggagattaacaatgtctttgattaacctggcggcagcgcaaaagatg

SEQ ID NO: 74359 - DNA, 103 bp, Artificial Sequence
  Synthetic Polynucleotide
taatacgactcactataggggaagaatagctatatagaaaatactaatcaaacagaggagatgattaatgttttctataaacctggcggcagcgcaaaagatg

SEQ ID NO: 74360 - DNA, 103 bp, Artificial Sequence
  Synthetic Polynucleotide
taatacgactcactatagggttaaagaagaatagctatatagaaaatactaacagaggagaagtattatgtatatagctaacctggcggcagcgcaaaagatg

SEQ ID NO: 74361 - DNA, 103 bp, Artificial Sequence
  Synthetic Polynucleotide
taatacgactcactatagggatcgtttaaagaagaatagctatatagaaaaacagaggagatttctaatgagctattctaacctggcggcagcgcaaaagatg

SEQ ID NO: 74362 - DNA, 103 bp, Artificial Sequence
  Synthetic Polynucleotide
taatacgactcactatagggggaaaatcgtttaaagaagaatagctatataacagaggagaatatagatgttcttctttaacctggcggcagcgcaaaagatg

SEQ ID NO: 74363 - DNA, 103 bp, Artificial Sequence
  Synthetic Polynucleotide
taatacgactcactataggggatttggaaaatcgtttaaagaagaatagcaacagaggagagctattatgctttaaacgaacctggcggcagcgcaaaagatg

SEQ ID NO: 74364 - DNA, 103 bp, Artificial Sequence
  Synthetic Polynucleotide
taatacgactcactatagggttactgatttggaaaatcgtttaaagaagaaacagaggagatcttctatgaacgattttaacctggcggcagcgcaaaagatg

SEQ ID NO: 74365 - DNA, 103 bp, Artificial Sequence
  Synthetic Polynucleotide
taatacgactcactatagggcatagttactgatttggaaaatcgtttaaaaacagaggagatttaaaatgttttccaaaaacctggcggcagcgcaaaagatg

SEQ ID NO: 74366 - DNA, 103 bp, Artificial Sequence
  Synthetic Polynucleotide
taatacgactcactatagggatgaacatagttactgatttggaaaatcgtaacagaggagaacgattatgcaaatcagtaacctggcggcagcgcaaaagatg

SEQ ID NO: 74367 - DNA, 103 bp, Artificial Sequence
  Synthetic Polynucleotide
taatacgactcactatagggaaaaaatgaacatagttactgatttggaaaaacagaggagatttccaatgcagtaactaaacctggcggcagcgcaaaagatg

SEQ ID NO: 74368 - DNA, 103 bp, Artificial Sequence
  Synthetic Polynucleotide
taatacgactcactatagggtcctaaaaaaatgaacatagttactgatttaacagaggagaaaatcaatgactatgttcaacctggcggcagcgcaaaagatg

SEQ ID NO: 74369 - DNA, 103 bp, Artificial Sequence
  Synthetic Polynucleotide
taatacgactcactatagggaaagactctagactttaaatcaaagaaagtaacagaggagaactttcatggatttaaagaacctggcggcagcgcaaaagatg

SEQ ID NO: 74370 - DNA, 103 bp, Artificial Sequence
  Synthetic Polynucleotide
taatacgactcactatagggcatactcctaaaaaaatgaacatagttactaacagaggagaagtaacatggttcattttaacctggcggcagcgcaaaagatg

SEQ ID NO: 74371 - DNA, 103 bp, Artificial Sequence
  Synthetic Polynucleotide
taatacgactcactatagggggcgtcatactcctaaaaaaatgaacatagaacagaggagactatgtatgtttttttagaacctggcggcagcgcaaaagatg

SEQ ID NO: 74372 - DNA, 103 bp, Artificial Sequence
  Synthetic Polynucleotide
taatacgactcactatagggggctaggcgtcatactcctaaaaaaatgaaaacagaggagattcattatgttaggagtaaacctggcggcagcgcaaaagatg

SEQ ID NO: 74373 - DNA, 103 bp, Artificial Sequence
  Synthetic Polynucleotide
taatacgactcactatagggatgctggctaggcgtcatactcctaaaaaaaacagaggagattttttatgagtatgacgaacctggcggcagcgcaaaagatg

SEQ ID NO: 74374 - DNA, 103 bp, Artificial Sequence
  Synthetic Polynucleotide
taatacgactcactatagggcttccatgctggctaggcgtcatactcctaaacagaggagataggagatggacgcctagaacctggcggcagcgcaaaagatg

SEQ ID NO: 74375 - DNA, 103 bp, Artificial Sequence
  Synthetic Polynucleotide
taatacgactcactatagggattctcttccatgctggctaggcgtcatacaacagaggagagtatgaatgctagccagcaacctggcggcagcgcaaaagatg

SEQ ID NO: 74376 - DNA, 103 bp, Artificial Sequence
  Synthetic Polynucleotide
taatacgactcactatagggagaaaattctcttccatgctggctaggcgtaacagaggagaacgcctatgcagcatggaaacctggcggcagcgcaaaagatg

SEQ ID NO: 74377 - DNA, 103 bp, Artificial Sequence
  Synthetic Polynucleotide
taatacgactcactataggggatctagaaaattctcttccatgctggctaaacagaggagatagccaatgtggaagagaaacctggcggcagcgcaaaagatg

SEQ ID NO: 74378 - DNA, 103 bp, Artificial Sequence
  Synthetic Polynucleotide
taatacgactcactataggggagaggatctagaaaattctcttccatgctaacagaggagaagcatgatggagaattttaacctggcggcagcgcaaaagatg

SEQ ID NO: 74379 - DNA, 103 bp, Artificial Sequence
  Synthetic Polynucleotide
taatacgactcactatagggttgaagagaggatctagaaaattctcttccaacagaggagaggaagaatgttttctagaaacctggcggcagcgcaaaagatg

SEQ ID NO: 74380 - DNA, 103 bp, Artificial Sequence
  Synthetic Polynucleotide
taatacgactcactatagggtttgcaaagactctagactttaaatcaaagaacagaggagactttgaatgaaagtctagaacctggcggcagcgcaaaagatg

SEQ ID NO: 74381 - DNA, 103 bp, Artificial Sequence
  Synthetic Polynucleotide
taatacgactcactatagggagatgttgaagagaggatctagaaaattctaacagaggagaagaattatgtagatcctcaacctggcggcagcgcaaaagatg

SEQ ID NO: 74382 - DNA, 103 bp, Artificial Sequence
  Synthetic Polynucleotide
taatacgactcactatagggattaaagatgttgaagagaggatctagaaaaacagaggagatttctaatgcctctcttcaacctggcggcagcgcaaaagatg

SEQ ID NO: 74383 - DNA, 103 bp, Artificial Sequence
  Synthetic Polynucleotide
taatacgactcactatagggttgagattaaagatgttgaagagaggatctaacagaggagaagatccatgcttcaacataacctggcggcagcgcaaaagatg

SEQ ID NO: 74384 - DNA, 103 bp, Artificial Sequence
  Synthetic Polynucleotide
taatacgactcactatagggtcccattgagattaaagatgttgaagagagaacagaggagactctctatgacatctttaaacctggcggcagcgcaaaagatg

SEQ ID NO: 74385 - DNA, 103 bp, Artificial Sequence
  Synthetic Polynucleotide
taatacgactcactatagggttgcatcccattgagattaaagatgttgaaaacagaggagattcaacatgtttaatctcaacctggcggcagcgcaaaagatg

SEQ ID NO: 74386 - DNA, 103 bp, Artificial Sequence
  Synthetic Polynucleotide
taatacgactcactataggggggttttgcatcccattgagattaaagatgaacagaggagacatcttatgtctcaatggaacctggcggcagcgcaaaagatg

SEQ ID NO: 74387 - DNA, 103 bp, Artificial Sequence
  Synthetic Polynucleotide
taatacgactcactatagggccatggggttttgcatcccattgagattaaaacagaggagattaatcatgatgggatgcaacctggcggcagcgcaaaagatg

SEQ ID NO: 74388 - DNA, 103 bp, Artificial Sequence
  Synthetic Polynucleotide
taatacgactcactatagggttacaccatggggttttgcatcccattgagaacagaggagactcaatatgatgcaaaacaacctggcggcagcgcaaaagatg

SEQ ID NO: 74389 - DNA, 103 bp, Artificial Sequence
  Synthetic Polynucleotide
taatacgactcactatagggagttgttacaccatggggttttgcatcccaaacagaggagatgggatatgaaaccccataacctggcggcagcgcaaaagatg

SEQ ID NO: 74390 - DNA, 103 bp, Artificial Sequence
  Synthetic Polynucleotide
taatacgactcactatagggtcgttagttgttacaccatggggttttgcaaacagaggagatgcaaaatgccatggtgtaacctggcggcagcgcaaaagatg

SEQ ID NO: 74391 - DNA, 103 bp, Artificial Sequence
  Synthetic Polynucleotide
taatacgactcactatagggttatgtttgcaaagactctagactttaaataacagaggagaatttaaatgctagagtctaacctggcggcagcgcaaaagatg

SEQ ID NO: 74392 - DNA, 103 bp, Artificial Sequence
  Synthetic Polynucleotide
taatacgactcactatagggttttatcgttagttgttacaccatggggttaacagaggagaaaccccatggtgtaacaaaacctggcggcagcgcaaaagatg

SEQ ID NO: 74393 - DNA, 103 bp, Artificial Sequence
  Synthetic Polynucleotide
taatacgactcactatagggattatttttatcgttagttgttacaccatgaacagaggagacatggtatgacaactaacaacctggcggcagcgcaaaagatg

SEQ ID NO: 74394 - DNA, 103 bp, Artificial Sequence
  Synthetic Polynucleotide
taatacgactcactatagggacaatattatttttatcgttagttgttacaaacagaggagatgtaacatgtaacgataaaacctggcggcagcgcaaaagatg

SEQ ID NO: 74395 - DNA, 103 bp, Artificial Sequence
  Synthetic Polynucleotide
taatacgactcactataggggaaaaacaatattatttttatcgttagttgaacagaggagacaactaatgataaaaataaacctggcggcagcgcaaaagatg

SEQ ID NO: 74396 - DNA, 103 bp, Artificial Sequence
  Synthetic Polynucleotide
taatacgactcactatagggaaagtgaaaaacaatattatttttatcgttaacagaggagaaacgatatgaataatattaacctggcggcagcgcaaaagatg

SEQ ID NO: 74397 - DNA, 103 bp, Artificial Sequence
  Synthetic Polynucleotide
taatacgactcactatagggtataaaaagtgaaaaacaatattatttttaaacagaggagataaaaaatgtattgttttaacctggcggcagcgcaaaagatg

SEQ ID NO: 74398 - DNA, 103 bp, Artificial Sequence
  Synthetic Polynucleotide
taatacgactcactatagggaaaattataaaaagtgaaaaacaatattataacagaggagaataataatgtttttcactaacctggcggcagcgcaaaagatg

SEQ ID NO: 74399 - DNA, 103 bp, Artificial Sequence
  Synthetic Polynucleotide
taatacgactcactatagggatggtaaaattataaaaagtgaaaaacaataacagaggagaattgttatgcactttttaaacctggcggcagcgcaaaagatg

SEQ ID NO: 74400 - DNA, 103 bp, Artificial Sequence
  Synthetic Polynucleotide
taatacgactcactataggggtcaaatggtaaaattataaaaagtgaaaaaacagaggagattttcaatgtttataattaacctggcggcagcgcaaaagatg

SEQ ID NO: 74401 - DNA, 103 bp, Artificial Sequence
  Synthetic Polynucleotide
taatacgactcactatagggcatgagtcaaatggtaaaattataaaaagtaacagaggagaacttttatgaattttaccaacctggcggcagcgcaaaagatg

SEQ ID NO: 74402 - DNA, 103 bp, Artificial Sequence
  Synthetic Polynucleotide
taatacgactcactatagggggatattatgtttgcaaagactctagacttaacagaggagaaagtctatggtctttgcaaacctggcggcagcgcaaaagatg

SEQ ID NO: 74403 - DNA, 103 bp, Artificial Sequence
  Synthetic Polynucleotide
taatacgactcactataggggaagtcatgagtcaaatggtaaaattataaaacagaggagattataaatgtaccatttgaacctggcggcagcgcaaaagatg

SEQ ID NO: 74404 - DNA, 103 bp, Artificial Sequence
  Synthetic Polynucleotide
taatacgactcactatagggtcaatgaagtcatgagtcaaatggtaaaataacagaggagaattttaatgtttgactcaaacctggcggcagcgcaaaagatg

SEQ ID NO: 74405 - DNA, 103 bp, Artificial Sequence
  Synthetic Polynucleotide
taatacgactcactatagggagatatcaatgaagtcatgagtcaaatggtaacagaggagaaccattatgctcatgactaacctggcggcagcgcaaaagatg

SEQ ID NO: 74406 - DNA, 103 bp, Artificial Sequence
  Synthetic Polynucleotide
taatacgactcactatagggtataaagatatcaatgaagtcatgagtcaaaacagaggagattgactatggacttcattaacctggcggcagcgcaaaagatg

SEQ ID NO: 74407 - DNA, 103 bp, Artificial Sequence
  Synthetic Polynucleotide
taatacgactcactataggggctcgtataaagatatcaatgaagtcatgaaacagaggagatcatgaatgcattgatataacctggcggcagcgcaaaagatg

SEQ ID NO: 74408 - DNA, 103 bp, Artificial Sequence
  Synthetic Polynucleotide
taatacgactcactatagggtcgtagctcgtataaagatatcaatgaagtaacagaggagaacttcaatgatatctttaaacctggcggcagcgcaaaagatg

SEQ ID NO: 74409 - DNA, 103 bp, Artificial Sequence
  Synthetic Polynucleotide
taatacgactcactatagggtatattcgtagctcgtataaagatatcaataacagaggagaattgatatgtttatacgaaacctggcggcagcgcaaaagatg

SEQ ID NO: 74410 - DNA, 103 bp, Artificial Sequence
  Synthetic Polynucleotide
taatacgactcactatagggaattatatattcgtagctcgtataaagataaacagaggagatatcttatgacgagctacaacctggcggcagcgcaaaagatg

SEQ ID NO: 74411 - DNA, 103 bp, Artificial Sequence
  Synthetic Polynucleotide
taatacgactcactatagggtaaagaattatatattcgtagctcgtataaaacagaggagattatacatgctacgaataaacctggcggcagcgcaaaagatg

SEQ ID NO: 74412 - DNA, 103 bp, Artificial Sequence
  Synthetic Polynucleotide
taatacgactcactatagggagttataaagaattatatattcgtagctcgaacagaggagacgagctatgaatatataaaacctggcggcagcgcaaaagatg

SEQ ID NO: 74413 - DNA, 103 bp, Artificial Sequence
  Synthetic Polynucleotide
taatacgactcactataggggataaggatattatgtttgcaaagactctaaacagaggagatagagtatgtgcaaacataacctggcggcagcgcaaaagatg

SEQ ID NO: 74414 - DNA, 103 bp, Artificial Sequence
  Synthetic Polynucleotide
taatacgactcactatagggagttcagttataaagaattatatattcgtaaacagaggagatacgaaatgataattcttaacctggcggcagcgcaaaagatg

SEQ ID NO: 74415 - DNA, 103 bp, Artificial Sequence
  Synthetic Polynucleotide
taatacgactcactatagggatctcagttcagttataaagaattatatataacagaggagaatatatatgtctttataaaacctggcggcagcgcaaaagatg

SEQ ID NO: 74416 - DNA, 103 bp, Artificial Sequence
  Synthetic Polynucleotide
taatacgactcactatagggtatatatctcagttcagttataaagaattaaacagaggagataattcatgataactgaaaacctggcggcagcgcaaaagatg

SEQ ID NO: 74417 - DNA, 103 bp, Artificial Sequence
  Synthetic Polynucleotide
taatacgactcactatagggcagtgtatatatctcagttcagttataaagaacagaggagactttatatgtgaactgagaacctggcggcagcgcaaaagatg

SEQ ID NO: 74418 - DNA, 103 bp, Artificial Sequence
  Synthetic Polynucleotide
taatacgactcactatagggagatccagtgtatatatctcagttcagttaaacagaggagataactgatgtgagatataaacctggcggcagcgcaaaagatg

SEQ ID NO: 74419 - DNA, 103 bp, Artificial Sequence
  Synthetic Polynucleotide
taatacgactcactatagggaccatagatccagtgtatatatctcagttcaacagaggagagaactgatgtatatacacaacctggcggcagcgcaaaagatg

SEQ ID NO: 74420 - DNA, 103 bp, Artificial Sequence
  Synthetic Polynucleotide
taatacgactcactatagggtggaaaccatagatccagtgtatatatctcaacagaggagagagataatgacactggataacctggcggcagcgcaaaagatg

SEQ ID NO: 74421 - DNA, 103 bp, Artificial Sequence
  Synthetic Polynucleotide
taatacgactcactatagggaattatggaaaccatagatccagtgtatataacagaggagaatatacatgggatctatgaacctggcggcagcgcaaaagatg

SEQ ID NO: 74422 - DNA, 103 bp, Artificial Sequence
  Synthetic Polynucleotide
taatacgactcactatagggtactcaattatggaaaccatagatccagtgaacagaggagacactggatgtatggtttcaacctggcggcagcgcaaaagatg

SEQ ID NO: 74423 - DNA, 103 bp, Artificial Sequence
  Synthetic Polynucleotide
taatacgactcactatagggttatttactcaattatggaaaccatagatcaacagaggagagatctaatgtttccataaaacctggcggcagcgcaaaagatg

SEQ ID NO: 74424 - DNA, 103 bp, Artificial Sequence
  Synthetic Polynucleotide
taatacgactcactatagggagtcggataaggatattatgtttgcaaagaaacagaggagatctttgatgacataatataacctggcggcagcgcaaaagatg

SEQ ID NO: 74425 - DNA, 103 bp, Artificial Sequence
  Synthetic Polynucleotide
taatacgactcactatagggagcatttatttactcaattatggaaaccataacagaggagaatggttatgataattgagaacctggcggcagcgcaaaagatg

SEQ ID NO: 74426 - DNA, 103 bp, Artificial Sequence
  Synthetic Polynucleotide
taatacgactcactatagggtgcagagcatttatttactcaattatggaaaacagaggagattccatatgtgagtaaataacctggcggcagcgcaaaagatg

SEQ ID NO: 74427 - DNA, 103 bp, Artificial Sequence
  Synthetic Polynucleotide
taatacgactcactataggggttattgcagagcatttatttactcaattaaacagaggagataattgatgaaataaatgaacctggcggcagcgcaaaagatg

SEQ ID NO: 74428 - DNA, 103 bp, Artificial Sequence
  Synthetic Polynucleotide
taatacgactcactatagggcattagttattgcagagcatttatttactcaacagaggagagagtaaatgaatgctctgaacctggcggcagcgcaaaagatg

SEQ ID NO: 74429 - DNA, 103 bp, Artificial Sequence
  Synthetic Polynucleotide
taatacgactcactatagggtttgccattagttattgcagagcatttattaacagaggagaaataaaatgtctgcaataaacctggcggcagcgcaaaagatg

SEQ ID NO: 74430 - DNA, 103 bp, Artificial Sequence
  Synthetic Polynucleotide
taatacgactcactatagggatacatttgccattagttattgcagagcataacagaggagaatgctcatgaataactaaaacctggcggcagcgcaaaagatg

SEQ ID NO: 74431 - DNA, 103 bp, Artificial Sequence
  Synthetic Polynucleotide
taatacgactcactataggggttttatacatttgccattagttattgcagaacagaggagactgcaaatgctaatggcaaacctggcggcagcgcaaaagatg

SEQ ID NO: 74432 - DNA, 103 bp, Artificial Sequence
  Synthetic Polynucleotide
taatacgactcactatagggttgttgttttatacatttgccattagttataacagaggagaataactatgggcaaatgtaacctggcggcagcgcaaaagatg

SEQ ID NO: 74433 - DNA, 103 bp, Artificial Sequence
  Synthetic Polynucleotide
taatacgactcactatagggtaattttgttgttttatacatttgccattaaacagaggagataatggatgatgtataaaaacctggcggcagcgcaaaagatg

SEQ ID NO: 74434 - DNA, 103 bp, Artificial Sequence
  Synthetic Polynucleotide
taatacgactcactatagggtagtataattttgttgttttatacatttgcaacagaggagagcaaatatgtaaaacaacaacctggcggcagcgcaaaagatg

SEQ ID NO: 74435 - DNA, 103 bp, Artificial Sequence
  Synthetic Polynucleotide
taatacgactcactatagggtataaagtcggataaggatattatgtttgcaacagaggagagcaaacatgatatccttaaacctggcggcagcgcaaaagatg

SEQ ID NO: 74436 - DNA, 103 bp, Artificial Sequence
  Synthetic Polynucleotide
taatacgactcactatagggaactctagtataattttgttgttttatacaaacagaggagatgtataatgcaacaaaataacctggcggcagcgcaaaagatg

SEQ ID NO: 74437 - DNA, 103 bp, Artificial Sequence
  Synthetic Polynucleotide
taatacgactcactatagggttaacaactctagtataattttgttgttttaacagaggagaaaaacaatgaaattatacaacctggcggcagcgcaaaagatg

SEQ ID NO: 74438 - DNA, 103 bp, Artificial Sequence
  Synthetic Polynucleotide
taatacgactcactatagggtaactttaacaactctagtataattttgttaacagaggagaaacaaaatgatactagagaacctggcggcagcgcaaaagatg

SEQ ID NO: 74439 - DNA, 103 bp, Artificial Sequence
  Synthetic Polynucleotide
taatacgactcactatagggaatattaactttaacaactctagtataattaacagaggagaaattatatgagagttgttaacctggcggcagcgcaaaagatg

SEQ ID NO: 74440 - DNA, 103 bp, Artificial Sequence
  Synthetic Polynucleotide
taatacgactcactatagggtagaaaatattaactttaacaactctagtaaacagaggagatactagatgtgttaaagtaacctggcggcagcgcaaaagatg

SEQ ID NO: 74441 - DNA, 103 bp, Artificial Sequence
  Synthetic Polynucleotide
taatacgactcactatagggactaatagaaaatattaactttaacaactcaacagaggagagagttgatgaagttaataaacctggcggcagcgcaaaagatg

SEQ ID NO: 74442 - DNA, 103 bp, Artificial Sequence
  Synthetic Polynucleotide
taatacgactcactataggggaacaactaatagaaaatattaactttaacaacagaggagagttaaaatgaatattttcaacctggcggcagcgcaaaagatg

SEQ ID NO: 74443 - DNA, 103 bp, Artificial Sequence
  Synthetic Polynucleotide
taatacgactcactatagggtattggaacaactaatagaaaatattaactaacagaggagaagttaaatgtttctattaaacctggcggcagcgcaaaagatg

SEQ ID NO: 74444 - DNA, 103 bp, Artificial Sequence
  Synthetic Polynucleotide
taatacgactcactatagggtaatttattggaacaactaatagaaaatataacagaggagaatatttatgattagttgtaacctggcggcagcgcaaaagatg

SEQ ID NO: 74445 - DNA, 103 bp, Artificial Sequence
  Synthetic Polynucleotide
taatacgactcactatagggacaaataatttattggaacaactaatagaaaacagaggagattctatatgttgttccaaaacctggcggcagcgcaaaagatg

SEQ ID NO: 74446 - DNA, 103 bp, Artificial Sequence
  Synthetic Polynucleotide
taatacgactcactatagggggaaatataaagtcggataaggatattatgaacagaggagacataatatgcttatccgaaacctggcggcagcgcaaaagatg

SEQ ID NO: 74447 - DNA, 103 bp, Artificial Sequence
  Synthetic Polynucleotide
taatacgactcactatagggtcacaacaaataatttattggaacaactaaaacagaggagattagttatgccaataaataacctggcggcagcgcaaaagatg

SEQ ID NO: 74448 - DNA, 103 bp, Artificial Sequence
  Synthetic Polynucleotide
taatacgactcactatagggcacagtcacaacaaataatttattggaacaaacagaggagatgttccatgaaattatttaacctggcggcagcgcaaaagatg

SEQ ID NO: 74449 - DNA, 103 bp, Artificial Sequence
  Synthetic Polynucleotide
taatacgactcactatagggttgaacacagtcacaacaaataatttattgaacagaggagacaataaatgatttgttgtaacctggcggcagcgcaaaagatg

SEQ ID NO: 74450 - DNA, 103 bp, Artificial Sequence
  Synthetic Polynucleotide
taatacgactcactatagggatgacttgaacacagtcacaacaaataattaacagaggagaaattatatgttgtgactgaacctggcggcagcgcaaaagatg

SEQ ID NO: 74451 - DNA, 103 bp, Artificial Sequence
  Synthetic Polynucleotide
taatacgactcactataggggatttatgacttgaacacagtcacaacaaaaacagaggagatttgttatgactgtgttcaacctggcggcagcgcaaaagatg

SEQ ID NO: 74452 - DNA, 103 bp, Artificial Sequence
  Synthetic Polynucleotide
taatacgactcactatagggaaaatgatttatgacttgaacacagtcacaaacagaggagatgtgacatggttcaagtcaacctggcggcagcgcaaaagatg

SEQ ID NO: 74453 - DNA, 103 bp, Artificial Sequence
  Synthetic Polynucleotide
taatacgactcactataggggtatcaaaatgatttatgacttgaacacagaacagaggagactgtgtatgagtcataaaaacctggcggcagcgcaaaagatg

SEQ ID NO: 74454 - DNA, 103 bp, Artificial Sequence
  Synthetic Polynucleotide
taatacgactcactatagggggatagtatcaaaatgatttatgacttgaaaacagaggagattcaagatgtaaatcattaacctggcggcagcgcaaaagatg

SEQ ID NO: 74455 - DNA, 103 bp, Artificial Sequence
  Synthetic Polynucleotide
taatacgactcactatagggttattggatagtatcaaaatgatttatgacaacagaggagagtcataatgcattttgataacctggcggcagcgcaaaagatg

SEQ ID NO: 74456 - DNA, 103 bp, Artificial Sequence
  Synthetic Polynucleotide
taatacgactcactatagggactgtttattggatagtatcaaaatgatttaacagaggagaaaatcaatgtgatactataacctggcggcagcgcaaaagatg

SEQ ID NO: 74457 - DNA, 103 bp, Artificial Sequence
  Synthetic Polynucleotide
taatacgactcactatagggtctgatgcatcaactatttctcaaacaataaacagaggagatattgtatgagaaatagtaacctggcggcagcgcaaaagatg

SEQ ID NO: 74458 - DNA, 103 bp, Artificial Sequence
  Synthetic Polynucleotide
taatacgactcactatagggcttactcactctcaatacactttttattataacagaggagaataataatgagtgtattgaacctggcggcagcgcaaaagatg

SEQ ID NO: 74459 - DNA, 103 bp, Artificial Sequence
  Synthetic Polynucleotide
taatacgactcactatagggctacaggaaatataaagtcggataaggataaacagaggagatatcctatgccgactttaaacctggcggcagcgcaaaagatg

SEQ ID NO: 74460 - DNA, 103 bp, Artificial Sequence
  Synthetic Polynucleotide
taatacgactcactatagggtaaagactgtttattggatagtatcaaaataacagaggagaattttgatgctatccaataacctggcggcagcgcaaaagatg

SEQ ID NO: 74461 - DNA, 103 bp, Artificial Sequence
  Synthetic Polynucleotide
taatacgactcactataggggaacttaaagactgtttattggatagtatcaacagaggagagatactatgcaataaacaaacctggcggcagcgcaaaagatg

SEQ ID NO: 74462 - DNA, 103 bp, Artificial Sequence
  Synthetic Polynucleotide
taatacgactcactatagggttccagaacttaaagactgtttattggataaacagaggagatatccaatgaacagtcttaacctggcggcagcgcaaaagatg

SEQ ID NO: 74463 - DNA, 103 bp, Artificial Sequence
  Synthetic Polynucleotide
taatacgactcactatagggtaatattccagaacttaaagactgtttattaacagaggagaaataaaatgtctttaagtaacctggcggcagcgcaaaagatg

SEQ ID NO: 74464 - DNA, 103 bp, Artificial Sequence
  Synthetic Polynucleotide
taatacgactcactataggggatgataatattccagaacttaaagactgtaacagaggagaacagtcatgaagttctggaacctggcggcagcgcaaaagatg

SEQ ID NO: 74465 - DNA, 103 bp, Artificial Sequence
  Synthetic Polynucleotide
taatacgactcactatagggaatgggatgataatattccagaacttaaagaacagaggagactttaaatgctggaatataacctggcggcagcgcaaaagatg

SEQ ID NO: 74466 - DNA, 103 bp, Artificial Sequence
  Synthetic Polynucleotide
taatacgactcactatagggtttacaatgggatgataatattccagaactaacagaggagaagttctatgatattatcaaacctggcggcagcgcaaaagatg

SEQ ID NO: 74467 - DNA, 103 bp, Artificial Sequence
  Synthetic Polynucleotide
taatacgactcactatagggggggctttacaatgggatgataatattccaaacagaggagatggaatatgatcatcccaaacctggcggcagcgcaaaagatg

SEQ ID NO: 74468 - DNA, 103 bp, Artificial Sequence
  Synthetic Polynucleotide
taatacgactcactatagggaattaggggctttacaatgggatgataataaacagaggagatattatatgcccattgtaaacctggcggcagcgcaaaagatg

SEQ ID NO: 74469 - DNA, 103 bp, Artificial Sequence
  Synthetic Polynucleotide
taatacgactcactatagggagtcgaattaggggctttacaatgggatgaaacagaggagatcatccatgtgtaaagccaacctggcggcagcgcaaaagatg

SEQ ID NO: 74470 - DNA, 103 bp, Artificial Sequence
  Synthetic Polynucleotide
taatacgactcactatagggccaccctacaggaaatataaagtcggataaaacagaggagattatccatgtttatatttaacctggcggcagcgcaaaagatg

SEQ ID NO: 74471 - DNA, 103 bp, Artificial Sequence
  Synthetic Polynucleotide
taatacgactcactatagggtcgatagtcgaattaggggctttacaatggaacagaggagaccattgatgagcccctaaaacctggcggcagcgcaaaagatg

SEQ ID NO: 74472 - DNA, 103 bp, Artificial Sequence
  Synthetic Polynucleotide
taatacgactcactatagggggtattcgatagtcgaattaggggctttacaacagaggagagtaaagatgctaattcgaaacctggcggcagcgcaaaagatg

SEQ ID NO: 74473 - DNA, 103 bp, Artificial Sequence
  Synthetic Polynucleotide
taatacgactcactatagggagcagggtattcgatagtcgaattaggggcaacagaggagagcccctatgtcgactatcaacctggcggcagcgcaaaagatg

SEQ ID NO: 74474 - DNA, 103 bp, Artificial Sequence
  Synthetic Polynucleotide
taatacgactcactatagggaccagagcagggtattcgatagtcgaattaaacagaggagataattcatgtatcgaataaacctggcggcagcgcaaaagatg

SEQ ID NO: 74475 - DNA, 103 bp, Artificial Sequence
  Synthetic Polynucleotide
taatacgactcactatagggcggctaccagagcagggtattcgatagtcgaacagaggagacgactaatgaataccctgaacctggcggcagcgcaaaagatg

SEQ ID NO: 74476 - DNA, 103 bp, Artificial Sequence
  Synthetic Polynucleotide
taatacgactcactatagggtgaaacggctaccagagcagggtattcgataacagaggagaatcgaaatgcctgctctgaacctggcggcagcgcaaaagatg

SEQ ID NO: 74477 - DNA, 103 bp, Artificial Sequence
  Synthetic Polynucleotide
taatacgactcactataggggatattgaaacggctaccagagcagggtataacagaggagaatacccatgtctggtagcaacctggcggcagcgcaaaagatg

SEQ ID NO: 74478 - DNA, 103 bp, Artificial Sequence
  Synthetic Polynucleotide
taatacgactcactatagggccgtcgatattgaaacggctaccagagcagaacagaggagactgctcatgtagccgtttaacctggcggcagcgcaaaagatg

SEQ ID NO: 74479 - DNA, 103 bp, Artificial Sequence
  Synthetic Polynucleotide
taatacgactcactataggggacgtccgtcgatattgaaacggctaccagaacagaggagactggtaatggtttcaataaacctggcggcagcgcaaaagatg

SEQ ID NO: 74480 - DNA, 103 bp, Artificial Sequence
  Synthetic Polynucleotide
taatacgactcactataggggtattgacgtccgtcgatattgaaacggctaacagaggagaagccgtatgaatatcgacaacctggcggcagcgcaaaagatg

SEQ ID NO: 74481 - DNA, 103 bp, Artificial Sequence
  Synthetic Polynucleotide
taatacgactcactatagggttataccaccctacaggaaatataaagtcgaacagaggagacgacttatgatttcctgtaacctggcggcagcgcaaaagatg

SEQ ID NO: 74482 - DNA, 103 bp, Artificial Sequence
  Synthetic Polynucleotide
taatacgactcactatagggttacagtattgacgtccgtcgatattgaaaaacagaggagatttcaaatgcgacggacgaacctggcggcagcgcaaaagatg

SEQ ID NO: 74483 - DNA, 103 bp, Artificial Sequence
  Synthetic Polynucleotide
taatacgactcactatagggctttattacagtattgacgtccgtcgatataacagaggagaatatcgatggacgtcaataacctggcggcagcgcaaaagatg

SEQ ID NO: 74484 - DNA, 103 bp, Artificial Sequence
  Synthetic Polynucleotide
taatacgactcactatagggaccacctttattacagtattgacgtccgtcaacagaggagagacggaatgcaatactgtaacctggcggcagcgcaaaagatg

SEQ ID NO: 74485 - DNA, 103 bp, Artificial Sequence
  Synthetic Polynucleotide
taatacgactcactatagggatactaccacctttattacagtattgacgtaacagaggagaacgtcaatgctgtaataaaacctggcggcagcgcaaaagatg

SEQ ID NO: 74486 - DNA, 103 bp, Artificial Sequence
  Synthetic Polynucleotide
taatacgactcactatagggtgacaatactaccacctttattacagtattaacagaggagaaatactatgataaaggtgaacctggcggcagcgcaaaagatg

SEQ ID NO: 74487 - DNA, 103 bp, Artificial Sequence
  Synthetic Polynucleotide
taatacgactcactataggggatgatgacaatactaccacctttattacaaacagaggagatgtaatatgggtggtagtaacctggcggcagcgcaaaagatg

SEQ ID NO: 74488 - DNA, 103 bp, Artificial Sequence
  Synthetic Polynucleotide
taatacgactcactatagggatcatgatgatgacaatactaccacctttaaacagaggagataaaggatgtagtattgtaacctggcggcagcgcaaaagatg

SEQ ID NO: 74489 - DNA, 103 bp, Artificial Sequence
  Synthetic Polynucleotide
taatacgactcactatagggtgtgtatcatgatgatgacaatactaccacaacagaggagagtggtaatgttgtcatcaaacctggcggcagcgcaaaagatg

SEQ ID NO: 74490 - DNA, 103 bp, Artificial Sequence
  Synthetic Polynucleotide
taatacgactcactatagggcctgttgtgtatcatgatgatgacaatactaacagaggagaagtattatgatcatcatgaacctggcggcagcgcaaaagatg

SEQ ID NO: 74491 - DNA, 103 bp, Artificial Sequence
  Synthetic Polynucleotide
taatacgactcactatagggatattcctgttgtgtatcatgatgatgacaaacagaggagatgtcatatgcatgatacaaacctggcggcagcgcaaaagatg

SEQ ID NO: 74492 - DNA, 103 bp, Artificial Sequence
  Synthetic Polynucleotide
taatacgactcactatagggtaaaattataccaccctacaggaaatataaaacagaggagattatatatgctgtagggtaacctggcggcagcgcaaaagatg

SEQ ID NO: 74493 - DNA, 103 bp, Artificial Sequence
  Synthetic Polynucleotide
taatacgactcactatagggcgaccatattcctgttgtgtatcatgatgaaacagaggagatcatcaatgtacacaacaaacctggcggcagcgcaaaagatg

SEQ ID NO: 74494 - DNA, 103 bp, Artificial Sequence
  Synthetic Polynucleotide
taatacgactcactatagggactaacgaccatattcctgttgtgtatcataacagaggagaatgataatgaacaggaataacctggcggcagcgcaaaagatg

SEQ ID NO: 74495 - DNA, 103 bp, Artificial Sequence
  Synthetic Polynucleotide
taatacgactcactatagggtacctactaacgaccatattcctgttgtgtaacagaggagaacacaaatggaatatggtaacctggcggcagcgcaaaagatg

SEQ ID NO: 74496 - DNA, 103 bp, Artificial Sequence
  Synthetic Polynucleotide
taatacgactcactatagggcaccgtacctactaacgaccatattcctgtaacagaggagaacaggaatgtggtcgttaaacctggcggcagcgcaaaagatg

SEQ ID NO: 74497 - DNA, 103 bp, Artificial Sequence
  Synthetic Polynucleotide
taatacgactcactatagggaaagtcaccgtacctactaacgaccatattaacagaggagaaatatgatggttagtaggaacctggcggcagcgcaaaagatg

SEQ ID NO: 74498 - DNA, 103 bp, Artificial Sequence
  Synthetic Polynucleotide
taatacgactcactatagggtgtgtaaagtcaccgtacctactaacgaccaacagaggagaggtcgtatgtaggtacggaacctggcggcagcgcaaaagatg

SEQ ID NO: 74499 - DNA, 103 bp, Artificial Sequence
  Synthetic Polynucleotide
taatacgactcactatagggcgcgttgtgtaaagtcaccgtacctactaaaacagaggagattagtaatgacggtgactaacctggcggcagcgcaaaagatg

SEQ ID NO: 74500 - DNA, 103 bp, Artificial Sequence
  Synthetic Polynucleotide
taatacgactcactatagggtatatcgcgttgtgtaaagtcaccgtacctaacagaggagaaggtacatggactttacaaacctggcggcagcgcaaaagatg

SEQ ID NO: 74501 - DNA, 103 bp, Artificial Sequence
  Synthetic Polynucleotide
taatacgactcactatagggagttatatatcgcgttgtgtaaagtcaccgaacagaggagacggtgaatgtacacaacgaacctggcggcagcgcaaaagatg

SEQ ID NO: 74502 - DNA, 103 bp, Artificial Sequence
  Synthetic Polynucleotide
taatacgactcactatagggaggaaagttatatatcgcgttgtgtaaagtaacagaggagaactttaatgaacgcgataaacctggcggcagcgcaaaagatg

SEQ ID NO: 74503 - DNA, 103 bp, Artificial Sequence
  Synthetic Polynucleotide
taatacgactcactatagggcaaaataaaattataccaccctacaggaaaaacagaggagatttcctatggggtggtataacctggcggcagcgcaaaagatg

SEQ ID NO: 74504 - DNA, 103 bp, Artificial Sequence
  Synthetic Polynucleotide
taatacgactcactatagggacaaaaggaaagttatatatcgcgttgtgtaacagaggagaacacaaatggatatataaaacctggcggcagcgcaaaagatg

SEQ ID NO: 74505 - DNA, 103 bp, Artificial Sequence
  Synthetic Polynucleotide
taatacgactcactatagggatggcacaaaaggaaagttatatatcgcgtaacagaggagaacgcgaatgataactttcaacctggcggcagcgcaaaagatg

SEQ ID NO: 74506 - DNA, 103 bp, Artificial Sequence
  Synthetic Polynucleotide
taatacgactcactatagggtaaaaatggcacaaaaggaaagttatatataacagaggagaatatatatgtttccttttaacctggcggcagcgcaaaagatg

SEQ ID NO: 74507 - DNA, 103 bp, Artificial Sequence
  Synthetic Polynucleotide
taatacgactcactatagggtacgttaaaaatggcacaaaaggaaagttaaacagaggagataacttatgttttgtgccaacctggcggcagcgcaaaagatg

SEQ ID NO: 74508 - DNA, 103 bp, Artificial Sequence
  Synthetic Polynucleotide
taatacgactcactatagggccaactacgttaaaaatggcacaaaaggaaaacagaggagattccttatgtgccattttaacctggcggcagcgcaaaagatg

SEQ ID NO: 74509 - DNA, 103 bp, Artificial Sequence
  Synthetic Polynucleotide
taatacgactcactatagggacgtcccaactacgttaaaaatggcacaaaaacagaggagatttgtgatgtttttaacgaacctggcggcagcgcaaaagatg

SEQ ID NO: 74510 - DNA, 103 bp, Artificial Sequence
  Synthetic Polynucleotide
taatacgactcactataggggcaggacgtcccaactacgttaaaaatggcaacagaggagagccattatgaacgtagttaacctggcggcagcgcaaaagatg

SEQ ID NO: 74511 - DNA, 103 bp, Artificial Sequence
  Synthetic Polynucleotide
taatacgactcactatagggaccctgcaggacgtcccaactacgttaaaaaacagaggagattttaaatgagttgggacaacctggcggcagcgcaaaagatg

SEQ ID NO: 74512 - DNA, 103 bp, Artificial Sequence
  Synthetic Polynucleotide
taatacgactcactatagggacaataccctgcaggacgtcccaactacgtaacagaggagaacgtagatgggacgtcctaacctggcggcagcgcaaaagatg

SEQ ID NO: 74513 - DNA, 103 bp, Artificial Sequence
  Synthetic Polynucleotide
taatacgactcactatagggtcaaaacaataccctgcaggacgtcccaacaacagaggagagttgggatgtcctgcaggaacctggcggcagcgcaaaagatg

SEQ ID NO: 74514 - DNA, 103 bp, Artificial Sequence
  Synthetic Polynucleotide
taatacgactcactatagggggaggcaaaataaaattataccaccctacaaacagaggagatgtaggatggtataatttaacctggcggcagcgcaaaagatg

SEQ ID NO: 74515 - DNA, 103 bp, Artificial Sequence
  Synthetic Polynucleotide
taatacgactcactatagggtttcttcaaaacaataccctgcaggacgtcaacagaggagagacgtcatgcagggtattaacctggcggcagcgcaaaagatg

SEQ ID NO: 74516 - DNA, 103 bp, Artificial Sequence
  Synthetic Polynucleotide
taatacgactcactatagggtatcatttcttcaaaacaataccctgcaggaacagaggagacctgcaatgtattgttttaacctggcggcagcgcaaaagatg

SEQ ID NO: 74517 - DNA, 103 bp, Artificial Sequence
  Synthetic Polynucleotide
taatacgactcactatagggctcgatatcatttcttcaaaacaataccctaacagaggagaagggtaatgttttgaagaaacctggcggcagcgcaaaagatg

SEQ ID NO: 74518 - DNA, 103 bp, Artificial Sequence
  Synthetic Polynucleotide
taatacgactcactatagggctgttctcgatatcatttcttcaaaacaataacagaggagaattgttatgaagaaatgaaacctggcggcagcgcaaaagatg

SEQ ID NO: 74519 - DNA, 103 bp, Artificial Sequence
  Synthetic Polynucleotide
taatacgactcactatagggcaaatctgttctcgatatcatttcttcaaaaacagaggagatttgaaatgatgatatcgaacctggcggcagcgcaaaagatg

SEQ ID NO: 74520 - DNA, 103 bp, Artificial Sequence
  Synthetic Polynucleotide
taatacgactcactatagggcgtatcaaatctgttctcgatatcatttctaacagaggagaagaaatatgatcgagaacaacctggcggcagcgcaaaagatg

SEQ ID NO: 74521 - DNA, 103 bp, Artificial Sequence
  Synthetic Polynucleotide
taatacgactcactatagggaatatcgtatcaaatctgttctcgatatcaaacagaggagatgatatatggaacagattaacctggcggcagcgcaaaagatg

SEQ ID NO: 74522 - DNA, 103 bp, Artificial Sequence
  Synthetic Polynucleotide
taatacgactcactatagggcaacaaatatcgtatcaaatctgttctcgaaacagaggagatcgagaatggatttgataaacctggcggcagcgcaaaagatg

SEQ ID NO: 74523 - DNA, 103 bp, Artificial Sequence
  Synthetic Polynucleotide
taatacgactcactatagggaaatccaacaaatatcgtatcaaatctgttaacagaggagaaacagaatggatacgataaacctggcggcagcgcaaaagatg

SEQ ID NO: 74524 - DNA, 103 bp, Artificial Sequence
  Synthetic Polynucleotide
taatacgactcactatagggatcagaaatccaacaaatatcgtatcaaataacagaggagaatttgaatggatatttgtaacctggcggcagcgcaaaagatg

SEQ ID NO: 74525 - DNA, 103 bp, Artificial Sequence
  Synthetic Polynucleotide
taatacgactcactatagggtatgtggaggcaaaataaaattataccaccaacagaggagaggtggtatgattttatttaacctggcggcagcgcaaaagatg

SEQ ID NO: 74526 - DNA, 103 bp, Artificial Sequence
  Synthetic Polynucleotide
taatacgactcactataggggaataatcagaaatccaacaaatatcgtataacagaggagaatacgaatgttgttggataacctggcggcagcgcaaaagatg

SEQ ID NO: 74527 - DNA, 103 bp, Artificial Sequence
  Synthetic Polynucleotide
taatacgactcactatagggatagtgaataatcagaaatccaacaaatataacagaggagaatatttatgggatttctgaacctggcggcagcgcaaaagatg

SEQ ID NO: 74528 - DNA, 103 bp, Artificial Sequence
  Synthetic Polynucleotide
taatacgactcactatagggatattatagtgaataatcagaaatccaacaaacagaggagatgttggatgtctgattataacctggcggcagcgcaaaagatg

SEQ ID NO: 74529 - DNA, 103 bp, Artificial Sequence
  Synthetic Polynucleotide
taatacgactcactatagggagattatattatagtgaataatcagaaatcaacagaggagagatttcatgttattcactaacctggcggcagcgcaaaagatg

SEQ ID NO: 74530 - DNA, 103 bp, Artificial Sequence
  Synthetic Polynucleotide
taatacgactcactatagggtgtctagattatattatagtgaataatcagaacagaggagactgattatgcactataataacctggcggcagcgcaaaagatg

SEQ ID NO: 74531 - DNA, 103 bp, Artificial Sequence
  Synthetic Polynucleotide
taatacgactcactatagggctatctgtctagattatattatagtgaataaacagaggagatattcaatgtaatataataacctggcggcagcgcaaaagatg

SEQ ID NO: 74532 - DNA, 103 bp, Artificial Sequence
  Synthetic Polynucleotide
taatacgactcactatagggatcatctatctgtctagattatattatagtaacagaggagaactataatgtaatctagaaacctggcggcagcgcaaaagatg

SEQ ID NO: 74533 - DNA, 103 bp, Artificial Sequence
  Synthetic Polynucleotide
taatacgactcactatagggatcgaatcatctatctgtctagattatattaacagaggagaaatataatgtagacagataacctggcggcagcgcaaaagatg

SEQ ID NO: 74534 - DNA, 103 bp, Artificial Sequence
  Synthetic Polynucleotide
taatacgactcactatagggtatttatcgaatcatctatctgtctagattaacagaggagaaatctaatgagatagatgaacctggcggcagcgcaaaagatg

SEQ ID NO: 74535 - DNA, 103 bp, Artificial Sequence
  Synthetic Polynucleotide
taatacgactcactatagggttctttatttatcgaatcatctatctgtctaacagaggagaagacagatggatgattcgaacctggcggcagcgcaaaagatg

SEQ ID NO: 74536 - DNA, 103 bp, Artificial Sequence
  Synthetic Polynucleotide
taatacgactcactatagggaccgatatgtggaggcaaaataaaattataaacagaggagatataatatgattttgcctaacctggcggcagcgcaaaagatg

SEQ ID NO: 74537 - DNA, 103 bp, Artificial Sequence
  Synthetic Polynucleotide
taatacgactcactatagggatatcttctttatttatcgaatcatctatcaacagaggagagatagaatgttcgataaaaacctggcggcagcgcaaaagatg

SEQ ID NO: 74538 - DNA, 103 bp, Artificial Sequence
  Synthetic Polynucleotide
taatacgactcactatagggacgatatatcttctttatttatcgaatcataacagaggagaatgattatgtaaataaagaacctggcggcagcgcaaaagatg

SEQ ID NO: 74539 - DNA, 103 bp, Artificial Sequence
  Synthetic Polynucleotide
taatacgactcactatagggtaccaacgatatatcttctttatttatcgaaacagaggagatcgataatgaaagaagataacctggcggcagcgcaaaagatg

SEQ ID NO: 74540 - DNA, 103 bp, Artificial Sequence
  Synthetic Polynucleotide
taatacgactcactatagggtatcctaccaacgatatatcttctttatttaacagaggagaaaataaatgagatatatcaacctggcggcagcgcaaaagatg

SEQ ID NO: 74541 - DNA, 103 bp, Artificial Sequence
  Synthetic Polynucleotide
taatacgactcactatagggtgtattatcctaccaacgatatatcttcttaacagaggagaaagaagatgtatcgttggaacctggcggcagcgcaaaagatg

SEQ ID NO: 74542 - DNA, 103 bp, Artificial Sequence
  Synthetic Polynucleotide
taatacgactcactatagggggggatgtattatcctaccaacgatatatcaacagaggagagatataatgttggtaggaaacctggcggcagcgcaaaagatg

SEQ ID NO: 74543 - DNA, 103 bp, Artificial Sequence
  Synthetic Polynucleotide
taatacgactcactatagggggaatggggatgtattatcctaccaacgataacagaggagaatcgttatgaggataataaacctggcggcagcgcaaaagatg

SEQ ID NO: 74544 - DNA, 103 bp, Artificial Sequence
  Synthetic Polynucleotide
taatacgactcactatagggatactggaatggggatgtattatcctaccaaacagaggagatggtagatgaatacatccaacctggcggcagcgcaaaagatg

SEQ ID NO: 74545 - DNA, 103 bp, Artificial Sequence
  Synthetic Polynucleotide
taatacgactcactatagggcaagaatactggaatggggatgtattatccaacagaggagaggataaatgatccccattaacctggcggcagcgcaaaagatg

SEQ ID NO: 74546 - DNA, 103 bp, Artificial Sequence
  Synthetic Polynucleotide
taatacgactcactataggggtatccaagaatactggaatggggatgtataacagaggagaatacatatgcattccagtaacctggcggcagcgcaaaagatg

SEQ ID NO: 74547 - DNA, 103 bp, Artificial Sequence
  Synthetic Polynucleotide
taatacgactcactataggggaaacaccgatatgtggaggcaaaataaaaaacagaggagattttatatggcctccacaaacctggcggcagcgcaaaagatg

SEQ ID NO: 74548 - DNA, 103 bp, Artificial Sequence
  Synthetic Polynucleotide
taatacgactcactatagggatagagtatccaagaatactggaatggggaaacagaggagatccccaatgcagtattctaacctggcggcagcgcaaaagatg

SEQ ID NO: 74549 - DNA, 103 bp, Artificial Sequence
  Synthetic Polynucleotide
taatacgactcactatagggcatcaatagagtatccaagaatactggaataacagaggagaattccaatgttcttggataacctggcggcagcgcaaaagatg

SEQ ID NO: 74550 - DNA, 103 bp, Artificial Sequence
  Synthetic Polynucleotide
taatacgactcactatagggagtgtcatcaatagagtatccaagaatactaacagaggagaagtattatgggatactctaacctggcggcagcgcaaaagatg

SEQ ID NO: 74551 - DNA, 103 bp, Artificial Sequence
  Synthetic Polynucleotide
taatacgactcactatagggtaactagtgtcatcaatagagtatccaagaaacagaggagatcttggatgctctattgaaacctggcggcagcgcaaaagatg

SEQ ID NO: 74552 - DNA, 103 bp, Artificial Sequence
  Synthetic Polynucleotide
taatacgactcactataggggttcttaactagtgtcatcaatagagtatcaacagaggagagatactatgttgatgacaaacctggcggcagcgcaaaagatg

SEQ ID NO: 74553 - DNA, 103 bp, Artificial Sequence
  Synthetic Polynucleotide
taatacgactcactataggggacatgttcttaactagtgtcatcaatagaaacagaggagatctattatggacactagtaacctggcggcagcgcaaaagatg

SEQ ID NO: 74554 - DNA, 103 bp, Artificial Sequence
  Synthetic Polynucleotide
taatacgactcactatagggttgaagacatgttcttaactagtgtcatcaaacagaggagatgatgaatgtagttaagaaacctggcggcagcgcaaaagatg

SEQ ID NO: 74555 - DNA, 103 bp, Artificial Sequence
  Synthetic Polynucleotide
taatacgactcactatagggtagaattgaagacatgttcttaactagtgtaacagaggagaacactaatgaagaacatgaacctggcggcagcgcaaaagatg

SEQ ID NO: 74556 - DNA, 103 bp, Artificial Sequence
  Synthetic Polynucleotide
taatacgactcactatagggttttctagaattgaagacatgttcttaactaacagaggagaagttaaatgcatgtcttcaacctggcggcagcgcaaaagatg

SEQ ID NO: 74557 - DNA, 103 bp, Artificial Sequence
  Synthetic Polynucleotide
taatacgactcactatagggtttcgttttctagaattgaagacatgttctaacagaggagaagaacaatgcttcaattcaacctggcggcagcgcaaaagatg

SEQ ID NO: 74558 - DNA, 103 bp, Artificial Sequence
  Synthetic Polynucleotide
taatacgactcactatagggatttggaaacaccgatatgtggaggcaaaaaacagaggagattttgcatgcacatatcgaacctggcggcagcgcaaaagatg

SEQ ID NO: 74559 - DNA, 103 bp, Artificial Sequence
  Synthetic Polynucleotide
taatacgactcactataggggatgttttcgttttctagaattgaagacataacagaggagaatgtctatgattctagaaaacctggcggcagcgcaaaagatg

SEQ ID NO: 74560 - DNA, 103 bp, Artificial Sequence
  Synthetic Polynucleotide
taatacgactcactatagggtgtaggatgttttcgttttctagaattgaaaacagaggagattcaatatgagaaaacgaaacctggcggcagcgcaaaagatg

SEQ ID NO: 74561 - DNA, 103 bp, Artificial Sequence
  Synthetic Polynucleotide
taatacgactcactataggggtccgtgtaggatgttttcgttttctagaaaacagaggagattctagatgacgaaaacaaacctggcggcagcgcaaaagatg

SEQ ID NO: 74562 - DNA, 103 bp, Artificial Sequence
  Synthetic Polynucleotide
taatacgactcactatagggaatgagtccgtgtaggatgttttcgttttcaacagaggagagaaaacatgaacatcctaaacctggcggcagcgcaaaagatg

SEQ ID NO: 74563 - DNA, 103 bp, Artificial Sequence
  Synthetic Polynucleotide
taatacgactcactataggggttttaatgagtccgtgtaggatgttttcgaacagaggagacgaaaaatgcctacacggaacctggcggcagcgcaaaagatg

SEQ ID NO: 74564 - DNA, 103 bp, Artificial Sequence
  Synthetic Polynucleotide
taatacgactcactatagggtagaagttttaatgagtccgtgtaggatgtaacagaggagaacatccatgacggactcaaacctggcggcagcgcaaaagatg

SEQ ID NO: 74565 - DNA, 103 bp, Artificial Sequence
  Synthetic Polynucleotide
taatacgactcactatagggagcgctagaagttttaatgagtccgtgtagaacagaggagactacacatgctcattaaaaacctggcggcagcgcaaaagatg

SEQ ID NO: 74566 - DNA, 103 bp, Artificial Sequence
  Synthetic Polynucleotide
taatacgactcactatagggtcaggagcgctagaagttttaatgagtccgaacagaggagacggactatgtaaaacttcaacctggcggcagcgcaaaagatg

SEQ ID NO: 74567 - DNA, 103 bp, Artificial Sequence
  Synthetic Polynucleotide
taatacgactcactatagggcacaatcaggagcgctagaagttttaatgaaacagaggagatcattaatgcttctagcgaacctggcggcagcgcaaaagatg

SEQ ID NO: 74568 - DNA, 103 bp, Artificial Sequence
  Synthetic Polynucleotide
taatacgactcactatagggtgagacacaatcaggagcgctagaagttttaacagaggagaaaaactatgagcgctcctaacctggcggcagcgcaaaagatg

SEQ ID NO: 74569 - DNA, 103 bp, Artificial Sequence
  Synthetic Polynucleotide
taatacgactcactatagggtcatgcttactcactctcaatacactttttaacagaggagaaaaaagatgattgagagtaacctggcggcagcgcaaaagatg

SEQ ID NO: 74570 - DNA, 103 bp, Artificial Sequence
  Synthetic Polynucleotide
taatacgactcactatagggaatatatttggaaacaccgatatgtggaggaacagaggagacctccaatgatcggtgttaacctggcggcagcgcaaaagatg

SEQ ID NO: 74571 - DNA, 103 bp, Artificial Sequence
  Synthetic Polynucleotide
taatacgactcactataggggcatttgagacacaatcaggagcgctagaaaacagaggagattctagatgtcctgattgaacctggcggcagcgcaaaagatg

SEQ ID NO: 74572 - DNA, 103 bp, Artificial Sequence
  Synthetic Polynucleotide
taatacgactcactatagggatgaggcatttgagacacaatcaggagcgcaacagaggagagcgctcatgattgtgtctaacctggcggcagcgcaaaagatg

SEQ ID NO: 74573 - DNA, 103 bp, Artificial Sequence
  Synthetic Polynucleotide
taatacgactcactatagggattgtatgaggcatttgagacacaatcaggaacagaggagacctgatatggtctcaaataacctggcggcagcgcaaaagatg

SEQ ID NO: 74574 - DNA, 103 bp, Artificial Sequence
  Synthetic Polynucleotide
taatacgactcactatagggaaatcattgtatgaggcatttgagacacaaaacagaggagattgtgtatgaaatgcctcaacctggcggcagcgcaaaagatg

SEQ ID NO: 74575 - DNA, 103 bp, Artificial Sequence
  Synthetic Polynucleotide
taatacgactcactatagggccttgaaatcattgtatgaggcatttgagaaacagaggagatctcaaatgcctcatacaaacctggcggcagcgcaaaagatg

SEQ ID NO: 74576 - DNA, 103 bp, Artificial Sequence
  Synthetic Polynucleotide
taatacgactcactataggggacatccttgaaatcattgtatgaggcattaacagaggagaaatgccatgtacaatgataacctggcggcagcgcaaaagatg

SEQ ID NO: 74577 - DNA, 103 bp, Artificial Sequence
  Synthetic Polynucleotide
taatacgactcactatagggtctatgacatccttgaaatcattgtatgagaacagaggagactcataatgtgatttcaaaacctggcggcagcgcaaaagatg

SEQ ID NO: 74578 - DNA, 103 bp, Artificial Sequence
  Synthetic Polynucleotide
taatacgactcactatagggaagaatctatgacatccttgaaatcattgtaacagaggagaacaatgatgtcaaggatgaacctggcggcagcgcaaaagatg

SEQ ID NO: 74579 - DNA, 103 bp, Artificial Sequence
  Synthetic Polynucleotide
taatacgactcactatagggggttaaagaatctatgacatccttgaaatcaacagaggagagatttcatggatgtcataaacctggcggcagcgcaaaagatg

SEQ ID NO: 74580 - DNA, 103 bp, Artificial Sequence
  Synthetic Polynucleotide
taatacgactcactatagggtcgtgggttaaagaatctatgacatccttgaacagaggagacaaggaatgcatagattcaacctggcggcagcgcaaaagatg

SEQ ID NO: 74581 - DNA, 103 bp, Artificial Sequence
  Synthetic Polynucleotide
taatacgactcactatagggctagtaatatatttggaaacaccgatatgtaacagaggagaacatatatgtgtttccaaaacctggcggcagcgcaaaagatg

SEQ ID NO: 74582 - DNA, 103 bp, Artificial Sequence
  Synthetic Polynucleotide
taatacgactcactatagggttaaatcgtgggttaaagaatctatgacataacagaggagaatgtcaatgattctttaaaacctggcggcagcgcaaaagatg

SEQ ID NO: 74583 - DNA, 103 bp, Artificial Sequence
  Synthetic Polynucleotide
taatacgactcactatagggcaatattaaatcgtgggttaaagaatctataacagaggagaatagatatgttaacccacaacctggcggcagcgcaaaagatg

SEQ ID NO: 74584 - DNA, 103 bp, Artificial Sequence
  Synthetic Polynucleotide
taatacgactcactatagggaaacgcaatattaaatcgtgggttaaagaaaacagaggagattctttatgccacgatttaacctggcggcagcgcaaaagatg

SEQ ID NO: 74585 - DNA, 103 bp, Artificial Sequence
  Synthetic Polynucleotide
taatacgactcactatagggatgctaaacgcaatattaaatcgtgggttaaacagaggagataacccatgatttaatataacctggcggcagcgcaaaagatg

SEQ ID NO: 74586 - DNA, 103 bp, Artificial Sequence
  Synthetic Polynucleotide
taatacgactcactatagggaatagatgctaaacgcaatattaaatcgtgaacagaggagacacgatatgatattgcgtaacctggcggcagcgcaaaagatg

SEQ ID NO: 74587 - DNA, 103 bp, Artificial Sequence
  Synthetic Polynucleotide
taatacgactcactatagggaaaaaaatagatgctaaacgcaatattaaaaacagaggagatttaatatggcgtttagcaacctggcggcagcgcaaaagatg

SEQ ID NO: 74588 - DNA, 103 bp, Artificial Sequence
  Synthetic Polynucleotide
taatacgactcactatagggtaataaaaaaaatagatgctaaacgcaataaacagaggagatattgcatgtagcatctaaacctggcggcagcgcaaaagatg

SEQ ID NO: 74589 - DNA, 103 bp, Artificial Sequence
  Synthetic Polynucleotide
taatacgactcactatagggcgatttaataaaaaaaatagatgctaaacgaacagaggagacgtttaatgtctatttttaacctggcggcagcgcaaaagatg

SEQ ID NO: 74590 - DNA, 103 bp, Artificial Sequence
  Synthetic Polynucleotide
taatacgactcactatagggccattcgatttaataaaaaaaatagatgctaacagaggagaagcatcatgtttttttataacctggcggcagcgcaaaagatg

SEQ ID NO: 74591 - DNA, 103 bp, Artificial Sequence
  Synthetic Polynucleotide
taatacgactcactataggggccgaccattcgatttaataaaaaaaatagaacagaggagactatttatgttattaaataacctggcggcagcgcaaaagatg

SEQ ID NO: 74592 - DNA, 103 bp, Artificial Sequence
  Synthetic Polynucleotide
taatacgactcactatagggattgtctagtaatatatttggaaacaccgaaacagaggagatcggtgatgccaaatataaacctggcggcagcgcaaaagatg

SEQ ID NO: 74593 - DNA, 103 bp, Artificial Sequence
  Synthetic Polynucleotide
taatacgactcactatagggagagagccgaccattcgatttaataaaaaaaacagaggagattttttatgaaatcgaataacctggcggcagcgcaaaagatg

SEQ ID NO: 74594 - DNA, 103 bp, Artificial Sequence
  Synthetic Polynucleotide
taatacgactcactatagggaaaccagagagccgaccattcgatttaataaacagaggagatattaaatggaatggtcgaacctggcggcagcgcaaaagatg

SEQ ID NO: 74595 - DNA, 103 bp, Artificial Sequence
  Synthetic Polynucleotide
taatacgactcactataggggtagcaaaccagagagccgaccattcgattaacagaggagaaatcgaatggtcggctctaacctggcggcagcgcaaaagatg

SEQ ID NO: 74596 - DNA, 103 bp, Artificial Sequence
  Synthetic Polynucleotide
taatacgactcactatagggttggggtagcaaaccagagagccgaccattaacagaggagaaatggtatgctctctggtaacctggcggcagcgcaaaagatg

SEQ ID NO: 74597 - DNA, 103 bp, Artificial Sequence
  Synthetic Polynucleotide
taatacgactcactatagggtatcattggggtagcaaaccagagagccgaaacagaggagatcggctatgtggtttgctaacctggcggcagcgcaaaagatg

SEQ ID NO: 74598 - DNA, 103 bp, Artificial Sequence
  Synthetic Polynucleotide
taatacgactcactatagggattgttatcattggggtagcaaaccagagaaacagaggagatctctgatgtgctaccccaacctggcggcagcgcaaaagatg

SEQ ID NO: 74599 - DNA, 103 bp, Artificial Sequence
  Synthetic Polynucleotide
taatacgactcactatagggagactattgttatcattggggtagcaaaccaacagaggagaggtttgatgccccaatgaaacctggcggcagcgcaaaagatg

SEQ ID NO: 74600 - DNA, 103 bp, Artificial Sequence
  Synthetic Polynucleotide
taatacgactcactatagggttacaagactattgttatcattggggtagcaacagaggagagctaccatgatgataacaaacctggcggcagcgcaaaagatg

SEQ ID NO: 74601 - DNA, 103 bp, Artificial Sequence
  Synthetic Polynucleotide
taatacgactcactatagggtatctttacaagactattgttatcattgggaacagaggagacccaatatgaacaatagtaacctggcggcagcgcaaaagatg

SEQ ID NO: 74602 - DNA, 103 bp, Artificial Sequence
  Synthetic Polynucleotide
taatacgactcactatagggcggtttatctttacaagactattgttatcaaacagaggagatgataaatgtagtcttgtaacctggcggcagcgcaaaagatg

SEQ ID NO: 74603 - DNA, 103 bp, Artificial Sequence
  Synthetic Polynucleotide
taatacgactcactatagggggaatattgtctagtaatatatttggaaacaacagaggagagtttccatgtatattactaacctggcggcagcgcaaaagatg

SEQ ID NO: 74604 - DNA, 103 bp, Artificial Sequence
  Synthetic Polynucleotide
taatacgactcactatagggtcttgcggtttatctttacaagactattgtaacagaggagaacaataatgttgtaaagaaacctggcggcagcgcaaaagatg

SEQ ID NO: 74605 - DNA, 103 bp, Artificial Sequence
  Synthetic Polynucleotide
taatacgactcactatagggaattttcttgcggtttatctttacaagactaacagaggagaagtcttatgaagataaacaacctggcggcagcgcaaaagatg

SEQ ID NO: 74606 - DNA, 103 bp, Artificial Sequence
  Synthetic Polynucleotide
taatacgactcactataggggtataaattttcttgcggtttatctttacaaacagaggagatgtaaaatgaaaccgcaaaacctggcggcagcgcaaaagatg

SEQ ID NO: 74607 - DNA, 103 bp, Artificial Sequence
  Synthetic Polynucleotide
taatacgactcactataggggatgcgtataaattttcttgcggtttatctaacagaggagaagataaatggcaagaaaaaacctggcggcagcgcaaaagatg

SEQ ID NO: 74608 - DNA, 103 bp, Artificial Sequence
  Synthetic Polynucleotide
taatacgactcactatagggggatggatgcgtataaattttcttgcggttaacagaggagaaaccgcatgaaaatttataacctggcggcagcgcaaaagatg

SEQ ID NO: 74609 - DNA, 103 bp, Artificial Sequence
  Synthetic Polynucleotide
taatacgactcactatagggtatttggatggatgcgtataaattttcttgaacagaggagacaagaaatgttatacgcaaacctggcggcagcgcaaaagatg

SEQ ID NO: 74610 - DNA, 103 bp, Artificial Sequence
  Synthetic Polynucleotide
taatacgactcactatagggagagttatttggatggatgcgtataaatttaacagaggagaaaatttatgcgcatccataacctggcggcagcgcaaaagatg

SEQ ID NO: 74611 - DNA, 103 bp, Artificial Sequence
  Synthetic Polynucleotide
taatacgactcactataggggtgcaagagttatttggatggatgcgtataaacagaggagatatacgatgccatccaaaaacctggcggcagcgcaaaagatg

SEQ ID NO: 74612 - DNA, 103 bp, Artificial Sequence
  Synthetic Polynucleotide
taatacgactcactatagggtgatggtgcaagagttatttggatggatgcaacagaggagagcatccatgcaaataactaacctggcggcagcgcaaaagatg

SEQ ID NO: 74613 - DNA, 103 bp, Artificial Sequence
  Synthetic Polynucleotide
taatacgactcactatagggtcatctgatggtgcaagagttatttggatgaacagaggagacatccaatgaactcttgcaacctggcggcagcgcaaaagatg

SEQ ID NO: 74614 - DNA, 103 bp, Artificial Sequence
  Synthetic Polynucleotide
taatacgactcactatagggtatatggaatattgtctagtaatatatttgaacagaggagacaaataatgtactagacaaacctggcggcagcgcaaaagatg

SEQ ID NO: 74615 - DNA, 103 bp, Artificial Sequence
  Synthetic Polynucleotide
taatacgactcactatagggtgatatcatctgatggtgcaagagttatttaacagaggagaaaataaatgttgcaccataacctggcggcagcgcaaaagatg

SEQ ID NO: 74616 - DNA, 103 bp, Artificial Sequence
  Synthetic Polynucleotide
taatacgactcactatagggtatactgatatcatctgatggtgcaagagtaacagaggagaactcttatgccatcagataacctggcggcagcgcaaaagatg

SEQ ID NO: 74617 - DNA, 103 bp, Artificial Sequence
  Synthetic Polynucleotide
taatacgactcactatagggaataatatactgatatcatctgatggtgcaaacagaggagatgcaccatgagatgatataacctggcggcagcgcaaaagatg

SEQ ID NO: 74618 - DNA, 103 bp, Artificial Sequence
  Synthetic Polynucleotide
taatacgactcactatagggtctataataatatactgatatcatctgatgaacagaggagacatcagatgatatcagtaaacctggcggcagcgcaaaagatg

SEQ ID NO: 74619 - DNA, 103 bp, Artificial Sequence
  Synthetic Polynucleotide
taatacgactcactataggggaaaatctataataatatactgatatcatcaacagaggagagatgatatgagtatattaaacctggcggcagcgcaaaagatg

SEQ ID NO: 74620 - DNA, 103 bp, Artificial Sequence
  Synthetic Polynucleotide
taatacgactcactatagggggatggaaaatctataataatatactgataaacagaggagatatcagatgattattataaacctggcggcagcgcaaaagatg

SEQ ID NO: 74621 - DNA, 103 bp, Artificial Sequence
  Synthetic Polynucleotide
taatacgactcactatagggattgtggatggaaaatctataataatatacaacagaggagagtatatatgtatagatttaacctggcggcagcgcaaaagatg

SEQ ID NO: 74622 - DNA, 103 bp, Artificial Sequence
  Synthetic Polynucleotide
taatacgactcactatagggcaataattgtggatggaaaatctataataaaacagaggagattattaatgattttccataacctggcggcagcgcaaaagatg

SEQ ID NO: 74623 - DNA, 103 bp, Artificial Sequence
  Synthetic Polynucleotide
taatacgactcactatagggtggcccaataattgtggatggaaaatctataacagaggagaatagatatgccatccacaaacctggcggcagcgcaaaagatg

SEQ ID NO: 74624 - DNA, 103 bp, Artificial Sequence
  Synthetic Polynucleotide
taatacgactcactatagggtatactggcccaataattgtggatggaaaaaacagaggagattttccatgcacaattataacctggcggcagcgcaaaagatg

SEQ ID NO: 74625 - DNA, 103 bp, Artificial Sequence
  Synthetic Polynucleotide
taatacgactcactatagggataactatatggaatattgtctagtaatataacagaggagaatattaatggacaatattaacctggcggcagcgcaaaagatg

SEQ ID NO: 74626 - DNA, 103 bp, Artificial Sequence
  Synthetic Polynucleotide
taatacgactcactatagggaacagtatactggcccaataattgtggatgaacagaggagacatccaatgttattgggcaacctggcggcagcgcaaaagatg

SEQ ID NO: 74627 - DNA, 103 bp, Artificial Sequence
  Synthetic Polynucleotide
taatacgactcactatagggttgctaacagtatactggcccaataattgtaacagaggagaacaattatggggccagtaaacctggcggcagcgcaaaagatg

SEQ ID NO: 74628 - DNA, 103 bp, Artificial Sequence
  Synthetic Polynucleotide
taatacgactcactatagggtaccgttgctaacagtatactggcccaataaacagaggagatattggatgagtatactgaacctggcggcagcgcaaaagatg

SEQ ID NO: 74629 - DNA, 103 bp, Artificial Sequence
  Synthetic Polynucleotide
taatacgactcactatagggcgatataccgttgctaacagtatactggccaacagaggagaggccagatgactgttagcaacctggcggcagcgcaaaagatg

SEQ ID NO: 74630 - DNA, 103 bp, Artificial Sequence
  Synthetic Polynucleotide
taatacgactcactatagggctattcgatataccgttgctaacagtatacaacagaggagagtatacatgtagcaacggaacctggcggcagcgcaaaagatg

SEQ ID NO: 74631 - DNA, 103 bp, Artificial Sequence
  Synthetic Polynucleotide
taatacgactcactataggggtaatctattcgatataccgttgctaacagaacagaggagactgttaatgacggtatataacctggcggcagcgcaaaagatg

SEQ ID NO: 74632 - DNA, 103 bp, Artificial Sequence
  Synthetic Polynucleotide
taatacgactcactatagggcatgagtaatctattcgatataccgttgctaacagaggagaagcaacatgatatcgaataacctggcggcagcgcaaaagatg

SEQ ID NO: 74633 - DNA, 103 bp, Artificial Sequence
  Synthetic Polynucleotide
taatacgactcactatagggggttacatgagtaatctattcgatataccgaacagaggagacggtatatggaatagattaacctggcggcagcgcaaaagatg

SEQ ID NO: 74634 - DNA, 103 bp, Artificial Sequence
  Synthetic Polynucleotide
taatacgactcactatagggtagtaggttacatgagtaatctattcgataaacagaggagatatcgaatggattactcaaacctggcggcagcgcaaaagatg

SEQ ID NO: 74635 - DNA, 103 bp, Artificial Sequence
  Synthetic Polynucleotide
taatacgactcactatagggcattctagtaggttacatgagtaatctattaacagaggagaaatagaatgctcatgtaaaacctggcggcagcgcaaaagatg

SEQ ID NO: 74636 - DNA, 103 bp, Artificial Sequence
  Synthetic Polynucleotide
taatacgactcactatagggaactaataactatatggaatattgtctagtaacagaggagaactagaatgtattccataaacctggcggcagcgcaaaagatg

SEQ ID NO: 74637 - DNA, 103 bp, Artificial Sequence
  Synthetic Polynucleotide
taatacgactcactatagggactatcattctagtaggttacatgagtaataacagaggagaattactatggtaacctacaacctggcggcagcgcaaaagatg

SEQ ID NO: 74638 - DNA, 103 bp, Artificial Sequence
  Synthetic Polynucleotide
taatacgactcactatagggcacgaactatcattctagtaggttacatgaaacagaggagatcatgtatgctactagaaaacctggcggcagcgcaaaagatg

SEQ ID NO: 74639 - DNA, 103 bp, Artificial Sequence
  Synthetic Polynucleotide
taatacgactcactatagggtagtacacgaactatcattctagtaggttaaacagaggagataacctatgagaatgataaacctggcggcagcgcaaaagatg

SEQ ID NO: 74640 - DNA, 103 bp, Artificial Sequence
  Synthetic Polynucleotide
taatacgactcactatagggatgactagtacacgaactatcattctagtaaacagaggagatactagatggatagttcgaacctggcggcagcgcaaaagatg

SEQ ID NO: 74641 - DNA, 103 bp, Artificial Sequence
  Synthetic Polynucleotide
taatacgactcactatagggatattatgactagtacacgaactatcattcaacagaggagagaatgaatgttcgtgtacaacctggcggcagcgcaaaagatg

SEQ ID NO: 74642 - DNA, 103 bp, Artificial Sequence
  Synthetic Polynucleotide
taatacgactcactatagggtaaagatattatgactagtacacgaactataacagaggagaatagttatggtactagtcaacctggcggcagcgcaaaagatg

SEQ ID NO: 74643 - DNA, 103 bp, Artificial Sequence
  Synthetic Polynucleotide
taatacgactcactatagggtggattaaagatattatgactagtacacgaaacagaggagatcgtgtatgagtcataataacctggcggcagcgcaaaagatg

SEQ ID NO: 74644 - DNA, 103 bp, Artificial Sequence
  Synthetic Polynucleotide
taatacgactcactatagggtagattggattaaagatattatgactagtaaacagaggagatactagatgtaatatcttaacctggcggcagcgcaaaagatg

SEQ ID NO: 74645 - DNA, 103 bp, Artificial Sequence
  Synthetic Polynucleotide
taatacgactcactatagggtttcttagattggattaaagatattatgacaacagaggagagtcataatgtctttaatcaacctggcggcagcgcaaaagatg

SEQ ID NO: 74646 - DNA, 103 bp, Artificial Sequence
  Synthetic Polynucleotide
taatacgactcactatagggttaaatttcttagattggattaaagatattaacagaggagaaatatcatgaatccaatcaacctggcggcagcgcaaaagatg

SEQ ID NO: 74647 - DNA, 103 bp, Artificial Sequence
  Synthetic Polynucleotide
taatacgactcactatagggcccttaactaataactatatggaatattgtaacagaggagaacaataatgcatatagttaacctggcggcagcgcaaaagatg

SEQ ID NO: 74648 - DNA, 103 bp, Artificial Sequence
  Synthetic Polynucleotide
taatacgactcactatagggtaattttaaatttcttagattggattaaagaacagaggagactttaaatgaatctaagaaacctggcggcagcgcaaaagatg

SEQ ID NO: 74649 - DNA, 103 bp, Artificial Sequence
  Synthetic Polynucleotide
taatacgactcactatagggagatctaattttaaatttcttagattggataacagaggagaatccaaatgaagaaatttaacctggcggcagcgcaaaagatg

SEQ ID NO: 74650 - DNA, 103 bp, Artificial Sequence
  Synthetic Polynucleotide
taatacgactcactataggggtaaaagatctaattttaaatttcttagataacagaggagaatctaaatgatttaaaataacctggcggcagcgcaaaagatg

SEQ ID NO: 74651 - DNA, 103 bp, Artificial Sequence
  Synthetic Polynucleotide
taatacgactcactatagggacagtgtaaaagatctaattttaaatttctaacagaggagaagaaatatgaaattagataacctggcggcagcgcaaaagatg

SEQ ID NO: 74652 - DNA, 103 bp, Artificial Sequence
  Synthetic Polynucleotide
taatacgactcactatagggctttaacagtgtaaaagatctaattttaaaaacagaggagatttaaaatgagatcttttaacctggcggcagcgcaaaagatg

SEQ ID NO: 74653 - DNA, 103 bp, Artificial Sequence
  Synthetic Polynucleotide
taatacgactcactataggggttaactttaacagtgtaaaagatctaattaacagaggagaaattagatgttttacactaacctggcggcagcgcaaaagatg

SEQ ID NO: 74654 - DNA, 103 bp, Artificial Sequence
  Synthetic Polynucleotide
taatacgactcactatagggcctttgttaactttaacagtgtaaaagatcaacagaggagagatcttatgcactgttaaaacctggcggcagcgcaaaagatg

SEQ ID NO: 74655 - DNA, 103 bp, Artificial Sequence
  Synthetic Polynucleotide
taatacgactcactatagggtaatacctttgttaactttaacagtgtaaaaacagaggagatttacaatgttaaagttaaacctggcggcagcgcaaaagatg

SEQ ID NO: 74656 - DNA, 103 bp, Artificial Sequence
  Synthetic Polynucleotide
taatacgactcactatagggccgggtaatacctttgttaactttaacagtaacagaggagaactgttatggttaacaaaaacctggcggcagcgcaaaagatg

SEQ ID NO: 74657 - DNA, 103 bp, Artificial Sequence
  Synthetic Polynucleotide
taatacgactcactatagggcgtacccgggtaatacctttgttaactttaaacagaggagataaagtatgcaaaggtataacctggcggcagcgcaaaagatg

SEQ ID NO: 74658 - DNA, 103 bp, Artificial Sequence
  Synthetic Polynucleotide
taatacgactcactataggggggtacccttaactaataactatatggaataacagaggagaattccaatgagttattagaacctggcggcagcgcaaaagatg

SEQ ID NO: 74659 - DNA, 103 bp, Artificial Sequence
  Synthetic Polynucleotide
taatacgactcactatagggatccacgtacccgggtaatacctttgttaaaacagaggagattaacaatggtattacccaacctggcggcagcgcaaaagatg

SEQ ID NO: 74660 - DNA, 103 bp, Artificial Sequence
  Synthetic Polynucleotide
taatacgactcactatagggatgatatccacgtacccgggtaatacctttaacagaggagaaaaggtatgacccgggtaaacctggcggcagcgcaaaagatg

SEQ ID NO: 74661 - DNA, 103 bp, Artificial Sequence
  Synthetic Polynucleotide
taatacgactcactatagggcatatatgatatccacgtacccgggtaataaacagaggagatattacatgggtacgtggaacctggcggcagcgcaaaagatg

SEQ ID NO: 74662 - DNA, 103 bp, Artificial Sequence
  Synthetic Polynucleotide
taatacgactcactatagggaatgccatatatgatatccacgtacccgggaacagaggagacccgggatggtggatatcaacctggcggcagcgcaaaagatg

SEQ ID NO: 74663 - DNA, 103 bp, Artificial Sequence
  Synthetic Polynucleotide
taatacgactcactatagggggaccaatgccatatatgatatccacgtacaacagaggagagtacgtatgtatcatataaacctggcggcagcgcaaaagatg

SEQ ID NO: 74664 - DNA, 103 bp, Artificial Sequence
  Synthetic Polynucleotide
taatacgactcactatagggataatggaccaatgccatatatgatatccaaacagaggagatggataatgtatatggcaaacctggcggcagcgcaaaagatg

SEQ ID NO: 74665 - DNA, 103 bp, Artificial Sequence
  Synthetic Polynucleotide
taatacgactcactatagggtactgataatggaccaatgccatatatgataacagaggagaatcataatgggcattggtaacctggcggcagcgcaaaagatg

SEQ ID NO: 74666 - DNA, 103 bp, Artificial Sequence
  Synthetic Polynucleotide
taatacgactcactataggggctattactgataatggaccaatgccatataacagaggagaatatggatgtggtccattaacctggcggcagcgcaaaagatg

SEQ ID NO: 74667 - DNA, 103 bp, Artificial Sequence
  Synthetic Polynucleotide
taatacgactcactatagggatggagctattactgataatggaccaatgcaacagaggagagcattgatgcattatcagaacctggcggcagcgcaaaagatg

SEQ ID NO: 74668 - DNA, 103 bp, Artificial Sequence
  Synthetic Polynucleotide
taatacgactcactatagggagtttatggagctattactgataatggaccaacagaggagaggtccaatgtcagtaataaacctggcggcagcgcaaaagatg

SEQ ID NO: 74669 - DNA, 103 bp, Artificial Sequence
  Synthetic Polynucleotide
taatacgactcactatagggtaattgggtacccttaactaataactatataacagaggagaatatagatgttagttaagaacctggcggcagcgcaaaagatg

SEQ ID NO: 74670 - DNA, 103 bp, Artificial Sequence
  Synthetic Polynucleotide
taatacgactcactataggggtatcagtttatggagctattactgataataacagaggagaattatcatgaatagctccaacctggcggcagcgcaaaagatg

SEQ ID NO: 74671 - DNA, 103 bp, Artificial Sequence
  Synthetic Polynucleotide
taatacgactcactatagggtcaccgtatcagtttatggagctattactgaacagaggagacagtaaatgctccataaaaacctggcggcagcgcaaaagatg

SEQ ID NO: 74672 - DNA, 103 bp, Artificial Sequence
  Synthetic Polynucleotide
taatacgactcactatagggaaccatcaccgtatcagtttatggagctataacagaggagaatagctatgtaaactgataacctggcggcagcgcaaaagatg

SEQ ID NO: 74673 - DNA, 103 bp, Artificial Sequence
  Synthetic Polynucleotide
taatacgactcactatagggataaaaaccatcaccgtatcagtttatggaaacagaggagatccataatgtgatacggtaacctggcggcagcgcaaaagatg

SEQ ID NO: 74674 - DNA, 103 bp, Artificial Sequence
  Synthetic Polynucleotide
taatacgactcactatagggcacatataaaaaccatcaccgtatcagtttaacagaggagaaaactgatgcggtgatggaacctggcggcagcgcaaaagatg

SEQ ID NO: 74675 - DNA, 103 bp, Artificial Sequence
  Synthetic Polynucleotide
taatacgactcactatagggtcaaacacatataaaaaccatcaccgtatcaacagaggagagatacgatgatggtttttaacctggcggcagcgcaaaagatg

SEQ ID NO: 74676 - DNA, 103 bp, Artificial Sequence
  Synthetic Polynucleotide
taatacgactcactatagggttagatcaaacacatataaaaaccatcaccaacagaggagaggtgatatgttttatatgaacctggcggcagcgcaaaagatg

SEQ ID NO: 74677 - DNA, 103 bp, Artificial Sequence
  Synthetic Polynucleotide
taatacgactcactatagggcctcgttagatcaaacacatataaaaaccaaacagaggagatggtttatgtatgtgtttaacctggcggcagcgcaaaagatg

SEQ ID NO: 74678 - DNA, 103 bp, Artificial Sequence
  Synthetic Polynucleotide
taatacgactcactatagggttcttcctcgttagatcaaacacatataaaaacagaggagatttataatggtttgatctaacctggcggcagcgcaaaagatg

SEQ ID NO: 74679 - DNA, 103 bp, Artificial Sequence
  Synthetic Polynucleotide
taatacgactcactatagggcaaatttcttcctcgttagatcaaacacataacagaggagaatgtgtatgatctaacgaaacctggcggcagcgcaaaagatg

SEQ ID NO: 74680 - DNA, 103 bp, Artificial Sequence
  Synthetic Polynucleotide
taatacgactcactatagggctttttcatgcttactcactctcaatacacaacagaggagagtgtatatggagtgagtaaacctggcggcagcgcaaaagatg

SEQ ID NO: 74681 - DNA, 103 bp, Artificial Sequence
  Synthetic Polynucleotide
taatacgactcactatagggtgttctaattgggtacccttaactaataacaacagaggagagttattatgtaagggtacaacctggcggcagcgcaaaagatg

SEQ ID NO: 74682 - DNA, 103 bp, Artificial Sequence
  Synthetic Polynucleotide
taatacgactcactataggggggcgcaaatttcttcctcgttagatcaaaaacagaggagatttgatatgacgaggaagaacctggcggcagcgcaaaagatg

SEQ ID NO: 74683 - DNA, 103 bp, Artificial Sequence
  Synthetic Polynucleotide
taatacgactcactatagggattatgggcgcaaatttcttcctcgttagaaacagaggagatctaacatggaagaaattaacctggcggcagcgcaaaagatg

SEQ ID NO: 74684 - DNA, 103 bp, Artificial Sequence
  Synthetic Polynucleotide
taatacgactcactataggggatgaattatgggcgcaaatttcttcctcgaacagaggagacgaggaatgaatttgcgcaacctggcggcagcgcaaaagatg

SEQ ID NO: 74685 - DNA, 103 bp, Artificial Sequence
  Synthetic Polynucleotide
taatacgactcactatagggctagagatgaattatgggcgcaaatttcttaacagaggagaaagaaaatggcgcccataaacctggcggcagcgcaaaagatg

SEQ ID NO: 74686 - DNA, 103 bp, Artificial Sequence
  Synthetic Polynucleotide
taatacgactcactatagggcatatctagagatgaattatgggcgcaaataacagaggagaatttgcatgcataattcaaacctggcggcagcgcaaaagatg

SEQ ID NO: 74687 - DNA, 103 bp, Artificial Sequence
  Synthetic Polynucleotide
taatacgactcactatagggaaatacatatctagagatgaattatgggcgaacagaggagacgcccaatgttcatctctaacctggcggcagcgcaaaagatg

SEQ ID NO: 74688 - DNA, 103 bp, Artificial Sequence
  Synthetic Polynucleotide
taatacgactcactatagggatattaaatacatatctagagatgaattataacagaggagaataattatgctctagataaacctggcggcagcgcaaaagatg

SEQ ID NO: 74689 - DNA, 103 bp, Artificial Sequence
  Synthetic Polynucleotide
taatacgactcactataggggtttgatattaaatacatatctagagatgaaacagaggagatcatctatggatatgtataacctggcggcagcgcaaaagatg

SEQ ID NO: 74690 - DNA, 103 bp, Artificial Sequence
  Synthetic Polynucleotide
taatacgactcactatagggttaccgtttgatattaaatacatatctagaaacagaggagatctagaatggtatttaataacctggcggcagcgcaaaagatg

SEQ ID NO: 74691 - DNA, 103 bp, Artificial Sequence
  Synthetic Polynucleotide
taatacgactcactatagggatgtgttaccgtttgatattaaatacatataacagaggagaatatgtatgtaatatcaaaacctggcggcagcgcaaaagatg

SEQ ID NO: 74692 - DNA, 103 bp, Artificial Sequence
  Synthetic Polynucleotide
taatacgactcactataggggtacgtgttctaattgggtacccttaactaaacagaggagatagttaatggtacccaataacctggcggcagcgcaaaagatg

SEQ ID NO: 74693 - DNA, 103 bp, Artificial Sequence
  Synthetic Polynucleotide
taatacgactcactatagggaattgatgtgttaccgtttgatattaaataaacagaggagatatttaatgtcaaacggtaacctggcggcagcgcaaaagatg

SEQ ID NO: 74694 - DNA, 103 bp, Artificial Sequence
  Synthetic Polynucleotide
taatacgactcactatagggcccgaaattgatgtgttaccgtttgatattaacagaggagaaatatcatgcggtaacacaacctggcggcagcgcaaaagatg

SEQ ID NO: 74695 - DNA, 103 bp, Artificial Sequence
  Synthetic Polynucleotide
taatacgactcactatagggcgcgtcccgaaattgatgtgttaccgtttgaacagaggagacaaacgatgacacatcaaaacctggcggcagcgcaaaagatg

SEQ ID NO: 74696 - DNA, 103 bp, Artificial Sequence
  Synthetic Polynucleotide
taatacgactcactatagggatatacgcgtcccgaaattgatgtgttaccaacagaggagaggtaacatgtcaatttcgaacctggcggcagcgcaaaagatg

SEQ ID NO: 74697 - DNA, 103 bp, Artificial Sequence
  Synthetic Polynucleotide
taatacgactcactataggggaaacatatacgcgtcccgaaattgatgtgaacagaggagacacatcatgttcgggacgaacctggcggcagcgcaaaagatg

SEQ ID NO: 74698 - DNA, 103 bp, Artificial Sequence
  Synthetic Polynucleotide
taatacgactcactatagggatttagaaacatatacgcgtcccgaaattgaacagaggagacaatttatggacgcgtataacctggcggcagcgcaaaagatg

SEQ ID NO: 74699 - DNA, 103 bp, Artificial Sequence
  Synthetic Polynucleotide
taatacgactcactatagggtaaaaatttagaaacatatacgcgtcccgaaacagaggagatcgggaatggtatatgttaacctggcggcagcgcaaaagatg

SEQ ID NO: 74700 - DNA, 103 bp, Artificial Sequence
  Synthetic Polynucleotide
taatacgactcactatagggtggattaaaaatttagaaacatatacgcgtaacagaggagaacgcgtatgtgtttctaaaacctggcggcagcgcaaaagatg

SEQ ID NO: 74701 - DNA, 103 bp, Artificial Sequence
  Synthetic Polynucleotide
taatacgactcactatagggatatttggattaaaaatttagaaacatataaacagaggagatatatgatgctaaattttaacctggcggcagcgcaaaagatg

SEQ ID NO: 74702 - DNA, 103 bp, Artificial Sequence
  Synthetic Polynucleotide
taatacgactcactatagggtcattatatttggattaaaaatttagaaacaacagaggagagtttctatgtttttaatcaacctggcggcagcgcaaaagatg

SEQ ID NO: 74703 - DNA, 103 bp, Artificial Sequence
  Synthetic Polynucleotide
taatacgactcactatagggtaagcgtacgtgttctaattgggtacccttaacagaggagaaagggtatgcaattagaaaacctggcggcagcgcaaaagatg

SEQ ID NO: 74704 - DNA, 103 bp, Artificial Sequence
  Synthetic Polynucleotide
taatacgactcactatagggggtcatcattatatttggattaaaaatttaaacagaggagataaattatgaatccaaataacctggcggcagcgcaaaagatg

SEQ ID NO: 74705 - DNA, 103 bp, Artificial Sequence
  Synthetic Polynucleotide
taatacgactcactatagggatataggtcatcattatatttggattaaaaaacagaggagattttaaatgaaatataataacctggcggcagcgcaaaagatg

SEQ ID NO: 74706 - DNA, 103 bp, Artificial Sequence
  Synthetic Polynucleotide
taatacgactcactatagggagggcatataggtcatcattatatttggataacagaggagaatccaaatgtaatgatgaaacctggcggcagcgcaaaagatg

SEQ ID NO: 74707 - DNA, 103 bp, Artificial Sequence
  Synthetic Polynucleotide
taatacgactcactatagggataatagggcatataggtcatcattatattaacagaggagaaatataatgatgacctataacctggcggcagcgcaaaagatg

SEQ ID NO: 74708 - DNA, 103 bp, Artificial Sequence
  Synthetic Polynucleotide
taatacgactcactataggggtatgataatagggcatataggtcatcattaacagaggagaaatgatatgctatatgccaacctggcggcagcgcaaaagatg

SEQ ID NO: 74709 - DNA, 103 bp, Artificial Sequence
  Synthetic Polynucleotide
taatacgactcactatagggtgacagtatgataatagggcatataggtcaaacagaggagatgacctatgtgccctattaacctggcggcagcgcaaaagatg

SEQ ID NO: 74710 - DNA, 103 bp, Artificial Sequence
  Synthetic Polynucleotide
taatacgactcactatagggatagttgacagtatgataatagggcatataaacagaggagatatatgatgtattatcataacctggcggcagcgcaaaagatg

SEQ ID NO: 74711 - DNA, 103 bp, Artificial Sequence
  Synthetic Polynucleotide
taatacgactcactataggggtactatagttgacagtatgataatagggcaacagaggagagccctaatgtcatactgtaacctggcggcagcgcaaaagatg

SEQ ID NO: 74712 - DNA, 103 bp, Artificial Sequence
  Synthetic Polynucleotide
taatacgactcactatagggtaagtgtactatagttgacagtatgataataacagaggagaattatcatgctgtcaactaacctggcggcagcgcaaaagatg

SEQ ID NO: 74713 - DNA, 103 bp, Artificial Sequence
  Synthetic Polynucleotide
taatacgactcactatagggttctctaagtgtactatagttgacagtatgaacagaggagacatactatgaactatagtaacctggcggcagcgcaaaagatg

SEQ ID NO: 74714 - DNA, 103 bp, Artificial Sequence
  Synthetic Polynucleotide
taatacgactcactataggggataataagcgtacgtgttctaattgggtaaacagaggagatacccaatgagaacacgtaacctggcggcagcgcaaaagatg

SEQ ID NO: 74715 - DNA, 103 bp, Artificial Sequence
  Synthetic Polynucleotide
taatacgactcactataggggtaagttctctaagtgtactatagttgacaaacagaggagatgtcaaatgtagtacactaacctggcggcagcgcaaaagatg

SEQ ID NO: 74716 - DNA, 103 bp, Artificial Sequence
  Synthetic Polynucleotide
taatacgactcactataggggtatcgtaagttctctaagtgtactatagtaacagaggagaactataatgcacttagagaacctggcggcagcgcaaaagatg

SEQ ID NO: 74717 - DNA, 103 bp, Artificial Sequence
  Synthetic Polynucleotide
taatacgactcactatagggcagatgtatcgtaagttctctaagtgtactaacagaggagaagtacaatgagagaacttaacctggcggcagcgcaaaagatg

SEQ ID NO: 74718 - DNA, 103 bp, Artificial Sequence
  Synthetic Polynucleotide
taatacgactcactatagggggaaacagatgtatcgtaagttctctaagtaacagaggagaacttagatgacttacgataacctggcggcagcgcaaaagatg

SEQ ID NO: 74719 - DNA, 103 bp, Artificial Sequence
  Synthetic Polynucleotide
taatacgactcactatagggttataggaaacagatgtatcgtaagttctcaacagaggagagagaacatgcgatacatcaacctggcggcagcgcaaaagatg

SEQ ID NO: 74720 - DNA, 103 bp, Artificial Sequence
  Synthetic Polynucleotide
taatacgactcactatagggaacgattataggaaacagatgtatcgtaagaacagaggagacttacgatgcatctgtttaacctggcggcagcgcaaaagatg

SEQ ID NO: 74721 - DNA, 103 bp, Artificial Sequence
  Synthetic Polynucleotide
taatacgactcactatagggaatttaacgattataggaaacagatgtatcaacagaggagagatacaatggtttcctataacctggcggcagcgcaaaagatg

SEQ ID NO: 74722 - DNA, 103 bp, Artificial Sequence
  Synthetic Polynucleotide
taatacgactcactatagggtgtaaaatttaacgattataggaaacagataacagaggagaatctgtatgctataatcgaacctggcggcagcgcaaaagatg

SEQ ID NO: 74723 - DNA, 103 bp, Artificial Sequence
  Synthetic Polynucleotide
taatacgactcactatagggagatttgtaaaatttaacgattataggaaaaacagaggagatttcctatgatcgttaaaaacctggcggcagcgcaaaagatg

SEQ ID NO: 74724 - DNA, 103 bp, Artificial Sequence
  Synthetic Polynucleotide
taatacgactcactataggggttatagatttgtaaaatttaacgattataaacagaggagatataatatgtaaattttaaacctggcggcagcgcaaaagatg

SEQ ID NO: 74725 - DNA, 103 bp, Artificial Sequence
  Synthetic Polynucleotide
taatacgactcactatagggatgatgataataagcgtacgtgttctaattaacagaggagaaattagatgacgtacgctaacctggcggcagcgcaaaagatg

SEQ ID NO: 74726 - DNA, 103 bp, Artificial Sequence
  Synthetic Polynucleotide
taatacgactcactatagggagcatgttatagatttgtaaaatttaacgaaacagaggagatcgttaatgtttacaaataacctggcggcagcgcaaaagatg

SEQ ID NO: 74727 - DNA, 103 bp, Artificial Sequence
  Synthetic Polynucleotide
taatacgactcactatagggggtttagcatgttatagatttgtaaaatttaacagaggagaaaatttatgaaatctataaacctggcggcagcgcaaaagatg

SEQ ID NO: 74728 - DNA, 103 bp, Artificial Sequence
  Synthetic Polynucleotide
taatacgactcactatagggcaaaaggtttagcatgttatagatttgtaaaacagaggagattacaaatgtataacatgaacctggcggcagcgcaaaagatg

SEQ ID NO: 74729 - DNA, 103 bp, Artificial Sequence
  Synthetic Polynucleotide
taatacgactcactataggggtcgtcaaaaggtttagcatgttatagattaacagaggagaaatctaatgcatgctaaaaacctggcggcagcgcaaaagatg

SEQ ID NO: 74730 - DNA, 103 bp, Artificial Sequence
  Synthetic Polynucleotide
taatacgactcactatagggtggttgtcgtcaaaaggtttagcatgttataacagaggagaataacaatgtaaacctttaacctggcggcagcgcaaaagatg

SEQ ID NO: 74731 - DNA, 103 bp, Artificial Sequence
  Synthetic Polynucleotide
taatacgactcactatagggatgaatggttgtcgtcaaaaggtttagcataacagaggagaatgctaatgcttttgacgaacctggcggcagcgcaaaagatg

SEQ ID NO: 74732 - DNA, 103 bp, Artificial Sequence
  Synthetic Polynucleotide
taatacgactcactatagggaattaatgaatggttgtcgtcaaaaggtttaacagaggagaaaacctatggacgacaacaacctggcggcagcgcaaaagatg

SEQ ID NO: 74733 - DNA, 103 bp, Artificial Sequence
  Synthetic Polynucleotide
taatacgactcactatagggtcagaaattaatgaatggttgtcgtcaaaaaacagaggagattttgaatgcaaccattcaacctggcggcagcgcaaaagatg

SEQ ID NO: 74734 - DNA, 103 bp, Artificial Sequence
  Synthetic Polynucleotide
taatacgactcactatagggccatatcagaaattaatgaatggttgtcgtaacagaggagaacgacaatgattcattaaaacctggcggcagcgcaaaagatg

SEQ ID NO: 74735 - DNA, 103 bp, Artificial Sequence
  Synthetic Polynucleotide
taatacgactcactatagggagattccatatcagaaattaatgaatggttaacagaggagaaaccatatgttaatttctaacctggcggcagcgcaaaagatg

SEQ ID NO: 74736 - DNA, 103 bp, Artificial Sequence
  Synthetic Polynucleotide
taatacgactcactatagggtccgaatgatgataataagcgtacgtgttcaacagaggagagaacacatgcgcttattaaacctggcggcagcgcaaaagatg

SEQ ID NO: 74737 - DNA, 103 bp, Artificial Sequence
  Synthetic Polynucleotide
taatacgactcactatagggaatacagattccatatcagaaattaatgaaaacagaggagattcattatgttctgatataacctggcggcagcgcaaaagatg

SEQ ID NO: 74738 - DNA, 103 bp, Artificial Sequence
  Synthetic Polynucleotide
taatacgactcactatagggtcgagaatacagattccatatcagaaattaaacagaggagataatttatgatatggaataacctggcggcagcgcaaaagatg

SEQ ID NO: 74739 - DNA, 103 bp, Artificial Sequence
  Synthetic Polynucleotide
taatacgactcactatagggctgtatcgagaatacagattccatatcagaaacagaggagatctgatatggaatctgtaaacctggcggcagcgcaaaagatg

SEQ ID NO: 74740 - DNA, 103 bp, Artificial Sequence
  Synthetic Polynucleotide
taatacgactcactatagggcgatactgtatcgagaatacagattccataaacagaggagatatggaatgtgtattctcaacctggcggcagcgcaaaagatg

SEQ ID NO: 74741 - DNA, 103 bp, Artificial Sequence
  Synthetic Polynucleotide
taatacgactcactatagggtaaaacgatactgtatcgagaatacagattaacagaggagaaatctgatgtctcgatacaacctggcggcagcgcaaaagatg

SEQ ID NO: 74742 - DNA, 103 bp, Artificial Sequence
  Synthetic Polynucleotide
taatacgactcactatagggggctttaaaacgatactgtatcgagaatacaacagaggagagtattcatgatacagtataacctggcggcagcgcaaaagatg

SEQ ID NO: 74743 - DNA, 103 bp, Artificial Sequence
  Synthetic Polynucleotide
taatacgactcactataggggcactggctttaaaacgatactgtatcgagaacagaggagactcgatatggtatcgtttaacctggcggcagcgcaaaagatg

SEQ ID NO: 74744 - DNA, 103 bp, Artificial Sequence
  Synthetic Polynucleotide
taatacgactcactatagggatatagcactggctttaaaacgatactgtaaacagaggagatacagtatggttttaaagaacctggcggcagcgcaaaagatg

SEQ ID NO: 74745 - DNA, 103 bp, Artificial Sequence
  Synthetic Polynucleotide
taatacgactcactataggggggagatatagcactggctttaaaacgataaacagaggagatatcgtatgaaagccagtaacctggcggcagcgcaaaagatg

SEQ ID NO: 74746 - DNA, 103 bp, Artificial Sequence
  Synthetic Polynucleotide
taatacgactcactataggggaacagggagatatagcactggctttaaaaaacagaggagattttaaatgcagtgctataacctggcggcagcgcaaaagatg

SEQ ID NO: 74747 - DNA, 103 bp, Artificial Sequence
  Synthetic Polynucleotide
taatacgactcactatagggtacgatccgaatgatgataataagcgtacgaacagaggagacgtacgatgattatcatcaacctggcggcagcgcaaaagatg

SEQ ID NO: 74748 - DNA, 103 bp, Artificial Sequence
  Synthetic Polynucleotide
taatacgactcactatagggctcacgaacagggagatatagcactggcttaacagaggagaaagccaatgctatatctcaacctggcggcagcgcaaaagatg

SEQ ID NO: 74749 - DNA, 103 bp, Artificial Sequence
  Synthetic Polynucleotide
taatacgactcactataggggcgttctcacgaacagggagatatagcactaacagaggagaagtgctatgtctccctgtaacctggcggcagcgcaaaagatg

SEQ ID NO: 74750 - DNA, 103 bp, Artificial Sequence
  Synthetic Polynucleotide
taatacgactcactatagggcgaaagcgttctcacgaacagggagatataaacagaggagatatatcatgctgttcgtgaacctggcggcagcgcaaaagatg

SEQ ID NO: 74751 - DNA, 103 bp, Artificial Sequence
  Synthetic Polynucleotide
taatacgactcactatagggttatacgaaagcgttctcacgaacagggagaacagaggagactccctatgcgtgagaacaacctggcggcagcgcaaaagatg

SEQ ID NO: 74752 - DNA, 103 bp, Artificial Sequence
  Synthetic Polynucleotide
taatacgactcactatagggtgatattatacgaaagcgttctcacgaacaaacagaggagatgttcgatggaacgctttaacctggcggcagcgcaaaagatg

SEQ ID NO: 74753 - DNA, 103 bp, Artificial Sequence
  Synthetic Polynucleotide
taatacgactcactatagggttgattgatattatacgaaagcgttctcacaacagaggagagtgagaatgctttcgtataacctggcggcagcgcaaaagatg

SEQ ID NO: 74754 - DNA, 103 bp, Artificial Sequence
  Synthetic Polynucleotide
taatacgactcactatagggatccgttgattgatattatacgaaagcgttaacagaggagaaacgctatggtataatataacctggcggcagcgcaaaagatg

SEQ ID NO: 74755 - DNA, 103 bp, Artificial Sequence
  Synthetic Polynucleotide
taatacgactcactatagggagattatccgttgattgatattatacgaaaaacagaggagatttcgtatgatatcaatcaacctggcggcagcgcaaaagatg

SEQ ID NO: 74756 - DNA, 103 bp, Artificial Sequence
  Synthetic Polynucleotide
taatacgactcactatagggacctcagattatccgttgattgatattataaacagaggagatataatatgaatcaacggaacctggcggcagcgcaaaagatg

SEQ ID NO: 74757 - DNA, 103 bp, Artificial Sequence
  Synthetic Polynucleotide
taatacgactcactatagggcaaaaacctcagattatccgttgattgataaacagaggagatatcaaatgacggataataacctggcggcagcgcaaaagatg

SEQ ID NO: 74758 - DNA, 103 bp, Artificial Sequence
  Synthetic Polynucleotide
taatacgactcactatagggtgaaatacgatccgaatgatgataataagcaacagaggagagcttatatgcatcattcgaacctggcggcagcgcaaaagatg

SEQ ID NO: 74759 - DNA, 103 bp, Artificial Sequence
  Synthetic Polynucleotide
taatacgactcactatagggttctccaaaaacctcagattatccgttgataacagaggagaatcaacatgtaatctgagaacctggcggcagcgcaaaagatg

SEQ ID NO: 74760 - DNA, 103 bp, Artificial Sequence
  Synthetic Polynucleotide
taatacgactcactatagggtattattctccaaaaacctcagattatccgaacagaggagacggataatgtgaggttttaacctggcggcagcgcaaaagatg

SEQ ID NO: 74761 - DNA, 103 bp, Artificial Sequence
  Synthetic Polynucleotide
taatacgactcactatagggagtcatattattctccaaaaacctcagattaacagaggagaaatctgatgtttttggagaacctggcggcagcgcaaaagatg

SEQ ID NO: 74762 - DNA, 103 bp, Artificial Sequence
  Synthetic Polynucleotide
taatacgactcactatagggtcatgagtcatattattctccaaaaacctcaacagaggagagaggttatgggagaataaaacctggcggcagcgcaaaagatg

SEQ ID NO: 74763 - DNA, 103 bp, Artificial Sequence
  Synthetic Polynucleotide
taatacgactcactatagggatagatcatgagtcatattattctccaaaaaacagaggagattttggatgataatatgaaacctggcggcagcgcaaaagatg

SEQ ID NO: 74764 - DNA, 103 bp, Artificial Sequence
  Synthetic Polynucleotide
taatacgactcactatagggacgaaatagatcatgagtcatattattctcaacagaggagagagaatatgatgactcataacctggcggcagcgcaaaagatg

SEQ ID NO: 74765 - DNA, 103 bp, Artificial Sequence
  Synthetic Polynucleotide
taatacgactcactatagggtatggacgaaatagatcatgagtcatattaaacagaggagataatatatgtcatgatctaacctggcggcagcgcaaaagatg

SEQ ID NO: 74766 - DNA, 103 bp, Artificial Sequence
  Synthetic Polynucleotide
taatacgactcactatagggttgtttatggacgaaatagatcatgagtcaaacagaggagatgactcatgatctatttcaacctggcggcagcgcaaaagatg

SEQ ID NO: 74767 - DNA, 103 bp, Artificial Sequence
  Synthetic Polynucleotide
taatacgactcactatagggctagattgtttatggacgaaatagatcatgaacagaggagacatgatatgtttcgtccaaacctggcggcagcgcaaaagatg

SEQ ID NO: 74768 - DNA, 103 bp, Artificial Sequence
  Synthetic Polynucleotide
taatacgactcactatagggtatgtctagattgtttatggacgaaatagaaacagaggagatctattatgtccataaacaacctggcggcagcgcaaaagatg

SEQ ID NO: 74769 - DNA, 103 bp, Artificial Sequence
  Synthetic Polynucleotide
taatacgactcactatagggttttatgaaatacgatccgaatgatgataaaacagaggagattatcaatgttcggatcgaacctggcggcagcgcaaaagatg

SEQ ID NO: 74770 - DNA, 103 bp, Artificial Sequence
  Synthetic Polynucleotide
taatacgactcactatagggattcctatgtctagattgtttatggacgaaaacagaggagattcgtcatgaaacaatctaacctggcggcagcgcaaaagatg

SEQ ID NO: 74771 - DNA, 103 bp, Artificial Sequence
  Synthetic Polynucleotide
taatacgactcactatagggctccaattcctatgtctagattgtttatggaacagaggagaccataaatgatctagacaaacctggcggcagcgcaaaagatg

SEQ ID NO: 74772 - DNA, 103 bp, Artificial Sequence
  Synthetic Polynucleotide
taatacgactcactatagggatcgcctccaattcctatgtctagattgttaacagaggagaaacaatatggacataggaaacctggcggcagcgcaaaagatg

SEQ ID NO: 74773 - DNA, 103 bp, Artificial Sequence
  Synthetic Polynucleotide
taatacgactcactatagggagatcatcgcctccaattcctatgtctagaaacagaggagatctagaatgaggaattggaacctggcggcagcgcaaaagatg

SEQ ID NO: 74774 - DNA, 103 bp, Artificial Sequence
  Synthetic Polynucleotide
taatacgactcactatagggaattaagatcatcgcctccaattcctatgtaacagaggagaacatagatgttggaggcgaacctggcggcagcgcaaaagatg

SEQ ID NO: 74775 - DNA, 103 bp, Artificial Sequence
  Synthetic Polynucleotide
taatacgactcactatagggcacaaaattaagatcatcgcctccaattccaacagaggagaggaattatgggcgatgataacctggcggcagcgcaaaagatg

SEQ ID NO: 74776 - DNA, 103 bp, Artificial Sequence
  Synthetic Polynucleotide
taatacgactcactatagggcattgcacaaaattaagatcatcgcctccaaacagaggagatggaggatgtgatcttaaaacctggcggcagcgcaaaagatg

SEQ ID NO: 74777 - DNA, 103 bp, Artificial Sequence
  Synthetic Polynucleotide
taatacgactcactatagggctactcattgcacaaaattaagatcatcgcaacagaggagagcgatgatgttaattttgaacctggcggcagcgcaaaagatg

SEQ ID NO: 74778 - DNA, 103 bp, Artificial Sequence
  Synthetic Polynucleotide
taatacgactcactatagggattaactactcattgcacaaaattaagatcaacagaggagagatcttatgtttgtgcaaaacctggcggcagcgcaaaagatg

SEQ ID NO: 74779 - DNA, 103 bp, Artificial Sequence
  Synthetic Polynucleotide
taatacgactcactatagggataggattaactactcattgcacaaaattaaacagaggagataatttatggcaatgagtaacctggcggcagcgcaaaagatg

SEQ ID NO: 74780 - DNA, 103 bp, Artificial Sequence
  Synthetic Polynucleotide
taatacgactcactatagggataacttttatgaaatacgatccgaatgataacagaggagaatcattatgatcgtatttaacctggcggcagcgcaaaagatg

SEQ ID NO: 74781 - DNA, 103 bp, Artificial Sequence
  Synthetic Polynucleotide
taatacgactcactatagggaagttataggattaactactcattgcacaaaacagaggagattgtgcatggagtagttaaacctggcggcagcgcaaaagatg

SEQ ID NO: 74782 - DNA, 103 bp, Artificial Sequence
  Synthetic Polynucleotide
taatacgactcactatagggattagaagttataggattaactactcattgaacagaggagacaatgaatggttaatcctaacctggcggcagcgcaaaagatg

SEQ ID NO: 74783 - DNA, 103 bp, Artificial Sequence
  Synthetic Polynucleotide
taatacgactcactatagggacaagattagaagttataggattaactactaacagaggagaagtagtatgtcctataacaacctggcggcagcgcaaaagatg

SEQ ID NO: 74784 - DNA, 103 bp, Artificial Sequence
  Synthetic Polynucleotide
taatacgactcactatagggatattacaagattagaagttataggattaaaacagaggagattaatcatgtaacttctaaacctggcggcagcgcaaaagatg

SEQ ID NO: 74785 - DNA, 103 bp, Artificial Sequence
  Synthetic Polynucleotide
taatacgactcactataggggatgaatattacaagattagaagttataggaacagaggagacctataatgtctaatcttaacctggcggcagcgcaaaagatg

SEQ ID NO: 74786 - DNA, 103 bp, Artificial Sequence
  Synthetic Polynucleotide
taatacgactcactatagggtcgatgatgaatattacaagattagaagttaacagaggagaaacttcatgtcttgtaataacctggcggcagcgcaaaagatg

SEQ ID NO: 74787 - DNA, 103 bp, Artificial Sequence
  Synthetic Polynucleotide
taatacgactcactatagggttatgtcgatgatgaatattacaagattagaacagaggagactaatcatgtaatattcaaacctggcggcagcgcaaaagatg

SEQ ID NO: 74788 - DNA, 103 bp, Artificial Sequence
  Synthetic Polynucleotide
taatacgactcactatagggtagtattatgtcgatgatgaatattacaagaacagaggagacttgtaatgttcatcatcaacctggcggcagcgcaaaagatg

SEQ ID NO: 74789 - DNA, 103 bp, Artificial Sequence
  Synthetic Polynucleotide
taatacgactcactatagggatagatagtattatgtcgatgatgaatattaacagaggagaaatattatgcatcgacataacctggcggcagcgcaaaagatg

SEQ ID NO: 74790 - DNA, 103 bp, Artificial Sequence
  Synthetic Polynucleotide
taatacgactcactatagggataacatagatagtattatgtcgatgatgaaacagaggagatcatcaatgacataatacaacctggcggcagcgcaaaagatg

SEQ ID NO: 74791 - DNA, 103 bp, Artificial Sequence
  Synthetic Polynucleotide
taatacgactcactatagggtaaatctttttcatgcttactcactctcaaaacagaggagattgagaatgagtaagcataacctggcggcagcgcaaaagatg

SEQ ID NO: 74792 - DNA, 103 bp, Artificial Sequence
  Synthetic Polynucleotide
taatacgactcactataggggtacaataacttttatgaaatacgatccgaaacagaggagatcggatatgatttcataaaacctggcggcagcgcaaaagatg

SEQ ID NO: 74793 - DNA, 103 bp, Artificial Sequence
  Synthetic Polynucleotide
taatacgactcactatagggcgatgataacatagatagtattatgtcgataacagaggagaatcgacatgatactatctaacctggcggcagcgcaaaagatg

SEQ ID NO: 74794 - DNA, 103 bp, Artificial Sequence
  Synthetic Polynucleotide
taatacgactcactatagggatatacgatgataacatagatagtattatgaacagaggagacataatatgatctatgttaacctggcggcagcgcaaaagatg

SEQ ID NO: 74795 - DNA, 103 bp, Artificial Sequence
  Synthetic Polynucleotide
taatacgactcactatagggtactaatatacgatgataacatagatagtaaacagaggagatactatatgtgttatcataacctggcggcagcgcaaaagatg

SEQ ID NO: 74796 - DNA, 103 bp, Artificial Sequence
  Synthetic Polynucleotide
taatacgactcactatagggtggtatactaatatacgatgataacatagaaacagaggagatctatgatgtcatcgtataacctggcggcagcgcaaaagatg

SEQ ID NO: 74797 - DNA, 103 bp, Artificial Sequence
  Synthetic Polynucleotide
taatacgactcactatagggggtcatggtatactaatatacgatgataacaacagaggagagttatcatggtatattagaacctggcggcagcgcaaaagatg

SEQ ID NO: 74798 - DNA, 103 bp, Artificial Sequence
  Synthetic Polynucleotide
taatacgactcactatagggaagaaggtcatggtatactaatatacgatgaacagaggagacatcgtatgttagtatacaacctggcggcagcgcaaaagatg

SEQ ID NO: 74799 - DNA, 103 bp, Artificial Sequence
  Synthetic Polynucleotide
taatacgactcactatagggaaatgaagaaggtcatggtatactaatataaacagaggagatatattatgataccatgaaacctggcggcagcgcaaaagatg

SEQ ID NO: 74800 - DNA, 103 bp, Artificial Sequence
  Synthetic Polynucleotide
taatacgactcactataggggcacgaaatgaagaaggtcatggtatactaaacagaggagatagtatatgatgaccttcaacctggcggcagcgcaaaagatg

SEQ ID NO: 74801 - DNA, 103 bp, Artificial Sequence
  Synthetic Polynucleotide
taatacgactcactatagggttttggcacgaaatgaagaaggtcatggtaaacagaggagataccatatgcttcttcataacctggcggcagcgcaaaagatg

SEQ ID NO: 74802 - DNA, 103 bp, Artificial Sequence
  Synthetic Polynucleotide
taatacgactcactatagggtatcattttggcacgaaatgaagaaggtcaaacagaggagatgacctatgtcatttcgtaacctggcggcagcgcaaaagatg

SEQ ID NO: 74803 - DNA, 103 bp, Artificial Sequence
  Synthetic Polynucleotide
taatacgactcactatagggcgatagtacaataacttttatgaaatacgaaacagaggagatcgtatatgataaaagttaacctggcggcagcgcaaaagatg

SEQ ID NO: 74804 - DNA, 103 bp, Artificial Sequence
  Synthetic Polynucleotide
taatacgactcactatagggctgtatatcattttggcacgaaatgaagaaaacagaggagattcttcatgtcgtgccaaaacctggcggcagcgcaaaagatg

SEQ ID NO: 74805 - DNA, 103 bp, Artificial Sequence
  Synthetic Polynucleotide
taatacgactcactatagggtaagactgtatatcattttggcacgaaatgaacagaggagacatttcatgccaaaatgaaacctggcggcagcgcaaaagatg

SEQ ID NO: 74806 - DNA, 103 bp, Artificial Sequence
  Synthetic Polynucleotide
taatacgactcactatagggctatttaagactgtatatcattttggcacgaacagaggagacgtgccatgatgatatacaacctggcggcagcgcaaaagatg

SEQ ID NO: 74807 - DNA, 103 bp, Artificial Sequence
  Synthetic Polynucleotide
taatacgactcactatagggcgtaactatttaagactgtatatcattttgaacagaggagacaaaatatgatacagtctaacctggcggcagcgcaaaagatg

SEQ ID NO: 74808 - DNA, 103 bp, Artificial Sequence
  Synthetic Polynucleotide
taatacgactcactatagggtattgcgtaactatttaagactgtatatcaaacagaggagatgatatatggtcttaaataacctggcggcagcgcaaaagatg

SEQ ID NO: 74809 - DNA, 103 bp, Artificial Sequence
  Synthetic Polynucleotide
taatacgactcactatagggtgagatattgcgtaactatttaagactgtaaacagaggagatacagtatgaaatagttaaacctggcggcagcgcaaaagatg

SEQ ID NO: 74810 - DNA, 103 bp, Artificial Sequence
  Synthetic Polynucleotide
taatacgactcactatagggactattgagatattgcgtaactatttaagaaacagaggagatcttaaatggttacgcaaaacctggcggcagcgcaaaagatg

SEQ ID NO: 74811 - DNA, 103 bp, Artificial Sequence
  Synthetic Polynucleotide
taatacgactcactatagggatgaaactattgagatattgcgtaactattaacagaggagaaatagtatggcaatatctaacctggcggcagcgcaaaagatg

SEQ ID NO: 74812 - DNA, 103 bp, Artificial Sequence
  Synthetic Polynucleotide
taatacgactcactatagggcaattatgaaactattgagatattgcgtaaaacagaggagattacgcatgatctcaataaacctggcggcagcgcaaaagatg

SEQ ID NO: 74813 - DNA, 103 bp, Artificial Sequence
  Synthetic Polynucleotide
taatacgactcactataggggctaacaattatgaaactattgagatattgaacagaggagacaatatatgaatagtttcaacctggcggcagcgcaaaagatg

SEQ ID NO: 74814 - DNA, 103 bp, Artificial Sequence
  Synthetic Polynucleotide
taatacgactcactataggggacatcgatagtacaataacttttatgaaaaacagaggagatttcatatgagttattgtaacctggcggcagcgcaaaagatg

SEQ ID NO: 74815 - DNA, 103 bp, Artificial Sequence
  Synthetic Polynucleotide
taatacgactcactatagggaaacagctaacaattatgaaactattgagaaacagaggagatctcaaatgtttcataataacctggcggcagcgcaaaagatg

SEQ ID NO: 74816 - DNA, 103 bp, Artificial Sequence
  Synthetic Polynucleotide
taatacgactcactatagggaatgaaaacagctaacaattatgaaactataacagaggagaatagttatgtaattgttaaacctggcggcagcgcaaaagatg

SEQ ID NO: 74817 - DNA, 103 bp, Artificial Sequence
  Synthetic Polynucleotide
taatacgactcactatagggatcttaatgaaaacagctaacaattatgaaaacagaggagattcataatggttagctgtaacctggcggcagcgcaaaagatg

SEQ ID NO: 74818 - DNA, 103 bp, Artificial Sequence
  Synthetic Polynucleotide
taatacgactcactatagggtacaaatcttaatgaaaacagctaacaattaacagaggagaaattgtatgctgttttcaaacctggcggcagcgcaaaagatg

SEQ ID NO: 74819 - DNA, 103 bp, Artificial Sequence
  Synthetic Polynucleotide
taatacgactcactatagggcagggtacaaatcttaatgaaaacagctaaaacagaggagattagctatgttcattaagaacctggcggcagcgcaaaagatg

SEQ ID NO: 74820 - DNA, 103 bp, Artificial Sequence
  Synthetic Polynucleotide
taatacgactcactatagggttaaacagggtacaaatcttaatgaaaacaaacagaggagatgttttatgtaagatttgaacctggcggcagcgcaaaagatg

SEQ ID NO: 74821 - DNA, 103 bp, Artificial Sequence
  Synthetic Polynucleotide
taatacgactcactatagggtcatgttaaacagggtacaaatcttaatgaaacagaggagatcattaatgtttgtacccaacctggcggcagcgcaaaagatg

SEQ ID NO: 74822 - DNA, 103 bp, Artificial Sequence
  Synthetic Polynucleotide
taatacgactcactatagggcaccatcatgttaaacagggtacaaatcttaacagaggagaaagattatgaccctgtttaacctggcggcagcgcaaaagatg

SEQ ID NO: 74823 - DNA, 103 bp, Artificial Sequence
  Synthetic Polynucleotide
taatacgactcactatagggtagaacaccatcatgttaaacagggtacaaaacagaggagattgtacatggtttaacataacctggcggcagcgcaaaagatg

SEQ ID NO: 74824 - DNA, 103 bp, Artificial Sequence
  Synthetic Polynucleotide
taatacgactcactatagggacgtatagaacaccatcatgttaaacagggaacagaggagaccctgtatgacatgatggaacctggcggcagcgcaaaagatg

SEQ ID NO: 74825 - DNA, 103 bp, Artificial Sequence
  Synthetic Polynucleotide
taatacgactcactataggggtgttgacatcgatagtacaataacttttaaacagaggagataaaagatgttgtactataacctggcggcagcgcaaaagatg

SEQ ID NO: 74826 - DNA, 103 bp, Artificial Sequence
  Synthetic Polynucleotide
taatacgactcactatagggtaaagacgtatagaacaccatcatgttaaaaacagaggagatttaacatgatggtgttcaacctggcggcagcgcaaaagatg

SEQ ID NO: 74827 - DNA, 103 bp, Artificial Sequence
  Synthetic Polynucleotide
taatacgactcactataggggaaaataaagacgtatagaacaccatcatgaacagaggagacatgatatggttctatacaacctggcggcagcgcaaaagatg

SEQ ID NO: 74828 - DNA, 103 bp, Artificial Sequence
  Synthetic Polynucleotide
taatacgactcactatagggaaatagaaaataaagacgtatagaacaccaaacagaggagatggtgtatgatacgtcttaacctggcggcagcgcaaaagatg

SEQ ID NO: 74829 - DNA, 103 bp, Artificial Sequence
  Synthetic Polynucleotide
taatacgactcactatagggattaaaaatagaaaataaagacgtatagaaaacagaggagattctatatgtctttatttaacctggcggcagcgcaaaagatg

SEQ ID NO: 74830 - DNA, 103 bp, Artificial Sequence
  Synthetic Polynucleotide
taatacgactcactatagggaaaaaattaaaaatagaaaataaagacgtaaacagaggagatacgtcatgattttctataacctggcggcagcgcaaaagatg

SEQ ID NO: 74831 - DNA, 103 bp, Artificial Sequence
  Synthetic Polynucleotide
taatacgactcactatagggaatttaaaaaattaaaaatagaaaataaagaacagaggagactttatatgctatttttaaacctggcggcagcgcaaaagatg

SEQ ID NO: 74832 - DNA, 103 bp, Artificial Sequence
  Synthetic Polynucleotide
taatacgactcactatagggttaaaaatttaaaaaattaaaaatagaaaaaacagaggagattttctatgtttaattttaacctggcggcagcgcaaaagatg

SEQ ID NO: 74833 - DNA, 103 bp, Artificial Sequence
  Synthetic Polynucleotide
taatacgactcactatagggaatcgttaaaaatttaaaaaattaaaaataaacagaggagatattttatgttttttaaaaacctggcggcagcgcaaaagatg

SEQ ID NO: 74834 - DNA, 103 bp, Artificial Sequence
  Synthetic Polynucleotide
taatacgactcactatagggcagtaaatcgttaaaaatttaaaaaattaaaacagaggagattaattatgtaaatttttaacctggcggcagcgcaaaagatg

SEQ ID NO: 74835 - DNA, 103 bp, Artificial Sequence
  Synthetic Polynucleotide
taatacgactcactatagggagccacagtaaatcgttaaaaatttaaaaaaacagaggagatttttaatgttttaacgaaacctggcggcagcgcaaaagatg

SEQ ID NO: 74836 - DNA, 103 bp, Artificial Sequence
  Synthetic Polynucleotide
taatacgactcactatagggagaatgtgttgacatcgatagtacaataacaacagaggagagttattatgctatcgatgaacctggcggcagcgcaaaagatg

SEQ ID NO: 74837 - DNA, 103 bp, Artificial Sequence
  Synthetic Polynucleotide
taatacgactcactatagggtatctagccacagtaaatcgttaaaaatttaacagaggagaaaatttatgacgatttacaacctggcggcagcgcaaaagatg

SEQ ID NO: 74838 - DNA, 103 bp, Artificial Sequence
  Synthetic Polynucleotide
taatacgactcactatagggttgggtatctagccacagtaaatcgttaaaaacagaggagatttaacatgttactgtggaacctggcggcagcgcaaaagatg

SEQ ID NO: 74839 - DNA, 103 bp, Artificial Sequence
  Synthetic Polynucleotide
taatacgactcactatagggagagattgggtatctagccacagtaaatcgaacagaggagacgatttatggtggctagaaacctggcggcagcgcaaaagatg

SEQ ID NO: 74840 - DNA, 103 bp, Artificial Sequence
  Synthetic Polynucleotide
taatacgactcactatagggttgagagagattgggtatctagccacagtaaacagaggagatactgtatgtagatacccaacctggcggcagcgcaaaagatg

SEQ ID NO: 74841 - DNA, 103 bp, Artificial Sequence
  Synthetic Polynucleotide
taatacgactcactatagggaatatttgagagagattgggtatctagccaaacagaggagatggctaatgacccaatctaacctggcggcagcgcaaaagatg

SEQ ID NO: 74842 - DNA, 103 bp, Artificial Sequence
  Synthetic Polynucleotide
taatacgactcactatagggaaaaaaatatttgagagagattgggtatctaacagaggagaagatacatgatctctctcaacctggcggcagcgcaaaagatg

SEQ ID NO: 74843 - DNA, 103 bp, Artificial Sequence
  Synthetic Polynucleotide
taatacgactcactatagggaggctaaaaaaatatttgagagagattgggaacagaggagacccaatatgtctcaaataaacctggcggcagcgcaaaagatg

SEQ ID NO: 74844 - DNA, 103 bp, Artificial Sequence
  Synthetic Polynucleotide
taatacgactcactatagggaagcgaggctaaaaaaatatttgagagagaaacagaggagatctctcatgaatatttttaacctggcggcagcgcaaaagatg

SEQ ID NO: 74845 - DNA, 103 bp, Artificial Sequence
  Synthetic Polynucleotide
taatacgactcactatagggcttgtaagcgaggctaaaaaaatatttgagaacagaggagactcaaaatgttttttagcaacctggcggcagcgcaaaagatg

SEQ ID NO: 74846 - DNA, 103 bp, Artificial Sequence
  Synthetic Polynucleotide
taatacgactcactatagggaacagcttgtaagcgaggctaaaaaaatataacagaggagaatatttatgtagcctcgcaacctggcggcagcgcaaaagatg

SEQ ID NO: 74847 - DNA, 103 bp, Artificial Sequence
  Synthetic Polynucleotide
taatacgactcactatagggaatgtagaatgtgttgacatcgatagtacaaacagaggagatgtactatggatgtcaacaacctggcggcagcgcaaaagatg

SEQ ID NO: 74848 - DNA, 103 bp, Artificial Sequence
  Synthetic Polynucleotide
taatacgactcactatagggagataaacagcttgtaagcgaggctaaaaaaacagaggagatttttaatgtcgcttacaaacctggcggcagcgcaaaagatg

SEQ ID NO: 74849 - DNA, 103 bp, Artificial Sequence
  Synthetic Polynucleotide
taatacgactcactatagggagtatagataaacagcttgtaagcgaggctaacagaggagaagcctcatgtacaagctgaacctggcggcagcgcaaaagatg

SEQ ID NO: 74850 - DNA, 103 bp, Artificial Sequence
  Synthetic Polynucleotide
taatacgactcactatagggttaatagtatagataaacagcttgtaagcgaacagaggagacgcttaatggctgtttataacctggcggcagcgcaaaagatg

SEQ ID NO: 74851 - DNA, 103 bp, Artificial Sequence
  Synthetic Polynucleotide
taatacgactcactatagggtagttttaatagtatagataaacagcttgtaacagaggagaacaagcatgttatctataaacctggcggcagcgcaaaagatg

SEQ ID NO: 74852 - DNA, 103 bp, Artificial Sequence
  Synthetic Polynucleotide
taatacgactcactatagggtttgttagttttaatagtatagataaacagaacagaggagactgtttatgtatactattaacctggcggcagcgcaaaagatg

SEQ ID NO: 74853 - DNA, 103 bp, Artificial Sequence
  Synthetic Polynucleotide
taatacgactcactatagggacggatttgttagttttaatagtatagataaacagaggagatatctaatgtattaaaacaacctggcggcagcgcaaaagatg

SEQ ID NO: 74854 - DNA, 103 bp, Artificial Sequence
  Synthetic Polynucleotide
taatacgactcactatagggaaatcacggatttgttagttttaatagtataacagaggagaatactaatgaaactaacaaacctggcggcagcgcaaaagatg

SEQ ID NO: 74855 - DNA, 103 bp, Artificial Sequence
  Synthetic Polynucleotide
taatacgactcactatagggtaccaaaatcacggatttgttagttttaataacagaggagaattaaaatgaacaaatccaacctggcggcagcgcaaaagatg

SEQ ID NO: 74856 - DNA, 103 bp, Artificial Sequence
  Synthetic Polynucleotide
taatacgactcactatagggcccattaccaaaatcacggatttgttagttaacagaggagaaactaaatgatccgtgataacctggcggcagcgcaaaagatg

SEQ ID NO: 74857 - DNA, 103 bp, Artificial Sequence
  Synthetic Polynucleotide
taatacgactcactatagggcggaacccattaccaaaatcacggatttgtaacagaggagaacaaatatgtgattttggaacctggcggcagcgcaaaagatg

SEQ ID NO: 74858 - DNA, 103 bp, Artificial Sequence
  Synthetic Polynucleotide
taatacgactcactatagggtaaaaaatgtagaatgtgttgacatcgataaacagaggagatatcgaatgcaacacattaacctggcggcagcgcaaaagatg

SEQ ID NO: 74859 - DNA, 103 bp, Artificial Sequence
  Synthetic Polynucleotide
taatacgactcactatagggtttgacggaacccattaccaaaatcacggaaacagaggagatccgtgatgttggtaatgaacctggcggcagcgcaaaagatg

SEQ ID NO: 74860 - DNA, 103 bp, Artificial Sequence
  Synthetic Polynucleotide
taatacgactcactatagggcaaattttgacggaacccattaccaaaatcaacagaggagagattttatgaatgggttcaacctggcggcagcgcaaaagatg

SEQ ID NO: 74861 - DNA, 103 bp, Artificial Sequence
  Synthetic Polynucleotide
taatacgactcactataggggtcggcaaattttgacggaacccattaccaaacagaggagatggtaaatggttccgtcaaacctggcggcagcgcaaaagatg

SEQ ID NO: 74862 - DNA, 103 bp, Artificial Sequence
  Synthetic Polynucleotide
taatacgactcactatagggatcacgtcggcaaattttgacggaacccataacagaggagaatgggtatggtcaaaattaacctggcggcagcgcaaaagatg

SEQ ID NO: 74863 - DNA, 103 bp, Artificial Sequence
  Synthetic Polynucleotide
taatacgactcactatagggttcatatcacgtcggcaaattttgacggaaaacagaggagattccgtatgaatttgccgaacctggcggcagcgcaaaagatg

SEQ ID NO: 74864 - DNA, 103 bp, Artificial Sequence
  Synthetic Polynucleotide
taatacgactcactatagggatatgttcatatcacgtcggcaaattttgaaacagaggagatcaaaaatggccgacgtgaacctggcggcagcgcaaaagatg

SEQ ID NO: 74865 - DNA, 103 bp, Artificial Sequence
  Synthetic Polynucleotide
taatacgactcactataggggatgaatatgttcatatcacgtcggcaaataacagaggagaatttgcatgcgtgatatgaacctggcggcagcgcaaaagatg

SEQ ID NO: 74866 - DNA, 103 bp, Artificial Sequence
  Synthetic Polynucleotide
taatacgactcactatagggtcgacgatgaatatgttcatatcacgtcggaacagaggagaccgacgatgtatgaacataacctggcggcagcgcaaaagatg

SEQ ID NO: 74867 - DNA, 103 bp, Artificial Sequence
  Synthetic Polynucleotide
taatacgactcactataggggatagtcgacgatgaatatgttcatatcacaacagaggagagtgataatgacatattcaaacctggcggcagcgcaaaagatg

SEQ ID NO: 74868 - DNA, 103 bp, Artificial Sequence
  Synthetic Polynucleotide
taatacgactcactatagggttgttgatagtcgacgatgaatatgttcataacagaggagaatgaacatgttcatcgtcaacctggcggcagcgcaaaagatg

SEQ ID NO: 74869 - DNA, 103 bp, Artificial Sequence
  Synthetic Polynucleotide
taatacgactcactatagggacgattaaaaaatgtagaatgtgttgacataacagaggagaatgtcaatgcattctacaaacctggcggcagcgcaaaagatg

SEQ ID NO: 74870 - DNA, 103 bp, Artificial Sequence
  Synthetic Polynucleotide
taatacgactcactatagggcaaaattgttgatagtcgacgatgaatatgaacagaggagacatattatgcgtcgactaaacctggcggcagcgcaaaagatg

SEQ ID NO: 74871 - DNA, 103 bp, Artificial Sequence
  Synthetic Polynucleotide
taatacgactcactatagggtaatacaaaattgttgatagtcgacgatgaaacagaggagatcatcgatgactatcaacaacctggcggcagcgcaaaagatg

SEQ ID NO: 74872 - DNA, 103 bp, Artificial Sequence
  Synthetic Polynucleotide
taatacgactcactatagggcagaataatacaaaattgttgatagtcgacaacagaggagagtcgacatgcaacaatttaacctggcggcagcgcaaaagatg

SEQ ID NO: 74873 - DNA, 103 bp, Artificial Sequence
  Synthetic Polynucleotide
taatacgactcactatagggctattcagaataatacaaaattgttgatagaacagaggagactatcaatgattttgtataacctggcggcagcgcaaaagatg

SEQ ID NO: 74874 - DNA, 103 bp, Artificial Sequence
  Synthetic Polynucleotide
taatacgactcactatagggtttcactattcagaataatacaaaattgttaacagaggagaaacaatatggtattattcaacctggcggcagcgcaaaagatg

SEQ ID NO: 74875 - DNA, 103 bp, Artificial Sequence
  Synthetic Polynucleotide
taatacgactcactatagggaaggttttcactattcagaataatacaaaaaacagaggagattttgtatgattctgaataacctggcggcagcgcaaaagatg

SEQ ID NO: 74876 - DNA, 103 bp, Artificial Sequence
  Synthetic Polynucleotide
taatacgactcactatagggctgtgaaggttttcactattcagaataataaacagaggagatattatatggaatagtgaaacctggcggcagcgcaaaagatg

SEQ ID NO: 74877 - DNA, 103 bp, Artificial Sequence
  Synthetic Polynucleotide
taatacgactcactatagggtctatctgtgaaggttttcactattcagaaaacagaggagattctgaatggtgaaaaccaacctggcggcagcgcaaaagatg

SEQ ID NO: 74878 - DNA, 103 bp, Artificial Sequence
  Synthetic Polynucleotide
taatacgactcactatagggaatgatctatctgtgaaggttttcactattaacagaggagaaatagtatgaaccttcacaacctggcggcagcgcaaaagatg

SEQ ID NO: 74879 - DNA, 103 bp, Artificial Sequence
  Synthetic Polynucleotide
taatacgactcactatagggttcaaaatgatctatctgtgaaggttttcaaacagaggagatgaaaaatgtcacagataaacctggcggcagcgcaaaagatg

SEQ ID NO: 74880 - DNA, 103 bp, Artificial Sequence
  Synthetic Polynucleotide
taatacgactcactatagggtatagacgattaaaaaatgtagaatgtgttaacagaggagaaacacaatgtacatttttaacctggcggcagcgcaaaagatg

SEQ ID NO: 74881 - DNA, 103 bp, Artificial Sequence
  Synthetic Polynucleotide
taatacgactcactataggggtgtgttcaaaatgatctatctgtgaaggtaacagaggagaaccttcatggatagatcaaacctggcggcagcgcaaaagatg

SEQ ID NO: 74882 - DNA, 103 bp, Artificial Sequence
  Synthetic Polynucleotide
taatacgactcactataggggcgttgtgtgttcaaaatgatctatctgtgaacagaggagacacagaatgatcattttgaacctggcggcagcgcaaaagatg

SEQ ID NO: 74883 - DNA, 103 bp, Artificial Sequence
  Synthetic Polynucleotide
taatacgactcactatagggtagatgcgttgtgtgttcaaaatgatctataacagaggagaatagatatgtttgaacacaacctggcggcagcgcaaaagatg

SEQ ID NO: 74884 - DNA, 103 bp, Artificial Sequence
  Synthetic Polynucleotide
taatacgactcactatagggaagtctagatgcgttgtgtgttcaaaatgaaacagaggagatcatttatgacacacaacaacctggcggcagcgcaaaagatg

SEQ ID NO: 74885 - DNA, 103 bp, Artificial Sequence
  Synthetic Polynucleotide
taatacgactcactataggggccgaaagtctagatgcgttgtgtgttcaaaacagaggagattgaacatgcaacgcatcaacctggcggcagcgcaaaagatg

SEQ ID NO: 74886 - DNA, 103 bp, Artificial Sequence
  Synthetic Polynucleotide
taatacgactcactatagggcaaccgccgaaagtctagatgcgttgtgtgaacagaggagacacacaatgcatctagacaacctggcggcagcgcaaaagatg

SEQ ID NO: 74887 - DNA, 103 bp, Artificial Sequence
  Synthetic Polynucleotide
taatacgactcactatagggtatggcaaccgccgaaagtctagatgcgttaacagaggagaaacgcaatgagactttcgaacctggcggcagcgcaaaagatg

SEQ ID NO: 74888 - DNA, 103 bp, Artificial Sequence
  Synthetic Polynucleotide
taatacgactcactatagggtattctatggcaaccgccgaaagtctagataacagaggagaatctagatgttcggcggtaacctggcggcagcgcaaaagatg

SEQ ID NO: 74889 - DNA, 103 bp, Artificial Sequence
  Synthetic Polynucleotide
taatacgactcactatagggacgtatattctatggcaaccgccgaaagtcaacagaggagagactttatgcggttgccaaacctggcggcagcgcaaaagatg

SEQ ID NO: 74890 - DNA, 103 bp, Artificial Sequence
  Synthetic Polynucleotide
taatacgactcactataggggaacgacgtatattctatggcaaccgccgaaacagaggagatcggcgatggccatagaaaacctggcggcagcgcaaaagatg

SEQ ID NO: 74891 - DNA, 103 bp, Artificial Sequence
  Synthetic Polynucleotide
taatacgactcactatagggtactatatagacgattaaaaaatgtagaataacagaggagaattctaatgtttttaatcaacctggcggcagcgcaaaagatg

SEQ ID NO: 74892 - DNA, 103 bp, Artificial Sequence
  Synthetic Polynucleotide
taatacgactcactataggggataagaacgacgtatattctatggcaaccaacagaggagaggttgcatgagaatatacaacctggcggcagcgcaaaagatg

SEQ ID NO: 74893 - DNA, 103 bp, Artificial Sequence
  Synthetic Polynucleotide
taatacgactcactatagggattgggataagaacgacgtatattctatggaacagaggagaccatagatgatacgtcgtaacctggcggcagcgcaaaagatg

SEQ ID NO: 74894 - DNA, 103 bp, Artificial Sequence
  Synthetic Polynucleotide
taatacgactcactatagggtggtaattgggataagaacgacgtatattcaacagaggagagaatatatgtcgttcttaaacctggcggcagcgcaaaagatg

SEQ ID NO: 74895 - DNA, 103 bp, Artificial Sequence
  Synthetic Polynucleotide
taatacgactcactatagggttagttggtaattgggataagaacgacgtaaacagaggagatacgtcatgcttatcccaaacctggcggcagcgcaaaagatg

SEQ ID NO: 74896 - DNA, 103 bp, Artificial Sequence
  Synthetic Polynucleotide
taatacgactcactataggggacttttagttggtaattgggataagaacgaacagaggagacgttctatgcccaattacaacctggcggcagcgcaaaagatg

SEQ ID NO: 74897 - DNA, 103 bp, Artificial Sequence
  Synthetic Polynucleotide
taatacgactcactataggggatcagacttttagttggtaattgggataaaacagaggagattatccatgttaccaactaacctggcggcagcgcaaaagatg

SEQ ID NO: 74898 - DNA, 103 bp, Artificial Sequence
  Synthetic Polynucleotide
taatacgactcactataggggttaagatcagacttttagttggtaattggaacagaggagaccaattatgaactaaaagaacctggcggcagcgcaaaagatg

SEQ ID NO: 74899 - DNA, 103 bp, Artificial Sequence
  Synthetic Polynucleotide
taatacgactcactataggggaggagttaagatcagacttttagttggtaaacagaggagataccaaatgaaagtctgaaacctggcggcagcgcaaaagatg

SEQ ID NO: 74900 - DNA, 103 bp, Artificial Sequence
  Synthetic Polynucleotide
taatacgactcactatagggtaatagaggagttaagatcagacttttagtaacagaggagaactaaaatgctgatcttaaacctggcggcagcgcaaaagatg

SEQ ID NO: 74901 - DNA, 103 bp, Artificial Sequence
  Synthetic Polynucleotide
taatacgactcactataggggccattaatagaggagttaagatcagacttaacagaggagaaagtctatgcttaactccaacctggcggcagcgcaaaagatg

SEQ ID NO: 74902 - DNA, 103 bp, Artificial Sequence
  Synthetic Polynucleotide
taatacgactcactatagggaatactaaatctttttcatgcttactcactaacagaggagaagtgagatggcatgaaaaaacctggcggcagcgcaaaagatg

SEQ ID NO: 74903 - DNA, 103 bp, Artificial Sequence
  Synthetic Polynucleotide
taatacgactcactatagggaaaaatactatatagacgattaaaaaatgtaacagaggagaacatttatgaatcgtctaaacctggcggcagcgcaaaagatg

SEQ ID NO: 74904 - DNA, 103 bp, Artificial Sequence
  Synthetic Polynucleotide
taatacgactcactatagggaagcagccattaatagaggagttaagatcaaacagaggagatgatctatgctcctctataacctggcggcagcgcaaaagatg

SEQ ID NO: 74905 - DNA, 103 bp, Artificial Sequence
  Synthetic Polynucleotide
taatacgactcactatagggtatagaagcagccattaatagaggagttaaaacagaggagattaactatgctattaatgaacctggcggcagcgcaaaagatg

SEQ ID NO: 74906 - DNA, 103 bp, Artificial Sequence
  Synthetic Polynucleotide
taatacgactcactatagggtccattatagaagcagccattaatagaggaaacagaggagatcctctatgaatggctgcaacctggcggcagcgcaaaagatg

SEQ ID NO: 74907 - DNA, 103 bp, Artificial Sequence
  Synthetic Polynucleotide
taatacgactcactatagggacaactccattatagaagcagccattaataaacagaggagatattaaatgctgcttctaaacctggcggcagcgcaaaagatg

SEQ ID NO: 74908 - DNA, 103 bp, Artificial Sequence
  Synthetic Polynucleotide
taatacgactcactatagggcatttacaactccattatagaagcagccataacagaggagaatggctatgtctataatgaacctggcggcagcgcaaaagatg

SEQ ID NO: 74909 - DNA, 103 bp, Artificial Sequence
  Synthetic Polynucleotide
taatacgactcactatagggcccgacatttacaactccattatagaagcaaacagaggagatgcttcatgaatggagttaacctggcggcagcgcaaaagatg

SEQ ID NO: 74910 - DNA, 103 bp, Artificial Sequence
  Synthetic Polynucleotide
taatacgactcactatagggattggcccgacatttacaactccattatagaacagaggagactataaatgagttgtaaaaacctggcggcagcgcaaaagatg

SEQ ID NO: 74911 - DNA, 103 bp, Artificial Sequence
  Synthetic Polynucleotide
taatacgactcactatagggctactattggcccgacatttacaactccataacagaggagaatggagatgtaaatgtcgaacctggcggcagcgcaaaagatg

SEQ ID NO: 74912 - DNA, 103 bp, Artificial Sequence
  Synthetic Polynucleotide
taatacgactcactatagggaatagctactattggcccgacatttacaacaacagaggagagttgtaatggtcgggccaaacctggcggcagcgcaaaagatg

SEQ ID NO: 74913 - DNA, 103 bp, Artificial Sequence
  Synthetic Polynucleotide
taatacgactcactatagggatggtaatagctactattggcccgacatttaacagaggagaaaatgtatggccaatagtaacctggcggcagcgcaaaagatg

SEQ ID NO: 74914 - DNA, 103 bp, Artificial Sequence
  Synthetic Polynucleotide
taatacgactcactatagggatcagaaaaatactatatagacgattaaaaaacagaggagattttaaatgtctatatagaacctggcggcagcgcaaaagatg

SEQ ID NO: 74915 - DNA, 103 bp, Artificial Sequence
  Synthetic Polynucleotide
taatacgactcactatagggtgtcgatggtaatagctactattggcccgaaacagaggagatcgggcatgtagtagctaaacctggcggcagcgcaaaagatg

SEQ ID NO: 74916 - DNA, 103 bp, Artificial Sequence
  Synthetic Polynucleotide
taatacgactcactatagggacacgtgtcgatggtaatagctactattggaacagaggagaccaataatggctattaccaacctggcggcagcgcaaaagatg

SEQ ID NO: 74917 - DNA, 103 bp, Artificial Sequence
  Synthetic Polynucleotide
taatacgactcactatagggccactacacgtgtcgatggtaatagctactaacagaggagaagtagcatgtaccatcgaaacctggcggcagcgcaaaagatg

SEQ ID NO: 74918 - DNA, 103 bp, Artificial Sequence
  Synthetic Polynucleotide
taatacgactcactatagggagttcccactacacgtgtcgatggtaatagaacagaggagactattaatgtcgacacgtaacctggcggcagcgcaaaagatg

SEQ ID NO: 74919 - DNA, 103 bp, Artificial Sequence
  Synthetic Polynucleotide
taatacgactcactataggggcaatagttcccactacacgtgtcgatggtaacagaggagaaccatcatgacgtgtagtaacctggcggcagcgcaaaagatg

SEQ ID NO: 74920 - DNA, 103 bp, Artificial Sequence
  Synthetic Polynucleotide
taatacgactcactatagggatttggcaatagttcccactacacgtgtcgaacagaggagacgacacatgtagtgggaaaacctggcggcagcgcaaaagatg

SEQ ID NO: 74921 - DNA, 103 bp, Artificial Sequence
  Synthetic Polynucleotide
taatacgactcactatagggtgaacatttggcaatagttcccactacacgaacagaggagacgtgtaatgggaactattaacctggcggcagcgcaaaagatg

SEQ ID NO: 74922 - DNA, 103 bp, Artificial Sequence
  Synthetic Polynucleotide
taatacgactcactataggggatattgaacatttggcaatagttcccactaacagaggagaagtgggatgtattgccaaaacctggcggcagcgcaaaagatg

SEQ ID NO: 74923 - DNA, 103 bp, Artificial Sequence
  Synthetic Polynucleotide
taatacgactcactataggggtatagatattgaacatttggcaatagttcaacagaggagagaactaatgccaaatgttaacctggcggcagcgcaaaagatg

SEQ ID NO: 74924 - DNA, 103 bp, Artificial Sequence
  Synthetic Polynucleotide
taatacgactcactatagggaactagtatagatattgaacatttggcaataacagaggagaattgccatgtgttcaataaacctggcggcagcgcaaaagatg

SEQ ID NO: 74925 - DNA, 103 bp, Artificial Sequence
  Synthetic Polynucleotide
taatacgactcactatagggaaaatatcagaaaaatactatatagacgataacagaggagaatcgtcatgatagtatttaacctggcggcagcgcaaaagatg

SEQ ID NO: 74926 - DNA, 103 bp, Artificial Sequence
  Synthetic Polynucleotide
taatacgactcactataggggctaaaactagtatagatattgaacatttgaacagaggagacaaatgatgaatatctataacctggcggcagcgcaaaagatg

SEQ ID NO: 74927 - DNA, 103 bp, Artificial Sequence
  Synthetic Polynucleotide
taatacgactcactatagggggtcagctaaaactagtatagatattgaacaacagaggagagttcaaatgctatactagaacctggcggcagcgcaaaagatg

SEQ ID NO: 74928 - DNA, 103 bp, Artificial Sequence
  Synthetic Polynucleotide
taatacgactcactatagggacttaggtcagctaaaactagtatagatataacagaggagaatatctatgctagttttaaacctggcggcagcgcaaaagatg

SEQ ID NO: 74929 - DNA, 103 bp, Artificial Sequence
  Synthetic Polynucleotide
taatacgactcactataggggataaacttaggtcagctaaaactagtataaacagaggagatatactatgtttagctgaaacctggcggcagcgcaaaagatg

SEQ ID NO: 74930 - DNA, 103 bp, Artificial Sequence
  Synthetic Polynucleotide
taatacgactcactatagggttattgataaacttaggtcagctaaaactaaacagaggagatagtttatgctgacctaaaacctggcggcagcgcaaaagatg

SEQ ID NO: 74931 - DNA, 103 bp, Artificial Sequence
  Synthetic Polynucleotide
taatacgactcactatagggtgtagttattgataaacttaggtcagctaaaacagaggagattagctatgctaagtttaaacctggcggcagcgcaaaagatg

SEQ ID NO: 74932 - DNA, 103 bp, Artificial Sequence
  Synthetic Polynucleotide
taatacgactcactatagggaccgatgtagttattgataaacttaggtcaaacagaggagatgacctatgtttatcaataacctggcggcagcgcaaaagatg

SEQ ID NO: 74933 - DNA, 103 bp, Artificial Sequence
  Synthetic Polynucleotide
taatacgactcactatagggtagataccgatgtagttattgataaacttaaacagaggagataagttatgcaataactaaacctggcggcagcgcaaaagatg

SEQ ID NO: 74934 - DNA, 103 bp, Artificial Sequence
  Synthetic Polynucleotide
taatacgactcactatagggagatctagataccgatgtagttattgataaaacagaggagattatcaatgactacatcgaacctggcggcagcgcaaaagatg

SEQ ID NO: 74935 - DNA, 103 bp, Artificial Sequence
  Synthetic Polynucleotide
taatacgactcactatagggtctagagatctagataccgatgtagttattaacagaggagaaataacatgatcggtatcaacctggcggcagcgcaaaagatg

SEQ ID NO: 74936 - DNA, 103 bp, Artificial Sequence
  Synthetic Polynucleotide
taatacgactcactatagggtatagaaaatatcagaaaaatactatatagaacagaggagactatatatgatttttctgaacctggcggcagcgcaaaagatg

SEQ ID NO: 74937 - DNA, 103 bp, Artificial Sequence
  Synthetic Polynucleotide
taatacgactcactataggggatattctagagatctagataccgatgtagaacagaggagactacatatgtatctagataacctggcggcagcgcaaaagatg

SEQ ID NO: 74938 - DNA, 103 bp, Artificial Sequence
  Synthetic Polynucleotide
taatacgactcactatagggattgggatattctagagatctagataccgaaacagaggagatcggtaatgagatctctaaacctggcggcagcgcaaaagatg

SEQ ID NO: 74939 - DNA, 103 bp, Artificial Sequence
  Synthetic Polynucleotide
taatacgactcactatagggcacctattgggatattctagagatctagataacagaggagaatctagatgtctagaataaacctggcggcagcgcaaaagatg

SEQ ID NO: 74940 - DNA, 103 bp, Artificial Sequence
  Synthetic Polynucleotide
taatacgactcactatagggcggaacacctattgggatattctagagatcaacagaggagagatctcatgaatatcccaaacctggcggcagcgcaaaagatg

SEQ ID NO: 74941 - DNA, 103 bp, Artificial Sequence
  Synthetic Polynucleotide
taatacgactcactatagggttctccggaacacctattgggatattctagaacagaggagactagaaatgcccaataggaacctggcggcagcgcaaaagatg

SEQ ID NO: 74942 - DNA, 103 bp, Artificial Sequence
  Synthetic Polynucleotide
taatacgactcactatagggactgattctccggaacacctattgggatataacagaggagaatatccatgtaggtgttcaacctggcggcagcgcaaaagatg

SEQ ID NO: 74943 - DNA, 103 bp, Artificial Sequence
  Synthetic Polynucleotide
taatacgactcactatagggtctttactgattctccggaacacctattggaacagaggagaccaataatggttccggagaacctggcggcagcgcaaaagatg

SEQ ID NO: 74944 - DNA, 103 bp, Artificial Sequence
  Synthetic Polynucleotide
taatacgactcactatagggagtgttctttactgattctccggaacacctaacagaggagaaggtgtatgggagaatcaaacctggcggcagcgcaaaagatg

SEQ ID NO: 74945 - DNA, 103 bp, Artificial Sequence
  Synthetic Polynucleotide
taatacgactcactatagggggtggagtgttctttactgattctccggaaaacagaggagattccggatgatcagtaaaaacctggcggcagcgcaaaagatg

SEQ ID NO: 74946 - DNA, 103 bp, Artificial Sequence
  Synthetic Polynucleotide
taatacgactcactatagggctataggtggagtgttctttactgattctcaacagaggagagagaatatgtaaagaacaaacctggcggcagcgcaaaagatg

SEQ ID NO: 74947 - DNA, 103 bp, Artificial Sequence
  Synthetic Polynucleotide
taatacgactcactataggggatattatagaaaatatcagaaaaatactaaacagaggagatagtatatgtctgatattaacctggcggcagcgcaaaagatg

SEQ ID NO: 74948 - DNA, 103 bp, Artificial Sequence
  Synthetic Polynucleotide
taatacgactcactataggggaatcctataggtggagtgttctttactgaaacagaggagatcagtaatgaacactccaaacctggcggcagcgcaaaagatg

SEQ ID NO: 74949 - DNA, 103 bp, Artificial Sequence
  Synthetic Polynucleotide
taatacgactcactatagggattaagaatcctataggtggagtgttctttaacagaggagaaaagaaatgtccacctataacctggcggcagcgcaaaagatg

SEQ ID NO: 74950 - DNA, 103 bp, Artificial Sequence
  Synthetic Polynucleotide
taatacgactcactatagggatcatattaagaatcctataggtggagtgtaacagaggagaacactcatgctataggataacctggcggcagcgcaaaagatg

SEQ ID NO: 74951 - DNA, 103 bp, Artificial Sequence
  Synthetic Polynucleotide
taatacgactcactatagggtgcgtatcatattaagaatcctataggtggaacagaggagaccacctatgggattcttaaacctggcggcagcgcaaaagatg

SEQ ID NO: 74952 - DNA, 103 bp, Artificial Sequence
  Synthetic Polynucleotide
taatacgactcactatagggagcactgcgtatcatattaagaatcctataaacagaggagatataggatgcttaatatgaacctggcggcagcgcaaaagatg

SEQ ID NO: 74953 - DNA, 103 bp, Artificial Sequence
  Synthetic Polynucleotide
taatacgactcactatagggcagttagcactgcgtatcatattaagaatcaacagaggagagattctatgtatgatacgaacctggcggcagcgcaaaagatg

SEQ ID NO: 74954 - DNA, 103 bp, Artificial Sequence
  Synthetic Polynucleotide
taatacgactcactatagggtctgccagttagcactgcgtatcatattaaaacagaggagattaataatgtacgcagtgaacctggcggcagcgcaaaagatg

SEQ ID NO: 74955 - DNA, 103 bp, Artificial Sequence
  Synthetic Polynucleotide
taatacgactcactatagggtgttgtctgccagttagcactgcgtatcataacagaggagaatgataatgagtgctaacaacctggcggcagcgcaaaagatg

SEQ ID NO: 74956 - DNA, 103 bp, Artificial Sequence
  Synthetic Polynucleotide
taatacgactcactatagggcggcttgttgtctgccagttagcactgcgtaacagaggagaacgcagatgtaactggcaaacctggcggcagcgcaaaagatg

SEQ ID NO: 74957 - DNA, 103 bp, Artificial Sequence
  Synthetic Polynucleotide
taatacgactcactatagggctcttcggcttgttgtctgccagttagcacaacagaggagagtgctaatgggcagacaaaacctggcggcagcgcaaaagatg

SEQ ID NO: 74958 - DNA, 103 bp, Artificial Sequence
  Synthetic Polynucleotide
taatacgactcactatagggattctgatattatagaaaatatcagaaaaaaacagaggagatttttcatgtattttctaaacctggcggcagcgcaaaagatg

SEQ ID NO: 74959 - DNA, 103 bp, Artificial Sequence
  Synthetic Polynucleotide
taatacgactcactatagggttatactcttcggcttgttgtctgccagttaacagaggagaaactggatgacaacaagcaacctggcggcagcgcaaaagatg

SEQ ID NO: 74960 - DNA, 103 bp, Artificial Sequence
  Synthetic Polynucleotide
taatacgactcactatagggtgaatttatactcttcggcttgttgtctgcaacagaggagagcagacatgaagccgaagaacctggcggcagcgcaaaagatg

SEQ ID NO: 74961 - DNA, 103 bp, Artificial Sequence
  Synthetic Polynucleotide
taatacgactcactatagggatggttgaatttatactcttcggcttgttgaacagaggagacaacaaatggaagagtataacctggcggcagcgcaaaagatg

SEQ ID NO: 74962 - DNA, 103 bp, Artificial Sequence
  Synthetic Polynucleotide
taatacgactcactatagggaattcatggttgaatttatactcttcggctaacagaggagaagccgaatggtataaattaacctggcggcagcgcaaaagatg

SEQ ID NO: 74963 - DNA, 103 bp, Artificial Sequence
  Synthetic Polynucleotide
taatacgactcactatagggtaaaaaattcatggttgaatttatactcttaacagaggagaaagagtatgaattcaaccaacctggcggcagcgcaaaagatg

SEQ ID NO: 74964 - DNA, 103 bp, Artificial Sequence
  Synthetic Polynucleotide
taatacgactcactatagggtagcgtaaaaaattcatggttgaatttataaacagaggagatataaaatgaaccatgaaaacctggcggcagcgcaaaagatg

SEQ ID NO: 74965 - DNA, 103 bp, Artificial Sequence
  Synthetic Polynucleotide
taatacgactcactatagggtttaatagcgtaaaaaattcatggttgaataacagaggagaattcaaatgtgaatttttaacctggcggcagcgcaaaagatg

SEQ ID NO: 74966 - DNA, 103 bp, Artificial Sequence
  Synthetic Polynucleotide
taatacgactcactatagggaagcctttaatagcgtaaaaaattcatggtaacagaggagaaccatgatgtttttacgcaacctggcggcagcgcaaaagatg

SEQ ID NO: 74967 - DNA, 103 bp, Artificial Sequence
  Synthetic Polynucleotide
taatacgactcactatagggttttaaagcctttaatagcgtaaaaaattcaacagaggagagaatttatgacgctattaaacctggcggcagcgcaaaagatg

SEQ ID NO: 74968 - DNA, 103 bp, Artificial Sequence
  Synthetic Polynucleotide
taatacgactcactataggggatacttttaaagcctttaatagcgtaaaaaacagaggagattttacatgattaaaggcaacctggcggcagcgcaaaagatg

SEQ ID NO: 74969 - DNA, 103 bp, Artificial Sequence
  Synthetic Polynucleotide
taatacgactcactatagggagacaattctgatattatagaaaatatcagaacagaggagactgataatgtctataataaacctggcggcagcgcaaaagatg

SEQ ID NO: 74970 - DNA, 103 bp, Artificial Sequence
  Synthetic Polynucleotide
taatacgactcactataggggatttgatacttttaaagcctttaatagcgaacagaggagacgctatatgaggctttaaaacctggcggcagcgcaaaagatg

SEQ ID NO: 74971 - DNA, 103 bp, Artificial Sequence
  Synthetic Polynucleotide
taatacgactcactatagggtagaagatttgatacttttaaagcctttaaaacagaggagattaaagatgttaaaagtaaacctggcggcagcgcaaaagatg

SEQ ID NO: 74972 - DNA, 103 bp, Artificial Sequence
  Synthetic Polynucleotide
taatacgactcactatagggcttcgtagaagatttgatacttttaaagccaacagaggagaggctttatgagtatcaaaaacctggcggcagcgcaaaagatg

SEQ ID NO: 74973 - DNA, 103 bp, Artificial Sequence
  Synthetic Polynucleotide
taatacgactcactatagggcagatcttcgtagaagatttgatacttttaaacagaggagataaaagatgcaaatcttcaacctggcggcagcgcaaaagatg

SEQ ID NO: 74974 - DNA, 103 bp, Artificial Sequence
  Synthetic Polynucleotide
taatacgactcactatagggggccacagatcttcgtagaagatttgatacaacagaggagagtatcaatgcttctacgaaacctggcggcagcgcaaaagatg

SEQ ID NO: 74975 - DNA, 103 bp, Artificial Sequence
  Synthetic Polynucleotide
taatacgactcactatagggccactggccacagatcttcgtagaagatttaacagaggagaaaatctatgacgaagatcaacctggcggcagcgcaaaagatg

SEQ ID NO: 74976 - DNA, 103 bp, Artificial Sequence
  Synthetic Polynucleotide
taatacgactcactatagggatccaccactggccacagatcttcgtagaaaacagaggagattctacatggatctgtggaacctggcggcagcgcaaaagatg

SEQ ID NO: 74977 - DNA, 103 bp, Artificial Sequence
  Synthetic Polynucleotide
taatacgactcactatagggtgattatccaccactggccacagatcttcgaacagaggagacgaagaatggtggccagtaacctggcggcagcgcaaaagatg

SEQ ID NO: 74978 - DNA, 103 bp, Artificial Sequence
  Synthetic Polynucleotide
taatacgactcactatagggtattctgattatccaccactggccacagataacagaggagaatctgtatgcagtggtggaacctggcggcagcgcaaaagatg

SEQ ID NO: 74979 - DNA, 103 bp, Artificial Sequence
  Synthetic Polynucleotide
taatacgactcactataggggtgtatattctgattatccaccactggccaaacagaggagatggccaatggtggataataacctggcggcagcgcaaaagatg

SEQ ID NO: 74980 - DNA, 103 bp, Artificial Sequence
  Synthetic Polynucleotide
taatacgactcactatagggatggaagacaattctgatattatagaaaataacagaggagaattttcatgaatatcagaaacctggcggcagcgcaaaagatg

SEQ ID NO: 74981 - DNA, 103 bp, Artificial Sequence
  Synthetic Polynucleotide
taatacgactcactataggggttaggtgtatattctgattatccaccactaacagaggagaagtggtatgtaatcagaaaacctggcggcagcgcaaaagatg

SEQ ID NO: 74982 - DNA, 103 bp, Artificial Sequence
  Synthetic Polynucleotide
taatacgactcactatagggaaaacgttaggtgtatattctgattatccaaacagaggagatggataatgagaatatacaacctggcggcagcgcaaaagatg

SEQ ID NO: 74983 - DNA, 103 bp, Artificial Sequence
  Synthetic Polynucleotide
taatacgactcactatagggcaattaaaacgttaggtgtatattctgattaacagaggagaaatcagatgatacacctaaacctggcggcagcgcaaaagatg

SEQ ID NO: 74984 - DNA, 103 bp, Artificial Sequence
  Synthetic Polynucleotide
taatacgactcactatagggacatacaattaaaacgttaggtgtatattcaacagaggagagaatatatgcctaacgttaacctggcggcagcgcaaaagatg

SEQ ID NO: 74985 - DNA, 103 bp, Artificial Sequence
  Synthetic Polynucleotide
taatacgactcactatagggtctatacatacaattaaaacgttaggtgtaaacagaggagatacaccatgcgttttaataacctggcggcagcgcaaaagatg

SEQ ID NO: 74986 - DNA, 103 bp, Artificial Sequence
  Synthetic Polynucleotide
taatacgactcactataggggaggatctatacatacaattaaaacgttagaacagaggagactaacgatgtaattgtataacctggcggcagcgcaaaagatg

SEQ ID NO: 74987 - DNA, 103 bp, Artificial Sequence
  Synthetic Polynucleotide
taatacgactcactatagggtactggaggatctatacatacaattaaaacaacagaggagagttttaatggtatgtataaacctggcggcagcgcaaaagatg

SEQ ID NO: 74988 - DNA, 103 bp, Artificial Sequence
  Synthetic Polynucleotide
taatacgactcactatagggtcatttactggaggatctatacatacaattaacagaggagaaattgtatgtatagatccaacctggcggcagcgcaaaagatg

SEQ ID NO: 74989 - DNA, 103 bp, Artificial Sequence
  Synthetic Polynucleotide
taatacgactcactatagggacgcgtcatttactggaggatctatacataaacagaggagatatgtaatgatcctccagaacctggcggcagcgcaaaagatg

SEQ ID NO: 74990 - DNA, 103 bp, Artificial Sequence
  Synthetic Polynucleotide
taatacgactcactatagggaggaaacgcgtcatttactggaggatctataacagaggagaatagatatgccagtaaataacctggcggcagcgcaaaagatg

SEQ ID NO: 74991 - DNA, 103 bp, Artificial Sequence
  Synthetic Polynucleotide
taatacgactcactatagggttccgatggaagacaattctgatattatagaacagaggagactataaatgcagaattgtaacctggcggcagcgcaaaagatg

SEQ ID NO: 74992 - DNA, 103 bp, Artificial Sequence
  Synthetic Polynucleotide
taatacgactcactatagggtatgtaggaaacgcgtcatttactggaggaaacagaggagatcctccatgaaatgacgcaacctggcggcagcgcaaaagatg

SEQ ID NO: 74993 - DNA, 103 bp, Artificial Sequence
  Synthetic Polynucleotide
taatacgactcactataggggatgttatgtaggaaacgcgtcatttactgaacagaggagacagtaaatgacgcgtttcaacctggcggcagcgcaaaagatg

SEQ ID NO: 74994 - DNA, 103 bp, Artificial Sequence
  Synthetic Polynucleotide
taatacgactcactatagggtgaaagatgttatgtaggaaacgcgtcattaacagaggagaaatgacatgtttcctacaaacctggcggcagcgcaaaagatg

SEQ ID NO: 74995 - DNA, 103 bp, Artificial Sequence
  Synthetic Polynucleotide
taatacgactcactataggggatgatgaaagatgttatgtaggaaacgcgaacagaggagacgcgttatgtacataacaaacctggcggcagcgcaaaagatg

SEQ ID NO: 74996 - DNA, 103 bp, Artificial Sequence
  Synthetic Polynucleotide
taatacgactcactatagggtatcagatgatgaaagatgttatgtaggaaaacagaggagattcctaatgaacatctttaacctggcggcagcgcaaaagatg

SEQ ID NO: 74997 - DNA, 103 bp, Artificial Sequence
  Synthetic Polynucleotide
taatacgactcactatagggttgggtatcagatgatgaaagatgttatgtaacagaggagaacataaatgctttcatcaaacctggcggcagcgcaaaagatg

SEQ ID NO: 74998 - DNA, 103 bp, Artificial Sequence
  Synthetic Polynucleotide
taatacgactcactatagggtgtttttgggtatcagatgatgaaagatgtaacagaggagaacatctatgatcatctgaaacctggcggcagcgcaaaagatg

SEQ ID NO: 74999 - DNA, 103 bp, Artificial Sequence
  Synthetic Polynucleotide
taatacgactcactatagggttggatgtttttgggtatcagatgatgaaaaacagaggagatttcatatgctgatacccaacctggcggcagcgcaaaagatg

SEQ ID NO: 75000 - DNA, 103 bp, Artificial Sequence
  Synthetic Polynucleotide
taatacgactcactatagggactacttggatgtttttgggtatcagatgaaacagaggagatcatctatgacccaaaaaaacctggcggcagcgcaaaagatg

SEQ ID NO: 75001 - DNA, 103 bp, Artificial Sequence
  Synthetic Polynucleotide
taatacgactcactatagggggactactacttggatgtttttgggtatcaaacagaggagatgatacatgaaaacatccaacctggcggcagcgcaaaagatg

SEQ ID NO: 75002 - DNA, 103 bp, Artificial Sequence
  Synthetic Polynucleotide
taatacgactcactatagggacaacttccgatggaagacaattctgatataacagaggagaatatcaatgttgtcttccaacctggcggcagcgcaaaagatg

SEQ ID NO: 75003 - DNA, 103 bp, Artificial Sequence
  Synthetic Polynucleotide
taatacgactcactatagggacgtaggactactacttggatgtttttgggaacagaggagacccaaaatgatccaagtaaacctggcggcagcgcaaaagatg

SEQ ID NO: 75004 - DNA, 103 bp, Artificial Sequence
  Synthetic Polynucleotide
taatacgactcactatagggaaataacgtaggactactacttggatgtttaacagaggagaaaacatatgagtagtagtaacctggcggcagcgcaaaagatg

SEQ ID NO: 75005 - DNA, 103 bp, Artificial Sequence
  Synthetic Polynucleotide
taatacgactcactatagggaaaaaaaataacgtaggactactacttggaaacagaggagatccaagatgtagtcctacaacctggcggcagcgcaaaagatg

SEQ ID NO: 75006 - DNA, 103 bp, Artificial Sequence
  Synthetic Polynucleotide
taatacgactcactatagggttgataaaaaaaataacgtaggactactacaacagaggagagtagtaatgctacgttataacctggcggcagcgcaaaagatg

SEQ ID NO: 75007 - DNA, 103 bp, Artificial Sequence
  Synthetic Polynucleotide
taatacgactcactatagggtaatattgataaaaaaaataacgtaggactaacagaggagaagtcctatgttattttttaacctggcggcagcgcaaaagatg

SEQ ID NO: 75008 - DNA, 103 bp, Artificial Sequence
  Synthetic Polynucleotide
taatacgactcactatagggaccgttaatattgataaaaaaaataacgtaaacagaggagatacgttatgttttttatcaacctggcggcagcgcaaaagatg

SEQ ID NO: 75009 - DNA, 103 bp, Artificial Sequence
  Synthetic Polynucleotide
taatacgactcactatagggttataaccgttaatattgataaaaaaaataaacagaggagatattttatgtatcaatataacctggcggcagcgcaaaagatg

SEQ ID NO: 75010 - DNA, 103 bp, Artificial Sequence
  Synthetic Polynucleotide
taatacgactcactatagggaaattttataaccgttaatattgataaaaaaacagaggagatttttaatgatattaacgaacctggcggcagcgcaaaagatg

SEQ ID NO: 75011 - DNA, 103 bp, Artificial Sequence
  Synthetic Polynucleotide
taatacgactcactataggggatataaattttataaccgttaatattgataacagaggagaatcaatatgaacggttataacctggcggcagcgcaaaagatg

SEQ ID NO: 75012 - DNA, 103 bp, Artificial Sequence
  Synthetic Polynucleotide
taatacgactcactataggggcccggatataaattttataaccgttaataaacagaggagatattaaatgttataaaataacctggcggcagcgcaaaagatg

SEQ ID NO: 75013 - DNA, 103 bp, Artificial Sequence
  Synthetic Polynucleotide
taatacgactcactatagggtgctaaatactaaatctttttcatgcttacaacagaggagagtaagcatgaaaaagattaacctggcggcagcgcaaaagatg

SEQ ID NO: 75014 - DNA, 103 bp, Artificial Sequence
  Synthetic Polynucleotide
taatacgactcactatagggagtatacaacttccgatggaagacaattctaacagaggagaagaattatgttccatcggaacctggcggcagcgcaaaagatg

SEQ ID NO: 75015 - DNA, 103 bp, Artificial Sequence
  Synthetic Polynucleotide
taatacgactcactatagggtcactgcccggatataaattttataaccgtaacagaggagaacggttatgaaatttataaacctggcggcagcgcaaaagatg

SEQ ID NO: 75016 - DNA, 103 bp, Artificial Sequence
  Synthetic Polynucleotide
taatacgactcactatagggcaaagtcactgcccggatataaattttataaacagaggagatataaaatgtatatccggaacctggcggcagcgcaaaagatg

SEQ ID NO: 75017 - DNA, 103 bp, Artificial Sequence
  Synthetic Polynucleotide
taatacgactcactatagggagctacaaagtcactgcccggatataaattaacagaggagaaatttaatgccgggcagtaacctggcggcagcgcaaaagatg

SEQ ID NO: 75018 - DNA, 103 bp, Artificial Sequence
  Synthetic Polynucleotide
taatacgactcactataggggggagagctacaaagtcactgcccggatataacagaggagaatatccatgcagtgacttaacctggcggcagcgcaaaagatg

SEQ ID NO: 75019 - DNA, 103 bp, Artificial Sequence
  Synthetic Polynucleotide
taatacgactcactatagggaatctgggagagctacaaagtcactgcccgaacagaggagacgggcaatgactttgtagaacctggcggcagcgcaaaagatg

SEQ ID NO: 75020 - DNA, 103 bp, Artificial Sequence
  Synthetic Polynucleotide
taatacgactcactatagggaaagaaatctgggagagctacaaagtcactaacagaggagaagtgacatggtagctctcaacctggcggcagcgcaaaagatg

SEQ ID NO: 75021 - DNA, 103 bp, Artificial Sequence
  Synthetic Polynucleotide
taatacgactcactatagggagggaaaagaaatctgggagagctacaaagaacagaggagactttgtatgtctcccagaaacctggcggcagcgcaaaagatg

SEQ ID NO: 75022 - DNA, 103 bp, Artificial Sequence
  Synthetic Polynucleotide
taatacgactcactataggggaacgagggaaaagaaatctgggagagctaaacagaggagatagctcatgcagatttctaacctggcggcagcgcaaaagatg

SEQ ID NO: 75023 - DNA, 103 bp, Artificial Sequence
  Synthetic Polynucleotide
taatacgactcactatagggtagatgaacgagggaaaagaaatctgggagaacagaggagactcccaatgttcttttccaacctggcggcagcgcaaaagatg

SEQ ID NO: 75024 - DNA, 103 bp, Artificial Sequence
  Synthetic Polynucleotide
taatacgactcactatagggtttgctagatgaacgagggaaaagaaatctaacagaggagaagatttatgttccctcgtaacctggcggcagcgcaaaagatg

SEQ ID NO: 75025 - DNA, 103 bp, Artificial Sequence
  Synthetic Polynucleotide
taatacgactcactatagggccgatagtatacaacttccgatggaagacaaacagaggagatgtcttatgtcggaagttaacctggcggcagcgcaaaagatg

SEQ ID NO: 75026 - DNA, 103 bp, Artificial Sequence
  Synthetic Polynucleotide
taatacgactcactatagggatagttttgctagatgaacgagggaaaagaaacagaggagatcttttatgtcgttcatcaacctggcggcagcgcaaaagatg

SEQ ID NO: 75027 - DNA, 103 bp, Artificial Sequence
  Synthetic Polynucleotide
taatacgactcactatagggaaataatagttttgctagatgaacgagggaaacagaggagatccctcatgcatctagcaaacctggcggcagcgcaaaagatg

SEQ ID NO: 75028 - DNA, 103 bp, Artificial Sequence
  Synthetic Polynucleotide
taatacgactcactataggggattaaaataatagttttgctagatgaacgaacagaggagacgttcaatgagcaaaactaacctggcggcagcgcaaaagatg

SEQ ID NO: 75029 - DNA, 103 bp, Artificial Sequence
  Synthetic Polynucleotide
taatacgactcactatagggaaagggattaaaataatagttttgctagataacagaggagaatctagatgaactattataacctggcggcagcgcaaaagatg

SEQ ID NO: 75030 - DNA, 103 bp, Artificial Sequence
  Synthetic Polynucleotide
taatacgactcactatagggctgaaaaagggattaaaataatagttttgcaacagaggagagcaaaaatgttattttaaaacctggcggcagcgcaaaagatg

SEQ ID NO: 75031 - DNA, 103 bp, Artificial Sequence
  Synthetic Polynucleotide
taatacgactcactatagggggcatctgaaaaagggattaaaataatagtaacagaggagaactattatgttaatccctaacctggcggcagcgcaaaagatg

SEQ ID NO: 75032 - DNA, 103 bp, Artificial Sequence
  Synthetic Polynucleotide
taatacgactcactatagggaaagaggcatctgaaaaagggattaaaataaacagaggagatattttatgccctttttcaacctggcggcagcgcaaaagatg

SEQ ID NO: 75033 - DNA, 103 bp, Artificial Sequence
  Synthetic Polynucleotide
taatacgactcactatagggaactaaaagaggcatctgaaaaagggattaaacagaggagataatccatgtttcagatgaacctggcggcagcgcaaaagatg

SEQ ID NO: 75034 - DNA, 103 bp, Artificial Sequence
  Synthetic Polynucleotide
taatacgactcactatagggtgataaactaaaagaggcatctgaaaaaggaacagaggagaccttttatggatgcctctaacctggcggcagcgcaaaagatg

SEQ ID NO: 75035 - DNA, 103 bp, Artificial Sequence
  Synthetic Polynucleotide
taatacgactcactatagggatttttgataaactaaaagaggcatctgaaaacagaggagattcagaatgctcttttagaacctggcggcagcgcaaaagatg

SEQ ID NO: 75036 - DNA, 103 bp, Artificial Sequence
  Synthetic Polynucleotide
taatacgactcactatagggtgattccgatagtatacaacttccgatggaaacagaggagatccatcatgagttgtataaacctggcggcagcgcaaaagatg

SEQ ID NO: 75037 - DNA, 103 bp, Artificial Sequence
  Synthetic Polynucleotide
taatacgactcactatagggcgcttatttttgataaactaaaagaggcataacagaggagaatgcctatgttagtttataacctggcggcagcgcaaaagatg

SEQ ID NO: 75038 - DNA, 103 bp, Artificial Sequence
  Synthetic Polynucleotide
taatacgactcactataggggggagcgcttatttttgataaactaaaagaaacagaggagatcttttatgttatcaaaaaacctggcggcagcgcaaaagatg

SEQ ID NO: 75039 - DNA, 103 bp, Artificial Sequence
  Synthetic Polynucleotide
taatacgactcactatagggactaggggagcgcttatttttgataaactaaacagaggagatagtttatgaaaaataagaacctggcggcagcgcaaaagatg

SEQ ID NO: 75040 - DNA, 103 bp, Artificial Sequence
  Synthetic Polynucleotide
taatacgactcactataggggtacgactaggggagcgcttatttttgataaacagaggagatatcaaatgtaagcgctcaacctggcggcagcgcaaaagatg

SEQ ID NO: 75041 - DNA, 103 bp, Artificial Sequence
  Synthetic Polynucleotide
taatacgactcactatagggtctgagtacgactaggggagcgcttattttaacagaggagaaaaataatggctcccctaaacctggcggcagcgcaaaagatg

SEQ ID NO: 75042 - DNA, 103 bp, Artificial Sequence
  Synthetic Polynucleotide
taatacgactcactatagggaatcctctgagtacgactaggggagcgcttaacagaggagaaagcgcatgcctagtcgtaacctggcggcagcgcaaaagatg

SEQ ID NO: 75043 - DNA, 103 bp, Artificial Sequence
  Synthetic Polynucleotide
taatacgactcactataggggttgtaatcctctgagtacgactaggggagaacagaggagactccccatgtcgtactcaaacctggcggcagcgcaaaagatg

SEQ ID NO: 75044 - DNA, 103 bp, Artificial Sequence
  Synthetic Polynucleotide
taatacgactcactatagggtttttgttgtaatcctctgagtacgactagaacagaggagactagtcatgctcagaggaaacctggcggcagcgcaaaagatg

SEQ ID NO: 75045 - DNA, 103 bp, Artificial Sequence
  Synthetic Polynucleotide
taatacgactcactataggggcatctttttgttgtaatcctctgagtacgaacagaggagacgtactatgaggattacaaacctggcggcagcgcaaaagatg

SEQ ID NO: 75046 - DNA, 103 bp, Artificial Sequence
  Synthetic Polynucleotide
taatacgactcactatagggacatagcatctttttgttgtaatcctctgaaacagaggagatcagagatgtacaacaaaaacctggcggcagcgcaaaagatg

SEQ ID NO: 75047 - DNA, 103 bp, Artificial Sequence
  Synthetic Polynucleotide
taatacgactcactataggggtaactgattccgatagtatacaacttccgaacagaggagacggaagatgtatactatcaacctggcggcagcgcaaaagatg

SEQ ID NO: 75048 - DNA, 103 bp, Artificial Sequence
  Synthetic Polynucleotide
taatacgactcactatagggtatatacatagcatctttttgttgtaatccaacagaggagaggattaatgcaaaaagataacctggcggcagcgcaaaagatg

SEQ ID NO: 75049 - DNA, 103 bp, Artificial Sequence
  Synthetic Polynucleotide
taatacgactcactatagggaaatatatatacatagcatctttttgttgtaacagaggagaacaacaatgagatgctataacctggcggcagcgcaaaagatg

SEQ ID NO: 75050 - DNA, 103 bp, Artificial Sequence
  Synthetic Polynucleotide
taatacgactcactatagggctaagaaatatatatacatagcatctttttaacagaggagaaaaaagatgctatgtataaacctggcggcagcgcaaaagatg

SEQ ID NO: 75051 - DNA, 103 bp, Artificial Sequence
  Synthetic Polynucleotide
taatacgactcactatagggtctagctaagaaatatatatacatagcatcaacagaggagagatgctatgtatatatataacctggcggcagcgcaaaagatg

SEQ ID NO: 75052 - DNA, 103 bp, Artificial Sequence
  Synthetic Polynucleotide
taatacgactcactatagggatcactctagctaagaaatatatatacataaacagaggagatatgtaatgatatttcttaacctggcggcagcgcaaaagatg

SEQ ID NO: 75053 - DNA, 103 bp, Artificial Sequence
  Synthetic Polynucleotide
taatacgactcactatagggaaattatcactctagctaagaaatatatataacagaggagaatatatatgtcttagctaaacctggcggcagcgcaaaagatg

SEQ ID NO: 75054 - DNA, 103 bp, Artificial Sequence
  Synthetic Polynucleotide
taatacgactcactatagggtaacgaaattatcactctagctaagaaataaacagaggagatatttcatggctagagtgaacctggcggcagcgcaaaagatg

SEQ ID NO: 75055 - DNA, 103 bp, Artificial Sequence
  Synthetic Polynucleotide
taatacgactcactatagggtgttttaacgaaattatcactctagctaagaacagaggagacttagcatgagtgataataacctggcggcagcgcaaaagatg

SEQ ID NO: 75056 - DNA, 103 bp, Artificial Sequence
  Synthetic Polynucleotide
taatacgactcactatagggttgaatgttttaacgaaattatcactctagaacagaggagactagagatgtaatttcgtaacctggcggcagcgcaaaagatg

SEQ ID NO: 75057 - DNA, 103 bp, Artificial Sequence
  Synthetic Polynucleotide
taatacgactcactatagggaacatttgaatgttttaacgaaattatcacaacagaggagagtgataatgtcgttaaaaaacctggcggcagcgcaaaagatg

SEQ ID NO: 75058 - DNA, 103 bp, Artificial Sequence
  Synthetic Polynucleotide
taatacgactcactatagggaacatgtaactgattccgatagtatacaacaacagaggagagttgtaatgtatcggaataacctggcggcagcgcaaaagatg

SEQ ID NO: 75059 - DNA, 103 bp, Artificial Sequence
  Synthetic Polynucleotide
taatacgactcactatagggttgacaacatttgaatgttttaacgaaattaacagaggagaaatttcatgaaaacattcaacctggcggcagcgcaaaagatg

SEQ ID NO: 75060 - DNA, 103 bp, Artificial Sequence
  Synthetic Polynucleotide
taatacgactcactatagggatcatttgacaacatttgaatgttttaacgaacagaggagacgttaaatgattcaaatgaacctggcggcagcgcaaaagatg

SEQ ID NO: 75061 - DNA, 103 bp, Artificial Sequence
  Synthetic Polynucleotide
taatacgactcactatagggatccgatcatttgacaacatttgaatgtttaacagaggagaaaacatatgaatgttgtcaacctggcggcagcgcaaaagatg

SEQ ID NO: 75062 - DNA, 103 bp, Artificial Sequence
  Synthetic Polynucleotide
taatacgactcactatagggtttagatccgatcatttgacaacatttgaaaacagaggagattcaaaatgtgtcaaatgaacctggcggcagcgcaaaagatg

SEQ ID NO: 75063 - DNA, 103 bp, Artificial Sequence
  Synthetic Polynucleotide
taatacgactcactatagggtggattttagatccgatcatttgacaacataacagaggagaatgttgatgaatgatcggaacctggcggcagcgcaaaagatg

SEQ ID NO: 75064 - DNA, 103 bp, Artificial Sequence
  Synthetic Polynucleotide
taatacgactcactatagggaaatatggattttagatccgatcatttgacaacagaggagagtcaaaatgtcggatctaaacctggcggcagcgcaaaagatg

SEQ ID NO: 75065 - DNA, 103 bp, Artificial Sequence
  Synthetic Polynucleotide
taatacgactcactatagggccagaaaatatggattttagatccgatcataacagaggagaatgatcatgtctaaaatcaacctggcggcagcgcaaaagatg

SEQ ID NO: 75066 - DNA, 103 bp, Artificial Sequence
  Synthetic Polynucleotide
taatacgactcactatagggcactaccagaaaatatggattttagatccgaacagaggagacggatcatgaatccatataacctggcggcagcgcaaaagatg

SEQ ID NO: 75067 - DNA, 103 bp, Artificial Sequence
  Synthetic Polynucleotide
taatacgactcactatagggagaaacactaccagaaaatatggattttagaacagaggagactaaaaatgatattttctaacctggcggcagcgcaaaagatg

SEQ ID NO: 75068 - DNA, 103 bp, Artificial Sequence
  Synthetic Polynucleotide
taatacgactcactatagggctggtagaaacactaccagaaaatatggataacagaggagaatccatatgttctggtagaacctggcggcagcgcaaaagatg

SEQ ID NO: 75069 - DNA, 103 bp, Artificial Sequence
  Synthetic Polynucleotide
taatacgactcactatagggatttaaacatgtaactgattccgatagtataacagaggagaatactaatggaatcagttaacctggcggcagcgcaaaagatg

SEQ ID NO: 75070 - DNA, 103 bp, Artificial Sequence
  Synthetic Polynucleotide
taatacgactcactataggggtagactggtagaaacactaccagaaaataaacagaggagatattttatggtagtgtttaacctggcggcagcgcaaaagatg

SEQ ID NO: 75071 - DNA, 103 bp, Artificial Sequence
  Synthetic Polynucleotide
taatacgactcactatagggaaaatgtagactggtagaaacactaccagaaacagaggagatctggtatggtttctaccaacctggcggcagcgcaaaagatg

SEQ ID NO: 75072 - DNA, 103 bp, Artificial Sequence
  Synthetic Polynucleotide
taatacgactcactatagggggagcaaaatgtagactggtagaaacactaaacagaggagatagtgtatgtaccagtctaacctggcggcagcgcaaaagatg

SEQ ID NO: 75073 - DNA, 103 bp, Artificial Sequence
  Synthetic Polynucleotide
taatacgactcactatagggctgcgggagcaaaatgtagactggtagaaaaacagaggagatttctaatggtctacattaacctggcggcagcgcaaaagatg

SEQ ID NO: 75074 - DNA, 103 bp, Artificial Sequence
  Synthetic Polynucleotide
taatacgactcactatagggagcacctgcgggagcaaaatgtagactggtaacagaggagaaccagtatgcattttgctaacctggcggcagcgcaaaagatg

SEQ ID NO: 75075 - DNA, 103 bp, Artificial Sequence
  Synthetic Polynucleotide
taatacgactcactatagggacatcagcacctgcgggagcaaaatgtagaaacagaggagatctacaatgtgctcccgcaacctggcggcagcgcaaaagatg

SEQ ID NO: 75076 - DNA, 103 bp, Artificial Sequence
  Synthetic Polynucleotide
taatacgactcactatagggcatttacatcagcacctgcgggagcaaaataacagaggagaattttgatgccgcaggtgaacctggcggcagcgcaaaagatg

SEQ ID NO: 75077 - DNA, 103 bp, Artificial Sequence
  Synthetic Polynucleotide
taatacgactcactataggggtggccatttacatcagcacctgcgggagcaacagaggagagctcccatgggtgctgataacctggcggcagcgcaaaagatg

SEQ ID NO: 75078 - DNA, 103 bp, Artificial Sequence
  Synthetic Polynucleotide
taatacgactcactatagggtaaatgtggccatttacatcagcacctgcgaacagaggagacgcaggatgtgatgtaaaaacctggcggcagcgcaaaagatg

SEQ ID NO: 75079 - DNA, 103 bp, Artificial Sequence
  Synthetic Polynucleotide
taatacgactcactatagggttaactaaatgtggccatttacatcagcacaacagaggagagtgctgatgtaaatggccaacctggcggcagcgcaaaagatg

SEQ ID NO: 75080 - DNA, 103 bp, Artificial Sequence
  Synthetic Polynucleotide
taatacgactcactataggggaattatttaaacatgtaactgattccgataacagaggagaatcggaatgagttacatgaacctggcggcagcgcaaaagatg

SEQ ID NO: 75081 - DNA, 103 bp, Artificial Sequence
  Synthetic Polynucleotide
taatacgactcactatagggttttgttaactaaatgtggccatttacatcaacagaggagagatgtaatgggccacattaacctggcggcagcgcaaaagatg

SEQ ID NO: 75082 - DNA, 103 bp, Artificial Sequence
  Synthetic Polynucleotide
taatacgactcactatagggattttttttgttaactaaatgtggccatttaacagaggagaaaatggatgcatttagttaacctggcggcagcgcaaaagatg

SEQ ID NO: 75083 - DNA, 103 bp, Artificial Sequence
  Synthetic Polynucleotide
taatacgactcactatagggtgtaaattttttttgttaactaaatgtggcaacagaggagagccacaatgagttaacaaaacctggcggcagcgcaaaagatg

SEQ ID NO: 75084 - DNA, 103 bp, Artificial Sequence
  Synthetic Polynucleotide
taatacgactcactatagggggatatgtaaattttttttgttaactaaataacagaggagaatttagatgacaaaaaaaaacctggcggcagcgcaaaagatg

SEQ ID NO: 75085 - DNA, 103 bp, Artificial Sequence
  Synthetic Polynucleotide
taatacgactcactataggggaacaggatatgtaaattttttttgttaacaacagaggagagttaacatgaaaaatttaaacctggcggcagcgcaaaagatg

SEQ ID NO: 75086 - DNA, 103 bp, Artificial Sequence
  Synthetic Polynucleotide
taatacgactcactatagggtgatggaacaggatatgtaaattttttttgaacagaggagacaaaaaatgtttacatataacctggcggcagcgcaaaagatg

SEQ ID NO: 75087 - DNA, 103 bp, Artificial Sequence
  Synthetic Polynucleotide
taatacgactcactatagggatcgttgatggaacaggatatgtaaattttaacagaggagaaaaattatgatatcctgtaacctggcggcagcgcaaaagatg

SEQ ID NO: 75088 - DNA, 103 bp, Artificial Sequence
  Synthetic Polynucleotide
taatacgactcactatagggctagaatcgttgatggaacaggatatgtaaaacagaggagattacatatgctgttccataacctggcggcagcgcaaaagatg

SEQ ID NO: 75089 - DNA, 103 bp, Artificial Sequence
  Synthetic Polynucleotide
taatacgactcactatagggacgttctagaatcgttgatggaacaggataaacagaggagatatcctatgccatcaacgaacctggcggcagcgcaaaagatg

SEQ ID NO: 75090 - DNA, 103 bp, Artificial Sequence
  Synthetic Polynucleotide
taatacgactcactatagggcgatgacgttctagaatcgttgatggaacaaacagaggagatgttccatgaacgattctaacctggcggcagcgcaaaagatg

SEQ ID NO: 75091 - DNA, 103 bp, Artificial Sequence
  Synthetic Polynucleotide
taatacgactcactatagggtcagagaattatttaaacatgtaactgattaacagaggagaaatcagatgcatgtttaaaacctggcggcagcgcaaaagatg

SEQ ID NO: 75092 - DNA, 103 bp, Artificial Sequence
  Synthetic Polynucleotide
taatacgactcactatagggataaccgatgacgttctagaatcgttgatgaacagaggagacatcaaatgttctagaacaacctggcggcagcgcaaaagatg

SEQ ID NO: 75093 - DNA, 103 bp, Artificial Sequence
  Synthetic Polynucleotide
taatacgactcactataggggcgatataaccgatgacgttctagaatcgtaacagaggagaacgattatggaacgtcataacctggcggcagcgcaaaagatg

SEQ ID NO: 75094 - DNA, 103 bp, Artificial Sequence
  Synthetic Polynucleotide
taatacgactcactatagggttttagcgatataaccgatgacgttctagaaacagaggagatctagaatgtcatcggttaacctggcggcagcgcaaaagatg

SEQ ID NO: 75095 - DNA, 103 bp, Artificial Sequence
  Synthetic Polynucleotide
taatacgactcactataggggaagattttagcgatataaccgatgacgttaacagaggagaaacgtcatgggttatatcaacctggcggcagcgcaaaagatg

SEQ ID NO: 75096 - DNA, 103 bp, Artificial Sequence
  Synthetic Polynucleotide
taatacgactcactatagggttgatgaagattttagcgatataaccgatgaacagaggagacatcggatgtatcgctaaaacctggcggcagcgcaaaagatg

SEQ ID NO: 75097 - DNA, 103 bp, Artificial Sequence
  Synthetic Polynucleotide
taatacgactcactatagggcgactttgatgaagattttagcgatataacaacagaggagagttataatgctaaaatctaacctggcggcagcgcaaaagatg

SEQ ID NO: 75098 - DNA, 103 bp, Artificial Sequence
  Synthetic Polynucleotide
taatacgactcactataggggatgtcgactttgatgaagattttagcgataacagaggagaatcgctatgatcttcatcaacctggcggcagcgcaaaagatg

SEQ ID NO: 75099 - DNA, 103 bp, Artificial Sequence
  Synthetic Polynucleotide
taatacgactcactataggggttgtgatgtcgactttgatgaagattttaaacagaggagataaaatatgcatcaaagtaacctggcggcagcgcaaaagatg

SEQ ID NO: 75100 - DNA, 103 bp, Artificial Sequence
  Synthetic Polynucleotide
taatacgactcactataggggctaggttgtgatgtcgactttgatgaagaaacagaggagatcttcaatgaagtcgacaaacctggcggcagcgcaaaagatg

SEQ ID NO: 75101 - DNA, 103 bp, Artificial Sequence
  Synthetic Polynucleotide
taatacgactcactatagggactgagctaggttgtgatgtcgactttgataacagaggagaatcaaaatggacatcacaaacctggcggcagcgcaaaagatg

SEQ ID NO: 75102 - DNA, 103 bp, Artificial Sequence
  Synthetic Polynucleotide
taatacgactcactatagggtgacatcagagaattatttaaacatgtaacaacagaggagagttacaatgttaaataataacctggcggcagcgcaaaagatg

SEQ ID NO: 75103 - DNA, 103 bp, Artificial Sequence
  Synthetic Polynucleotide
taatacgactcactatagggtattgactgagctaggttgtgatgtcgactaacagaggagaagtcgaatgcacaacctaaacctggcggcagcgcaaaagatg

SEQ ID NO: 75104 - DNA, 103 bp, Artificial Sequence
  Synthetic Polynucleotide
taatacgactcactatagggtaatatattgactgagctaggttgtgatgtaacagaggagaacatcaatgcctagctcaaacctggcggcagcgcaaaagatg

SEQ ID NO: 75105 - DNA, 103 bp, Artificial Sequence
  Synthetic Polynucleotide
taatacgactcactatagggcttcttaatatattgactgagctaggttgtaacagaggagaacaaccatgctcagtcaaaacctggcggcagcgcaaaagatg

SEQ ID NO: 75106 - DNA, 103 bp, Artificial Sequence
  Synthetic Polynucleotide
taatacgactcactatagggcggaacttcttaatatattgactgagctagaacagaggagactagctatgtcaatatataacctggcggcagcgcaaaagatg

SEQ ID NO: 75107 - DNA, 103 bp, Artificial Sequence
  Synthetic Polynucleotide
taatacgactcactatagggtatcacggaacttcttaatatattgactgaaacagaggagatcagtcatgatattaagaaacctggcggcagcgcaaaagatg

SEQ ID NO: 75108 - DNA, 103 bp, Artificial Sequence
  Synthetic Polynucleotide
taatacgactcactataggggataatatcacggaacttcttaatatattgaacagaggagacaatatatgaagaagttcaacctggcggcagcgcaaaagatg

SEQ ID NO: 75109 - DNA, 103 bp, Artificial Sequence
  Synthetic Polynucleotide
taatacgactcactatagggatgaagataatatcacggaacttcttaataaacagaggagatattaaatggttccgtgaaacctggcggcagcgcaaaagatg

SEQ ID NO: 75110 - DNA, 103 bp, Artificial Sequence
  Synthetic Polynucleotide
taatacgactcactatagggaatcgatgaagataatatcacggaacttctaacagaggagaagaagtatggtgatattaaacctggcggcagcgcaaaagatg

SEQ ID NO: 75111 - DNA, 103 bp, Artificial Sequence
  Synthetic Polynucleotide
taatacgactcactatagggatagaaatcgatgaagataatatcacggaaaacagaggagattccgtatgattatcttcaacctggcggcagcgcaaaagatg

SEQ ID NO: 75112 - DNA, 103 bp, Artificial Sequence
  Synthetic Polynucleotide
taatacgactcactatagggtggatatagaaatcgatgaagataatatcaaacagaggagatgatatatgcttcatcgaaacctggcggcagcgcaaaagatg

SEQ ID NO: 75113 - DNA, 103 bp, Artificial Sequence
  Synthetic Polynucleotide
taatacgactcactatagggaggaatgacatcagagaattatttaaacataacagaggagaatgtttatgtaattctctaacctggcggcagcgcaaaagatg

SEQ ID NO: 75114 - DNA, 103 bp, Artificial Sequence
  Synthetic Polynucleotide
taatacgactcactatagggcgatatggatatagaaatcgatgaagataaaacagaggagattatctatgtcgatttctaacctggcggcagcgcaaaagatg

SEQ ID NO: 75115 - DNA, 103 bp, Artificial Sequence
  Synthetic Polynucleotide
taatacgactcactatagggacatccgatatggatatagaaatcgatgaaaacagaggagattcatcatgttctatatcaacctggcggcagcgcaaaagatg

SEQ ID NO: 75116 - DNA, 103 bp, Artificial Sequence
  Synthetic Polynucleotide
taatacgactcactatagggtatctacatccgatatggatatagaaatcgaacagaggagacgatttatgtatccatataacctggcggcagcgcaaaagatg

SEQ ID NO: 75117 - DNA, 103 bp, Artificial Sequence
  Synthetic Polynucleotide
taatacgactcactatagggtcaattatctacatccgatatggatatagaaacagaggagatctataatgatatcggataacctggcggcagcgcaaaagatg

SEQ ID NO: 75118 - DNA, 103 bp, Artificial Sequence
  Synthetic Polynucleotide
taatacgactcactatagggatcagtcaattatctacatccgatatggataacagaggagaatccatatgggatgtagaaacctggcggcagcgcaaaagatg

SEQ ID NO: 75119 - DNA, 103 bp, Artificial Sequence
  Synthetic Polynucleotide
taatacgactcactatagggcaataatcagtcaattatctacatccgataaacagaggagatatcggatgtagataattaacctggcggcagcgcaaaagatg

SEQ ID NO: 75120 - DNA, 103 bp, Artificial Sequence
  Synthetic Polynucleotide
taatacgactcactatagggtaactcaataatcagtcaattatctacatcaacagaggagagatgtaatgaattgactgaacctggcggcagcgcaaaagatg

SEQ ID NO: 75121 - DNA, 103 bp, Artificial Sequence
  Synthetic Polynucleotide
taatacgactcactataggggattttaactcaataatcagtcaattatctaacagaggagaagataaatgactgattataacctggcggcagcgcaaaagatg

SEQ ID NO: 75122 - DNA, 103 bp, Artificial Sequence
  Synthetic Polynucleotide
taatacgactcactataggggtactgattttaactcaataatcagtcaataacagaggagaattgacatgttattgagtaacctggcggcagcgcaaaagatg

SEQ ID NO: 75123 - DNA, 103 bp, Artificial Sequence
  Synthetic Polynucleotide
taatacgactcactatagggaattagtactgattttaactcaataatcagaacagaggagactgattatggagttaaaaaacctggcggcagcgcaaaagatg

SEQ ID NO: 75124 - DNA, 103 bp, Artificial Sequence
  Synthetic Polynucleotide
taatacgactcactatagggcgcactgctaaatactaaatctttttcatgaacagaggagacatgaaatggatttagtaaacctggcggcagcgcaaaagatg

SEQ ID NO: 75125 - DNA, 103 bp, Artificial Sequence
  Synthetic Polynucleotide
taatacgactcactataggggtataaggaatgacatcagagaattatttaaacagaggagataaataatgctctgatgtaacctggcggcagcgcaaaagatg

SEQ ID NO: 75126 - DNA, 103 bp, Artificial Sequence
  Synthetic Polynucleotide
taatacgactcactatagggttggaaattagtactgattttaactcaataaacagaggagatattgaatgaaaatcagtaacctggcggcagcgcaaaagatg

SEQ ID NO: 75127 - DNA, 103 bp, Artificial Sequence
  Synthetic Polynucleotide
taatacgactcactatagggaagggttggaaattagtactgattttaactaacagaggagaagttaaatgcagtactaaaacctggcggcagcgcaaaagatg

SEQ ID NO: 75128 - DNA, 103 bp, Artificial Sequence
  Synthetic Polynucleotide
taatacgactcactatagggttctgaagggttggaaattagtactgatttaacagaggagaaaatcaatgctaatttccaacctggcggcagcgcaaaagatg

SEQ ID NO: 75129 - DNA, 103 bp, Artificial Sequence
  Synthetic Polynucleotide
taatacgactcactataggggtatattctgaagggttggaaattagtactaacagaggagaagtactatgttccaacccaacctggcggcagcgcaaaagatg

SEQ ID NO: 75130 - DNA, 103 bp, Artificial Sequence
  Synthetic Polynucleotide
taatacgactcactatagggacaaagtatattctgaagggttggaaattaaacagaggagataatttatgacccttcagaacctggcggcagcgcaaaagatg

SEQ ID NO: 75131 - DNA, 103 bp, Artificial Sequence
  Synthetic Polynucleotide
taatacgactcactataggggaaacacaaagtatattctgaagggttggaaacagaggagatccaacatgtcagaatataacctggcggcagcgcaaaagatg

SEQ ID NO: 75132 - DNA, 103 bp, Artificial Sequence
  Synthetic Polynucleotide
taatacgactcactatagggaccatgaaacacaaagtatattctgaagggaacagaggagacccttcatgatatactttaacctggcggcagcgcaaaagatg

SEQ ID NO: 75133 - DNA, 103 bp, Artificial Sequence
  Synthetic Polynucleotide
taatacgactcactatagggatattaccatgaaacacaaagtatattctgaacagaggagacagaatatgctttgtgttaacctggcggcagcgcaaaagatg

SEQ ID NO: 75134 - DNA, 103 bp, Artificial Sequence
  Synthetic Polynucleotide
taatacgactcactatagggtaccgatattaccatgaaacacaaagtataaacagaggagatatactatgtgtttcatgaacctggcggcagcgcaaaagatg

SEQ ID NO: 75135 - DNA, 103 bp, Artificial Sequence
  Synthetic Polynucleotide
taatacgactcactatagggtacgctaccgatattaccatgaaacacaaaaacagaggagatttgtgatgcatggtaataacctggcggcagcgcaaaagatg

SEQ ID NO: 75136 - DNA, 103 bp, Artificial Sequence
  Synthetic Polynucleotide
taatacgactcactatagggtgattgtataaggaatgacatcagagaattaacagaggagaaattctatgatgtcattcaacctggcggcagcgcaaaagatg

SEQ ID NO: 75137 - DNA, 103 bp, Artificial Sequence
  Synthetic Polynucleotide
taatacgactcactatagggttaaatacgctaccgatattaccatgaaacaacagaggagagtttcaatgtaatatcggaacctggcggcagcgcaaaagatg

SEQ ID NO: 75138 - DNA, 103 bp, Artificial Sequence
  Synthetic Polynucleotide
taatacgactcactatagggccaacttaaatacgctaccgatattaccataacagaggagaatggtaatgtcggtagcgaacctggcggcagcgcaaaagatg

SEQ ID NO: 75139 - DNA, 103 bp, Artificial Sequence
  Synthetic Polynucleotide
taatacgactcactatagggatctaccaacttaaatacgctaccgatattaacagaggagaaatatcatgagcgtatttaacctggcggcagcgcaaaagatg

SEQ ID NO: 75140 - DNA, 103 bp, Artificial Sequence
  Synthetic Polynucleotide
taatacgactcactataggggaaaaatctaccaacttaaatacgctaccgaacagaggagacggtagatgatttaagttaacctggcggcagcgcaaaagatg

SEQ ID NO: 75141 - DNA, 103 bp, Artificial Sequence
  Synthetic Polynucleotide
taatacgactcactatagggtaattgaaaaatctaccaacttaaatacgcaacagaggagagcgtatatgagttggtagaacctggcggcagcgcaaaagatg

SEQ ID NO: 75142 - DNA, 103 bp, Artificial Sequence
  Synthetic Polynucleotide
taatacgactcactatagggatgcataattgaaaaatctaccaacttaaaaacagaggagatttaagatggtagattttaacctggcggcagcgcaaaagatg

SEQ ID NO: 75143 - DNA, 103 bp, Artificial Sequence
  Synthetic Polynucleotide
taatacgactcactatagggtattgatgcataattgaaaaatctaccaacaacagaggagagttggtatgtttttcaataacctggcggcagcgcaaaagatg

SEQ ID NO: 75144 - DNA, 103 bp, Artificial Sequence
  Synthetic Polynucleotide
taatacgactcactatagggtgctatattgatgcataattgaaaaatctaaacagaggagatagattatgcaattatgcaacctggcggcagcgcaaaagatg

SEQ ID NO: 75145 - DNA, 103 bp, Artificial Sequence
  Synthetic Polynucleotide
taatacgactcactatagggactgttgctatattgatgcataattgaaaaaacagaggagattttcaatgatgcatcaaaacctggcggcagcgcaaaagatg

SEQ ID NO: 75146 - DNA, 103 bp, Artificial Sequence
  Synthetic Polynucleotide
taatacgactcactataggggaactactgttgctatattgatgcataattaacagaggagaaattatatgtcaatatagaacctggcggcagcgcaaaagatg

SEQ ID NO: 75147 - DNA, 103 bp, Artificial Sequence
  Synthetic Polynucleotide
taatacgactcactataggggaatttgattgtataaggaatgacatcagaaacagaggagatctgatatgattccttataacctggcggcagcgcaaaagatg

SEQ ID NO: 75148 - DNA, 103 bp, Artificial Sequence
  Synthetic Polynucleotide
taatacgactcactatagggagcaagaactactgttgctatattgatgcaaacagaggagatgcatcatgatagcaacaaacctggcggcagcgcaaaagatg

SEQ ID NO: 75149 - DNA, 103 bp, Artificial Sequence
  Synthetic Polynucleotide
taatacgactcactatagggggaggagcaagaactactgttgctatattgaacagaggagacaatatatgaacagtagtaacctggcggcagcgcaaaagatg

SEQ ID NO: 75150 - DNA, 103 bp, Artificial Sequence
  Synthetic Polynucleotide
taatacgactcactatagggattaaggaggagcaagaactactgttgctaaacagaggagatagcaaatgtagttcttgaacctggcggcagcgcaaaagatg

SEQ ID NO: 75151 - DNA, 103 bp, Artificial Sequence
  Synthetic Polynucleotide
taatacgactcactatagggctagaattaaggaggagcaagaactactgtaacagaggagaacagtaatgcttgctcctaacctggcggcagcgcaaaagatg

SEQ ID NO: 75152 - DNA, 103 bp, Artificial Sequence
  Synthetic Polynucleotide
taatacgactcactatagggagatgctagaattaaggaggagcaagaactaacagaggagaagttctatgtcctccttaaacctggcggcagcgcaaaagatg

SEQ ID NO: 75153 - DNA, 103 bp, Artificial Sequence
  Synthetic Polynucleotide
taatacgactcactataggggaagaagatgctagaattaaggaggagcaaaacagaggagattgctcatgcttaattctaacctggcggcagcgcaaaagatg

SEQ ID NO: 75154 - DNA, 103 bp, Artificial Sequence
  Synthetic Polynucleotide
taatacgactcactatagggataatgaagaagatgctagaattaaggaggaacagaggagacctcctatgttctagcataacctggcggcagcgcaaaagatg

SEQ ID NO: 75155 - DNA, 103 bp, Artificial Sequence
  Synthetic Polynucleotide
taatacgactcactatagggagaaaataatgaagaagatgctagaattaaaacagaggagattaattatggcatcttctaacctggcggcagcgcaaaagatg

SEQ ID NO: 75156 - DNA, 103 bp, Artificial Sequence
  Synthetic Polynucleotide
taatacgactcactataggggtagaagaaaataatgaagaagatgctagaaacagaggagatctagcatgttcttcattaacctggcggcagcgcaaaagatg

SEQ ID NO: 75157 - DNA, 103 bp, Artificial Sequence
  Synthetic Polynucleotide
taatacgactcactatagggtgtatgtagaagaaaataatgaagaagatgaacagaggagacatcttatgcattattttaacctggcggcagcgcaaaagatg

SEQ ID NO: 75158 - DNA, 103 bp, Artificial Sequence
  Synthetic Polynucleotide
taatacgactcactatagggataatgaatttgattgtataaggaatgacaaacagaggagatgtcatatgttatacaataacctggcggcagcgcaaaagatg

SEQ ID NO: 75159 - DNA, 103 bp, Artificial Sequence
  Synthetic Polynucleotide
taatacgactcactataggggcttatgtatgtagaagaaaataatgaagaaacagaggagatcttcaatgttttcttctaacctggcggcagcgcaaaagatg

SEQ ID NO: 75160 - DNA, 103 bp, Artificial Sequence
  Synthetic Polynucleotide
taatacgactcactataggggagatgcttatgtatgtagaagaaaataataacagaggagaattattatgttctacataaacctggcggcagcgcaaaagatg

SEQ ID NO: 75161 - DNA, 103 bp, Artificial Sequence
  Synthetic Polynucleotide
taatacgactcactatagggtattggagatgcttatgtatgtagaagaaaaacagaggagatttcttatgcatacataaaacctggcggcagcgcaaaagatg

SEQ ID NO: 75162 - DNA, 103 bp, Artificial Sequence
  Synthetic Polynucleotide
taatacgactcactatagggtaacgtattggagatgcttatgtatgtagaaacagaggagatctacaatgataagcatcaacctggcggcagcgcaaaagatg

SEQ ID NO: 75163 - DNA, 103 bp, Artificial Sequence
  Synthetic Polynucleotide
taatacgactcactatagggctgtctaacgtattggagatgcttatgtataacagaggagaatacatatgcatctccaaaacctggcggcagcgcaaaagatg

SEQ ID NO: 75164 - DNA, 103 bp, Artificial Sequence
  Synthetic Polynucleotide
taatacgactcactataggggtgtgctgtctaacgtattggagatgcttaaacagaggagataagcaatgccaatacgtaacctggcggcagcgcaaaagatg

SEQ ID NO: 75165 - DNA, 103 bp, Artificial Sequence
  Synthetic Polynucleotide
taatacgactcactatagggcatcggtgtgctgtctaacgtattggagataacagaggagaatctccatgacgttagacaacctggcggcagcgcaaaagatg

SEQ ID NO: 75166 - DNA, 103 bp, Artificial Sequence
  Synthetic Polynucleotide
taatacgactcactataggggccatcatcggtgtgctgtctaacgtattgaacagaggagacaatacatgagacagcacaacctggcggcagcgcaaaagatg

SEQ ID NO: 75167 - DNA, 103 bp, Artificial Sequence
  Synthetic Polynucleotide
taatacgactcactatagggcggccgccatcatcggtgtgctgtctaacgaacagaggagacgttagatggcacaccgaaacctggcggcagcgcaaaagatg

SEQ ID NO: 75168 - DNA, 103 bp, Artificial Sequence
  Synthetic Polynucleotide
taatacgactcactatagggtgtggcggccgccatcatcggtgtgctgtcaacagaggagagacagcatgccgatgatgaacctggcggcagcgcaaaagatg

SEQ ID NO: 75169 - DNA, 103 bp, Artificial Sequence
  Synthetic Polynucleotide
taatacgactcactataggggtttaataatgaatttgattgtataaggaaaacagaggagattccttatgcaatcaaataacctggcggcagcgcaaaagatg

SEQ ID NO: 75170 - DNA, 103 bp, Artificial Sequence
  Synthetic Polynucleotide
taatacgactcactataggggtgtctgtggcggccgccatcatcggtgtgaacagaggagacacaccatggatggcggcaacctggcggcagcgcaaaagatg

SEQ ID NO: 75171 - DNA, 103 bp, Artificial Sequence
  Synthetic Polynucleotide
taatacgactcactatagggtattcgtgtctgtggcggccgccatcatcgaacagaggagacgatgaatgcggccgccaaacctggcggcagcgcaaaagatg

SEQ ID NO: 75172 - DNA, 103 bp, Artificial Sequence
  Synthetic Polynucleotide
taatacgactcactatagggagtcatattcgtgtctgtggcggccgccataacagaggagaatggcgatggccacagacaacctggcggcagcgcaaaagatg

SEQ ID NO: 75173 - DNA, 103 bp, Artificial Sequence
  Synthetic Polynucleotide
taatacgactcactatagggagtctagtcatattcgtgtctgtggcggccaacagaggagaggccgcatgagacacgaaaacctggcggcagcgcaaaagatg

SEQ ID NO: 75174 - DNA, 103 bp, Artificial Sequence
  Synthetic Polynucleotide
taatacgactcactatagggtcatcagtctagtcatattcgtgtctgtggaacagaggagaccacagatgcgaatatgaaacctggcggcagcgcaaaagatg

SEQ ID NO: 75175 - DNA, 103 bp, Artificial Sequence
  Synthetic Polynucleotide
taatacgactcactatagggaatggtcatcagtctagtcatattcgtgtcaacagaggagagacacgatgatgactagaaacctggcggcagcgcaaaagatg

SEQ ID NO: 75176 - DNA, 103 bp, Artificial Sequence
  Synthetic Polynucleotide
taatacgactcactatagggttttaaatggtcatcagtctagtcatattcaacagaggagagaatatatgtagactgataacctggcggcagcgcaaaagatg

SEQ ID NO: 75177 - DNA, 103 bp, Artificial Sequence
  Synthetic Polynucleotide
taatacgactcactatagggtgtttttttaaatggtcatcagtctagtcaaacagaggagatgactaatgtgatgaccaaacctggcggcagcgcaaaagatg

SEQ ID NO: 75178 - DNA, 103 bp, Artificial Sequence
  Synthetic Polynucleotide
taatacgactcactatagggtagagtgtttttttaaatggtcatcagtctaacagaggagaagactgatgaccatttaaaacctggcggcagcgcaaaagatg

SEQ ID NO: 75179 - DNA, 103 bp, Artificial Sequence
  Synthetic Polynucleotide
taatacgactcactatagggaaagctagagtgtttttttaaatggtcatcaacagaggagagatgacatgttaaaaaaaaacctggcggcagcgcaaaagatg

SEQ ID NO: 75180 - DNA, 103 bp, Artificial Sequence
  Synthetic Polynucleotide
taatacgactcactatagggaaactgtttaataatgaatttgattgtataaacagaggagatatacaatgaaattcattaacctggcggcagcgcaaaagatg

SEQ ID NO: 75181 - DNA, 103 bp, Artificial Sequence
  Synthetic Polynucleotide
taatacgactcactatagggaagtgaaagctagagtgtttttttaaatggaacagaggagaccatttatgaaaacactcaacctggcggcagcgcaaaagatg

SEQ ID NO: 75182 - DNA, 103 bp, Artificial Sequence
  Synthetic Polynucleotide
taatacgactcactatagggagtttaagtgaaagctagagtgtttttttaaacagaggagataaaaaatgactctagctaacctggcggcagcgcaaaagatg

SEQ ID NO: 75183 - DNA, 103 bp, Artificial Sequence
  Synthetic Polynucleotide
taatacgactcactataggggatacagtttaagtgaaagctagagtgtttaacagaggagaaaacacatgagctttcacaacctggcggcagcgcaaaagatg

SEQ ID NO: 75184 - DNA, 103 bp, Artificial Sequence
  Synthetic Polynucleotide
taatacgactcactatagggtgatcgatacagtttaagtgaaagctagagaacagaggagactctagatgtcacttaaaaacctggcggcagcgcaaaagatg

SEQ ID NO: 75185 - DNA, 103 bp, Artificial Sequence
  Synthetic Polynucleotide
taatacgactcactatagggaagaatgatcgatacagtttaagtgaaagcaacagaggagagctttcatgtaaactgtaaacctggcggcagcgcaaaagatg

SEQ ID NO: 75186 - DNA, 103 bp, Artificial Sequence
  Synthetic Polynucleotide
taatacgactcactataggggctaaaagaatgatcgatacagtttaagtgaacagaggagacacttaatgtgtatcgataacctggcggcagcgcaaaagatg

SEQ ID NO: 75187 - DNA, 103 bp, Artificial Sequence
  Synthetic Polynucleotide
taatacgactcactatagggcatgtgctaaaagaatgatcgatacagtttaacagaggagaaaactgatgcgatcattcaacctggcggcagcgcaaaagatg

SEQ ID NO: 75188 - DNA, 103 bp, Artificial Sequence
  Synthetic Polynucleotide
taatacgactcactatagggttatacatgtgctaaaagaatgatcgatacaacagaggagagtatcgatgattcttttaaacctggcggcagcgcaaaagatg

SEQ ID NO: 75189 - DNA, 103 bp, Artificial Sequence
  Synthetic Polynucleotide
taatacgactcactatagggttatattatacatgtgctaaaagaatgatcaacagaggagagatcatatgtttagcacaaacctggcggcagcgcaaaagatg

SEQ ID NO: 75190 - DNA, 103 bp, Artificial Sequence
  Synthetic Polynucleotide
taatacgactcactatagggtgtttttatattatacatgtgctaaaagaaaacagaggagattctttatgcacatgtataacctggcggcagcgcaaaagatg

SEQ ID NO: 75191 - DNA, 103 bp, Artificial Sequence
  Synthetic Polynucleotide
taatacgactcactatagggctattaaactgtttaataatgaatttgattaacagaggagaaatcaaatgcattattaaaacctggcggcagcgcaaaagatg

SEQ ID NO: 75192 - DNA, 103 bp, Artificial Sequence
  Synthetic Polynucleotide
taatacgactcactatagggaataatgtttttatattatacatgtgctaaaacagaggagattagcaatggtataatataacctggcggcagcgcaaaagatg

SEQ ID NO: 75193 - DNA, 103 bp, Artificial Sequence
  Synthetic Polynucleotide
taatacgactcactatagggaatagaataatgtttttatattatacatgtaacagaggagaacatgtatgatataaaaaaacctggcggcagcgcaaaagatg

SEQ ID NO: 75194 - DNA, 103 bp, Artificial Sequence
  Synthetic Polynucleotide
taatacgactcactatagggttcgaaatagaataatgtttttatattataaacagaggagatataatatgaaaacattaaacctggcggcagcgcaaaagatg

SEQ ID NO: 75195 - DNA, 103 bp, Artificial Sequence
  Synthetic Polynucleotide
taatacgactcactatagggctaaattcgaaatagaataatgtttttataaacagaggagatataaaatgattattctaaacctggcggcagcgcaaaagatg

SEQ ID NO: 75196 - DNA, 103 bp, Artificial Sequence
  Synthetic Polynucleotide
taatacgactcactataggggaagcctaaattcgaaatagaataatgtttaacagaggagaaaacatatgtctatttcgaacctggcggcagcgcaaaagatg

SEQ ID NO: 75197 - DNA, 103 bp, Artificial Sequence
  Synthetic Polynucleotide
taatacgactcactatagggttttggaagcctaaattcgaaatagaataaaacagaggagattattcatgttcgaatttaacctggcggcagcgcaaaagatg

SEQ ID NO: 75198 - DNA, 103 bp, Artificial Sequence
  Synthetic Polynucleotide
taatacgactcactatagggaaaatttttggaagcctaaattcgaaatagaacagaggagactatttatgatttaggctaacctggcggcagcgcaaaagatg

SEQ ID NO: 75199 - DNA, 103 bp, Artificial Sequence
  Synthetic Polynucleotide
taatacgactcactataggggatgaaaaatttttggaagcctaaattcgaaacagaggagatcgaatatgggcttccaaaacctggcggcagcgcaaaagatg

SEQ ID NO: 75200 - DNA, 103 bp, Artificial Sequence
  Synthetic Polynucleotide
taatacgactcactatagggttacggatgaaaaatttttggaagcctaaaaacagaggagatttaggatgccaaaaattaacctggcggcagcgcaaaagatg

SEQ ID NO: 75201 - DNA, 103 bp, Artificial Sequence
  Synthetic Polynucleotide
taatacgactcactatagggtcggtttacggatgaaaaatttttggaagcaacagaggagagcttccatgaatttttcaaacctggcggcagcgcaaaagatg

SEQ ID NO: 75202 - DNA, 103 bp, Artificial Sequence
  Synthetic Polynucleotide
taatacgactcactatagggacagactattaaactgtttaataatgaattaacagaggagaaattcaatgttaaacagtaacctggcggcagcgcaaaagatg

SEQ ID NO: 75203 - DNA, 103 bp, Artificial Sequence
  Synthetic Polynucleotide
taatacgactcactatagggtattatcggtttacggatgaaaaatttttgaacagaggagacaaaaaatgttcatccgtaacctggcggcagcgcaaaagatg

SEQ ID NO: 75204 - DNA, 103 bp, Artificial Sequence
  Synthetic Polynucleotide
taatacgactcactatagggtatattattatcggtttacggatgaaaaataacagaggagaatttttatgccgtaaaccaacctggcggcagcgcaaaagatg

SEQ ID NO: 75205 - DNA, 103 bp, Artificial Sequence
  Synthetic Polynucleotide
taatacgactcactatagggctatatatattattatcggtttacggatgaaacagaggagatcatccatgaaccgataaaacctggcggcagcgcaaaagatg

SEQ ID NO: 75206 - DNA, 103 bp, Artificial Sequence
  Synthetic Polynucleotide
taatacgactcactatagggcaagtctatatatattattatcggtttacgaacagaggagacgtaaaatgataataataaacctggcggcagcgcaaaagatg

SEQ ID NO: 75207 - DNA, 103 bp, Artificial Sequence
  Synthetic Polynucleotide
taatacgactcactatagggattaacaagtctatatatattattatcggtaacagaggagaaccgatatgaatatatataacctggcggcagcgcaaaagatg

SEQ ID NO: 75208 - DNA, 103 bp, Artificial Sequence
  Synthetic Polynucleotide
taatacgactcactatagggcaactattaacaagtctatatatattattaaacagaggagataataaatgatatagactaacctggcggcagcgcaaaagatg

SEQ ID NO: 75209 - DNA, 103 bp, Artificial Sequence
  Synthetic Polynucleotide
taatacgactcactatagggtattccaactattaacaagtctatatatataacagaggagaatatatatggacttgttaaacctggcggcagcgcaaaagatg

SEQ ID NO: 75210 - DNA, 103 bp, Artificial Sequence
  Synthetic Polynucleotide
taatacgactcactatagggctatttattccaactattaacaagtctataaacagaggagatatagaatggttaatagtaacctggcggcagcgcaaaagatg

SEQ ID NO: 75211 - DNA, 103 bp, Artificial Sequence
  Synthetic Polynucleotide
taatacgactcactatagggttaatctatttattccaactattaacaagtaacagaggagaacttgtatgtagttggaaaacctggcggcagcgcaaaagatg

SEQ ID NO: 75212 - DNA, 103 bp, Artificial Sequence
  Synthetic Polynucleotide
taatacgactcactatagggaagcattaatctatttattccaactattaaaacagaggagattaataatgggaataaataacctggcggcagcgcaaaagatg

SEQ ID NO: 75213 - DNA, 103 bp, Artificial Sequence
  Synthetic Polynucleotide
taatacgactcactatagggggtctacagactattaaactgtttaataataacagaggagaattattatgcagtttaataacctggcggcagcgcaaaagatg

SEQ ID NO: 75214 - DNA, 103 bp, Artificial Sequence
  Synthetic Polynucleotide
taatacgactcactatagggagtttaagcattaatctatttattccaactaacagaggagaagttggatgaaatagattaacctggcggcagcgcaaaagatg

SEQ ID NO: 75215 - DNA, 103 bp, Artificial Sequence
  Synthetic Polynucleotide
taatacgactcactatagggatgatagtttaagcattaatctatttattcaacagaggagagaataaatggattaatgcaacctggcggcagcgcaaaagatg

SEQ ID NO: 75216 - DNA, 103 bp, Artificial Sequence
  Synthetic Polynucleotide
taatacgactcactatagggagatgatgatagtttaagcattaatctattaacagaggagaaatagaatgatgcttaaaaacctggcggcagcgcaaaagatg

SEQ ID NO: 75217 - DNA, 103 bp, Artificial Sequence
  Synthetic Polynucleotide
taatacgactcactatagggcgtggagatgatgatagtttaagcattaataacagaggagaattaatatgtaaactatcaacctggcggcagcgcaaaagatg

SEQ ID NO: 75218 - DNA, 103 bp, Artificial Sequence
  Synthetic Polynucleotide
taatacgactcactatagggctaatcgtggagatgatgatagtttaagcaaacagaggagatgcttaatgtatcatcataacctggcggcagcgcaaaagatg

SEQ ID NO: 75219 - DNA, 103 bp, Artificial Sequence
  Synthetic Polynucleotide
taatacgactcactatagggtatctctaatcgtggagatgatgatagtttaacagaggagaaaactaatgtcatctccaaacctggcggcagcgcaaaagatg

SEQ ID NO: 75220 - DNA, 103 bp, Artificial Sequence
  Synthetic Polynucleotide
taatacgactcactatagggtattgtatctctaatcgtggagatgatgataacagaggagaatcatcatgtccacgattaacctggcggcagcgcaaaagatg

SEQ ID NO: 75221 - DNA, 103 bp, Artificial Sequence
  Synthetic Polynucleotide
taatacgactcactataggggtaaatattgtatctctaatcgtggagatgaacagaggagacatctcatggattagagaaacctggcggcagcgcaaaagatg

SEQ ID NO: 75222 - DNA, 103 bp, Artificial Sequence
  Synthetic Polynucleotide
taatacgactcactatagggagaatgtaaatattgtatctctaatcgtggaacagaggagaccacgaatggagatacaaaacctggcggcagcgcaaaagatg

SEQ ID NO: 75223 - DNA, 103 bp, Artificial Sequence
  Synthetic Polynucleotide
taatacgactcactatagggcaaaaagaatgtaaatattgtatctctaataacagaggagaattagaatgacaatatttaacctggcggcagcgcaaaagatg

SEQ ID NO: 75224 - DNA, 103 bp, Artificial Sequence
  Synthetic Polynucleotide
taatacgactcactatagggataaaggtctacagactattaaactgtttaaacagaggagataaacaatgtaatagtctaacctggcggcagcgcaaaagatg

SEQ ID NO: 75225 - DNA, 103 bp, Artificial Sequence
  Synthetic Polynucleotide
taatacgactcactatagggaacagcaaaaagaatgtaaatattgtatctaacagaggagaagatacatgatttacattaacctggcggcagcgcaaaagatg

SEQ ID NO: 75226 - DNA, 103 bp, Artificial Sequence
  Synthetic Polynucleotide
taatacgactcactatagggttcgaaacagcaaaaagaatgtaaatattgaacagaggagacaatatatgcattcttttaacctggcggcagcgcaaaagatg

SEQ ID NO: 75227 - DNA, 103 bp, Artificial Sequence
  Synthetic Polynucleotide
taatacgactcactatagggaaagtttcgaaacagcaaaaagaatgtaaaaacagaggagatttacaatgtttttgctgaacctggcggcagcgcaaaagatg

SEQ ID NO: 75228 - DNA, 103 bp, Artificial Sequence
  Synthetic Polynucleotide
taatacgactcactatagggttgataaagtttcgaaacagcaaaaagaataacagaggagaattcttatggctgtttcgaacctggcggcagcgcaaaagatg

SEQ ID NO: 75229 - DNA, 103 bp, Artificial Sequence
  Synthetic Polynucleotide
taatacgactcactataggggtgtattgataaagtttcgaaacagcaaaaaacagaggagattttgcatgttcgaaactaacctggcggcagcgcaaaagatg

SEQ ID NO: 75230 - DNA, 103 bp, Artificial Sequence
  Synthetic Polynucleotide
taatacgactcactatagggttaacgtgtattgataaagtttcgaaacagaacagaggagactgtttatgaactttatcaacctggcggcagcgcaaaagatg

SEQ ID NO: 75231 - DNA, 103 bp, Artificial Sequence
  Synthetic Polynucleotide
taatacgactcactatagggttgtattaacgtgtattgataaagtttcgaaacagaggagatcgaaaatgtatcaatacaacctggcggcagcgcaaaagatg

SEQ ID NO: 75232 - DNA, 103 bp, Artificial Sequence
  Synthetic Polynucleotide
taatacgactcactatagggtgggtttgtattaacgtgtattgataaagtaacagaggagaactttaatgatacacgttaacctggcggcagcgcaaaagatg

SEQ ID NO: 75233 - DNA, 103 bp, Artificial Sequence
  Synthetic Polynucleotide
taatacgactcactatagggcttcctgggtttgtattaacgtgtattgataacagaggagaatcaatatgcgttaatacaacctggcggcagcgcaaaagatg

SEQ ID NO: 75234 - DNA, 103 bp, Artificial Sequence
  Synthetic Polynucleotide
taatacgactcactatagggatctccttcctgggtttgtattaacgtgtaaacagaggagatacacgatgatacaaaccaacctggcggcagcgcaaaagatg

SEQ ID NO: 75235 - DNA, 103 bp, Artificial Sequence
  Synthetic Polynucleotide
taatacgactcactatagggatatccgcactgctaaatactaaatcttttaacagaggagaaaaagaatgagtatttagaacctggcggcagcgcaaaagatg

SEQ ID NO: 75236 - DNA, 103 bp, Artificial Sequence
  Synthetic Polynucleotide
taatacgactcactatagggcaacgataaaggtctacagactattaaactaacagaggagaagtttaatggtctgtagaaacctggcggcagcgcaaaagatg

SEQ ID NO: 75237 - DNA, 103 bp, Artificial Sequence
  Synthetic Polynucleotide
taatacgactcactatagggtcaatatctccttcctgggtttgtattaacaacagaggagagttaatatgaacccaggaaacctggcggcagcgcaaaagatg

SEQ ID NO: 75238 - DNA, 103 bp, Artificial Sequence
  Synthetic Polynucleotide
taatacgactcactatagggcagtttcaatatctccttcctgggtttgtaaacagaggagatacaaaatgaggaaggagaacctggcggcagcgcaaaagatg

SEQ ID NO: 75239 - DNA, 103 bp, Artificial Sequence
  Synthetic Polynucleotide
taatacgactcactatagggagcctcagtttcaatatctccttcctgggtaacagaggagaacccagatgggagatattaacctggcggcagcgcaaaagatg

SEQ ID NO: 75240 - DNA, 103 bp, Artificial Sequence
  Synthetic Polynucleotide
taatacgactcactatagggtcaacagcctcagtttcaatatctccttccaacagaggagaggaaggatgtattgaaacaacctggcggcagcgcaaaagatg

SEQ ID NO: 75241 - DNA, 103 bp, Artificial Sequence
  Synthetic Polynucleotide
taatacgactcactatagggcattttcaacagcctcagtttcaatatctcaacagaggagagagataatgaaactgaggaacctggcggcagcgcaaaagatg

SEQ ID NO: 75242 - DNA, 103 bp, Artificial Sequence
  Synthetic Polynucleotide
taatacgactcactatagggcgtttcattttcaacagcctcagtttcaataacagaggagaattgaaatggaggctgttaacctggcggcagcgcaaaagatg

SEQ ID NO: 75243 - DNA, 103 bp, Artificial Sequence
  Synthetic Polynucleotide
taatacgactcactatagggttcaccgtttcattttcaacagcctcagttaacagaggagaaactgaatgtgttgaaaaaacctggcggcagcgcaaaagatg

SEQ ID NO: 75244 - DNA, 103 bp, Artificial Sequence
  Synthetic Polynucleotide
taatacgactcactatagggttgtattcaccgtttcattttcaacagcctaacagaggagaaggctgatgaaaatgaaaaacctggcggcagcgcaaaagatg

SEQ ID NO: 75245 - DNA, 103 bp, Artificial Sequence
  Synthetic Polynucleotide
taatacgactcactatagggaactattgtattcaccgtttcattttcaacaacagaggagagttgaaatggaaacggtgaacctggcggcagcgcaaaagatg

SEQ ID NO: 75246 - DNA, 103 bp, Artificial Sequence
  Synthetic Polynucleotide
taatacgactcactatagggatctgaactattgtattcaccgtttcatttaacagaggagaaaatgaatgggtgaatacaacctggcggcagcgcaaaagatg

SEQ ID NO: 75247 - DNA, 103 bp, Artificial Sequence
  Synthetic Polynucleotide
taatacgactcactatagggatttacaacgataaaggtctacagactattaacagaggagaaatagtatgtagacctttaacctggcggcagcgcaaaagatg

SEQ ID NO: 75248 - DNA, 103 bp, Artificial Sequence
  Synthetic Polynucleotide
taatacgactcactatagggacattatctgaactattgtattcaccgtttaacagaggagaaaacggatgatacaatagaacctggcggcagcgcaaaagatg

SEQ ID NO: 75249 - DNA, 103 bp, Artificial Sequence
  Synthetic Polynucleotide
taatacgactcactatagggattttacattatctgaactattgtattcacaacagaggagagtgaatatgatagttcagaacctggcggcagcgcaaaagatg

SEQ ID NO: 75250 - DNA, 103 bp, Artificial Sequence
  Synthetic Polynucleotide
taatacgactcactatagggtcatgattttacattatctgaactattgtaaacagaggagatacaatatgtcagataataacctggcggcagcgcaaaagatg

SEQ ID NO: 75251 - DNA, 103 bp, Artificial Sequence
  Synthetic Polynucleotide
taatacgactcactatagggcggaatcatgattttacattatctgaactaaacagaggagatagttcatgtaatgtaaaaacctggcggcagcgcaaaagatg

SEQ ID NO: 75252 - DNA, 103 bp, Artificial Sequence
  Synthetic Polynucleotide
taatacgactcactataggggaatacggaatcatgattttacattatctgaacagaggagacagataatgtaaaatcataacctggcggcagcgcaaaagatg

SEQ ID NO: 75253 - DNA, 103 bp, Artificial Sequence
  Synthetic Polynucleotide
taatacgactcactatagggcatcagaatacggaatcatgattttacattaacagaggagaaatgtaatgtcatgattcaacctggcggcagcgcaaaagatg

SEQ ID NO: 75254 - DNA, 103 bp, Artificial Sequence
  Synthetic Polynucleotide
taatacgactcactatagggaatatcatcagaatacggaatcatgattttaacagaggagaaaaatcatgattccgtataacctggcggcagcgcaaaagatg

SEQ ID NO: 75255 - DNA, 103 bp, Artificial Sequence
  Synthetic Polynucleotide
taatacgactcactataggggttctaatatcatcagaatacggaatcatgaacagaggagacatgatatggtattctgaaacctggcggcagcgcaaaagatg

SEQ ID NO: 75256 - DNA, 103 bp, Artificial Sequence
  Synthetic Polynucleotide
taatacgactcactatagggtagtagttctaatatcatcagaatacggaaaacagaggagattccgtatgctgatgataaacctggcggcagcgcaaaagatg

SEQ ID NO: 75257 - DNA, 103 bp, Artificial Sequence
  Synthetic Polynucleotide
taatacgactcactatagggtccattagtagttctaatatcatcagaataaacagaggagatattctatggatattagaaacctggcggcagcgcaaaagatg

SEQ ID NO: 75258 - DNA, 103 bp, Artificial Sequence
  Synthetic Polynucleotide
taatacgactcactatagggtggatatttacaacgataaaggtctacagaaacagaggagatctgtaatgctttatcgtaacctggcggcagcgcaaaagatg

SEQ ID NO: 75259 - DNA, 103 bp, Artificial Sequence
  Synthetic Polynucleotide
taatacgactcactatagggtgacatccattagtagttctaatatcatcaaacagaggagatgatgaatgtagaactacaacctggcggcagcgcaaaagatg

SEQ ID NO: 75260 - DNA, 103 bp, Artificial Sequence
  Synthetic Polynucleotide
taatacgactcactatagggaccattgacatccattagtagttctaatataacagaggagaatattaatgctactaatgaacctggcggcagcgcaaaagatg

SEQ ID NO: 75261 - DNA, 103 bp, Artificial Sequence
  Synthetic Polynucleotide
taatacgactcactatagggtacataccattgacatccattagtagttctaacagaggagaagaactatgaatggatgtaacctggcggcagcgcaaaagatg

SEQ ID NO: 75262 - DNA, 103 bp, Artificial Sequence
  Synthetic Polynucleotide
taatacgactcactatagggctagatacataccattgacatccattagtaaacagaggagatactaaatgatgtcaatgaacctggcggcagcgcaaaagatg

SEQ ID NO: 75263 - DNA, 103 bp, Artificial Sequence
  Synthetic Polynucleotide
taatacgactcactatagggtactcctagatacataccattgacatccataacagaggagaatggatatgaatggtatgaacctggcggcagcgcaaaagatg

SEQ ID NO: 75264 - DNA, 103 bp, Artificial Sequence
  Synthetic Polynucleotide
taatacgactcactatagggatagatactcctagatacataccattgacaaacagaggagatgtcaaatgtatgtatctaacctggcggcagcgcaaaagatg

SEQ ID NO: 75265 - DNA, 103 bp, Artificial Sequence
  Synthetic Polynucleotide
taatacgactcactatagggttaaaatagatactcctagatacataccataacagaggagaatggtaatgatctaggagaacctggcggcagcgcaaaagatg

SEQ ID NO: 75266 - DNA, 103 bp, Artificial Sequence
  Synthetic Polynucleotide
taatacgactcactatagggctttgttaaaatagatactcctagatacataacagaggagaatgtatatgggagtatctaacctggcggcagcgcaaaagatg

SEQ ID NO: 75267 - DNA, 103 bp, Artificial Sequence
  Synthetic Polynucleotide
taatacgactcactatagggagatgctttgttaaaatagatactcctagaaacagaggagatctaggatgatctattttaacctggcggcagcgcaaaagatg

SEQ ID NO: 75268 - DNA, 103 bp, Artificial Sequence
  Synthetic Polynucleotide
taatacgactcactatagggcaaatagatgctttgttaaaatagatactcaacagaggagagagtatatgttttaacaaaacctggcggcagcgcaaaagatg

SEQ ID NO: 75269 - DNA, 103 bp, Artificial Sequence
  Synthetic Polynucleotide
taatacgactcactataggggacaatggatatttacaacgataaaggtctaacagaggagaagacctatgtcgttgtaaaacctggcggcagcgcaaaagatg

SEQ ID NO: 75270 - DNA, 103 bp, Artificial Sequence
  Synthetic Polynucleotide
taatacgactcactatagggattagcaaatagatgctttgttaaaatagaaacagaggagatctattatgacaaagcataacctggcggcagcgcaaaagatg

SEQ ID NO: 75271 - DNA, 103 bp, Artificial Sequence
  Synthetic Polynucleotide
taatacgactcactatagggtgtatattagcaaatagatgctttgttaaaaacagaggagatttaacatggcatctattaacctggcggcagcgcaaaagatg

SEQ ID NO: 75272 - DNA, 103 bp, Artificial Sequence
  Synthetic Polynucleotide
taatacgactcactatagggataattgtatattagcaaatagatgctttgaacagaggagacaaagcatgtatttgctaaacctggcggcagcgcaaaagatg

SEQ ID NO: 75273 - DNA, 103 bp, Artificial Sequence
  Synthetic Polynucleotide
taatacgactcactatagggaaaggataattgtatattagcaaatagatgaacagaggagacatctaatggctaatataaacctggcggcagcgcaaaagatg

SEQ ID NO: 75274 - DNA, 103 bp, Artificial Sequence
  Synthetic Polynucleotide
taatacgactcactatagggaatcaaaaggataattgtatattagcaaataacagaggagaatttgcatgtatacaattaacctggcggcagcgcaaaagatg

SEQ ID NO: 75275 - DNA, 103 bp, Artificial Sequence
  Synthetic Polynucleotide
taatacgactcactatagggcaattaatcaaaaggataattgtatattagaacagaggagactaataatgaattatcctaacctggcggcagcgcaaaagatg

SEQ ID NO: 75276 - DNA, 103 bp, Artificial Sequence
  Synthetic Polynucleotide
taatacgactcactatagggaataacaattaatcaaaaggataattgtataacagaggagaatacaaatgtccttttgaaacctggcggcagcgcaaaagatg

SEQ ID NO: 75277 - DNA, 103 bp, Artificial Sequence
  Synthetic Polynucleotide
taatacgactcactatagggaataaaataacaattaatcaaaaggataataacagaggagaattatcatgttgattaataacctggcggcagcgcaaaagatg

SEQ ID NO: 75278 - DNA, 103 bp, Artificial Sequence
  Synthetic Polynucleotide
taatacgactcactatagggatatgaataaaataacaattaatcaaaaggaacagaggagaccttttatgtaattgttaaacctggcggcagcgcaaaagatg

SEQ ID NO: 75279 - DNA, 103 bp, Artificial Sequence
  Synthetic Polynucleotide
taatacgactcactatagggtaagaatatgaataaaataacaattaatcaaacagaggagatgattaatggttattttaaacctggcggcagcgcaaaagatg

SEQ ID NO: 75280 - DNA, 103 bp, Artificial Sequence
  Synthetic Polynucleotide
taatacgactcactatagggaataagacaatggatatttacaacgataaaaacagaggagatttatcatggtaaatatcaacctggcggcagcgcaaaagatg

SEQ ID NO: 75281 - DNA, 103 bp, Artificial Sequence
  Synthetic Polynucleotide
taatacgactcactatagggccttttaagaatatgaataaaataacaattaacagaggagaaattgtatgtttattcataacctggcggcagcgcaaaagatg

SEQ ID NO: 75282 - DNA, 103 bp, Artificial Sequence
  Synthetic Polynucleotide
taatacgactcactatagggtgaaaccttttaagaatatgaataaaataaaacagaggagattatttatgtcatattctaacctggcggcagcgcaaaagatg

SEQ ID NO: 75283 - DNA, 103 bp, Artificial Sequence
  Synthetic Polynucleotide
taatacgactcactatagggaaatatgaaaccttttaagaatatgaataaaacagaggagattattcatgttcttaaaaaacctggcggcagcgcaaaagatg

SEQ ID NO: 75284 - DNA, 103 bp, Artificial Sequence
  Synthetic Polynucleotide
taatacgactcactatagggttgataaatatgaaaccttttaagaatatgaacagaggagacatattatgaaaaggtttaacctggcggcagcgcaaaagatg

SEQ ID NO: 75285 - DNA, 103 bp, Artificial Sequence
  Synthetic Polynucleotide
taatacgactcactatagggaagaattgataaatatgaaaccttttaagaaacagaggagatcttaaatggtttcatataacctggcggcagcgcaaaagatg

SEQ ID NO: 75286 - DNA, 103 bp, Artificial Sequence
  Synthetic Polynucleotide
taatacgactcactatagggtgtagaagaattgataaatatgaaacctttaacagaggagaaaaggtatgatatttatcaacctggcggcagcgcaaaagatg

SEQ ID NO: 75287 - DNA, 103 bp, Artificial Sequence
  Synthetic Polynucleotide
taatacgactcactatagggtttaatgtagaagaattgataaatatgaaaaacagaggagatttcatatgtatcaattcaacctggcggcagcgcaaaagatg

SEQ ID NO: 75288 - DNA, 103 bp, Artificial Sequence
  Synthetic Polynucleotide
taatacgactcactatagggaaatttttaatgtagaagaattgataaataaacagaggagatatttaatgattcttctaaacctggcggcagcgcaaaagatg

SEQ ID NO: 75289 - DNA, 103 bp, Artificial Sequence
  Synthetic Polynucleotide
taatacgactcactatagggaatggaaatttttaatgtagaagaattgataacagaggagaatcaatatgtctacattaaacctggcggcagcgcaaaagatg

SEQ ID NO: 75290 - DNA, 103 bp, Artificial Sequence
  Synthetic Polynucleotide
taatacgactcactatagggttaaaaatggaaatttttaatgtagaagaaaacagaggagattcttcatgattaaaaataacctggcggcagcgcaaaagatg

SEQ ID NO: 75291 - DNA, 103 bp, Artificial Sequence
  Synthetic Polynucleotide
taatacgactcactatagggtaactaataagacaatggatatttacaacgaacagaggagacgttgtatgtatccattgaacctggcggcagcgcaaaagatg

SEQ ID NO: 75292 - DNA, 103 bp, Artificial Sequence
  Synthetic Polynucleotide
taatacgactcactatagggataaattaaaaatggaaatttttaatgtagaacagaggagactacatatgaaatttccaaacctggcggcagcgcaaaagatg

SEQ ID NO: 75293 - DNA, 103 bp, Artificial Sequence
  Synthetic Polynucleotide
taatacgactcactataggggctacataaattaaaaatggaaatttttaaaacagaggagattaaaaatgtccatttttaacctggcggcagcgcaaaagatg

SEQ ID NO: 75294 - DNA, 103 bp, Artificial Sequence
  Synthetic Polynucleotide
taatacgactcactatagggtgcgggctacataaattaaaaatggaaattaacagaggagaaatttcatgttttaatttaacctggcggcagcgcaaaagatg

SEQ ID NO: 75295 - DNA, 103 bp, Artificial Sequence
  Synthetic Polynucleotide
taatacgactcactatagggagtattgcgggctacataaattaaaaatggaacagaggagaccatttatgatttatgtaaacctggcggcagcgcaaaagatg

SEQ ID NO: 75296 - DNA, 103 bp, Artificial Sequence
  Synthetic Polynucleotide
taatacgactcactatagggtgaggagtattgcgggctacataaattaaaaacagaggagatttaatatgtgtagcccgaacctggcggcagcgcaaaagatg

SEQ ID NO: 75297 - DNA, 103 bp, Artificial Sequence
  Synthetic Polynucleotide
taatacgactcactatagggcgtaatgaggagtattgcgggctacataaaaacagaggagatttatgatgcccgcaataaacctggcggcagcgcaaaagatg

SEQ ID NO: 75298 - DNA, 103 bp, Artificial Sequence
  Synthetic Polynucleotide
taatacgactcactatagggtgaaacgtaatgaggagtattgcgggctacaacagaggagagtagccatgaatactcctaacctggcggcagcgcaaaagatg

SEQ ID NO: 75299 - DNA, 103 bp, Artificial Sequence
  Synthetic Polynucleotide
taatacgactcactatagggaaaaatgaaacgtaatgaggagtattgcggaacagaggagaccgcaaatgtcctcattaaacctggcggcagcgcaaaagatg

SEQ ID NO: 75300 - DNA, 103 bp, Artificial Sequence
  Synthetic Polynucleotide
taatacgactcactatagggagacaaaaaatgaaacgtaatgaggagtataacagaggagaatactcatgattacgtttaacctggcggcagcgcaaaagatg

SEQ ID NO: 75301 - DNA, 103 bp, Artificial Sequence
  Synthetic Polynucleotide
taatacgactcactatagggattatagacaaaaaatgaaacgtaatgaggaacagaggagacctcatatggtttcatttaacctggcggcagcgcaaaagatg

SEQ ID NO: 75302 - DNA, 103 bp, Artificial Sequence
  Synthetic Polynucleotide
taatacgactcactatagggaagcgtaactaataagacaatggatatttaaacagaggagataaataatgattgtcttaaacctggcggcagcgcaaaagatg

SEQ ID NO: 75303 - DNA, 103 bp, Artificial Sequence
  Synthetic Polynucleotide
taatacgactcactatagggtggatattatagacaaaaaatgaaacgtaaaacagaggagattacgtatgattttttgtaacctggcggcagcgcaaaagatg

SEQ ID NO: 75304 - DNA, 103 bp, Artificial Sequence
  Synthetic Polynucleotide
taatacgactcactatagggcaaaatggatattatagacaaaaaatgaaaaacagaggagatttcatatgttgtctataaacctggcggcagcgcaaaagatg

SEQ ID NO: 75305 - DNA, 103 bp, Artificial Sequence
  Synthetic Polynucleotide
taatacgactcactatagggataaacaaaatggatattatagacaaaaaaaacagaggagattttttatgtataatatcaacctggcggcagcgcaaaagatg

SEQ ID NO: 75306 - DNA, 103 bp, Artificial Sequence
  Synthetic Polynucleotide
taatacgactcactatagggctgagataaacaaaatggatattatagacaaacagaggagatgtctaatgtatccatttaacctggcggcagcgcaaaagatg

SEQ ID NO: 75307 - DNA, 103 bp, Artificial Sequence
  Synthetic Polynucleotide
taatacgactcactatagggatgtactgagataaacaaaatggatattataacagaggagaataataatgattttgtttaacctggcggcagcgcaaaagatg

SEQ ID NO: 75308 - DNA, 103 bp, Artificial Sequence
  Synthetic Polynucleotide
taatacgactcactatagggaatctatgtactgagataaacaaaatggataacagaggagaatccatatggtttatctcaacctggcggcagcgcaaaagatg

SEQ ID NO: 75309 - DNA, 103 bp, Artificial Sequence
  Synthetic Polynucleotide
taatacgactcactatagggtggataatctatgtactgagataaacaaaaaacagaggagattttgtatgtctcagtacaacctggcggcagcgcaaaagatg

SEQ ID NO: 75310 - DNA, 103 bp, Artificial Sequence
  Synthetic Polynucleotide
taatacgactcactatagggtcaattggataatctatgtactgagataaaaacagaggagatttatcatggtacatagaaacctggcggcagcgcaaaagatg

SEQ ID NO: 75311 - DNA, 103 bp, Artificial Sequence
  Synthetic Polynucleotide
taatacgactcactataggggcttctcaattggataatctatgtactgagaacagaggagactcagtatgtagattatcaacctggcggcagcgcaaaagatg

SEQ ID NO: 75312 - DNA, 103 bp, Artificial Sequence
  Synthetic Polynucleotide
taatacgactcactatagggaatgtgcttctcaattggataatctatgtaaacagaggagatacataatgtatccaattaacctggcggcagcgcaaaagatg

SEQ ID NO: 75313 - DNA, 103 bp, Artificial Sequence
  Synthetic Polynucleotide
taatacgactcactatagggaaaataagcgtaactaataagacaatggataacagaggagaatccatatgcttattagtaacctggcggcagcgcaaaagatg

SEQ ID NO: 75314 - DNA, 103 bp, Artificial Sequence
  Synthetic Polynucleotide
taatacgactcactatagggtactaaatgtgcttctcaattggataatctaacagaggagaagattaatgaattgagaaaacctggcggcagcgcaaaagatg

SEQ ID NO: 75315 - DNA, 103 bp, Artificial Sequence
  Synthetic Polynucleotide
taatacgactcactatagggaaaactactaaatgtgcttctcaattggataacagaggagaatccaaatgagaagcacaaacctggcggcagcgcaaaagatg

SEQ ID NO: 75316 - DNA, 103 bp, Artificial Sequence
  Synthetic Polynucleotide
taatacgactcactatagggtgtacaaaactactaaatgtgcttctcaataacagaggagaattgagatgcacatttagaacctggcggcagcgcaaaagatg

SEQ ID NO: 75317 - DNA, 103 bp, Artificial Sequence
  Synthetic Polynucleotide
taatacgactcactatagggtaaaatgtacaaaactactaaatgtgcttcaacagaggagagaagcaatgttagtagttaacctggcggcagcgcaaaagatg

SEQ ID NO: 75318 - DNA, 103 bp, Artificial Sequence
  Synthetic Polynucleotide
taatacgactcactatagggaaacttaaaatgtacaaaactactaaatgtaacagaggagaacatttatgagttttgtaaacctggcggcagcgcaaaagatg

SEQ ID NO: 75319 - DNA, 103 bp, Artificial Sequence
  Synthetic Polynucleotide
taatacgactcactatagggtcaataaacttaaaatgtacaaaactactaaacagaggagatagtagatgtgtacatttaacctggcggcagcgcaaaagatg

SEQ ID NO: 75320 - DNA, 103 bp, Artificial Sequence
  Synthetic Polynucleotide
taatacgactcactatagggattcgtcaataaacttaaaatgtacaaaacaacagaggagagttttgatgattttaagtaacctggcggcagcgcaaaagatg

SEQ ID NO: 75321 - DNA, 103 bp, Artificial Sequence
  Synthetic Polynucleotide
taatacgactcactatagggcgacgattcgtcaataaacttaaaatgtacaacagaggagagtacatatgaagtttattaacctggcggcagcgcaaaagatg

SEQ ID NO: 75322 - DNA, 103 bp, Artificial Sequence
  Synthetic Polynucleotide
taatacgactcactataggggttttcgacgattcgtcaataaacttaaaaaacagaggagattttaaatgtattgacgaaacctggcggcagcgcaaaagatg

SEQ ID NO: 75323 - DNA, 103 bp, Artificial Sequence
  Synthetic Polynucleotide
taatacgactcactatagggaactagttttcgacgattcgtcaataaactaacagaggagaagtttaatgacgaatcgtaacctggcggcagcgcaaaagatg

SEQ ID NO: 75324 - DNA, 103 bp, Artificial Sequence
  Synthetic Polynucleotide
taatacgactcactatagggacataaaaataagcgtaactaataagacaaaacagaggagattgtctatgtagttacgcaacctggcggcagcgcaaaagatg

SEQ ID NO: 75325 - DNA, 103 bp, Artificial Sequence
  Synthetic Polynucleotide
taatacgactcactatagggactataactagttttcgacgattcgtcaataacagaggagaattgacatgtcgtcgaaaaacctggcggcagcgcaaaagatg

SEQ ID NO: 75326 - DNA, 103 bp, Artificial Sequence
  Synthetic Polynucleotide
taatacgactcactatagggtgttaactataactagttttcgacgattcgaacagaggagacgaatcatggaaaactagaacctggcggcagcgcaaaagatg

SEQ ID NO: 75327 - DNA, 103 bp, Artificial Sequence
  Synthetic Polynucleotide
taatacgactcactatagggtaaaatgttaactataactagttttcgacgaacagaggagacgtcgaatgctagttataaacctggcggcagcgcaaaagatg

SEQ ID NO: 75328 - DNA, 103 bp, Artificial Sequence
  Synthetic Polynucleotide
taatacgactcactatagggaataataaaatgttaactataactagttttaacagaggagaaaaactatgtatagttaaaacctggcggcagcgcaaaagatg

SEQ ID NO: 75329 - DNA, 103 bp, Artificial Sequence
  Synthetic Polynucleotide
taatacgactcactatagggtatcaaataataaaatgttaactataactaaacagaggagatagttaatgttaacatttaacctggcggcagcgcaaaagatg

SEQ ID NO: 75330 - DNA, 103 bp, Artificial Sequence
  Synthetic Polynucleotide
taatacgactcactatagggcagggtatcaaataataaaatgttaactataacagaggagaatagttatgattttattaaacctggcggcagcgcaaaagatg

SEQ ID NO: 75331 - DNA, 103 bp, Artificial Sequence
  Synthetic Polynucleotide
taatacgactcactatagggaatatcagggtatcaaataataaaatgttaaacagaggagataacatatgattatttgaaacctggcggcagcgcaaaagatg

SEQ ID NO: 75332 - DNA, 103 bp, Artificial Sequence
  Synthetic Polynucleotide
taatacgactcactataggggtattaatatcagggtatcaaataataaaaaacagaggagattttatatgttgatacccaacctggcggcagcgcaaaagatg

SEQ ID NO: 75333 - DNA, 103 bp, Artificial Sequence
  Synthetic Polynucleotide
taatacgactcactatagggtaggggtattaatatcagggtatcaaataaaacagaggagattatttatgaccctgataaacctggcggcagcgcaaaagatg

SEQ ID NO: 75334 - DNA, 103 bp, Artificial Sequence
  Synthetic Polynucleotide
taatacgactcactatagggaacggtaggggtattaatatcagggtatcaaacagaggagatgatacatggatattaataacctggcggcagcgcaaaagatg

SEQ ID NO: 75335 - DNA, 103 bp, Artificial Sequence
  Synthetic Polynucleotide
taatacgactcactatagggaaaacacataaaaataagcgtaactaataaaacagaggagattattaatgacgcttattaacctggcggcagcgcaaaagatg

SEQ ID NO: 75336 - DNA, 103 bp, Artificial Sequence
  Synthetic Polynucleotide
taatacgactcactatagggatagtaacggtaggggtattaatatcagggaacagaggagaccctgaatgtaataccccaacctggcggcagcgcaaaagatg

SEQ ID NO: 75337 - DNA, 103 bp, Artificial Sequence
  Synthetic Polynucleotide
taatacgactcactatagggaaataatagtaacggtaggggtattaatataacagaggagaatattaatgcccctaccgaacctggcggcagcgcaaaagatg

SEQ ID NO: 75338 - DNA, 103 bp, Artificial Sequence
  Synthetic Polynucleotide
taatacgactcactataggggttataaataatagtaacggtaggggtattaacagaggagaaataccatgaccgttactaacctggcggcagcgcaaaagatg

SEQ ID NO: 75339 - DNA, 103 bp, Artificial Sequence
  Synthetic Polynucleotide
taatacgactcactatagggcatcagttataaataatagtaacggtagggaacagaggagaccctacatgtactattataacctggcggcagcgcaaaagatg

SEQ ID NO: 75340 - DNA, 103 bp, Artificial Sequence
  Synthetic Polynucleotide
taatacgactcactatagggggttacatcagttataaataatagtaacggaacagaggagaccgttaatgttatttataaacctggcggcagcgcaaaagatg

SEQ ID NO: 75341 - DNA, 103 bp, Artificial Sequence
  Synthetic Polynucleotide
taatacgactcactatagggacgtgggttacatcagttataaataatagtaacagaggagaactattatgtataactgaaacctggcggcagcgcaaaagatg

SEQ ID NO: 75342 - DNA, 103 bp, Artificial Sequence
  Synthetic Polynucleotide
taatacgactcactatagggatgttacgtgggttacatcagttataaataaacagaggagatatttaatgctgatgtaaaacctggcggcagcgcaaaagatg

SEQ ID NO: 75343 - DNA, 103 bp, Artificial Sequence
  Synthetic Polynucleotide
taatacgactcactatagggttctaatgttacgtgggttacatcagttataacagaggagaataactatggtaacccacaacctggcggcagcgcaaaagatg

SEQ ID NO: 75344 - DNA, 103 bp, Artificial Sequence
  Synthetic Polynucleotide
taatacgactcactatagggattaattctaatgttacgtgggttacatcaaacagaggagatgatgtatgccacgtaacaacctggcggcagcgcaaaagatg

SEQ ID NO: 75345 - DNA, 103 bp, Artificial Sequence
  Synthetic Polynucleotide
taatacgactcactatagggcgataattaattctaatgttacgtgggttaaacagaggagataacccatgtaacattagaacctggcggcagcgcaaaagatg

SEQ ID NO: 75346 - DNA, 103 bp, Artificial Sequence
  Synthetic Polynucleotide
taatacgactcactatagggggatcatatccgcactgctaaatactaaataacagaggagaatttagatgttagcagtgaacctggcggcagcgcaaaagatg

SEQ ID NO: 75347 - DNA, 103 bp, Artificial Sequence
  Synthetic Polynucleotide
taatacgactcactatagggaacataaaacacataaaaataagcgtaactaacagaggagaagttacatgtatttttataacctggcggcagcgcaaaagatg

SEQ ID NO: 75348 - DNA, 103 bp, Artificial Sequence
  Synthetic Polynucleotide
taatacgactcactatagggactatcgataattaattctaatgttacgtgaacagaggagacacgtaatgttagaattaaacctggcggcagcgcaaaagatg

SEQ ID NO: 75349 - DNA, 103 bp, Artificial Sequence
  Synthetic Polynucleotide
taatacgactcactataggggcattactatcgataattaattctaatgttaacagaggagaaacattatgattaattataacctggcggcagcgcaaaagatg

SEQ ID NO: 75350 - DNA, 103 bp, Artificial Sequence
  Synthetic Polynucleotide
taatacgactcactatagggtgaatgcattactatcgataattaattctaaacagaggagatagaatatgttatcgataaacctggcggcagcgcaaaagatg

SEQ ID NO: 75351 - DNA, 103 bp, Artificial Sequence
  Synthetic Polynucleotide
taatacgactcactatagggaagcgtgaatgcattactatcgataattaaaacagaggagattaattatggatagtaataacctggcggcagcgcaaaagatg

SEQ ID NO: 75352 - DNA, 103 bp, Artificial Sequence
  Synthetic Polynucleotide
taatacgactcactatagggtttggaagcgtgaatgcattactatcgataaacagaggagatatcgaatgtaatgcattaacctggcggcagcgcaaaagatg

SEQ ID NO: 75353 - DNA, 103 bp, Artificial Sequence
  Synthetic Polynucleotide
taatacgactcactatagggacaattttggaagcgtgaatgcattactataacagaggagaatagtaatgcattcacgcaacctggcggcagcgcaaaagatg

SEQ ID NO: 75354 - DNA, 103 bp, Artificial Sequence
  Synthetic Polynucleotide
taatacgactcactatagggaatagacaattttggaagcgtgaatgcattaacagaggagaaatgcaatgacgcttccaaacctggcggcagcgcaaaagatg

SEQ ID NO: 75355 - DNA, 103 bp, Artificial Sequence
  Synthetic Polynucleotide
taatacgactcactatagggtttataatagacaattttggaagcgtgaataacagaggagaattcacatgtccaaaattaacctggcggcagcgcaaaagatg

SEQ ID NO: 75356 - DNA, 103 bp, Artificial Sequence
  Synthetic Polynucleotide
taatacgactcactataggggtgagtttataatagacaattttggaagcgaacagaggagacgcttcatgaattgtctaaacctggcggcagcgcaaaagatg

SEQ ID NO: 75357 - DNA, 103 bp, Artificial Sequence
  Synthetic Polynucleotide
taatacgactcactatagggtattggtgagtttataatagacaattttggaacagaggagaccaaaaatgtctattataaacctggcggcagcgcaaaagatg

SEQ ID NO: 75358 - DNA, 103 bp, Artificial Sequence
  Synthetic Polynucleotide
taatacgactcactatagggaaatcaacataaaacacataaaaataagcgaacagaggagacgcttaatgttatgtgttaacctggcggcagcgcaaaagatg

SEQ ID NO: 75359 - DNA, 103 bp, Artificial Sequence
  Synthetic Polynucleotide
taatacgactcactatagggaaaattattggtgagtttataatagacaataacagaggagaattgtcatgtataaactcaacctggcggcagcgcaaaagatg

SEQ ID NO: 75360 - DNA, 103 bp, Artificial Sequence
  Synthetic Polynucleotide
taatacgactcactatagggataaaaaaattattggtgagtttataatagaacagaggagactattaatgactcaccaaaacctggcggcagcgcaaaagatg

SEQ ID NO: 75361 - DNA, 103 bp, Artificial Sequence
  Synthetic Polynucleotide
taatacgactcactatagggatgcaataaaaaaattattggtgagtttataacagaggagaataaacatgccaataattaacctggcggcagcgcaaaagatg

SEQ ID NO: 75362 - DNA, 103 bp, Artificial Sequence
  Synthetic Polynucleotide
taatacgactcactatagggaaaacatgcaataaaaaaattattggtgagaacagaggagactcaccatgaatttttttaacctggcggcagcgcaaaagatg

SEQ ID NO: 75363 - DNA, 103 bp, Artificial Sequence
  Synthetic Polynucleotide
taatacgactcactatagggatatgaaaacatgcaataaaaaaattattgaacagaggagacaataaatgttttattgcaacctggcggcagcgcaaaagatg

SEQ ID NO: 75364 - DNA, 103 bp, Artificial Sequence
  Synthetic Polynucleotide
taatacgactcactatagggaatgaatatgaaaacatgcaataaaaaaataacagaggagaatttttatgttgcatgttaacctggcggcagcgcaaaagatg

SEQ ID NO: 75365 - DNA, 103 bp, Artificial Sequence
  Synthetic Polynucleotide
taatacgactcactatagggatcctaatgaatatgaaaacatgcaataaaaacagaggagatttattatgtgttttcataacctggcggcagcgcaaaagatg

SEQ ID NO: 75366 - DNA, 103 bp, Artificial Sequence
  Synthetic Polynucleotide
taatacgactcactatagggtgataatcctaatgaatatgaaaacatgcaaacagaggagatgcatgatgtcatattcaaacctggcggcagcgcaaaagatg

SEQ ID NO: 75367 - DNA, 103 bp, Artificial Sequence
  Synthetic Polynucleotide
taatacgactcactatagggagatttgataatcctaatgaatatgaaaacaacagaggagagttttcatgttcattaggaacctggcggcagcgcaaaagatg

SEQ ID NO: 75368 - DNA, 103 bp, Artificial Sequence
  Synthetic Polynucleotide
taatacgactcactatagggattaaagatttgataatcctaatgaatatgaacagaggagacatattatgtaggattataacctggcggcagcgcaaaagatg

SEQ ID NO: 75369 - DNA, 103 bp, Artificial Sequence
  Synthetic Polynucleotide
taatacgactcactatagggataataaatcaacataaaacacataaaaataacagaggagaatttttatgtgttttatgaacctggcggcagcgcaaaagatg

SEQ ID NO: 75370 - DNA, 103 bp, Artificial Sequence
  Synthetic Polynucleotide
taatacgactcactatagggataagattaaagatttgataatcctaatgaaacagaggagatcattaatgttatcaaataacctggcggcagcgcaaaagatg

SEQ ID NO: 75371 - DNA, 103 bp, Artificial Sequence
  Synthetic Polynucleotide
taatacgactcactatagggtcgtaataagattaaagatttgataatcctaacagaggagaaggattatgaaatctttaaacctggcggcagcgcaaaagatg

SEQ ID NO: 75372 - DNA, 103 bp, Artificial Sequence
  Synthetic Polynucleotide
taatacgactcactatagggtacaatcgtaataagattaaagatttgataaacagaggagatatcaaatgtttaatcttaacctggcggcagcgcaaaagatg

SEQ ID NO: 75373 - DNA, 103 bp, Artificial Sequence
  Synthetic Polynucleotide
taatacgactcactatagggacgcatacaatcgtaataagattaaagattaacagaggagaaatcttatgtcttattacaacctggcggcagcgcaaaagatg

SEQ ID NO: 75374 - DNA, 103 bp, Artificial Sequence
  Synthetic Polynucleotide
taatacgactcactatagggtattaacgcatacaatcgtaataagattaaaacagaggagattaatcatgttacgattgaacctggcggcagcgcaaaagatg

SEQ ID NO: 75375 - DNA, 103 bp, Artificial Sequence
  Synthetic Polynucleotide
taatacgactcactatagggtgtaatattaacgcatacaatcgtaataagaacagaggagacttattatgattgtatgcaacctggcggcagcgcaaaagatg

SEQ ID NO: 75376 - DNA, 103 bp, Artificial Sequence
  Synthetic Polynucleotide
taatacgactcactatagggcgtcttgtaatattaacgcatacaatcgtaaacagaggagatacgatatgatgcgttaaaacctggcggcagcgcaaaagatg

SEQ ID NO: 75377 - DNA, 103 bp, Artificial Sequence
  Synthetic Polynucleotide
taatacgactcactatagggaatgacgtcttgtaatattaacgcatacaaaacagaggagattgtatatgttaatattaaacctggcggcagcgcaaaagatg

SEQ ID NO: 75378 - DNA, 103 bp, Artificial Sequence
  Synthetic Polynucleotide
taatacgactcactatagggtttagaatgacgtcttgtaatattaacgcaaacagaggagatgcgttatgattacaagaaacctggcggcagcgcaaaagatg

SEQ ID NO: 75379 - DNA, 103 bp, Artificial Sequence
  Synthetic Polynucleotide
taatacgactcactatagggcgtcttttagaatgacgtcttgtaatattaaacagaggagataatatatgaagacgtcaaacctggcggcagcgcaaaagatg

SEQ ID NO: 75380 - DNA, 103 bp, Artificial Sequence
  Synthetic Polynucleotide
taatacgactcactatagggtaaatataataaatcaacataaaacacataaacagaggagatatgtgatgtatgttgataacctggcggcagcgcaaaagatg

SEQ ID NO: 75381 - DNA, 103 bp, Artificial Sequence
  Synthetic Polynucleotide
taatacgactcactatagggtcctccgtcttttagaatgacgtcttgtaaaacagaggagattacaaatggtcattctaaacctggcggcagcgcaaaagatg

SEQ ID NO: 75382 - DNA, 103 bp, Artificial Sequence
  Synthetic Polynucleotide
taatacgactcactatagggggagatcctccgtcttttagaatgacgtctaacagaggagaagacgtatgtctaaaagaaacctggcggcagcgcaaaagatg

SEQ ID NO: 75383 - DNA, 103 bp, Artificial Sequence
  Synthetic Polynucleotide
taatacgactcactatagggttgatggagatcctccgtcttttagaatgaaacagaggagatcattcatgaagacggagaacctggcggcagcgcaaaagatg

SEQ ID NO: 75384 - DNA, 103 bp, Artificial Sequence
  Synthetic Polynucleotide
taatacgactcactatagggggcatttgatggagatcctccgtcttttagaacagaggagactaaaaatgggaggatctaacctggcggcagcgcaaaagatg

SEQ ID NO: 75385 - DNA, 103 bp, Artificial Sequence
  Synthetic Polynucleotide
taatacgactcactatagggtgtctggcatttgatggagatcctccgtctaacagaggagaagacggatgatctccatcaacctggcggcagcgcaaaagatg

SEQ ID NO: 75386 - DNA, 103 bp, Artificial Sequence
  Synthetic Polynucleotide
taatacgactcactataggggtgattgtctggcatttgatggagatcctcaacagaggagagaggatatgcatcaaatgaacctggcggcagcgcaaaagatg

SEQ ID NO: 75387 - DNA, 103 bp, Artificial Sequence
  Synthetic Polynucleotide
taatacgactcactatagggtgtacgtgattgtctggcatttgatggagaaacagaggagatctccaatgaatgccagaaacctggcggcagcgcaaaagatg

SEQ ID NO: 75388 - DNA, 103 bp, Artificial Sequence
  Synthetic Polynucleotide
taatacgactcactatagggttctttgtacgtgattgtctggcatttgataacagaggagaatcaaaatgcagacaatcaacctggcggcagcgcaaaagatg

SEQ ID NO: 75389 - DNA, 103 bp, Artificial Sequence
  Synthetic Polynucleotide
taatacgactcactatagggccatgttctttgtacgtgattgtctggcataacagaggagaatgccaatgaatcacgtaaacctggcggcagcgcaaaagatg

SEQ ID NO: 75390 - DNA, 103 bp, Artificial Sequence
  Synthetic Polynucleotide
taatacgactcactatagggtatttccatgttctttgtacgtgattgtctaacagaggagaagacaaatgcgtacaaagaacctggcggcagcgcaaaagatg

SEQ ID NO: 75391 - DNA, 103 bp, Artificial Sequence
  Synthetic Polynucleotide
taatacgactcactatagggtcttataaatataataaatcaacataaaacaacagaggagagttttaatgtgatttattaacctggcggcagcgcaaaagatg

SEQ ID NO: 75392 - DNA, 103 bp, Artificial Sequence
  Synthetic Polynucleotide
taatacgactcactatagggaaacctatttccatgttctttgtacgtgataacagaggagaatcacgatgaaagaacataacctggcggcagcgcaaaagatg

SEQ ID NO: 75393 - DNA, 103 bp, Artificial Sequence
  Synthetic Polynucleotide
taatacgactcactataggggaacaaaacctatttccatgttctttgtacaacagaggagagtacaaatgacatggaaaaacctggcggcagcgcaaaagatg

SEQ ID NO: 75394 - DNA, 103 bp, Artificial Sequence
  Synthetic Polynucleotide
taatacgactcactatagggcaatagaacaaaacctatttccatgttcttaacagaggagaaagaacatggaaataggtaacctggcggcagcgcaaaagatg

SEQ ID NO: 75395 - DNA, 103 bp, Artificial Sequence
  Synthetic Polynucleotide
taatacgactcactatagggatgcgcaatagaacaaaacctatttccatgaacagaggagacatggaatgaggttttgtaacctggcggcagcgcaaaagatg

SEQ ID NO: 75396 - DNA, 103 bp, Artificial Sequence
  Synthetic Polynucleotide
taatacgactcactatagggctatgatgcgcaatagaacaaaacctatttaacagaggagaaaatagatgttgttctataacctggcggcagcgcaaaagatg

SEQ ID NO: 75397 - DNA, 103 bp, Artificial Sequence
  Synthetic Polynucleotide
taatacgactcactatagggtgaatctatgatgcgcaatagaacaaaaccaacagaggagaggttttatgctattgcgcaacctggcggcagcgcaaaagatg

SEQ ID NO: 75398 - DNA, 103 bp, Artificial Sequence
  Synthetic Polynucleotide
taatacgactcactatagggctatatgaatctatgatgcgcaatagaacaaacagaggagatgttctatggcgcatcataacctggcggcagcgcaaaagatg

SEQ ID NO: 75399 - DNA, 103 bp, Artificial Sequence
  Synthetic Polynucleotide
taatacgactcactataggggtgttctatatgaatctatgatgcgcaataaacagaggagatattgcatgtcatagattaacctggcggcagcgcaaaagatg

SEQ ID NO: 75400 - DNA, 103 bp, Artificial Sequence
  Synthetic Polynucleotide
taatacgactcactatagggtacgggtgttctatatgaatctatgatgcgaacagaggagacgcatcatggattcatataacctggcggcagcgcaaaagatg

SEQ ID NO: 75401 - DNA, 103 bp, Artificial Sequence
  Synthetic Polynucleotide
taatacgactcactatagggatttctacgggtgttctatatgaatctatgaacagaggagacatagaatgatatagaacaacctggcggcagcgcaaaagatg

SEQ ID NO: 75402 - DNA, 103 bp, Artificial Sequence
  Synthetic Polynucleotide
taatacgactcactatagggatcattcttataaatataataaatcaacataacagaggagaatgttgatgtattatattaacctggcggcagcgcaaaagatg

SEQ ID NO: 75403 - DNA, 103 bp, Artificial Sequence
  Synthetic Polynucleotide
taatacgactcactatagggttagtatttctacgggtgttctatatgaataacagaggagaattcatatggaacacccgaacctggcggcagcgcaaaagatg

SEQ ID NO: 75404 - DNA, 103 bp, Artificial Sequence
  Synthetic Polynucleotide
taatacgactcactatagggacaaattagtatttctacgggtgttctataaacagaggagatatagaatgcccgtagaaaacctggcggcagcgcaaaagatg

SEQ ID NO: 75405 - DNA, 103 bp, Artificial Sequence
  Synthetic Polynucleotide
taatacgactcactataggggtaaaacaaattagtatttctacgggtgttaacagaggagaaacaccatgagaaatactaacctggcggcagcgcaaaagatg

SEQ ID NO: 75406 - DNA, 103 bp, Artificial Sequence
  Synthetic Polynucleotide
taatacgactcactatagggatagagtaaaacaaattagtatttctacggaacagaggagaccgtagatgtactaatttaacctggcggcagcgcaaaagatg

SEQ ID NO: 75407 - DNA, 103 bp, Artificial Sequence
  Synthetic Polynucleotide
taatacgactcactatagggattttatagagtaaaacaaattagtatttcaacagaggagagaaataatgatttgttttaacctggcggcagcgcaaaagatg

SEQ ID NO: 75408 - DNA, 103 bp, Artificial Sequence
  Synthetic Polynucleotide
taatacgactcactatagggttagtattttatagagtaaaacaaattagtaacagaggagaactaatatgttttactctaacctggcggcagcgcaaaagatg

SEQ ID NO: 75409 - DNA, 103 bp, Artificial Sequence
  Synthetic Polynucleotide
taatacgactcactatagggatgcattagtattttatagagtaaaacaaaaacagaggagatttgttatgctctataaaaacctggcggcagcgcaaaagatg

SEQ ID NO: 75410 - DNA, 103 bp, Artificial Sequence
  Synthetic Polynucleotide
taatacgactcactatagggaatagatgcattagtattttatagagtaaaaacagaggagatttactatgtaaaatactaacctggcggcagcgcaaaagatg

SEQ ID NO: 75411 - DNA, 103 bp, Artificial Sequence
  Synthetic Polynucleotide
taatacgactcactataggggatgaaatagatgcattagtattttatagaaacagaggagatctataatgtactaatgcaacctggcggcagcgcaaaagatg

SEQ ID NO: 75412 - DNA, 103 bp, Artificial Sequence
  Synthetic Polynucleotide
taatacgactcactatagggaaaacgatgaaatagatgcattagtattttaacagaggagaaaaataatgatgcatctaaacctggcggcagcgcaaaagatg

SEQ ID NO: 75413 - DNA, 103 bp, Artificial Sequence
  Synthetic Polynucleotide
taatacgactcactatagggaaacaatcattcttataaatataataaatcaacagaggagagatttaatgtatttataaaacctggcggcagcgcaaaagatg

SEQ ID NO: 75414 - DNA, 103 bp, Artificial Sequence
  Synthetic Polynucleotide
taatacgactcactatagggtatacaaaacgatgaaatagatgcattagtaacagaggagaactaatatgtctatttcaaacctggcggcagcgcaaaagatg

SEQ ID NO: 75415 - DNA, 103 bp, Artificial Sequence
  Synthetic Polynucleotide
taatacgactcactataggggacgttatacaaaacgatgaaatagatgcaaacagaggagatgcatcatgttcatcgttaacctggcggcagcgcaaaagatg

SEQ ID NO: 75416 - DNA, 103 bp, Artificial Sequence
  Synthetic Polynucleotide
taatacgactcactatagggggaaagacgttatacaaaacgatgaaatagaacagaggagactatttatgcgttttgtaaacctggcggcagcgcaaaagatg

SEQ ID NO: 75417 - DNA, 103 bp, Artificial Sequence
  Synthetic Polynucleotide
taatacgactcactatagggcacttggaaagacgttatacaaaacgatgaaacagaggagatcatcgatgtgtataacgaacctggcggcagcgcaaaagatg

SEQ ID NO: 75418 - DNA, 103 bp, Artificial Sequence
  Synthetic Polynucleotide
taatacgactcactatagggttcgccacttggaaagacgttatacaaaacaacagaggagagttttgatgaacgtctttaacctggcggcagcgcaaaagatg

SEQ ID NO: 75419 - DNA, 103 bp, Artificial Sequence
  Synthetic Polynucleotide
taatacgactcactatagggtggaattcgccacttggaaagacgttatacaacagaggagagtataaatgctttccaagaacctggcggcagcgcaaaagatg

SEQ ID NO: 75420 - DNA, 103 bp, Artificial Sequence
  Synthetic Polynucleotide
taatacgactcactatagggaaatttggaattcgccacttggaaagacgtaacagaggagaacgtctatgcaagtggcgaacctggcggcagcgcaaaagatg

SEQ ID NO: 75421 - DNA, 103 bp, Artificial Sequence
  Synthetic Polynucleotide
taatacgactcactataggggaaaaaaatttggaattcgccacttggaaaaacagaggagatttccaatgggcgaattcaacctggcggcagcgcaaaagatg

SEQ ID NO: 75422 - DNA, 103 bp, Artificial Sequence
  Synthetic Polynucleotide
taatacgactcactatagggtcaatgaaaaaaatttggaattcgccacttaacagaggagaaagtggatgattccaaataacctggcggcagcgcaaaagatg

SEQ ID NO: 75423 - DNA, 103 bp, Artificial Sequence
  Synthetic Polynucleotide
taatacgactcactatagggtactatcaatgaaaaaaatttggaattcgcaacagaggagagcgaatatgaaattttttaacctggcggcagcgcaaaagatg

SEQ ID NO: 75424 - DNA, 103 bp, Artificial Sequence
  Synthetic Polynucleotide
taatacgactcactatagggttgtcaaacaatcattcttataaatataataacagaggagaattataatgataagaatgaacctggcggcagcgcaaaagatg

SEQ ID NO: 75425 - DNA, 103 bp, Artificial Sequence
  Synthetic Polynucleotide
taatacgactcactatagggtttggtactatcaatgaaaaaaatttggaaaacagaggagattccaaatgtttttcattaacctggcggcagcgcaaaagatg

SEQ ID NO: 75426 - DNA, 103 bp, Artificial Sequence
  Synthetic Polynucleotide
taatacgactcactatagggaagaatttggtactatcaatgaaaaaaattaacagaggagaaattttatgcattgatagaacctggcggcagcgcaaaagatg

SEQ ID NO: 75427 - DNA, 103 bp, Artificial Sequence
  Synthetic Polynucleotide
taatacgactcactataggggatagaagaatttggtactatcaatgaaaaaacagaggagattttcaatgatagtaccaaacctggcggcagcgcaaaagatg

SEQ ID NO: 75428 - DNA, 103 bp, Artificial Sequence
  Synthetic Polynucleotide
taatacgactcactatagggaaagagatagaagaatttggtactatcaataacagaggagaattgatatgaccaaattcaacctggcggcagcgcaaaagatg

SEQ ID NO: 75429 - DNA, 103 bp, Artificial Sequence
  Synthetic Polynucleotide
taatacgactcactatagggtagttaaagagatagaagaatttggtactaaacagaggagatagtacatgattcttctaaacctggcggcagcgcaaaagatg

SEQ ID NO: 75430 - DNA, 103 bp, Artificial Sequence
  Synthetic Polynucleotide
taatacgactcactataggggcaaatagttaaagagatagaagaatttggaacagaggagaccaaatatgtctatctctaacctggcggcagcgcaaaagatg

SEQ ID NO: 75431 - DNA, 103 bp, Artificial Sequence
  Synthetic Polynucleotide
taatacgactcactatagggtctatgcaaatagttaaagagatagaagaaaacagaggagattcttcatgctctttaacaacctggcggcagcgcaaaagatg

SEQ ID NO: 75432 - DNA, 103 bp, Artificial Sequence
  Synthetic Polynucleotide
taatacgactcactatagggacctatctatgcaaatagttaaagagatagaacagaggagactatctatgtaactatttaacctggcggcagcgcaaaagatg

SEQ ID NO: 75433 - DNA, 103 bp, Artificial Sequence
  Synthetic Polynucleotide
taatacgactcactatagggtaattacctatctatgcaaatagttaaagaaacagaggagatctttaatgatttgcataaacctggcggcagcgcaaaagatg

SEQ ID NO: 75434 - DNA, 103 bp, Artificial Sequence
  Synthetic Polynucleotide
taatacgactcactatagggcactgtaattacctatctatgcaaatagttaacagaggagaaactatatgcatagatagaacctggcggcagcgcaaaagatg

SEQ ID NO: 75435 - DNA, 103 bp, Artificial Sequence
  Synthetic Polynucleotide
taatacgactcactataggggtgatttgtcaaacaatcattcttataaataacagaggagaatttatatgaatgattgtaacctggcggcagcgcaaaagatg

SEQ ID NO: 75436 - DNA, 103 bp, Artificial Sequence
  Synthetic Polynucleotide
taatacgactcactataggggacatcactgtaattacctatctatgcaaaaacagaggagatttgcaatgataggtaataacctggcggcagcgcaaaagatg

SEQ ID NO: 75437 - DNA, 103 bp, Artificial Sequence
  Synthetic Polynucleotide
taatacgactcactatagggatgtagacatcactgtaattacctatctataacagaggagaatagatatgtaattacagaacctggcggcagcgcaaaagatg

SEQ ID NO: 75438 - DNA, 103 bp, Artificial Sequence
  Synthetic Polynucleotide
taatacgactcactatagggacggcatgtagacatcactgtaattacctaaacagaggagataggtaatgacagtgatgaacctggcggcagcgcaaaagatg

SEQ ID NO: 75439 - DNA, 103 bp, Artificial Sequence
  Synthetic Polynucleotide
taatacgactcactatagggaaaaaacggcatgtagacatcactgtaattaacagaggagaaattacatggatgtctacaacctggcggcagcgcaaaagatg

SEQ ID NO: 75440 - DNA, 103 bp, Artificial Sequence
  Synthetic Polynucleotide
taatacgactcactataggggtttcaaaaaacggcatgtagacatcactgaacagaggagacagtgaatgctacatgccaacctggcggcagcgcaaaagatg

SEQ ID NO: 75441 - DNA, 103 bp, Artificial Sequence
  Synthetic Polynucleotide
taatacgactcactatagggattcagtttcaaaaaacggcatgtagacataacagaggagaatgtctatgtgccgttttaacctggcggcagcgcaaaagatg

SEQ ID NO: 75442 - DNA, 103 bp, Artificial Sequence
  Synthetic Polynucleotide
taatacgactcactatagggcatctattcagtttcaaaaaacggcatgtaaacagaggagatacatgatgttttttgaaaacctggcggcagcgcaaaagatg

SEQ ID NO: 75443 - DNA, 103 bp, Artificial Sequence
  Synthetic Polynucleotide
taatacgactcactatagggagatgcatctattcagtttcaaaaaacggcaacagaggagagccgttatgtgaaactgaaacctggcggcagcgcaaaagatg

SEQ ID NO: 75444 - DNA, 103 bp, Artificial Sequence
  Synthetic Polynucleotide
taatacgactcactatagggcttttagatgcatctattcagtttcaaaaaaacagaggagatttttgatgctgaatagaaacctggcggcagcgcaaaagatg

SEQ ID NO: 75445 - DNA, 103 bp, Artificial Sequence
  Synthetic Polynucleotide
taatacgactcactatagggcatcgcttttagatgcatctattcagtttcaacagaggagagaaactatgtagatgcataacctggcggcagcgcaaaagatg

SEQ ID NO: 75446 - DNA, 103 bp, Artificial Sequence
  Synthetic Polynucleotide
taatacgactcactatagggttctcgtgatttgtcaaacaatcattcttaaacagaggagataagaaatgttgtttgacaacctggcggcagcgcaaaagatg

SEQ ID NO: 75447 - DNA, 103 bp, Artificial Sequence
  Synthetic Polynucleotide
taatacgactcactatagggcgtagcatcgcttttagatgcatctattcaaacagaggagatgaataatggcatctaaaaacctggcggcagcgcaaaagatg

SEQ ID NO: 75448 - DNA, 103 bp, Artificial Sequence
  Synthetic Polynucleotide
taatacgactcactatagggactagcgtagcatcgcttttagatgcatctaacagaggagaagatgcatgtaaaagcgaaacctggcggcagcgcaaaagatg

SEQ ID NO: 75449 - DNA, 103 bp, Artificial Sequence
  Synthetic Polynucleotide
taatacgactcactatagggtcgtgactagcgtagcatcgcttttagatgaacagaggagacatctaatggcgatgctaaacctggcggcagcgcaaaagatg

SEQ ID NO: 75450 - DNA, 103 bp, Artificial Sequence
  Synthetic Polynucleotide
taatacgactcactatagggggtgatcgtgactagcgtagcatcgcttttaacagaggagaaaaagcatggctacgctaaacctggcggcagcgcaaaagatg

SEQ ID NO: 75451 - DNA, 103 bp, Artificial Sequence
  Synthetic Polynucleotide
taatacgactcactatagggaaagtggtgatcgtgactagcgtagcatcgaacagaggagacgatgcatggctagtcacaacctggcggcagcgcaaaagatg

SEQ ID NO: 75452 - DNA, 103 bp, Artificial Sequence
  Synthetic Polynucleotide
taatacgactcactatagggatatgaaagtggtgatcgtgactagcgtagaacagaggagactacgcatgtcacgatcaaacctggcggcagcgcaaaagatg

SEQ ID NO: 75453 - DNA, 103 bp, Artificial Sequence
  Synthetic Polynucleotide
taatacgactcactatagggtctaaatatgaaagtggtgatcgtgactagaacagaggagactagtcatgatcaccactaacctggcggcagcgcaaaagatg

SEQ ID NO: 75454 - DNA, 103 bp, Artificial Sequence
  Synthetic Polynucleotide
taatacgactcactatagggtatattctaaatatgaaagtggtgatcgtgaacagaggagacacgatatgcactttcataacctggcggcagcgcaaaagatg

SEQ ID NO: 75455 - DNA, 103 bp, Artificial Sequence
  Synthetic Polynucleotide
taatacgactcactatagggatacatatattctaaatatgaaagtggtgaaacagaggagatcaccaatgtcatatttaaacctggcggcagcgcaaaagatg

SEQ ID NO: 75456 - DNA, 103 bp, Artificial Sequence
  Synthetic Polynucleotide
taatacgactcactatagggtttacatacatatattctaaatatgaaagtaacagaggagaactttcatgtttagaataaacctggcggcagcgcaaaagatg

SEQ ID NO: 75457 - DNA, 103 bp, Artificial Sequence
  Synthetic Polynucleotide
taatacgactcactatagggctcttggatcatatccgcactgctaaatacaacagaggagagtatttatgagtgcggataacctggcggcagcgcaaaagatg

SEQ ID NO: 75458 - DNA, 103 bp, Artificial Sequence
  Synthetic Polynucleotide
taatacgactcactatagggaatagttctcgtgatttgtcaaacaatcataacagaggagaatgattatgtgacaaatcaacctggcggcagcgcaaaagatg

SEQ ID NO: 75459 - DNA, 103 bp, Artificial Sequence
  Synthetic Polynucleotide
taatacgactcactatagggatatttttacatacatatattctaaatatgaacagaggagacatattatgaatatatgtaacctggcggcagcgcaaaagatg

SEQ ID NO: 75460 - DNA, 103 bp, Artificial Sequence
  Synthetic Polynucleotide
taatacgactcactatagggctactatatttttacatacatatattctaaaacagaggagattagaaatgatgtatgtaaacctggcggcagcgcaaaagatg

SEQ ID NO: 75461 - DNA, 103 bp, Artificial Sequence
  Synthetic Polynucleotide
taatacgactcactatagggaaattctactatatttttacatacatatataacagaggagaatatatatgtgtaaaaataacctggcggcagcgcaaaagatg

SEQ ID NO: 75462 - DNA, 103 bp, Artificial Sequence
  Synthetic Polynucleotide
taatacgactcactatagggaaatgaaattctactatatttttacatacaaacagaggagatgtatgatgaaatatagtaacctggcggcagcgcaaaagatg

SEQ ID NO: 75463 - DNA, 103 bp, Artificial Sequence
  Synthetic Polynucleotide
taatacgactcactatagggaaacaaaatgaaattctactatatttttacaacagaggagagtaaaaatgtagtagaataacctggcggcagcgcaaaagatg

SEQ ID NO: 75464 - DNA, 103 bp, Artificial Sequence
  Synthetic Polynucleotide
taatacgactcactataggggaaaaaaacaaaatgaaattctactatattaacagaggagaaatataatggaatttcataacctggcggcagcgcaaaagatg

SEQ ID NO: 75465 - DNA, 103 bp, Artificial Sequence
  Synthetic Polynucleotide
taatacgactcactataggggcatagaaaaaaacaaaatgaaattctactaacagaggagaagtagaatgtcattttgtaacctggcggcagcgcaaaagatg

SEQ ID NO: 75466 - DNA, 103 bp, Artificial Sequence
  Synthetic Polynucleotide
taatacgactcactatagggttatagcatagaaaaaaacaaaatgaaattaacagaggagaaatttcatgttgttttttaacctggcggcagcgcaaaagatg

SEQ ID NO: 75467 - DNA, 103 bp, Artificial Sequence
  Synthetic Polynucleotide
taatacgactcactatagggttcatttatagcatagaaaaaaacaaaatgaacagaggagacattttatgtttttctataacctggcggcagcgcaaaagatg

SEQ ID NO: 75468 - DNA, 103 bp, Artificial Sequence
  Synthetic Polynucleotide
taatacgactcactataggggagaattcatttatagcatagaaaaaaacaaacagaggagatgttttatgctatgctataacctggcggcagcgcaaaagatg

SEQ ID NO: 75469 - DNA, 103 bp, Artificial Sequence
  Synthetic Polynucleotide
taatacgactcactataggggtcttaatagttctcgtgatttgtcaaacaaacagaggagatgtttgatgaatcacgagaacctggcggcagcgcaaaagatg

SEQ ID NO: 75470 - DNA, 103 bp, Artificial Sequence
  Synthetic Polynucleotide
taatacgactcactatagggaaaatgagaattcatttatagcatagaaaaaacagaggagattttctatgctataaatgaacctggcggcagcgcaaaagatg

SEQ ID NO: 75471 - DNA, 103 bp, Artificial Sequence
  Synthetic Polynucleotide
taatacgactcactataggggatgcaaaatgagaattcatttatagcataaacagaggagatatgctatgaatgaattcaacctggcggcagcgcaaaagatg

SEQ ID NO: 75472 - DNA, 103 bp, Artificial Sequence
  Synthetic Polynucleotide
taatacgactcactataggggggcagatgcaaaatgagaattcatttataaacagaggagatataaaatgattctcattaacctggcggcagcgcaaaagatg

SEQ ID NO: 75473 - DNA, 103 bp, Artificial Sequence
  Synthetic Polynucleotide
taatacgactcactatagggagtatgggcagatgcaaaatgagaattcataacagaggagaatgaatatgcattttgcaaacctggcggcagcgcaaaagatg

SEQ ID NO: 75474 - DNA, 103 bp, Artificial Sequence
  Synthetic Polynucleotide
taatacgactcactatagggaacggagtatgggcagatgcaaaatgagaaaacagaggagattctcaatgtgcatctgcaacctggcggcagcgcaaaagatg

SEQ ID NO: 75475 - DNA, 103 bp, Artificial Sequence
  Synthetic Polynucleotide
taatacgactcactatagggtataaaacggagtatgggcagatgcaaaataacagaggagaattttgatgctgcccataaacctggcggcagcgcaaaagatg

SEQ ID NO: 75476 - DNA, 103 bp, Artificial Sequence
  Synthetic Polynucleotide
taatacgactcactatagggattgatataaaacggagtatgggcagatgcaacagaggagagcatctatgcatactccgaacctggcggcagcgcaaaagatg

SEQ ID NO: 75477 - DNA, 103 bp, Artificial Sequence
  Synthetic Polynucleotide
taatacgactcactatagggttggtattgatataaaacggagtatgggcaaacagaggagatgcccaatgtccgttttaaacctggcggcagcgcaaaagatg

SEQ ID NO: 75478 - DNA, 103 bp, Artificial Sequence
  Synthetic Polynucleotide
taatacgactcactatagggcttctttggtattgatataaaacggagtataacagaggagaatactcatgtttatatcaaacctggcggcagcgcaaaagatg

SEQ ID NO: 75479 - DNA, 103 bp, Artificial Sequence
  Synthetic Polynucleotide
taatacgactcactatagggtcttccttctttggtattgatataaaacggaacagaggagaccgtttatgatcaataccaacctggcggcagcgcaaaagatg

SEQ ID NO: 75480 - DNA, 103 bp, Artificial Sequence
  Synthetic Polynucleotide
taatacgactcactatagggtatatgtcttaatagttctcgtgatttgtcaacagaggagagacaaaatgcgagaactaaacctggcggcagcgcaaaagatg

SEQ ID NO: 75481 - DNA, 103 bp, Artificial Sequence
  Synthetic Polynucleotide
taatacgactcactatagggagatatcttccttctttggtattgatataaaacagaggagattatatatgtaccaaagaaacctggcggcagcgcaaaagatg

SEQ ID NO: 75482 - DNA, 103 bp, Artificial Sequence
  Synthetic Polynucleotide
taatacgactcactataggggaaccagatatcttccttctttggtattgaaacagaggagatcaataatgaagaaggaaaacctggcggcagcgcaaaagatg

SEQ ID NO: 75483 - DNA, 103 bp, Artificial Sequence
  Synthetic Polynucleotide
taatacgactcactatagggttttagaaccagatatcttccttctttggtaacagaggagaaccaaaatgggaagatataacctggcggcagcgcaaaagatg

SEQ ID NO: 75484 - DNA, 103 bp, Artificial Sequence
  Synthetic Polynucleotide
taatacgactcactatagggacagcttttagaaccagatatcttccttctaacagaggagaagaaggatgatatctggtaacctggcggcagcgcaaaagatg

SEQ ID NO: 75485 - DNA, 103 bp, Artificial Sequence
  Synthetic Polynucleotide
taatacgactcactatagggctttaacagcttttagaaccagatatcttcaacagaggagagaagatatgtggttctaaaacctggcggcagcgcaaaagatg

SEQ ID NO: 75486 - DNA, 103 bp, Artificial Sequence
  Synthetic Polynucleotide
taatacgactcactataggggcatactttaacagcttttagaaccagataaacagaggagatatctgatgctaaaagctaacctggcggcagcgcaaaagatg

SEQ ID NO: 75487 - DNA, 103 bp, Artificial Sequence
  Synthetic Polynucleotide
taatacgactcactatagggacatcgcatactttaacagcttttagaaccaacagaggagaggttctatgagctgttaaaacctggcggcagcgcaaaagatg

SEQ ID NO: 75488 - DNA, 103 bp, Artificial Sequence
  Synthetic Polynucleotide
taatacgactcactatagggttctaacatcgcatactttaacagcttttaaacagaggagataaaagatgttaaagtataacctggcggcagcgcaaaagatg

SEQ ID NO: 75489 - DNA, 103 bp, Artificial Sequence
  Synthetic Polynucleotide
taatacgactcactatagggtacagttctaacatcgcatactttaacagcaacagaggagagctgttatggtatgcgataacctggcggcagcgcaaaagatg

SEQ ID NO: 75490 - DNA, 103 bp, Artificial Sequence
  Synthetic Polynucleotide
taatacgactcactatagggaattctacagttctaacatcgcatactttaaacagaggagataaagtatgcgatgttagaacctggcggcagcgcaaaagatg

SEQ ID NO: 75491 - DNA, 103 bp, Artificial Sequence
  Synthetic Polynucleotide
taatacgactcactatagggaataatatatgtcttaatagttctcgtgataacagaggagaatcacgatgactattaagaacctggcggcagcgcaaaagatg

SEQ ID NO: 75492 - DNA, 103 bp, Artificial Sequence
  Synthetic Polynucleotide
taatacgactcactatagggcttcgaattctacagttctaacatcgcataaacagaggagatatgcgatgttagaactgaacctggcggcagcgcaaaagatg

SEQ ID NO: 75493 - DNA, 103 bp, Artificial Sequence
  Synthetic Polynucleotide
taatacgactcactatagggacttccttcgaattctacagttctaacatcaacagaggagagatgttatgactgtagaaaacctggcggcagcgcaaaagatg

SEQ ID NO: 75494 - DNA, 103 bp, Artificial Sequence
  Synthetic Polynucleotide
taatacgactcactataggggctttacttccttcgaattctacagttctaaacagaggagatagaacatgagaattcgaaacctggcggcagcgcaaaagatg

SEQ ID NO: 75495 - DNA, 103 bp, Artificial Sequence
  Synthetic Polynucleotide
taatacgactcactatagggaggaagctttacttccttcgaattctacagaacagaggagactgtagatgtcgaaggaaaacctggcggcagcgcaaaagatg

SEQ ID NO: 75496 - DNA, 103 bp, Artificial Sequence
  Synthetic Polynucleotide
taatacgactcactatagggtacgcaggaagctttacttccttcgaattcaacagaggagagaattcatgggaagtaaaaacctggcggcagcgcaaaagatg

SEQ ID NO: 75497 - DNA, 103 bp, Artificial Sequence
  Synthetic Polynucleotide
taatacgactcactatagggttgagtacgcaggaagctttacttccttcgaacagaggagacgaaggatgtaaagcttcaacctggcggcagcgcaaaagatg

SEQ ID NO: 75498 - DNA, 103 bp, Artificial Sequence
  Synthetic Polynucleotide
taatacgactcactatagggctactttgagtacgcaggaagctttacttcaacagaggagagaagtaatgcttcctgcgaacctggcggcagcgcaaaagatg

SEQ ID NO: 75499 - DNA, 103 bp, Artificial Sequence
  Synthetic Polynucleotide
taatacgactcactatagggtttatctactttgagtacgcaggaagctttaacagaggagaaaagctatgtgcgtactcaacctggcggcagcgcaaaagatg

SEQ ID NO: 75500 - DNA, 103 bp, Artificial Sequence
  Synthetic Polynucleotide
taatacgactcactataggggagggtttatctactttgagtacgcaggaaaacagaggagattcctgatgactcaaagtaacctggcggcagcgcaaaagatg

SEQ ID NO: 75501 - DNA, 103 bp, Artificial Sequence
  Synthetic Polynucleotide
taatacgactcactataggggcgatgagggtttatctactttgagtacgcaacagaggagagcgtacatgaagtagataaacctggcggcagcgcaaaagatg

SEQ ID NO: 75502 - DNA, 103 bp, Artificial Sequence
  Synthetic Polynucleotide
taatacgactcactatagggcctctaataatatatgtcttaatagttctcaacagaggagagagaacatgtaagacataaacctggcggcagcgcaaaagatg

SEQ ID NO: 75503 - DNA, 103 bp, Artificial Sequence
  Synthetic Polynucleotide
taatacgactcactatagggcgcgggcgatgagggtttatctactttgagaacagaggagactcaaaatggataaacccaacctggcggcagcgcaaaagatg

SEQ ID NO: 75504 - DNA, 103 bp, Artificial Sequence
  Synthetic Polynucleotide
taatacgactcactatagggtcgctcgcgggcgatgagggtttatctactaacagaggagaagtagaatgaccctcatcaacctggcggcagcgcaaaagatg

SEQ ID NO: 75505 - DNA, 103 bp, Artificial Sequence
  Synthetic Polynucleotide
taatacgactcactatagggttctctcgctcgcgggcgatgagggtttataacagaggagaataaacatgcatcgcccgaacctggcggcagcgcaaaagatg

SEQ ID NO: 75506 - DNA, 103 bp, Artificial Sequence
  Synthetic Polynucleotide
taatacgactcactatagggaggtcttctctcgctcgcgggcgatgagggaacagaggagaccctcaatgcccgcgagcaacctggcggcagcgcaaaagatg

SEQ ID NO: 75507 - DNA, 103 bp, Artificial Sequence
  Synthetic Polynucleotide
taatacgactcactataggggacgaaggtcttctctcgctcgcgggcgataacagaggagaatcgccatggagcgagagaacctggcggcagcgcaaaagatg

SEQ ID NO: 75508 - DNA, 103 bp, Artificial Sequence
  Synthetic Polynucleotide
taatacgactcactatagggacggtgacgaaggtcttctctcgctcgcggaacagaggagaccgcgaatgagagaagacaacctggcggcagcgcaaaagatg

SEQ ID NO: 75509 - DNA, 103 bp, Artificial Sequence
  Synthetic Polynucleotide
taatacgactcactatagggtctggacggtgacgaaggtcttctctcgctaacagaggagaagcgagatgagaccttcgaacctggcggcagcgcaaaagatg

SEQ ID NO: 75510 - DNA, 103 bp, Artificial Sequence
  Synthetic Polynucleotide
taatacgactcactatagggtcgcatctggacggtgacgaaggtcttctcaacagaggagagagaagatgttcgtcaccaacctggcggcagcgcaaaagatg

SEQ ID NO: 75511 - DNA, 103 bp, Artificial Sequence
  Synthetic Polynucleotide
taatacgactcactatagggttctctcgcatctggacggtgacgaaggtcaacagaggagagaccttatgcaccgtccaaacctggcggcagcgcaaaagatg

SEQ ID NO: 75512 - DNA, 103 bp, Artificial Sequence
  Synthetic Polynucleotide
taatacgactcactatagggattcattctctcgcatctggacggtgacgaaacagaggagatcgtcaatgtccagatgcaacctggcggcagcgcaaaagatg

SEQ ID NO: 75513 - DNA, 103 bp, Artificial Sequence
  Synthetic Polynucleotide
taatacgactcactatagggatatacctctaataatatatgtcttaatagaacagaggagactattaatgcatatattaaacctggcggcagcgcaaaagatg

SEQ ID NO: 75514 - DNA, 103 bp, Artificial Sequence
  Synthetic Polynucleotide
taatacgactcactataggggggttattcattctctcgcatctggacggtaacagaggagaaccgtcatgatgcgagagaacctggcggcagcgcaaaagatg

SEQ ID NO: 75515 - DNA, 103 bp, Artificial Sequence
  Synthetic Polynucleotide
taatacgactcactatagggttcctgggttattcattctctcgcatctggaacagaggagaccagatatgagagaatgaaacctggcggcagcgcaaaagatg

SEQ ID NO: 75516 - DNA, 103 bp, Artificial Sequence
  Synthetic Polynucleotide
taatacgactcactatagggttgttttcctgggttattcattctctcgcaaacagaggagatgcgagatgatgaataacaacctggcggcagcgcaaaagatg

SEQ ID NO: 75517 - DNA, 103 bp, Artificial Sequence
  Synthetic Polynucleotide
taatacgactcactatagggggaacttgttttcctgggttattcattctcaacagaggagagagaatatgtaacccaggaacctggcggcagcgcaaaagatg

SEQ ID NO: 75518 - DNA, 103 bp, Artificial Sequence
  Synthetic Polynucleotide
taatacgactcactatagggtaaacggaacttgttttcctgggttattcaaacagaggagatgaataatgcaggaaaacaacctggcggcagcgcaaaagatg

SEQ ID NO: 75519 - DNA, 103 bp, Artificial Sequence
  Synthetic Polynucleotide
taatacgactcactatagggcctcataaacggaacttgttttcctgggttaacagaggagaaacccaatgaaacaagttaacctggcggcagcgcaaaagatg

SEQ ID NO: 75520 - DNA, 103 bp, Artificial Sequence
  Synthetic Polynucleotide
taatacgactcactatagggtccgtcctcataaacggaacttgttttcctaacagaggagaaggaaaatgagttccgttaacctggcggcagcgcaaaagatg

SEQ ID NO: 75521 - DNA, 103 bp, Artificial Sequence
  Synthetic Polynucleotide
taatacgactcactataggggcatgtccgtcctcataaacggaacttgttaacagaggagaaacaagatgcgtttatgaaacctggcggcagcgcaaaagatg

SEQ ID NO: 75522 - DNA, 103 bp, Artificial Sequence
  Synthetic Polynucleotide
taatacgactcactatagggttgtagcatgtccgtcctcataaacggaacaacagaggagagttccgatgatgaggacgaacctggcggcagcgcaaaagatg

SEQ ID NO: 75523 - DNA, 103 bp, Artificial Sequence
  Synthetic Polynucleotide
taatacgactcactatagggatattttgtagcatgtccgtcctcataaacaacagaggagagtttatatggacggacataacctggcggcagcgcaaaagatg

SEQ ID NO: 75524 - DNA, 103 bp, Artificial Sequence
  Synthetic Polynucleotide
taatacgactcactatagggataatatatacctctaataatatatgtcttaacagaggagaaagacaatgattattagaaacctggcggcagcgcaaaagatg

SEQ ID NO: 75525 - DNA, 103 bp, Artificial Sequence
  Synthetic Polynucleotide
taatacgactcactatagggcgaacatattttgtagcatgtccgtcctcaaacagaggagatgaggaatgacatgctacaacctggcggcagcgcaaaagatg

SEQ ID NO: 75526 - DNA, 103 bp, Artificial Sequence
  Synthetic Polynucleotide
taatacgactcactatagggagccgcgaacatattttgtagcatgtccgtaacagaggagaacggacatgctacaaaataacctggcggcagcgcaaaagatg

SEQ ID NO: 75527 - DNA, 103 bp, Artificial Sequence
  Synthetic Polynucleotide
taatacgactcactatagggcgattagccgcgaacatattttgtagcatgaacagaggagacatgctatgaaatatgttaacctggcggcagcgcaaaagatg

SEQ ID NO: 75528 - DNA, 103 bp, Artificial Sequence
  Synthetic Polynucleotide
taatacgactcactatagggtatcgcgattagccgcgaacatattttgtaaacagaggagatacaaaatgtgttcgcggaacctggcggcagcgcaaaagatg

SEQ ID NO: 75529 - DNA, 103 bp, Artificial Sequence
  Synthetic Polynucleotide
taatacgactcactatagggtacattatcgcgattagccgcgaacatattaacagaggagaaatatgatggcggctaataacctggcggcagcgcaaaagatg

SEQ ID NO: 75530 - DNA, 103 bp, Artificial Sequence
  Synthetic Polynucleotide
taatacgactcactataggggaagctacattatcgcgattagccgcgaacaacagaggagagttcgcatgtaatcgcgaaacctggcggcagcgcaaaagatg

SEQ ID NO: 75531 - DNA, 103 bp, Artificial Sequence
  Synthetic Polynucleotide
taatacgactcactataggggtctagaagctacattatcgcgattagccgaacagaggagacggctaatggcgataatgaacctggcggcagcgcaaaagatg

SEQ ID NO: 75532 - DNA, 103 bp, Artificial Sequence
  Synthetic Polynucleotide
taatacgactcactatagggcaaaagtctagaagctacattatcgcgattaacagaggagaaatcgcatgaatgtagctaacctggcggcagcgcaaaagatg

SEQ ID NO: 75533 - DNA, 103 bp, Artificial Sequence
  Synthetic Polynucleotide
taatacgactcactatagggtaggacaaaagtctagaagctacattatcgaacagaggagacgataaatgagcttctagaacctggcggcagcgcaaaagatg

SEQ ID NO: 75534 - DNA, 103 bp, Artificial Sequence
  Synthetic Polynucleotide
taatacgactcactatagggtattttaggacaaaagtctagaagctacataacagaggagaatgtagatgctagactttaacctggcggcagcgcaaaagatg

SEQ ID NO: 75535 - DNA, 103 bp, Artificial Sequence
  Synthetic Polynucleotide
taatacgactcactatagggtttttataatatatacctctaataatatataacagaggagaatatatatgtagaggtataacctggcggcagcgcaaaagatg

SEQ ID NO: 75536 - DNA, 103 bp, Artificial Sequence
  Synthetic Polynucleotide
taatacgactcactatagggaatagtattttaggacaaaagtctagaagcaacagaggagagcttctatgcttttgtccaacctggcggcagcgcaaaagatg

SEQ ID NO: 75537 - DNA, 103 bp, Artificial Sequence
  Synthetic Polynucleotide
taatacgactcactataggggatataatagtattttaggacaaaagtctaaacagaggagatagactatggtcctaaaaaacctggcggcagcgcaaaagatg

SEQ ID NO: 75538 - DNA, 103 bp, Artificial Sequence
  Synthetic Polynucleotide
taatacgactcactatagggaaaaagatataatagtattttaggacaaaaaacagaggagattttgtatgaaaatactaaacctggcggcagcgcaaaagatg

SEQ ID NO: 75539 - DNA, 103 bp, Artificial Sequence
  Synthetic Polynucleotide
taatacgactcactatagggtatcgaaaaagatataatagtattttaggaaacagaggagatcctaaatgactattataaacctggcggcagcgcaaaagatg

SEQ ID NO: 75540 - DNA, 103 bp, Artificial Sequence
  Synthetic Polynucleotide
taatacgactcactatagggattaatatcgaaaaagatataatagtatttaacagaggagaaaatacatgtatatctttaacctggcggcagcgcaaaagatg

SEQ ID NO: 75541 - DNA, 103 bp, Artificial Sequence
  Synthetic Polynucleotide
taatacgactcactataggggatttattaatatcgaaaaagatataatagaacagaggagactattaatgctttttcgaaacctggcggcagcgcaaaagatg

SEQ ID NO: 75542 - DNA, 103 bp, Artificial Sequence
  Synthetic Polynucleotide
taatacgactcactatagggacacggatttattaatatcgaaaaagatataacagaggagaatatctatgtcgatattaaacctggcggcagcgcaaaagatg

SEQ ID NO: 75543 - DNA, 103 bp, Artificial Sequence
  Synthetic Polynucleotide
taatacgactcactataggggggcgacacggatttattaatatcgaaaaaaacagaggagatttttcatgattaataaaaacctggcggcagcgcaaaagatg

SEQ ID NO: 75544 - DNA, 103 bp, Artificial Sequence
  Synthetic Polynucleotide
taatacgactcactatagggaacatgggcgacacggatttattaatatcgaacagaggagacgatatatgtaaatccgtaacctggcggcagcgcaaaagatg

SEQ ID NO: 75545 - DNA, 103 bp, Artificial Sequence
  Synthetic Polynucleotide
taatacgactcactatagggtaaaaaacatgggcgacacggatttattaaaacagaggagattaataatgccgtgtcgcaacctggcggcagcgcaaaagatg

SEQ ID NO: 75546 - DNA, 103 bp, Artificial Sequence
  Synthetic Polynucleotide
taatacgactcactatagggaaacttttttataatatatacctctaataaaacagaggagattattaatggtatatattaacctggcggcagcgcaaaagatg

SEQ ID NO: 75547 - DNA, 103 bp, Artificial Sequence
  Synthetic Polynucleotide
taatacgactcactatagggagagataaaaaacatgggcgacacggatttaacagaggagaaaatccatgtcgcccatgaacctggcggcagcgcaaaagatg

SEQ ID NO: 75548 - DNA, 103 bp, Artificial Sequence
  Synthetic Polynucleotide
taatacgactcactatagggctgaaagagataaaaaacatgggcgacacgaacagaggagacgtgtcatgcatgtttttaacctggcggcagcgcaaaagatg

SEQ ID NO: 75549 - DNA, 103 bp, Artificial Sequence
  Synthetic Polynucleotide
taatacgactcactatagggacatactgaaagagataaaaaacatgggcgaacagaggagacgcccaatgtttttatctaacctggcggcagcgcaaaagatg

SEQ ID NO: 75550 - DNA, 103 bp, Artificial Sequence
  Synthetic Polynucleotide
taatacgactcactatagggtattcacatactgaaagagataaaaaacataacagaggagaatgtttatgatctctttcaacctggcggcagcgcaaaagatg

SEQ ID NO: 75551 - DNA, 103 bp, Artificial Sequence
  Synthetic Polynucleotide
taatacgactcactatagggctatctattcacatactgaaagagataaaaaacagaggagattttatatgtttcagtataacctggcggcagcgcaaaagatg

SEQ ID NO: 75552 - DNA, 103 bp, Artificial Sequence
  Synthetic Polynucleotide
taatacgactcactatagggaatacctatctattcacatactgaaagagaaacagaggagatctcttatggtatgtgaaaacctggcggcagcgcaaaagatg

SEQ ID NO: 75553 - DNA, 103 bp, Artificial Sequence
  Synthetic Polynucleotide
taatacgactcactataggggataaaatacctatctattcacatactgaaaacagaggagattcagtatgtgaatagataacctggcggcagcgcaaaagatg

SEQ ID NO: 75554 - DNA, 103 bp, Artificial Sequence
  Synthetic Polynucleotide
taatacgactcactatagggatagagataaaatacctatctattcacataaacagaggagatatgtgatgagataggtaaacctggcggcagcgcaaaagatg

SEQ ID NO: 75555 - DNA, 103 bp, Artificial Sequence
  Synthetic Polynucleotide
taatacgactcactataggggatgaatagagataaaatacctatctattcaacagaggagagaatagatgggtattttaaacctggcggcagcgcaaaagatg

SEQ ID NO: 75556 - DNA, 103 bp, Artificial Sequence
  Synthetic Polynucleotide
taatacgactcactatagggtcgatgatgaatagagataaaatacctatcaacagaggagagataggatgtttatctctaacctggcggcagcgcaaaagatg

SEQ ID NO: 75557 - DNA, 103 bp, Artificial Sequence
  Synthetic Polynucleotide
taatacgactcactatagggatcaaaaacttttttataatatatacctctaacagaggagaagaggtatgtattataaaaacctggcggcagcgcaaaagatg

SEQ ID NO: 75558 - DNA, 103 bp, Artificial Sequence
  Synthetic Polynucleotide
taatacgactcactatagggtaaattcgatgatgaatagagataaaatacaacagaggagagtatttatgctctattcaaacctggcggcagcgcaaaagatg

SEQ ID NO: 75559 - DNA, 103 bp, Artificial Sequence
  Synthetic Polynucleotide
taatacgactcactatagggtctcttaaattcgatgatgaatagagataaaacagaggagattatctatgttcatcatcaacctggcggcagcgcaaaagatg

SEQ ID NO: 75560 - DNA, 103 bp, Artificial Sequence
  Synthetic Polynucleotide
taatacgactcactatagggtcggatctcttaaattcgatgatgaatagaaacagaggagatctattatgcatcgaattaacctggcggcagcgcaaaagatg

SEQ ID NO: 75561 - DNA, 103 bp, Artificial Sequence
  Synthetic Polynucleotide
taatacgactcactataggggtttatcggatctcttaaattcgatgatgaaacagaggagatcatcaatgaatttaagaaacctggcggcagcgcaaaagatg

SEQ ID NO: 75562 - DNA, 103 bp, Artificial Sequence
  Synthetic Polynucleotide
taatacgactcactatagggacaatgtttatcggatctcttaaattcgataacagaggagaatcgaaatgaagagatccaacctggcggcagcgcaaaagatg

SEQ ID NO: 75563 - DNA, 103 bp, Artificial Sequence
  Synthetic Polynucleotide
taatacgactcactatagggtacaaacaatgtttatcggatctcttaaataacagaggagaatttaaatgatccgataaaacctggcggcagcgcaaaagatg

SEQ ID NO: 75564 - DNA, 103 bp, Artificial Sequence
  Synthetic Polynucleotide
taatacgactcactataggggagcatacaaacaatgtttatcggatctctaacagaggagaagagatatgataaacattaacctggcggcagcgcaaaagatg

SEQ ID NO: 75565 - DNA, 103 bp, Artificial Sequence
  Synthetic Polynucleotide
taatacgactcactatagggatctggagcatacaaacaatgtttatcggaaacagaggagatccgatatgcattgtttgaacctggcggcagcgcaaaagatg

SEQ ID NO: 75566 - DNA, 103 bp, Artificial Sequence
  Synthetic Polynucleotide
taatacgactcactatagggctgacatctggagcatacaaacaatgtttaaacagaggagataaacaatgtttgtatgcaacctggcggcagcgcaaaagatg

SEQ ID NO: 75567 - DNA, 103 bp, Artificial Sequence
  Synthetic Polynucleotide
taatacgactcactatagggagatgctgacatctggagcatacaaacaataacagaggagaattgttatgatgctccagaacctggcggcagcgcaaaagatg

SEQ ID NO: 75568 - DNA, 103 bp, Artificial Sequence
  Synthetic Polynucleotide
taatacgactcactatagggaccattctgatgcatcaactatttctcaaaaacagaggagatttgagatgtagttgatgaacctggcggcagcgcaaaagatg

SEQ ID NO: 75569 - DNA, 103 bp, Artificial Sequence
  Synthetic Polynucleotide
taatacgactcactatagggtcaccctcttggatcatatccgcactgctaaacagaggagatagcagatgggatatgataacctggcggcagcgcaaaagatg

SEQ ID NO: 75570 - DNA, 103 bp, Artificial Sequence
  Synthetic Polynucleotide
taatacgactcactatagggtcgtaatcaaaaacttttttataatatataaacagaggagatatataatgtaaaaaagtaacctggcggcagcgcaaaagatg

SEQ ID NO: 75571 - DNA, 103 bp, Artificial Sequence
  Synthetic Polynucleotide
taatacgactcactataggggtatcagatgctgacatctggagcatacaaaacagaggagattgtatatgccagatgtcaacctggcggcagcgcaaaagatg

SEQ ID NO: 75572 - DNA, 103 bp, Artificial Sequence
  Synthetic Polynucleotide
taatacgactcactatagggttgttgtatcagatgctgacatctggagcaaacagaggagatgctccatgtgtcagcataacctggcggcagcgcaaaagatg

SEQ ID NO: 75573 - DNA, 103 bp, Artificial Sequence
  Synthetic Polynucleotide
taatacgactcactatagggatatattgttgtatcagatgctgacatctgaacagaggagacagatgatggcatctgataacctggcggcagcgcaaaagatg

SEQ ID NO: 75574 - DNA, 103 bp, Artificial Sequence
  Synthetic Polynucleotide
taatacgactcactatagggtgcacatatattgttgtatcagatgctgacaacagaggagagtcagcatgtgatacaacaacctggcggcagcgcaaaagatg

SEQ ID NO: 75575 - DNA, 103 bp, Artificial Sequence
  Synthetic Polynucleotide
taatacgactcactatagggttatgtgcacatatattgttgtatcagatgaacagaggagacatctgatgcaacaatataacctggcggcagcgcaaaagatg

SEQ ID NO: 75576 - DNA, 103 bp, Artificial Sequence
  Synthetic Polynucleotide
taatacgactcactataggggaggtttatgtgcacatatattgttgtatcaacagaggagagatacaatgatatatgtgaacctggcggcagcgcaaaagatg

SEQ ID NO: 75577 - DNA, 103 bp, Artificial Sequence
  Synthetic Polynucleotide
taatacgactcactatagggtgccagaggtttatgtgcacatatattgttaacagaggagaaacaatatgtgtgcacataacctggcggcagcgcaaaagatg

SEQ ID NO: 75578 - DNA, 103 bp, Artificial Sequence
  Synthetic Polynucleotide
taatacgactcactatagggataagtgccagaggtttatgtgcacatataaacagaggagatatatgatgacataaaccaacctggcggcagcgcaaaagatg

SEQ ID NO: 75579 - DNA, 103 bp, Artificial Sequence
  Synthetic Polynucleotide
taatacgactcactatagggacgaaataagtgccagaggtttatgtgcacaacagaggagagtgcacatgaacctctggaacctggcggcagcgcaaaagatg

SEQ ID NO: 75580 - DNA, 103 bp, Artificial Sequence
  Synthetic Polynucleotide
taatacgactcactatagggggtacacgaaataagtgccagaggtttatgaacagaggagacataaaatgctggcacttaacctggcggcagcgcaaaagatg

SEQ ID NO: 75581 - DNA, 103 bp, Artificial Sequence
  Synthetic Polynucleotide
taatacgactcactatagggtaacatcgtaatcaaaaacttttttataataacagaggagaattataatgaagtttttgaacctggcggcagcgcaaaagatg

SEQ ID NO: 75582 - DNA, 103 bp, Artificial Sequence
  Synthetic Polynucleotide
taatacgactcactataggggggaaggtacacgaaataagtgccagaggtaacagaggagaacctctatgacttatttcaacctggcggcagcgcaaaagatg

SEQ ID NO: 75583 - DNA, 103 bp, Artificial Sequence
  Synthetic Polynucleotide
taatacgactcactatagggataaggggaaggtacacgaaataagtgccaaacagaggagatggcacatgtttcgtgtaaacctggcggcagcgcaaaagatg

SEQ ID NO: 75584 - DNA, 103 bp, Artificial Sequence
  Synthetic Polynucleotide
taatacgactcactatagggtagtgataaggggaaggtacacgaaataagaacagaggagacttattatgtgtaccttcaacctggcggcagcgcaaaagatg

SEQ ID NO: 75585 - DNA, 103 bp, Artificial Sequence
  Synthetic Polynucleotide
taatacgactcactatagggctccttagtgataaggggaaggtacacgaaaacagaggagattcgtgatgcttccccttaacctggcggcagcgcaaaagatg

SEQ ID NO: 75586 - DNA, 103 bp, Artificial Sequence
  Synthetic Polynucleotide
taatacgactcactatagggctattctccttagtgataaggggaaggtacaacagaggagagtacctatgccttatcacaacctggcggcagcgcaaaagatg

SEQ ID NO: 75587 - DNA, 103 bp, Artificial Sequence
  Synthetic Polynucleotide
taatacgactcactatagggaaatactattctccttagtgataaggggaaaacagaggagattccccatgtcactaaggaacctggcggcagcgcaaaagatg

SEQ ID NO: 75588 - DNA, 103 bp, Artificial Sequence
  Synthetic Polynucleotide
taatacgactcactatagggttctcaaatactattctccttagtgataagaacagaggagacttatcatgaaggagaataacctggcggcagcgcaaaagatg

SEQ ID NO: 75589 - DNA, 103 bp, Artificial Sequence
  Synthetic Polynucleotide
taatacgactcactatagggcatatttctcaaatactattctccttagtgaacagaggagacactaaatggaatagtataacctggcggcagcgcaaaagatg

SEQ ID NO: 75590 - DNA, 103 bp, Artificial Sequence
  Synthetic Polynucleotide
taatacgactcactataggggtatacatatttctcaaatactattctcctaacagaggagaaggagaatggtatttgagaacctggcggcagcgcaaaagatg

SEQ ID NO: 75591 - DNA, 103 bp, Artificial Sequence
  Synthetic Polynucleotide
taatacgactcactatagggattatgtatacatatttctcaaatactattaacagaggagaaatagtatgtgagaaataaacctggcggcagcgcaaaagatg

SEQ ID NO: 75592 - DNA, 103 bp, Artificial Sequence
  Synthetic Polynucleotide
taatacgactcactatagggtcttataacatcgtaatcaaaaacttttttaacagaggagaaaaaaaatgtttgattacaacctggcggcagcgcaaaagatg

SEQ ID NO: 75593 - DNA, 103 bp, Artificial Sequence
  Synthetic Polynucleotide
taatacgactcactatagggataatattatgtatacatatttctcaaataaacagaggagatatttgatgaatatgtataacctggcggcagcgcaaaagatg

SEQ ID NO: 75594 - DNA, 103 bp, Artificial Sequence
  Synthetic Polynucleotide
taatacgactcactatagggtcatgataatattatgtatacatatttctcaacagaggagagagaaaatggtatacataaacctggcggcagcgcaaaagatg

SEQ ID NO: 75595 - DNA, 103 bp, Artificial Sequence
  Synthetic Polynucleotide
taatacgactcactatagggctaattcatgataatattatgtatacatataacagaggagaatatgtatgcataatattaacctggcggcagcgcaaaagatg

SEQ ID NO: 75596 - DNA, 103 bp, Artificial Sequence
  Synthetic Polynucleotide
taatacgactcactatagggtatatctaattcatgataatattatgtataaacagaggagatatacaatgtattatcataacctggcggcagcgcaaaagatg

SEQ ID NO: 75597 - DNA, 103 bp, Artificial Sequence
  Synthetic Polynucleotide
taatacgactcactatagggttctgtatatctaattcatgataatattataacagaggagaataataatgtcatgaattaacctggcggcagcgcaaaagatg

SEQ ID NO: 75598 - DNA, 103 bp, Artificial Sequence
  Synthetic Polynucleotide
taatacgactcactatagggacaaattctgtatatctaattcatgataataacagaggagaattatcatgaattagataaacctggcggcagcgcaaaagatg

SEQ ID NO: 75599 - DNA, 103 bp, Artificial Sequence
  Synthetic Polynucleotide
taatacgactcactataggggtgttacaaattctgtatatctaattcatgaacagaggagacatgaaatggatatacagaacctggcggcagcgcaaaagatg

SEQ ID NO: 75600 - DNA, 103 bp, Artificial Sequence
  Synthetic Polynucleotide
taatacgactcactatagggcgagagtgttacaaattctgtatatctaataacagaggagaattagaatgacagaatttaacctggcggcagcgcaaaagatg

SEQ ID NO: 75601 - DNA, 103 bp, Artificial Sequence
  Synthetic Polynucleotide
taatacgactcactataggggatttcgagagtgttacaaattctgtatataacagaggagaatatacatgatttgtaacaacctggcggcagcgcaaaagatg

SEQ ID NO: 75602 - DNA, 103 bp, Artificial Sequence
  Synthetic Polynucleotide
taatacgactcactatagggcgtgtgatttcgagagtgttacaaattctgaacagaggagacagaatatgtaacactctaacctggcggcagcgcaaaagatg

SEQ ID NO: 75603 - DNA, 103 bp, Artificial Sequence
  Synthetic Polynucleotide
taatacgactcactatagggtttcctcttataacatcgtaatcaaaaactaacagaggagaagttttatgttacgatgtaacctggcggcagcgcaaaagatg

SEQ ID NO: 75604 - DNA, 103 bp, Artificial Sequence
  Synthetic Polynucleotide
taatacgactcactatagggcacatcgtgtgatttcgagagtgttacaaaaacagaggagatttgtaatgctctcgaaaaacctggcggcagcgcaaaagatg

SEQ ID NO: 75605 - DNA, 103 bp, Artificial Sequence
  Synthetic Polynucleotide
taatacgactcactataggggcagacacatcgtgtgatttcgagagtgttaacagaggagaaacactatggaaatcacaaacctggcggcagcgcaaaagatg

SEQ ID NO: 75606 - DNA, 103 bp, Artificial Sequence
  Synthetic Polynucleotide
taatacgactcactatagggttaacgcagacacatcgtgtgatttcgagaaacagaggagatctcgaatgcacacgatgaacctggcggcagcgcaaaagatg

SEQ ID NO: 75607 - DNA, 103 bp, Artificial Sequence
  Synthetic Polynucleotide
taatacgactcactatagggagatcttaacgcagacacatcgtgtgatttaacagaggagaaaatcaatggatgtgtctaacctggcggcagcgcaaaagatg

SEQ ID NO: 75608 - DNA, 103 bp, Artificial Sequence
  Synthetic Polynucleotide
taatacgactcactatagggatattagatcttaacgcagacacatcgtgtaacagaggagaacacgaatggtctgcgttaacctggcggcagcgcaaaagatg

SEQ ID NO: 75609 - DNA, 103 bp, Artificial Sequence
  Synthetic Polynucleotide
taatacgactcactataggggtgatatattagatcttaacgcagacacataacagaggagaatgtgtatgcgttaagataacctggcggcagcgcaaaagatg

SEQ ID NO: 75610 - DNA, 103 bp, Artificial Sequence
  Synthetic Polynucleotide
taatacgactcactatagggatcgagtgatatattagatcttaacgcagaaacagaggagatctgcgatgagatctaataacctggcggcagcgcaaaagatg

SEQ ID NO: 75611 - DNA, 103 bp, Artificial Sequence
  Synthetic Polynucleotide
taatacgactcactataggggtgttatcgagtgatatattagatcttaacaacagaggagagttaagatgtaatatatcaacctggcggcagcgcaaaagatg

SEQ ID NO: 75612 - DNA, 103 bp, Artificial Sequence
  Synthetic Polynucleotide
taatacgactcactatagggaaaatgtgttatcgagtgatatattagatcaacagaggagagatctaatgtatcactcgaacctggcggcagcgcaaaagatg

SEQ ID NO: 75613 - DNA, 103 bp, Artificial Sequence
  Synthetic Polynucleotide
taatacgactcactatagggagatgaaaatgtgttatcgagtgatatattaacagaggagaaatataatgctcgataacaacctggcggcagcgcaaaagatg

SEQ ID NO: 75614 - DNA, 103 bp, Artificial Sequence
  Synthetic Polynucleotide
taatacgactcactatagggtcctttttcctcttataacatcgtaatcaaaacagaggagattgattatgatgttataaaacctggcggcagcgcaaaagatg

SEQ ID NO: 75615 - DNA, 103 bp, Artificial Sequence
  Synthetic Polynucleotide
taatacgactcactatagggtatctagatgaaaatgtgttatcgagtgataacagaggagaatcactatgtaacacattaacctggcggcagcgcaaaagatg

SEQ ID NO: 75616 - DNA, 103 bp, Artificial Sequence
  Synthetic Polynucleotide
taatacgactcactatagggtagtgtatctagatgaaaatgtgttatcgaaacagaggagatcgataatgcattttcataacctggcggcagcgcaaaagatg

SEQ ID NO: 75617 - DNA, 103 bp, Artificial Sequence
  Synthetic Polynucleotide
taatacgactcactatagggatgtctagtgtatctagatgaaaatgtgttaacagaggagaaacacaatgtcatctagaaacctggcggcagcgcaaaagatg

SEQ ID NO: 75618 - DNA, 103 bp, Artificial Sequence
  Synthetic Polynucleotide
taatacgactcactatagggaaaaaatgtctagtgtatctagatgaaaataacagaggagaattttcatgtagatacacaacctggcggcagcgcaaaagatg

SEQ ID NO: 75619 - DNA, 103 bp, Artificial Sequence
  Synthetic Polynucleotide
taatacgactcactataggggctttaaaaaatgtctagtgtatctagatgaacagaggagacatctaatgacactagacaacctggcggcagcgcaaaagatg

SEQ ID NO: 75620 - DNA, 103 bp, Artificial Sequence
  Synthetic Polynucleotide
taatacgactcactatagggttttagctttaaaaaatgtctagtgtatctaacagaggagaagatacatgagacattttaacctggcggcagcgcaaaagatg

SEQ ID NO: 75621 - DNA, 103 bp, Artificial Sequence
  Synthetic Polynucleotide
taatacgactcactataggggactattttagctttaaaaaatgtctagtgaacagaggagacactagatgttttttaaaaacctggcggcagcgcaaaagatg

SEQ ID NO: 75622 - DNA, 103 bp, Artificial Sequence
  Synthetic Polynucleotide
taatacgactcactatagggctaaagactattttagctttaaaaaatgtcaacagaggagagacattatgtaaagctaaaacctggcggcagcgcaaaagatg

SEQ ID NO: 75623 - DNA, 103 bp, Artificial Sequence
  Synthetic Polynucleotide
taatacgactcactatagggtactactaaagactattttagctttaaaaaaacagaggagatttttaatgctaaaatagaacctggcggcagcgcaaaagatg

SEQ ID NO: 75624 - DNA, 103 bp, Artificial Sequence
  Synthetic Polynucleotide
taatacgactcactatagggactgttactactaaagactattttagctttaacagaggagaaaagctatgatagtctttaacctggcggcagcgcaaaagatg

SEQ ID NO: 75625 - DNA, 103 bp, Artificial Sequence
  Synthetic Polynucleotide
taatacgactcactatagggatgtgtcctttttcctcttataacatcgtaaacagaggagatacgatatgataagaggaaacctggcggcagcgcaaaagatg

SEQ ID NO: 75626 - DNA, 103 bp, Artificial Sequence
  Synthetic Polynucleotide
taatacgactcactatagggtagttactgttactactaaagactattttaaacagaggagataaaatatgctttagtagaacctggcggcagcgcaaaagatg

SEQ ID NO: 75627 - DNA, 103 bp, Artificial Sequence
  Synthetic Polynucleotide
taatacgactcactatagggtcgcgtagttactgttactactaaagactaaacagaggagatagtctatggtagtaacaaacctggcggcagcgcaaaagatg

SEQ ID NO: 75628 - DNA, 103 bp, Artificial Sequence
  Synthetic Polynucleotide
taatacgactcactatagggaataatcgcgtagttactgttactactaaaaacagaggagatttagtatgaacagtaacaacctggcggcagcgcaaaagatg

SEQ ID NO: 75629 - DNA, 103 bp, Artificial Sequence
  Synthetic Polynucleotide
taatacgactcactatagggatgaaaataatcgcgtagttactgttactaaacagaggagatagtaaatgtaactacgcaacctggcggcagcgcaaaagatg

SEQ ID NO: 75630 - DNA, 103 bp, Artificial Sequence
  Synthetic Polynucleotide
taatacgactcactatagggcatcgatgaaaataatcgcgtagttactgtaacagaggagaacagtaatgacgcgattaaacctggcggcagcgcaaaagatg

SEQ ID NO: 75631 - DNA, 103 bp, Artificial Sequence
  Synthetic Polynucleotide
taatacgactcactatagggtgcatcatcgatgaaaataatcgcgtagttaacagaggagaaactacatgattattttcaacctggcggcagcgcaaaagatg

SEQ ID NO: 75632 - DNA, 103 bp, Artificial Sequence
  Synthetic Polynucleotide
taatacgactcactatagggtgaaatgcatcatcgatgaaaataatcgcgaacagaggagacgcgatatgtttcatcgaaacctggcggcagcgcaaaagatg

SEQ ID NO: 75633 - DNA, 103 bp, Artificial Sequence
  Synthetic Polynucleotide
taatacgactcactataggggccgatgaaatgcatcatcgatgaaaataaaacagaggagattatttatgtcgatgatgaacctggcggcagcgcaaaagatg

SEQ ID NO: 75634 - DNA, 103 bp, Artificial Sequence
  Synthetic Polynucleotide
taatacgactcactatagggaatatgccgatgaaatgcatcatcgatgaaaacagaggagattcatcatggatgcatttaacctggcggcagcgcaaaagatg

SEQ ID NO: 75635 - DNA, 103 bp, Artificial Sequence
  Synthetic Polynucleotide
taatacgactcactataggggtaataatatgccgatgaaatgcatcatcgaacagaggagacgatgaatgatttcatcgaacctggcggcagcgcaaaagatg

SEQ ID NO: 75636 - DNA, 103 bp, Artificial Sequence
  Synthetic Polynucleotide
taatacgactcactatagggtgttaatgtgtcctttttcctcttataacaaacagaggagatgttatatgaggaaaaagaacctggcggcagcgcaaaagatg

SEQ ID NO: 75637 - DNA, 103 bp, Artificial Sequence
  Synthetic Polynucleotide
taatacgactcactatagggtaagcgtaataatatgccgatgaaatgcataacagaggagaatgcatatgatcggcataaacctggcggcagcgcaaaagatg

SEQ ID NO: 75638 - DNA, 103 bp, Artificial Sequence
  Synthetic Polynucleotide
taatacgactcactataggggatggtaagcgtaataatatgccgatgaaaaacagaggagatttcatatgcatattattaacctggcggcagcgcaaaagatg

SEQ ID NO: 75639 - DNA, 103 bp, Artificial Sequence
  Synthetic Polynucleotide
taatacgactcactatagggtctttgatggtaagcgtaataatatgccgaaacagaggagatcggcaatgtattacgctaacctggcggcagcgcaaaagatg

SEQ ID NO: 75640 - DNA, 103 bp, Artificial Sequence
  Synthetic Polynucleotide
taatacgactcactatagggtatagtctttgatggtaagcgtaataatataacagaggagaatattaatgcgcttaccaaacctggcggcagcgcaaaagatg

SEQ ID NO: 75641 - DNA, 103 bp, Artificial Sequence
  Synthetic Polynucleotide
taatacgactcactatagggcatggtatagtctttgatggtaagcgtaataacagaggagaattacgatgaccatcaaaaacctggcggcagcgcaaaagatg

SEQ ID NO: 75642 - DNA, 103 bp, Artificial Sequence
  Synthetic Polynucleotide
taatacgactcactatagggatacacatggtatagtctttgatggtaagcaacagaggagagcttacatgcaaagactaaacctggcggcagcgcaaaagatg

SEQ ID NO: 75643 - DNA, 103 bp, Artificial Sequence
  Synthetic Polynucleotide
taatacgactcactatagggtagatatacacatggtatagtctttgatggaacagaggagaccatcaatgactataccaaacctggcggcagcgcaaaagatg

SEQ ID NO: 75644 - DNA, 103 bp, Artificial Sequence
  Synthetic Polynucleotide
taatacgactcactatagggtacgttagatatacacatggtatagtctttaacagaggagaaaagacatgaccatgtgtaacctggcggcagcgcaaaagatg

SEQ ID NO: 75645 - DNA, 103 bp, Artificial Sequence
  Synthetic Polynucleotide
taatacgactcactatagggtagaatacgttagatatacacatggtatagaacagaggagactatacatggtgtatatcaacctggcggcagcgcaaaagatg

SEQ ID NO: 75646 - DNA, 103 bp, Artificial Sequence
  Synthetic Polynucleotide
taatacgactcactatagggtatgctagaatacgttagatatacacatggaacagaggagaccatgtatgtatctaacgaacctggcggcagcgcaaaagatg

SEQ ID NO: 75647 - DNA, 103 bp, Artificial Sequence
  Synthetic Polynucleotide
taatacgactcactatagggtatgatgttaatgtgtcctttttcctcttaaacagaggagataagagatgaaaggacacaacctggcggcagcgcaaaagatg

SEQ ID NO: 75648 - DNA, 103 bp, Artificial Sequence
  Synthetic Polynucleotide
taatacgactcactataggggcaactatgctagaatacgttagatatacaaacagaggagatgtataatgaacgtattcaacctggcggcagcgcaaaagatg

SEQ ID NO: 75649 - DNA, 103 bp, Artificial Sequence
  Synthetic Polynucleotide
taatacgactcactataggggtatggcaactatgctagaatacgttagataacagaggagaatctaaatgattctagcaaacctggcggcagcgcaaaagatg

SEQ ID NO: 75650 - DNA, 103 bp, Artificial Sequence
  Synthetic Polynucleotide
taatacgactcactatagggtgcgcgtatggcaactatgctagaatacgtaacagaggagaacgtatatgagcatagttaacctggcggcagcgcaaaagatg

SEQ ID NO: 75651 - DNA, 103 bp, Artificial Sequence
  Synthetic Polynucleotide
taatacgactcactatagggtttaatgcgcgtatggcaactatgctagaaaacagaggagattctagatgagttgccataacctggcggcagcgcaaaagatg

SEQ ID NO: 75652 - DNA, 103 bp, Artificial Sequence
  Synthetic Polynucleotide
taatacgactcactatagggaaaagtttaatgcgcgtatggcaactatgcaacagaggagagcatagatgccatacgcgaacctggcggcagcgcaaaagatg

SEQ ID NO: 75653 - DNA, 103 bp, Artificial Sequence
  Synthetic Polynucleotide
taatacgactcactatagggtcctgaaaagtttaatgcgcgtatggcaacaacagaggagagttgccatgcgcgcattaaacctggcggcagcgcaaaagatg

SEQ ID NO: 75654 - DNA, 103 bp, Artificial Sequence
  Synthetic Polynucleotide
taatacgactcactatagggaaagatcctgaaaagtttaatgcgcgtatgaacagaggagacatacgatgattaaacttaacctggcggcagcgcaaaagatg

SEQ ID NO: 75655 - DNA, 103 bp, Artificial Sequence
  Synthetic Polynucleotide
taatacgactcactatagggtatccaaagatcctgaaaagtttaatgcgcaacagaggagagcgcatatgacttttcagaacctggcggcagcgcaaaagatg

SEQ ID NO: 75656 - DNA, 103 bp, Artificial Sequence
  Synthetic Polynucleotide
taatacgactcactatagggagatctatccaaagatcctgaaaagtttaaaacagaggagattaaacatgtcaggatctaacctggcggcagcgcaaaagatg

SEQ ID NO: 75657 - DNA, 103 bp, Artificial Sequence
  Synthetic Polynucleotide
taatacgactcactatagggttggaagatctatccaaagatcctgaaaagaacagaggagacttttcatgatctttggaaacctggcggcagcgcaaaagatg

SEQ ID NO: 75658 - DNA, 103 bp, Artificial Sequence
  Synthetic Polynucleotide
taatacgactcactatagggtgatgtatgatgttaatgtgtcctttttccaacagaggagaggaaaaatgacacattaaaacctggcggcagcgcaaaagatg

SEQ ID NO: 75659 - DNA, 103 bp, Artificial Sequence
  Synthetic Polynucleotide
taatacgactcactatagggatagattggaagatctatccaaagatcctgaacagaggagacaggatatgtggatagataacctggcggcagcgcaaaagatg

SEQ ID NO: 75660 - DNA, 103 bp, Artificial Sequence
  Synthetic Polynucleotide
taatacgactcactatagggaatagatagattggaagatctatccaaagaaacagaggagatctttgatgagatcttccaacctggcggcagcgcaaaagatg

SEQ ID NO: 75661 - DNA, 103 bp, Artificial Sequence
  Synthetic Polynucleotide
taatacgactcactatagggtctcaaatagatagattggaagatctatccaacagaggagaggatagatgttccaatctaacctggcggcagcgcaaaagatg

SEQ ID NO: 75662 - DNA, 103 bp, Artificial Sequence
  Synthetic Polynucleotide
taatacgactcactatagggtgttttctcaaatagatagattggaagatcaacagaggagagatcttatgatctatctaaacctggcggcagcgcaaaagatg

SEQ ID NO: 75663 - DNA, 103 bp, Artificial Sequence
  Synthetic Polynucleotide
taatacgactcactatagggaaaaatgttttctcaaatagatagattggaaacagaggagatccaatatgtctatttgaaacctggcggcagcgcaaaagatg

SEQ ID NO: 75664 - DNA, 103 bp, Artificial Sequence
  Synthetic Polynucleotide
taatacgactcactatagggatgataaaaatgttttctcaaatagatagaaacagaggagatctatcatgttgagaaaaaacctggcggcagcgcaaaagatg

SEQ ID NO: 75665 - DNA, 103 bp, Artificial Sequence
  Synthetic Polynucleotide
taatacgactcactatagggtgaacatgataaaaatgttttctcaaatagaacagaggagactatttatgaaaacatttaacctggcggcagcgcaaaagatg

SEQ ID NO: 75666 - DNA, 103 bp, Artificial Sequence
  Synthetic Polynucleotide
taatacgactcactatagggactattgaacatgataaaaatgttttctcaaacagaggagatgagaaatgatttttatcaacctggcggcagcgcaaaagatg

SEQ ID NO: 75667 - DNA, 103 bp, Artificial Sequence
  Synthetic Polynucleotide
taatacgactcactatagggtttcaactattgaacatgataaaaatgtttaacagaggagaaaacatatgtatcatgttaacctggcggcagcgcaaaagatg

SEQ ID NO: 75668 - DNA, 103 bp, Artificial Sequence
  Synthetic Polynucleotide
taatacgactcactatagggcgacgtttcaactattgaacatgataaaaaaacagaggagatttttaatgtgttcaataaacctggcggcagcgcaaaagatg

SEQ ID NO: 75669 - DNA, 103 bp, Artificial Sequence
  Synthetic Polynucleotide
taatacgactcactatagggttaattgatgtatgatgttaatgtgtccttaacagaggagaaaggacatgttaacatcaaacctggcggcagcgcaaaagatg

SEQ ID NO: 75670 - DNA, 103 bp, Artificial Sequence
  Synthetic Polynucleotide
taatacgactcactatagggggacccgacgtttcaactattgaacatgataacagaggagaatcatgatgaatagttgaaacctggcggcagcgcaaaagatg

SEQ ID NO: 75671 - DNA, 103 bp, Artificial Sequence
  Synthetic Polynucleotide
taatacgactcactatagggatagtggacccgacgtttcaactattgaacaacagaggagagttcaaatgttgaaacgtaacctggcggcagcgcaaaagatg

SEQ ID NO: 75672 - DNA, 103 bp, Artificial Sequence
  Synthetic Polynucleotide
taatacgactcactatagggtctatatagtggacccgacgtttcaactataacagaggagaatagttatgacgtcgggtaacctggcggcagcgcaaaagatg

SEQ ID NO: 75673 - DNA, 103 bp, Artificial Sequence
  Synthetic Polynucleotide
taatacgactcactatagggtaatatctatatagtggacccgacgtttcaaacagaggagatgaaacatggggtccactaacctggcggcagcgcaaaagatg

SEQ ID NO: 75674 - DNA, 103 bp, Artificial Sequence
  Synthetic Polynucleotide
taatacgactcactatagggatagataatatctatatagtggacccgacgaacagaggagacgtcggatgcactatataaacctggcggcagcgcaaaagatg

SEQ ID NO: 75675 - DNA, 103 bp, Artificial Sequence
  Synthetic Polynucleotide
taatacgactcactatagggtctttatagataatatctatatagtggaccaacagaggagaggtccaatgtatagatataacctggcggcagcgcaaaagatg

SEQ ID NO: 75676 - DNA, 103 bp, Artificial Sequence
  Synthetic Polynucleotide
taatacgactcactatagggtaaaatctttatagataatatctatatagtaacagaggagaactataatgatattatctaacctggcggcagcgcaaaagatg

SEQ ID NO: 75677 - DNA, 103 bp, Artificial Sequence
  Synthetic Polynucleotide
taatacgactcactataggggttcctaaaatctttatagataatatctataacagaggagaatagatatgatctataaaaacctggcggcagcgcaaaagatg

SEQ ID NO: 75678 - DNA, 103 bp, Artificial Sequence
  Synthetic Polynucleotide
taatacgactcactatagggacgtagttcctaaaatctttatagataataaacagaggagatattatatgtaaagatttaacctggcggcagcgcaaaagatg

SEQ ID NO: 75679 - DNA, 103 bp, Artificial Sequence
  Synthetic Polynucleotide
taatacgactcactatagggcatgaacgtagttcctaaaatctttatagaaacagaggagatctataatgattttaggaaacctggcggcagcgcaaaagatg

SEQ ID NO: 75680 - DNA, 103 bp, Artificial Sequence
  Synthetic Polynucleotide
taatacgactcactatagggctatttcaccctcttggatcatatccgcacaacagaggagagtgcggatgtgatccaagaacctggcggcagcgcaaaagatg

SEQ ID NO: 75681 - DNA, 103 bp, Artificial Sequence
  Synthetic Polynucleotide
taatacgactcactataggggaatgttaattgatgtatgatgttaatgtgaacagaggagacacattatgatcatacataacctggcggcagcgcaaaagatg

SEQ ID NO: 75682 - DNA, 103 bp, Artificial Sequence
  Synthetic Polynucleotide
taatacgactcactataggggataccatgaacgtagttcctaaaatctttaacagaggagaaaagatatgaggaactacaacctggcggcagcgcaaaagatg

SEQ ID NO: 75683 - DNA, 103 bp, Artificial Sequence
  Synthetic Polynucleotide
taatacgactcactataggggccaggataccatgaacgtagttcctaaaaaacagaggagattttagatgctacgttcaaacctggcggcagcgcaaaagatg

SEQ ID NO: 75684 - DNA, 103 bp, Artificial Sequence
  Synthetic Polynucleotide
taatacgactcactatagggtattcgccaggataccatgaacgtagttccaacagaggagaggaactatgttcatggtaaacctggcggcagcgcaaaagatg

SEQ ID NO: 75685 - DNA, 103 bp, Artificial Sequence
  Synthetic Polynucleotide
taatacgactcactatagggtttaatattcgccaggataccatgaacgtaaacagaggagatacgttatgggtatcctgaacctggcggcagcgcaaaagatg

SEQ ID NO: 75686 - DNA, 103 bp, Artificial Sequence
  Synthetic Polynucleotide
taatacgactcactatagggatagttttaatattcgccaggataccatgaaacagaggagatcatggatgcctggcgaaaacctggcggcagcgcaaaagatg

SEQ ID NO: 75687 - DNA, 103 bp, Artificial Sequence
  Synthetic Polynucleotide
taatacgactcactatagggcattgatagttttaatattcgccaggatacaacagaggagagtatccatgcgaatattaaacctggcggcagcgcaaaagatg

SEQ ID NO: 75688 - DNA, 103 bp, Artificial Sequence
  Synthetic Polynucleotide
taatacgactcactatagggcatatcattgatagttttaatattcgccagaacagaggagactggcgatgattaaaactaacctggcggcagcgcaaaagatg

SEQ ID NO: 75689 - DNA, 103 bp, Artificial Sequence
  Synthetic Polynucleotide
taatacgactcactatagggataatcatatcattgatagttttaatattcaacagaggagagaatatatgaactatcaaaacctggcggcagcgcaaaagatg

SEQ ID NO: 75690 - DNA, 103 bp, Artificial Sequence
  Synthetic Polynucleotide
taatacgactcactatagggaaacgataatcatatcattgatagttttaaaacagaggagattaaaaatgtcaatgataaacctggcggcagcgcaaaagatg

SEQ ID NO: 75691 - DNA, 103 bp, Artificial Sequence
  Synthetic Polynucleotide
taatacgactcactataggggatgaaaacgataatcatatcattgatagtaacagaggagaactatcatggatatgattaacctggcggcagcgcaaaagatg

SEQ ID NO: 75692 - DNA, 103 bp, Artificial Sequence
  Synthetic Polynucleotide
taatacgactcactatagggtataagaatgttaattgatgtatgatgttaaacagaggagataacatatgacatcaattaacctggcggcagcgcaaaagatg

SEQ ID NO: 75693 - DNA, 103 bp, Artificial Sequence
  Synthetic Polynucleotide
taatacgactcactatagggtaaaagatgaaaacgataatcatatcattgaacagaggagacaatgaatggattatcgtaacctggcggcagcgcaaaagatg

SEQ ID NO: 75694 - DNA, 103 bp, Artificial Sequence
  Synthetic Polynucleotide
taatacgactcactatagggggtgataaaagatgaaaacgataatcatataacagaggagaatatgaatgtcgttttcaaacctggcggcagcgcaaaagatg

SEQ ID NO: 75695 - DNA, 103 bp, Artificial Sequence
  Synthetic Polynucleotide
taatacgactcactatagggtatatggtgataaaagatgaaaacgataataacagaggagaattatcatgttcatctttaacctggcggcagcgcaaaagatg

SEQ ID NO: 75696 - DNA, 103 bp, Artificial Sequence
  Synthetic Polynucleotide
taatacgactcactataggggaaactatatggtgataaaagatgaaaacgaacagaggagacgttttatgcttttatcaaacctggcggcagcgcaaaagatg

SEQ ID NO: 75697 - DNA, 103 bp, Artificial Sequence
  Synthetic Polynucleotide
taatacgactcactatagggtcttagaaactatatggtgataaaagatgaaacagaggagatcatctatgatcaccataaacctggcggcagcgcaaaagatg

SEQ ID NO: 75698 - DNA, 103 bp, Artificial Sequence
  Synthetic Polynucleotide
taatacgactcactatagggccatatcttagaaactatatggtgataaaaaacagaggagattttatatgcatatagttaacctggcggcagcgcaaaagatg

SEQ ID NO: 75699 - DNA, 103 bp, Artificial Sequence
  Synthetic Polynucleotide
taatacgactcactatagggaaatcccatatcttagaaactatatggtgaaacagaggagatcaccaatgagtttctaaaacctggcggcagcgcaaaagatg

SEQ ID NO: 75700 - DNA, 103 bp, Artificial Sequence
  Synthetic Polynucleotide
taatacgactcactatagggaagtaaaatcccatatcttagaaactatataacagaggagaatatagatgctaagatataacctggcggcagcgcaaaagatg

SEQ ID NO: 75701 - DNA, 103 bp, Artificial Sequence
  Synthetic Polynucleotide
taatacgactcactatagggatattaagtaaaatcccatatcttagaaacaacagaggagagtttctatgatatgggataacctggcggcagcgcaaaagatg

SEQ ID NO: 75702 - DNA, 103 bp, Artificial Sequence
  Synthetic Polynucleotide
taatacgactcactatagggatattatattaagtaaaatcccatatcttaaacagaggagataagatatgggattttacaacctggcggcagcgcaaaagatg

SEQ ID NO: 75703 - DNA, 103 bp, Artificial Sequence
  Synthetic Polynucleotide
taatacgactcactataggggatgttataagaatgttaattgatgtatgaaacagaggagatcatacatgaattaacataacctggcggcagcgcaaaagatg

SEQ ID NO: 75704 - DNA, 103 bp, Artificial Sequence
  Synthetic Polynucleotide
taatacgactcactatagggaaataatattatattaagtaaaatcccataaacagaggagatatgggatgttacttaataacctggcggcagcgcaaaagatg

SEQ ID NO: 75705 - DNA, 103 bp, Artificial Sequence
  Synthetic Polynucleotide
taatacgactcactatagggacgggaaataatattatattaagtaaaatcaacagaggagagattttatgtaatataataacctggcggcagcgcaaaagatg

SEQ ID NO: 75706 - DNA, 103 bp, Artificial Sequence
  Synthetic Polynucleotide
taatacgactcactatagggttattacgggaaataatattatattaagtaaacagaggagatacttaatgtaatattataacctggcggcagcgcaaaagatg

SEQ ID NO: 75707 - DNA, 103 bp, Artificial Sequence
  Synthetic Polynucleotide
taatacgactcactatagggaaaatttattacgggaaataatattatattaacagaggagaaatataatgttatttcccaacctggcggcagcgcaaaagatg

SEQ ID NO: 75708 - DNA, 103 bp, Artificial Sequence
  Synthetic Polynucleotide
taatacgactcactatagggctaataaaatttattacgggaaataatattaacagaggagaaatattatgtcccgtaataacctggcggcagcgcaaaagatg

SEQ ID NO: 75709 - DNA, 103 bp, Artificial Sequence
  Synthetic Polynucleotide
taatacgactcactatagggcatttctaataaaatttattacgggaaataaacagaggagatatttcatgtaataaattaacctggcggcagcgcaaaagatg

SEQ ID NO: 75710 - DNA, 103 bp, Artificial Sequence
  Synthetic Polynucleotide
taatacgactcactatagggtttggcatttctaataaaatttattacgggaacagaggagacccgtaatgaattttattaacctggcggcagcgcaaaagatg

SEQ ID NO: 75711 - DNA, 103 bp, Artificial Sequence
  Synthetic Polynucleotide
taatacgactcactatagggatagatttggcatttctaataaaatttattaacagaggagaaataaaatgtattagaaaaacctggcggcagcgcaaaagatg

SEQ ID NO: 75712 - DNA, 103 bp, Artificial Sequence
  Synthetic Polynucleotide
taatacgactcactatagggttcttatagatttggcatttctaataaaataacagaggagaattttaatggaaatgccaaacctggcggcagcgcaaaagatg

SEQ ID NO: 75713 - DNA, 103 bp, Artificial Sequence
  Synthetic Polynucleotide
taatacgactcactataggggacttttcttatagatttggcatttctaataacagaggagaattagaatggccaaatctaacctggcggcagcgcaaaagatg

SEQ ID NO: 75714 - DNA, 103 bp, Artificial Sequence
  Synthetic Polynucleotide
taatacgactcactatagggattacgatgttataagaatgttaattgatgaacagaggagacatcaaatgacattcttaaacctggcggcagcgcaaaagatg

SEQ ID NO: 75715 - DNA, 103 bp, Artificial Sequence
  Synthetic Polynucleotide
taatacgactcactatagggtctaggacttttcttatagatttggcatttaacagaggagaaaatgcatgatctataagaacctggcggcagcgcaaaagatg

SEQ ID NO: 75716 - DNA, 103 bp, Artificial Sequence
  Synthetic Polynucleotide
taatacgactcactatagggctaattctaggacttttcttatagatttggaacagaggagaccaaatatgtaagaaaagaacctggcggcagcgcaaaagatg

SEQ ID NO: 75717 - DNA, 103 bp, Artificial Sequence
  Synthetic Polynucleotide
taatacgactcactatagggtcagactaattctaggacttttcttatagaaacagaggagatctataatgaaagtcctaaacctggcggcagcgcaaaagatg

SEQ ID NO: 75718 - DNA, 103 bp, Artificial Sequence
  Synthetic Polynucleotide
taatacgactcactatagggattcttcagactaattctaggacttttcttaacagaggagaaagaaaatgcctagaattaacctggcggcagcgcaaaagatg

SEQ ID NO: 75719 - DNA, 103 bp, Artificial Sequence
  Synthetic Polynucleotide
taatacgactcactatagggtagatattcttcagactaattctaggacttaacagaggagaaagtccatgaattagtctaacctggcggcagcgcaaaagatg

SEQ ID NO: 75720 - DNA, 103 bp, Artificial Sequence
  Synthetic Polynucleotide
taatacgactcactatagggtgatatagatattcttcagactaattctagaacagaggagactagaaatggtctgaagaaacctggcggcagcgcaaaagatg

SEQ ID NO: 75721 - DNA, 103 bp, Artificial Sequence
  Synthetic Polynucleotide
taatacgactcactatagggtacggtgatatagatattcttcagactaataacagaggagaattagtatgaagaatatcaacctggcggcagcgcaaaagatg

SEQ ID NO: 75722 - DNA, 103 bp, Artificial Sequence
  Synthetic Polynucleotide
taatacgactcactatagggtacggtacggtgatatagatattcttcagaaacagaggagatctgaaatgtatctatataacctggcggcagcgcaaaagatg

SEQ ID NO: 75723 - DNA, 103 bp, Artificial Sequence
  Synthetic Polynucleotide
taatacgactcactatagggaaatatacggtacggtgatatagatattctaacagaggagaagaataatgatatcaccgaacctggcggcagcgcaaaagatg

SEQ ID NO: 75724 - DNA, 103 bp, Artificial Sequence
  Synthetic Polynucleotide
taatacgactcactatagggaatccaaatatacggtacggtgatatagataacagaggagaatctatatgaccgtaccgaacctggcggcagcgcaaaagatg

SEQ ID NO: 75725 - DNA, 103 bp, Artificial Sequence
  Synthetic Polynucleotide
taatacgactcactatagggttttgattacgatgttataagaatgttaataacagaggagaattaacatgcttataacaaacctggcggcagcgcaaaagatg

SEQ ID NO: 75726 - DNA, 103 bp, Artificial Sequence
  Synthetic Polynucleotide
taatacgactcactatagggtaattaatccaaatatacggtacggtgataaacagaggagatatcacatgaccgtatataacctggcggcagcgcaaaagatg

SEQ ID NO: 75727 - DNA, 103 bp, Artificial Sequence
  Synthetic Polynucleotide
taatacgactcactatagggatatctaattaatccaaatatacggtacggaacagaggagaccgtacatgatatttggaaacctggcggcagcgcaaaagatg

SEQ ID NO: 75728 - DNA, 103 bp, Artificial Sequence
  Synthetic Polynucleotide
taatacgactcactatagggtctctatatctaattaatccaaatatacggaacagaggagaccgtatatgtggattaataacctggcggcagcgcaaaagatg

SEQ ID NO: 75729 - DNA, 103 bp, Artificial Sequence
  Synthetic Polynucleotide
taatacgactcactatagggcatattctctatatctaattaatccaaataaacagaggagatatttgatgtaattagataacctggcggcagcgcaaaagatg

SEQ ID NO: 75730 - DNA, 103 bp, Artificial Sequence
  Synthetic Polynucleotide
taatacgactcactatagggcggatcatattctctatatctaattaatccaacagaggagaggattaatgagatatagaaacctggcggcagcgcaaaagatg

SEQ ID NO: 75731 - DNA, 103 bp, Artificial Sequence
  Synthetic Polynucleotide
taatacgactcactatagggtgttacggatcatattctctatatctaattaacagaggagaaattagatgtagagaataaacctggcggcagcgcaaaagatg

SEQ ID NO: 75732 - DNA, 103 bp, Artificial Sequence
  Synthetic Polynucleotide
taatacgactcactataggggtatatgttacggatcatattctctatatcaacagaggagagatataatgaatatgatcaacctggcggcagcgcaaaagatg

SEQ ID NO: 75733 - DNA, 103 bp, Artificial Sequence
  Synthetic Polynucleotide
taatacgactcactatagggaagttgtatatgttacggatcatattctctaacagaggagaagagaaatggatccgtaaaacctggcggcagcgcaaaagatg

SEQ ID NO: 75734 - DNA, 103 bp, Artificial Sequence
  Synthetic Polynucleotide
taatacgactcactatagggaataaaagttgtatatgttacggatcatataacagaggagaatatgaatggtaacatataacctggcggcagcgcaaaagatg

SEQ ID NO: 75735 - DNA, 103 bp, Artificial Sequence
  Synthetic Polynucleotide
taatacgactcactataggggccataataaaagttgtatatgttacggataacagaggagaatccgtatgatatacaacaacctggcggcagcgcaaaagatg

SEQ ID NO: 75736 - DNA, 103 bp, Artificial Sequence
  Synthetic Polynucleotide
taatacgactcactatagggaattcttttgattacgatgttataagaatgaacagaggagacattctatgaacatcgtaaacctggcggcagcgcaaaagatg

SEQ ID NO: 75737 - DNA, 103 bp, Artificial Sequence
  Synthetic Polynucleotide
taatacgactcactatagggtagacgccataataaaagttgtatatgttaaacagaggagataacatatgcaacttttaaacctggcggcagcgcaaaagatg

SEQ ID NO: 75738 - DNA, 103 bp, Artificial Sequence
  Synthetic Polynucleotide
taatacgactcactatagggtatcttagacgccataataaaagttgtataaacagaggagatatacaatgtttattatgaacctggcggcagcgcaaaagatg

SEQ ID NO: 75739 - DNA, 103 bp, Artificial Sequence
  Synthetic Polynucleotide
taatacgactcactatagggaagaatatcttagacgccataataaaagttaacagaggagaaactttatgtatggcgtcaacctggcggcagcgcaaaagatg

SEQ ID NO: 75740 - DNA, 103 bp, Artificial Sequence
  Synthetic Polynucleotide
taatacgactcactataggggatggaagaatatcttagacgccataataaaacagaggagattattaatgcgtctaagaaacctggcggcagcgcaaaagatg

SEQ ID NO: 75741 - DNA, 103 bp, Artificial Sequence
  Synthetic Polynucleotide
taatacgactcactatagggaagttgatggaagaatatcttagacgccataacagaggagaatggcgatgaagatattcaacctggcggcagcgcaaaagatg

SEQ ID NO: 75742 - DNA, 103 bp, Artificial Sequence
  Synthetic Polynucleotide
taatacgactcactatagggttaataagttgatggaagaatatcttagacaacagaggagagtctaaatgattcttccaaacctggcggcagcgcaaaagatg

SEQ ID NO: 75743 - DNA, 103 bp, Artificial Sequence
  Synthetic Polynucleotide
taatacgactcactatagggaaatgttaataagttgatggaagaatatctaacagaggagaagatatatgtccatcaacaacctggcggcagcgcaaaagatg

SEQ ID NO: 75744 - DNA, 103 bp, Artificial Sequence
  Synthetic Polynucleotide
taatacgactcactataggggtcaaaaatgttaataagttgatggaagaaaacagaggagattcttcatgcaacttattaacctggcggcagcgcaaaagatg

SEQ ID NO: 75745 - DNA, 103 bp, Artificial Sequence
  Synthetic Polynucleotide
taatacgactcactatagggccctagtcaaaaatgttaataagttgatggaacagaggagaccatcaatgtattaacataacctggcggcagcgcaaaagatg

SEQ ID NO: 75746 - DNA, 103 bp, Artificial Sequence
  Synthetic Polynucleotide
taatacgactcactatagggatcttccctagtcaaaaatgttaataagttaacagaggagaaacttaatgacatttttgaacctggcggcagcgcaaaagatg

SEQ ID NO: 75747 - DNA, 103 bp, Artificial Sequence
  Synthetic Polynucleotide
taatacgactcactatagggattgcaattcttttgattacgatgttataaaacagaggagattataaatgcgtaatcaaaacctggcggcagcgcaaaagatg

SEQ ID NO: 75748 - DNA, 103 bp, Artificial Sequence
  Synthetic Polynucleotide
taatacgactcactatagggaatgtatcttccctagtcaaaaatgttaataacagaggagaattaacatgtttgactagaacctggcggcagcgcaaaagatg

SEQ ID NO: 75749 - DNA, 103 bp, Artificial Sequence
  Synthetic Polynucleotide
taatacgactcactataggggtcataatgtatcttccctagtcaaaaatgaacagaggagacattttatgctagggaagaacctggcggcagcgcaaaagatg

SEQ ID NO: 75750 - DNA, 103 bp, Artificial Sequence
  Synthetic Polynucleotide
taatacgactcactataggggggacgtcataatgtatcttccctagtcaaaacagaggagattgactatggaagatacaaacctggcggcagcgcaaaagatg

SEQ ID NO: 75751 - DNA, 103 bp, Artificial Sequence
  Synthetic Polynucleotide
taatacgactcactataggggtgatgggacgtcataatgtatcttccctaaacagaggagatagggaatgtacattatgaacctggcggcagcgcaaaagatg

SEQ ID NO: 75752 - DNA, 103 bp, Artificial Sequence
  Synthetic Polynucleotide
taatacgactcactatagggcaaaagtgatgggacgtcataatgtatcttaacagaggagaaagataatgtatgacgtcaacctggcggcagcgcaaaagatg

SEQ ID NO: 75753 - DNA, 103 bp, Artificial Sequence
  Synthetic Polynucleotide
taatacgactcactatagggcaaggcaaaagtgatgggacgtcataatgtaacagaggagaacattaatgcgtcccatcaacctggcggcagcgcaaaagatg

SEQ ID NO: 75754 - DNA, 103 bp, Artificial Sequence
  Synthetic Polynucleotide
taatacgactcactatagggatagacaaggcaaaagtgatgggacgtcataacagaggagaatgacgatgcatcactttaacctggcggcagcgcaaaagatg

SEQ ID NO: 75755 - DNA, 103 bp, Artificial Sequence
  Synthetic Polynucleotide
taatacgactcactatagggcagtaatagacaaggcaaaagtgatgggacaacagaggagagtcccaatgcttttgcctaacctggcggcagcgcaaaagatg

SEQ ID NO: 75756 - DNA, 103 bp, Artificial Sequence
  Synthetic Polynucleotide
taatacgactcactatagggcgttgcagtaatagacaaggcaaaagtgataacagaggagaatcactatggccttgtctaacctggcggcagcgcaaaagatg

SEQ ID NO: 75757 - DNA, 103 bp, Artificial Sequence
  Synthetic Polynucleotide
taatacgactcactatagggatgaacgttgcagtaatagacaaggcaaaaaacagaggagattttgcatggtctattacaacctggcggcagcgcaaaagatg

SEQ ID NO: 75758 - DNA, 103 bp, Artificial Sequence
  Synthetic Polynucleotide
taatacgactcactatagggtcaaaattgcaattcttttgattacgatgtaacagaggagaacatcgatgtcaaaagaaaacctggcggcagcgcaaaagatg

SEQ ID NO: 75759 - DNA, 103 bp, Artificial Sequence
  Synthetic Polynucleotide
taatacgactcactatagggattctatgaacgttgcagtaatagacaaggaacagaggagaccttgtatgttactgcaaaacctggcggcagcgcaaaagatg

SEQ ID NO: 75760 - DNA, 103 bp, Artificial Sequence
  Synthetic Polynucleotide
taatacgactcactataggggctaaattctatgaacgttgcagtaatagaaacagaggagatctattatggcaacgttcaacctggcggcagcgcaaaagatg

SEQ ID NO: 75761 - DNA, 103 bp, Artificial Sequence
  Synthetic Polynucleotide
taatacgactcactataggggatatgctaaattctatgaacgttgcagtaaacagaggagatactgcatggttcatagaaacctggcggcagcgcaaaagatg

SEQ ID NO: 75762 - DNA, 103 bp, Artificial Sequence
  Synthetic Polynucleotide
taatacgactcactatagggcaagagatatgctaaattctatgaacgttgaacagaggagacaacgtatgtagaatttaaacctggcggcagcgcaaaagatg

SEQ ID NO: 75763 - DNA, 103 bp, Artificial Sequence
  Synthetic Polynucleotide
taatacgactcactatagggattggcaagagatatgctaaattctatgaaaacagaggagattcataatgtttagcataaacctggcggcagcgcaaaagatg

SEQ ID NO: 75764 - DNA, 103 bp, Artificial Sequence
  Synthetic Polynucleotide
taatacgactcactataggggaagaattggcaagagatatgctaaattctaacagaggagaagaattatgcatatctctaacctggcggcagcgcaaaagatg

SEQ ID NO: 75765 - DNA, 103 bp, Artificial Sequence
  Synthetic Polynucleotide
taatacgactcactatagggcaatggaagaattggcaagagatatgctaaaacagaggagattagcaatgctcttgccaaacctggcggcagcgcaaaagatg

SEQ ID NO: 75766 - DNA, 103 bp, Artificial Sequence
  Synthetic Polynucleotide
taatacgactcactatagggaacatcaatggaagaattggcaagagatataacagaggagaatatctatggccaattctaacctggcggcagcgcaaaagatg

SEQ ID NO: 75767 - DNA, 103 bp, Artificial Sequence
  Synthetic Polynucleotide
taatacgactcactatagggaatgtaacatcaatggaagaattggcaagaaacagaggagatcttgcatgttcttccataacctggcggcagcgcaaaagatg

SEQ ID NO: 75768 - DNA, 103 bp, Artificial Sequence
  Synthetic Polynucleotide
taatacgactcactatagggcttataatgtaacatcaatggaagaattggaacagaggagaccaattatgccattgatgaacctggcggcagcgcaaaagatg

SEQ ID NO: 75769 - DNA, 103 bp, Artificial Sequence
  Synthetic Polynucleotide
taatacgactcactatagggatacatcaaaattgcaattcttttgattacaacagaggagagtaatcatgagaattgcaaacctggcggcagcgcaaaagatg

SEQ ID NO: 75770 - DNA, 103 bp, Artificial Sequence
  Synthetic Polynucleotide
taatacgactcactatagggaatttcttataatgtaacatcaatggaagaaacagaggagatcttccatggatgttacaaacctggcggcagcgcaaaagatg

SEQ ID NO: 75771 - DNA, 103 bp, Artificial Sequence
  Synthetic Polynucleotide
taatacgactcactatagggtctaaaatttcttataatgtaacatcaatgaacagaggagacattgaatgtacattataaacctggcggcagcgcaaaagatg

SEQ ID NO: 75772 - DNA, 103 bp, Artificial Sequence
  Synthetic Polynucleotide
taatacgactcactatagggtttcatctaaaatttcttataatgtaacataacagaggagaatgttaatgtataagaaaaacctggcggcagcgcaaaagatg

SEQ ID NO: 75773 - DNA, 103 bp, Artificial Sequence
  Synthetic Polynucleotide
taatacgactcactatagggtgtaatttcatctaaaatttcttataatgtaacagaggagaacattaatggaaattttaaacctggcggcagcgcaaaagatg

SEQ ID NO: 75774 - DNA, 103 bp, Artificial Sequence
  Synthetic Polynucleotide
taatacgactcactatagggccaaatgtaatttcatctaaaatttcttataacagaggagaataagaatgtttagatgaaacctggcggcagcgcaaaagatg

SEQ ID NO: 75775 - DNA, 103 bp, Artificial Sequence
  Synthetic Polynucleotide
taatacgactcactatagggaagctccaaatgtaatttcatctaaaatttaacagaggagaaaatttatgatgaaattaaacctggcggcagcgcaaaagatg

SEQ ID NO: 75776 - DNA, 103 bp, Artificial Sequence
  Synthetic Polynucleotide
taatacgactcactatagggtattaaagctccaaatgtaatttcatctaaaacagaggagattagatatgattacatttaacctggcggcagcgcaaaagatg

SEQ ID NO: 75777 - DNA, 103 bp, Artificial Sequence
  Synthetic Polynucleotide
taatacgactcactatagggcttactattaaagctccaaatgtaatttcaaacagaggagatgaaatatgatttggagcaacctggcggcagcgcaaaagatg

SEQ ID NO: 75778 - DNA, 103 bp, Artificial Sequence
  Synthetic Polynucleotide
taatacgactcactataggggagttcttactattaaagctccaaatgtaaaacagaggagattacatatggagctttaaaacctggcggcagcgcaaaagatg

SEQ ID NO: 75779 - DNA, 103 bp, Artificial Sequence
  Synthetic Polynucleotide
taatacgactcactatagggattaggagttcttactattaaagctccaaaaacagaggagatttggaatgttaatagtaaacctggcggcagcgcaaaagatg

SEQ ID NO: 75780 - DNA, 103 bp, Artificial Sequence
  Synthetic Polynucleotide
taatacgactcactatagggttgttatacatcaaaattgcaattcttttgaacagaggagacaaaagatgtgcaattttaacctggcggcagcgcaaaagatg

SEQ ID NO: 75781 - DNA, 103 bp, Artificial Sequence
  Synthetic Polynucleotide
taatacgactcactatagggaacatattaggagttcttactattaaagctaacagaggagaagctttatgagtaagaacaacctggcggcagcgcaaaagatg

SEQ ID NO: 75782 - DNA, 103 bp, Artificial Sequence
  Synthetic Polynucleotide
taatacgactcactatagggacacgaacatattaggagttcttactattaaacagaggagataatagatggaactcctaaacctggcggcagcgcaaaagatg

SEQ ID NO: 75783 - DNA, 103 bp, Artificial Sequence
  Synthetic Polynucleotide
taatacgactcactatagggcacatacacgaacatattaggagttcttacaacagaggagagtaagaatgcctaatatgaacctggcggcagcgcaaaagatg

SEQ ID NO: 75784 - DNA, 103 bp, Artificial Sequence
  Synthetic Polynucleotide
taatacgactcactataggggtgaccacatacacgaacatattaggagttaacagaggagaaactccatgtatgttcgtaacctggcggcagcgcaaaagatg

SEQ ID NO: 75785 - DNA, 103 bp, Artificial Sequence
  Synthetic Polynucleotide
taatacgactcactatagggtattagtgaccacatacacgaacatattagaacagaggagactaataatgtcgtgtatgaacctggcggcagcgcaaaagatg

SEQ ID NO: 75786 - DNA, 103 bp, Artificial Sequence
  Synthetic Polynucleotide
taatacgactcactatagggatctgtattagtgaccacatacacgaacataacagaggagaatgttcatgtatgtggtcaacctggcggcagcgcaaaagatg

SEQ ID NO: 75787 - DNA, 103 bp, Artificial Sequence
  Synthetic Polynucleotide
taatacgactcactatagggctacaatctgtattagtgaccacatacacgaacagaggagacgtgtaatgggtcactaaaacctggcggcagcgcaaaagatg

SEQ ID NO: 75788 - DNA, 103 bp, Artificial Sequence
  Synthetic Polynucleotide
taatacgactcactatagggtagaactacaatctgtattagtgaccacataacagaggagaatgtggatgctaatacagaacctggcggcagcgcaaaagatg

SEQ ID NO: 75789 - DNA, 103 bp, Artificial Sequence
  Synthetic Polynucleotide
taatacgactcactataggggattatagaactacaatctgtattagtgacaacagaggagagtcactatgacagattgtaacctggcggcagcgcaaaagatg

SEQ ID NO: 75790 - DNA, 103 bp, Artificial Sequence
  Synthetic Polynucleotide
taatacgactcactatagggtttacgattatagaactacaatctgtattaaacagaggagataatacatgttgtagttcaacctggcggcagcgcaaaagatg

SEQ ID NO: 75791 - DNA, 103 bp, Artificial Sequence
  Synthetic Polynucleotide
taatacgactcactatagggaacgactatttcaccctcttggatcatatcaacagaggagagatatgatgcaagagggtaacctggcggcagcgcaaaagatg

SEQ ID NO: 75792 - DNA, 103 bp, Artificial Sequence
  Synthetic Polynucleotide
taatacgactcactataggggacagttgttatacatcaaaattgcaattcaacagaggagagaattgatgttttgatgtaacctggcggcagcgcaaaagatg

SEQ ID NO: 75793 - DNA, 103 bp, Artificial Sequence
  Synthetic Polynucleotide
taatacgactcactatagggaattatttacgattatagaactacaatctgaacagaggagacagattatggttctataaaacctggcggcagcgcaaaagatg

SEQ ID NO: 75794 - DNA, 103 bp, Artificial Sequence
  Synthetic Polynucleotide
taatacgactcactatagggaggtaaattatttacgattatagaactacaaacagaggagatgtagtatgataatcgtaaacctggcggcagcgcaaaagatg

SEQ ID NO: 75795 - DNA, 103 bp, Artificial Sequence
  Synthetic Polynucleotide
taatacgactcactatagggaatataggtaaattatttacgattatagaaaacagaggagattctatatgcgtaaataaaacctggcggcagcgcaaaagatg

SEQ ID NO: 75796 - DNA, 103 bp, Artificial Sequence
  Synthetic Polynucleotide
taatacgactcactatagggcatataatataggtaaattatttacgattaaacagaggagataatcgatgataatttacaacctggcggcagcgcaaaagatg

SEQ ID NO: 75797 - DNA, 103 bp, Artificial Sequence
  Synthetic Polynucleotide
taatacgactcactatagggtcaaacatataatataggtaaattatttacaacagaggagagtaaatatgttacctataaacctggcggcagcgcaaaagatg

SEQ ID NO: 75798 - DNA, 103 bp, Artificial Sequence
  Synthetic Polynucleotide
taatacgactcactatagggcagactcaaacatataatataggtaaattaaacagaggagataatttatgtatattataaacctggcggcagcgcaaaagatg

SEQ ID NO: 75799 - DNA, 103 bp, Artificial Sequence
  Synthetic Polynucleotide
taatacgactcactatagggctaaacagactcaaacatataatataggtaaacagaggagatacctaatgtatatgtttaacctggcggcagcgcaaaagatg

SEQ ID NO: 75800 - DNA, 103 bp, Artificial Sequence
  Synthetic Polynucleotide
taatacgactcactatagggcttttctaaacagactcaaacatataatataacagaggagaatattaatggtttgagtcaacctggcggcagcgcaaaagatg

SEQ ID NO: 75801 - DNA, 103 bp, Artificial Sequence
  Synthetic Polynucleotide
taatacgactcactatagggagctacttttctaaacagactcaaacatataacagaggagaatatgtatgagtctgtttaacctggcggcagcgcaaaagatg

SEQ ID NO: 75802 - DNA, 103 bp, Artificial Sequence
  Synthetic Polynucleotide
taatacgactcactatagggtacttagctacttttctaaacagactcaaaaacagaggagatttgagatggtttagaaaaacctggcggcagcgcaaaagatg

SEQ ID NO: 75803 - DNA, 103 bp, Artificial Sequence
  Synthetic Polynucleotide
taatacgactcactatagggtcattgacagttgttatacatcaaaattgcaacagaggagagcaattatgatgtataacaacctggcggcagcgcaaaagatg

SEQ ID NO: 75804 - DNA, 103 bp, Artificial Sequence
  Synthetic Polynucleotide
taatacgactcactatagggtcgtatacttagctacttttctaaacagacaacagaggagagtctgtatggaaaagtagaacctggcggcagcgcaaaagatg

SEQ ID NO: 75805 - DNA, 103 bp, Artificial Sequence
  Synthetic Polynucleotide
taatacgactcactatagggaaagatcgtatacttagctacttttctaaaaacagaggagatttagaatggtagctaagaacctggcggcagcgcaaaagatg

SEQ ID NO: 75806 - DNA, 103 bp, Artificial Sequence
  Synthetic Polynucleotide
taatacgactcactatagggaaataaaagatcgtatacttagctacttttaacagaggagaaaaagtatgtaagtatacaacctggcggcagcgcaaaagatg

SEQ ID NO: 75807 - DNA, 103 bp, Artificial Sequence
  Synthetic Polynucleotide
taatacgactcactatagggatcagaaataaaagatcgtatacttagctaaacagaggagatagctaatgatacgatctaacctggcggcagcgcaaaagatg

SEQ ID NO: 75808 - DNA, 103 bp, Artificial Sequence
  Synthetic Polynucleotide
taatacgactcactatagggtctgcatcagaaataaaagatcgtatacttaacagaggagaaagtatatgatcttttataacctggcggcagcgcaaaagatg

SEQ ID NO: 75809 - DNA, 103 bp, Artificial Sequence
  Synthetic Polynucleotide
taatacgactcactatagggatacatctgcatcagaaataaaagatcgtaaacagaggagatacgatatgttatttctgaacctggcggcagcgcaaaagatg

SEQ ID NO: 75810 - DNA, 103 bp, Artificial Sequence
  Synthetic Polynucleotide
taatacgactcactatagggtgttgatacatctgcatcagaaataaaagaaacagaggagatcttttatgtctgatgcaaacctggcggcagcgcaaaagatg

SEQ ID NO: 75811 - DNA, 103 bp, Artificial Sequence
  Synthetic Polynucleotide
taatacgactcactatagggtccgatgttgatacatctgcatcagaaataaacagaggagatatttcatgtgcagatgtaacctggcggcagcgcaaaagatg

SEQ ID NO: 75812 - DNA, 103 bp, Artificial Sequence
  Synthetic Polynucleotide
taatacgactcactatagggttttttccgatgttgatacatctgcatcagaacagaggagactgatgatgatgtatcaaaacctggcggcagcgcaaaagatg

SEQ ID NO: 75813 - DNA, 103 bp, Artificial Sequence
  Synthetic Polynucleotide
taatacgactcactatagggaagatttttttccgatgttgatacatctgcaacagaggagagcagatatgtcaacatcgaacctggcggcagcgcaaaagatg

SEQ ID NO: 75814 - DNA, 103 bp, Artificial Sequence
  Synthetic Polynucleotide
taatacgactcactatagggataattcattgacagttgttatacatcaaaaacagaggagatttgatatgtaacaactgaacctggcggcagcgcaaaagatg

SEQ ID NO: 75815 - DNA, 103 bp, Artificial Sequence
  Synthetic Polynucleotide
taatacgactcactatagggaaaaaaagatttttttccgatgttgatacaaacagaggagatgtatcatgatcggaaaaaacctggcggcagcgcaaaagatg

SEQ ID NO: 75816 - DNA, 103 bp, Artificial Sequence
  Synthetic Polynucleotide
taatacgactcactatagggagaataaaaaaagatttttttccgatgttgaacagaggagacaacatatgaaaaaaatcaacctggcggcagcgcaaaagatg

SEQ ID NO: 75817 - DNA, 103 bp, Artificial Sequence
  Synthetic Polynucleotide
taatacgactcactatagggaaaaaagaataaaaaaagatttttttccgaaacagaggagatcggaaatgaatctttttaacctggcggcagcgcaaaagatg

SEQ ID NO: 75818 - DNA, 103 bp, Artificial Sequence
  Synthetic Polynucleotide
taatacgactcactatagggttagtaaaaaagaataaaaaaagattttttaacagaggagaaaaaaaatgttttttattaacctggcggcagcgcaaaagatg

SEQ ID NO: 75819 - DNA, 103 bp, Artificial Sequence
  Synthetic Polynucleotide
taatacgactcactatagggtatctttagtaaaaaagaataaaaaaagataacagaggagaatctttatgtattcttttaacctggcggcagcgcaaaagatg

SEQ ID NO: 75820 - DNA, 103 bp, Artificial Sequence
  Synthetic Polynucleotide
taatacgactcactatagggatttgtatctttagtaaaaaagaataaaaaaacagaggagatttttaatgttttttactaacctggcggcagcgcaaaagatg

SEQ ID NO: 75821 - DNA, 103 bp, Artificial Sequence
  Synthetic Polynucleotide
taatacgactcactataggggacatatttgtatctttagtaaaaaagaataacagaggagaattcttatgtactaaagaaacctggcggcagcgcaaaagatg

SEQ ID NO: 75822 - DNA, 103 bp, Artificial Sequence
  Synthetic Polynucleotide
taatacgactcactatagggacaaagacatatttgtatctttagtaaaaaaacagaggagatttttaatgaagatacaaaacctggcggcagcgcaaaagatg

SEQ ID NO: 75823 - DNA, 103 bp, Artificial Sequence
  Synthetic Polynucleotide
taatacgactcactatagggttttaacaaagacatatttgtatctttagtaacagaggagaactaaaatgacaaatatgaacctggcggcagcgcaaaagatg

SEQ ID NO: 75824 - DNA, 103 bp, Artificial Sequence
  Synthetic Polynucleotide
taatacgactcactatagggactgtttttaacaaagacatatttgtatctaacagaggagaagatacatgtatgtctttaacctggcggcagcgcaaaagatg

SEQ ID NO: 75825 - DNA, 103 bp, Artificial Sequence
  Synthetic Polynucleotide
taatacgactcactatagggattccataattcattgacagttgttatacaaacagaggagatgtataatgactgtcaataacctggcggcagcgcaaaagatg

SEQ ID NO: 75826 - DNA, 103 bp, Artificial Sequence
  Synthetic Polynucleotide
taatacgactcactatagggaaataactgtttttaacaaagacatatttgaacagaggagacaaataatgctttgttaaaacctggcggcagcgcaaaagatg

SEQ ID NO: 75827 - DNA, 103 bp, Artificial Sequence
  Synthetic Polynucleotide
taatacgactcactatagggtcagaaaataactgtttttaacaaagacataacagaggagaatgtctatgttaaaaacaaacctggcggcagcgcaaaagatg

SEQ ID NO: 75828 - DNA, 103 bp, Artificial Sequence
  Synthetic Polynucleotide
taatacgactcactatagggaatattcagaaaataactgtttttaacaaaaacagaggagatttgttatgaacagttataacctggcggcagcgcaaaagatg

SEQ ID NO: 75829 - DNA, 103 bp, Artificial Sequence
  Synthetic Polynucleotide
taatacgactcactatagggctagaaatattcagaaaataactgtttttaaacagaggagataaaaaatgttattttctaacctggcggcagcgcaaaagatg

SEQ ID NO: 75830 - DNA, 103 bp, Artificial Sequence
  Synthetic Polynucleotide
taatacgactcactatagggacaaactagaaatattcagaaaataactgtaacagaggagaacagttatgttctgaataaacctggcggcagcgcaaaagatg

SEQ ID NO: 75831 - DNA, 103 bp, Artificial Sequence
  Synthetic Polynucleotide
taatacgactcactatagggaaattacaaactagaaatattcagaaaataaacagaggagatattttatgaatatttctaacctggcggcagcgcaaaagatg

SEQ ID NO: 75832 - DNA, 103 bp, Artificial Sequence
  Synthetic Polynucleotide
taatacgactcactatagggtgttaaaattacaaactagaaatattcagaaacagaggagatctgaaatgttctagtttaacctggcggcagcgcaaaagatg

SEQ ID NO: 75833 - DNA, 103 bp, Artificial Sequence
  Synthetic Polynucleotide
taatacgactcactatagggtcatatgttaaaattacaaactagaaatataacagaggagaatatttatggtttgtaataacctggcggcagcgcaaaagatg

SEQ ID NO: 75834 - DNA, 103 bp, Artificial Sequence
  Synthetic Polynucleotide
taatacgactcactataggggaatatcatatgttaaaattacaaactagaaacagaggagatctagtatgtaattttaaaacctggcggcagcgcaaaagatg

SEQ ID NO: 75835 - DNA, 103 bp, Artificial Sequence
  Synthetic Polynucleotide
taatacgactcactatagggtgaatgaatatcatatgttaaaattacaaaaacagaggagatttgtaatgttaacatataacctggcggcagcgcaaaagatg

SEQ ID NO: 75836 - DNA, 103 bp, Artificial Sequence
  Synthetic Polynucleotide
taatacgactcactatagggatacaattccataattcattgacagttgttaacagaggagaaacaacatgcaatgaattaacctggcggcagcgcaaaagatg

SEQ ID NO: 75837 - DNA, 103 bp, Artificial Sequence
  Synthetic Polynucleotide
taatacgactcactatagggtagtgtgaatgaatatcatatgttaaaattaacagaggagaaattttatgatatgatataacctggcggcagcgcaaaagatg

SEQ ID NO: 75838 - DNA, 103 bp, Artificial Sequence
  Synthetic Polynucleotide
taatacgactcactatagggttacctagtgtgaatgaatatcatatgttaaacagaggagataacatatgatattcattaacctggcggcagcgcaaaagatg

SEQ ID NO: 75839 - DNA, 103 bp, Artificial Sequence
  Synthetic Polynucleotide
taatacgactcactataggggtagattacctagtgtgaatgaatatcataaacagaggagatatgatatgcattcacacaacctggcggcagcgcaaaagatg

SEQ ID NO: 75840 - DNA, 103 bp, Artificial Sequence
  Synthetic Polynucleotide
taatacgactcactatagggtttaggtagattacctagtgtgaatgaataaacagaggagatattcaatgacactaggtaacctggcggcagcgcaaaagatg

SEQ ID NO: 75841 - DNA, 103 bp, Artificial Sequence
  Synthetic Polynucleotide
taatacgactcactatagggacctatttaggtagattacctagtgtgaataacagaggagaattcacatgaggtaatctaacctggcggcagcgcaaaagatg

SEQ ID NO: 75842 - DNA, 103 bp, Artificial Sequence
  Synthetic Polynucleotide
taatacgactcactatagggtagaaacctatttaggtagattacctagtgaacagaggagacactagatgatctacctaaacctggcggcagcgcaaaagatg

SEQ ID NO: 75843 - DNA, 103 bp, Artificial Sequence
  Synthetic Polynucleotide
taatacgactcactataggggattatagaaacctatttaggtagattaccaacagaggagaggtaatatgcctaaatagaacctggcggcagcgcaaaagatg

SEQ ID NO: 75844 - DNA, 103 bp, Artificial Sequence
  Synthetic Polynucleotide
taatacgactcactatagggttaaagattatagaaacctatttaggtagaaacagaggagatctaccatgataggtttcaacctggcggcagcgcaaaagatg

SEQ ID NO: 75845 - DNA, 103 bp, Artificial Sequence
  Synthetic Polynucleotide
taatacgactcactatagggttacattaaagattatagaaacctatttagaacagaggagactaaatatgtttctataaaacctggcggcagcgcaaaagatg

SEQ ID NO: 75846 - DNA, 103 bp, Artificial Sequence
  Synthetic Polynucleotide
taatacgactcactatagggtaatattacattaaagattatagaaacctaaacagaggagataggttatgataatctttaacctggcggcagcgcaaaagatg

SEQ ID NO: 75847 - DNA, 103 bp, Artificial Sequence
  Synthetic Polynucleotide
taatacgactcactataggggtaatatacaattccataattcattgacagaacagaggagactgtcaatgaattatggaaacctggcggcagcgcaaaagatg

SEQ ID NO: 75848 - DNA, 103 bp, Artificial Sequence
  Synthetic Polynucleotide
taatacgactcactatagggtttcctaatattacattaaagattatagaaaacagaggagattctatatgctttaatgtaacctggcggcagcgcaaaagatg

SEQ ID NO: 75849 - DNA, 103 bp, Artificial Sequence
  Synthetic Polynucleotide
taatacgactcactatagggatacttttcctaatattacattaaagattaaacagaggagataatctatgatgtaatataacctggcggcagcgcaaaagatg

SEQ ID NO: 75850 - DNA, 103 bp, Artificial Sequence
  Synthetic Polynucleotide
taatacgactcactatagggtcataatacttttcctaatattacattaaaaacagaggagatttaatatgatattaggaaacctggcggcagcgcaaaagatg

SEQ ID NO: 75851 - DNA, 103 bp, Artificial Sequence
  Synthetic Polynucleotide
taatacgactcactatagggcctgatcataatacttttcctaatattacaaacagaggagatgtaatatgaggaaaagtaacctggcggcagcgcaaaagatg

SEQ ID NO: 75852 - DNA, 103 bp, Artificial Sequence
  Synthetic Polynucleotide
taatacgactcactatagggggaatcctgatcataatacttttcctaataaacagaggagatattagatgaagtattataacctggcggcagcgcaaaagatg

SEQ ID NO: 75853 - DNA, 103 bp, Artificial Sequence
  Synthetic Polynucleotide
taatacgactcactataggggaataggaatcctgatcataatacttttccaacagaggagaggaaaaatgttatgatcaaacctggcggcagcgcaaaagatg

SEQ ID NO: 75854 - DNA, 103 bp, Artificial Sequence
  Synthetic Polynucleotide
taatacgactcactatagggaaaatgaataggaatcctgatcataatactaacagaggagaagtattatgatcaggattaacctggcggcagcgcaaaagatg

SEQ ID NO: 75855 - DNA, 103 bp, Artificial Sequence
  Synthetic Polynucleotide
taatacgactcactatagggtcctcaaaatgaataggaatcctgatcataaacagaggagatatgatatggattcctataacctggcggcagcgcaaaagatg

SEQ ID NO: 75856 - DNA, 103 bp, Artificial Sequence
  Synthetic Polynucleotide
taatacgactcactatagggttaaatcctcaaaatgaataggaatcctgaaacagaggagatcaggaatgctattcattaacctggcggcagcgcaaaagatg

SEQ ID NO: 75857 - DNA, 103 bp, Artificial Sequence
  Synthetic Polynucleotide
taatacgactcactataggggagttttaaatcctcaaaatgaataggaataacagaggagaattcctatgcattttgagaacctggcggcagcgcaaaagatg

SEQ ID NO: 75858 - DNA, 103 bp, Artificial Sequence
  Synthetic Polynucleotide
taatacgactcactatagggaatgtgtaatatacaattccataattcattaacagaggagaaatgaaatgtggaattgtaacctggcggcagcgcaaaagatg

SEQ ID NO: 75859 - DNA, 103 bp, Artificial Sequence
  Synthetic Polynucleotide
taatacgactcactatagggaatcagagttttaaatcctcaaaatgaataaacagaggagatattcaatgtgaggatttaacctggcggcagcgcaaaagatg

SEQ ID NO: 75860 - DNA, 103 bp, Artificial Sequence
  Synthetic Polynucleotide
taatacgactcactatagggacaataatcagagttttaaatcctcaaaataacagaggagaattttgatgatttaaaacaacctggcggcagcgcaaaagatg

SEQ ID NO: 75861 - DNA, 103 bp, Artificial Sequence
  Synthetic Polynucleotide
taatacgactcactatagggattagacaataatcagagttttaaatcctcaacagaggagagaggatatgaaactctgaaacctggcggcagcgcaaaagatg

SEQ ID NO: 75862 - DNA, 103 bp, Artificial Sequence
  Synthetic Polynucleotide
taatacgactcactatagggaccatattagacaataatcagagttttaaaaacagaggagatttaaaatgctgattattaacctggcggcagcgcaaaagatg

SEQ ID NO: 75863 - DNA, 103 bp, Artificial Sequence
  Synthetic Polynucleotide
taatacgactcactatagggttgagaccatattagacaataatcagagttaacagaggagaaactctatgtattgtctaaacctggcggcagcgcaaaagatg

SEQ ID NO: 75864 - DNA, 103 bp, Artificial Sequence
  Synthetic Polynucleotide
taatacgactcactatagggttgcgttgagaccatattagacaataatcaaacagaggagatgattaatgtctaatatgaacctggcggcagcgcaaaagatg

SEQ ID NO: 75865 - DNA, 103 bp, Artificial Sequence
  Synthetic Polynucleotide
taatacgactcactatagggaaagtttgcgttgagaccatattagacaataacagaggagaattgtcatgtatggtctcaacctggcggcagcgcaaaagatg

SEQ ID NO: 75866 - DNA, 103 bp, Artificial Sequence
  Synthetic Polynucleotide
taatacgactcactataggggtgaaaaagtttgcgttgagaccatattagaacagaggagactaataatgtctcaacgcaacctggcggcagcgcaaaagatg

SEQ ID NO: 75867 - DNA, 103 bp, Artificial Sequence
  Synthetic Polynucleotide
taatacgactcactataggggctctgtgaaaaagtttgcgttgagaccataacagaggagaatggtcatgacgcaaactaacctggcggcagcgcaaaagatg

SEQ ID NO: 75868 - DNA, 103 bp, Artificial Sequence
  Synthetic Polynucleotide
taatacgactcactatagggctatcgctctgtgaaaaagtttgcgttgagaacagaggagactcaacatgaactttttcaacctggcggcagcgcaaaagatg

SEQ ID NO: 75869 - DNA, 103 bp, Artificial Sequence
  Synthetic Polynucleotide
taatacgactcactatagggcgtataatgtgtaatatacaattccataataacagaggagaattatgatgttgtatattaacctggcggcagcgcaaaagatg

SEQ ID NO: 75870 - DNA, 103 bp, Artificial Sequence
  Synthetic Polynucleotide
taatacgactcactatagggaaactctatcgctctgtgaaaaagtttgcgaacagaggagacgcaaaatgtttcacagaaacctggcggcagcgcaaaagatg

SEQ ID NO: 75871 - DNA, 103 bp, Artificial Sequence
  Synthetic Polynucleotide
taatacgactcactatagggatcaaaaactctatcgctctgtgaaaaagtaacagaggagaacttttatgcagagcgataacctggcggcagcgcaaaagatg

SEQ ID NO: 75872 - DNA, 103 bp, Artificial Sequence
  Synthetic Polynucleotide
taatacgactcactataggggagttatcaaaaactctatcgctctgtgaaaacagaggagattcacaatgcgatagagtaacctggcggcagcgcaaaagatg

SEQ ID NO: 75873 - DNA, 103 bp, Artificial Sequence
  Synthetic Polynucleotide
taatacgactcactatagggaaaacgagttatcaaaaactctatcgctctaacagaggagaagagcgatggagtttttgaacctggcggcagcgcaaaagatg

SEQ ID NO: 75874 - DNA, 103 bp, Artificial Sequence
  Synthetic Polynucleotide
taatacgactcactatagggtaagaaaaacgagttatcaaaaactctatcaacagaggagagatagaatgtttgataacaacctggcggcagcgcaaaagatg

SEQ ID NO: 75875 - DNA, 103 bp, Artificial Sequence
  Synthetic Polynucleotide
taatacgactcactatagggtttcttaagaaaaacgagttatcaaaaactaacagaggagaagttttatgtaactcgttaacctggcggcagcgcaaaagatg

SEQ ID NO: 75876 - DNA, 103 bp, Artificial Sequence
  Synthetic Polynucleotide
taatacgactcactatagggttatatttcttaagaaaaacgagttatcaaaacagaggagattgataatgcgtttttctaacctggcggcagcgcaaaagatg

SEQ ID NO: 75877 - DNA, 103 bp, Artificial Sequence
  Synthetic Polynucleotide
taatacgactcactatagggtagttttatatttcttaagaaaaacgagttaacagaggagaaactcgatgttcttaagaaacctggcggcagcgcaaaagatg

SEQ ID NO: 75878 - DNA, 103 bp, Artificial Sequence
  Synthetic Polynucleotide
taatacgactcactataggggacagtagttttatatttcttaagaaaaacaacagaggagagtttttatgaagaaatataacctggcggcagcgcaaaagatg

SEQ ID NO: 75879 - DNA, 103 bp, Artificial Sequence
  Synthetic Polynucleotide
taatacgactcactatagggctggagacagtagttttatatttcttaagaaacagaggagatcttaaatgatataaaacaacctggcggcagcgcaaaagatg

SEQ ID NO: 75880 - DNA, 103 bp, Artificial Sequence
  Synthetic Polynucleotide
taatacgactcactatagggcataccgtataatgtgtaatatacaattccaacagaggagaggaattatgtattacacaaacctggcggcagcgcaaaagatg

SEQ ID NO: 75881 - DNA, 103 bp, Artificial Sequence
  Synthetic Polynucleotide
taatacgactcactatagggaagctctggagacagtagttttatatttctaacagaggagaagaaatatgaaactactgaacctggcggcagcgcaaaagatg

SEQ ID NO: 75882 - DNA, 103 bp, Artificial Sequence
  Synthetic Polynucleotide
taatacgactcactatagggagagcaagctctggagacagtagttttataaacagaggagatataaaatgactgtctccaacctggcggcagcgcaaaagatg

SEQ ID NO: 75883 - DNA, 103 bp, Artificial Sequence
  Synthetic Polynucleotide
taatacgactcactatagggaagatagagcaagctctggagacagtagttaacagaggagaaactacatgctccagagcaacctggcggcagcgcaaaagatg

SEQ ID NO: 75884 - DNA, 103 bp, Artificial Sequence
  Synthetic Polynucleotide
taatacgactcactatagggaataaaagatagagcaagctctggagacagaacagaggagactgtctatggagcttgctaacctggcggcagcgcaaaagatg

SEQ ID NO: 75885 - DNA, 103 bp, Artificial Sequence
  Synthetic Polynucleotide
taatacgactcactataggggataaaataaaagatagagcaagctctggaaacagaggagatccagaatgtgctctatcaacctggcggcagcgcaaaagatg

SEQ ID NO: 75886 - DNA, 103 bp, Artificial Sequence
  Synthetic Polynucleotide
taatacgactcactatagggaattagataaaataaaagatagagcaagctaacagaggagaagcttgatgtatcttttaaacctggcggcagcgcaaaagatg

SEQ ID NO: 75887 - DNA, 103 bp, Artificial Sequence
  Synthetic Polynucleotide
taatacgactcactatagggtatcgaattagataaaataaaagatagagcaacagaggagagctctaatgtttattttaaacctggcggcagcgcaaaagatg

SEQ ID NO: 75888 - DNA, 103 bp, Artificial Sequence
  Synthetic Polynucleotide
taatacgactcactataggggtttgtatcgaattagataaaataaaagataacagaggagaatctttatgtttatctaaaacctggcggcagcgcaaaagatg

SEQ ID NO: 75889 - DNA, 103 bp, Artificial Sequence
  Synthetic Polynucleotide
taatacgactcactatagggcaggagtttgtatcgaattagataaaataaaacagaggagattatttatgctaattcgaaacctggcggcagcgcaaaagatg

SEQ ID NO: 75890 - DNA, 103 bp, Artificial Sequence
  Synthetic Polynucleotide
taatacgactcactatagggagtatcaggagtttgtatcgaattagataaaacagaggagattatctatgtcgatacaaaacctggcggcagcgcaaaagatg

SEQ ID NO: 75891 - DNA, 103 bp, Artificial Sequence
  Synthetic Polynucleotide
taatacgactcactataggggccaacataccgtataatgtgtaatatacaaacagaggagatgtataatgcacattataaacctggcggcagcgcaaaagatg

SEQ ID NO: 75892 - DNA, 103 bp, Artificial Sequence
  Synthetic Polynucleotide
taatacgactcactataggggaaccagtatcaggagtttgtatcgaattaaacagaggagataattcatgacaaactccaacctggcggcagcgcaaaagatg

SEQ ID NO: 75893 - DNA, 103 bp, Artificial Sequence
  Synthetic Polynucleotide
taatacgactcactatagggtttctgaaccagtatcaggagtttgtatcgaacagaggagacgatacatgctcctgataaacctggcggcagcgcaaaagatg

SEQ ID NO: 75894 - DNA, 103 bp, Artificial Sequence
  Synthetic Polynucleotide
taatacgactcactatagggattactttctgaaccagtatcaggagtttgaacagaggagacaaactatggatactggtaacctggcggcagcgcaaaagatg

SEQ ID NO: 75895 - DNA, 103 bp, Artificial Sequence
  Synthetic Polynucleotide
taatacgactcactatagggaatgaattactttctgaaccagtatcaggaaacagaggagatcctgaatgtggttcagaaacctggcggcagcgcaaaagatg

SEQ ID NO: 75896 - DNA, 103 bp, Artificial Sequence
  Synthetic Polynucleotide
taatacgactcactatagggaaattaatgaattactttctgaaccagtataacagaggagaatactgatgcagaaagtaaacctggcggcagcgcaaaagatg

SEQ ID NO: 75897 - DNA, 103 bp, Artificial Sequence
  Synthetic Polynucleotide
taatacgactcactatagggactgaaaattaatgaattactttctgaaccaacagaggagaggttcaatgagtaattcaaacctggcggcagcgcaaaagatg

SEQ ID NO: 75898 - DNA, 103 bp, Artificial Sequence
  Synthetic Polynucleotide
taatacgactcactatagggaaaggactgaaaattaatgaattactttctaacagaggagaagaaagatgttcattaataacctggcggcagcgcaaaagatg

SEQ ID NO: 75899 - DNA, 103 bp, Artificial Sequence
  Synthetic Polynucleotide
taatacgactcactatagggtctataaaggactgaaaattaatgaattacaacagaggagagtaattatgtaattttcaaacctggcggcagcgcaaaagatg

SEQ ID NO: 75900 - DNA, 103 bp, Artificial Sequence
  Synthetic Polynucleotide
taatacgactcactatagggtatcttctataaaggactgaaaattaatgaaacagaggagatcattaatgttcagtcctaacctggcggcagcgcaaaagatg

SEQ ID NO: 75901 - DNA, 103 bp, Artificial Sequence
  Synthetic Polynucleotide
taatacgactcactatagggttaaatatcttctataaaggactgaaaattaacagaggagaaattttatgtcctttataaacctggcggcagcgcaaaagatg

SEQ ID NO: 75902 - DNA, 103 bp, Artificial Sequence
  Synthetic Polynucleotide
taatacgactcactatagggacgagaacgactatttcaccctcttggatcaacagaggagagatccaatggggtgaaataacctggcggcagcgcaaaagatg

SEQ ID NO: 75903 - DNA, 103 bp, Artificial Sequence
  Synthetic Polynucleotide
taatacgactcactatagggtcgttgccaacataccgtataatgtgtaataacagaggagaattacaatgtatacggtaaacctggcggcagcgcaaaagatg

SEQ ID NO: 75904 - DNA, 103 bp, Artificial Sequence
  Synthetic Polynucleotide
taatacgactcactatagggctatattaaatatcttctataaaggactgaaacagaggagatcagtcatgtatagaagaaacctggcggcagcgcaaaagatg

SEQ ID NO: 75905 - DNA, 103 bp, Artificial Sequence
  Synthetic Polynucleotide
taatacgactcactatagggattatctatattaaatatcttctataaaggaacagaggagacctttaatgaagatatttaacctggcggcagcgcaaaagatg

SEQ ID NO: 75906 - DNA, 103 bp, Artificial Sequence
  Synthetic Polynucleotide
taatacgactcactatagggtttgtattatctatattaaatatcttctataacagaggagaatagaaatgatttaatataacctggcggcagcgcaaaagatg

SEQ ID NO: 75907 - DNA, 103 bp, Artificial Sequence
  Synthetic Polynucleotide
taatacgactcactatagggaaaattttgtattatctatattaaatatctaacagaggagaagatatatgatatagataaacctggcggcagcgcaaaagatg

SEQ ID NO: 75908 - DNA, 103 bp, Artificial Sequence
  Synthetic Polynucleotide
taatacgactcactatagggaactgaaaattttgtattatctatattaaaaacagaggagatttaatatggataatacaaacctggcggcagcgcaaaagatg

SEQ ID NO: 75909 - DNA, 103 bp, Artificial Sequence
  Synthetic Polynucleotide
taatacgactcactatagggtcaaaaactgaaaattttgtattatctataaacagaggagatatagaatgtacaaaattaacctggcggcagcgcaaaagatg

SEQ ID NO: 75910 - DNA, 103 bp, Artificial Sequence
  Synthetic Polynucleotide
taatacgactcactatagggcgatatcaaaaactgaaaattttgtattataacagaggagaataataatgaattttcagaacctggcggcagcgcaaaagatg

SEQ ID NO: 75911 - DNA, 103 bp, Artificial Sequence
  Synthetic Polynucleotide
taatacgactcactatagggcagatcgatatcaaaaactgaaaattttgtaacagaggagaacaaaaatgtcagtttttaacctggcggcagcgcaaaagatg

SEQ ID NO: 75912 - DNA, 103 bp, Artificial Sequence
  Synthetic Polynucleotide
taatacgactcactatagggtcaatcagatcgatatcaaaaactgaaaataacagaggagaattttcatgttttgatataacctggcggcagcgcaaaagatg

SEQ ID NO: 75913 - DNA, 103 bp, Artificial Sequence
  Synthetic Polynucleotide
taatacgactcactatagggtaggatcaatcagatcgatatcaaaaactgaacagaggagacagtttatgatatcgatcaacctggcggcagcgcaaaagatg

SEQ ID NO: 75914 - DNA, 103 bp, Artificial Sequence
  Synthetic Polynucleotide
taatacgactcactatagggatttgtcgttgccaacataccgtataatgtaacagaggagaacattaatgggtatgttgaacctggcggcagcgcaaaagatg

SEQ ID NO: 75915 - DNA, 103 bp, Artificial Sequence
  Synthetic Polynucleotide
taatacgactcactatagggagttctaggatcaatcagatcgatatcaaaaacagaggagatttgatatggatctgattaacctggcggcagcgcaaaagatg

SEQ ID NO: 75916 - DNA, 103 bp, Artificial Sequence
  Synthetic Polynucleotide
taatacgactcactatagggtatctagttctaggatcaatcagatcgataaacagaggagatatcgaatggattgatccaacctggcggcagcgcaaaagatg

SEQ ID NO: 75917 - DNA, 103 bp, Artificial Sequence
  Synthetic Polynucleotide
taatacgactcactatagggtaatatatctagttctaggatcaatcagataacagaggagaatctgaatgatcctagaaaacctggcggcagcgcaaaagatg

SEQ ID NO: 75918 - DNA, 103 bp, Artificial Sequence
  Synthetic Polynucleotide
taatacgactcactataggggttattaatatatctagttctaggatcaataacagaggagaattgatatgagaactagaaacctggcggcagcgcaaaagatg

SEQ ID NO: 75919 - DNA, 103 bp, Artificial Sequence
  Synthetic Polynucleotide
taatacgactcactatagggagcacgttattaatatatctagttctaggaaacagaggagatcctagatgtagatatataacctggcggcagcgcaaaagatg

SEQ ID NO: 75920 - DNA, 103 bp, Artificial Sequence
  Synthetic Polynucleotide
taatacgactcactatagggtaatgagcacgttattaatatatctagttcaacagaggagagaactaatgatattaataaacctggcggcagcgcaaaagatg

SEQ ID NO: 75921 - DNA, 103 bp, Artificial Sequence
  Synthetic Polynucleotide
taatacgactcactatagggctgcctaatgagcacgttattaatatatctaacagaggagaagatatatgaataacgtgaacctggcggcagcgcaaaagatg

SEQ ID NO: 75922 - DNA, 103 bp, Artificial Sequence
  Synthetic Polynucleotide
taatacgactcactatagggataaactgcctaatgagcacgttattaataaacagaggagatattaaatgcgtgctcataacctggcggcagcgcaaaagatg

SEQ ID NO: 75923 - DNA, 103 bp, Artificial Sequence
  Synthetic Polynucleotide
taatacgactcactatagggctgccataaactgcctaatgagcacgttataacagaggagaataacgatgtcattaggcaacctggcggcagcgcaaaagatg

SEQ ID NO: 75924 - DNA, 103 bp, Artificial Sequence
  Synthetic Polynucleotide
taatacgactcactatagggtcaagctgccataaactgcctaatgagcacaacagaggagagtgctcatgaggcagtttaacctggcggcagcgcaaaagatg

SEQ ID NO: 75925 - DNA, 103 bp, Artificial Sequence
  Synthetic Polynucleotide
taatacgactcactatagggtcggtatttgtcgttgccaacataccgtataacagaggagaatacggatggttggcaacaacctggcggcagcgcaaaagatg

SEQ ID NO: 75926 - DNA, 103 bp, Artificial Sequence
  Synthetic Polynucleotide
taatacgactcactatagggaattatcaagctgccataaactgcctaatgaacagaggagacattagatggtttatggcaacctggcggcagcgcaaaagatg

SEQ ID NO: 75927 - DNA, 103 bp, Artificial Sequence
  Synthetic Polynucleotide
taatacgactcactatagggtatctaattatcaagctgccataaactgccaacagaggagaggcagtatgtggcagcttaacctggcggcagcgcaaaagatg

SEQ ID NO: 75928 - DNA, 103 bp, Artificial Sequence
  Synthetic Polynucleotide
taatacgactcactatagggtactatatctaattatcaagctgccataaaaacagaggagatttatgatggcttgataaaacctggcggcagcgcaaaagatg

SEQ ID NO: 75929 - DNA, 103 bp, Artificial Sequence
  Synthetic Polynucleotide
taatacgactcactataggggaatatactatatctaattatcaagctgccaacagaggagaggcagcatgataattagaaacctggcggcagcgcaaaagatg

SEQ ID NO: 75930 - DNA, 103 bp, Artificial Sequence
  Synthetic Polynucleotide
taatacgactcactatagggaactggaatatactatatctaattatcaagaacagaggagacttgatatgtagatatagaacctggcggcagcgcaaaagatg

SEQ ID NO: 75931 - DNA, 103 bp, Artificial Sequence
  Synthetic Polynucleotide
taatacgactcactatagggatatgaactggaatatactatatctaattaaacagaggagataattaatgatagtatataacctggcggcagcgcaaaagatg

SEQ ID NO: 75932 - DNA, 103 bp, Artificial Sequence
  Synthetic Polynucleotide
taatacgactcactatagggaataaatatgaactggaatatactatatctaacagaggagaagatatatgatattccagaacctggcggcagcgcaaaagatg

SEQ ID NO: 75933 - DNA, 103 bp, Artificial Sequence
  Synthetic Polynucleotide
taatacgactcactatagggtatctaataaatatgaactggaatatactaaacagaggagatagtatatgccagttcataacctggcggcagcgcaaaagatg

SEQ ID NO: 75934 - DNA, 103 bp, Artificial Sequence
  Synthetic Polynucleotide
taatacgactcactatagggtgcggtatctaataaatatgaactggaataaacagaggagatattccatgtcatatttaaacctggcggcagcgcaaaagatg

SEQ ID NO: 75935 - DNA, 103 bp, Artificial Sequence
  Synthetic Polynucleotide
taatacgactcactatagggggcaatgcggtatctaataaatatgaactgaacagaggagacagttcatgtttattagaaacctggcggcagcgcaaaagatg

SEQ ID NO: 75936 - DNA, 103 bp, Artificial Sequence
  Synthetic Polynucleotide
taatacgactcactatagggaccaatcggtatttgtcgttgccaacatacaacagaggagagtatgtatgcaacgacaaaacctggcggcagcgcaaaagatg

SEQ ID NO: 75937 - DNA, 103 bp, Artificial Sequence
  Synthetic Polynucleotide
taatacgactcactatagggatctgggcaatgcggtatctaataaatatgaacagaggagacatattatgtagataccgaacctggcggcagcgcaaaagatg

SEQ ID NO: 75938 - DNA, 103 bp, Artificial Sequence
  Synthetic Polynucleotide
taatacgactcactatagggtcaaaatctgggcaatgcggtatctaataaaacagaggagattattaatgaccgcattgaacctggcggcagcgcaaaagatg

SEQ ID NO: 75939 - DNA, 103 bp, Artificial Sequence
  Synthetic Polynucleotide
taatacgactcactataggggaatatcaaaatctgggcaatgcggtatctaacagaggagaagatacatgattgcccagaacctggcggcagcgcaaaagatg

SEQ ID NO: 75940 - DNA, 103 bp, Artificial Sequence
  Synthetic Polynucleotide
taatacgactcactatagggtcatagaatatcaaaatctgggcaatgcggaacagaggagaccgcatatgccagattttaacctggcggcagcgcaaaagatg

SEQ ID NO: 75941 - DNA, 103 bp, Artificial Sequence
  Synthetic Polynucleotide
taatacgactcactatagggggaattcatagaatatcaaaatctgggcaaaacagaggagattgcccatgttttgatataacctggcggcagcgcaaaagatg

SEQ ID NO: 75942 - DNA, 103 bp, Artificial Sequence
  Synthetic Polynucleotide
taatacgactcactatagggtcagaggaattcatagaatatcaaaatctgaacagaggagacagattatgatattctataacctggcggcagcgcaaaagatg

SEQ ID NO: 75943 - DNA, 103 bp, Artificial Sequence
  Synthetic Polynucleotide
taatacgactcactatagggtattttcagaggaattcatagaatatcaaaaacagaggagatttgatatgctatgaattaacctggcggcagcgcaaaagatg

SEQ ID NO: 75944 - DNA, 103 bp, Artificial Sequence
  Synthetic Polynucleotide
taatacgactcactatagggggatttattttcagaggaattcatagaataaacagaggagatattctatgaattcctctaacctggcggcagcgcaaaagatg

SEQ ID NO: 75945 - DNA, 103 bp, Artificial Sequence
  Synthetic Polynucleotide
taatacgactcactatagggattttggatttattttcagaggaattcataaacagaggagatatgaaatgctctgaaaaaacctggcggcagcgcaaaagatg

SEQ ID NO: 75946 - DNA, 103 bp, Artificial Sequence
  Synthetic Polynucleotide
taatacgactcactatagggtagttattttggatttattttcagaggaataacagaggagaattcctatgaaaataaataacctggcggcagcgcaaaagatg

SEQ ID NO: 75947 - DNA, 103 bp, Artificial Sequence
  Synthetic Polynucleotide
taatacgactcactatagggcaattaccaatcggtatttgtcgttgccaaaacagaggagattggcaatgacaaataccaacctggcggcagcgcaaaagatg

SEQ ID NO: 75948 - DNA, 103 bp, Artificial Sequence
  Synthetic Polynucleotide
taatacgactcactatagggatgtctagttattttggatttattttcagaaacagaggagatctgaaatgaaatccaaaaacctggcggcagcgcaaaagatg

SEQ ID NO: 75949 - DNA, 103 bp, Artificial Sequence
  Synthetic Polynucleotide
taatacgactcactatagggatagaatgtctagttattttggatttatttaacagaggagaaaataaatgcaaaataacaacctggcggcagcgcaaaagatg

SEQ ID NO: 75950 - DNA, 103 bp, Artificial Sequence
  Synthetic Polynucleotide
taatacgactcactatagggaaaaaatagaatgtctagttattttggattaacagaggagaaatccaatgtaactagacaacctggcggcagcgcaaaagatg

SEQ ID NO: 75951 - DNA, 103 bp, Artificial Sequence
  Synthetic Polynucleotide
taatacgactcactatagggtccacaaaaaatagaatgtctagttattttaacagaggagaaaaataatgagacattctaacctggcggcagcgcaaaagatg

SEQ ID NO: 75952 - DNA, 103 bp, Artificial Sequence
  Synthetic Polynucleotide
taatacgactcactatagggactaatccacaaaaaatagaatgtctagttaacagaggagaaactagatgttctattttaacctggcggcagcgcaaaagatg

SEQ ID NO: 75953 - DNA, 103 bp, Artificial Sequence
  Synthetic Polynucleotide
taatacgactcactatagggagtacactaatccacaaaaaatagaatgtcaacagaggagagacattatgttttttgtgaacctggcggcagcgcaaaagatg

SEQ ID NO: 75954 - DNA, 103 bp, Artificial Sequence
  Synthetic Polynucleotide
taatacgactcactatagggaagagagtacactaatccacaaaaaatagaaacagaggagatctattatgtgtggattaaacctggcggcagcgcaaaagatg

SEQ ID NO: 75955 - DNA, 103 bp, Artificial Sequence
  Synthetic Polynucleotide
taatacgactcactataggggagggaagagagtacactaatccacaaaaaaacagaggagatttttgatgattagtgtaaacctggcggcagcgcaaaagatg

SEQ ID NO: 75956 - DNA, 103 bp, Artificial Sequence
  Synthetic Polynucleotide
taatacgactcactatagggtgatagagggaagagagtacactaatccacaacagaggagagtggatatgtgtactctcaacctggcggcagcgcaaaagatg

SEQ ID NO: 75957 - DNA, 103 bp, Artificial Sequence
  Synthetic Polynucleotide
taatacgactcactataggggaacatgatagagggaagagagtacactaaaacagaggagattagtgatgtctcttcccaacctggcggcagcgcaaaagatg

SEQ ID NO: 75958 - DNA, 103 bp, Artificial Sequence
  Synthetic Polynucleotide
taatacgactcactataggggtaaacaattaccaatcggtatttgtcgttaacagaggagaaacgacatgtaccgattgaacctggcggcagcgcaaaagatg

SEQ ID NO: 75959 - DNA, 103 bp, Artificial Sequence
  Synthetic Polynucleotide
taatacgactcactataggggttgtgaacatgatagagggaagagagtacaacagaggagagtactcatgtccctctataacctggcggcagcgcaaaagatg

SEQ ID NO: 75960 - DNA, 103 bp, Artificial Sequence
  Synthetic Polynucleotide
taatacgactcactatagggcaccagttgtgaacatgatagagggaagagaacagaggagactcttcatgctatcatgtaacctggcggcagcgcaaaagatg

SEQ ID NO: 75961 - DNA, 103 bp, Artificial Sequence
  Synthetic Polynucleotide
taatacgactcactataggggtggacaccagttgtgaacatgatagagggaacagaggagaccctctatgatgttcacaaacctggcggcagcgcaaaagatg

SEQ ID NO: 75962 - DNA, 103 bp, Artificial Sequence
  Synthetic Polynucleotide
taatacgactcactatagggtcatcgtggacaccagttgtgaacatgataaacagaggagatatcatatgcacaactggaacctggcggcagcgcaaaagatg

SEQ ID NO: 75963 - DNA, 103 bp, Artificial Sequence
  Synthetic Polynucleotide
taatacgactcactatagggatttatcatcgtggacaccagttgtgaacaaacagaggagatgttcaatgctggtgtccaacctggcggcagcgcaaaagatg

SEQ ID NO: 75964 - DNA, 103 bp, Artificial Sequence
  Synthetic Polynucleotide
taatacgactcactatagggtagatatttatcatcgtggacaccagttgtaacagaggagaacaactatggtccacgataacctggcggcagcgcaaaagatg

SEQ ID NO: 75965 - DNA, 103 bp, Artificial Sequence
  Synthetic Polynucleotide
taatacgactcactatagggccctctagatatttatcatcgtggacaccaaacagaggagatggtgtatgcgatgataaaacctggcggcagcgcaaaagatg

SEQ ID NO: 75966 - DNA, 103 bp, Artificial Sequence
  Synthetic Polynucleotide
taatacgactcactatagggatattccctctagatatttatcatcgtggaaacagaggagatccacgatgataaatatcaacctggcggcagcgcaaaagatg

SEQ ID NO: 75967 - DNA, 103 bp, Artificial Sequence
  Synthetic Polynucleotide
taatacgactcactatagggatattatattccctctagatatttatcatcaacagaggagagatgatatgtatctagagaacctggcggcagcgcaaaagatg

SEQ ID NO: 75968 - DNA, 103 bp, Artificial Sequence
  Synthetic Polynucleotide
taatacgactcactatagggggactatattatattccctctagatatttaaacagaggagataaataatgagagggaataacctggcggcagcgcaaaagatg

SEQ ID NO: 75969 - DNA, 103 bp, Artificial Sequence
  Synthetic Polynucleotide
taatacgactcactatagggcaccggtaaacaattaccaatcggtatttgaacagaggagacaaataatgattggtaataacctggcggcagcgcaaaagatg

SEQ ID NO: 75970 - DNA, 103 bp, Artificial Sequence
  Synthetic Polynucleotide
taatacgactcactatagggcctatggactatattatattccctctagataacagaggagaatctagatggaatataataacctggcggcagcgcaaaagatg

SEQ ID NO: 75971 - DNA, 103 bp, Artificial Sequence
  Synthetic Polynucleotide
taatacgactcactatagggggcatcctatggactatattatattccctcaacagaggagagagggaatgtaatatagtaacctggcggcagcgcaaaagatg

SEQ ID NO: 75972 - DNA, 103 bp, Artificial Sequence
  Synthetic Polynucleotide
taatacgactcactatagggagattggcatcctatggactatattatattaacagaggagaaatataatgtagtccataaacctggcggcagcgcaaaagatg

SEQ ID NO: 75973 - DNA, 103 bp, Artificial Sequence
  Synthetic Polynucleotide
taatacgactcactatagggttgctagattggcatcctatggactatattaacagaggagaaatataatgcataggatgaacctggcggcagcgcaaaagatg

SEQ ID NO: 75974 - DNA, 103 bp, Artificial Sequence
  Synthetic Polynucleotide
taatacgactcactatagggcgacattgctagattggcatcctatggactaacagaggagaagtccaatggatgccaataacctggcggcagcgcaaaagatg

SEQ ID NO: 75975 - DNA, 103 bp, Artificial Sequence
  Synthetic Polynucleotide
taatacgactcactatagggttattcgacattgctagattggcatcctataacagaggagaataggaatgcaatctagcaacctggcggcagcgcaaaagatg

SEQ ID NO: 75976 - DNA, 103 bp, Artificial Sequence
  Synthetic Polynucleotide
taatacgactcactatagggtacagttattcgacattgctagattggcataacagaggagaatgccaatgtagcaatgtaacctggcggcagcgcaaaagatg

SEQ ID NO: 75977 - DNA, 103 bp, Artificial Sequence
  Synthetic Polynucleotide
taatacgactcactatagggaaaattacagttattcgacattgctagattaacagaggagaaatctaatgatgtcgaataacctggcggcagcgcaaaagatg

SEQ ID NO: 75978 - DNA, 103 bp, Artificial Sequence
  Synthetic Polynucleotide
taatacgactcactatagggagaataaaattacagttattcgacattgctaacagaggagaagcaatatggaataactgaacctggcggcagcgcaaaagatg

SEQ ID NO: 75979 - DNA, 103 bp, Artificial Sequence
  Synthetic Polynucleotide
taatacgactcactatagggagcgaagaataaaattacagttattcgacaaacagaggagatgtcgaatgactgtaattaacctggcggcagcgcaaaagatg

SEQ ID NO: 75980 - DNA, 103 bp, Artificial Sequence
  Synthetic Polynucleotide
taatacgactcactatagggtattacaccggtaaacaattaccaatcggtaacagaggagaaccgatatgtaattgtttaacctggcggcagcgcaaaagatg

SEQ ID NO: 75981 - DNA, 103 bp, Artificial Sequence
  Synthetic Polynucleotide
taatacgactcactatagggtgaagagcgaagaataaaattacagttattaacagaggagaaataacatgaattttattaacctggcggcagcgcaaaagatg

SEQ ID NO: 75982 - DNA, 103 bp, Artificial Sequence
  Synthetic Polynucleotide
taatacgactcactatagggcataatgaagagcgaagaataaaattacagaacagaggagactgtaaatgtattcttcgaacctggcggcagcgcaaaagatg

SEQ ID NO: 75983 - DNA, 103 bp, Artificial Sequence
  Synthetic Polynucleotide
taatacgactcactatagggcaattcataatgaagagcgaagaataaaataacagaggagaattttaatgttcgctcttaacctggcggcagcgcaaaagatg

SEQ ID NO: 75984 - DNA, 103 bp, Artificial Sequence
  Synthetic Polynucleotide
taatacgactcactatagggagaatcaattcataatgaagagcgaagaataacagaggagaattcttatgtcttcattaaacctggcggcagcgcaaaagatg

SEQ ID NO: 75985 - DNA, 103 bp, Artificial Sequence
  Synthetic Polynucleotide
taatacgactcactatagggcctcaagaatcaattcataatgaagagcgaaacagaggagatcgctcatgattatgaataacctggcggcagcgcaaaagatg

SEQ ID NO: 75986 - DNA, 103 bp, Artificial Sequence
  Synthetic Polynucleotide
taatacgactcactatagggttatacctcaagaatcaattcataatgaagaacagaggagacttcatatggaattgattaacctggcggcagcgcaaaagatg

SEQ ID NO: 75987 - DNA, 103 bp, Artificial Sequence
  Synthetic Polynucleotide
taatacgactcactatagggtaggtttatacctcaagaatcaattcataaaacagaggagattatgaatggattcttgaaacctggcggcagcgcaaaagatg

SEQ ID NO: 75988 - DNA, 103 bp, Artificial Sequence
  Synthetic Polynucleotide
taatacgactcactatagggtgtgttaggtttatacctcaagaatcaattaacagaggagaaattgaatgttgaggtataacctggcggcagcgcaaaagatg

SEQ ID NO: 75989 - DNA, 103 bp, Artificial Sequence
  Synthetic Polynucleotide
taatacgactcactatagggtaatttgtgttaggtttatacctcaagaataacagaggagaattcttatggtataaaccaacctggcggcagcgcaaaagatg

SEQ ID NO: 75990 - DNA, 103 bp, Artificial Sequence
  Synthetic Polynucleotide
taatacgactcactatagggtaatataatttgtgttaggtttatacctcaaacagaggagatgaggtatgaacctaacaaacctggcggcagcgcaaaagatg

SEQ ID NO: 75991 - DNA, 103 bp, Artificial Sequence
  Synthetic Polynucleotide
taatacgactcactatagggaattctattacaccggtaaacaattaccaaaacagaggagattggtaatggtttaccggaacctggcggcagcgcaaaagatg

SEQ ID NO: 75992 - DNA, 103 bp, Artificial Sequence
  Synthetic Polynucleotide
taatacgactcactatagggtctaataatataatttgtgttaggtttataaacagaggagatataaaatgaacacaaataacctggcggcagcgcaaaagatg

SEQ ID NO: 75993 - DNA, 103 bp, Artificial Sequence
  Synthetic Polynucleotide
taatacgactcactatagggaaaagtctaataatataatttgtgttaggtaacagaggagaacctaaatgaaattatataacctggcggcagcgcaaaagatg

SEQ ID NO: 75994 - DNA, 103 bp, Artificial Sequence
  Synthetic Polynucleotide
taatacgactcactatagggatacgaaaagtctaataatataatttgtgtaacagaggagaacacaaatgatattattaaacctggcggcagcgcaaaagatg

SEQ ID NO: 75995 - DNA, 103 bp, Artificial Sequence
  Synthetic Polynucleotide
taatacgactcactatagggattacatacgaaaagtctaataatataattaacagaggagaaattatatgattagacttaacctggcggcagcgcaaaagatg

SEQ ID NO: 75996 - DNA, 103 bp, Artificial Sequence
  Synthetic Polynucleotide
taatacgactcactatagggaagacattacatacgaaaagtctaataataaacagaggagatattatatgacttttcgtaacctggcggcagcgcaaaagatg

SEQ ID NO: 75997 - DNA, 103 bp, Artificial Sequence
  Synthetic Polynucleotide
taatacgactcactatagggcatgaaagacattacatacgaaaagtctaaaacagaggagattagacatgtcgtatgtaaacctggcggcagcgcaaaagatg

SEQ ID NO: 75998 - DNA, 103 bp, Artificial Sequence
  Synthetic Polynucleotide
taatacgactcactatagggtataacatgaaagacattacatacgaaaagaacagaggagacttttcatgtgtaatgtcaacctggcggcagcgcaaaagatg

SEQ ID NO: 75999 - DNA, 103 bp, Artificial Sequence
  Synthetic Polynucleotide
taatacgactcactatagggaaacttataacatgaaagacattacatacgaacagaggagacgtatgatgtgtctttcaaacctggcggcagcgcaaaagatg

SEQ ID NO: 76000 - DNA, 103 bp, Artificial Sequence
  Synthetic Polynucleotide
taatacgactcactatagggattaaaaacttataacatgaaagacattacaacagaggagagtaatgatgttcatgttaaacctggcggcagcgcaaaagatg

SEQ ID NO: 76001 - DNA, 103 bp, Artificial Sequence
  Synthetic Polynucleotide
taatacgactcactatagggccaggattaaaaacttataacatgaaagacaacagaggagagtctttatggttataagtaacctggcggcagcgcaaaagatg

SEQ ID NO: 76002 - DNA, 103 bp, Artificial Sequence
  Synthetic Polynucleotide
taatacgactcactatagggatataaattctattacaccggtaaacaattaacagaggagaaattgtatgccggtgtaaaacctggcggcagcgcaaaagatg

SEQ ID NO: 76003 - DNA, 103 bp, Artificial Sequence
  Synthetic Polynucleotide
taatacgactcactatagggctattccaggattaaaaacttataacatgaaacagaggagatcatgtatgaagtttttaaacctggcggcagcgcaaaagatg

SEQ ID NO: 76004 - DNA, 103 bp, Artificial Sequence
  Synthetic Polynucleotide
taatacgactcactatagggagattctattccaggattaaaaacttataaaacagaggagattataaatgtttaatcctaacctggcggcagcgcaaaagatg

SEQ ID NO: 76005 - DNA, 103 bp, Artificial Sequence
  Synthetic Polynucleotide
taatacgactcactatagggaaaatagattctattccaggattaaaaactaacagaggagaagttttatgtcctggaataacctggcggcagcgcaaaagatg

SEQ ID NO: 76006 - DNA, 103 bp, Artificial Sequence
  Synthetic Polynucleotide
taatacgactcactatagggtcattaaaatagattctattccaggattaaaacagaggagattaatcatggaatagaataacctggcggcagcgcaaaagatg

SEQ ID NO: 76007 - DNA, 103 bp, Artificial Sequence
  Synthetic Polynucleotide
taatacgactcactatagggaagcctcattaaaatagattctattccaggaacagaggagacctggaatggaatctattaacctggcggcagcgcaaaagatg

SEQ ID NO: 76008 - DNA, 103 bp, Artificial Sequence
  Synthetic Polynucleotide
taatacgactcactatagggtttaaaagcctcattaaaatagattctattaacagaggagaaatagaatgtattttaataacctggcggcagcgcaaaagatg

SEQ ID NO: 76009 - DNA, 103 bp, Artificial Sequence
  Synthetic Polynucleotide
taatacgactcactatagggctgcgtttaaaagcctcattaaaatagattaacagaggagaaatctaatgtaatgaggcaacctggcggcagcgcaaaagatg

SEQ ID NO: 76010 - DNA, 103 bp, Artificial Sequence
  Synthetic Polynucleotide
taatacgactcactataggggaactctgcgtttaaaagcctcattaaaataacagaggagaattttaatgaggcttttaaacctggcggcagcgcaaaagatg

SEQ ID NO: 76011 - DNA, 103 bp, Artificial Sequence
  Synthetic Polynucleotide
taatacgactcactatagggttggagaactctgcgtttaaaagcctcattaacagaggagaaatgagatgtttaaacgcaacctggcggcagcgcaaaagatg

SEQ ID NO: 76012 - DNA, 103 bp, Artificial Sequence
  Synthetic Polynucleotide
taatacgactcactatagggacttgttggagaactctgcgtttaaaagccaacagaggagaggctttatgacgcagagtaacctggcggcagcgcaaaagatg

SEQ ID NO: 76013 - DNA, 103 bp, Artificial Sequence
  Synthetic Polynucleotide
taatacgactcactatagggtctgaacgagaacgactatttcaccctcttaacagaggagaaagaggatgaaatagtcgaacctggcggcagcgcaaaagatg

SEQ ID NO: 76014 - DNA, 103 bp, Artificial Sequence
  Synthetic Polynucleotide
taatacgactcactatagggtagatatataaattctattacaccggtaaaaacagaggagatttaccatggtaatagaaaacctggcggcagcgcaaaagatg

SEQ ID NO: 76015 - DNA, 103 bp, Artificial Sequence
  Synthetic Polynucleotide
taatacgactcactatagggttttgacttgttggagaactctgcgtttaaaacagaggagattaaacatggagttctccaacctggcggcagcgcaaaagatg

SEQ ID NO: 76016 - DNA, 103 bp, Artificial Sequence
  Synthetic Polynucleotide
taatacgactcactatagggttatgttttgacttgttggagaactctgcgaacagaggagacgcagaatgctccaacaaaacctggcggcagcgcaaaagatg

SEQ ID NO: 76017 - DNA, 103 bp, Artificial Sequence
  Synthetic Polynucleotide
taatacgactcactataggggagtattatgttttgacttgttggagaactaacagaggagaagttctatgacaagtcaaaacctggcggcagcgcaaaagatg

SEQ ID NO: 76018 - DNA, 103 bp, Artificial Sequence
  Synthetic Polynucleotide
taatacgactcactatagggcaacagagtattatgttttgacttgttggaaacagaggagatccaacatgtcaaaacataacctggcggcagcgcaaaagatg

SEQ ID NO: 76019 - DNA, 103 bp, Artificial Sequence
  Synthetic Polynucleotide
taatacgactcactatagggaaaaccaacagagtattatgttttgacttgaacagaggagacaagtcatgacataatacaacctggcggcagcgcaaaagatg

SEQ ID NO: 76020 - DNA, 103 bp, Artificial Sequence
  Synthetic Polynucleotide
taatacgactcactatagggataagaaaaccaacagagtattatgttttgaacagaggagacaaaacatgatactctgtaacctggcggcagcgcaaaagatg

SEQ ID NO: 76021 - DNA, 103 bp, Artificial Sequence
  Synthetic Polynucleotide
taatacgactcactatagggtgtatataagaaaaccaacagagtattatgaacagaggagacataatatgctgttggttaacctggcggcagcgcaaaagatg

SEQ ID NO: 76022 - DNA, 103 bp, Artificial Sequence
  Synthetic Polynucleotide
taatacgactcactatagggaatattgtatataagaaaaccaacagagtaaacagaggagatactctatgggttttcttaacctggcggcagcgcaaaagatg

SEQ ID NO: 76023 - DNA, 103 bp, Artificial Sequence
  Synthetic Polynucleotide
taatacgactcactatagggatcgtaatattgtatataagaaaaccaacaaacagaggagatgttggatgtcttatataaacctggcggcagcgcaaaagatg

SEQ ID NO: 76024 - DNA, 103 bp, Artificial Sequence
  Synthetic Polynucleotide
taatacgactcactatagggagaaaatcgtaatattgtatataagaaaacaacagaggagagttttcatgtatacaataaacctggcggcagcgcaaaagatg

SEQ ID NO: 76025 - DNA, 103 bp, Artificial Sequence
  Synthetic Polynucleotide
taatacgactcactatagggtgtaatagatatataaattctattacaccgaacagaggagacggtgtatgagaatttataacctggcggcagcgcaaaagatg

SEQ ID NO: 76026 - DNA, 103 bp, Artificial Sequence
  Synthetic Polynucleotide
taatacgactcactatagggaaagaagaaaatcgtaatattgtatataagaacagaggagacttataatgaatattacgaacctggcggcagcgcaaaagatg

SEQ ID NO: 76027 - DNA, 103 bp, Artificial Sequence
  Synthetic Polynucleotide
taatacgactcactatagggcattcaaagaagaaaatcgtaatattgtataacagaggagaatacaaatgtacgattttaacctggcggcagcgcaaaagatg

SEQ ID NO: 76028 - DNA, 103 bp, Artificial Sequence
  Synthetic Polynucleotide
taatacgactcactatagggtattccattcaaagaagaaaatcgtaatataacagaggagaatattaatgttttcttctaacctggcggcagcgcaaaagatg

SEQ ID NO: 76029 - DNA, 103 bp, Artificial Sequence
  Synthetic Polynucleotide
taatacgactcactatagggaaacctattccattcaaagaagaaaatcgtaacagaggagaacgattatgttctttgaaaacctggcggcagcgcaaaagatg

SEQ ID NO: 76030 - DNA, 103 bp, Artificial Sequence
  Synthetic Polynucleotide
taatacgactcactatagggttcaaaaacctattccattcaaagaagaaaaacagaggagatttcttatgtgaatggaaaacctggcggcagcgcaaaagatg

SEQ ID NO: 76031 - DNA, 103 bp, Artificial Sequence
  Synthetic Polynucleotide
taatacgactcactatagggactaattcaaaaacctattccattcaaagaaacagaggagatctttgatgggaataggtaacctggcggcagcgcaaaagatg

SEQ ID NO: 76032 - DNA, 103 bp, Artificial Sequence
  Synthetic Polynucleotide
taatacgactcactatagggtataaactaattcaaaaacctattccattcaacagaggagagaatggatgaggtttttgaacctggcggcagcgcaaaagatg

SEQ ID NO: 76033 - DNA, 103 bp, Artificial Sequence
  Synthetic Polynucleotide
taatacgactcactataggggtaattataaactaattcaaaaacctattcaacagaggagagaatagatgtttgaattaaacctggcggcagcgcaaaagatg

SEQ ID NO: 76034 - DNA, 103 bp, Artificial Sequence
  Synthetic Polynucleotide
taatacgactcactatagggatgttgtaattataaactaattcaaaaaccaacagaggagaggttttatgattagtttaaacctggcggcagcgcaaaagatg

SEQ ID NO: 76035 - DNA, 103 bp, Artificial Sequence
  Synthetic Polynucleotide
taatacgactcactatagggttattatgttgtaattataaactaattcaaaacagaggagattgaatatgtttataattaacctggcggcagcgcaaaagatg

SEQ ID NO: 76036 - DNA, 103 bp, Artificial Sequence
  Synthetic Polynucleotide
taatacgactcactataggggccggtgtaatagatatataaattctattaaacagaggagataatagatgttatatatcaacctggcggcagcgcaaaagatg

SEQ ID NO: 76037 - DNA, 103 bp, Artificial Sequence
  Synthetic Polynucleotide
taatacgactcactatagggcttatttattatgttgtaattataaactaaaacagaggagattagttatgaattacaacaacctggcggcagcgcaaaagatg

SEQ ID NO: 76038 - DNA, 103 bp, Artificial Sequence
  Synthetic Polynucleotide
taatacgactcactatagggacttccttatttattatgttgtaattataaaacagaggagattataaatgcaacataataacctggcggcagcgcaaaagatg

SEQ ID NO: 76039 - DNA, 103 bp, Artificial Sequence
  Synthetic Polynucleotide
taatacgactcactatagggtgcacacttccttatttattatgttgtaataacagaggagaattacaatgtaataaataaacctggcggcagcgcaaaagatg

SEQ ID NO: 76040 - DNA, 103 bp, Artificial Sequence
  Synthetic Polynucleotide
taatacgactcactatagggctatttgcacacttccttatttattatgttaacagaggagaaacataatgaataaggaaaacctggcggcagcgcaaaagatg

SEQ ID NO: 76041 - DNA, 103 bp, Artificial Sequence
  Synthetic Polynucleotide
taatacgactcactataggggcgtactatttgcacacttccttatttattaacagaggagaaataaaatgggaagtgtgaacctggcggcagcgcaaaagatg

SEQ ID NO: 76042 - DNA, 103 bp, Artificial Sequence
  Synthetic Polynucleotide
taatacgactcactatagggtttccgcgtactatttgcacacttccttataacagaggagaataaggatgtgtgcaaataacctggcggcagcgcaaaagatg

SEQ ID NO: 76043 - DNA, 103 bp, Artificial Sequence
  Synthetic Polynucleotide
taatacgactcactatagggtgttttttccgcgtactatttgcacacttcaacagaggagagaagtgatgaaatagtacaacctggcggcagcgcaaaagatg

SEQ ID NO: 76044 - DNA, 103 bp, Artificial Sequence
  Synthetic Polynucleotide
taatacgactcactatagggtattatgttttttccgcgtactatttgcacaacagaggagagtgcaaatggtacgcggaaacctggcggcagcgcaaaagatg

SEQ ID NO: 76045 - DNA, 103 bp, Artificial Sequence
  Synthetic Polynucleotide
taatacgactcactatagggggagctattatgttttttccgcgtactattaacagaggagaaatagtatgcggaaaaaaaacctggcggcagcgcaaaagatg

SEQ ID NO: 76046 - DNA, 103 bp, Artificial Sequence
  Synthetic Polynucleotide
taatacgactcactatagggacaggggagctattatgttttttccgcgtaaacagaggagatacgcgatgaaaacataaaacctggcggcagcgcaaaagatg

SEQ ID NO: 76047 - DNA, 103 bp, Artificial Sequence
  Synthetic Polynucleotide
taatacgactcactatagggacttggccggtgtaatagatatataaattcaacagaggagagaatttatgtatctattaaacctggcggcagcgcaaaagatg

SEQ ID NO: 76048 - DNA, 103 bp, Artificial Sequence
  Synthetic Polynucleotide
taatacgactcactatagggtgaaaacaggggagctattatgttttttccaacagaggagaggaaaaatgataatagctaacctggcggcagcgcaaaagatg

SEQ ID NO: 76049 - DNA, 103 bp, Artificial Sequence
  Synthetic Polynucleotide
taatacgactcactatagggatggatgaaaacaggggagctattatgtttaacagaggagaaaacatatgagctcccctaacctggcggcagcgcaaaagatg

SEQ ID NO: 76050 - DNA, 103 bp, Artificial Sequence
  Synthetic Polynucleotide
taatacgactcactatagggaaaccatggatgaaaacaggggagctattaaacagaggagataatagatgccctgttttaacctggcggcagcgcaaaagatg

SEQ ID NO: 76051 - DNA, 103 bp, Artificial Sequence
  Synthetic Polynucleotide
taatacgactcactatagggacttaaaaccatggatgaaaacaggggagcaacagaggagagctcccatgttttcatccaacctggcggcagcgcaaaagatg

SEQ ID NO: 76052 - DNA, 103 bp, Artificial Sequence
  Synthetic Polynucleotide
taatacgactcactatagggcatttacttaaaaccatggatgaaaacaggaacagaggagacctgttatgatccatggtaacctggcggcagcgcaaaagatg

SEQ ID NO: 76053 - DNA, 103 bp, Artificial Sequence
  Synthetic Polynucleotide
taatacgactcactataggggtgatcatttacttaaaaccatggatgaaaaacagaggagatttcatatgtggttttaaaacctggcggcagcgcaaaagatg

SEQ ID NO: 76054 - DNA, 103 bp, Artificial Sequence
  Synthetic Polynucleotide
taatacgactcactatagggagccagtgatcatttacttaaaaccatggaaacagaggagatccatgatgttaagtaaaaacctggcggcagcgcaaaagatg

SEQ ID NO: 76055 - DNA, 103 bp, Artificial Sequence
  Synthetic Polynucleotide
taatacgactcactatagggaaagaagccagtgatcatttacttaaaaccaacagaggagaggttttatgtaaatgatcaacctggcggcagcgcaaaagatg

SEQ ID NO: 76056 - DNA, 103 bp, Artificial Sequence
  Synthetic Polynucleotide
taatacgactcactatagggtgactaaagaagccagtgatcatttacttaaacagaggagataagtaatggatcactggaacctggcggcagcgcaaaagatg

SEQ ID NO: 76057 - DNA, 103 bp, Artificial Sequence
  Synthetic Polynucleotide
taatacgactcactatagggtccattgactaaagaagccagtgatcatttaacagaggagaaaatgaatgctggcttctaacctggcggcagcgcaaaagatg

SEQ ID NO: 76058 - DNA, 103 bp, Artificial Sequence
  Synthetic Polynucleotide
taatacgactcactatagggtgcatacttggccggtgtaatagatatataaacagaggagatatataatgattacaccgaacctggcggcagcgcaaaagatg

SEQ ID NO: 76059 - DNA, 103 bp, Artificial Sequence
  Synthetic Polynucleotide
taatacgactcactataggggaatatccattgactaaagaagccagtgataacagaggagaatcactatgttctttagtaacctggcggcagcgcaaaagatg

SEQ ID NO: 76060 - DNA, 103 bp, Artificial Sequence
  Synthetic Polynucleotide
taatacgactcactatagggtgttcgaatatccattgactaaagaagccaaacagaggagatggcttatgtagtcaatgaacctggcggcagcgcaaaagatg

SEQ ID NO: 76061 - DNA, 103 bp, Artificial Sequence
  Synthetic Polynucleotide
taatacgactcactataggggttaatgttcgaatatccattgactaaagaaacagaggagatctttaatgaatggatataacctggcggcagcgcaaaagatg

SEQ ID NO: 76062 - DNA, 103 bp, Artificial Sequence
  Synthetic Polynucleotide
taatacgactcactatagggaaacggttaatgttcgaatatccattgactaacagaggagaagtcaaatgatattcgaaaacctggcggcagcgcaaaagatg

SEQ ID NO: 76063 - DNA, 103 bp, Artificial Sequence
  Synthetic Polynucleotide
taatacgactcactatagggtgatgaaacggttaatgttcgaatatccataacagaggagaatggatatgcgaacattaaacctggcggcagcgcaaaagatg

SEQ ID NO: 76064 - DNA, 103 bp, Artificial Sequence
  Synthetic Polynucleotide
taatacgactcactatagggaatgatgatgaaacggttaatgttcgaataaacagaggagatattcgatgattaaccgtaacctggcggcagcgcaaaagatg

SEQ ID NO: 76065 - DNA, 103 bp, Artificial Sequence
  Synthetic Polynucleotide
taatacgactcactatagggtgtccaatgatgatgaaacggttaatgttcaacagaggagagaacatatgccgtttcataacctggcggcagcgcaaaagatg

SEQ ID NO: 76066 - DNA, 103 bp, Artificial Sequence
  Synthetic Polynucleotide
taatacgactcactataggggattttgtccaatgatgatgaaacggttaaaacagaggagattaaccatgtcatcatcaaacctggcggcagcgcaaaagatg

SEQ ID NO: 76067 - DNA, 103 bp, Artificial Sequence
  Synthetic Polynucleotide
taatacgactcactatagggatatggattttgtccaatgatgatgaaacgaacagaggagacgtttcatgatcattggaaacctggcggcagcgcaaaagatg

SEQ ID NO: 76068 - DNA, 103 bp, Artificial Sequence
  Synthetic Polynucleotide
taatacgactcactatagggaagaaatatggattttgtccaatgatgatgaacagaggagacatcatatgtggacaaaaaacctggcggcagcgcaaaagatg

SEQ ID NO: 76069 - DNA, 103 bp, Artificial Sequence
  Synthetic Polynucleotide
taatacgactcactatagggtattatgcatacttggccggtgtaatagataacagaggagaatctatatgaccggccaaaacctggcggcagcgcaaaagatg

SEQ ID NO: 76070 - DNA, 103 bp, Artificial Sequence
  Synthetic Polynucleotide
taatacgactcactatagggacattaagaaatatggattttgtccaatgaaacagaggagatcattgatgaaaatccataacctggcggcagcgcaaaagatg

SEQ ID NO: 76071 - DNA, 103 bp, Artificial Sequence
  Synthetic Polynucleotide
taatacgactcactatagggtctttacattaagaaatatggattttgtccaacagaggagaggacaaatgccatatttcaacctggcggcagcgcaaaagatg

SEQ ID NO: 76072 - DNA, 103 bp, Artificial Sequence
  Synthetic Polynucleotide
taatacgactcactatagggatcactctttacattaagaaatatggatttaacagaggagaaaatccatgtttcttaataacctggcggcagcgcaaaagatg

SEQ ID NO: 76073 - DNA, 103 bp, Artificial Sequence
  Synthetic Polynucleotide
taatacgactcactatagggatttgatcactctttacattaagaaatatgaacagaggagacatattatgtaatgtaaaaacctggcggcagcgcaaaagatg

SEQ ID NO: 76074 - DNA, 103 bp, Artificial Sequence
  Synthetic Polynucleotide
taatacgactcactatagggtaatgatttgatcactctttacattaagaaaacagaggagattcttaatgtaaagagtgaacctggcggcagcgcaaaagatg

SEQ ID NO: 76075 - DNA, 103 bp, Artificial Sequence
  Synthetic Polynucleotide
taatacgactcactatagggaaacataatgatttgatcactctttacattaacagaggagaaatgtaatgagtgatcaaaacctggcggcagcgcaaaagatg

SEQ ID NO: 76076 - DNA, 103 bp, Artificial Sequence
  Synthetic Polynucleotide
taatacgactcactatagggacaataaacataatgatttgatcactctttaacagaggagaaaagagatgtcaaatcataacctggcggcagcgcaaaagatg

SEQ ID NO: 76077 - DNA, 103 bp, Artificial Sequence
  Synthetic Polynucleotide
taatacgactcactatagggatggtacaataaacataatgatttgatcacaacagaggagagtgatcatgtcattatgtaacctggcggcagcgcaaaagatg

SEQ ID NO: 76078 - DNA, 103 bp, Artificial Sequence
  Synthetic Polynucleotide
taatacgactcactatagggacaagatggtacaataaacataatgatttgaacagaggagacaaatcatgatgtttattaacctggcggcagcgcaaaagatg

SEQ ID NO: 76079 - DNA, 103 bp, Artificial Sequence
  Synthetic Polynucleotide
taatacgactcactatagggttacaacaagatggtacaataaacataatgaacagaggagacattatatgtattgtaccaacctggcggcagcgcaaaagatg

SEQ ID NO: 76080 - DNA, 103 bp, Artificial Sequence
  Synthetic Polynucleotide
taatacgactcactatagggcttattattatgcatacttggccggtgtaaaacagaggagattacacatgccaagtatgaacctggcggcagcgcaaaagatg

SEQ ID NO: 76081 - DNA, 103 bp, Artificial Sequence
  Synthetic Polynucleotide
taatacgactcactatagggcacatttacaacaagatggtacaataaacaaacagaggagatgtttaatgtaccatcttaacctggcggcagcgcaaaagatg

SEQ ID NO: 76082 - DNA, 103 bp, Artificial Sequence
  Synthetic Polynucleotide
taatacgactcactataggggaatacacatttacaacaagatggtacaataacagaggagaattgtaatgtcttgttgtaacctggcggcagcgcaaaagatg

SEQ ID NO: 76083 - DNA, 103 bp, Artificial Sequence
  Synthetic Polynucleotide
taatacgactcactatagggtaaccgaatacacatttacaacaagatggtaacagaggagaaccatcatgttgtaaatgaacctggcggcagcgcaaaagatg

SEQ ID NO: 76084 - DNA, 103 bp, Artificial Sequence
  Synthetic Polynucleotide
taatacgactcactatagggtccgataaccgaatacacatttacaacaagaacagaggagacttgttatgaatgtgtataacctggcggcagcgcaaaagatg

SEQ ID NO: 76085 - DNA, 103 bp, Artificial Sequence
  Synthetic Polynucleotide
taatacgactcactataggggcagatccgataaccgaatacacatttacaaacagaggagatgtaaaatggtattcggtaacctggcggcagcgcaaaagatg

SEQ ID NO: 76086 - DNA, 103 bp, Artificial Sequence
  Synthetic Polynucleotide
taatacgactcactatagggaaggagcagatccgataaccgaatacacataacagaggagaatgtgtatgcggttatcgaacctggcggcagcgcaaaagatg

SEQ ID NO: 76087 - DNA, 103 bp, Artificial Sequence
  Synthetic Polynucleotide
taatacgactcactatagggagaaaaaggagcagatccgataaccgaataaacagaggagatattcgatgatcggatctaacctggcggcagcgcaaaagatg

SEQ ID NO: 76088 - DNA, 103 bp, Artificial Sequence
  Synthetic Polynucleotide
taatacgactcactatagggttaatagaaaaaggagcagatccgataaccaacagaggagaggttatatgatctgctccaacctggcggcagcgcaaaagatg

SEQ ID NO: 76089 - DNA, 103 bp, Artificial Sequence
  Synthetic Polynucleotide
taatacgactcactatagggatactttaatagaaaaaggagcagatccgaaacagaggagatcggatatgctcctttttaacctggcggcagcgcaaaagatg

SEQ ID NO: 76090 - DNA, 103 bp, Artificial Sequence
  Synthetic Polynucleotide
taatacgactcactatagggcatcgatactttaatagaaaaaggagcagaaacagaggagatctgctatgttttctattaacctggcggcagcgcaaaagatg

SEQ ID NO: 76091 - DNA, 103 bp, Artificial Sequence
  Synthetic Polynucleotide
taatacgactcactatagggcacaacttattattatgcatacttggccggaacagaggagaccggccatgtatgcataaaacctggcggcagcgcaaaagatg

SEQ ID NO: 76092 - DNA, 103 bp, Artificial Sequence
  Synthetic Polynucleotide
taatacgactcactatagggatcgacatcgatactttaatagaaaaaggaaacagaggagatcctttatgtattaaagtaacctggcggcagcgcaaaagatg

SEQ ID NO: 76093 - DNA, 103 bp, Artificial Sequence
  Synthetic Polynucleotide
taatacgactcactatagggacgagatcgacatcgatactttaatagaaaaacagaggagatttctaatgaagtatcgaaacctggcggcagcgcaaaagatg

SEQ ID NO: 76094 - DNA, 103 bp, Artificial Sequence
  Synthetic Polynucleotide
taatacgactcactatagggcttagacgagatcgacatcgatactttaataacagaggagaattaaaatgtcgatgtcgaacctggcggcagcgcaaaagatg

SEQ ID NO: 76095 - DNA, 103 bp, Artificial Sequence
  Synthetic Polynucleotide
taatacgactcactataggggaattcttagacgagatcgacatcgatactaacagaggagaagtatcatggtcgatctcaacctggcggcagcgcaaaagatg

SEQ ID NO: 76096 - DNA, 103 bp, Artificial Sequence
  Synthetic Polynucleotide
taatacgactcactatagggtagttgaattcttagacgagatcgacatcgaacagaggagacgatgtatgtctcgtctaaacctggcggcagcgcaaaagatg

SEQ ID NO: 76097 - DNA, 103 bp, Artificial Sequence
  Synthetic Polynucleotide
taatacgactcactatagggcgatatagttgaattcttagacgagatcgaaacagaggagatcgatcatgtctaagaataacctggcggcagcgcaaaagatg

SEQ ID NO: 76098 - DNA, 103 bp, Artificial Sequence
  Synthetic Polynucleotide
taatacgactcactatagggtatgtcgatatagttgaattcttagacgagaacagaggagactcgtcatggaattcaacaacctggcggcagcgcaaaagatg

SEQ ID NO: 76099 - DNA, 103 bp, Artificial Sequence
  Synthetic Polynucleotide
taatacgactcactatagggtgaaatatgtcgatatagttgaattcttagaacagaggagactaagaatgcaactatataacctggcggcagcgcaaaagatg

SEQ ID NO: 76100 - DNA, 103 bp, Artificial Sequence
  Synthetic Polynucleotide
taatacgactcactatagggacaaatgaaatatgtcgatatagttgaattaacagaggagaaattcaatgatatcgacaaacctggcggcagcgcaaaagatg

SEQ ID NO: 76101 - DNA, 103 bp, Artificial Sequence
  Synthetic Polynucleotide
taatacgactcactatagggtgtatacaaatgaaatatgtcgatatagttaacagaggagaaactatatggacatatttaacctggcggcagcgcaaaagatg

SEQ ID NO: 76102 - DNA, 103 bp, Artificial Sequence
  Synthetic Polynucleotide
taatacgactcactatagggctacccacaacttattattatgcatacttgaacagaggagacaagtaatgataataataaacctggcggcagcgcaaaagatg

SEQ ID NO: 76103 - DNA, 103 bp, Artificial Sequence
  Synthetic Polynucleotide
taatacgactcactatagggttatgtgtatacaaatgaaatatgtcgataaacagaggagatatcgaatgatttcatttaacctggcggcagcgcaaaagatg

SEQ ID NO: 76104 - DNA, 103 bp, Artificial Sequence
  Synthetic Polynucleotide
taatacgactcactatagggaatggttatgtgtatacaaatgaaatatgtaacagaggagaacatatatgatttgtataaacctggcggcagcgcaaaagatg

SEQ ID NO: 76105 - DNA, 103 bp, Artificial Sequence
  Synthetic Polynucleotide
taatacgactcactatagggttagtaatggttatgtgtatacaaatgaaaaacagaggagatttcatatgtatacacataacctggcggcagcgcaaaagatg

SEQ ID NO: 76106 - DNA, 103 bp, Artificial Sequence
  Synthetic Polynucleotide
taatacgactcactatagggctacgttagtaatggttatgtgtatacaaaaacagaggagatttgtaatgacataaccaaacctggcggcagcgcaaaagatg

SEQ ID NO: 76107 - DNA, 103 bp, Artificial Sequence
  Synthetic Polynucleotide
taatacgactcactatagggacattctacgttagtaatggttatgtgtataacagaggagaatacacatgaccattactaacctggcggcagcgcaaaagatg

SEQ ID NO: 76108 - DNA, 103 bp, Artificial Sequence
  Synthetic Polynucleotide
taatacgactcactatagggcctatacattctacgttagtaatggttatgaacagaggagacataacatgtactaacgtaacctggcggcagcgcaaaagatg

SEQ ID NO: 76109 - DNA, 103 bp, Artificial Sequence
  Synthetic Polynucleotide
taatacgactcactatagggctcttcctatacattctacgttagtaatggaacagaggagaccattaatgacgtagaataacctggcggcagcgcaaaagatg

SEQ ID NO: 76110 - DNA, 103 bp, Artificial Sequence
  Synthetic Polynucleotide
taatacgactcactatagggtacatctcttcctatacattctacgttagtaacagaggagaactaacatggaatgtataaacctggcggcagcgcaaaagatg

SEQ ID NO: 76111 - DNA, 103 bp, Artificial Sequence
  Synthetic Polynucleotide
taatacgactcactatagggcccgttacatctcttcctatacattctacgaacagaggagacgtagaatgtataggaagaacctggcggcagcgcaaaagatg

SEQ ID NO: 76112 - DNA, 103 bp, Artificial Sequence
  Synthetic Polynucleotide
taatacgactcactatagggctgttcccgttacatctcttcctatacattaacagaggagaaatgtaatggaagagatgaacctggcggcagcgcaaaagatg

SEQ ID NO: 76113 - DNA, 103 bp, Artificial Sequence
  Synthetic Polynucleotide
taatacgactcactatagggtgatactacccacaacttattattatgcataacagaggagaatgcatatgaataagttgaacctggcggcagcgcaaaagatg

SEQ ID NO: 76114 - DNA, 103 bp, Artificial Sequence
  Synthetic Polynucleotide
taatacgactcactatagggaaaccctgttcccgttacatctcttcctataacagaggagaataggaatggatgtaacgaacctggcggcagcgcaaaagatg

SEQ ID NO: 76115 - DNA, 103 bp, Artificial Sequence
  Synthetic Polynucleotide
taatacgactcactatagggtcaacaaaccctgttcccgttacatctcttaacagaggagaaagagaatgaacgggaacaacctggcggcagcgcaaaagatg

SEQ ID NO: 76116 - DNA, 103 bp, Artificial Sequence
  Synthetic Polynucleotide
taatacgactcactataggggcgaatcaacaaaccctgttcccgttacataacagaggagaatgtaaatggaacagggtaacctggcggcagcgcaaaagatg

SEQ ID NO: 76117 - DNA, 103 bp, Artificial Sequence
  Synthetic Polynucleotide
taatacgactcactatagggagtttgcgaatcaacaaaccctgttcccgtaacagaggagaacgggaatggggtttgttaacctggcggcagcgcaaaagatg

SEQ ID NO: 76118 - DNA, 103 bp, Artificial Sequence
  Synthetic Polynucleotide
taatacgactcactatagggagaatagtttgcgaatcaacaaaccctgttaacagaggagaaacaggatgtgttgattcaacctggcggcagcgcaaaagatg

SEQ ID NO: 76119 - DNA, 103 bp, Artificial Sequence
  Synthetic Polynucleotide
taatacgactcactataggggtattagaatagtttgcgaatcaacaaaccaacagaggagaggtttgatgattcgcaaaaacctggcggcagcgcaaaagatg

SEQ ID NO: 76120 - DNA, 103 bp, Artificial Sequence
  Synthetic Polynucleotide
taatacgactcactatagggattatgtattagaatagtttgcgaatcaacaacagaggagagttgatatgcaaactattaacctggcggcagcgcaaaagatg

SEQ ID NO: 76121 - DNA, 103 bp, Artificial Sequence
  Synthetic Polynucleotide
taatacgactcactataggggaagaattatgtattagaatagtttgcgaaaacagaggagattcgcaatgtattctaataacctggcggcagcgcaaaagatg

SEQ ID NO: 76122 - DNA, 103 bp, Artificial Sequence
  Synthetic Polynucleotide
taatacgactcactatagggtaacagaagaattatgtattagaatagtttaacagaggagaaaactaatgtaatacataaacctggcggcagcgcaaaagatg

SEQ ID NO: 76123 - DNA, 103 bp, Artificial Sequence
  Synthetic Polynucleotide
taatacgactcactatagggcgtattaacagaagaattatgtattagaataacagaggagaattctaatgcataattctaacctggcggcagcgcaaaagatg

SEQ ID NO: 76124 - DNA, 103 bp, Artificial Sequence
  Synthetic Polynucleotide
taatacgactcactatagggaagattctgaacgagaacgactatttcaccaacagaggagaggtgaaatggtcgttctcaacctggcggcagcgcaaaagatg

SEQ ID NO: 76125 - DNA, 103 bp, Artificial Sequence
  Synthetic Polynucleotide
taatacgactcactataggggtggatgatactacccacaacttattattaaacagaggagataataaatggttgtgggtaacctggcggcagcgcaaaagatg

SEQ ID NO: 76126 - DNA, 103 bp, Artificial Sequence
  Synthetic Polynucleotide
taatacgactcactatagggcaagacgtattaacagaagaattatgtattaacagaggagaaatacaatgttcttctgtaacctggcggcagcgcaaaagatg

SEQ ID NO: 76127 - DNA, 103 bp, Artificial Sequence
  Synthetic Polynucleotide
taatacgactcactatagggacgtgcaagacgtattaacagaagaattataacagaggagaataattatgctgttaataaacctggcggcagcgcaaaagatg

SEQ ID NO: 76128 - DNA, 103 bp, Artificial Sequence
  Synthetic Polynucleotide
taatacgactcactatagggagattacgtgcaagacgtattaacagaagaaacagaggagatcttctatgaatacgtctaacctggcggcagcgcaaaagatg

SEQ ID NO: 76129 - DNA, 103 bp, Artificial Sequence
  Synthetic Polynucleotide
taatacgactcactatagggataatagattacgtgcaagacgtattaacaaacagaggagatgttaaatggtcttgcacaacctggcggcagcgcaaaagatg

SEQ ID NO: 76130 - DNA, 103 bp, Artificial Sequence
  Synthetic Polynucleotide
taatacgactcactatagggcatctataatagattacgtgcaagacgtataacagaggagaatacgtatggcacgtaataacctggcggcagcgcaaaagatg

SEQ ID NO: 76131 - DNA, 103 bp, Artificial Sequence
  Synthetic Polynucleotide
taatacgactcactatagggcttggcatctataatagattacgtgcaagaaacagaggagatcttgcatgtaatctattaacctggcggcagcgcaaaagatg

SEQ ID NO: 76132 - DNA, 103 bp, Artificial Sequence
  Synthetic Polynucleotide
taatacgactcactataggggatatcttggcatctataatagattacgtgaacagaggagacacgtaatgtattatagaaacctggcggcagcgcaaaagatg

SEQ ID NO: 76133 - DNA, 103 bp, Artificial Sequence
  Synthetic Polynucleotide
taatacgactcactatagggatatagatatcttggcatctataatagattaacagaggagaaatctaatgtagatgccaaacctggcggcagcgcaaaagatg

SEQ ID NO: 76134 - DNA, 103 bp, Artificial Sequence
  Synthetic Polynucleotide
taatacgactcactatagggtaattatatagatatcttggcatctataataacagaggagaattataatggccaagataaacctggcggcagcgcaaaagatg

SEQ ID NO: 76135 - DNA, 103 bp, Artificial Sequence
  Synthetic Polynucleotide
taatacgactcactatagggcaaaataattatatagatatcttggcatctaacagaggagaagatgcatggatatctataacctggcggcagcgcaaaagatg

SEQ ID NO: 76136 - DNA, 103 bp, Artificial Sequence
  Synthetic Polynucleotide
taatacgactcactatagggaatatgtggatgatactacccacaacttataacagaggagaataagtatggggtagtataacctggcggcagcgcaaaagatg

SEQ ID NO: 76137 - DNA, 103 bp, Artificial Sequence
  Synthetic Polynucleotide
taatacgactcactatagggtcttacaaaataattatatagatatcttggaacagaggagaccaagaatgctatataataacctggcggcagcgcaaaagatg

SEQ ID NO: 76138 - DNA, 103 bp, Artificial Sequence
  Synthetic Polynucleotide
taatacgactcactatagggcatcatcttacaaaataattatatagatataacagaggagaatatctatgtaattatttaacctggcggcagcgcaaaagatg

SEQ ID NO: 76139 - DNA, 103 bp, Artificial Sequence
  Synthetic Polynucleotide
taatacgactcactataggggttaacatcatcttacaaaataattatataaacagaggagatatataatgattttgtaaaacctggcggcagcgcaaaagatg

SEQ ID NO: 76140 - DNA, 103 bp, Artificial Sequence
  Synthetic Polynucleotide
taatacgactcactatagggacatagttaacatcatcttacaaaataattaacagaggagaaattatatggtaagatgaaacctggcggcagcgcaaaagatg

SEQ ID NO: 76141 - DNA, 103 bp, Artificial Sequence
  Synthetic Polynucleotide
taatacgactcactatagggagatcacatagttaacatcatcttacaaaaaacagaggagattttgtatgatgatgttaaacctggcggcagcgcaaaagatg

SEQ ID NO: 76142 - DNA, 103 bp, Artificial Sequence
  Synthetic Polynucleotide
taatacgactcactatagggtatatagatcacatagttaacatcatcttaaacagaggagataagatatggttaactataacctggcggcagcgcaaaagatg

SEQ ID NO: 76143 - DNA, 103 bp, Artificial Sequence
  Synthetic Polynucleotide
taatacgactcactatagggctacttatatagatcacatagttaacatcaaacagaggagatgatgtatgctatgtgataacctggcggcagcgcaaaagatg

SEQ ID NO: 76144 - DNA, 103 bp, Artificial Sequence
  Synthetic Polynucleotide
taatacgactcactatagggttacactacttatatagatcacatagttaaaacagaggagattaactatgtgatctataaacctggcggcagcgcaaaagatg

SEQ ID NO: 76145 - DNA, 103 bp, Artificial Sequence
  Synthetic Polynucleotide
taatacgactcactatagggaattattacactacttatatagatcacataaacagaggagatatgtgatgtatataagtaacctggcggcagcgcaaaagatg

SEQ ID NO: 76146 - DNA, 103 bp, Artificial Sequence
  Synthetic Polynucleotide
taatacgactcactatagggacataaattattacactacttatatagatcaacagaggagagatctaatgaagtagtgtaacctggcggcagcgcaaaagatg

SEQ ID NO: 76147 - DNA, 103 bp, Artificial Sequence
  Synthetic Polynucleotide
taatacgactcactatagggttataaatatgtggatgatactacccacaaaacagaggagattgtggatggtatcatccaacctggcggcagcgcaaaagatg

SEQ ID NO: 76148 - DNA, 103 bp, Artificial Sequence
  Synthetic Polynucleotide
taatacgactcactataggggaaatacataaattattacactacttatataacagaggagaatataaatggtgtaataaaacctggcggcagcgcaaaagatg

SEQ ID NO: 76149 - DNA, 103 bp, Artificial Sequence
  Synthetic Polynucleotide
taatacgactcactatagggatatcgaaatacataaattattacactactaacagaggagaagtagtatgataatttataacctggcggcagcgcaaaagatg

SEQ ID NO: 76150 - DNA, 103 bp, Artificial Sequence
  Synthetic Polynucleotide
taatacgactcactatagggaacatatatcgaaatacataaattattacaaacagaggagatgtaatatgttatgtattaacctggcggcagcgcaaaagatg

SEQ ID NO: 76151 - DNA, 103 bp, Artificial Sequence
  Synthetic Polynucleotide
taatacgactcactataggggttggaacatatatcgaaatacataaattaaacagaggagataatttatgtatttcgataacctggcggcagcgcaaaagatg

SEQ ID NO: 76152 - DNA, 103 bp, Artificial Sequence
  Synthetic Polynucleotide
taatacgactcactatagggacagagttggaacatatatcgaaatacataaacagaggagatatgtaatgcgatatatgaacctggcggcagcgcaaaagatg

SEQ ID NO: 76153 - DNA, 103 bp, Artificial Sequence
  Synthetic Polynucleotide
taatacgactcactatagggcaaagacagagttggaacatatatcgaaataacagaggagaatttcgatgtatgttccaaacctggcggcagcgcaaaagatg

SEQ ID NO: 76154 - DNA, 103 bp, Artificial Sequence
  Synthetic Polynucleotide
taatacgactcactatagggcatcacaaagacagagttggaacatatatcaacagaggagagatataatgtccaactctaacctggcggcagcgcaaaagatg

SEQ ID NO: 76155 - DNA, 103 bp, Artificial Sequence
  Synthetic Polynucleotide
taatacgactcactatagggctagacatcacaaagacagagttggaacataacagaggagaatgttcatgctctgtcttaacctggcggcagcgcaaaagatg

SEQ ID NO: 76156 - DNA, 103 bp, Artificial Sequence
  Synthetic Polynucleotide
taatacgactcactatagggcaaaactagacatcacaaagacagagttggaacagaggagaccaactatgtctttgtgaaacctggcggcagcgcaaaagatg

SEQ ID NO: 76157 - DNA, 103 bp, Artificial Sequence
  Synthetic Polynucleotide
taatacgactcactatagggtattacaaaactagacatcacaaagacagaaacagaggagatctgtcatggtgatgtctaacctggcggcagcgcaaaagatg

SEQ ID NO: 76158 - DNA, 103 bp, Artificial Sequence
  Synthetic Polynucleotide
taatacgactcactatagggctaaattataaatatgtggatgatactaccaacagaggagaggtagtatgatccacataaacctggcggcagcgcaaaagatg

SEQ ID NO: 76159 - DNA, 103 bp, Artificial Sequence
  Synthetic Polynucleotide
taatacgactcactatagggatagatattacaaaactagacatcacaaagaacagaggagactttgtatggtctagtttaacctggcggcagcgcaaaagatg

SEQ ID NO: 76160 - DNA, 103 bp, Artificial Sequence
  Synthetic Polynucleotide
taatacgactcactatagggatgctatagatattacaaaactagacatcaaacagaggagatgatgtatggttttgtaaaacctggcggcagcgcaaaagatg

SEQ ID NO: 76161 - DNA, 103 bp, Artificial Sequence
  Synthetic Polynucleotide
taatacgactcactatagggtgaggatgctatagatattacaaaactagaaacagaggagatctagtatggtaatatctaacctggcggcagcgcaaaagatg

SEQ ID NO: 76162 - DNA, 103 bp, Artificial Sequence
  Synthetic Polynucleotide
taatacgactcactatagggttttttgaggatgctatagatattacaaaaaacagaggagattttgtatgatctatagcaacctggcggcagcgcaaaagatg

SEQ ID NO: 76163 - DNA, 103 bp, Artificial Sequence
  Synthetic Polynucleotide
taatacgactcactatagggatatattttttgaggatgctatagatattaaacagaggagataatatatgtagcatcctaacctggcggcagcgcaaaagatg

SEQ ID NO: 76164 - DNA, 103 bp, Artificial Sequence
  Synthetic Polynucleotide
taatacgactcactatagggtgcgaatatattttttgaggatgctatagaaacagaggagatctataatgtcctcaaaaaacctggcggcagcgcaaaagatg

SEQ ID NO: 76165 - DNA, 103 bp, Artificial Sequence
  Synthetic Polynucleotide
taatacgactcactatagggatatatgcgaatatattttttgaggatgctaacagaggagaagcatcatgaaaaaatataacctggcggcagcgcaaaagatg

SEQ ID NO: 76166 - DNA, 103 bp, Artificial Sequence
  Synthetic Polynucleotide
taatacgactcactatagggtgggaatatatgcgaatatattttttgaggaacagaggagacctcaaatgatatattcgaacctggcggcagcgcaaaagatg

SEQ ID NO: 76167 - DNA, 103 bp, Artificial Sequence
  Synthetic Polynucleotide
taatacgactcactatagggagacttgggaatatatgcgaatatatttttaacagaggagaaaaaatatgttcgcatataacctggcggcagcgcaaaagatg

SEQ ID NO: 76168 - DNA, 103 bp, Artificial Sequence
  Synthetic Polynucleotide
taatacgactcactatagggactgaagacttgggaatatatgcgaatataaacagaggagatatattatgatatattccaacctggcggcagcgcaaaagatg

SEQ ID NO: 76169 - DNA, 103 bp, Artificial Sequence
  Synthetic Polynucleotide
taatacgactcactatagggaagtcctaaattataaatatgtggatgataaacagaggagatatcatatgcatatttataacctggcggcagcgcaaaagatg

SEQ ID NO: 76170 - DNA, 103 bp, Artificial Sequence
  Synthetic Polynucleotide
taatacgactcactatagggatagaactgaagacttgggaatatatgcgaaacagaggagatcgcatatgttcccaagtaacctggcggcagcgcaaaagatg

SEQ ID NO: 76171 - DNA, 103 bp, Artificial Sequence
  Synthetic Polynucleotide
taatacgactcactatagggagaagatagaactgaagacttgggaatataaacagaggagatatattatgaagtcttcaaacctggcggcagcgcaaaagatg

SEQ ID NO: 76172 - DNA, 103 bp, Artificial Sequence
  Synthetic Polynucleotide
taatacgactcactatagggtttttagaagatagaactgaagacttgggaaacagaggagatcccaaatgttcagttctaacctggcggcagcgcaaaagatg

SEQ ID NO: 76173 - DNA, 103 bp, Artificial Sequence
  Synthetic Polynucleotide
taatacgactcactatagggaagattttttagaagatagaactgaagactaacagaggagaagtcttatgttctatcttaacctggcggcagcgcaaaagatg

SEQ ID NO: 76174 - DNA, 103 bp, Artificial Sequence
  Synthetic Polynucleotide
taatacgactcactatagggcgttgaagattttttagaagatagaactgaaacagaggagatcagttatgtcttctaaaaacctggcggcagcgcaaaagatg

SEQ ID NO: 76175 - DNA, 103 bp, Artificial Sequence
  Synthetic Polynucleotide
taatacgactcactatagggccatacgttgaagattttttagaagatagaaacagaggagatctatcatgtaaaaaatcaacctggcggcagcgcaaaagatg

SEQ ID NO: 76176 - DNA, 103 bp, Artificial Sequence
  Synthetic Polynucleotide
taatacgactcactatagggatattccatacgttgaagattttttagaagaacagaggagacttctaatgaatcttcaaaacctggcggcagcgcaaaagatg

SEQ ID NO: 76177 - DNA, 103 bp, Artificial Sequence
  Synthetic Polynucleotide
taatacgactcactatagggttattatattccatacgttgaagattttttaacagaggagaaaaaaaatgtcaacgtataacctggcggcagcgcaaaagatg

SEQ ID NO: 76178 - DNA, 103 bp, Artificial Sequence
  Synthetic Polynucleotide
taatacgactcactatagggatagattattatattccatacgttgaagataacagaggagaatcttcatggtatggaataacctggcggcagcgcaaaagatg

SEQ ID NO: 76179 - DNA, 103 bp, Artificial Sequence
  Synthetic Polynucleotide
taatacgactcactataggggtaaaatagattattatattccatacgttgaacagaggagacaacgtatggaatataataacctggcggcagcgcaaaagatg

SEQ ID NO: 76180 - DNA, 103 bp, Artificial Sequence
  Synthetic Polynucleotide
taatacgactcactatagggatacaaagtcctaaattataaatatgtggaaacagaggagatccacaatgttataatttaacctggcggcagcgcaaaagatg

SEQ ID NO: 76181 - DNA, 103 bp, Artificial Sequence
  Synthetic Polynucleotide
taatacgactcactatagggaagaggtaaaatagattattatattccataaacagaggagatatggaatgtaataatctaacctggcggcagcgcaaaagatg

SEQ ID NO: 76182 - DNA, 103 bp, Artificial Sequence
  Synthetic Polynucleotide
taatacgactcactatagggatcagaagaggtaaaatagattattatattaacagaggagaaatataatgatctattttaacctggcggcagcgcaaaagatg

SEQ ID NO: 76183 - DNA, 103 bp, Artificial Sequence
  Synthetic Polynucleotide
taatacgactcactatagggatgatatcagaagaggtaaaatagattattaacagaggagaaataatatgttttacctcaacctggcggcagcgcaaaagatg

SEQ ID NO: 76184 - DNA, 103 bp, Artificial Sequence
  Synthetic Polynucleotide
taatacgactcactatagggcattaatgatatcagaagaggtaaaatagaaacagaggagatctattatgcctcttctgaacctggcggcagcgcaaaagatg

SEQ ID NO: 76185 - DNA, 103 bp, Artificial Sequence
  Synthetic Polynucleotide
taatacgactcactatagggtatatcattaatgatatcagaagaggtaaaaacagaggagatttaccatgtctgatatcaacctggcggcagcgcaaaagatg

SEQ ID NO: 76186 - DNA, 103 bp, Artificial Sequence
  Synthetic Polynucleotide
taatacgactcactatagggaaaactatatcattaatgatatcagaagagaacagaggagactcttcatgtatcattaaaacctggcggcagcgcaaaagatg

SEQ ID NO: 76187 - DNA, 103 bp, Artificial Sequence
  Synthetic Polynucleotide
taatacgactcactatagggtgtcaaaaactatatcattaatgatatcagaacagaggagactgataatgttaatgataaacctggcggcagcgcaaaagatg

SEQ ID NO: 76188 - DNA, 103 bp, Artificial Sequence
  Synthetic Polynucleotide
taatacgactcactataggggatagtgtcaaaaactatatcattaatgataacagaggagaatcattatggatatagttaacctggcggcagcgcaaaagatg

SEQ ID NO: 76189 - DNA, 103 bp, Artificial Sequence
  Synthetic Polynucleotide
taatacgactcactatagggcagaagatagtgtcaaaaactatatcattaaacagaggagataatgaatgagtttttgaaacctggcggcagcgcaaaagatg

SEQ ID NO: 76190 - DNA, 103 bp, Artificial Sequence
  Synthetic Polynucleotide
taatacgactcactatagggattgacagaagatagtgtcaaaaactatataacagaggagaatatagatgttgacactaaacctggcggcagcgcaaaagatg

SEQ ID NO: 76191 - DNA, 103 bp, Artificial Sequence
  Synthetic Polynucleotide
taatacgactcactatagggactgaatacaaagtcctaaattataaatataacagaggagaatatttatgatttaggacaacctggcggcagcgcaaaagatg

SEQ ID NO: 76192 - DNA, 103 bp, Artificial Sequence
  Synthetic Polynucleotide
taatacgactcactatagggaatcaattgacagaagatagtgtcaaaaacaacagaggagagtttttatgactatcttcaacctggcggcagcgcaaaagatg

SEQ ID NO: 76193 - DNA, 103 bp, Artificial Sequence
  Synthetic Polynucleotide
taatacgactcactatagggataagaatcaattgacagaagatagtgtcaaacagaggagatgacacatgcttctgtcaaacctggcggcagcgcaaaagatg

SEQ ID NO: 76194 - DNA, 103 bp, Artificial Sequence
  Synthetic Polynucleotide
taatacgactcactatagggagtgaataagaatcaattgacagaagatagaacagaggagactatctatggtcaattgaaacctggcggcagcgcaaaagatg

SEQ ID NO: 76195 - DNA, 103 bp, Artificial Sequence
  Synthetic Polynucleotide
taatacgactcactataggggatatagtgaataagaatcaattgacagaaaacagaggagattctgtatgttgattcttaacctggcggcagcgcaaaagatg

SEQ ID NO: 76196 - DNA, 103 bp, Artificial Sequence
  Synthetic Polynucleotide
taatacgactcactatagggtcttagatatagtgaataagaatcaattgaaacagaggagatcaattatgtcttattcaaacctggcggcagcgcaaaagatg

SEQ ID NO: 76197 - DNA, 103 bp, Artificial Sequence
  Synthetic Polynucleotide
taatacgactcactatagggccgtttcttagatatagtgaataagaatcaaacagaggagatgattcatgttcactataaacctggcggcagcgcaaaagatg

SEQ ID NO: 76198 - DNA, 103 bp, Artificial Sequence
  Synthetic Polynucleotide
taatacgactcactataggggctatccgtttcttagatatagtgaataagaacagaggagacttattatgtatatctaaaacctggcggcagcgcaaaagatg

SEQ ID NO: 76199 - DNA, 103 bp, Artificial Sequence
  Synthetic Polynucleotide
taatacgactcactataggggggacgctatccgtttcttagatatagtgaaacagaggagatcactaatgctaagaaacaacctggcggcagcgcaaaagatg

SEQ ID NO: 76200 - DNA, 103 bp, Artificial Sequence
  Synthetic Polynucleotide
taatacgactcactatagggtcctagggacgctatccgtttcttagatataacagaggagaatatctatgaaacggataaacctggcggcagcgcaaaagatg

SEQ ID NO: 76201 - DNA, 103 bp, Artificial Sequence
  Synthetic Polynucleotide
taatacgactcactataggggttcgtcctagggacgctatccgtttcttaaacagaggagataagaaatggatagcgtcaacctggcggcagcgcaaaagatg

SEQ ID NO: 76202 - DNA, 103 bp, Artificial Sequence
  Synthetic Polynucleotide
taatacgactcactatagggaaaatactgaatacaaagtcctaaattataaacagaggagatataatatgggactttgtaacctggcggcagcgcaaaagatg

SEQ ID NO: 76203 - DNA, 103 bp, Artificial Sequence
  Synthetic Polynucleotide
taatacgactcactatagggcagtagttcgtcctagggacgctatccgttaacagaggagaaacggaatgcgtccctagaacctggcggcagcgcaaaagatg

SEQ ID NO: 76204 - DNA, 103 bp, Artificial Sequence
  Synthetic Polynucleotide
taatacgactcactatagggaatggcagtagttcgtcctagggacgctataacagaggagaatagcgatgctaggacgaaacctggcggcagcgcaaaagatg

SEQ ID NO: 76205 - DNA, 103 bp, Artificial Sequence
  Synthetic Polynucleotide
taatacgactcactatagggatattaatggcagtagttcgtcctagggacaacagaggagagtccctatgacgaactacaacctggcggcagcgcaaaagatg

SEQ ID NO: 76206 - DNA, 103 bp, Artificial Sequence
  Synthetic Polynucleotide
taatacgactcactatagggtagagatattaatggcagtagttcgtcctaaacagaggagataggacatgctactgccaaacctggcggcagcgcaaaagatg

SEQ ID NO: 76207 - DNA, 103 bp, Artificial Sequence
  Synthetic Polynucleotide
taatacgactcactatagggtataatagagatattaatggcagtagttcgaacagaggagacgaactatggccattaataacctggcggcagcgcaaaagatg

SEQ ID NO: 76208 - DNA, 103 bp, Artificial Sequence
  Synthetic Polynucleotide
taatacgactcactataggggaagctataatagagatattaatggcagtaaacagaggagatactgcatgtaatatctcaacctggcggcagcgcaaaagatg

SEQ ID NO: 76209 - DNA, 103 bp, Artificial Sequence
  Synthetic Polynucleotide
taatacgactcactatagggatccagaagctataatagagatattaatggaacagaggagaccattaatgtctctattaaacctggcggcagcgcaaaagatg

SEQ ID NO: 76210 - DNA, 103 bp, Artificial Sequence
  Synthetic Polynucleotide
taatacgactcactatagggattatatccagaagctataatagagatattaacagaggagaaatatcatgattatagctaacctggcggcagcgcaaaagatg

SEQ ID NO: 76211 - DNA, 103 bp, Artificial Sequence
  Synthetic Polynucleotide
taatacgactcactataggggatgaattatatccagaagctataatagagaacagaggagactctatatgagcttctggaacctggcggcagcgcaaaagatg

SEQ ID NO: 76212 - DNA, 103 bp, Artificial Sequence
  Synthetic Polynucleotide
taatacgactcactatagggtaatagatgaattatatccagaagctataaaacagaggagattatagatgctggatataaacctggcggcagcgcaaaagatg

SEQ ID NO: 76213 - DNA, 103 bp, Artificial Sequence
  Synthetic Polynucleotide
taatacgactcactatagggttccaaaaatactgaatacaaagtcctaaaaacagaggagatttaggatgttgtattcaaacctggcggcagcgcaaaagatg

SEQ ID NO: 76214 - DNA, 103 bp, Artificial Sequence
  Synthetic Polynucleotide
taatacgactcactatagggtggtataatagatgaattatatccagaagcaacagaggagagcttctatgtataattcaaacctggcggcagcgcaaaagatg

SEQ ID NO: 76215 - DNA, 103 bp, Artificial Sequence
  Synthetic Polynucleotide
taatacgactcactatagggaattctggtataatagatgaattatatccaaacagaggagatggataatgttcatctataacctggcggcagcgcaaaagatg

SEQ ID NO: 76216 - DNA, 103 bp, Artificial Sequence
  Synthetic Polynucleotide
taatacgactcactatagggctattaattctggtataatagatgaattataacagaggagaataattatgctattatacaacctggcggcagcgcaaaagatg

SEQ ID NO: 76217 - DNA, 103 bp, Artificial Sequence
  Synthetic Polynucleotide
taatacgactcactatagggagttcctattaattctggtataatagatgaaacagaggagatcatctatgataccagaaaacctggcggcagcgcaaaagatg

SEQ ID NO: 76218 - DNA, 103 bp, Artificial Sequence
  Synthetic Polynucleotide
taatacgactcactatagggggaatagttcctattaattctggtataataaacagaggagatattatatgagaattaataacctggcggcagcgcaaaagatg

SEQ ID NO: 76219 - DNA, 103 bp, Artificial Sequence
  Synthetic Polynucleotide
taatacgactcactatagggaatacggaatagttcctattaattctggtaaacagaggagataccagatgtaataggaaaacctggcggcagcgcaaaagatg

SEQ ID NO: 76220 - DNA, 103 bp, Artificial Sequence
  Synthetic Polynucleotide
taatacgactcactatagggagataaatacggaatagttcctattaattcaacagaggagagaattaatgggaactattaacctggcggcagcgcaaaagatg

SEQ ID NO: 76221 - DNA, 103 bp, Artificial Sequence
  Synthetic Polynucleotide
taatacgactcactatagggatgttagataaatacggaatagttcctattaacagaggagaaataggatgtattccgtaaacctggcggcagcgcaaaagatg

SEQ ID NO: 76222 - DNA, 103 bp, Artificial Sequence
  Synthetic Polynucleotide
taatacgactcactatagggaaactatgttagataaatacggaatagttcaacagaggagagaactaatgcgtatttataacctggcggcagcgcaaaagatg

SEQ ID NO: 76223 - DNA, 103 bp, Artificial Sequence
  Synthetic Polynucleotide
taatacgactcactatagggtcttaaaactatgttagataaatacggaataacagaggagaattccgatgttatctaacaacctggcggcagcgcaaaagatg

SEQ ID NO: 76224 - DNA, 103 bp, Artificial Sequence
  Synthetic Polynucleotide
taatacgactcactatagggtatgattccaaaaatactgaatacaaagtcaacagaggagagactttatgttcagtattaacctggcggcagcgcaaaagatg

SEQ ID NO: 76225 - DNA, 103 bp, Artificial Sequence
  Synthetic Polynucleotide
taatacgactcactataggggactttcttaaaactatgttagataaatacaacagaggagagtatttatgtaacatagtaacctggcggcagcgcaaaagatg

SEQ ID NO: 76226 - DNA, 103 bp, Artificial Sequence
  Synthetic Polynucleotide
taatacgactcactatagggattctgactttcttaaaactatgttagataaacagaggagatatctaatgtagttttaaaacctggcggcagcgcaaaagatg

SEQ ID NO: 76227 - DNA, 103 bp, Artificial Sequence
  Synthetic Polynucleotide
taatacgactcactatagggcttagattctgactttcttaaaactatgttaacagaggagaaacataatgttaagaaagaacctggcggcagcgcaaaagatg

SEQ ID NO: 76228 - DNA, 103 bp, Artificial Sequence
  Synthetic Polynucleotide
taatacgactcactatagggcaggtcttagattctgactttcttaaaactaacagaggagaagttttatgaaagtcagaaacctggcggcagcgcaaaagatg

SEQ ID NO: 76229 - DNA, 103 bp, Artificial Sequence
  Synthetic Polynucleotide
taatacgactcactatagggaacatcaggtcttagattctgactttcttaaacagaggagataagaaatgcagaatctaaacctggcggcagcgcaaaagatg

SEQ ID NO: 76230 - DNA, 103 bp, Artificial Sequence
  Synthetic Polynucleotide
taatacgactcactatagggatatgaacatcaggtcttagattctgacttaacagaggagaaagtcaatgtctaagaccaacctggcggcagcgcaaaagatg

SEQ ID NO: 76231 - DNA, 103 bp, Artificial Sequence
  Synthetic Polynucleotide
taatacgactcactatagggccaatatatgaacatcaggtcttagattctaacagaggagaagaatcatggacctgatgaacctggcggcagcgcaaaagatg

SEQ ID NO: 76232 - DNA, 103 bp, Artificial Sequence
  Synthetic Polynucleotide
taatacgactcactatagggatgaaccaatatatgaacatcaggtcttagaacagaggagactaagaatggatgttcataacctggcggcagcgcaaaagatg

SEQ ID NO: 76233 - DNA, 103 bp, Artificial Sequence
  Synthetic Polynucleotide
taatacgactcactatagggcatgtatgaaccaatatatgaacatcaggtaacagaggagaacctgaatgtcatatattaacctggcggcagcgcaaaagatg

SEQ ID NO: 76234 - DNA, 103 bp, Artificial Sequence
  Synthetic Polynucleotide
taatacgactcactatagggcatttcatgtatgaaccaatatatgaacataacagaggagaatgttcatgtattggttcaacctggcggcagcgcaaaagatg

SEQ ID NO: 76235 - DNA, 103 bp, Artificial Sequence
  Synthetic Polynucleotide
taatacgactcactatagggtgcaaaagattctgaacgagaacgactattaacagaggagaaatagtatgtctcgttcaaacctggcggcagcgcaaaagatg

SEQ ID NO: 76236 - DNA, 103 bp, Artificial Sequence
  Synthetic Polynucleotide
taatacgactcactatagggttttttatgattccaaaaatactgaatacaaacagaggagatgtattatgtatttttggaacctggcggcagcgcaaaagatg

SEQ ID NO: 76237 - DNA, 103 bp, Artificial Sequence
  Synthetic Polynucleotide
taatacgactcactataggggagatcatttcatgtatgaaccaatatatgaacagaggagacatataatggttcatacaaacctggcggcagcgcaaaagatg

SEQ ID NO: 76238 - DNA, 103 bp, Artificial Sequence
  Synthetic Polynucleotide
taatacgactcactatagggcaatagagatcatttcatgtatgaaccaataacagaggagaattggtatgtacatgaaaaacctggcggcagcgcaaaagatg

SEQ ID NO: 76239 - DNA, 103 bp, Artificial Sequence
  Synthetic Polynucleotide
taatacgactcactatagggatcatcaatagagatcatttcatgtatgaaaacagaggagattcataatggaaatgatcaacctggcggcagcgcaaaagatg

SEQ ID NO: 76240 - DNA, 103 bp, Artificial Sequence
  Synthetic Polynucleotide
taatacgactcactatagggtcactatcatcaatagagatcatttcatgtaacagaggagaacatgaatggatctctataacctggcggcagcgcaaaagatg

SEQ ID NO: 76241 - DNA, 103 bp, Artificial Sequence
  Synthetic Polynucleotide
taatacgactcactatagggaatagtcactatcatcaatagagatcatttaacagaggagaaaatgaatgctattgatgaacctggcggcagcgcaaaagatg

SEQ ID NO: 76242 - DNA, 103 bp, Artificial Sequence
  Synthetic Polynucleotide
taatacgactcactatagggaacgaaatagtcactatcatcaatagagataacagaggagaatctctatggatgatagtaacctggcggcagcgcaaaagatg

SEQ ID NO: 76243 - DNA, 103 bp, Artificial Sequence
  Synthetic Polynucleotide
taatacgactcactatagggcagagaacgaaatagtcactatcatcaataaacagaggagatattgaatgtagtgactaaacctggcggcagcgcaaaagatg

SEQ ID NO: 76244 - DNA, 103 bp, Artificial Sequence
  Synthetic Polynucleotide
taatacgactcactatagggattttcagagaacgaaatagtcactatcataacagaggagaatgataatgactatttcgaacctggcggcagcgcaaaagatg

SEQ ID NO: 76245 - DNA, 103 bp, Artificial Sequence
  Synthetic Polynucleotide
taatacgactcactatagggtaccaattttcagagaacgaaatagtcactaacagaggagaagtgacatgttcgttctcaacctggcggcagcgcaaaagatg

SEQ ID NO: 76246 - DNA, 103 bp, Artificial Sequence
  Synthetic Polynucleotide
taatacgactcactatagggtgagttaccaattttcagagaacgaaatagaacagaggagactatttatgtctctgaaaaacctggcggcagcgcaaaagatg

SEQ ID NO: 76247 - DNA, 103 bp, Artificial Sequence
  Synthetic Polynucleotide
taatacgactcactatagggaacttttttttatgattccaaaaatactgaaacagaggagatcagtaatgttggaatcaaacctggcggcagcgcaaaagatg

SEQ ID NO: 76248 - DNA, 103 bp, Artificial Sequence
  Synthetic Polynucleotide
taatacgactcactatagggtagaatgagttaccaattttcagagaacgaaacagaggagatcgttcatggaaaattggaacctggcggcagcgcaaaagatg

SEQ ID NO: 76249 - DNA, 103 bp, Artificial Sequence
  Synthetic Polynucleotide
taatacgactcactatagggatatatagaatgagttaccaattttcagagaacagaggagactctgaatgttggtaactaacctggcggcagcgcaaaagatg

SEQ ID NO: 76250 - DNA, 103 bp, Artificial Sequence
  Synthetic Polynucleotide
taatacgactcactatagggaaagcatatatagaatgagttaccaattttaacagaggagaaaaattatgaactcattcaacctggcggcagcgcaaaagatg

SEQ ID NO: 76251 - DNA, 103 bp, Artificial Sequence
  Synthetic Polynucleotide
taatacgactcactatagggcaaggaaagcatatatagaatgagttaccaaacagaggagatggtaaatgattctatataacctggcggcagcgcaaaagatg

SEQ ID NO: 76252 - DNA, 103 bp, Artificial Sequence
  Synthetic Polynucleotide
taatacgactcactatagggatcaacaaggaaagcatatatagaatgagtaacagaggagaactcatatgatatatgctaacctggcggcagcgcaaaagatg

SEQ ID NO: 76253 - DNA, 103 bp, Artificial Sequence
  Synthetic Polynucleotide
taatacgactcactatagggccttcatcaacaaggaaagcatatatagaaaacagaggagattctatatgtgctttcctaacctggcggcagcgcaaaagatg

SEQ ID NO: 76254 - DNA, 103 bp, Artificial Sequence
  Synthetic Polynucleotide
taatacgactcactatagggcctatccttcatcaacaaggaaagcatataaacagaggagatatatgatgtccttgttgaacctggcggcagcgcaaaagatg

SEQ ID NO: 76255 - DNA, 103 bp, Artificial Sequence
  Synthetic Polynucleotide
taatacgactcactatagggtatatcctatccttcatcaacaaggaaagcaacagaggagagctttcatggttgatgaaaacctggcggcagcgcaaaagatg

SEQ ID NO: 76256 - DNA, 103 bp, Artificial Sequence
  Synthetic Polynucleotide
taatacgactcactatagggttgagtatatcctatccttcatcaacaaggaacagaggagaccttgtatgtgaaggataaacctggcggcagcgcaaaagatg

SEQ ID NO: 76257 - DNA, 103 bp, Artificial Sequence
  Synthetic Polynucleotide
taatacgactcactatagggttctattgagtatatcctatccttcatcaaaacagaggagattgatgatggataggataaacctggcggcagcgcaaaagatg

SEQ ID NO: 76258 - DNA, 103 bp, Artificial Sequence
  Synthetic Polynucleotide
taatacgactcactatagggggtaaaacttttttttatgattccaaaaataacagaggagaatttttatgatcataaaaaacctggcggcagcgcaaaagatg

SEQ ID NO: 76259 - DNA, 103 bp, Artificial Sequence
  Synthetic Polynucleotide
taatacgactcactatagggacaaattctattgagtatatcctatccttcaacagaggagagaaggaatggatatactcaacctggcggcagcgcaaaagatg

SEQ ID NO: 76260 - DNA, 103 bp, Artificial Sequence
  Synthetic Polynucleotide
taatacgactcactatagggttggtacaaattctattgagtatatcctataacagaggagaataggaatgactcaatagaacctggcggcagcgcaaaagatg

SEQ ID NO: 76261 - DNA, 103 bp, Artificial Sequence
  Synthetic Polynucleotide
taatacgactcactataggggtttgttggtacaaattctattgagtatataacagaggagaatatacatgatagaatttaacctggcggcagcgcaaaagatg

SEQ ID NO: 76262 - DNA, 103 bp, Artificial Sequence
  Synthetic Polynucleotide
taatacgactcactataggggaacagtttgttggtacaaattctattgagaacagaggagactcaatatgatttgtaccaacctggcggcagcgcaaaagatg

SEQ ID NO: 76263 - DNA, 103 bp, Artificial Sequence
  Synthetic Polynucleotide
taatacgactcactatagggtaagagaacagtttgttggtacaaattctaaacagaggagatagaatatgtaccaacaaaacctggcggcagcgcaaaagatg

SEQ ID NO: 76264 - DNA, 103 bp, Artificial Sequence
  Synthetic Polynucleotide
taatacgactcactatagggattcataagagaacagtttgttggtacaaaaacagaggagatttgtaatgacaaactgtaacctggcggcagcgcaaaagatg

SEQ ID NO: 76265 - DNA, 103 bp, Artificial Sequence
  Synthetic Polynucleotide
taatacgactcactatagggatacgattcataagagaacagtttgttggtaacagaggagaaccaacatgctgttctctaacctggcggcagcgcaaaagatg

SEQ ID NO: 76266 - DNA, 103 bp, Artificial Sequence
  Synthetic Polynucleotide
taatacgactcactatagggatgatatacgattcataagagaacagtttgaacagaggagacaaactatgctcttatgaaacctggcggcagcgcaaaagatg

SEQ ID NO: 76267 - DNA, 103 bp, Artificial Sequence
  Synthetic Polynucleotide
taatacgactcactatagggagatgatgatatacgattcataagagaacaaacagaggagatgttctatgatgaatcgtaacctggcggcagcgcaaaagatg

SEQ ID NO: 76268 - DNA, 103 bp, Artificial Sequence
  Synthetic Polynucleotide
taatacgactcactatagggatttcagatgatgatatacgattcataagaaacagaggagatcttatatgtcgtatatcaacctggcggcagcgcaaaagatg

SEQ ID NO: 76269 - DNA, 103 bp, Artificial Sequence
  Synthetic Polynucleotide
taatacgactcactatagggaaaatggtaaaacttttttttatgattccaaacagaggagatggaatatgaaaaaaaagaacctggcggcagcgcaaaagatg

SEQ ID NO: 76270 - DNA, 103 bp, Artificial Sequence
  Synthetic Polynucleotide
taatacgactcactatagggtgattatttcagatgatgatatacgattcaaacagaggagatgaatcatgtatcatcataacctggcggcagcgcaaaagatg

SEQ ID NO: 76271 - DNA, 103 bp, Artificial Sequence
  Synthetic Polynucleotide
taatacgactcactatagggttacatgattatttcagatgatgatatacgaacagaggagacgtataatgtcatctgaaaacctggcggcagcgcaaaagatg

SEQ ID NO: 76272 - DNA, 103 bp, Artificial Sequence
  Synthetic Polynucleotide
taatacgactcactatagggatgccttacatgattatttcagatgatgataacagaggagaatcatcatgtgaaataataacctggcggcagcgcaaaagatg

SEQ ID NO: 76273 - DNA, 103 bp, Artificial Sequence
  Synthetic Polynucleotide
taatacgactcactatagggaatgtatgccttacatgattatttcagatgaacagaggagacatctgatgtaatcatgtaacctggcggcagcgcaaaagatg

SEQ ID NO: 76274 - DNA, 103 bp, Artificial Sequence
  Synthetic Polynucleotide
taatacgactcactatagggtgttaaatgtatgccttacatgattatttcaacagaggagagaaataatgatgtaaggcaacctggcggcagcgcaaaagatg

SEQ ID NO: 76275 - DNA, 103 bp, Artificial Sequence
  Synthetic Polynucleotide
taatacgactcactatagggcttattgttaaatgtatgccttacatgattaacagaggagaaatcatatgaggcatacaaacctggcggcagcgcaaaagatg

SEQ ID NO: 76276 - DNA, 103 bp, Artificial Sequence
  Synthetic Polynucleotide
taatacgactcactatagggagtctcttattgttaaatgtatgccttacaaacagaggagatgtaagatgtacatttaaaacctggcggcagcgcaaaagatg

SEQ ID NO: 76277 - DNA, 103 bp, Artificial Sequence
  Synthetic Polynucleotide
taatacgactcactatagggagacaagtctcttattgttaaatgtatgccaacagaggagaggcataatgttaacaataaacctggcggcagcgcaaaagatg

SEQ ID NO: 76278 - DNA, 103 bp, Artificial Sequence
  Synthetic Polynucleotide
taatacgactcactatagggacaggagacaagtctcttattgttaaatgtaacagaggagaacatttatgaataagagaaacctggcggcagcgcaaaagatg

SEQ ID NO: 76279 - DNA, 103 bp, Artificial Sequence
  Synthetic Polynucleotide
taatacgactcactatagggtgataacaggagacaagtctcttattgttaaacagaggagataacaaatggagacttgtaacctggcggcagcgcaaaagatg

SEQ ID NO: 76280 - DNA, 103 bp, Artificial Sequence
  Synthetic Polynucleotide
taatacgactcactatagggattttaaaatggtaaaacttttttttatgaaacagaggagatcataaatgaaagttttaaacctggcggcagcgcaaaagatg

SEQ ID NO: 76281 - DNA, 103 bp, Artificial Sequence
  Synthetic Polynucleotide
taatacgactcactatagggtatattgataacaggagacaagtctcttataacagaggagaataagaatgttgtctcctaacctggcggcagcgcaaaagatg

SEQ ID NO: 76282 - DNA, 103 bp, Artificial Sequence
  Synthetic Polynucleotide
taatacgactcactatagggaatagtatattgataacaggagacaagtctaacagaggagaagacttatgtcctgttataacctggcggcagcgcaaaagatg

SEQ ID NO: 76283 - DNA, 103 bp, Artificial Sequence
  Synthetic Polynucleotide
taatacgactcactatagggacaagaatagtatattgataacaggagacaaacagaggagatgtctcatgttatcaataaacctggcggcagcgcaaaagatg

SEQ ID NO: 76284 - DNA, 103 bp, Artificial Sequence
  Synthetic Polynucleotide
taatacgactcactatagggttatcacaagaatagtatattgataacaggaacagaggagacctgttatgaatatactaaacctggcggcagcgcaaaagatg

SEQ ID NO: 76285 - DNA, 103 bp, Artificial Sequence
  Synthetic Polynucleotide
taatacgactcactatagggataaattatcacaagaatagtatattgataaacagaggagatatcaaatgactattcttaacctggcggcagcgcaaaagatg

SEQ ID NO: 76286 - DNA, 103 bp, Artificial Sequence
  Synthetic Polynucleotide
taatacgactcactatagggcacacataaattatcacaagaatagtatataacagaggagaatatacatgtcttgtgataacctggcggcagcgcaaaagatg

SEQ ID NO: 76287 - DNA, 103 bp, Artificial Sequence
  Synthetic Polynucleotide
taatacgactcactatagggtgcctcacacataaattatcacaagaatagaacagaggagactattcatgtgataatttaacctggcggcagcgcaaaagatg

SEQ ID NO: 76288 - DNA, 103 bp, Artificial Sequence
  Synthetic Polynucleotide
taatacgactcactatagggaaatttgcctcacacataaattatcacaagaacagaggagacttgtgatgatttatgtgaacctggcggcagcgcaaaagatg

SEQ ID NO: 76289 - DNA, 103 bp, Artificial Sequence
  Synthetic Polynucleotide
taatacgactcactatagggtggacaaatttgcctcacacataaattatcaacagaggagagataatatgtgtgtgaggaacctggcggcagcgcaaaagatg

SEQ ID NO: 76290 - DNA, 103 bp, Artificial Sequence
  Synthetic Polynucleotide
taatacgactcactataggggaacgtggacaaatttgcctcacacataaaaacagaggagatttatgatggaggcaaataacctggcggcagcgcaaaagatg

SEQ ID NO: 76291 - DNA, 103 bp, Artificial Sequence
  Synthetic Polynucleotide
taatacgactcactatagggtttaaattttaaaatggtaaaactttttttaacagaggagaaaaaaaatgtttaccattaacctggcggcagcgcaaaagatg

SEQ ID NO: 76292 - DNA, 103 bp, Artificial Sequence
  Synthetic Polynucleotide
taatacgactcactatagggttaaagaacgtggacaaatttgcctcacacaacagaggagagtgtgaatgaaatttgtcaacctggcggcagcgcaaaagatg

SEQ ID NO: 76293 - DNA, 103 bp, Artificial Sequence
  Synthetic Polynucleotide
taatacgactcactatagggcaaaattaaagaacgtggacaaatttgcctaacagaggagaaggcaaatgtgtccacgtaacctggcggcagcgcaaaagatg

SEQ ID NO: 76294 - DNA, 103 bp, Artificial Sequence
  Synthetic Polynucleotide
taatacgactcactatagggtataacaaaattaaagaacgtggacaaattaacagaggagaaatttgatgacgttctttaacctggcggcagcgcaaaagatg

SEQ ID NO: 76295 - DNA, 103 bp, Artificial Sequence
  Synthetic Polynucleotide
taatacgactcactatagggtctactataacaaaattaaagaacgtggacaacagaggagagtccacatgctttaatttaacctggcggcagcgcaaaagatg

SEQ ID NO: 76296 - DNA, 103 bp, Artificial Sequence
  Synthetic Polynucleotide
taatacgactcactatagggtgatatctactataacaaaattaaagaacgaacagaggagacgttctatgattttgttaaacctggcggcagcgcaaaagatg

SEQ ID NO: 76297 - DNA, 103 bp, Artificial Sequence
  Synthetic Polynucleotide
taatacgactcactatagggggatttgatatctactataacaaaattaaaaacagaggagatttaatatggttatagtaaacctggcggcagcgcaaaagatg

SEQ ID NO: 76298 - DNA, 103 bp, Artificial Sequence
  Synthetic Polynucleotide
taatacgactcactatagggccattggatttgatatctactataacaaaaaacagaggagattttgtatgagtagatataacctggcggcagcgcaaaagatg

SEQ ID NO: 76299 - DNA, 103 bp, Artificial Sequence
  Synthetic Polynucleotide
taatacgactcactatagggtagctccattggatttgatatctactataaaacagaggagattatagatgatatcaaataacctggcggcagcgcaaaagatg

SEQ ID NO: 76300 - DNA, 103 bp, Artificial Sequence
  Synthetic Polynucleotide
taatacgactcactatagggaactgtagctccattggatttgatatctacaacagaggagagtagatatgaaatccaataacctggcggcagcgcaaaagatg

SEQ ID NO: 76301 - DNA, 103 bp, Artificial Sequence
  Synthetic Polynucleotide
taatacgactcactatagggccaagaactgtagctccattggatttgataaacagaggagatatcaaatgcaatggagcaacctggcggcagcgcaaaagatg

SEQ ID NO: 76302 - DNA, 103 bp, Artificial Sequence
  Synthetic Polynucleotide
taatacgactcactatagggtactttttaaattttaaaatggtaaaacttaacagaggagaaagtttatgcattttaaaaacctggcggcagcgcaaaagatg

SEQ ID NO: 76303 - DNA, 103 bp, Artificial Sequence
  Synthetic Polynucleotide
taatacgactcactatagggttaagccaagaactgtagctccattggattaacagaggagaaatccaatggagctacagaacctggcggcagcgcaaaagatg

SEQ ID NO: 76304 - DNA, 103 bp, Artificial Sequence
  Synthetic Polynucleotide
taatacgactcactatagggtctgtttaagccaagaactgtagctccattaacagaggagaaatggaatgacagttcttaacctggcggcagcgcaaaagatg

SEQ ID NO: 76305 - DNA, 103 bp, Artificial Sequence
  Synthetic Polynucleotide
taatacgactcactatagggctatatctgtttaagccaagaactgtagctaacagaggagaagctacatgtcttggcttaacctggcggcagcgcaaaagatg

SEQ ID NO: 76306 - DNA, 103 bp, Artificial Sequence
  Synthetic Polynucleotide
taatacgactcactatagggaaaaactatatctgtttaagccaagaactgaacagaggagacagttcatggcttaaacaaacctggcggcagcgcaaaagatg

SEQ ID NO: 76307 - DNA, 103 bp, Artificial Sequence
  Synthetic Polynucleotide
taatacgactcactatagggtccagaaaaactatatctgtttaagccaagaacagaggagacttggcatgaacagatataacctggcggcagcgcaaaagatg

SEQ ID NO: 76308 - DNA, 103 bp, Artificial Sequence
  Synthetic Polynucleotide
taatacgactcactatagggttcgttccagaaaaactatatctgtttaagaacagaggagacttaaaatgatatagtttaacctggcggcagcgcaaaagatg

SEQ ID NO: 76309 - DNA, 103 bp, Artificial Sequence
  Synthetic Polynucleotide
taatacgactcactatagggtagaattcgttccagaaaaactatatctgtaacagaggagaacagatatggtttttctgaacctggcggcagcgcaaaagatg

SEQ ID NO: 76310 - DNA, 103 bp, Artificial Sequence
  Synthetic Polynucleotide
taatacgactcactatagggtgttgtagaattcgttccagaaaaactataaacagaggagatatagtatgtctggaacgaacctggcggcagcgcaaaagatg

SEQ ID NO: 76311 - DNA, 103 bp, Artificial Sequence
  Synthetic Polynucleotide
taatacgactcactatagggaataatgttgtagaattcgttccagaaaaaaacagaggagatttttcatgaacgaattcaacctggcggcagcgcaaaagatg

SEQ ID NO: 76312 - DNA, 103 bp, Artificial Sequence
  Synthetic Polynucleotide
taatacgactcactatagggtttataataatgttgtagaattcgttccagaacagaggagactggaaatgattctacaaaacctggcggcagcgcaaaagatg

SEQ ID NO: 76313 - DNA, 103 bp, Artificial Sequence
  Synthetic Polynucleotide
taatacgactcactataggggtaaatactttttaaattttaaaatggtaaaacagaggagattaccaatgtaaaatttaaacctggcggcagcgcaaaagatg

SEQ ID NO: 76314 - DNA, 103 bp, Artificial Sequence
  Synthetic Polynucleotide
taatacgactcactatagggagtcctttataataatgttgtagaattcgtaacagaggagaacgaatatgacaacattaaacctggcggcagcgcaaaagatg

SEQ ID NO: 76315 - DNA, 103 bp, Artificial Sequence
  Synthetic Polynucleotide
taatacgactcactatagggcccaaagtcctttataataatgttgtagaaaacagaggagattctacatgattattataaacctggcggcagcgcaaaagatg

SEQ ID NO: 76316 - DNA, 103 bp, Artificial Sequence
  Synthetic Polynucleotide
taatacgactcactatagggatctacccaaagtcctttataataatgttgaacagaggagacaacatatgtataaaggaaacctggcggcagcgcaaaagatg

SEQ ID NO: 76317 - DNA, 103 bp, Artificial Sequence
  Synthetic Polynucleotide
taatacgactcactatagggcacttatctacccaaagtcctttataataaaacagaggagattattaatgaggactttgaacctggcggcagcgcaaaagatg

SEQ ID NO: 76318 - DNA, 103 bp, Artificial Sequence
  Synthetic Polynucleotide
taatacgactcactatagggcatcccacttatctacccaaagtcctttataacagaggagaataaagatgtttgggtagaacctggcggcagcgcaaaagatg

SEQ ID NO: 76319 - DNA, 103 bp, Artificial Sequence
  Synthetic Polynucleotide
taatacgactcactataggggatttcatcccacttatctacccaaagtccaacagaggagaggacttatggtagataagaacctggcggcagcgcaaaagatg

SEQ ID NO: 76320 - DNA, 103 bp, Artificial Sequence
  Synthetic Polynucleotide
taatacgactcactatagggaataggatttcatcccacttatctacccaaaacagaggagattgggtatgtaagtgggaaacctggcggcagcgcaaaagatg

SEQ ID NO: 76321 - DNA, 103 bp, Artificial Sequence
  Synthetic Polynucleotide
taatacgactcactatagggattaaaataggatttcatcccacttatctaaacagaggagatagataatggggatgaaaaacctggcggcagcgcaaaagatg

SEQ ID NO: 76322 - DNA, 103 bp, Artificial Sequence
  Synthetic Polynucleotide
taatacgactcactatagggcattaattaaaataggatttcatcccacttaacagaggagaaagtggatggaaatcctaaacctggcggcagcgcaaaagatg

SEQ ID NO: 76323 - DNA, 103 bp, Artificial Sequence
  Synthetic Polynucleotide
taatacgactcactatagggtattgcattaattaaaataggatttcatccaacagaggagaggatgaatgcctattttaaacctggcggcagcgcaaaagatg

SEQ ID NO: 76324 - DNA, 103 bp, Artificial Sequence
  Synthetic Polynucleotide
taatacgactcactatagggaaaatgtaaatactttttaaattttaaaataacagaggagaattttaatgtttaaaaagaacctggcggcagcgcaaaagatg

SEQ ID NO: 76325 - DNA, 103 bp, Artificial Sequence
  Synthetic Polynucleotide
taatacgactcactatagggaaggctattgcattaattaaaataggatttaacagaggagaaaatccatgtttaattaaaacctggcggcagcgcaaaagatg

SEQ ID NO: 76326 - DNA, 103 bp, Artificial Sequence
  Synthetic Polynucleotide
taatacgactcactatagggaggacaaggctattgcattaattaaaatagaacagaggagactatttatgttaatgcaaaacctggcggcagcgcaaaagatg

SEQ ID NO: 76327 - DNA, 103 bp, Artificial Sequence
  Synthetic Polynucleotide
taatacgactcactataggggcacgaggacaaggctattgcattaattaaaacagaggagattaattatggcaatagccaacctggcggcagcgcaaaagatg

SEQ ID NO: 76328 - DNA, 103 bp, Artificial Sequence
  Synthetic Polynucleotide
taatacgactcactatagggtatctgcacgaggacaaggctattgcattaaacagaggagataatgcatgagccttgtcaacctggcggcagcgcaaaagatg

SEQ ID NO: 76329 - DNA, 103 bp, Artificial Sequence
  Synthetic Polynucleotide
taatacgactcactatagggttggatatctgcacgaggacaaggctattgaacagaggagacaatagatgtgtcctcgtaacctggcggcagcgcaaaagatg

SEQ ID NO: 76330 - DNA, 103 bp, Artificial Sequence
  Synthetic Polynucleotide
taatacgactcactatagggagcgtttggatatctgcacgaggacaaggcaacagaggagagccttgatgtcgtgcagaaacctggcggcagcgcaaaagatg

SEQ ID NO: 76331 - DNA, 103 bp, Artificial Sequence
  Synthetic Polynucleotide
taatacgactcactatagggacaaaagcgtttggatatctgcacgaggacaacagaggagagtcctcatgcagatatccaacctggcggcagcgcaaaagatg

SEQ ID NO: 76332 - DNA, 103 bp, Artificial Sequence
  Synthetic Polynucleotide
taatacgactcactatagggctatcacaaaagcgtttggatatctgcacgaacagaggagacgtgcaatgatccaaacgaacctggcggcagcgcaaaagatg

SEQ ID NO: 76333 - DNA, 103 bp, Artificial Sequence
  Synthetic Polynucleotide
taatacgactcactatagggccatactatcacaaaagcgtttggatatctaacagaggagaagatatatgaacgcttttaacctggcggcagcgcaaaagatg

SEQ ID NO: 76334 - DNA, 103 bp, Artificial Sequence
  Synthetic Polynucleotide
taatacgactcactataggggaatgccatactatcacaaaagcgtttggaaacagaggagatccaaaatgttttgtgataacctggcggcagcgcaaaagatg

SEQ ID NO: 76335 - DNA, 103 bp, Artificial Sequence
  Synthetic Polynucleotide
taatacgactcactatagggtgaaaaaaatgtaaatactttttaaattttaacagaggagaaaaattatgaaagtatttaacctggcggcagcgcaaaagatg

SEQ ID NO: 76336 - DNA, 103 bp, Artificial Sequence
  Synthetic Polynucleotide
taatacgactcactatagggacaatgaatgccatactatcacaaaagcgtaacagaggagaacgcttatgtgatagtataacctggcggcagcgcaaaagatg

SEQ ID NO: 76337 - DNA, 103 bp, Artificial Sequence
  Synthetic Polynucleotide
taatacgactcactatagggtttagacaatgaatgccatactatcacaaaaacagaggagatttgtgatggtatggcataacctggcggcagcgcaaaagatg

SEQ ID NO: 76338 - DNA, 103 bp, Artificial Sequence
  Synthetic Polynucleotide
taatacgactcactataggggcgtttttagacaatgaatgccatactatcaacagaggagagatagtatggcattcattaacctggcggcagcgcaaaagatg

SEQ ID NO: 76339 - DNA, 103 bp, Artificial Sequence
  Synthetic Polynucleotide
taatacgactcactataggggtagagcgtttttagacaatgaatgccataaacagaggagatatggcatgcattgtctaaacctggcggcagcgcaaaagatg

SEQ ID NO: 76340 - DNA, 103 bp, Artificial Sequence
  Synthetic Polynucleotide
taatacgactcactatagggtattcgtagagcgtttttagacaatgaatgaacagaggagacattcaatgtctaaaaacaacctggcggcagcgcaaaagatg

SEQ ID NO: 76341 - DNA, 103 bp, Artificial Sequence
  Synthetic Polynucleotide
taatacgactcactatagggacagatattcgtagagcgtttttagacaataacagaggagaattgtcatgaaacgctctaacctggcggcagcgcaaaagatg

SEQ ID NO: 76342 - DNA, 103 bp, Artificial Sequence
  Synthetic Polynucleotide
taatacgactcactatagggctgtcacagatattcgtagagcgtttttagaacagaggagactaaaaatgctctacgaaaacctggcggcagcgcaaaagatg

SEQ ID NO: 76343 - DNA, 103 bp, Artificial Sequence
  Synthetic Polynucleotide
taatacgactcactataggggatatctgtcacagatattcgtagagcgttaacagaggagaaacgctatgcgaatatctaacctggcggcagcgcaaaagatg

SEQ ID NO: 76344 - DNA, 103 bp, Artificial Sequence
  Synthetic Polynucleotide
taatacgactcactatagggaagatgatatctgtcacagatattcgtagaaacagaggagatctacgatgatctgtgacaacctggcggcagcgcaaaagatg

SEQ ID NO: 76345 - DNA, 103 bp, Artificial Sequence
  Synthetic Polynucleotide
taatacgactcactatagggctctaaagatgatatctgtcacagatattcaacagaggagagaatatatgtgacagataaacctggcggcagcgcaaaagatg

SEQ ID NO: 76346 - DNA, 103 bp, Artificial Sequence
  Synthetic Polynucleotide
taatacgactcactatagggtatgctgcaaaagattctgaacgagaacgaaacagaggagatcgttcatgttcagaatcaacctggcggcagcgcaaaagatg

SEQ ID NO: 76347 - DNA, 103 bp, Artificial Sequence
  Synthetic Polynucleotide
taatacgactcactatagggaacagtgaaaaaaatgtaaatactttttaaaacagaggagattaaaaatgatttacattaacctggcggcagcgcaaaagatg

SEQ ID NO: 76348 - DNA, 103 bp, Artificial Sequence
  Synthetic Polynucleotide
taatacgactcactataggggtattctctaaagatgatatctgtcacagaaacagaggagatctgtgatggatatcatcaacctggcggcagcgcaaaagatg

SEQ ID NO: 76349 - DNA, 103 bp, Artificial Sequence
  Synthetic Polynucleotide
taatacgactcactataggggactagtattctctaaagatgatatctgtcaacagaggagagacagaatgcatctttagaacctggcggcagcgcaaaagatg

SEQ ID NO: 76350 - DNA, 103 bp, Artificial Sequence
  Synthetic Polynucleotide
taatacgactcactatagggaacgcgactagtattctctaaagatgatataacagaggagaatatcaatgttagagaataacctggcggcagcgcaaaagatg

SEQ ID NO: 76351 - DNA, 103 bp, Artificial Sequence
  Synthetic Polynucleotide
taatacgactcactatagggctattaacgcgactagtattctctaaagataacagaggagaatctttatggaatactagaacctggcggcagcgcaaaagatg

SEQ ID NO: 76352 - DNA, 103 bp, Artificial Sequence
  Synthetic Polynucleotide
taatacgactcactatagggtagtactattaacgcgactagtattctctaaacagaggagatagagaatgctagtcgcgaacctggcggcagcgcaaaagatg

SEQ ID NO: 76353 - DNA, 103 bp, Artificial Sequence
  Synthetic Polynucleotide
taatacgactcactatagggaattttagtactattaacgcgactagtattaacagaggagaaatactatgcgcgttaataacctggcggcagcgcaaaagatg

SEQ ID NO: 76354 - DNA, 103 bp, Artificial Sequence
  Synthetic Polynucleotide
taatacgactcactatagggatacaaattttagtactattaacgcgactaaacagaggagatagtcgatgtaatagtacaacctggcggcagcgcaaaagatg

SEQ ID NO: 76355 - DNA, 103 bp, Artificial Sequence
  Synthetic Polynucleotide
taatacgactcactatagggtaaaaatacaaattttagtactattaacgcaacagaggagagcgttaatggtactaaaaaacctggcggcagcgcaaaagatg

SEQ ID NO: 76356 - DNA, 103 bp, Artificial Sequence
  Synthetic Polynucleotide
taatacgactcactatagggtagattaaaaatacaaattttagtactattaacagaggagaaatagtatgaaaatttgtaacctggcggcagcgcaaaagatg

SEQ ID NO: 76357 - DNA, 103 bp, Artificial Sequence
  Synthetic Polynucleotide
taatacgactcactatagggtgagatagattaaaaatacaaattttagtaaacagaggagatactaaatgttgtattttaacctggcggcagcgcaaaagatg

SEQ ID NO: 76358 - DNA, 103 bp, Artificial Sequence
  Synthetic Polynucleotide
taatacgactcactataggggactaaacagtgaaaaaaatgtaaatacttaacagaggagaaagtatatgcatttttttaacctggcggcagcgcaaaagatg

SEQ ID NO: 76359 - DNA, 103 bp, Artificial Sequence
  Synthetic Polynucleotide
taatacgactcactatagggtttattgagatagattaaaaatacaaatttaacagaggagaaaatttatgtttttaatcaacctggcggcagcgcaaaagatg

SEQ ID NO: 76360 - DNA, 103 bp, Artificial Sequence
  Synthetic Polynucleotide
taatacgactcactatagggaattttttattgagatagattaaaaatacaaacagaggagatgtattatgaatctatctaacctggcggcagcgcaaaagatg

SEQ ID NO: 76361 - DNA, 103 bp, Artificial Sequence
  Synthetic Polynucleotide
taatacgactcactatagggatattaattttttattgagatagattaaaaaacagaggagattttaaatgatctcaataaacctggcggcagcgcaaaagatg

SEQ ID NO: 76362 - DNA, 103 bp, Artificial Sequence
  Synthetic Polynucleotide
taatacgactcactatagggcataaatattaattttttattgagatagataacagaggagaatctatatgaataaaaaaaacctggcggcagcgcaaaagatg

SEQ ID NO: 76363 - DNA, 103 bp, Artificial Sequence
  Synthetic Polynucleotide
taatacgactcactatagggtaaatcataaatattaattttttattgagaaacagaggagatctcaaatgaaaattaataacctggcggcagcgcaaaagatg

SEQ ID NO: 76364 - DNA, 103 bp, Artificial Sequence
  Synthetic Polynucleotide
taatacgactcactatagggtacattaaatcataaatattaattttttataacagaggagaataaaaatgtaatatttaaacctggcggcagcgcaaaagatg

SEQ ID NO: 76365 - DNA, 103 bp, Artificial Sequence
  Synthetic Polynucleotide
taatacgactcactatagggagttatacattaaatcataaatattaatttaacagaggagaaaattaatgtttatgattaacctggcggcagcgcaaaagatg

SEQ ID NO: 76366 - DNA, 103 bp, Artificial Sequence
  Synthetic Polynucleotide
taatacgactcactatagggagtaaagttatacattaaatcataaatattaacagaggagaaatattatggatttaatgaacctggcggcagcgcaaaagatg

SEQ ID NO: 76367 - DNA, 103 bp, Artificial Sequence
  Synthetic Polynucleotide
taatacgactcactatagggcagttagtaaagttatacattaaatcataaaacagaggagattatgaatgaatgtataaaacctggcggcagcgcaaaagatg

SEQ ID NO: 76368 - DNA, 103 bp, Artificial Sequence
  Synthetic Polynucleotide
taatacgactcactatagggaataacagttagtaaagttatacattaaataacagaggagaatttaaatgataactttaaacctggcggcagcgcaaaagatg

SEQ ID NO: 76369 - DNA, 103 bp, Artificial Sequence
  Synthetic Polynucleotide
taatacgactcactatagggtccgcgactaaacagtgaaaaaaatgtaaaaacagaggagatttacaatgttttcactgaacctggcggcagcgcaaaagatg

SEQ ID NO: 76370 - DNA, 103 bp, Artificial Sequence
  Synthetic Polynucleotide
taatacgactcactatagggttatcaataacagttagtaaagttatacataacagaggagaatgtatatgtttactaacaacctggcggcagcgcaaaagatg

SEQ ID NO: 76371 - DNA, 103 bp, Artificial Sequence
  Synthetic Polynucleotide
taatacgactcactatagggtctagttatcaataacagttagtaaagttaaacagaggagataacttatgtaactgttaaacctggcggcagcgcaaaagatg

SEQ ID NO: 76372 - DNA, 103 bp, Artificial Sequence
  Synthetic Polynucleotide
taatacgactcactatagggctgattctagttatcaataacagttagtaaaacagaggagattactaatggttattgataacctggcggcagcgcaaaagatg

SEQ ID NO: 76373 - DNA, 103 bp, Artificial Sequence
  Synthetic Polynucleotide
taatacgactcactatagggagattctgattctagttatcaataacagttaacagaggagaaactgtatgtgataactaaacctggcggcagcgcaaaagatg

SEQ ID NO: 76374 - DNA, 103 bp, Artificial Sequence
  Synthetic Polynucleotide
taatacgactcactatagggtcattagattctgattctagttatcaataaaacagaggagattattgatgactagaatcaacctggcggcagcgcaaaagatg

SEQ ID NO: 76375 - DNA, 103 bp, Artificial Sequence
  Synthetic Polynucleotide
taatacgactcactatagggcgtcatcattagattctgattctagttatcaacagaggagagataacatgaatcagaataacctggcggcagcgcaaaagatg

SEQ ID NO: 76376 - DNA, 103 bp, Artificial Sequence
  Synthetic Polynucleotide
taatacgactcactatagggggttacgtcatcattagattctgattctagaacagaggagactagaaatggaatctaataacctggcggcagcgcaaaagatg

SEQ ID NO: 76377 - DNA, 103 bp, Artificial Sequence
  Synthetic Polynucleotide
taatacgactcactatagggttcttggttacgtcatcattagattctgataacagaggagaatcagaatgtaatgatgaaacctggcggcagcgcaaaagatg

SEQ ID NO: 76378 - DNA, 103 bp, Artificial Sequence
  Synthetic Polynucleotide
taatacgactcactatagggtaaacttcttggttacgtcatcattagattaacagaggagaaatctaatgatgacgtaaaacctggcggcagcgcaaaagatg

SEQ ID NO: 76379 - DNA, 103 bp, Artificial Sequence
  Synthetic Polynucleotide
taatacgactcactataggggtagataaacttcttggttacgtcatcattaacagaggagaaatgatatggtaaccaagaacctggcggcagcgcaaaagatg

SEQ ID NO: 76380 - DNA, 103 bp, Artificial Sequence
  Synthetic Polynucleotide
taatacgactcactatagggccatatccgcgactaaacagtgaaaaaaataacagaggagaatttttatgactgtttagaacctggcggcagcgcaaaagatg

SEQ ID NO: 76381 - DNA, 103 bp, Artificial Sequence
  Synthetic Polynucleotide
taatacgactcactatagggtggctgtagataaacttcttggttacgtcaaacagaggagatgacgtatgcaagaagttaacctggcggcagcgcaaaagatg

SEQ ID NO: 76382 - DNA, 103 bp, Artificial Sequence
  Synthetic Polynucleotide
taatacgactcactatagggtaaattggctgtagataaacttcttggttaaacagaggagataaccaatgagtttatctaacctggcggcagcgcaaaagatg

SEQ ID NO: 76383 - DNA, 103 bp, Artificial Sequence
  Synthetic Polynucleotide
taatacgactcactataggggcagctaaattggctgtagataaacttcttaacagaggagaaagaagatgatctacagcaacctggcggcagcgcaaaagatg

SEQ ID NO: 76384 - DNA, 103 bp, Artificial Sequence
  Synthetic Polynucleotide
taatacgactcactatagggataatgcagctaaattggctgtagataaacaacagaggagagtttatatgcagccaattaacctggcggcagcgcaaaagatg

SEQ ID NO: 76385 - DNA, 103 bp, Artificial Sequence
  Synthetic Polynucleotide
taatacgactcactatagggtaaaaataatgcagctaaattggctgtagaaacagaggagatctacaatgaatttagctaacctggcggcagcgcaaaagatg

SEQ ID NO: 76386 - DNA, 103 bp, Artificial Sequence
  Synthetic Polynucleotide
taatacgactcactataggggatgctaaaaataatgcagctaaattggctaacagaggagaagccaaatgagctgcattaacctggcggcagcgcaaaagatg

SEQ ID NO: 76387 - DNA, 103 bp, Artificial Sequence
  Synthetic Polynucleotide
taatacgactcactatagggaacgagatgctaaaaataatgcagctaaataacagaggagaatttagatgcattattttaacctggcggcagcgcaaaagatg

SEQ ID NO: 76388 - DNA, 103 bp, Artificial Sequence
  Synthetic Polynucleotide
taatacgactcactatagggatctaaacgagatgctaaaaataatgcagcaacagaggagagctgcaatgtttttagcaaacctggcggcagcgcaaaagatg

SEQ ID NO: 76389 - DNA, 103 bp, Artificial Sequence
  Synthetic Polynucleotide
taatacgactcactatagggggaaaatctaaacgagatgctaaaaataataacagaggagaattattatgagcatctcgaacctggcggcagcgcaaaagatg

SEQ ID NO: 76390 - DNA, 103 bp, Artificial Sequence
  Synthetic Polynucleotide
taatacgactcactatagggccgatggaaaatctaaacgagatgctaaaaaacagaggagattttagatgctcgtttagaacctggcggcagcgcaaaagatg

SEQ ID NO: 76391 - DNA, 103 bp, Artificial Sequence
  Synthetic Polynucleotide
taatacgactcactatagggaaattccatatccgcgactaaacagtgaaaaacagaggagatttcacatgttagtcgcgaacctggcggcagcgcaaaagatg

SEQ ID NO: 76392 - DNA, 103 bp, Artificial Sequence
  Synthetic Polynucleotide
taatacgactcactatagggtaaggccgatggaaaatctaaacgagatgcaacagaggagagcatctatgttagattttaacctggcggcagcgcaaaagatg

SEQ ID NO: 76393 - DNA, 103 bp, Artificial Sequence
  Synthetic Polynucleotide
taatacgactcactatagggttcgataaggccgatggaaaatctaaacgaaacagaggagatcgtttatgttttccatcaacctggcggcagcgcaaaagatg

SEQ ID NO: 76394 - DNA, 103 bp, Artificial Sequence
  Synthetic Polynucleotide
taatacgactcactataggggagtattcgataaggccgatggaaaatctaaacagaggagatagattatgcatcggcctaacctggcggcagcgcaaaagatg

SEQ ID NO: 76395 - DNA, 103 bp, Artificial Sequence
  Synthetic Polynucleotide
taatacgactcactatagggcgggagagtattcgataaggccgatggaaaaacagaggagatttccaatggccttatcgaacctggcggcagcgcaaaagatg

SEQ ID NO: 76396 - DNA, 103 bp, Artificial Sequence
  Synthetic Polynucleotide
taatacgactcactatagggatcgacgggagagtattcgataaggccgataacagaggagaatcggcatgatcgaatacaacctggcggcagcgcaaaagatg

SEQ ID NO: 76397 - DNA, 103 bp, Artificial Sequence
  Synthetic Polynucleotide
taatacgactcactatagggtagacatcgacgggagagtattcgataaggaacagaggagaccttatatgatactctccaacctggcggcagcgcaaaagatg

SEQ ID NO: 76398 - DNA, 103 bp, Artificial Sequence
  Synthetic Polynucleotide
taatacgactcactatagggctgtgtagacatcgacgggagagtattcgaaacagaggagatcgaatatgctcccgtcgaacctggcggcagcgcaaaagatg

SEQ ID NO: 76399 - DNA, 103 bp, Artificial Sequence
  Synthetic Polynucleotide
taatacgactcactatagggtatgcctgtgtagacatcgacgggagagtaaacagaggagatactctatggtcgatgtcaacctggcggcagcgcaaaagatg

SEQ ID NO: 76400 - DNA, 103 bp, Artificial Sequence
  Synthetic Polynucleotide
taatacgactcactatagggcattttatgcctgtgtagacatcgacgggaaacagaggagatcccgtatgtgtctacacaacctggcggcagcgcaaaagatg

SEQ ID NO: 76401 - DNA, 103 bp, Artificial Sequence
  Synthetic Polynucleotide
taatacgactcactatagggtcctacattttatgcctgtgtagacatcgaaacagaggagatcgatgatgacacaggcaaacctggcggcagcgcaaaagatg

SEQ ID NO: 76402 - DNA, 103 bp, Artificial Sequence
  Synthetic Polynucleotide
taatacgactcactatagggggatcaaattccatatccgcgactaaacagaacagaggagactgtttatgcgcggatataacctggcggcagcgcaaaagatg

SEQ ID NO: 76403 - DNA, 103 bp, Artificial Sequence
  Synthetic Polynucleotide
taatacgactcactatagggaactctcctacattttatgcctgtgtagacaacagaggagagtctacatgggcataaaaaacctggcggcagcgcaaaagatg

SEQ ID NO: 76404 - DNA, 103 bp, Artificial Sequence
  Synthetic Polynucleotide
taatacgactcactatagggctagtaactctcctacattttatgcctgtgaacagaggagacacaggatgaaaatgtagaacctggcggcagcgcaaaagatg

SEQ ID NO: 76405 - DNA, 103 bp, Artificial Sequence
  Synthetic Polynucleotide
taatacgactcactatagggggggcctagtaactctcctacattttatgcaacagaggagagcataaatggtaggagagaacctggcggcagcgcaaaagatg

SEQ ID NO: 76406 - DNA, 103 bp, Artificial Sequence
  Synthetic Polynucleotide
taatacgactcactatagggtcagtggggcctagtaactctcctacatttaacagaggagaaaatgtatgagagttactaacctggcggcagcgcaaaagatg

SEQ ID NO: 76407 - DNA, 103 bp, Artificial Sequence
  Synthetic Polynucleotide
taatacgactcactatagggttgaatcagtggggcctagtaactctcctaaacagaggagataggagatgtactaggccaacctggcggcagcgcaaaagatg

SEQ ID NO: 76408 - DNA, 103 bp, Artificial Sequence
  Synthetic Polynucleotide
taatacgactcactatagggtcgtattgaatcagtggggcctagtaactcaacagaggagagagttaatgggccccactaacctggcggcagcgcaaaagatg

SEQ ID NO: 76409 - DNA, 103 bp, Artificial Sequence
  Synthetic Polynucleotide
taatacgactcactatagggtcttttcgtattgaatcagtggggcctagtaacagaggagaactaggatgcactgattcaacctggcggcagcgcaaaagatg

SEQ ID NO: 76410 - DNA, 103 bp, Artificial Sequence
  Synthetic Polynucleotide
taatacgactcactatagggattggtcttttcgtattgaatcagtggggcaacagaggagagccccaatgattcaatacaacctggcggcagcgcaaaagatg

SEQ ID NO: 76411 - DNA, 103 bp, Artificial Sequence
  Synthetic Polynucleotide
taatacgactcactataggggagagattggtcttttcgtattgaatcagtaacagaggagaactgatatgatacgaaaaaacctggcggcagcgcaaaagatg

SEQ ID NO: 76412 - DNA, 103 bp, Artificial Sequence
  Synthetic Polynucleotide
taatacgactcactatagggactaagagagattggtcttttcgtattgaaaacagaggagattcaatatgaaaagaccaaacctggcggcagcgcaaaagatg

SEQ ID NO: 76413 - DNA, 103 bp, Artificial Sequence
  Synthetic Polynucleotide
taatacgactcactatagggtggtaggatcaaattccatatccgcgactaaacagaggagatagtcgatgatatggaataacctggcggcagcgcaaaagatg

SEQ ID NO: 76414 - DNA, 103 bp, Artificial Sequence
  Synthetic Polynucleotide
taatacgactcactatagggaaataactaagagagattggtcttttcgtaaacagaggagatacgaaatgaccaatctcaacctggcggcagcgcaaaagatg

SEQ ID NO: 76415 - DNA, 103 bp, Artificial Sequence
  Synthetic Polynucleotide
taatacgactcactatagggctgccaaataactaagagagattggtctttaacagaggagaaaagacatgtctctcttaaacctggcggcagcgcaaaagatg

SEQ ID NO: 76416 - DNA, 103 bp, Artificial Sequence
  Synthetic Polynucleotide
taatacgactcactataggggagtactgccaaataactaagagagattggaacagaggagaccaatcatgcttagttataacctggcggcagcgcaaaagatg

SEQ ID NO: 76417 - DNA, 103 bp, Artificial Sequence
  Synthetic Polynucleotide
taatacgactcactatagggttaatgagtactgccaaataactaagagagaacagaggagactctctatgttatttggcaacctggcggcagcgcaaaagatg

SEQ ID NO: 76418 - DNA, 103 bp, Artificial Sequence
  Synthetic Polynucleotide
taatacgactcactatagggcattattaatgagtactgccaaataactaaaacagaggagattagttatgtggcagtacaacctggcggcagcgcaaaagatg

SEQ ID NO: 76419 - DNA, 103 bp, Artificial Sequence
  Synthetic Polynucleotide
taatacgactcactataggggtcaccattattaatgagtactgccaaataaacagaggagatatttgatggtactcattaacctggcggcagcgcaaaagatg

SEQ ID NO: 76420 - DNA, 103 bp, Artificial Sequence
  Synthetic Polynucleotide
taatacgactcactatagggaccctgtcaccattattaatgagtactgccaacagaggagaggcagtatgcattaataaaacctggcggcagcgcaaaagatg

SEQ ID NO: 76421 - DNA, 103 bp, Artificial Sequence
  Synthetic Polynucleotide
taatacgactcactatagggtgctaaccctgtcaccattattaatgagtaaacagaggagatactcaatgataatggtgaacctggcggcagcgcaaaagatg

SEQ ID NO: 76422 - DNA, 103 bp, Artificial Sequence
  Synthetic Polynucleotide
taatacgactcactatagggaaaaatgctaaccctgtcaccattattaataacagaggagaattaatatgggtgacaggaacctggcggcagcgcaaaagatg

SEQ ID NO: 76423 - DNA, 103 bp, Artificial Sequence
  Synthetic Polynucleotide
taatacgactcactatagggattggaaaaatgctaaccctgtcaccattaaacagaggagataatggatgcagggttagaacctggcggcagcgcaaaagatg

SEQ ID NO: 76424 - DNA, 103 bp, Artificial Sequence
  Synthetic Polynucleotide
taatacgactcactataggggattttggtaggatcaaattccatatccgcaacagaggagagcggatatggaatttgataacctggcggcagcgcaaaagatg

SEQ ID NO: 76425 - DNA, 103 bp, Artificial Sequence
  Synthetic Polynucleotide
taatacgactcactatagggtattgattggaaaaatgctaaccctgtcacaacagaggagagtgacaatgttagcatttaacctggcggcagcgcaaaagatg

SEQ ID NO: 76426 - DNA, 103 bp, Artificial Sequence
  Synthetic Polynucleotide
taatacgactcactatagggaaaattattgattggaaaaatgctaaccctaacagaggagaagggttatgatttttccaaacctggcggcagcgcaaaagatg

SEQ ID NO: 76427 - DNA, 103 bp, Artificial Sequence
  Synthetic Polynucleotide
taatacgactcactatagggctaaaaaaattattgattggaaaaatgctaaacagaggagatagcatatgtccaatcaaaacctggcggcagcgcaaaagatg

SEQ ID NO: 76428 - DNA, 103 bp, Artificial Sequence
  Synthetic Polynucleotide
taatacgactcactatagggtccggctaaaaaaattattgattggaaaaaaacagaggagatttttcatgtcaataattaacctggcggcagcgcaaaagatg

SEQ ID NO: 76429 - DNA, 103 bp, Artificial Sequence
  Synthetic Polynucleotide
taatacgactcactataggggttattccggctaaaaaaattattgattggaacagaggagaccaatcatgaatttttttaacctggcggcagcgcaaaagatg

SEQ ID NO: 76430 - DNA, 103 bp, Artificial Sequence
  Synthetic Polynucleotide
taatacgactcactatagggatgatgttattccggctaaaaaaattattgaacagaggagacaataaatgttttagccgaacctggcggcagcgcaaaagatg

SEQ ID NO: 76431 - DNA, 103 bp, Artificial Sequence
  Synthetic Polynucleotide
taatacgactcactatagggttttgatgatgttattccggctaaaaaaataacagaggagaatttttatggccggaataaacctggcggcagcgcaaaagatg

SEQ ID NO: 76432 - DNA, 103 bp, Artificial Sequence
  Synthetic Polynucleotide
taatacgactcactatagggaagtcttttgatgatgttattccggctaaaaacagaggagatttagcatgaataacatcaacctggcggcagcgcaaaagatg

SEQ ID NO: 76433 - DNA, 103 bp, Artificial Sequence
  Synthetic Polynucleotide
taatacgactcactatagggatcataagtcttttgatgatgttattccggaacagaggagaccggaaatgcatcatcaaaacctggcggcagcgcaaaagatg

SEQ ID NO: 76434 - DNA, 103 bp, Artificial Sequence
  Synthetic Polynucleotide
taatacgactcactatagggagaggatcataagtcttttgatgatgttataacagaggagaataacaatgtcaaaagacaacctggcggcagcgcaaaagatg

SEQ ID NO: 76435 - DNA, 103 bp, Artificial Sequence
  Synthetic Polynucleotide
taatacgactcactatagggatattgattttggtaggatcaaattccataaacagaggagatatggaatgtgatcctacaacctggcggcagcgcaaaagatg

SEQ ID NO: 76436 - DNA, 103 bp, Artificial Sequence
  Synthetic Polynucleotide
taatacgactcactatagggatgagagaggatcataagtcttttgatgataacagaggagaatcatcatgagacttatgaacctggcggcagcgcaaaagatg

SEQ ID NO: 76437 - DNA, 103 bp, Artificial Sequence
  Synthetic Polynucleotide
taatacgactcactatagggaatcaatgagagaggatcataagtcttttgaacagaggagacaaaagatgtatgatcctaacctggcggcagcgcaaaagatg

SEQ ID NO: 76438 - DNA, 103 bp, Artificial Sequence
  Synthetic Polynucleotide
taatacgactcactatagggcgaaaaatcaatgagagaggatcataagtcaacagaggagagacttaatgtcctctctcaacctggcggcagcgcaaaagatg

SEQ ID NO: 76439 - DNA, 103 bp, Artificial Sequence
  Synthetic Polynucleotide
taatacgactcactatagggtcccgcgaaaaatcaatgagagaggatcataacagaggagaatgatcatgtctcattgaaacctggcggcagcgcaaaagatg

SEQ ID NO: 76440 - DNA, 103 bp, Artificial Sequence
  Synthetic Polynucleotide
taatacgactcactatagggatgtatcccgcgaaaaatcaatgagagaggaacagaggagacctctcatgttgatttttaacctggcggcagcgcaaaagatg

SEQ ID NO: 76441 - DNA, 103 bp, Artificial Sequence
  Synthetic Polynucleotide
taatacgactcactatagggagatgatgtatcccgcgaaaaatcaatgagaacagaggagactcattatgttttcgcggaacctggcggcagcgcaaaagatg

SEQ ID NO: 76442 - DNA, 103 bp, Artificial Sequence
  Synthetic Polynucleotide
taatacgactcactatagggataatagatgatgtatcccgcgaaaaatcaaacagaggagatgatttatggcgggatacaacctggcggcagcgcaaaagatg

SEQ ID NO: 76443 - DNA, 103 bp, Artificial Sequence
  Synthetic Polynucleotide
taatacgactcactatagggacgtcataatagatgatgtatcccgcgaaaaacagaggagatttcgcatgatacatcataacctggcggcagcgcaaaagatg

SEQ ID NO: 76444 - DNA, 103 bp, Artificial Sequence
  Synthetic Polynucleotide
taatacgactcactatagggggctgacgtcataatagatgatgtatcccgaacagaggagacgggatatgtcatctattaacctggcggcagcgcaaaagatg

SEQ ID NO: 76445 - DNA, 103 bp, Artificial Sequence
  Synthetic Polynucleotide
taatacgactcactatagggactatggctgacgtcataatagatgatgtaaacagaggagatacatcatgtattatgacaacctggcggcagcgcaaaagatg

SEQ ID NO: 76446 - DNA, 103 bp, Artificial Sequence
  Synthetic Polynucleotide
taatacgactcactatagggatgatatattgattttggtaggatcaaattaacagaggagaaatttgatgctaccaaaaaacctggcggcagcgcaaaagatg

SEQ ID NO: 76447 - DNA, 103 bp, Artificial Sequence
  Synthetic Polynucleotide
taatacgactcactatagggctatgactatggctgacgtcataatagatgaacagaggagacatctaatgtgacgtcagaacctggcggcagcgcaaaagatg

SEQ ID NO: 76448 - DNA, 103 bp, Artificial Sequence
  Synthetic Polynucleotide
taatacgactcactatagggggatgctatgactatggctgacgtcataataacagaggagaattatgatgtcagccataaacctggcggcagcgcaaaagatg

SEQ ID NO: 76449 - DNA, 103 bp, Artificial Sequence
  Synthetic Polynucleotide
taatacgactcactatagggaagccggatgctatgactatggctgacgtcaacagaggagagacgtcatgcatagtcataacctggcggcagcgcaaaagatg

SEQ ID NO: 76450 - DNA, 103 bp, Artificial Sequence
  Synthetic Polynucleotide
taatacgactcactatagggcggataagccggatgctatgactatggctgaacagaggagacagccaatgtcatagcataacctggcggcagcgcaaaagatg

SEQ ID NO: 76451 - DNA, 103 bp, Artificial Sequence
  Synthetic Polynucleotide
taatacgactcactatagggtgaggcggataagccggatgctatgactataacagaggagaatagtcatggcatccggcaacctggcggcagcgcaaaagatg

SEQ ID NO: 76452 - DNA, 103 bp, Artificial Sequence
  Synthetic Polynucleotide
taatacgactcactatagggacaactgaggcggataagccggatgctatgaacagaggagacatagcatgcggcttatcaacctggcggcagcgcaaaagatg

SEQ ID NO: 76453 - DNA, 103 bp, Artificial Sequence
  Synthetic Polynucleotide
taatacgactcactatagggttatgacaactgaggcggataagccggatgaacagaggagacatccgatgtatccgcctaacctggcggcagcgcaaaagatg

SEQ ID NO: 76454 - DNA, 103 bp, Artificial Sequence
  Synthetic Polynucleotide
taatacgactcactatagggttggtttatgacaactgaggcggataagccaacagaggagaggcttaatggcctcagttaacctggcggcagcgcaaaagatg

SEQ ID NO: 76455 - DNA, 103 bp, Artificial Sequence
  Synthetic Polynucleotide
taatacgactcactatagggcctcgttggtttatgacaactgaggcggataacagaggagaatccgcatgagttgtcataacctggcggcagcgcaaaagatg

SEQ ID NO: 76456 - DNA, 103 bp, Artificial Sequence
  Synthetic Polynucleotide
taatacgactcactatagggttcctcctcgttggtttatgacaactgaggaacagaggagacctcagatgtcataaaccaacctggcggcagcgcaaaagatg

SEQ ID NO: 76457 - DNA, 103 bp, Artificial Sequence
  Synthetic Polynucleotide
taatacgactcactatagggctacttatgctgcaaaagattctgaacgagaacagaggagactcgttatgaatcttttgaacctggcggcagcgcaaaagatg

SEQ ID NO: 76458 - DNA, 103 bp, Artificial Sequence
  Synthetic Polynucleotide
taatacgactcactatagggtatagatgatatattgattttggtaggatcaacagaggagagatcctatgaaaatcaataacctggcggcagcgcaaaagatg

SEQ ID NO: 76459 - DNA, 103 bp, Artificial Sequence
  Synthetic Polynucleotide
taatacgactcactatagggcgatattcctcctcgttggtttatgacaacaacagaggagagttgtcatgaaccaacgaaacctggcggcagcgcaaaagatg

SEQ ID NO: 76460 - DNA, 103 bp, Artificial Sequence
  Synthetic Polynucleotide
taatacgactcactatagggtccgacgatattcctcctcgttggtttatgaacagaggagacataaaatgacgaggaggaacctggcggcagcgcaaaagatg

SEQ ID NO: 76461 - DNA, 103 bp, Artificial Sequence
  Synthetic Polynucleotide
taatacgactcactatagggacagctccgacgatattcctcctcgttggtaacagaggagaaccaacatggaggaatataacctggcggcagcgcaaaagatg

SEQ ID NO: 76462 - DNA, 103 bp, Artificial Sequence
  Synthetic Polynucleotide
taatacgactcactatagggggtgtacagctccgacgatattcctcctcgaacagaggagacgaggaatgatatcgtcgaacctggcggcagcgcaaaagatg

SEQ ID NO: 76463 - DNA, 103 bp, Artificial Sequence
  Synthetic Polynucleotide
taatacgactcactataggggctatggtgtacagctccgacgatattcctaacagaggagaaggaatatggtcggagctaacctggcggcagcgcaaaagatg

SEQ ID NO: 76464 - DNA, 103 bp, Artificial Sequence
  Synthetic Polynucleotide
taatacgactcactataggggtagtgctatggtgtacagctccgacgataaacagaggagatatcgtatgagctgtacaaacctggcggcagcgcaaaagatg

SEQ ID NO: 76465 - DNA, 103 bp, Artificial Sequence
  Synthetic Polynucleotide
taatacgactcactatagggtcaacgtagtgctatggtgtacagctccgaaacagaggagatcggagatgtacaccataaacctggcggcagcgcaaaagatg

SEQ ID NO: 76466 - DNA, 103 bp, Artificial Sequence
  Synthetic Polynucleotide
taatacgactcactataggggatcttcaacgtagtgctatggtgtacagcaacagaggagagctgtaatgcatagcactaacctggcggcagcgcaaaagatg

SEQ ID NO: 76467 - DNA, 103 bp, Artificial Sequence
  Synthetic Polynucleotide
taatacgactcactatagggtgtacgatcttcaacgtagtgctatggtgtaacagaggagaacaccaatgcactacgttaacctggcggcagcgcaaaagatg

SEQ ID NO: 76468 - DNA, 103 bp, Artificial Sequence
  Synthetic Polynucleotide
taatacgactcactatagggagctctgtacgatcttcaacgtagtgctataacagaggagaatagcaatgcgttgaagaaacctggcggcagcgcaaaagatg

SEQ ID NO: 76469 - DNA, 103 bp, Artificial Sequence
  Synthetic Polynucleotide
taatacgactcactatagggtgatctatagatgatatattgattttggtaaacagaggagataccaaatgcaatatatcaacctggcggcagcgcaaaagatg

SEQ ID NO: 76470 - DNA, 103 bp, Artificial Sequence
  Synthetic Polynucleotide
taatacgactcactatagggaataaagctctgtacgatcttcaacgtagtaacagaggagaactacgatgaagatcgtaaacctggcggcagcgcaaaagatg

SEQ ID NO: 76471 - DNA, 103 bp, Artificial Sequence
  Synthetic Polynucleotide
taatacgactcactatagggaagttaataaagctctgtacgatcttcaacaacagaggagagttgaaatgcgtacagagaacctggcggcagcgcaaaagatg

SEQ ID NO: 76472 - DNA, 103 bp, Artificial Sequence
  Synthetic Polynucleotide
taatacgactcactataggggcgagaagttaataaagctctgtacgatctaacagaggagaagatcgatgagagctttaaacctggcggcagcgcaaaagatg

SEQ ID NO: 76473 - DNA, 103 bp, Artificial Sequence
  Synthetic Polynucleotide
taatacgactcactataggggagaagcgagaagttaataaagctctgtacaacagaggagagtacagatgtttattaacaacctggcggcagcgcaaaagatg

SEQ ID NO: 76474 - DNA, 103 bp, Artificial Sequence
  Synthetic Polynucleotide
taatacgactcactatagggatatggagaagcgagaagttaataaagctcaacagaggagagagcttatgtaacttctcaacctggcggcagcgcaaaagatg

SEQ ID NO: 76475 - DNA, 103 bp, Artificial Sequence
  Synthetic Polynucleotide
taatacgactcactatagggacttaatatggagaagcgagaagttaataaaacagaggagattattaatgtctcgcttcaacctggcggcagcgcaaaagatg

SEQ ID NO: 76476 - DNA, 103 bp, Artificial Sequence
  Synthetic Polynucleotide
taatacgactcactatagggagacaacttaatatggagaagcgagaagttaacagaggagaaacttcatgcttctccataacctggcggcagcgcaaaagatg

SEQ ID NO: 76477 - DNA, 103 bp, Artificial Sequence
  Synthetic Polynucleotide
taatacgactcactatagggtaactagacaacttaatatggagaagcgagaacagaggagactcgctatgccatattaaaacctggcggcagcgcaaaagatg

SEQ ID NO: 76478 - DNA, 103 bp, Artificial Sequence
  Synthetic Polynucleotide
taatacgactcactatagggacaactaactagacaacttaatatggagaaaacagaggagattctccatgttaagttgtaacctggcggcagcgcaaaagatg

SEQ ID NO: 76479 - DNA, 103 bp, Artificial Sequence
  Synthetic Polynucleotide
taatacgactcactataggggctgtacaactaactagacaacttaatatgaacagaggagacatattatgttgtctagtaacctggcggcagcgcaaaagatg

SEQ ID NO: 76480 - DNA, 103 bp, Artificial Sequence
  Synthetic Polynucleotide
taatacgactcactatagggttacatgatctatagatgatatattgatttaacagaggagaaaatcaatgtatcatctaaacctggcggcagcgcaaaagatg

SEQ ID NO: 76481 - DNA, 103 bp, Artificial Sequence
  Synthetic Polynucleotide
taatacgactcactatagggttactgctgtacaactaactagacaacttaaacagaggagataagttatgtagttagttaacctggcggcagcgcaaaagatg

SEQ ID NO: 76482 - DNA, 103 bp, Artificial Sequence
  Synthetic Polynucleotide
taatacgactcactatagggaggagttactgctgtacaactaactagacaaacagaggagatgtctaatgagttgtacaaacctggcggcagcgcaaaagatg

SEQ ID NO: 76483 - DNA, 103 bp, Artificial Sequence
  Synthetic Polynucleotide
taatacgactcactatagggcttgaaggagttactgctgtacaactaactaacagaggagaagttagatgtacagcagtaacctggcggcagcgcaaaagatg

SEQ ID NO: 76484 - DNA, 103 bp, Artificial Sequence
  Synthetic Polynucleotide
taatacgactcactatagggttggacttgaaggagttactgctgtacaacaacagaggagagttgtaatgcagtaactcaacctggcggcagcgcaaaagatg

SEQ ID NO: 76485 - DNA, 103 bp, Artificial Sequence
  Synthetic Polynucleotide
taatacgactcactatagggaaacattggacttgaaggagttactgctgtaacagaggagaacagcaatgactccttcaaacctggcggcagcgcaaaagatg

SEQ ID NO: 76486 - DNA, 103 bp, Artificial Sequence
  Synthetic Polynucleotide
taatacgactcactatagggattaaaaacattggacttgaaggagttactaacagaggagaagtaacatgttcaagtccaacctggcggcagcgcaaaagatg

SEQ ID NO: 76487 - DNA, 103 bp, Artificial Sequence
  Synthetic Polynucleotide
taatacgactcactatagggaggctattaaaaacattggacttgaaggagaacagaggagactccttatggtccaatgtaacctggcggcagcgcaaaagatg

SEQ ID NO: 76488 - DNA, 103 bp, Artificial Sequence
  Synthetic Polynucleotide
taatacgactcactatagggatgtgaggctattaaaaacattggacttgaaacagaggagatcaagtatgatgtttttaaacctggcggcagcgcaaaagatg

SEQ ID NO: 76489 - DNA, 103 bp, Artificial Sequence
  Synthetic Polynucleotide
taatacgactcactatagggattgtatgtgaggctattaaaaacattggaaacagaggagatccaatatgtttaatagcaacctggcggcagcgcaaaagatg

SEQ ID NO: 76490 - DNA, 103 bp, Artificial Sequence
  Synthetic Polynucleotide
taatacgactcactatagggcagagattgtatgtgaggctattaaaaacaaacagaggagatgttttatgtagcctcacaacctggcggcagcgcaaaagatg

SEQ ID NO: 76491 - DNA, 103 bp, Artificial Sequence
  Synthetic Polynucleotide
taatacgactcactatagggtattgttacatgatctatagatgatatattaacagaggagaaatataatgtctatagataacctggcggcagcgcaaaagatg

SEQ ID NO: 76492 - DNA, 103 bp, Artificial Sequence
  Synthetic Polynucleotide
taatacgactcactatagggtgacgcagagattgtatgtgaggctattaaaacagaggagattaataatgtcacatacaaacctggcggcagcgcaaaagatg

SEQ ID NO: 76493 - DNA, 103 bp, Artificial Sequence
  Synthetic Polynucleotide
taatacgactcactatagggcgttctgacgcagagattgtatgtgaggctaacagaggagaagcctcatgtacaatctcaacctggcggcagcgcaaaagatg

SEQ ID NO: 76494 - DNA, 103 bp, Artificial Sequence
  Synthetic Polynucleotide
taatacgactcactatagggacgagcgttctgacgcagagattgtatgtgaacagaggagacacataatgtctctgcgtaacctggcggcagcgcaaaagatg

SEQ ID NO: 76495 - DNA, 103 bp, Artificial Sequence
  Synthetic Polynucleotide
taatacgactcactatagggtattgacgagcgttctgacgcagagattgtaacagaggagaacaatcatggcgtcagaaaacctggcggcagcgcaaaagatg

SEQ ID NO: 76496 - DNA, 103 bp, Artificial Sequence
  Synthetic Polynucleotide
taatacgactcactatagggatctatattgacgagcgttctgacgcagagaacagaggagactctgcatgagaacgctcaacctggcggcagcgcaaaagatg

SEQ ID NO: 76497 - DNA, 103 bp, Artificial Sequence
  Synthetic Polynucleotide
taatacgactcactatagggctaagatctatattgacgagcgttctgacgaacagaggagacgtcagatggctcgtcaaaacctggcggcagcgcaaaagatg

SEQ ID NO: 76498 - DNA, 103 bp, Artificial Sequence
  Synthetic Polynucleotide
taatacgactcactatagggaatgtctaagatctatattgacgagcgttcaacagaggagagaacgcatgtcaatatagaacctggcggcagcgcaaaagatg

SEQ ID NO: 76499 - DNA, 103 bp, Artificial Sequence
  Synthetic Polynucleotide
taatacgactcactatagggctaaaaatgtctaagatctatattgacgagaacagaggagactcgtcatgatagatcttaacctggcggcagcgcaaaagatg

SEQ ID NO: 76500 - DNA, 103 bp, Artificial Sequence
  Synthetic Polynucleotide
taatacgactcactatagggtctctctaaaaatgtctaagatctatattgaacagaggagacaatatatgtcttagacaaacctggcggcagcgcaaaagatg

SEQ ID NO: 76501 - DNA, 103 bp, Artificial Sequence
  Synthetic Polynucleotide
taatacgactcactataggggtagttctctctaaaaatgtctaagatctaaacagaggagatagatcatggacatttttaacctggcggcagcgcaaaagatg

SEQ ID NO: 76502 - DNA, 103 bp, Artificial Sequence
  Synthetic Polynucleotide
taatacgactcactatagggtgtaatattgttacatgatctatagatgataacagaggagaatcatcatgagatcatgtaacctggcggcagcgcaaaagatg

SEQ ID NO: 76503 - DNA, 103 bp, Artificial Sequence
  Synthetic Polynucleotide
taatacgactcactatagggttgcggtagttctctctaaaaatgtctaagaacagaggagacttagaatgttttagagaaacctggcggcagcgcaaaagatg

SEQ ID NO: 76504 - DNA, 103 bp, Artificial Sequence
  Synthetic Polynucleotide
taatacgactcactatagggactagttgcggtagttctctctaaaaatgtaacagaggagaacatttatggagagaactaacctggcggcagcgcaaaagatg

SEQ ID NO: 76505 - DNA, 103 bp, Artificial Sequence
  Synthetic Polynucleotide
taatacgactcactatagggttattactagttgcggtagttctctctaaaaacagaggagatttagaatgaactaccgcaacctggcggcagcgcaaaagatg

SEQ ID NO: 76506 - DNA, 103 bp, Artificial Sequence
  Synthetic Polynucleotide
taatacgactcactatagggtagttttattactagttgcggtagttctctaacagaggagaagagaaatgccgcaactaaacctggcggcagcgcaaaagatg

SEQ ID NO: 76507 - DNA, 103 bp, Artificial Sequence
  Synthetic Polynucleotide
taatacgactcactatagggtagattagttttattactagttgcggtagtaacagaggagaactaccatgactagtaataacctggcggcagcgcaaaagatg

SEQ ID NO: 76508 - DNA, 103 bp, Artificial Sequence
  Synthetic Polynucleotide
taatacgactcactatagggtaaaatagattagttttattactagttgcgaacagaggagacgcaacatgtaataaaacaacctggcggcagcgcaaaagatg

SEQ ID NO: 76509 - DNA, 103 bp, Artificial Sequence
  Synthetic Polynucleotide
taatacgactcactatagggaatgataaaatagattagttttattactagaacagaggagactagtaatgaaactaatcaacctggcggcagcgcaaaagatg

SEQ ID NO: 76510 - DNA, 103 bp, Artificial Sequence
  Synthetic Polynucleotide
taatacgactcactatagggaaaaaaatgataaaatagattagttttattaacagaggagaaataaaatgaatctatttaacctggcggcagcgcaaaagatg

SEQ ID NO: 76511 - DNA, 103 bp, Artificial Sequence
  Synthetic Polynucleotide
taatacgactcactatagggtgaataaaaaaatgataaaatagattagttaacagaggagaaactaaatgattttatcaaacctggcggcagcgcaaaagatg

SEQ ID NO: 76512 - DNA, 103 bp, Artificial Sequence
  Synthetic Polynucleotide
taatacgactcactataggggatgatgaataaaaaaatgataaaatagataacagaggagaatctatatgatcatttttaacctggcggcagcgcaaaagatg

SEQ ID NO: 76513 - DNA, 103 bp, Artificial Sequence
  Synthetic Polynucleotide
taatacgactcactatagggtgtattgtaatattgttacatgatctatagaacagaggagactatagatgatgtaacaaaacctggcggcagcgcaaaagatg

SEQ ID NO: 76514 - DNA, 103 bp, Artificial Sequence
  Synthetic Polynucleotide
taatacgactcactatagggcagaagatgatgaataaaaaaatgataaaaaacagaggagattttatatgttttttattaacctggcggcagcgcaaaagatg

SEQ ID NO: 76515 - DNA, 103 bp, Artificial Sequence
  Synthetic Polynucleotide
taatacgactcactatagggaccaccagaagatgatgaataaaaaaatgaaacagaggagatcatttatgtattcatcaaacctggcggcagcgcaaaagatg

SEQ ID NO: 76516 - DNA, 103 bp, Artificial Sequence
  Synthetic Polynucleotide
taatacgactcactataggggatgaaccaccagaagatgatgaataaaaaaacagaggagatttttaatgatcatcttcaacctggcggcagcgcaaaagatg

SEQ ID NO: 76517 - DNA, 103 bp, Artificial Sequence
  Synthetic Polynucleotide
taatacgactcactatagggggaacgatgaaccaccagaagatgatgaataacagaggagaattcatatgcttctggtgaacctggcggcagcgcaaaagatg

SEQ ID NO: 76518 - DNA, 103 bp, Artificial Sequence
  Synthetic Polynucleotide
taatacgactcactatagggcgataggaacgatgaaccaccagaagatgaaacagaggagatcatctatgggtggttcaaacctggcggcagcgcaaaagatg

SEQ ID NO: 76519 - DNA, 103 bp, Artificial Sequence
  Synthetic Polynucleotide
taatacgactcactatagggacattcgataggaacgatgaaccaccagaaaacagaggagattctggatgttcatcgttaacctggcggcagcgcaaaagatg

SEQ ID NO: 76520 - DNA, 103 bp, Artificial Sequence
  Synthetic Polynucleotide
taatacgactcactataggggagtcacattcgataggaacgatgaaccacaacagaggagagtggttatgcgttcctataacctggcggcagcgcaaaagatg

SEQ ID NO: 76521 - DNA, 103 bp, Artificial Sequence
  Synthetic Polynucleotide
taatacgactcactatagggaatcagagtcacattcgataggaacgatgaaacagaggagatcatcgatgctatcgaataacctggcggcagcgcaaaagatg

SEQ ID NO: 76522 - DNA, 103 bp, Artificial Sequence
  Synthetic Polynucleotide
taatacgactcactataggggggttaatcagagtcacattcgataggaacaacagaggagagttcctatggaatgtgacaacctggcggcagcgcaaaagatg

SEQ ID NO: 76523 - DNA, 103 bp, Artificial Sequence
  Synthetic Polynucleotide
taatacgactcactatagggatgatgggttaatcagagtcacattcgataaacagaggagatatcgaatgtgactctgaaacctggcggcagcgcaaaagatg

SEQ ID NO: 76524 - DNA, 103 bp, Artificial Sequence
  Synthetic Polynucleotide
taatacgactcactatagggatctatgtattgtaatattgttacatgatcaacagaggagagatcatatgacaatattaaacctggcggcagcgcaaaagatg

SEQ ID NO: 76525 - DNA, 103 bp, Artificial Sequence
  Synthetic Polynucleotide
taatacgactcactatagggtatagatgatgggttaatcagagtcacattaacagaggagaaatgtgatgctgattaacaacctggcggcagcgcaaaagatg

SEQ ID NO: 76526 - DNA, 103 bp, Artificial Sequence
  Synthetic Polynucleotide
taatacgactcactatagggtcacctatagatgatgggttaatcagagtcaacagaggagagactctatgtaacccatcaacctggcggcagcgcaaaagatg

SEQ ID NO: 76527 - DNA, 103 bp, Artificial Sequence
  Synthetic Polynucleotide
taatacgactcactatagggcagcatcacctatagatgatgggttaatcaaacagaggagatgattaatgcatcatctaaacctggcggcagcgcaaaagatg

SEQ ID NO: 76528 - DNA, 103 bp, Artificial Sequence
  Synthetic Polynucleotide
taatacgactcactatagggagaaccagcatcacctatagatgatgggttaacagaggagaaacccaatgtctataggtaacctggcggcagcgcaaaagatg

SEQ ID NO: 76529 - DNA, 103 bp, Artificial Sequence
  Synthetic Polynucleotide
taatacgactcactatagggtctccagaaccagcatcacctatagatgataacagaggagaatcatcatgaggtgatgcaacctggcggcagcgcaaaagatg

SEQ ID NO: 76530 - DNA, 103 bp, Artificial Sequence
  Synthetic Polynucleotide
taatacgactcactatagggcagaatctccagaaccagcatcacctatagaacagaggagactatagatgatgctggttaacctggcggcagcgcaaaagatg

SEQ ID NO: 76531 - DNA, 103 bp, Artificial Sequence
  Synthetic Polynucleotide
taatacgactcactatagggtcctccagaatctccagaaccagcatcaccaacagaggagaggtgatatgggttctggaaacctggcggcagcgcaaaagatg

SEQ ID NO: 76532 - DNA, 103 bp, Artificial Sequence
  Synthetic Polynucleotide
taatacgactcactatagggccatctcctccagaatctccagaaccagcaaacagaggagatgctggatgtggagattcaacctggcggcagcgcaaaagatg

SEQ ID NO: 76533 - DNA, 103 bp, Artificial Sequence
  Synthetic Polynucleotide
taatacgactcactatagggataatccatctcctccagaatctccagaacaacagaggagagttctgatgattctggagaacctggcggcagcgcaaaagatg

SEQ ID NO: 76534 - DNA, 103 bp, Artificial Sequence
  Synthetic Polynucleotide
taatacgactcactatagggagataataatccatctcctccagaatctccaacagaggagaggagatatgggaggagataacctggcggcagcgcaaaagatg

SEQ ID NO: 76535 - DNA, 103 bp, Artificial Sequence
  Synthetic Polynucleotide
taatacgactcactatagggggttcatctatgtattgtaatattgttacaaacagaggagatgtaacatgattacaataaacctggcggcagcgcaaaagatg

SEQ ID NO: 76536 - DNA, 103 bp, Artificial Sequence
  Synthetic Polynucleotide
taatacgactcactatagggcttccagataataatccatctcctccagaaaacagaggagattctggatgagatggattaacctggcggcagcgcaaaagatg

SEQ ID NO: 76537 - DNA, 103 bp, Artificial Sequence
  Synthetic Polynucleotide
taatacgactcactatagggagattcttccagataataatccatctcctcaacagaggagagaggagatggattattataacctggcggcagcgcaaaagatg

SEQ ID NO: 76538 - DNA, 103 bp, Artificial Sequence
  Synthetic Polynucleotide
taatacgactcactatagggaacagagattcttccagataataatccatcaacagaggagagatggaatgttatctggaaacctggcggcagcgcaaaagatg

SEQ ID NO: 76539 - DNA, 103 bp, Artificial Sequence
  Synthetic Polynucleotide
taatacgactcactataggggaaataacagagattcttccagataataataacagaggagaattattatgtggaagaataacctggcggcagcgcaaaagatg

SEQ ID NO: 76540 - DNA, 103 bp, Artificial Sequence
  Synthetic Polynucleotide
taatacgactcactatagggacaaggaaataacagagattcttccagataaacagaggagatatctgatggaatctctgaacctggcggcagcgcaaaagatg

SEQ ID NO: 76541 - DNA, 103 bp, Artificial Sequence
  Synthetic Polynucleotide
taatacgactcactatagggtaaaaacaaggaaataacagagattcttccaacagaggagaggaagaatgtctgttattaacctggcggcagcgcaaaagatg

SEQ ID NO: 76542 - DNA, 103 bp, Artificial Sequence
  Synthetic Polynucleotide
taatacgactcactatagggatacataaaaacaaggaaataacagagattaacagaggagaaatctcatgtatttccttaacctggcggcagcgcaaaagatg

SEQ ID NO: 76543 - DNA, 103 bp, Artificial Sequence
  Synthetic Polynucleotide
taatacgactcactatagggaatcgatacataaaaacaaggaaataacagaacagaggagactgttaatgccttgttttaacctggcggcagcgcaaaagatg

SEQ ID NO: 76544 - DNA, 103 bp, Artificial Sequence
  Synthetic Polynucleotide
taatacgactcactatagggaacgcaatcgatacataaaaacaaggaaataacagaggagaatttccatgtttttatgtaacctggcggcagcgcaaaagatg

SEQ ID NO: 76545 - DNA, 103 bp, Artificial Sequence
  Synthetic Polynucleotide
taatacgactcactataggggttacaacgcaatcgatacataaaaacaagaacagaggagacttgttatgatgtatcgaaacctggcggcagcgcaaaagatg

SEQ ID NO: 76546 - DNA, 103 bp, Artificial Sequence
  Synthetic Polynucleotide
taatacgactcactatagggcatttggttcatctatgtattgtaatattgaacagaggagacaatatatgaatacatagaacctggcggcagcgcaaaagatg

SEQ ID NO: 76547 - DNA, 103 bp, Artificial Sequence
  Synthetic Polynucleotide
taatacgactcactatagggttaatgttacaacgcaatcgatacataaaaaacagaggagattttatatgtcgattgcgaacctggcggcagcgcaaaagatg

SEQ ID NO: 76548 - DNA, 103 bp, Artificial Sequence
  Synthetic Polynucleotide
taatacgactcactatagggcaatcttaatgttacaacgcaatcgatacaaacagaggagatgtatcatgtgcgttgtaaacctggcggcagcgcaaaagatg

SEQ ID NO: 76549 - DNA, 103 bp, Artificial Sequence
  Synthetic Polynucleotide
taatacgactcactatagggtttcgcaatcttaatgttacaacgcaatcgaacagaggagacgattgatgtgtaacattaacctggcggcagcgcaaaagatg

SEQ ID NO: 76550 - DNA, 103 bp, Artificial Sequence
  Synthetic Polynucleotide
taatacgactcactataggggagcatttcgcaatcttaatgttacaacgcaacagaggagagcgttgatgcattaagataacctggcggcagcgcaaaagatg

SEQ ID NO: 76551 - DNA, 103 bp, Artificial Sequence
  Synthetic Polynucleotide
taatacgactcactatagggatttagagcatttcgcaatcttaatgttacaacagaggagagtaacaatgagattgcgaaacctggcggcagcgcaaaagatg

SEQ ID NO: 76552 - DNA, 103 bp, Artificial Sequence
  Synthetic Polynucleotide
taatacgactcactatagggcccaaatttagagcatttcgcaatcttaataacagaggagaattaagatggcgaaatgcaacctggcggcagcgcaaaagatg

SEQ ID NO: 76553 - DNA, 103 bp, Artificial Sequence
  Synthetic Polynucleotide
taatacgactcactatagggagcctcccaaatttagagcatttcgcaatcaacagaggagagattgcatgatgctctaaaacctggcggcagcgcaaaagatg

SEQ ID NO: 76554 - DNA, 103 bp, Artificial Sequence
  Synthetic Polynucleotide
taatacgactcactatagggcttcaagcctcccaaatttagagcatttcgaacagaggagacgaaatatgctaaatttgaacctggcggcagcgcaaaagatg

SEQ ID NO: 76555 - DNA, 103 bp, Artificial Sequence
  Synthetic Polynucleotide
taatacgactcactatagggcaacacttcaagcctcccaaatttagagcaaacagaggagatgctctatgtttgggaggaacctggcggcagcgcaaaagatg

SEQ ID NO: 76556 - DNA, 103 bp, Artificial Sequence
  Synthetic Polynucleotide
taatacgactcactataggggcaaacaacacttcaagcctcccaaatttaaacagaggagataaattatggaggcttgaaacctggcggcagcgcaaaagatg

SEQ ID NO: 76557 - DNA, 103 bp, Artificial Sequence
  Synthetic Polynucleotide
taatacgactcactatagggtatatcatttggttcatctatgtattgtaaaacagaggagattacaaatgatagatgaaaacctggcggcagcgcaaaagatg

SEQ ID NO: 76558 - DNA, 103 bp, Artificial Sequence
  Synthetic Polynucleotide
taatacgactcactatagggagattgcaaacaacacttcaagcctcccaaaacagaggagattgggaatgttgaagtgtaacctggcggcagcgcaaaagatg

SEQ ID NO: 76559 - DNA, 103 bp, Artificial Sequence
  Synthetic Polynucleotide
taatacgactcactatagggtgtagagattgcaaacaacacttcaagcctaacagaggagaaggcttatggtgttgtttaacctggcggcagcgcaaaagatg

SEQ ID NO: 76560 - DNA, 103 bp, Artificial Sequence
  Synthetic Polynucleotide
taatacgactcactatagggacgcgtgtagagattgcaaacaacacttcaaacagaggagatgaagtatggtttgcaataacctggcggcagcgcaaaagatg

SEQ ID NO: 76561 - DNA, 103 bp, Artificial Sequence
  Synthetic Polynucleotide
taatacgactcactatagggtagacacgcgtgtagagattgcaaacaacaaacagaggagatgttgtatgcaatctctaaacctggcggcagcgcaaaagatg

SEQ ID NO: 76562 - DNA, 103 bp, Artificial Sequence
  Synthetic Polynucleotide
taatacgactcactatagggttagttagacacgcgtgtagagattgcaaaaacagaggagatttgcaatgtctacacgcaacctggcggcagcgcaaaagatg

SEQ ID NO: 76563 - DNA, 103 bp, Artificial Sequence
  Synthetic Polynucleotide
taatacgactcactatagggctccattagttagacacgcgtgtagagattaacagaggagaaatctcatgacgcgtgtcaacctggcggcagcgcaaaagatg

SEQ ID NO: 76564 - DNA, 103 bp, Artificial Sequence
  Synthetic Polynucleotide
taatacgactcactatagggtgaacctccattagttagacacgcgtgtagaacagaggagactacacatgtgtctaactaacctggcggcagcgcaaaagatg

SEQ ID NO: 76565 - DNA, 103 bp, Artificial Sequence
  Synthetic Polynucleotide
taatacgactcactataggggctgatgaacctccattagttagacacgcgaacagaggagacgcgtgatgaactaatggaacctggcggcagcgcaaaagatg

SEQ ID NO: 76566 - DNA, 103 bp, Artificial Sequence
  Synthetic Polynucleotide
taatacgactcactataggggagccgctgatgaacctccattagttagacaacagaggagagtctaaatgatggaggttaacctggcggcagcgcaaaagatg

SEQ ID NO: 76567 - DNA, 103 bp, Artificial Sequence
  Synthetic Polynucleotide
taatacgactcactatagggaactagagccgctgatgaacctccattagtaacagaggagaactaatatgggttcatcaaacctggcggcagcgcaaaagatg

SEQ ID NO: 76568 - DNA, 103 bp, Artificial Sequence
  Synthetic Polynucleotide
taatacgactcactatagggacatactacttatgctgcaaaagattctgaaacagaggagatcagaaatgtttgcagcaaacctggcggcagcgcaaaagatg

SEQ ID NO: 76569 - DNA, 103 bp, Artificial Sequence
  Synthetic Polynucleotide
taatacgactcactatagggagtcttatatcatttggttcatctatgtataacagaggagaatacatatgtgaaccaaaaacctggcggcagcgcaaaagatg

SEQ ID NO: 76570 - DNA, 103 bp, Artificial Sequence
  Synthetic Polynucleotide
taatacgactcactatagggattcaaactagagccgctgatgaacctccaaacagaggagatggaggatgatcagcggcaacctggcggcagcgcaaaagatg

SEQ ID NO: 76571 - DNA, 103 bp, Artificial Sequence
  Synthetic Polynucleotide
taatacgactcactatagggtgatgattcaaactagagccgctgatgaacaacagaggagagttcatatgcggctctagaacctggcggcagcgcaaaagatg

SEQ ID NO: 76572 - DNA, 103 bp, Artificial Sequence
  Synthetic Polynucleotide
taatacgactcactatagggaccgatgatgattcaaactagagccgctgaaacagaggagatcagcgatgctagtttgaaacctggcggcagcgcaaaagatg

SEQ ID NO: 76573 - DNA, 103 bp, Artificial Sequence
  Synthetic Polynucleotide
taatacgactcactatagggactacaccgatgatgattcaaactagagccaacagaggagaggctctatgttgaatcataacctggcggcagcgcaaaagatg

SEQ ID NO: 76574 - DNA, 103 bp, Artificial Sequence
  Synthetic Polynucleotide
taatacgactcactatagggggaatactacaccgatgatgattcaaactaaacagaggagatagtttatgtcatcatcgaacctggcggcagcgcaaaagatg

SEQ ID NO: 76575 - DNA, 103 bp, Artificial Sequence
  Synthetic Polynucleotide
taatacgactcactatagggaagtaggaatactacaccgatgatgattcaaacagaggagatgaatcatgatcggtgtaaacctggcggcagcgcaaaagatg

SEQ ID NO: 76576 - DNA, 103 bp, Artificial Sequence
  Synthetic Polynucleotide
taatacgactcactatagggtgtaaaagtaggaatactacaccgatgatgaacagaggagacatcatatgtgtagtattaacctggcggcagcgcaaaagatg

SEQ ID NO: 76577 - DNA, 103 bp, Artificial Sequence
  Synthetic Polynucleotide
taatacgactcactatagggctaactgtaaaagtaggaatactacaccgaaacagaggagatcggtgatgtattcctacaacctggcggcagcgcaaaagatg

SEQ ID NO: 76578 - DNA, 103 bp, Artificial Sequence
  Synthetic Polynucleotide
taatacgactcactataggggtgtcctaactgtaaaagtaggaatactacaacagaggagagtagtaatgctacttttaaacctggcggcagcgcaaaagatg

SEQ ID NO: 76579 - DNA, 103 bp, Artificial Sequence
  Synthetic Polynucleotide
taatacgactcactatagggacaccgtgtcctaactgtaaaagtaggaataacagaggagaattcctatgtttacagttaacctggcggcagcgcaaaagatg

SEQ ID NO: 76580 - DNA, 103 bp, Artificial Sequence
  Synthetic Polynucleotide
taatacgactcactatagggctgttagtcttatatcatttggttcatctaaacagaggagatagatgatgcaaatgataaacctggcggcagcgcaaaagatg

SEQ ID NO: 76581 - DNA, 103 bp, Artificial Sequence
  Synthetic Polynucleotide
taatacgactcactatagggacaatacaccgtgtcctaactgtaaaagtaaacagaggagatactttatgagttaggacaacctggcggcagcgcaaaagatg

SEQ ID NO: 76582 - DNA, 103 bp, Artificial Sequence
  Synthetic Polynucleotide
taatacgactcactataggggaaatacaatacaccgtgtcctaactgtaaaacagaggagattacagatgggacacggtaacctggcggcagcgcaaaagatg

SEQ ID NO: 76583 - DNA, 103 bp, Artificial Sequence
  Synthetic Polynucleotide
taatacgactcactatagggaacgagaaatacaatacaccgtgtcctaacaacagaggagagttaggatgcggtgtattaacctggcggcagcgcaaaagatg

SEQ ID NO: 76584 - DNA, 103 bp, Artificial Sequence
  Synthetic Polynucleotide
taatacgactcactatagggttctcaacgagaaatacaatacaccgtgtcaacagaggagagacacgatgtattgtattaacctggcggcagcgcaaaagatg

SEQ ID NO: 76585 - DNA, 103 bp, Artificial Sequence
  Synthetic Polynucleotide
taatacgactcactatagggtaacgttctcaacgagaaatacaatacaccaacagaggagaggtgtaatgtatttctcgaacctggcggcagcgcaaaagatg

SEQ ID NO: 76586 - DNA, 103 bp, Artificial Sequence
  Synthetic Polynucleotide
taatacgactcactatagggtactttaacgttctcaacgagaaatacaataacagaggagaattgtaatgctcgttgagaacctggcggcagcgcaaaagatg

SEQ ID NO: 76587 - DNA, 103 bp, Artificial Sequence
  Synthetic Polynucleotide
taatacgactcactatagggatgattactttaacgttctcaacgagaaataacagaggagaatttctatgtgagaacgtaacctggcggcagcgcaaaagatg

SEQ ID NO: 76588 - DNA, 103 bp, Artificial Sequence
  Synthetic Polynucleotide
taatacgactcactatagggttacaatgattactttaacgttctcaacgaaacagaggagatcgttgatgacgttaaagaacctggcggcagcgcaaaagatg

SEQ ID NO: 76589 - DNA, 103 bp, Artificial Sequence
  Synthetic Polynucleotide
taatacgactcactataggggtgagttacaatgattactttaacgttctcaacagaggagagagaacatgaaagtaatcaacctggcggcagcgcaaaagatg

SEQ ID NO: 76590 - DNA, 103 bp, Artificial Sequence
  Synthetic Polynucleotide
taatacgactcactatagggaggatgtgagttacaatgattactttaacgaacagaggagacgttaaatgaatcattgtaacctggcggcagcgcaaaagatg

SEQ ID NO: 76591 - DNA, 103 bp, Artificial Sequence
  Synthetic Polynucleotide
taatacgactcactataggggcatactgttagtcttatatcatttggttcaacagaggagagaaccaatggatataagaaacctggcggcagcgcaaaagatg

SEQ ID NO: 76592 - DNA, 103 bp, Artificial Sequence
  Synthetic Polynucleotide
taatacgactcactatagggaataaaggatgtgagttacaatgattacttaacagaggagaaagtaaatgttgtaactcaacctggcggcagcgcaaaagatg

SEQ ID NO: 76593 - DNA, 103 bp, Artificial Sequence
  Synthetic Polynucleotide
taatacgactcactataggggataaaataaaggatgtgagttacaatgataacagaggagaatcattatgactcacatcaacctggcggcagcgcaaaagatg

SEQ ID NO: 76594 - DNA, 103 bp, Artificial Sequence
  Synthetic Polynucleotide
taatacgactcactatagggatatagataaaataaaggatgtgagttacaaacagaggagatgtaacatgcatcctttaaacctggcggcagcgcaaaagatg

SEQ ID NO: 76595 - DNA, 103 bp, Artificial Sequence
  Synthetic Polynucleotide
taatacgactcactatagggatacaatatagataaaataaaggatgtgagaacagaggagactcacaatgtttattttaaacctggcggcagcgcaaaagatg

SEQ ID NO: 76596 - DNA, 103 bp, Artificial Sequence
  Synthetic Polynucleotide
taatacgactcactataggggtagaatacaatatagataaaataaaggataacagaggagaatccttatgtttatctataacctggcggcagcgcaaaagatg

SEQ ID NO: 76597 - DNA, 103 bp, Artificial Sequence
  Synthetic Polynucleotide
taatacgactcactatagggaaggagtagaatacaatatagataaaataaaacagaggagattatttatgctatattgtaacctggcggcagcgcaaaagatg

SEQ ID NO: 76598 - DNA, 103 bp, Artificial Sequence
  Synthetic Polynucleotide
taatacgactcactatagggtaagaaaggagtagaatacaatatagataaaacagaggagattatctatgttgtattctaacctggcggcagcgcaaaagatg

SEQ ID NO: 76599 - DNA, 103 bp, Artificial Sequence
  Synthetic Polynucleotide
taatacgactcactatagggtgcattaagaaaggagtagaatacaatataaacagaggagatatattatgttctactccaacctggcggcagcgcaaaagatg

SEQ ID NO: 76600 - DNA, 103 bp, Artificial Sequence
  Synthetic Polynucleotide
taatacgactcactatagggtaaaatgcattaagaaaggagtagaatacaaacagaggagatgtattatgctcctttctaacctggcggcagcgcaaaagatg

SEQ ID NO: 76601 - DNA, 103 bp, Artificial Sequence
  Synthetic Polynucleotide
taatacgactcactatagggcggtataaaatgcattaagaaaggagtagaaacagaggagatctactatgttcttaatgaacctggcggcagcgcaaaagatg

SEQ ID NO: 76602 - DNA, 103 bp, Artificial Sequence
  Synthetic Polynucleotide
taatacgactcactatagggataatgcatactgttagtcttatatcatttaacagaggagaaaatgaatgaagactaacaacctggcggcagcgcaaaagatg

SEQ ID NO: 76603 - DNA, 103 bp, Artificial Sequence
  Synthetic Polynucleotide
taatacgactcactatagggttattcggtataaaatgcattaagaaaggaaacagaggagatcctttatgaatgcatttaacctggcggcagcgcaaaagatg

SEQ ID NO: 76604 - DNA, 103 bp, Artificial Sequence
  Synthetic Polynucleotide
taatacgactcactatagggatctcttattcggtataaaatgcattaagaaacagaggagatcttaaatgattttatacaacctggcggcagcgcaaaagatg

SEQ ID NO: 76605 - DNA, 103 bp, Artificial Sequence
  Synthetic Polynucleotide
taatacgactcactatagggtcgctatctcttattcggtataaaatgcataacagaggagaatgcatatgataccgaataacctggcggcagcgcaaaagatg

SEQ ID NO: 76606 - DNA, 103 bp, Artificial Sequence
  Synthetic Polynucleotide
taatacgactcactatagggttccttcgctatctcttattcggtataaaaaacagaggagattttatatggaataagagaacctggcggcagcgcaaaagatg

SEQ ID NO: 76607 - DNA, 103 bp, Artificial Sequence
  Synthetic Polynucleotide
taatacgactcactatagggaagaattccttcgctatctcttattcggtaaacagaggagataccgaatgagagatagcaacctggcggcagcgcaaaagatg

SEQ ID NO: 76608 - DNA, 103 bp, Artificial Sequence
  Synthetic Polynucleotide
taatacgactcactatagggcgaaaaagaattccttcgctatctcttattaacagaggagaaataagatgtagcgaaggaacctggcggcagcgcaaaagatg

SEQ ID NO: 76609 - DNA, 103 bp, Artificial Sequence
  Synthetic Polynucleotide
taatacgactcactatagggggtaccgaaaaagaattccttcgctatctcaacagaggagagagataatgaaggaattcaacctggcggcagcgcaaaagatg

SEQ ID NO: 76610 - DNA, 103 bp, Artificial Sequence
  Synthetic Polynucleotide
taatacgactcactatagggctagcggtaccgaaaaagaattccttcgctaacagaggagaagcgaaatgattctttttaacctggcggcagcgcaaaagatg

SEQ ID NO: 76611 - DNA, 103 bp, Artificial Sequence
  Synthetic Polynucleotide
taatacgactcactataggggggtactagcggtaccgaaaaagaattcctaacagaggagaaggaatatgttttcggtaaacctggcggcagcgcaaaagatg

SEQ ID NO: 76612 - DNA, 103 bp, Artificial Sequence
  Synthetic Polynucleotide
taatacgactcactatagggattaagggtactagcggtaccgaaaaagaaaacagaggagattctttatgggtaccgctaacctggcggcagcgcaaaagatg

SEQ ID NO: 76613 - DNA, 103 bp, Artificial Sequence
  Synthetic Polynucleotide
taatacgactcactatagggtttggataatgcatactgttagtcttatataacagaggagaatataaatgtaacagtataacctggcggcagcgcaaaagatg

SEQ ID NO: 76614 - DNA, 103 bp, Artificial Sequence
  Synthetic Polynucleotide
taatacgactcactatagggacatgattaagggtactagcggtaccgaaaaacagaggagatttcggatgcgctagtacaacctggcggcagcgcaaaagatg

SEQ ID NO: 76615 - DNA, 103 bp, Artificial Sequence
  Synthetic Polynucleotide
taatacgactcactatagggatgtgacatgattaagggtactagcggtacaacagaggagagtaccgatggtacccttaaacctggcggcagcgcaaaagatg

SEQ ID NO: 76616 - DNA, 103 bp, Artificial Sequence
  Synthetic Polynucleotide
taatacgactcactatagggacactatgtgacatgattaagggtactagcaacagaggagagctagtatgcttaatcataacctggcggcagcgcaaaagatg

SEQ ID NO: 76617 - DNA, 103 bp, Artificial Sequence
  Synthetic Polynucleotide
taatacgactcactatagggataaaacactatgtgacatgattaagggtaaacagaggagataccctatgtcatgtcacaacctggcggcagcgcaaaagatg

SEQ ID NO: 76618 - DNA, 103 bp, Artificial Sequence
  Synthetic Polynucleotide
taatacgactcactatagggggaatataaaacactatgtgacatgattaaaacagaggagattaatcatgtcacatagtaacctggcggcagcgcaaaagatg

SEQ ID NO: 76619 - DNA, 103 bp, Artificial Sequence
  Synthetic Polynucleotide
taatacgactcactatagggaatttggaatataaaacactatgtgacatgaacagaggagacatgtcatgtagtgttttaacctggcggcagcgcaaaagatg

SEQ ID NO: 76620 - DNA, 103 bp, Artificial Sequence
  Synthetic Polynucleotide
taatacgactcactatagggccacaaatttggaatataaaacactatgtgaacagaggagacacataatgttttatattaacctggcggcagcgcaaaagatg

SEQ ID NO: 76621 - DNA, 103 bp, Artificial Sequence
  Synthetic Polynucleotide
taatacgactcactatagggcattgccacaaatttggaatataaaacactaacagaggagaagtgttatgtattccaaaaacctggcggcagcgcaaaagatg

SEQ ID NO: 76622 - DNA, 103 bp, Artificial Sequence
  Synthetic Polynucleotide
taatacgactcactatagggccgttcattgccacaaatttggaatataaaaacagaggagatttataatgcaaatttgtaacctggcggcagcgcaaaagatg

SEQ ID NO: 76623 - DNA, 103 bp, Artificial Sequence
  Synthetic Polynucleotide
taatacgactcactatagggataaaccgttcattgccacaaatttggaataacagaggagaattccaatgttgtggcaaaacctggcggcagcgcaaaagatg

SEQ ID NO: 76624 - DNA, 103 bp, Artificial Sequence
  Synthetic Polynucleotide
taatacgactcactatagggaatattttggataatgcatactgttagtctaacagaggagaagactaatggtatgcattaacctggcggcagcgcaaaagatg

SEQ ID NO: 76625 - DNA, 103 bp, Artificial Sequence
  Synthetic Polynucleotide
taatacgactcactatagggtagaaataaaccgttcattgccacaaatttaacagaggagaaaatttatggcaatgaacaacctggcggcagcgcaaaagatg

SEQ ID NO: 76626 - DNA, 103 bp, Artificial Sequence
  Synthetic Polynucleotide
taatacgactcactatagggtcgtatagaaataaaccgttcattgccacaaacagaggagatgtggcatggaacggtttaacctggcggcagcgcaaaagatg

SEQ ID NO: 76627 - DNA, 103 bp, Artificial Sequence
  Synthetic Polynucleotide
taatacgactcactatagggaactatcgtatagaaataaaccgttcattgaacagaggagacaatgaatggtttatttcaacctggcggcagcgcaaaagatg

SEQ ID NO: 76628 - DNA, 103 bp, Artificial Sequence
  Synthetic Polynucleotide
taatacgactcactatagggaaacaaactatcgtatagaaataaaccgttaacagaggagaaacggtatgtttctatacaacctggcggcagcgcaaaagatg

SEQ ID NO: 76629 - DNA, 103 bp, Artificial Sequence
  Synthetic Polynucleotide
taatacgactcactatagggtctagaaacaaactatcgtatagaaataaaaacagaggagatttattatgatacgatagaacctggcggcagcgcaaaagatg

SEQ ID NO: 76630 - DNA, 103 bp, Artificial Sequence
  Synthetic Polynucleotide
taatacgactcactatagggaggattctagaaacaaactatcgtatagaaaacagaggagattctatatgatagtttgtaacctggcggcagcgcaaaagatg

SEQ ID NO: 76631 - DNA, 103 bp, Artificial Sequence
  Synthetic Polynucleotide
taatacgactcactatagggctcaaaggattctagaaacaaactatcgtaaacagaggagatacgatatgttgtttctaaacctggcggcagcgcaaaagatg

SEQ ID NO: 76632 - DNA, 103 bp, Artificial Sequence
  Synthetic Polynucleotide
taatacgactcactataggggaatactcaaaggattctagaaacaaactaaacagaggagatagtttatgtctagaatcaacctggcggcagcgcaaaagatg

SEQ ID NO: 76633 - DNA, 103 bp, Artificial Sequence
  Synthetic Polynucleotide
taatacgactcactataggggtatagaatactcaaaggattctagaaacaaacagaggagatgtttcatgaatcctttgaacctggcggcagcgcaaaagatg

SEQ ID NO: 76634 - DNA, 103 bp, Artificial Sequence
  Synthetic Polynucleotide
taatacgactcactatagggtattggtatagaatactcaaaggattctagaacagaggagactagaaatgtttgagtataacctggcggcagcgcaaaagatg

SEQ ID NO: 76635 - DNA, 103 bp, Artificial Sequence
  Synthetic Polynucleotide
taatacgactcactatagggttattaatattttggataatgcatactgttaacagaggagaaacagtatgcattatccaaacctggcggcagcgcaaaagatg

SEQ ID NO: 76636 - DNA, 103 bp, Artificial Sequence
  Synthetic Polynucleotide
taatacgactcactatagggaataatattggtatagaatactcaaaggataacagaggagaatccttatggtattctataacctggcggcagcgcaaaagatg

SEQ ID NO: 76637 - DNA, 103 bp, Artificial Sequence
  Synthetic Polynucleotide
taatacgactcactatagggcaaagaataatattggtatagaatactcaaaacagaggagattgagtatgctataccaaaacctggcggcagcgcaaaagatg

SEQ ID NO: 76638 - DNA, 103 bp, Artificial Sequence
  Synthetic Polynucleotide
taatacgactcactatagggcgaatcaaagaataatattggtatagaataaacagaggagatattctatgccaatattaaacctggcggcagcgcaaaagatg

SEQ ID NO: 76639 - DNA, 103 bp, Artificial Sequence
  Synthetic Polynucleotide
taatacgactcactatagggaaattcgaatcaaagaataatattggtataaacagaggagatataccatgattattcttaacctggcggcagcgcaaaagatg

SEQ ID NO: 76640 - DNA, 103 bp, Artificial Sequence
  Synthetic Polynucleotide
taatacgactcactatagggaaactaaattcgaatcaaagaataatattgaacagaggagacaatatatgtctttgattaacctggcggcagcgcaaaagatg

SEQ ID NO: 76641 - DNA, 103 bp, Artificial Sequence
  Synthetic Polynucleotide
taatacgactcactatagggcgaagaaactaaattcgaatcaaagaataaaacagaggagattattcatggattcgaataacctggcggcagcgcaaaagatg

SEQ ID NO: 76642 - DNA, 103 bp, Artificial Sequence
  Synthetic Polynucleotide
taatacgactcactatagggaatatcgaagaaactaaattcgaatcaaagaacagaggagactttgaatggaatttagtaacctggcggcagcgcaaaagatg

SEQ ID NO: 76643 - DNA, 103 bp, Artificial Sequence
  Synthetic Polynucleotide
taatacgactcactatagggaatccaatatcgaagaaactaaattcgaataacagaggagaattcgaatgtagtttcttaacctggcggcagcgcaaaagatg

SEQ ID NO: 76644 - DNA, 103 bp, Artificial Sequence
  Synthetic Polynucleotide
taatacgactcactatagggtacaaaatccaatatcgaagaaactaaattaacagaggagaaatttaatgtcttcgataaacctggcggcagcgcaaaagatg

SEQ ID NO: 76645 - DNA, 103 bp, Artificial Sequence
  Synthetic Polynucleotide
taatacgactcactatagggggtaatacaaaatccaatatcgaagaaactaacagaggagaagtttcatggatattggaaacctggcggcagcgcaaaagatg

SEQ ID NO: 76646 - DNA, 103 bp, Artificial Sequence
  Synthetic Polynucleotide
taatacgactcactatagggtaatgttattaatattttggataatgcataaacagaggagatatgcaatgtccaaaataaacctggcggcagcgcaaaagatg

SEQ ID NO: 76647 - DNA, 103 bp, Artificial Sequence
  Synthetic Polynucleotide
taatacgactcactatagggatataggtaatacaaaatccaatatcgaagaacagaggagacttcgaatgtggattttgaacctggcggcagcgcaaaagatg

SEQ ID NO: 76648 - DNA, 103 bp, Artificial Sequence
  Synthetic Polynucleotide
taatacgactcactatagggcaagaatataggtaatacaaaatccaatataacagaggagaatattgatgtttgtattaaacctggcggcagcgcaaaagatg

SEQ ID NO: 76649 - DNA, 103 bp, Artificial Sequence
  Synthetic Polynucleotide
taatacgactcactatagggtacatcaagaatataggtaatacaaaatccaacagaggagaggatttatgattacctataacctggcggcagcgcaaaagatg

SEQ ID NO: 76650 - DNA, 103 bp, Artificial Sequence
  Synthetic Polynucleotide
taatacgactcactatagggagtactacatcaagaatataggtaatacaaaacagaggagattgtatatgctatattctaacctggcggcagcgcaaaagatg

SEQ ID NO: 76651 - DNA, 103 bp, Artificial Sequence
  Synthetic Polynucleotide
taatacgactcactatagggatcaaagtactacatcaagaatataggtaaaacagaggagattacctatgttcttgatgaacctggcggcagcgcaaaagatg

SEQ ID NO: 76652 - DNA, 103 bp, Artificial Sequence
  Synthetic Polynucleotide
taatacgactcactatagggaaatcatcaaagtactacatcaagaatataaacagaggagatatattatggatgtagtaaacctggcggcagcgcaaaagatg

SEQ ID NO: 76653 - DNA, 103 bp, Artificial Sequence
  Synthetic Polynucleotide
taatacgactcactatagggtggaaaaatcatcaaagtactacatcaagaaacagaggagatcttgaatgagtactttgaacctggcggcagcgcaaaagatg

SEQ ID NO: 76654 - DNA, 103 bp, Artificial Sequence
  Synthetic Polynucleotide
taatacgactcactatagggggccatggaaaaatcatcaaagtactacataacagaggagaatgtagatgtttgatgataacctggcggcagcgcaaaagatg

SEQ ID NO: 76655 - DNA, 103 bp, Artificial Sequence
  Synthetic Polynucleotide
taatacgactcactataggggaatgggccatggaaaaatcatcaaagtacaacagaggagagtacttatgtgatttttcaacctggcggcagcgcaaaagatg

SEQ ID NO: 76656 - DNA, 103 bp, Artificial Sequence
  Synthetic Polynucleotide
taatacgactcactatagggtaatagaatgggccatggaaaaatcatcaaaacagaggagattgatgatgtttccatggaacctggcggcagcgcaaaagatg

SEQ ID NO: 76657 - DNA, 103 bp, Artificial Sequence
  Synthetic Polynucleotide
taatacgactcactatagggatatgtaatgttattaatattttggataataacagaggagaattatcatgaatattaataacctggcggcagcgcaaaagatg

SEQ ID NO: 76658 - DNA, 103 bp, Artificial Sequence
  Synthetic Polynucleotide
taatacgactcactatagggagacttaatagaatgggccatggaaaaatcaacagaggagagattttatgatggcccataacctggcggcagcgcaaaagatg

SEQ ID NO: 76659 - DNA, 103 bp, Artificial Sequence
  Synthetic Polynucleotide
taatacgactcactatagggttggaagacttaatagaatgggccatggaaaacagaggagattccatatgccattctataacctggcggcagcgcaaaagatg

SEQ ID NO: 76660 - DNA, 103 bp, Artificial Sequence
  Synthetic Polynucleotide
taatacgactcactatagggccaacttggaagacttaatagaatgggccaaacagaggagatggcccatgctattaagtaacctggcggcagcgcaaaagatg

SEQ ID NO: 76661 - DNA, 103 bp, Artificial Sequence
  Synthetic Polynucleotide
taatacgactcactatagggtgatgccaacttggaagacttaatagaatgaacagaggagacattctatgaagtcttccaacctggcggcagcgcaaaagatg

SEQ ID NO: 76662 - DNA, 103 bp, Artificial Sequence
  Synthetic Polynucleotide
taatacgactcactataggggtggatgatgccaacttggaagacttaataaacagaggagatattaaatgttccaagttaacctggcggcagcgcaaaagatg

SEQ ID NO: 76663 - DNA, 103 bp, Artificial Sequence
  Synthetic Polynucleotide
taatacgactcactatagggaatatgtggatgatgccaacttggaagactaacagaggagaagtcttatgagttggcataacctggcggcagcgcaaaagatg

SEQ ID NO: 76664 - DNA, 103 bp, Artificial Sequence
  Synthetic Polynucleotide
taatacgactcactatagggatcacaatatgtggatgatgccaacttggaaacagaggagatccaagatggcatcatccaacctggcggcagcgcaaaagatg

SEQ ID NO: 76665 - DNA, 103 bp, Artificial Sequence
  Synthetic Polynucleotide
taatacgactcactatagggttactatcacaatatgtggatgatgccaacaacagaggagagttggcatgatccacataaacctggcggcagcgcaaaagatg

SEQ ID NO: 76666 - DNA, 103 bp, Artificial Sequence
  Synthetic Polynucleotide
taatacgactcactataggggagaattactatcacaatatgtggatgatgaacagaggagacatcatatgcatattgtgaacctggcggcagcgcaaaagatg

SEQ ID NO: 76667 - DNA, 103 bp, Artificial Sequence
  Synthetic Polynucleotide
taatacgactcactatagggtatccgagaattactatcacaatatgtggaaacagaggagatccacaatgtgtgatagtaacctggcggcagcgcaaaagatg

SEQ ID NO: 76668 - DNA, 103 bp, Artificial Sequence
  Synthetic Polynucleotide
taatacgactcactatagggatataatatgtaatgttattaatattttggaacagaggagaccaaaaatgtaataacataacctggcggcagcgcaaaagatg

SEQ ID NO: 76669 - DNA, 103 bp, Artificial Sequence
  Synthetic Polynucleotide
taatacgactcactatagggactaatatccgagaattactatcacaatataacagaggagaatattgatgtagtaattcaacctggcggcagcgcaaaagatg

SEQ ID NO: 76670 - DNA, 103 bp, Artificial Sequence
  Synthetic Polynucleotide
taatacgactcactatagggccgctactaatatccgagaattactatcacaacagaggagagtgataatgattctcggaaacctggcggcagcgcaaaagatg

SEQ ID NO: 76671 - DNA, 103 bp, Artificial Sequence
  Synthetic Polynucleotide
taatacgactcactatagggggtagccgctactaatatccgagaattactaacagaggagaagtaatatgcggatattaaacctggcggcagcgcaaaagatg

SEQ ID NO: 76672 - DNA, 103 bp, Artificial Sequence
  Synthetic Polynucleotide
taatacgactcactatagggatggcggtagccgctactaatatccgagaaaacagaggagattctcgatgattagtagcaacctggcggcagcgcaaaagatg

SEQ ID NO: 76673 - DNA, 103 bp, Artificial Sequence
  Synthetic Polynucleotide
taatacgactcactatagggcatcaatggcggtagccgctactaatatccaacagaggagaggatatatgtagcggctaaacctggcggcagcgcaaaagatg

SEQ ID NO: 76674 - DNA, 103 bp, Artificial Sequence
  Synthetic Polynucleotide
taatacgactcactatagggacaaacatcaatggcggtagccgctactaaaacagaggagattagtaatggctaccgccaacctggcggcagcgcaaaagatg

SEQ ID NO: 76675 - DNA, 103 bp, Artificial Sequence
  Synthetic Polynucleotide
taatacgactcactatagggaatgaacaaacatcaatggcggtagccgctaacagaggagaagcggcatgcgccattgaaacctggcggcagcgcaaaagatg

SEQ ID NO: 76676 - DNA, 103 bp, Artificial Sequence
  Synthetic Polynucleotide
taatacgactcactatagggcatccaatgaacaaacatcaatggcggtagaacagaggagactaccgatgttgatgtttaacctggcggcagcgcaaaagatg

SEQ ID NO: 76677 - DNA, 103 bp, Artificial Sequence
  Synthetic Polynucleotide
taatacgactcactatagggttactcatccaatgaacaaacatcaatggcaacagaggagagccattatggtttgttcaaacctggcggcagcgcaaaagatg

SEQ ID NO: 76678 - DNA, 103 bp, Artificial Sequence
  Synthetic Polynucleotide
taatacgactcactatagggagtagttactcatccaatgaacaaacatcaaacagaggagatgatgtatgttcattggaaacctggcggcagcgcaaaagatg

SEQ ID NO: 76679 - DNA, 103 bp, Artificial Sequence
  Synthetic Polynucleotide
taatacgactcactatagggtgcaaaccattctgatgcatcaactatttcaacagaggagagaaataatggatgcatcaaacctggcggcagcgcaaaagatg

SEQ ID NO: 76680 - DNA, 103 bp, Artificial Sequence
  Synthetic Polynucleotide
taatacgactcactatagggtatcgacatactacttatgctgcaaaagataacagaggagaatctttatgagcataagtaacctggcggcagcgcaaaagatg

SEQ ID NO: 76681 - DNA, 103 bp, Artificial Sequence
  Synthetic Polynucleotide
taatacgactcactatagggtattgatataatatgtaatgttattaatataacagaggagaatattaatgacattacataacctggcggcagcgcaaaagatg

SEQ ID NO: 76682 - DNA, 103 bp, Artificial Sequence
  Synthetic Polynucleotide
taatacgactcactatagggacattagtagttactcatccaatgaacaaaaacagaggagatttgttatgtggatgagtaacctggcggcagcgcaaaagatg

SEQ ID NO: 76683 - DNA, 103 bp, Artificial Sequence
  Synthetic Polynucleotide
taatacgactcactatagggtgtatacattagtagttactcatccaatgaaacagaggagatcattgatggagtaactaaacctggcggcagcgcaaaagatg

SEQ ID NO: 76684 - DNA, 103 bp, Artificial Sequence
  Synthetic Polynucleotide
taatacgactcactataggggaaaatgtatacattagtagttactcatccaacagaggagaggatgaatgactactaataacctggcggcagcgcaaaagatg

SEQ ID NO: 76685 - DNA, 103 bp, Artificial Sequence
  Synthetic Polynucleotide
taatacgactcactatagggaaatggaaaatgtatacattagtagttactaacagaggagaagtaacatgtaatgtataaacctggcggcagcgcaaaagatg

SEQ ID NO: 76686 - DNA, 103 bp, Artificial Sequence
  Synthetic Polynucleotide
taatacgactcactataggggttataaatggaaaatgtatacattagtagaacagaggagactactaatgtatacatttaacctggcggcagcgcaaaagatg

SEQ ID NO: 76687 - DNA, 103 bp, Artificial Sequence
  Synthetic Polynucleotide
taatacgactcactatagggtacgtgttataaatggaaaatgtatacattaacagaggagaaatgtaatgattttccataacctggcggcagcgcaaaagatg

SEQ ID NO: 76688 - DNA, 103 bp, Artificial Sequence
  Synthetic Polynucleotide
taatacgactcactatagggatacatacgtgttataaatggaaaatgtataacagaggagaatacatatgccatttataaacctggcggcagcgcaaaagatg

SEQ ID NO: 76689 - DNA, 103 bp, Artificial Sequence
  Synthetic Polynucleotide
taatacgactcactatagggagttaatacatacgtgttataaatggaaaaaacagaggagattttccatgtataacacgaacctggcggcagcgcaaaagatg

SEQ ID NO: 76690 - DNA, 103 bp, Artificial Sequence
  Synthetic Polynucleotide
taatacgactcactatagggaacaaagttaatacatacgtgttataaatgaacagaggagacatttaatgcacgtatgtaacctggcggcagcgcaaaagatg

SEQ ID NO: 76691 - DNA, 103 bp, Artificial Sequence
  Synthetic Polynucleotide
taatacgactcactatagggaaatgaacaaagttaatacatacgtgttataacagaggagaataacaatgatgtattaaaacctggcggcagcgcaaaagatg

SEQ ID NO: 76692 - DNA, 103 bp, Artificial Sequence
  Synthetic Polynucleotide
taatacgactcactatagggtgtgatattgatataatatgtaatgttattaacagaggagaaataacatgacatattataacctggcggcagcgcaaaagatg

SEQ ID NO: 76693 - DNA, 103 bp, Artificial Sequence
  Synthetic Polynucleotide
taatacgactcactatagggaatataaatgaacaaagttaatacatacgtaacagaggagaacgtatatgttaactttgaacctggcggcagcgcaaaagatg

SEQ ID NO: 76694 - DNA, 103 bp, Artificial Sequence
  Synthetic Polynucleotide
taatacgactcactataggggaaaaaatataaatgaacaaagttaatacaaacagaggagatgtattatgtttgttcataacctggcggcagcgcaaaagatg

SEQ ID NO: 76695 - DNA, 103 bp, Artificial Sequence
  Synthetic Polynucleotide
taatacgactcactatagggataatgaaaaaatataaatgaacaaagttaaacagaggagataacttatgtcatttataaacctggcggcagcgcaaaagatg

SEQ ID NO: 76696 - DNA, 103 bp, Artificial Sequence
  Synthetic Polynucleotide
taatacgactcactatagggacataataatgaaaaaatataaatgaacaaaacagaggagattgttcatgtatatttttaacctggcggcagcgcaaaagatg

SEQ ID NO: 76697 - DNA, 103 bp, Artificial Sequence
  Synthetic Polynucleotide
taatacgactcactatagggtatcaacataataatgaaaaaatataaatgaacagaggagacatttaatgtttttcattaacctggcggcagcgcaaaagatg

SEQ ID NO: 76698 - DNA, 103 bp, Artificial Sequence
  Synthetic Polynucleotide
taatacgactcactataggggttaatatcaacataataatgaaaaaatataacagaggagaatatttatgcattattataacctggcggcagcgcaaaagatg

SEQ ID NO: 76699 - DNA, 103 bp, Artificial Sequence
  Synthetic Polynucleotide
taatacgactcactatagggcttttgttaatatcaacataataatgaaaaaacagaggagattttcaatgttatgttgaaacctggcggcagcgcaaaagatg

SEQ ID NO: 76700 - DNA, 103 bp, Artificial Sequence
  Synthetic Polynucleotide
taatacgactcactatagggattcacttttgttaatatcaacataataataacagaggagaattattatgttgatattaaacctggcggcagcgcaaaagatg

SEQ ID NO: 76701 - DNA, 103 bp, Artificial Sequence
  Synthetic Polynucleotide
taatacgactcactatagggtatatattcacttttgttaatatcaacataaacagaggagatatgttatgattaacaaaaacctggcggcagcgcaaaagatg

SEQ ID NO: 76702 - DNA, 103 bp, Artificial Sequence
  Synthetic Polynucleotide
taatacgactcactatagggacatatatatattcacttttgttaatatcaaacagaggagatgatatatgcaaaagtgaaacctggcggcagcgcaaaagatg

SEQ ID NO: 76703 - DNA, 103 bp, Artificial Sequence
  Synthetic Polynucleotide
taatacgactcactatagggatttttgtgatattgatataatatgtaatgaacagaggagacattacatgttatatcaaaacctggcggcagcgcaaaagatg

SEQ ID NO: 76704 - DNA, 103 bp, Artificial Sequence
  Synthetic Polynucleotide
taatacgactcactatagggtattaacatatatatattcacttttgttaaaacagaggagattaacaatggtgaatataaacctggcggcagcgcaaaagatg

SEQ ID NO: 76705 - DNA, 103 bp, Artificial Sequence
  Synthetic Polynucleotide
taatacgactcactatagggacaattattaacatatatatattcacttttaacagaggagaaaaagtatgtatatatataacctggcggcagcgcaaaagatg

SEQ ID NO: 76706 - DNA, 103 bp, Artificial Sequence
  Synthetic Polynucleotide
taatacgactcactatagggacaatacaattattaacatatatatattcaaacagaggagatgaataatgatatgttaaaacctggcggcagcgcaaaagatg

SEQ ID NO: 76707 - DNA, 103 bp, Artificial Sequence
  Synthetic Polynucleotide
taatacgactcactatagggtaaccacaatacaattattaacatatatataacagaggagaatatatatgttaataattaacctggcggcagcgcaaaagatg

SEQ ID NO: 76708 - DNA, 103 bp, Artificial Sequence
  Synthetic Polynucleotide
taatacgactcactatagggccatataaccacaatacaattattaacataaacagaggagatatgttatgaattgtattaacctggcggcagcgcaaaagatg

SEQ ID NO: 76709 - DNA, 103 bp, Artificial Sequence
  Synthetic Polynucleotide
taatacgactcactatagggtgtagccatataaccacaatacaattattaaacagaggagataataaatgtattgtggtaacctggcggcagcgcaaaagatg

SEQ ID NO: 76710 - DNA, 103 bp, Artificial Sequence
  Synthetic Polynucleotide
taatacgactcactataggggaaattgtagccatataaccacaatacaataacagaggagaattgtaatgtggttatataacctggcggcagcgcaaaagatg

SEQ ID NO: 76711 - DNA, 103 bp, Artificial Sequence
  Synthetic Polynucleotide
taatacgactcactatagggattatgaaattgtagccatataaccacaataacagaggagaattgtgatgatatggctaaacctggcggcagcgcaaaagatg

SEQ ID NO: 76712 - DNA, 103 bp, Artificial Sequence
  Synthetic Polynucleotide
taatacgactcactatagggcgctcattatgaaattgtagccatataaccaacagaggagaggttatatggctacaattaacctggcggcagcgcaaaagatg

SEQ ID NO: 76713 - DNA, 103 bp, Artificial Sequence
  Synthetic Polynucleotide
taatacgactcactatagggacttccgctcattatgaaattgtagccataaacagaggagatatggcatgaatttcataaacctggcggcagcgcaaaagatg

SEQ ID NO: 76714 - DNA, 103 bp, Artificial Sequence
  Synthetic Polynucleotide
taatacgactcactataggggatttatttttgtgatattgatataatatgaacagaggagacatattatgtcaatatcaaacctggcggcagcgcaaaagatg

SEQ ID NO: 76715 - DNA, 103 bp, Artificial Sequence
  Synthetic Polynucleotide
taatacgactcactatagggcactgacttccgctcattatgaaattgtagaacagaggagactacaaatgcataatgagaacctggcggcagcgcaaaagatg

SEQ ID NO: 76716 - DNA, 103 bp, Artificial Sequence
  Synthetic Polynucleotide
taatacgactcactatagggtcggacactgacttccgctcattatgaaataacagaggagaatttcaatgtgagcggaaaacctggcggcagcgcaaaagatg

SEQ ID NO: 76717 - DNA, 103 bp, Artificial Sequence
  Synthetic Polynucleotide
taatacgactcactatagggaatcatcggacactgacttccgctcattataacagaggagaataatgatgggaagtcagaacctggcggcagcgcaaaagatg

SEQ ID NO: 76718 - DNA, 103 bp, Artificial Sequence
  Synthetic Polynucleotide
taatacgactcactatagggtcattaatcatcggacactgacttccgctcaacagaggagagagcggatgtcagtgtccaacctggcggcagcgcaaaagatg

SEQ ID NO: 76719 - DNA, 103 bp, Artificial Sequence
  Synthetic Polynucleotide
taatacgactcactatagggtatcgtcattaatcatcggacactgacttcaacagaggagagaagtcatggtccgatgaaacctggcggcagcgcaaaagatg

SEQ ID NO: 76720 - DNA, 103 bp, Artificial Sequence
  Synthetic Polynucleotide
taatacgactcactatagggaaatctatcgtcattaatcatcggacactgaacagaggagacagtgtatgatgattaataacctggcggcagcgcaaaagatg

SEQ ID NO: 76721 - DNA, 103 bp, Artificial Sequence
  Synthetic Polynucleotide
taatacgactcactatagggagagtaaatctatcgtcattaatcatcggaaacagaggagatccgatatgtaatgacgaaacctggcggcagcgcaaaagatg

SEQ ID NO: 76722 - DNA, 103 bp, Artificial Sequence
  Synthetic Polynucleotide
taatacgactcactatagggttttcagagtaaatctatcgtcattaatcaaacagaggagatgattaatgacgatagataacctggcggcagcgcaaaagatg

SEQ ID NO: 76723 - DNA, 103 bp, Artificial Sequence
  Synthetic Polynucleotide
taatacgactcactatagggctttcttttcagagtaaatctatcgtcattaacagaggagaaatgacatgagatttactaacctggcggcagcgcaaaagatg

SEQ ID NO: 76724 - DNA, 103 bp, Artificial Sequence
  Synthetic Polynucleotide
taatacgactcactatagggtgatactttcttttcagagtaaatctatcgaacagaggagacgatagatgtactctgaaaacctggcggcagcgcaaaagatg

SEQ ID NO: 76725 - DNA, 103 bp, Artificial Sequence
  Synthetic Polynucleotide
taatacgactcactatagggatgtggatttatttttgtgatattgatataaacagaggagatatatcatgatcacaaaaaacctggcggcagcgcaaaagatg

SEQ ID NO: 76726 - DNA, 103 bp, Artificial Sequence
  Synthetic Polynucleotide
taatacgactcactatagggcgatttgatactttcttttcagagtaaatcaacagaggagagatttaatgtgaaaagaaaacctggcggcagcgcaaaagatg

SEQ ID NO: 76727 - DNA, 103 bp, Artificial Sequence
  Synthetic Polynucleotide
taatacgactcactatagggactatcgatttgatactttcttttcagagtaacagaggagaactctgatgagaaagtataacctggcggcagcgcaaaagatg

SEQ ID NO: 76728 - DNA, 103 bp, Artificial Sequence
  Synthetic Polynucleotide
taatacgactcactatagggtctacactatcgatttgatactttcttttcaacagaggagagaaaagatggtatcaaataacctggcggcagcgcaaaagatg

SEQ ID NO: 76729 - DNA, 103 bp, Artificial Sequence
  Synthetic Polynucleotide
taatacgactcactatagggtcgactctacactatcgatttgatactttcaacagaggagagaaagtatgaaatcgataaacctggcggcagcgcaaaagatg

SEQ ID NO: 76730 - DNA, 103 bp, Artificial Sequence
  Synthetic Polynucleotide
taatacgactcactatagggcattgtcgactctacactatcgatttgataaacagaggagatatcaaatggatagtgtaaacctggcggcagcgcaaaagatg

SEQ ID NO: 76731 - DNA, 103 bp, Artificial Sequence
  Synthetic Polynucleotide
taatacgactcactatagggattttcattgtcgactctacactatcgattaacagaggagaaatcgaatgtgtagagtcaacctggcggcagcgcaaaagatg

SEQ ID NO: 76732 - DNA, 103 bp, Artificial Sequence
  Synthetic Polynucleotide
taatacgactcactatagggtatccattttcattgtcgactctacactataacagaggagaatagtgatgagtcgacaaaacctggcggcagcgcaaaagatg

SEQ ID NO: 76733 - DNA, 103 bp, Artificial Sequence
  Synthetic Polynucleotide
taatacgactcactatagggcttcttatccattttcattgtcgactctacaacagaggagagtagagatgacaatgaaaaacctggcggcagcgcaaaagatg

SEQ ID NO: 76734 - DNA, 103 bp, Artificial Sequence
  Synthetic Polynucleotide
taatacgactcactataggggtcctcttcttatccattttcattgtcgacaacagaggagagtcgacatggaaaatggaaacctggcggcagcgcaaaagatg

SEQ ID NO: 76735 - DNA, 103 bp, Artificial Sequence
  Synthetic Polynucleotide
taatacgactcactatagggactttgtcctcttcttatccattttcattgaacagaggagacaatgaatgtggataagaaacctggcggcagcgcaaaagatg

SEQ ID NO: 76736 - DNA, 103 bp, Artificial Sequence
  Synthetic Polynucleotide
taatacgactcactataggggccaaatgtggatttatttttgtgatattgaacagaggagacaatatatgaaaaataaaaacctggcggcagcgcaaaagatg

SEQ ID NO: 76737 - DNA, 103 bp, Artificial Sequence
  Synthetic Polynucleotide
taatacgactcactatagggttgaaactttgtcctcttcttatccattttaacagaggagaaaaatgatgaagaagaggaacctggcggcagcgcaaaagatg

SEQ ID NO: 76738 - DNA, 103 bp, Artificial Sequence
  Synthetic Polynucleotide
taatacgactcactatagggctattttgaaactttgtcctcttcttatccaacagaggagaggataaatggaggacaaaaacctggcggcagcgcaaaagatg

SEQ ID NO: 76739 - DNA, 103 bp, Artificial Sequence
  Synthetic Polynucleotide
taatacgactcactatagggtggctctattttgaaactttgtcctcttctaacagaggagaagaagaatgcaaagtttcaacctggcggcagcgcaaaagatg

SEQ ID NO: 76740 - DNA, 103 bp, Artificial Sequence
  Synthetic Polynucleotide
taatacgactcactatagggcattttggctctattttgaaactttgtcctaacagaggagaaggacaatgtttcaaaataacctggcggcagcgcaaaagatg

SEQ ID NO: 76741 - DNA, 103 bp, Artificial Sequence
  Synthetic Polynucleotide
taatacgactcactatagggtttaccattttggctctattttgaaactttaacagaggagaaaagttatgaaatagagcaacctggcggcagcgcaaaagatg

SEQ ID NO: 76742 - DNA, 103 bp, Artificial Sequence
  Synthetic Polynucleotide
taatacgactcactatagggtttcttttaccattttggctctattttgaaaacagaggagattcaaaatggagccaaaaaacctggcggcagcgcaaaagatg

SEQ ID NO: 76743 - DNA, 103 bp, Artificial Sequence
  Synthetic Polynucleotide
taatacgactcactatagggatttatttcttttaccattttggctctattaacagaggagaaatagaatgaaaatggtaaacctggcggcagcgcaaaagatg

SEQ ID NO: 76744 - DNA, 103 bp, Artificial Sequence
  Synthetic Polynucleotide
taatacgactcactataggggtctgatttatttcttttaccattttggctaacagaggagaagccaaatgggtaaaagaaacctggcggcagcgcaaaagatg

SEQ ID NO: 76745 - DNA, 103 bp, Artificial Sequence
  Synthetic Polynucleotide
taatacgactcactatagggttattgtctgatttatttcttttaccatttaacagaggagaaaatggatgaagaaataaaacctggcggcagcgcaaaagatg

SEQ ID NO: 76746 - DNA, 103 bp, Artificial Sequence
  Synthetic Polynucleotide
taatacgactcactatagggtgctcttattgtctgatttatttcttttacaacagaggagagtaaaaatgataaatcagaacctggcggcagcgcaaaagatg

SEQ ID NO: 76747 - DNA, 103 bp, Artificial Sequence
  Synthetic Polynucleotide
taatacgactcactataggggattagccaaatgtggatttatttttgtgaaacagaggagatcacaaatgtaaatccacaacctggcggcagcgcaaaagatg

SEQ ID NO: 76748 - DNA, 103 bp, Artificial Sequence
  Synthetic Polynucleotide
taatacgactcactatagggtgtgctgctcttattgtctgatttatttctaacagaggagaagaaatatgtcagacaataacctggcggcagcgcaaaagatg

SEQ ID NO: 76749 - DNA, 103 bp, Artificial Sequence
  Synthetic Polynucleotide
taatacgactcactataggggagtttgtgctgctcttattgtctgatttaaacagaggagataaatcatgcaataagagaacctggcggcagcgcaaaagatg

SEQ ID NO: 76750 - DNA, 103 bp, Artificial Sequence
  Synthetic Polynucleotide
taatacgactcactataggggtaatgagtttgtgctgctcttattgtctgaacagaggagacagacaatgagagcagcaaacctggcggcagcgcaaaagatg

SEQ ID NO: 76751 - DNA, 103 bp, Artificial Sequence
  Synthetic Polynucleotide
taatacgactcactataggggtctcgtaatgagtttgtgctgctcttattaacagaggagaaataagatgagcacaaacaacctggcggcagcgcaaaagatg

SEQ ID NO: 76752 - DNA, 103 bp, Artificial Sequence
  Synthetic Polynucleotide
taatacgactcactatagggtcaatgtctcgtaatgagtttgtgctgctcaacagaggagagagcagatgaaactcattaacctggcggcagcgcaaaagatg

SEQ ID NO: 76753 - DNA, 103 bp, Artificial Sequence
  Synthetic Polynucleotide
taatacgactcactatagggtagtttcaatgtctcgtaatgagtttgtgcaacagaggagagcacaaatgcattacgagaacctggcggcagcgcaaaagatg

SEQ ID NO: 76754 - DNA, 103 bp, Artificial Sequence
  Synthetic Polynucleotide
taatacgactcactatagggtatcctagtttcaatgtctcgtaatgagttaacagaggagaaactcaatgcgagacattaacctggcggcagcgcaaaagatg

SEQ ID NO: 76755 - DNA, 103 bp, Artificial Sequence
  Synthetic Polynucleotide
taatacgactcactatagggttatgtatcctagtttcaatgtctcgtaataacagaggagaattacgatgcattgaaacaacctggcggcagcgcaaaagatg

SEQ ID NO: 76756 - DNA, 103 bp, Artificial Sequence
  Synthetic Polynucleotide
taatacgactcactatagggaaattttatgtatcctagtttcaatgtctcaacagaggagagagacaatgaaactaggaaacctggcggcagcgcaaaagatg

SEQ ID NO: 76757 - DNA, 103 bp, Artificial Sequence
  Synthetic Polynucleotide
taatacgactcactatagggttcttaaattttatgtatcctagtttcaataacagaggagaattgaaatgaggatacataacctggcggcagcgcaaaagatg

SEQ ID NO: 76758 - DNA, 103 bp, Artificial Sequence
  Synthetic Polynucleotide
taatacgactcactatagggaaattgattagccaaatgtggatttattttaacagaggagaaaaataatgccacatttgaacctggcggcagcgcaaaagatg

SEQ ID NO: 76759 - DNA, 103 bp, Artificial Sequence
  Synthetic Polynucleotide
taatacgactcactatagggtcattttcttaaattttatgtatcctagttaacagaggagaaactagatgacataaaataacctggcggcagcgcaaaagatg

SEQ ID NO: 76760 - DNA, 103 bp, Artificial Sequence
  Synthetic Polynucleotide
taatacgactcactatagggcctaatcattttcttaaattttatgtatccaacagaggagaggatacatgaaatttaagaacctggcggcagcgcaaaagatg

SEQ ID NO: 76761 - DNA, 103 bp, Artificial Sequence
  Synthetic Polynucleotide
taatacgactcactataggggtagtcctaatcattttcttaaattttatgaacagaggagacataaaatgtaagaaaataacctggcggcagcgcaaaagatg

SEQ ID NO: 76762 - DNA, 103 bp, Artificial Sequence
  Synthetic Polynucleotide
taatacgactcactatagggaagtagtagtcctaatcattttcttaaattaacagaggagaaatttaatgaaatgattaaacctggcggcagcgcaaaagatg

SEQ ID NO: 76763 - DNA, 103 bp, Artificial Sequence
  Synthetic Polynucleotide
taatacgactcactatagggttctaaagtagtagtcctaatcattttcttaacagaggagaaagaaaatgattaggactaacctggcggcagcgcaaaagatg

SEQ ID NO: 76764 - DNA, 103 bp, Artificial Sequence
  Synthetic Polynucleotide
taatacgactcactatagggatatcttctaaagtagtagtcctaatcattaacagaggagaaatgatatggactactacaacctggcggcagcgcaaaagatg

SEQ ID NO: 76765 - DNA, 103 bp, Artificial Sequence
  Synthetic Polynucleotide
taatacgactcactatagggttgttatatcttctaaagtagtagtcctaaaacagaggagattaggaatgctactttagaacctggcggcagcgcaaaagatg

SEQ ID NO: 76766 - DNA, 103 bp, Artificial Sequence
  Synthetic Polynucleotide
taatacgactcactatagggagatgttgttatatcttctaaagtagtagtaacagaggagaactactatgttagaagataacctggcggcagcgcaaaagatg

SEQ ID NO: 76767 - DNA, 103 bp, Artificial Sequence
  Synthetic Polynucleotide
taatacgactcactatagggggaatagatgttgttatatcttctaaagtaaacagaggagatactttatgagatataacaacctggcggcagcgcaaaagatg

SEQ ID NO: 76768 - DNA, 103 bp, Artificial Sequence
  Synthetic Polynucleotide
taatacgactcactatagggtatttggaatagatgttgttatatcttctaaacagaggagatagaagatgtaacaacataacctggcggcagcgcaaaagatg

SEQ ID NO: 76769 - DNA, 103 bp, Artificial Sequence
  Synthetic Polynucleotide
taatacgactcactataggggcccgaaattgattagccaaatgtggatttaacagaggagaaaatccatgtttggctaaaacctggcggcagcgcaaaagatg

SEQ ID NO: 76770 - DNA, 103 bp, Artificial Sequence
  Synthetic Polynucleotide
taatacgactcactatagggctgaatatttggaatagatgttgttatatcaacagaggagagatataatgacatctattaacctggcggcagcgcaaaagatg

SEQ ID NO: 76771 - DNA, 103 bp, Artificial Sequence
  Synthetic Polynucleotide
taatacgactcactatagggattttctgaatatttggaatagatgttgttaacagaggagaaacaacatgtattccaaaaacctggcggcagcgcaaaagatg

SEQ ID NO: 76772 - DNA, 103 bp, Artificial Sequence
  Synthetic Polynucleotide
taatacgactcactatagggtataaattttctgaatatttggaatagatgaacagaggagacatctaatgcaaatattcaacctggcggcagcgcaaaagatg

SEQ ID NO: 76773 - DNA, 103 bp, Artificial Sequence
  Synthetic Polynucleotide
taatacgactcactatagggtagtttataaattttctgaatatttggaataacagaggagaattccaatgattcagaaaaacctggcggcagcgcaaaagatg

SEQ ID NO: 76774 - DNA, 103 bp, Artificial Sequence
  Synthetic Polynucleotide
taatacgactcactataggggagaatagtttataaattttctgaatatttaacagaggagaaaatatatggaaaatttaaacctggcggcagcgcaaaagatg

SEQ ID NO: 76775 - DNA, 103 bp, Artificial Sequence
  Synthetic Polynucleotide
taatacgactcactatagggtgtccgagaatagtttataaattttctgaaaacagaggagattcagaatgtttataaacaacctggcggcagcgcaaaagatg

SEQ ID NO: 76776 - DNA, 103 bp, Artificial Sequence
  Synthetic Polynucleotide
taatacgactcactatagggtgaaatgtccgagaatagtttataaattttaacagaggagaaaaattatgaaactattcaacctggcggcagcgcaaaagatg

SEQ ID NO: 76777 - DNA, 103 bp, Artificial Sequence
  Synthetic Polynucleotide
taatacgactcactatagggatggctgaaatgtccgagaatagtttataaaacagaggagattataaatgattctcggaaacctggcggcagcgcaaaagatg

SEQ ID NO: 76778 - DNA, 103 bp, Artificial Sequence
  Synthetic Polynucleotide
taatacgactcactatagggtgccaatggctgaaatgtccgagaatagttaacagaggagaaactatatgcggacatttaacctggcggcagcgcaaaagatg

SEQ ID NO: 76779 - DNA, 103 bp, Artificial Sequence
  Synthetic Polynucleotide
taatacgactcactatagggtactttgccaatggctgaaatgtccgagaaaacagaggagattctcgatgatttcagccaacctggcggcagcgcaaaagatg

SEQ ID NO: 76780 - DNA, 103 bp, Artificial Sequence
  Synthetic Polynucleotide
taatacgactcactatagggtccaagcccgaaattgattagccaaatgtgaacagaggagacacattatgctaatcaataacctggcggcagcgcaaaagatg

SEQ ID NO: 76781 - DNA, 103 bp, Artificial Sequence
  Synthetic Polynucleotide
taatacgactcactatagggtgtgatactttgccaatggctgaaatgtccaacagaggagaggacatatgagccattggaacctggcggcagcgcaaaagatg

SEQ ID NO: 76782 - DNA, 103 bp, Artificial Sequence
  Synthetic Polynucleotide
taatacgactcactataggggattctgtgatactttgccaatggctgaaaaacagaggagatttcagatgttggcaaagaacctggcggcagcgcaaaagatg

SEQ ID NO: 76783 - DNA, 103 bp, Artificial Sequence
  Synthetic Polynucleotide
taatacgactcactatagggactcggattctgtgatactttgccaatggcaacagaggagagccattatgaaagtatcaaacctggcggcagcgcaaaagatg

SEQ ID NO: 76784 - DNA, 103 bp, Artificial Sequence
  Synthetic Polynucleotide
taatacgactcactatagggattttactcggattctgtgatactttgccaaacagaggagatggcaaatgatcacagaaaacctggcggcagcgcaaaagatg

SEQ ID NO: 76785 - DNA, 103 bp, Artificial Sequence
  Synthetic Polynucleotide
taatacgactcactatagggatgccattttactcggattctgtgatacttaacagaggagaaagtatatgagaatccgaaacctggcggcagcgcaaaagatg

SEQ ID NO: 76786 - DNA, 103 bp, Artificial Sequence
  Synthetic Polynucleotide
taatacgactcactatagggagcatatgccattttactcggattctgtgaaacagaggagatcacagatgccgagtaaaaacctggcggcagcgcaaaagatg

SEQ ID NO: 76787 - DNA, 103 bp, Artificial Sequence
  Synthetic Polynucleotide
taatacgactcactatagggagtaaagcatatgccattttactcggattcaacagaggagagaatccatgtaaaatggcaacctggcggcagcgcaaaagatg

SEQ ID NO: 76788 - DNA, 103 bp, Artificial Sequence
  Synthetic Polynucleotide
taatacgactcactatagggaaagcagtaaagcatatgccattttactcgaacagaggagacgagtaatgtggcatatgaacctggcggcagcgcaaaagatg

SEQ ID NO: 76789 - DNA, 103 bp, Artificial Sequence
  Synthetic Polynucleotide
taatacgactcactatagggcatgtaaagcagtaaagcatatgccattttaacagaggagaaaaatgatgtatgctttaaacctggcggcagcgcaaaagatg

SEQ ID NO: 76790 - DNA, 103 bp, Artificial Sequence
  Synthetic Polynucleotide
taatacgactcactataggggggaacatgtaaagcagtaaagcatatgccaacagaggagaggcataatgtttactgctaacctggcggcagcgcaaaagatg

SEQ ID NO: 76791 - DNA, 103 bp, Artificial Sequence
  Synthetic Polynucleotide
taatacgactcactatagggaagtatatcgacatactacttatgctgcaaaacagaggagattgcagatgaagtagtataacctggcggcagcgcaaaagatg

SEQ ID NO: 76792 - DNA, 103 bp, Artificial Sequence
  Synthetic Polynucleotide
taatacgactcactatagggttttttccaagcccgaaattgattagccaaaacagaggagattggctatgcaatttcggaacctggcggcagcgcaaaagatg

SEQ ID NO: 76793 - DNA, 103 bp, Artificial Sequence
  Synthetic Polynucleotide
taatacgactcactatagggaattggggaacatgtaaagcagtaaagcataacagaggagaatgcttatgtgctttacaaacctggcggcagcgcaaaagatg

SEQ ID NO: 76794 - DNA, 103 bp, Artificial Sequence
  Synthetic Polynucleotide
taatacgactcactatagggaaacaaattggggaacatgtaaagcagtaaaacagaggagattactgatgtacatgttcaacctggcggcagcgcaaaagatg

SEQ ID NO: 76795 - DNA, 103 bp, Artificial Sequence
  Synthetic Polynucleotide
taatacgactcactatagggtctccaaacaaattggggaacatgtaaagcaacagaggagagctttaatggttccccaaaacctggcggcagcgcaaaagatg

SEQ ID NO: 76796 - DNA, 103 bp, Artificial Sequence
  Synthetic Polynucleotide
taatacgactcactatagggggtcatctccaaacaaattggggaacatgtaacagaggagaacatgtatgccaatttgtaacctggcggcagcgcaaaagatg

SEQ ID NO: 76797 - DNA, 103 bp, Artificial Sequence
  Synthetic Polynucleotide
taatacgactcactatagggtctatggtcatctccaaacaaattggggaaaacagaggagattccccatgttgtttggaaacctggcggcagcgcaaaagatg

SEQ ID NO: 76798 - DNA, 103 bp, Artificial Sequence
  Synthetic Polynucleotide
taatacgactcactatagggatgaatctatggtcatctccaaacaaattgaacagaggagacaatttatgtggagatgaaacctggcggcagcgcaaaagatg

SEQ ID NO: 76799 - DNA, 103 bp, Artificial Sequence
  Synthetic Polynucleotide
taatacgactcactatagggaaagaatgaatctatggtcatctccaaacaaacagaggagatgtttgatgatgaccataaacctggcggcagcgcaaaagatg

SEQ ID NO: 76800 - DNA, 103 bp, Artificial Sequence
  Synthetic Polynucleotide
taatacgactcactatagggtctataaagaatgaatctatggtcatctccaacagaggagaggagatatgcatagattcaacctggcggcagcgcaaaagatg

SEQ ID NO: 76801 - DNA, 103 bp, Artificial Sequence
  Synthetic Polynucleotide
taatacgactcactatagggaacattctataaagaatgaatctatggtcaaacagaggagatgaccaatgattcattctaacctggcggcagcgcaaaagatg

SEQ ID NO: 76802 - DNA, 103 bp, Artificial Sequence
  Synthetic Polynucleotide
taatacgactcactatagggttggaaacattctataaagaatgaatctataacagaggagaatagatatgttctttataaacctggcggcagcgcaaaagatg

SEQ ID NO: 76803 - DNA, 103 bp, Artificial Sequence
  Synthetic Polynucleotide
taatacgactcactatagggatacgttttttccaagcccgaaattgattaaacagaggagataatcaatgtcgggcttgaacctggcggcagcgcaaaagatg

SEQ ID NO: 76804 - DNA, 103 bp, Artificial Sequence
  Synthetic Polynucleotide
taatacgactcactatagggactcattggaaacattctataaagaatgaaaacagaggagattcattatgtatagaatgaacctggcggcagcgcaaaagatg

SEQ ID NO: 76805 - DNA, 103 bp, Artificial Sequence
  Synthetic Polynucleotide
taatacgactcactatagggattttactcattggaaacattctataaagaaacagaggagatctttaatgaatgtttccaacctggcggcagcgcaaaagatg

SEQ ID NO: 76806 - DNA, 103 bp, Artificial Sequence
  Synthetic Polynucleotide
taatacgactcactataggggtttgattttactcattggaaacattctataacagaggagaatagaaatgttccaatgaaacctggcggcagcgcaaaagatg

SEQ ID NO: 76807 - DNA, 103 bp, Artificial Sequence
  Synthetic Polynucleotide
taatacgactcactatagggcttgtgtttgattttactcattggaaacataacagaggagaatgtttatgatgagtaaaaacctggcggcagcgcaaaagatg

SEQ ID NO: 76808 - DNA, 103 bp, Artificial Sequence
  Synthetic Polynucleotide
taatacgactcactatagggaagatcttgtgtttgattttactcattggaaacagaggagatccaatatgtaaaatcaaaacctggcggcagcgcaaaagatg

SEQ ID NO: 76809 - DNA, 103 bp, Artificial Sequence
  Synthetic Polynucleotide
taatacgactcactataggggagagaagatcttgtgtttgattttactcaaacagaggagatgagtaatgtcaaacacaaacctggcggcagcgcaaaagatg

SEQ ID NO: 76810 - DNA, 103 bp, Artificial Sequence
  Synthetic Polynucleotide
taatacgactcactataggggaaaggagagaagatcttgtgtttgattttaacagaggagaaaaatcatgcacaagatcaacctggcggcagcgcaaaagatg

SEQ ID NO: 76811 - DNA, 103 bp, Artificial Sequence
  Synthetic Polynucleotide
taatacgactcactatagggagtttgaaaggagagaagatcttgtgtttgaacagaggagacaaacaatggatcttctcaacctggcggcagcgcaaaagatg

SEQ ID NO: 76812 - DNA, 103 bp, Artificial Sequence
  Synthetic Polynucleotide
taatacgactcactataggggattaagtttgaaaggagagaagatcttgtaacagaggagaacaagaatgtctctccttaacctggcggcagcgcaaaagatg

SEQ ID NO: 76813 - DNA, 103 bp, Artificial Sequence
  Synthetic Polynucleotide
taatacgactcactatagggaataagattaagtttgaaaggagagaagataacagaggagaatcttcatgcctttcaaaaacctggcggcagcgcaaaagatg

SEQ ID NO: 76814 - DNA, 103 bp, Artificial Sequence
  Synthetic Polynucleotide
taatacgactcactatagggcagcgatacgttttttccaagcccgaaattaacagaggagaaatttcatgcttggaaaaaacctggcggcagcgcaaaagatg

SEQ ID NO: 76815 - DNA, 103 bp, Artificial Sequence
  Synthetic Polynucleotide
taatacgactcactatagggattctaataagattaagtttgaaaggagagaacagaggagactctccatgcaaacttaaaacctggcggcagcgcaaaagatg

SEQ ID NO: 76816 - DNA, 103 bp, Artificial Sequence
  Synthetic Polynucleotide
taatacgactcactatagggctaatattctaataagattaagtttgaaagaacagaggagactttcaatgttaatcttaaacctggcggcagcgcaaaagatg

SEQ ID NO: 76817 - DNA, 103 bp, Artificial Sequence
  Synthetic Polynucleotide
taatacgactcactatagggttccactaatattctaataagattaagtttaacagaggagaaaacttatgcttattagaaacctggcggcagcgcaaaagatg

SEQ ID NO: 76818 - DNA, 103 bp, Artificial Sequence
  Synthetic Polynucleotide
taatacgactcactatagggctttcttccactaatattctaataagattaaacagaggagataatctatgtagaatattaacctggcggcagcgcaaaagatg

SEQ ID NO: 76819 - DNA, 103 bp, Artificial Sequence
  Synthetic Polynucleotide
taatacgactcactatagggagaatctttcttccactaatattctaataaaacagaggagattattaatgtattagtggaacctggcggcagcgcaaaagatg

SEQ ID NO: 76820 - DNA, 103 bp, Artificial Sequence
  Synthetic Polynucleotide
taatacgactcactatagggattatagaatctttcttccactaatattctaacagaggagaagaataatggtggaagaaaacctggcggcagcgcaaaagatg

SEQ ID NO: 76821 - DNA, 103 bp, Artificial Sequence
  Synthetic Polynucleotide
taatacgactcactatagggtcattattatagaatctttcttccactaataacagaggagaattagtatgagaaagattaacctggcggcagcgcaaaagatg

SEQ ID NO: 76822 - DNA, 103 bp, Artificial Sequence
  Synthetic Polynucleotide
taatacgactcactatagggtgcattcattattatagaatctttcttccaaacagaggagatggaagatggattctataaacctggcggcagcgcaaaagatg

SEQ ID NO: 76823 - DNA, 103 bp, Artificial Sequence
  Synthetic Polynucleotide
taatacgactcactatagggagatctgcattcattattatagaatctttcaacagaggagagaaagaatgtataataataacctggcggcagcgcaaaagatg

SEQ ID NO: 76824 - DNA, 103 bp, Artificial Sequence
  Synthetic Polynucleotide
taatacgactcactatagggttattagatctgcattcattattatagaataacagaggagaattctaatgtaatgaatgaacctggcggcagcgcaaaagatg

SEQ ID NO: 76825 - DNA, 103 bp, Artificial Sequence
  Synthetic Polynucleotide
taatacgactcactatagggccttccagcgatacgttttttccaagcccgaacagaggagacgggctatgaaaaaacgtaacctggcggcagcgcaaaagatg

SEQ ID NO: 76826 - DNA, 103 bp, Artificial Sequence
  Synthetic Polynucleotide
taatacgactcactatagggtccatttattagatctgcattcattattataacagaggagaataataatgaatgcagataacctggcggcagcgcaaaagatg

SEQ ID NO: 76827 - DNA, 103 bp, Artificial Sequence
  Synthetic Polynucleotide
taatacgactcactatagggtattctccatttattagatctgcattcattaacagaggagaaatgaaatgagatctaataacctggcggcagcgcaaaagatg

SEQ ID NO: 76828 - DNA, 103 bp, Artificial Sequence
  Synthetic Polynucleotide
taatacgactcactatagggccaattattctccatttattagatctgcataacagaggagaatgcagatgtaataaatgaacctggcggcagcgcaaaagatg

SEQ ID NO: 76829 - DNA, 103 bp, Artificial Sequence
  Synthetic Polynucleotide
taatacgactcactataggggtgttccaattattctccatttattagatcaacagaggagagatctaatgaatggagaaaacctggcggcagcgcaaaagatg

SEQ ID NO: 76830 - DNA, 103 bp, Artificial Sequence
  Synthetic Polynucleotide
taatacgactcactatagggaacttgtgttccaattattctccatttattaacagaggagaaataaaatgagaataattaacctggcggcagcgcaaaagatg

SEQ ID NO: 76831 - DNA, 103 bp, Artificial Sequence
  Synthetic Polynucleotide
taatacgactcactatagggttatcaacttgtgttccaattattctccataacagaggagaatggagatgaattggaacaacctggcggcagcgcaaaagatg

SEQ ID NO: 76832 - DNA, 103 bp, Artificial Sequence
  Synthetic Polynucleotide
taatacgactcactatagggacattttatcaacttgtgttccaattattcaacagaggagagaataaatggaacacaagaacctggcggcagcgcaaaagatg

SEQ ID NO: 76833 - DNA, 103 bp, Artificial Sequence
  Synthetic Polynucleotide
taatacgactcactatagggtatcaacattttatcaacttgtgttccaataacagaggagaattggaatgcaagttgataacctggcggcagcgcaaaagatg

SEQ ID NO: 76834 - DNA, 103 bp, Artificial Sequence
  Synthetic Polynucleotide
taatacgactcactatagggtcagctatcaacattttatcaacttgtgttaacagaggagaaacacaatgtgataaaataacctggcggcagcgcaaaagatg

SEQ ID NO: 76835 - DNA, 103 bp, Artificial Sequence
  Synthetic Polynucleotide
taatacgactcactatagggcagattcagctatcaacattttatcaacttaacagaggagaaagttgatgaaatgttgaaacctggcggcagcgcaaaagatg

SEQ ID NO: 76836 - DNA, 103 bp, Artificial Sequence
  Synthetic Polynucleotide
taatacgactcactatagggtagtcccttccagcgatacgttttttccaaaacagaggagattggaaatgacgtatcgcaacctggcggcagcgcaaaagatg

SEQ ID NO: 76837 - DNA, 103 bp, Artificial Sequence
  Synthetic Polynucleotide
taatacgactcactatagggtttatcagattcagctatcaacattttatcaacagaggagagataaaatgttgatagctaacctggcggcagcgcaaaagatg

SEQ ID NO: 76838 - DNA, 103 bp, Artificial Sequence
  Synthetic Polynucleotide
taatacgactcactataggggtatatttatcagattcagctatcaacattaacagaggagaaatgttatgagctgaatcaacctggcggcagcgcaaaagatg

SEQ ID NO: 76839 - DNA, 103 bp, Artificial Sequence
  Synthetic Polynucleotide
taatacgactcactatagggctattgtatatttatcagattcagctatcaaacagaggagatgatagatgaatctgataaacctggcggcagcgcaaaagatg

SEQ ID NO: 76840 - DNA, 103 bp, Artificial Sequence
  Synthetic Polynucleotide
taatacgactcactatagggtgcatctattgtatatttatcagattcagcaacagaggagagctgaaatggataaatataacctggcggcagcgcaaaagatg

SEQ ID NO: 76841 - DNA, 103 bp, Artificial Sequence
  Synthetic Polynucleotide
taatacgactcactatagggtaccttgcatctattgtatatttatcagataacagaggagaatctgaatgatatacaataacctggcggcagcgcaaaagatg

SEQ ID NO: 76842 - DNA, 103 bp, Artificial Sequence
  Synthetic Polynucleotide
taatacgactcactatagggggcgataccttgcatctattgtatatttataacagaggagaataaatatgcaatagatgaacctggcggcagcgcaaaagatg

SEQ ID NO: 76843 - DNA, 103 bp, Artificial Sequence
  Synthetic Polynucleotide
taatacgactcactatagggtcttaggcgataccttgcatctattgtataaacagaggagatatacaatggatgcaaggaacctggcggcagcgcaaaagatg

SEQ ID NO: 76844 - DNA, 103 bp, Artificial Sequence
  Synthetic Polynucleotide
taatacgactcactatagggataggtcttaggcgataccttgcatctattaacagaggagaaatagaatgaaggtatcgaacctggcggcagcgcaaaagatg

SEQ ID NO: 76845 - DNA, 103 bp, Artificial Sequence
  Synthetic Polynucleotide
taatacgactcactatagggtatatataggtcttaggcgataccttgcataacagaggagaatgcaaatgatcgcctaaaacctggcggcagcgcaaaagatg

SEQ ID NO: 76846 - DNA, 103 bp, Artificial Sequence
  Synthetic Polynucleotide
taatacgactcactataggggattctatatataggtcttaggcgatacctaacagaggagaaggtatatgctaagacctaacctggcggcagcgcaaaagatg

SEQ ID NO: 76847 - DNA, 103 bp, Artificial Sequence
  Synthetic Polynucleotide
taatacgactcactatagggtcatatagtcccttccagcgatacgtttttaacagaggagaaaaaacatgtcgctggaaaacctggcggcagcgcaaaagatg

SEQ ID NO: 76848 - DNA, 103 bp, Artificial Sequence
  Synthetic Polynucleotide
taatacgactcactatagggcccttgattctatatataggtcttaggcgaaacagaggagatcgcctatgacctatataaacctggcggcagcgcaaaagatg

SEQ ID NO: 76849 - DNA, 103 bp, Artificial Sequence
  Synthetic Polynucleotide
taatacgactcactatagggattttcccttgattctatatataggtcttaaacagaggagataagacatgtatatagaaaacctggcggcagcgcaaaagatg

SEQ ID NO: 76850 - DNA, 103 bp, Artificial Sequence
  Synthetic Polynucleotide
taatacgactcactatagggttcagattttcccttgattctatatataggaacagaggagacctataatgagaatcaagaacctggcggcagcgcaaaagatg

SEQ ID NO: 76851 - DNA, 103 bp, Artificial Sequence
  Synthetic Polynucleotide
taatacgactcactatagggtcttcttcagattttcccttgattctatataacagaggagaatatagatgcaagggaaaaacctggcggcagcgcaaaagatg

SEQ ID NO: 76852 - DNA, 103 bp, Artificial Sequence
  Synthetic Polynucleotide
taatacgactcactataggggggtatcttcttcagattttcccttgattcaacagaggagagaatcaatggaaaatctgaacctggcggcagcgcaaaagatg

SEQ ID NO: 76853 - DNA, 103 bp, Artificial Sequence
  Synthetic Polynucleotide
taatacgactcactataggggaagagggtatcttcttcagattttcccttaacagaggagaaagggaatgtctgaagaaaacctggcggcagcgcaaaagatg

SEQ ID NO: 76854 - DNA, 103 bp, Artificial Sequence
  Synthetic Polynucleotide
taatacgactcactatagggttgatgaagagggtatcttcttcagattttaacagaggagaaaaatcatgagaagatacaacctggcggcagcgcaaaagatg

SEQ ID NO: 76855 - DNA, 103 bp, Artificial Sequence
  Synthetic Polynucleotide
taatacgactcactatagggtctgtttgatgaagagggtatcttcttcagaacagaggagactgaagatgataccctctaacctggcggcagcgcaaaagatg

SEQ ID NO: 76856 - DNA, 103 bp, Artificial Sequence
  Synthetic Polynucleotide
taatacgactcactatagggtaccatctgtttgatgaagagggtatcttcaacagaggagagaagatatgctcttcatcaacctggcggcagcgcaaaagatg

SEQ ID NO: 76857 - DNA, 103 bp, Artificial Sequence
  Synthetic Polynucleotide
taatacgactcactatagggtggtctaccatctgtttgatgaagagggtaaacagaggagataccctatgcatcaaacaaacctggcggcagcgcaaaagatg

SEQ ID NO: 76858 - DNA, 103 bp, Artificial Sequence
  Synthetic Polynucleotide
taatacgactcactataggggttagtcatatagtcccttccagcgatacgaacagaggagacgtatcatgggaagggacaacctggcggcagcgcaaaagatg

SEQ ID NO: 76859 - DNA, 103 bp, Artificial Sequence
  Synthetic Polynucleotide
taatacgactcactatagggcacattggtctaccatctgtttgatgaagaaacagaggagatcttcaatgaacagatggaacctggcggcagcgcaaaagatg

SEQ ID NO: 76860 - DNA, 103 bp, Artificial Sequence
  Synthetic Polynucleotide
taatacgactcactatagggtgtcacacattggtctaccatctgtttgataacagaggagaatcaaaatgatggtagacaacctggcggcagcgcaaaagatg

SEQ ID NO: 76861 - DNA, 103 bp, Artificial Sequence
  Synthetic Polynucleotide
taatacgactcactatagggtgggatgtcacacattggtctaccatctgtaacagaggagaacagatatgagaccaatgaacctggcggcagcgcaaaagatg

SEQ ID NO: 76862 - DNA, 103 bp, Artificial Sequence
  Synthetic Polynucleotide
taatacgactcactatagggattcctgggatgtcacacattggtctaccaaacagaggagatggtagatgaatgtgtgaaacctggcggcagcgcaaaagatg

SEQ ID NO: 76863 - DNA, 103 bp, Artificial Sequence
  Synthetic Polynucleotide
taatacgactcactatagggcaccaattcctgggatgtcacacattggtcaacagaggagagaccaaatggtgacatccaacctggcggcagcgcaaaagatg

SEQ ID NO: 76864 - DNA, 103 bp, Artificial Sequence
  Synthetic Polynucleotide
taatacgactcactatagggttttccaccaattcctgggatgtcacacataacagaggagaatgtgtatgatcccaggaaacctggcggcagcgcaaaagatg

SEQ ID NO: 76865 - DNA, 103 bp, Artificial Sequence
  Synthetic Polynucleotide
taatacgactcactatagggacactttttccaccaattcctgggatgtcaaacagaggagatgacatatgaggaattggaacctggcggcagcgcaaaagatg

SEQ ID NO: 76866 - DNA, 103 bp, Artificial Sequence
  Synthetic Polynucleotide
taatacgactcactatagggcttcaacactttttccaccaattcctgggaaacagaggagatcccagatgttggtggaaaacctggcggcagcgcaaaagatg

SEQ ID NO: 76867 - DNA, 103 bp, Artificial Sequence
  Synthetic Polynucleotide
taatacgactcactatagggagtatcttcaacactttttccaccaattccaacagaggagaggaattatgggaaaaagtaacctggcggcagcgcaaaagatg

SEQ ID NO: 76868 - DNA, 103 bp, Artificial Sequence
  Synthetic Polynucleotide
taatacgactcactatagggtaaacagtatcttcaacactttttccaccaaacagaggagatggtggatgaagtgttgaaacctggcggcagcgcaaaagatg

SEQ ID NO: 76869 - DNA, 103 bp, Artificial Sequence
  Synthetic Polynucleotide
taatacgactcactataggggataagttagtcatatagtcccttccagcgaacagaggagacgctggatgggactatataacctggcggcagcgcaaaagatg

SEQ ID NO: 76870 - DNA, 103 bp, Artificial Sequence
  Synthetic Polynucleotide
taatacgactcactatagggatctctaaacagtatcttcaacactttttcaacagaggagagaaaaaatgttgaagataaacctggcggcagcgcaaaagatg

SEQ ID NO: 76871 - DNA, 103 bp, Artificial Sequence
  Synthetic Polynucleotide
taatacgactcactatagggaacaaatctctaaacagtatcttcaacactaacagaggagaagtgttatggatactgttaacctggcggcagcgcaaaagatg

SEQ ID NO: 76872 - DNA, 103 bp, Artificial Sequence
  Synthetic Polynucleotide
taatacgactcactatagggtcttgaacaaatctctaaacagtatcttcaaacagaggagatgaagaatgtgtttagagaacctggcggcagcgcaaaagatg

SEQ ID NO: 76873 - DNA, 103 bp, Artificial Sequence
  Synthetic Polynucleotide
taatacgactcactatagggtccactcttgaacaaatctctaaacagtataacagaggagaatactgatgagagatttgaacctggcggcagcgcaaaagatg

SEQ ID NO: 76874 - DNA, 103 bp, Artificial Sequence
  Synthetic Polynucleotide
taatacgactcactatagggtattctccactcttgaacaaatctctaaacaacagaggagagtttagatgtttgttcaaaacctggcggcagcgcaaaagatg

SEQ ID NO: 76875 - DNA, 103 bp, Artificial Sequence
  Synthetic Polynucleotide
taatacgactcactatagggctttgtattctccactcttgaacaaatctcaacagaggagagagattatgtcaagagtgaacctggcggcagcgcaaaagatg

SEQ ID NO: 76876 - DNA, 103 bp, Artificial Sequence
  Synthetic Polynucleotide
taatacgactcactataggggtacgctttgtattctccactcttgaacaaaacagaggagattgttcatgagtggagaaaacctggcggcagcgcaaaagatg

SEQ ID NO: 76877 - DNA, 103 bp, Artificial Sequence
  Synthetic Polynucleotide
taatacgactcactatagggtatctgtacgctttgtattctccactcttgaacagaggagacaagagatgagaatacaaaacctggcggcagcgcaaaagatg

SEQ ID NO: 76878 - DNA, 103 bp, Artificial Sequence
  Synthetic Polynucleotide
taatacgactcactatagggcatcgtatctgtacgctttgtattctccacaacagaggagagtggagatgacaaagcgtaacctggcggcagcgcaaaagatg

SEQ ID NO: 76879 - DNA, 103 bp, Artificial Sequence
  Synthetic Polynucleotide
taatacgactcactataggggtcatcatcgtatctgtacgctttgtattcaacagaggagagaatacatggcgtacagaaacctggcggcagcgcaaaagatg

SEQ ID NO: 76880 - DNA, 103 bp, Artificial Sequence
  Synthetic Polynucleotide
taatacgactcactatagggctctagataagttagtcatatagtcccttcaacagaggagagaagggatgatatgactaaacctggcggcagcgcaaaagatg

SEQ ID NO: 76881 - DNA, 103 bp, Artificial Sequence
  Synthetic Polynucleotide
taatacgactcactatagggtctacgtcatcatcgtatctgtacgctttgaacagaggagacaaagcatgcagatacgaaacctggcggcagcgcaaaagatg

SEQ ID NO: 76882 - DNA, 103 bp, Artificial Sequence
  Synthetic Polynucleotide
taatacgactcactatagggcattttctacgtcatcatcgtatctgtacgaacagaggagacgtacaatgacgatgatgaacctggcggcagcgcaaaagatg

SEQ ID NO: 76883 - DNA, 103 bp, Artificial Sequence
  Synthetic Polynucleotide
taatacgactcactataggggaatccattttctacgtcatcatcgtatctaacagaggagaagatacatggatgacgtaaacctggcggcagcgcaaaagatg

SEQ ID NO: 76884 - DNA, 103 bp, Artificial Sequence
  Synthetic Polynucleotide
taatacgactcactatagggccaatgaatccattttctacgtcatcatcgaacagaggagacgatgaatgcgtagaaaaaacctggcggcagcgcaaaagatg

SEQ ID NO: 76885 - DNA, 103 bp, Artificial Sequence
  Synthetic Polynucleotide
taatacgactcactatagggccaatccaatgaatccattttctacgtcataacagaggagaatgacgatgaaaatggataacctggcggcagcgcaaaagatg

SEQ ID NO: 76886 - DNA, 103 bp, Artificial Sequence
  Synthetic Polynucleotide
taatacgactcactatagggtttatccaatccaatgaatccattttctacaacagaggagagtagaaatgggattcattaacctggcggcagcgcaaaagatg

SEQ ID NO: 76887 - DNA, 103 bp, Artificial Sequence
  Synthetic Polynucleotide
taatacgactcactatagggtttagtttatccaatccaatgaatccatttaacagaggagaaaatggatgcattggattaacctggcggcagcgcaaaagatg

SEQ ID NO: 76888 - DNA, 103 bp, Artificial Sequence
  Synthetic Polynucleotide
taatacgactcactatagggttaattttagtttatccaatccaatgaatcaacagaggagagattcaatggattggataaacctggcggcagcgcaaaagatg

SEQ ID NO: 76889 - DNA, 103 bp, Artificial Sequence
  Synthetic Polynucleotide
taatacgactcactatagggaatgtttaattttagtttatccaatccaataacagaggagaattggaatggataaactaaacctggcggcagcgcaaaagatg

SEQ ID NO: 76890 - DNA, 103 bp, Artificial Sequence
  Synthetic Polynucleotide
taatacgactcactatagggtgaacaatgtttaattttagtttatccaataacagaggagaattggaatgactaaaattaacctggcggcagcgcaaaagatg

SEQ ID NO: 76891 - DNA, 103 bp, Artificial Sequence
  Synthetic Polynucleotide
taatacgactcactatagggtgtatctctagataagttagtcatatagtcaacagaggagagactatatgactaacttaaacctggcggcagcgcaaaagatg

SEQ ID NO: 76892 - DNA, 103 bp, Artificial Sequence
  Synthetic Polynucleotide
taatacgactcactatagggtatcatgaacaatgtttaattttagtttataacagaggagaataaacatgaattaaacaaacctggcggcagcgcaaaagatg

SEQ ID NO: 76893 - DNA, 103 bp, Artificial Sequence
  Synthetic Polynucleotide
taatacgactcactatagggaactatatcatgaacaatgtttaattttagaacagaggagactaaaaatgaacattgttaacctggcggcagcgcaaaagatg

SEQ ID NO: 76894 - DNA, 103 bp, Artificial Sequence
  Synthetic Polynucleotide
taatacgactcactatagggggttcaactatatcatgaacaatgtttaataacagaggagaattaaaatgtgttcatgaaacctggcggcagcgcaaaagatg

SEQ ID NO: 76895 - DNA, 103 bp, Artificial Sequence
  Synthetic Polynucleotide
taatacgactcactatagggtacatggttcaactatatcatgaacaatgtaacagaggagaacattgatgatgatatagaacctggcggcagcgcaaaagatg

SEQ ID NO: 76896 - DNA, 103 bp, Artificial Sequence
  Synthetic Polynucleotide
taatacgactcactatagggaggcatacatggttcaactatatcatgaacaacagaggagagttcatatgatagttgaaaacctggcggcagcgcaaaagatg

SEQ ID NO: 76897 - DNA, 103 bp, Artificial Sequence
  Synthetic Polynucleotide
taatacgactcactatagggcgaacaggcatacatggttcaactatatcaaacagaggagatgatatatgtgaaccatgaacctggcggcagcgcaaaagatg

SEQ ID NO: 76898 - DNA, 103 bp, Artificial Sequence
  Synthetic Polynucleotide
taatacgactcactataggggcctacgaacaggcatacatggttcaactaaacagaggagatagttgatgcatgtatgcaacctggcggcagcgcaaaagatg

SEQ ID NO: 76899 - DNA, 103 bp, Artificial Sequence
  Synthetic Polynucleotide
taatacgactcactatagggcactggcctacgaacaggcatacatggttcaacagaggagagaaccaatgatgcctgttaacctggcggcagcgcaaaagatg

SEQ ID NO: 76900 - DNA, 103 bp, Artificial Sequence
  Synthetic Polynucleotide
taatacgactcactatagggttagccactggcctacgaacaggcatacataacagaggagaatgtatatgtgttcgtagaacctggcggcagcgcaaaagatg

SEQ ID NO: 76901 - DNA, 103 bp, Artificial Sequence
  Synthetic Polynucleotide
taatacgactcactataggggtatcttagccactggcctacgaacaggcaaacagaggagatgcctgatggtaggccagaacctggcggcagcgcaaaagatg

SEQ ID NO: 76902 - DNA, 103 bp, Artificial Sequence
  Synthetic Polynucleotide
taatacgactcactatagggacgataagtatatcgacatactacttatgcaacagaggagagcataaatggtatgtcgaaacctggcggcagcgcaaaagatg

SEQ ID NO: 76903 - DNA, 103 bp, Artificial Sequence
  Synthetic Polynucleotide
taatacgactcactatagggattcctgtatctctagataagttagtcataaacagaggagatatgacatgcttatctagaacctggcggcagcgcaaaagatg

SEQ ID NO: 76904 - DNA, 103 bp, Artificial Sequence
  Synthetic Polynucleotide
taatacgactcactatagggacacagtatcttagccactggcctacgaacaacagaggagagttcgtatgccagtggctaacctggcggcagcgcaaaagatg

SEQ ID NO: 76905 - DNA, 103 bp, Artificial Sequence
  Synthetic Polynucleotide
taatacgactcactatagggtctttacacagtatcttagccactggcctaaacagaggagataggccatgggctaagataacctggcggcagcgcaaaagatg

SEQ ID NO: 76906 - DNA, 103 bp, Artificial Sequence
  Synthetic Polynucleotide
taatacgactcactatagggccatttctttacacagtatcttagccactgaacagaggagacagtggatgagatactgtaacctggcggcagcgcaaaagatg

SEQ ID NO: 76907 - DNA, 103 bp, Artificial Sequence
  Synthetic Polynucleotide
taatacgactcactatagggatttaccatttctttacacagtatcttagcaacagaggagagctaagatgctgtgtaaaaacctggcggcagcgcaaaagatg

SEQ ID NO: 76908 - DNA, 103 bp, Artificial Sequence
  Synthetic Polynucleotide
taatacgactcactatagggtatttatttaccatttctttacacagtatcaacagaggagagatactatgtaaagaaataacctggcggcagcgcaaaagatg

SEQ ID NO: 76909 - DNA, 103 bp, Artificial Sequence
  Synthetic Polynucleotide
taatacgactcactatagggcaaagtatttatttaccatttctttacacaaacagaggagatgtgtaatgaaatggtaaaacctggcggcagcgcaaaagatg

SEQ ID NO: 76910 - DNA, 103 bp, Artificial Sequence
  Synthetic Polynucleotide
taatacgactcactatagggattctcaaagtatttatttaccatttctttaacagaggagaaaagaaatggtaaataaaaacctggcggcagcgcaaaagatg

SEQ ID NO: 76911 - DNA, 103 bp, Artificial Sequence
  Synthetic Polynucleotide
taatacgactcactatagggagcggattctcaaagtatttatttaccattaacagaggagaaatggtatgtaaatacttaacctggcggcagcgcaaaagatg

SEQ ID NO: 76912 - DNA, 103 bp, Artificial Sequence
  Synthetic Polynucleotide
taatacgactcactatagggtatgcagcggattctcaaagtatttatttaaacagaggagataaataatgactttgagaaacctggcggcagcgcaaaagatg

SEQ ID NO: 76913 - DNA, 103 bp, Artificial Sequence
  Synthetic Polynucleotide
taatacgactcactatagggaataatatgcagcggattctcaaagtatttaacagaggagaaaatacatggagaatccgaacctggcggcagcgcaaaagatg

SEQ ID NO: 76914 - DNA, 103 bp, Artificial Sequence
  Synthetic Polynucleotide
taatacgactcactataggggttgtattcctgtatctctagataagttagaacagaggagactaactatgctagagataaacctggcggcagcgcaaaagatg

SEQ ID NO: 76915 - DNA, 103 bp, Artificial Sequence
  Synthetic Polynucleotide
taatacgactcactatagggttaccaataatatgcagcggattctcaaagaacagaggagactttgaatgtccgctgcaaacctggcggcagcgcaaaagatg

SEQ ID NO: 76916 - DNA, 103 bp, Artificial Sequence
  Synthetic Polynucleotide
taatacgactcactataggggattcttaccaataatatgcagcggattctaacagaggagaagaatcatgtgcatattaaacctggcggcagcgcaaaagatg

SEQ ID NO: 76917 - DNA, 103 bp, Artificial Sequence
  Synthetic Polynucleotide
taatacgactcactatagggttgaagattcttaccaataatatgcagcggaacagaggagaccgctgatgattattggtaacctggcggcagcgcaaaagatg

SEQ ID NO: 76918 - DNA, 103 bp, Artificial Sequence
  Synthetic Polynucleotide
taatacgactcactatagggcactcttgaagattcttaccaataatatgcaacagaggagagcatatatgtggtaagaaaacctggcggcagcgcaaaagatg

SEQ ID NO: 76919 - DNA, 103 bp, Artificial Sequence
  Synthetic Polynucleotide
taatacgactcactatagggcaatgcactcttgaagattcttaccaataaaacagaggagattattgatgagaatcttcaacctggcggcagcgcaaaagatg

SEQ ID NO: 76920 - DNA, 103 bp, Artificial Sequence
  Synthetic Polynucleotide
taatacgactcactatagggaaagtcaatgcactcttgaagattcttaccaacagaggagaggtaagatgcttcaagagaacctggcggcagcgcaaaagatg

SEQ ID NO: 76921 - DNA, 103 bp, Artificial Sequence
  Synthetic Polynucleotide
taatacgactcactatagggctaacaaagtcaatgcactcttgaagattcaacagaggagagaatctatgagagtgcataacctggcggcagcgcaaaagatg

SEQ ID NO: 76922 - DNA, 103 bp, Artificial Sequence
  Synthetic Polynucleotide
taatacgactcactatagggattcactaacaaagtcaatgcactcttgaaaacagaggagattcaagatggcattgactaacctggcggcagcgcaaaagatg

SEQ ID NO: 76923 - DNA, 103 bp, Artificial Sequence
  Synthetic Polynucleotide
taatacgactcactatagggtgcctattcactaacaaagtcaatgcactcaacagaggagagagtgcatggactttgttaacctggcggcagcgcaaaagatg

SEQ ID NO: 76924 - DNA, 103 bp, Artificial Sequence
  Synthetic Polynucleotide
taatacgactcactatagggtgaaatgcctattcactaacaaagtcaatgaacagaggagacattgaatgtgttagtgaaacctggcggcagcgcaaaagatg

SEQ ID NO: 76925 - DNA, 103 bp, Artificial Sequence
  Synthetic Polynucleotide
taatacgactcactatagggtgattgttgtattcctgtatctctagataaaacagaggagattatctatggatacaggaaacctggcggcagcgcaaaagatg

SEQ ID NO: 76926 - DNA, 103 bp, Artificial Sequence
  Synthetic Polynucleotide
taatacgactcactatagggaaagatgaaatgcctattcactaacaaagtaacagaggagaactttgatggtgaataggaacctggcggcagcgcaaaagatg

SEQ ID NO: 76927 - DNA, 103 bp, Artificial Sequence
  Synthetic Polynucleotide
taatacgactcactatagggtggagaaagatgaaatgcctattcactaacaacagaggagagttagtatgtaggcatttaacctggcggcagcgcaaaagatg

SEQ ID NO: 76928 - DNA, 103 bp, Artificial Sequence
  Synthetic Polynucleotide
taatacgactcactatagggagtattggagaaagatgaaatgcctattcaaacagaggagatgaataatgatttcatctaacctggcggcagcgcaaaagatg

SEQ ID NO: 76929 - DNA, 103 bp, Artificial Sequence
  Synthetic Polynucleotide
taatacgactcactataggggaattagtattggagaaagatgaaatgcctaacagaggagaaggcatatgatctttctcaacctggcggcagcgcaaaagatg

SEQ ID NO: 76930 - DNA, 103 bp, Artificial Sequence
  Synthetic Polynucleotide
taatacgactcactatagggaatttgaattagtattggagaaagatgaaaaacagaggagatttcatatgtctccaataaacctggcggcagcgcaaaagatg

SEQ ID NO: 76931 - DNA, 103 bp, Artificial Sequence
  Synthetic Polynucleotide
taatacgactcactatagggttaacaatttgaattagtattggagaaagaaacagaggagatctttcatgaatactaataacctggcggcagcgcaaaagatg

SEQ ID NO: 76932 - DNA, 103 bp, Artificial Sequence
  Synthetic Polynucleotide
taatacgactcactatagggttaatttaacaatttgaattagtattggagaacagaggagactccaaatgtaattcaaaaacctggcggcagcgcaaaagatg

SEQ ID NO: 76933 - DNA, 103 bp, Artificial Sequence
  Synthetic Polynucleotide
taatacgactcactatagggcattattaatttaacaatttgaattagtataacagaggagaatactaatgcaaattgttaacctggcggcagcgcaaaagatg

SEQ ID NO: 76934 - DNA, 103 bp, Artificial Sequence
  Synthetic Polynucleotide
taatacgactcactatagggatatccattattaatttaacaatttgaattaacagaggagaaattcaatgtgttaaattaacctggcggcagcgcaaaagatg

SEQ ID NO: 76935 - DNA, 103 bp, Artificial Sequence
  Synthetic Polynucleotide
taatacgactcactatagggatactatatccattattaatttaacaatttaacagaggagaaaattgatgaattaataaaacctggcggcagcgcaaaagatg

SEQ ID NO: 76936 - DNA, 103 bp, Artificial Sequence
  Synthetic Polynucleotide
taatacgactcactatagggaggtttgattgttgtattcctgtatctctaaacagaggagatagagaatgaggaatacaaacctggcggcagcgcaaaagatg

SEQ ID NO: 76937 - DNA, 103 bp, Artificial Sequence
  Synthetic Polynucleotide
taatacgactcactatagggtatttatactatatccattattaatttaacaacagaggagagttaaaatgataatggataacctggcggcagcgcaaaagatg

SEQ ID NO: 76938 - DNA, 103 bp, Artificial Sequence
  Synthetic Polynucleotide
taatacgactcactatagggataactatttatactatatccattattaataacagaggagaattaatatgggatatagtaacctggcggcagcgcaaaagatg

SEQ ID NO: 76939 - DNA, 103 bp, Artificial Sequence
  Synthetic Polynucleotide
taatacgactcactatagggttctaataactatttatactatatccattaaacagaggagataatggatgtagtataaaaacctggcggcagcgcaaaagatg

SEQ ID NO: 76940 - DNA, 103 bp, Artificial Sequence
  Synthetic Polynucleotide
taatacgactcactatagggtcttattctaataactatttatactatatcaacagaggagagatataatgtaaatagttaacctggcggcagcgcaaaagatg

SEQ ID NO: 76941 - DNA, 103 bp, Artificial Sequence
  Synthetic Polynucleotide
taatacgactcactatagggtacactcttattctaataactatttatactaacagaggagaagtataatgagttattagaacctggcggcagcgcaaaagatg

SEQ ID NO: 76942 - DNA, 103 bp, Artificial Sequence
  Synthetic Polynucleotide
taatacgactcactataggggatactacactcttattctaataactatttaacagaggagaaaatagatgttagaataaaacctggcggcagcgcaaaagatg

SEQ ID NO: 76943 - DNA, 103 bp, Artificial Sequence
  Synthetic Polynucleotide
taatacgactcactatagggtctatgatactacactcttattctaataacaacagaggagagttattatgataagagtgaacctggcggcagcgcaaaagatg

SEQ ID NO: 76944 - DNA, 103 bp, Artificial Sequence
  Synthetic Polynucleotide
taatacgactcactatagggacttatctatgatactacactcttattctaaacagaggagatagaatatgagtgtagtaaacctggcggcagcgcaaaagatg

SEQ ID NO: 76945 - DNA, 103 bp, Artificial Sequence
  Synthetic Polynucleotide
taatacgactcactatagggtaaatacttatctatgatactacactcttaaacagaggagataagagatgagtatcataaacctggcggcagcgcaaaagatg

SEQ ID NO: 76946 - DNA, 103 bp, Artificial Sequence
  Synthetic Polynucleotide
taatacgactcactataggggaaagtaaatacttatctatgatactacacaacagaggagagtgtagatgcatagataaaacctggcggcagcgcaaaagatg

SEQ ID NO: 76947 - DNA, 103 bp, Artificial Sequence
  Synthetic Polynucleotide
taatacgactcactatagggcagtaaggtttgattgttgtattcctgtataacagaggagaatacagatgtacaacaataacctggcggcagcgcaaaagatg

SEQ ID NO: 76948 - DNA, 103 bp, Artificial Sequence
  Synthetic Polynucleotide
taatacgactcactatagggtagaagaaagtaaatacttatctatgatacaacagaggagagtatcaatgataagtattaacctggcggcagcgcaaaagatg

SEQ ID NO: 76949 - DNA, 103 bp, Artificial Sequence
  Synthetic Polynucleotide
taatacgactcactatagggttttatagaagaaagtaaatacttatctataacagaggagaatagatatgtatttacttaacctggcggcagcgcaaaagatg

SEQ ID NO: 76950 - DNA, 103 bp, Artificial Sequence
  Synthetic Polynucleotide
taatacgactcactatagggatccattttatagaagaaagtaaatacttaaacagaggagataagtaatgactttcttcaacctggcggcagcgcaaaagatg

SEQ ID NO: 76951 - DNA, 103 bp, Artificial Sequence
  Synthetic Polynucleotide
taatacgactcactatagggataaaatccattttatagaagaaagtaaataacagaggagaatttacatgcttctataaaacctggcggcagcgcaaaagatg

SEQ ID NO: 76952 - DNA, 103 bp, Artificial Sequence
  Synthetic Polynucleotide
taatacgactcactatagggtacgaataaaatccattttatagaagaaagaacagaggagactttctatgataaaatggaacctggcggcagcgcaaaagatg

SEQ ID NO: 76953 - DNA, 103 bp, Artificial Sequence
  Synthetic Polynucleotide
taatacgactcactatagggctttctacgaataaaatccattttatagaaaacagaggagattctatatgatggattttaacctggcggcagcgcaaaagatg

SEQ ID NO: 76954 - DNA, 103 bp, Artificial Sequence
  Synthetic Polynucleotide
taatacgactcactatagggagatactttctacgaataaaatccattttaaacagaggagataaaatatgttttattcgaacctggcggcagcgcaaaagatg

SEQ ID NO: 76955 - DNA, 103 bp, Artificial Sequence
  Synthetic Polynucleotide
taatacgactcactatagggatataagatactttctacgaataaaatccaaacagaggagatggattatgttcgtagaaaacctggcggcagcgcaaaagatg

SEQ ID NO: 76956 - DNA, 103 bp, Artificial Sequence
  Synthetic Polynucleotide
taatacgactcactatagggtgtgtatataagatactttctacgaataaaaacagaggagatttattatgagaaagtataacctggcggcagcgcaaaagatg

SEQ ID NO: 76957 - DNA, 103 bp, Artificial Sequence
  Synthetic Polynucleotide
taatacgactcactatagggtctactgtgtatataagatactttctacgaaacagaggagatcgtagatggtatcttataacctggcggcagcgcaaaagatg

SEQ ID NO: 76958 - DNA, 103 bp, Artificial Sequence
  Synthetic Polynucleotide
taatacgactcactatagggagtttcagtaaggtttgattgttgtattccaacagaggagaggaataatgcaatcaaacaacctggcggcagcgcaaaagatg

SEQ ID NO: 76959 - DNA, 103 bp, Artificial Sequence
  Synthetic Polynucleotide
taatacgactcactatagggtattttctactgtgtatataagatactttcaacagaggagagaaagtatgttatatacaaacctggcggcagcgcaaaagatg

SEQ ID NO: 76960 - DNA, 103 bp, Artificial Sequence
  Synthetic Polynucleotide
taatacgactcactatagggtatattattttctactgtgtatataagataaacagaggagatatcttatgtacacagtaaacctggcggcagcgcaaaagatg

SEQ ID NO: 76961 - DNA, 103 bp, Artificial Sequence
  Synthetic Polynucleotide
taatacgactcactatagggaaatctatattattttctactgtgtatataaacagaggagatatataatgagtagaaaaaacctggcggcagcgcaaaagatg

SEQ ID NO: 76962 - DNA, 103 bp, Artificial Sequence
  Synthetic Polynucleotide
taatacgactcactatagggttaaaaaatctatattattttctactgtgtaacagaggagaacacagatgaaaataataaacctggcggcagcgcaaaagatg

SEQ ID NO: 76963 - DNA, 103 bp, Artificial Sequence
  Synthetic Polynucleotide
taatacgactcactatagggatcctttaaaaaatctatattattttctacaacagaggagagtagaaatgaatatagataacctggcggcagcgcaaaagatg

SEQ ID NO: 76964 - DNA, 103 bp, Artificial Sequence
  Synthetic Polynucleotide
taatacgactcactataggggtatcatcctttaaaaaatctatattatttaacagaggagaaaataaatgagattttttaacctggcggcagcgcaaaagatg

SEQ ID NO: 76965 - DNA, 103 bp, Artificial Sequence
  Synthetic Polynucleotide
taatacgactcactatagggttaatgtatcatcctttaaaaaatctatataacagaggagaatatagatgttttaaaggaacctggcggcagcgcaaaagatg

SEQ ID NO: 76966 - DNA, 103 bp, Artificial Sequence
  Synthetic Polynucleotide
taatacgactcactatagggtttacttaatgtatcatcctttaaaaaatcaacagaggagagattttatgaaggatgataacctggcggcagcgcaaaagatg

SEQ ID NO: 76967 - DNA, 103 bp, Artificial Sequence
  Synthetic Polynucleotide
taatacgactcactatagggtttactttacttaatgtatcatcctttaaaaacagaggagatttaaaatgtgatacattaacctggcggcagcgcaaaagatg

SEQ ID NO: 76968 - DNA, 103 bp, Artificial Sequence
  Synthetic Polynucleotide
taatacgactcactatagggaattgtttactttacttaatgtatcatcctaacagaggagaaggatgatgcattaagtaaacctggcggcagcgcaaaagatg

SEQ ID NO: 76969 - DNA, 103 bp, Artificial Sequence
  Synthetic Polynucleotide
taatacgactcactatagggcgtatagtttcagtaaggtttgattgttgtaacagaggagaacaacaatgaaaccttacaacctggcggcagcgcaaaagatg

SEQ ID NO: 76970 - DNA, 103 bp, Artificial Sequence
  Synthetic Polynucleotide
taatacgactcactatagggggtaaaattgtttactttacttaatgtatcaacagaggagagatacaatgagtaaagtaaacctggcggcagcgcaaaagatg

SEQ ID NO: 76971 - DNA, 103 bp, Artificial Sequence
  Synthetic Polynucleotide
taatacgactcactatagggttgagggtaaaattgtttactttacttaataacagaggagaattaagatgagtaaacaaaacctggcggcagcgcaaaagatg

SEQ ID NO: 76972 - DNA, 103 bp, Artificial Sequence
  Synthetic Polynucleotide
taatacgactcactatagggcatgattgagggtaaaattgtttactttacaacagaggagagtaaagatgacaattttaaacctggcggcagcgcaaaagatg

SEQ ID NO: 76973 - DNA, 103 bp, Artificial Sequence
  Synthetic Polynucleotide
taatacgactcactatagggtagtacatgattgagggtaaaattgtttacaacagaggagagtaaacatgtttaccctcaacctggcggcagcgcaaaagatg

SEQ ID NO: 76974 - DNA, 103 bp, Artificial Sequence
  Synthetic Polynucleotide
taatacgactcactatagggagagctagtacatgattgagggtaaaattgaacagaggagacaatttatgcctcaatcaaacctggcggcagcgcaaaagatg

SEQ ID NO: 76975 - DNA, 103 bp, Artificial Sequence
  Synthetic Polynucleotide
taatacgactcactatagggacttgagagctagtacatgattgagggtaaaacagaggagattacccatgatcatgtacaacctggcggcagcgcaaaagatg

SEQ ID NO: 76976 - DNA, 103 bp, Artificial Sequence
  Synthetic Polynucleotide
taatacgactcactatagggtagatacttgagagctagtacatgattgagaacagaggagactcaatatggtactagctaacctggcggcagcgcaaaagatg

SEQ ID NO: 76977 - DNA, 103 bp, Artificial Sequence
  Synthetic Polynucleotide
taatacgactcactatagggctaactagatacttgagagctagtacatgaaacagaggagatcatgtatgagctctcaaaacctggcggcagcgcaaaagatg

SEQ ID NO: 76978 - DNA, 103 bp, Artificial Sequence
  Synthetic Polynucleotide
taatacgactcactatagggaattgctaactagatacttgagagctagtaaacagaggagatactagatgtcaagtatcaacctggcggcagcgcaaaagatg

SEQ ID NO: 76979 - DNA, 103 bp, Artificial Sequence
  Synthetic Polynucleotide
taatacgactcactatagggaggaaaattgctaactagatacttgagagcaacagaggagagctctcatgtatctagttaacctggcggcagcgcaaaagatg

SEQ ID NO: 76980 - DNA, 103 bp, Artificial Sequence
  Synthetic Polynucleotide
taatacgactcactatagggagttacgtatagtttcagtaaggtttgattaacagaggagaaatcaaatgttactgaaaaacctggcggcagcgcaaaagatg

SEQ ID NO: 76981 - DNA, 103 bp, Artificial Sequence
  Synthetic Polynucleotide
taatacgactcactatagggtgttgaggaaaattgctaactagatacttgaacagaggagacaagtaatgagttagcaaaacctggcggcagcgcaaaagatg

SEQ ID NO: 76982 - DNA, 103 bp, Artificial Sequence
  Synthetic Polynucleotide
taatacgactcactatagggtaacgtgttgaggaaaattgctaactagataacagaggagaatctagatggcaattttcaacctggcggcagcgcaaaagatg

SEQ ID NO: 76983 - DNA, 103 bp, Artificial Sequence
  Synthetic Polynucleotide
taatacgactcactatagggagtaataacgtgttgaggaaaattgctaacaacagaggagagttagcatgtttcctcaaaacctggcggcagcgcaaaagatg

SEQ ID NO: 76984 - DNA, 103 bp, Artificial Sequence
  Synthetic Polynucleotide
taatacgactcactatagggtccttagtaataacgtgttgaggaaaattgaacagaggagacaatttatgtcaacacgtaacctggcggcagcgcaaaagatg

SEQ ID NO: 76985 - DNA, 103 bp, Artificial Sequence
  Synthetic Polynucleotide
taatacgactcactatagggatacatccttagtaataacgtgttgaggaaaacagaggagattcctcatgacgttattaaacctggcggcagcgcaaaagatg

SEQ ID NO: 76986 - DNA, 103 bp, Artificial Sequence
  Synthetic Polynucleotide
taatacgactcactatagggagctaatacatccttagtaataacgtgttgaacagaggagacaacacatgattactaagaacctggcggcagcgcaaaagatg

SEQ ID NO: 76987 - DNA, 103 bp, Artificial Sequence
  Synthetic Polynucleotide
taatacgactcactataggggtattagctaatacatccttagtaataacgaacagaggagacgttatatgtaaggatgtaacctggcggcagcgcaaaagatg

SEQ ID NO: 76988 - DNA, 103 bp, Artificial Sequence
  Synthetic Polynucleotide
taatacgactcactatagggaattggtattagctaatacatccttagtaaaacagaggagattactaatgatgtattagaacctggcggcagcgcaaaagatg

SEQ ID NO: 76989 - DNA, 103 bp, Artificial Sequence
  Synthetic Polynucleotide
taatacgactcactatagggaaaaaaattggtattagctaatacatccttaacagaggagaaaggatatgttagctaataacctggcggcagcgcaaaagatg

SEQ ID NO: 76990 - DNA, 103 bp, Artificial Sequence
  Synthetic Polynucleotide
taatacgactcactatagggaaaacaaaaaaattggtattagctaatacaaacagaggagatgtattatgtaataccaaaacctggcggcagcgcaaaagatg

SEQ ID NO: 76991 - DNA, 103 bp, Artificial Sequence
  Synthetic Polynucleotide
taatacgactcactatagggttgacagttacgtatagtttcagtaaggttaacagaggagaaaccttatggaaactataaacctggcggcagcgcaaaagatg

SEQ ID NO: 76992 - DNA, 103 bp, Artificial Sequence
  Synthetic Polynucleotide
taatacgactcactataggggtatgaaaacaaaaaaattggtattagctaaacagaggagatagctaatgccaatttttaacctggcggcagcgcaaaagatg

SEQ ID NO: 76993 - DNA, 103 bp, Artificial Sequence
  Synthetic Polynucleotide
taatacgactcactatagggcatatgtatgaaaacaaaaaaattggtattaacagaggagaaataccatgttttttgttaacctggcggcagcgcaaaagatg

SEQ ID NO: 76994 - DNA, 103 bp, Artificial Sequence
  Synthetic Polynucleotide
taatacgactcactatagggcgtaccatatgtatgaaaacaaaaaaattgaacagaggagacaatttatgtgttttcataacctggcggcagcgcaaaagatg

SEQ ID NO: 76995 - DNA, 103 bp, Artificial Sequence
  Synthetic Polynucleotide
taatacgactcactatagggaacatcgtaccatatgtatgaaaacaaaaaaacagaggagatttttgatgtcatacataaacctggcggcagcgcaaaagatg

SEQ ID NO: 76996 - DNA, 103 bp, Artificial Sequence
  Synthetic Polynucleotide
taatacgactcactatagggtttacaacatcgtaccatatgtatgaaaacaacagaggagagttttcatgcatatggtaaacctggcggcagcgcaaaagatg

SEQ ID NO: 76997 - DNA, 103 bp, Artificial Sequence
  Synthetic Polynucleotide
taatacgactcactatagggtacactttacaacatcgtaccatatgtatgaacagaggagacatacaatgggtacgatgaacctggcggcagcgcaaaagatg

SEQ ID NO: 76998 - DNA, 103 bp, Artificial Sequence
  Synthetic Polynucleotide
taatacgactcactatagggcttcgtacactttacaacatcgtaccatataacagaggagaatatggatggatgttgtaaacctggcggcagcgcaaaagatg

SEQ ID NO: 76999 - DNA, 103 bp, Artificial Sequence
  Synthetic Polynucleotide
taatacgactcactatagggaaccgcttcgtacactttacaacatcgtacaacagaggagagtacgaatgtgtaaagtgaacctggcggcagcgcaaaagatg

SEQ ID NO: 77000 - DNA, 103 bp, Artificial Sequence
  Synthetic Polynucleotide
taatacgactcactatagggcgtaaaaccgcttcgtacactttacaacataacagaggagaatgttgatgagtgtacgaaacctggcggcagcgcaaaagatg

SEQ ID NO: 77001 - DNA, 103 bp, Artificial Sequence
  Synthetic Polynucleotide
taatacgactcactatagggcgtgtcgtaaaaccgcttcgtacactttacaacagaggagagtaaagatgacgaagcggaacctggcggcagcgcaaaagatg

SEQ ID NO: 77002 - DNA, 103 bp, Artificial Sequence
  Synthetic Polynucleotide
taatacgactcactatagggtttttttgacagttacgtatagtttcagtaaacagaggagatactgaatgtatacgtaaaacctggcggcagcgcaaaagatg

SEQ ID NO: 77003 - DNA, 103 bp, Artificial Sequence
  Synthetic Polynucleotide
taatacgactcactatagggaaatgcgtgtcgtaaaaccgcttcgtacacaacagaggagagtgtacatggcggttttaaacctggcggcagcgcaaaagatg

SEQ ID NO: 77004 - DNA, 103 bp, Artificial Sequence
  Synthetic Polynucleotide
taatacgactcactataggggcatcaaatgcgtgtcgtaaaaccgcttcgaacagaggagacgaagcatgtttacgacaaacctggcggcagcgcaaaagatg

SEQ ID NO: 77005 - DNA, 103 bp, Artificial Sequence
  Synthetic Polynucleotide
taatacgactcactatagggtgggtgcatcaaatgcgtgtcgtaaaaccgaacagaggagacggtttatggacacgcataacctggcggcagcgcaaaagatg

SEQ ID NO: 77006 - DNA, 103 bp, Artificial Sequence
  Synthetic Polynucleotide
taatacgactcactatagggcaacgtgggtgcatcaaatgcgtgtcgtaaaacagaggagattacgaatggcatttgataacctggcggcagcgcaaaagatg

SEQ ID NO: 77007 - DNA, 103 bp, Artificial Sequence
  Synthetic Polynucleotide
taatacgactcactatagggacgtacaacgtgggtgcatcaaatgcgtgtaacagaggagaacacgcatgtgatgcaccaacctggcggcagcgcaaaagatg

SEQ ID NO: 77008 - DNA, 103 bp, Artificial Sequence
  Synthetic Polynucleotide
taatacgactcactatagggctttaacgtacaacgtgggtgcatcaaatgaacagaggagacatttgatgcacccacgtaacctggcggcagcgcaaaagatg

SEQ ID NO: 77009 - DNA, 103 bp, Artificial Sequence
  Synthetic Polynucleotide
taatacgactcactatagggcaatgctttaacgtacaacgtgggtgcatcaacagaggagagatgcaatgacgttgtacaacctggcggcagcgcaaaagatg

SEQ ID NO: 77010 - DNA, 103 bp, Artificial Sequence
  Synthetic Polynucleotide
taatacgactcactatagggttagtcaatgctttaacgtacaacgtgggtaacagaggagaacccacatggtacgttaaaacctggcggcagcgcaaaagatg

SEQ ID NO: 77011 - DNA, 103 bp, Artificial Sequence
  Synthetic Polynucleotide
taatacgactcactatagggaattcttagtcaatgctttaacgtacaacgaacagaggagacgttgtatgttaaagcataacctggcggcagcgcaaaagatg

SEQ ID NO: 77012 - DNA, 103 bp, Artificial Sequence
  Synthetic Polynucleotide
taatacgactcactatagggtaaataattcttagtcaatgctttaacgtaaacagaggagatacgttatggcattgactaacctggcggcagcgcaaaagatg

SEQ ID NO: 77013 - DNA, 103 bp, Artificial Sequence
  Synthetic Polynucleotide
taatacgactcactatagggcttcaacgataagtatatcgacatactactaacagaggagaagtagtatgtcgatatacaacctggcggcagcgcaaaagatg

SEQ ID NO: 77014 - DNA, 103 bp, Artificial Sequence
  Synthetic Polynucleotide
taatacgactcactatagggttctatttttttgacagttacgtatagtttaacagaggagaaaactaatggtaactgtcaacctggcggcagcgcaaaagatg

SEQ ID NO: 77015 - DNA, 103 bp, Artificial Sequence
  Synthetic Polynucleotide
taatacgactcactatagggaacgataaataattcttagtcaatgctttaaacagaggagataaagcatggactaagaaaacctggcggcagcgcaaaagatg

SEQ ID NO: 77016 - DNA, 103 bp, Artificial Sequence
  Synthetic Polynucleotide
taatacgactcactatagggtactaaacgataaataattcttagtcaatgaacagaggagacattgaatgagaattattaacctggcggcagcgcaaaagatg

SEQ ID NO: 77017 - DNA, 103 bp, Artificial Sequence
  Synthetic Polynucleotide
taatacgactcactatagggtgcgttactaaacgataaataattcttagtaacagaggagaactaagatgtatttatcgaacctggcggcagcgcaaaagatg

SEQ ID NO: 77018 - DNA, 103 bp, Artificial Sequence
  Synthetic Polynucleotide
taatacgactcactatagggtgtattgcgttactaaacgataaataattcaacagaggagagaattaatgatcgtttagaacctggcggcagcgcaaaagatg

SEQ ID NO: 77019 - DNA, 103 bp, Artificial Sequence
  Synthetic Polynucleotide
taatacgactcactatagggacgattgtattgcgttactaaacgataaataacagaggagaatttatatgttagtaacgaacctggcggcagcgcaaaagatg

SEQ ID NO: 77020 - DNA, 103 bp, Artificial Sequence
  Synthetic Polynucleotide
taatacgactcactatagggcttgtacgattgtattgcgttactaaacgaaacagaggagatcgtttatgaacgcaataaacctggcggcagcgcaaaagatg

SEQ ID NO: 77021 - DNA, 103 bp, Artificial Sequence
  Synthetic Polynucleotide
taatacgactcactataggggtttccttgtacgattgtattgcgttactaaacagaggagatagtaaatgaatacaatcaacctggcggcagcgcaaaagatg

SEQ ID NO: 77022 - DNA, 103 bp, Artificial Sequence
  Synthetic Polynucleotide
taatacgactcactataggggcactgtttccttgtacgattgtattgcgtaacagaggagaacgcaaatgaatcgtacaaacctggcggcagcgcaaaagatg

SEQ ID NO: 77023 - DNA, 103 bp, Artificial Sequence
  Synthetic Polynucleotide
taatacgactcactatagggtttatgcactgtttccttgtacgattgtataacagaggagaatacaaatgtacaaggaaaacctggcggcagcgcaaaagatg

SEQ ID NO: 77024 - DNA, 103 bp, Artificial Sequence
  Synthetic Polynucleotide
taatacgactcactataggggttagtttatgcactgtttccttgtacgataacagaggagaatcgtaatgggaaacagtaacctggcggcagcgcaaaagatg

SEQ ID NO: 77025 - DNA, 103 bp, Artificial Sequence
  Synthetic Polynucleotide
taatacgactcactatagggtatgtttctatttttttgacagttacgtataacagaggagaatacgtatgtgtcaaaaaaacctggcggcagcgcaaaagatg

SEQ ID NO: 77026 - DNA, 103 bp, Artificial Sequence
  Synthetic Polynucleotide
taatacgactcactatagggcttgtgttagtttatgcactgtttccttgtaacagaggagaacaaggatgcagtgcataaacctggcggcagcgcaaaagatg

SEQ ID NO: 77027 - DNA, 103 bp, Artificial Sequence
  Synthetic Polynucleotide
taatacgactcactatagggttcatcttgtgttagtttatgcactgtttcaacagaggagagaaacaatgcataaactaaacctggcggcagcgcaaaagatg

SEQ ID NO: 77028 - DNA, 103 bp, Artificial Sequence
  Synthetic Polynucleotide
taatacgactcactatagggaatttttcatcttgtgttagtttatgcactaacagaggagaagtgcaatgactaacacaaacctggcggcagcgcaaaagatg

SEQ ID NO: 77029 - DNA, 103 bp, Artificial Sequence
  Synthetic Polynucleotide
taatacgactcactatagggctaaaaatttttcatcttgtgttagtttataacagaggagaataaacatgcacaagatgaacctggcggcagcgcaaaagatg

SEQ ID NO: 77030 - DNA, 103 bp, Artificial Sequence
  Synthetic Polynucleotide
taatacgactcactatagggtacctctaaaaatttttcatcttgtgttagaacagaggagactaacaatggatgaaaaaaacctggcggcagcgcaaaagatg

SEQ ID NO: 77031 - DNA, 103 bp, Artificial Sequence
  Synthetic Polynucleotide
taatacgactcactatagggtcggctacctctaaaaatttttcatcttgtaacagaggagaacaagaatgaaaatttttaacctggcggcagcgcaaaagatg

SEQ ID NO: 77032 - DNA, 103 bp, Artificial Sequence
  Synthetic Polynucleotide
taatacgactcactatagggtgtattcggctacctctaaaaatttttcataacagaggagaatgaaaatgttttagaggaacctggcggcagcgcaaaagatg

SEQ ID NO: 77033 - DNA, 103 bp, Artificial Sequence
  Synthetic Polynucleotide
taatacgactcactatagggttccatgtattcggctacctctaaaaatttaacagaggagaaaatttatggaggtagccaacctggcggcagcgcaaaagatg

SEQ ID NO: 77034 - DNA, 103 bp, Artificial Sequence
  Synthetic Polynucleotide
taatacgactcactatagggaattcttccatgtattcggctacctctaaaaacagaggagatttagaatgagccgaataaacctggcggcagcgcaaaagatg

SEQ ID NO: 77035 - DNA, 103 bp, Artificial Sequence
  Synthetic Polynucleotide
taatacgactcactatagggctcctaattcttccatgtattcggctacctaacagaggagaaggtagatgaatacatggaacctggcggcagcgcaaaagatg

SEQ ID NO: 77036 - DNA, 103 bp, Artificial Sequence
  Synthetic Polynucleotide
taatacgactcactatagggccatatatgtttctatttttttgacagttaaacagaggagataactgatgaaaaaatagaacctggcggcagcgcaaaagatg

SEQ ID NO: 77037 - DNA, 103 bp, Artificial Sequence
  Synthetic Polynucleotide
taatacgactcactatagggaagttctcctaattcttccatgtattcggcaacagaggagagccgaaatgatggaagaaaacctggcggcagcgcaaaagatg

SEQ ID NO: 77038 - DNA, 103 bp, Artificial Sequence
  Synthetic Polynucleotide
taatacgactcactatagggcctataagttctcctaattcttccatgtataacagaggagaatacatatgagaattaggaacctggcggcagcgcaaaagatg

SEQ ID NO: 77039 - DNA, 103 bp, Artificial Sequence
  Synthetic Polynucleotide
taatacgactcactatagggttacccctataagttctcctaattcttccaaacagaggagatggaagatgtaggagaacaacctggcggcagcgcaaaagatg

SEQ ID NO: 77040 - DNA, 103 bp, Artificial Sequence
  Synthetic Polynucleotide
taatacgactcactatagggataatttacccctataagttctcctaattcaacagaggagagaattaatggaacttataaacctggcggcagcgcaaaagatg

SEQ ID NO: 77041 - DNA, 103 bp, Artificial Sequence
  Synthetic Polynucleotide
taatacgactcactatagggaagtcataatttacccctataagttctcctaacagaggagaaggagaatgtataggggtaacctggcggcagcgcaaaagatg

SEQ ID NO: 77042 - DNA, 103 bp, Artificial Sequence
  Synthetic Polynucleotide
taatacgactcactataggggaactaagtcataatttacccctataagttaacagaggagaaacttaatggggtaaattaacctggcggcagcgcaaaagatg

SEQ ID NO: 77043 - DNA, 103 bp, Artificial Sequence
  Synthetic Polynucleotide
taatacgactcactatagggattaagaactaagtcataatttacccctataacagaggagaatagggatgaattatgacaacctggcggcagcgcaaaagatg

SEQ ID NO: 77044 - DNA, 103 bp, Artificial Sequence
  Synthetic Polynucleotide
taatacgactcactatagggaatggattaagaactaagtcataatttaccaacagaggagaggtaaaatgtgacttagtaacctggcggcagcgcaaaagatg

SEQ ID NO: 77045 - DNA, 103 bp, Artificial Sequence
  Synthetic Polynucleotide
taatacgactcactataggggaaataatggattaagaactaagtcataataacagaggagaattatgatgtagttcttaaacctggcggcagcgcaaaagatg

SEQ ID NO: 77046 - DNA, 103 bp, Artificial Sequence
  Synthetic Polynucleotide
taatacgactcactatagggtccgtgaaataatggattaagaactaagtcaacagaggagagacttaatgcttaatccaaacctggcggcagcgcaaaagatg

SEQ ID NO: 77047 - DNA, 103 bp, Artificial Sequence
  Synthetic Polynucleotide
taatacgactcactatagggatagaccatatatgtttctatttttttgacaacagaggagagtcaaaatgatagaaacaaacctggcggcagcgcaaaagatg

SEQ ID NO: 77048 - DNA, 103 bp, Artificial Sequence
  Synthetic Polynucleotide
taatacgactcactatagggtcccctccgtgaaataatggattaagaactaacagaggagaagttctatgtccattattaacctggcggcagcgcaaaagatg

SEQ ID NO: 77049 - DNA, 103 bp, Artificial Sequence
  Synthetic Polynucleotide
taatacgactcactatagggtgggttcccctccgtgaaataatggattaaaacagaggagattaatcatgtatttcacgaacctggcggcagcgcaaaagatg

SEQ ID NO: 77050 - DNA, 103 bp, Artificial Sequence
  Synthetic Polynucleotide
taatacgactcactatagggtttgatgggttcccctccgtgaaataatggaacagaggagaccattaatgcacggagggaacctggcggcagcgcaaaagatg

SEQ ID NO: 77051 - DNA, 103 bp, Artificial Sequence
  Synthetic Polynucleotide
taatacgactcactatagggatatctttgatgggttcccctccgtgaaataacagaggagaatttcaatgaggggaaccaacctggcggcagcgcaaaagatg

SEQ ID NO: 77052 - DNA, 103 bp, Artificial Sequence
  Synthetic Polynucleotide
taatacgactcactatagggtttccatatctttgatgggttcccctccgtaacagaggagaacggagatgaacccatcaaacctggcggcagcgcaaaagatg

SEQ ID NO: 77053 - DNA, 103 bp, Artificial Sequence
  Synthetic Polynucleotide
taatacgactcactatagggaatgatttccatatctttgatgggttccccaacagaggagaggggaaatgatcaaagataacctggcggcagcgcaaaagatg

SEQ ID NO: 77054 - DNA, 103 bp, Artificial Sequence
  Synthetic Polynucleotide
taatacgactcactatagggaaaaaaatgatttccatatctttgatgggtaacagaggagaacccatatgagatatggaaacctggcggcagcgcaaaagatg

SEQ ID NO: 77055 - DNA, 103 bp, Artificial Sequence
  Synthetic Polynucleotide
taatacgactcactataggggttttaaaaaaatgatttccatatctttgaaacagaggagatcaaagatgtggaaatcaaacctggcggcagcgcaaaagatg

SEQ ID NO: 77056 - DNA, 103 bp, Artificial Sequence
  Synthetic Polynucleotide
taatacgactcactatagggaaacagttttaaaaaaatgatttccatatcaacagaggagagatatgatgatcatttttaacctggcggcagcgcaaaagatg

SEQ ID NO: 77057 - DNA, 103 bp, Artificial Sequence
  Synthetic Polynucleotide
taatacgactcactatagggttcttaaacagttttaaaaaaatgatttccaacagaggagaggaaatatgttttttaaaaacctggcggcagcgcaaaagatg

SEQ ID NO: 77058 - DNA, 103 bp, Artificial Sequence
  Synthetic Polynucleotide
taatacgactcactatagggtatatatagaccatatatgtttctatttttaacagaggagaaaaaatatgaacatatataacctggcggcagcgcaaaagatg

SEQ ID NO: 77059 - DNA, 103 bp, Artificial Sequence
  Synthetic Polynucleotide
taatacgactcactatagggctgttttcttaaacagttttaaaaaaatgaaacagaggagatcatttatgtaaaactgtaacctggcggcagcgcaaaagatg

SEQ ID NO: 77060 - DNA, 103 bp, Artificial Sequence
  Synthetic Polynucleotide
taatacgactcactatagggaaagtctgttttcttaaacagttttaaaaaaacagaggagatttttaatgctgtttaagaacctggcggcagcgcaaaagatg

SEQ ID NO: 77061 - DNA, 103 bp, Artificial Sequence
  Synthetic Polynucleotide
taatacgactcactatagggactttaaagtctgttttcttaaacagttttaacagaggagaaaaactatgtaagaaaacaacctggcggcagcgcaaaagatg

SEQ ID NO: 77062 - DNA, 103 bp, Artificial Sequence
  Synthetic Polynucleotide
taatacgactcactatagggtaacaactttaaagtctgttttcttaaacaaacagaggagatgtttaatgaaacagactaacctggcggcagcgcaaaagatg

SEQ ID NO: 77063 - DNA, 103 bp, Artificial Sequence
  Synthetic Polynucleotide
taatacgactcactatagggttttttaacaactttaaagtctgttttcttaacagaggagaaagaaaatggactttaaaaacctggcggcagcgcaaaagatg

SEQ ID NO: 77064 - DNA, 103 bp, Artificial Sequence
  Synthetic Polynucleotide
taatacgactcactatagggcttaattttttaacaactttaaagtctgttaacagaggagaaacagaatgtaaagttgtaacctggcggcagcgcaaaagatg

SEQ ID NO: 77065 - DNA, 103 bp, Artificial Sequence
  Synthetic Polynucleotide
taatacgactcactatagggtaacacttaattttttaacaactttaaagtaacagaggagaactttaatgttgttaaaaaacctggcggcagcgcaaaagatg

SEQ ID NO: 77066 - DNA, 103 bp, Artificial Sequence
  Synthetic Polynucleotide
taatacgactcactatagggtcttataacacttaattttttaacaactttaacagaggagaaaagttatgaaaaaattaaacctggcggcagcgcaaaagatg

SEQ ID NO: 77067 - DNA, 103 bp, Artificial Sequence
  Synthetic Polynucleotide
taatacgactcactatagggagtaatcttataacacttaattttttaacaaacagaggagatgttaaatgattaagtgtaacctggcggcagcgcaaaagatg

SEQ ID NO: 77068 - DNA, 103 bp, Artificial Sequence
  Synthetic Polynucleotide
taatacgactcactatagggaaataagtaatcttataacacttaatttttaacagaggagaaaaaatatggtgttataaaacctggcggcagcgcaaaagatg

SEQ ID NO: 77069 - DNA, 103 bp, Artificial Sequence
  Synthetic Polynucleotide
taatacgactcactatagggtagtgtatatatagaccatatatgtttctaaacagaggagatagaaaatgatatggtctaacctggcggcagcgcaaaagatg

SEQ ID NO: 77070 - DNA, 103 bp, Artificial Sequence
  Synthetic Polynucleotide
taatacgactcactatagggagcccaaataagtaatcttataacacttaaaacagaggagattaagtatgataagattaaacctggcggcagcgcaaaagatg

SEQ ID NO: 77071 - DNA, 103 bp, Artificial Sequence
  Synthetic Polynucleotide
taatacgactcactatagggaggtaagcccaaataagtaatcttataacaaacagaggagatgttatatgattacttataacctggcggcagcgcaaaagatg

SEQ ID NO: 77072 - DNA, 103 bp, Artificial Sequence
  Synthetic Polynucleotide
taatacgactcactatagggtgcttaggtaagcccaaataagtaatcttaaacagaggagataagatatgttatttgggaacctggcggcagcgcaaaagatg

SEQ ID NO: 77073 - DNA, 103 bp, Artificial Sequence
  Synthetic Polynucleotide
taatacgactcactatagggtttcttgcttaggtaagcccaaataagtaaaacagaggagattacttatgtgggcttacaacctggcggcagcgcaaaagatg

SEQ ID NO: 77074 - DNA, 103 bp, Artificial Sequence
  Synthetic Polynucleotide
taatacgactcactataggggtatctttcttgcttaggtaagcccaaataaacagaggagatatttgatgttacctaagaacctggcggcagcgcaaaagatg

SEQ ID NO: 77075 - DNA, 103 bp, Artificial Sequence
  Synthetic Polynucleotide
taatacgactcactatagggtacctgtatctttcttgcttaggtaagcccaacagaggagagggcttatgtaagcaagaaacctggcggcagcgcaaaagatg

SEQ ID NO: 77076 - DNA, 103 bp, Artificial Sequence
  Synthetic Polynucleotide
taatacgactcactatagggctctatacctgtatctttcttgcttaggtaaacagaggagatacctaatgaagaaagataacctggcggcagcgcaaaagatg

SEQ ID NO: 77077 - DNA, 103 bp, Artificial Sequence
  Synthetic Polynucleotide
taatacgactcactataggggcaaactctatacctgtatctttcttgcttaacagaggagaaagcaaatgagatacaggaacctggcggcagcgcaaaagatg

SEQ ID NO: 77078 - DNA, 103 bp, Artificial Sequence
  Synthetic Polynucleotide
taatacgactcactatagggtatccgcaaactctatacctgtatctttctaacagaggagaagaaagatgcaggtatagaacctggcggcagcgcaaaagatg

SEQ ID NO: 77079 - DNA, 103 bp, Artificial Sequence
  Synthetic Polynucleotide
taatacgactcactatagggatcattatccgcaaactctatacctgtatcaacagaggagagatacaatgatagagtttaacctggcggcagcgcaaaagatg

SEQ ID NO: 77080 - DNA, 103 bp, Artificial Sequence
  Synthetic Polynucleotide
taatacgactcactatagggaattgtagtgtatatatagaccatatatgtaacagaggagaacatatatggtctatataaacctggcggcagcgcaaaagatg

SEQ ID NO: 77081 - DNA, 103 bp, Artificial Sequence
  Synthetic Polynucleotide
taatacgactcactatagggtgtctatcattatccgcaaactctatacctaacagaggagaaggtatatggtttgcggaaacctggcggcagcgcaaaagatg

SEQ ID NO: 77082 - DNA, 103 bp, Artificial Sequence
  Synthetic Polynucleotide
taatacgactcactatagggtatcttgtctatcattatccgcaaactctaaacagaggagatagagtatgcggataatgaacctggcggcagcgcaaaagatg

SEQ ID NO: 77083 - DNA, 103 bp, Artificial Sequence
  Synthetic Polynucleotide
taatacgactcactatagggatatatatcttgtctatcattatccgcaaaaacagaggagatttgcgatgaatgatagaaacctggcggcagcgcaaaagatg

SEQ ID NO: 77084 - DNA, 103 bp, Artificial Sequence
  Synthetic Polynucleotide
taatacgactcactatagggagagtatatatatcttgtctatcattatccaacagaggagaggataaatgtagacaagaaacctggcggcagcgcaaaagatg

SEQ ID NO: 77085 - DNA, 103 bp, Artificial Sequence
  Synthetic Polynucleotide
taatacgactcactataggggaaatagagtatatatatcttgtctatcataacagaggagaatgataatgaagatatataacctggcggcagcgcaaaagatg

SEQ ID NO: 77086 - DNA, 103 bp, Artificial Sequence
  Synthetic Polynucleotide
taatacgactcactataggggtgttgaaatagagtatatatatcttgtctaacagaggagaagacaaatgatatatactaacctggcggcagcgcaaaagatg

SEQ ID NO: 77087 - DNA, 103 bp, Artificial Sequence
  Synthetic Polynucleotide
taatacgactcactatagggccagtgtgttgaaatagagtatatatatctaacagaggagaagatatatgtactctattaacctggcggcagcgcaaaagatg

SEQ ID NO: 77088 - DNA, 103 bp, Artificial Sequence
  Synthetic Polynucleotide
taatacgactcactatagggttctaccagtgtgttgaaatagagtatataaacagaggagatatataatgtatttcaacaacctggcggcagcgcaaaagatg

SEQ ID NO: 77089 - DNA, 103 bp, Artificial Sequence
  Synthetic Polynucleotide
taatacgactcactataggggactattctaccagtgtgttgaaatagagtaacagaggagaactctaatgcaacacactaacctggcggcagcgcaaaagatg

SEQ ID NO: 77090 - DNA, 103 bp, Artificial Sequence
  Synthetic Polynucleotide
taatacgactcactatagggctatggactattctaccagtgtgttgaaataacagaggagaatttcaatgcactggtagaacctggcggcagcgcaaaagatg

SEQ ID NO: 77091 - DNA, 103 bp, Artificial Sequence
  Synthetic Polynucleotide
taatacgactcactatagggaactaaattgtagtgtatatatagaccataaacagaggagatatggtatgtatatacacaacctggcggcagcgcaaaagatg

SEQ ID NO: 77092 - DNA, 103 bp, Artificial Sequence
  Synthetic Polynucleotide
taatacgactcactataggggattgctatggactattctaccagtgtgttaacagaggagaaacacaatggtagaatagaacctggcggcagcgcaaaagatg

SEQ ID NO: 77093 - DNA, 103 bp, Artificial Sequence
  Synthetic Polynucleotide
taatacgactcactatagggtgttagattgctatggactattctaccagtaacagaggagaactggtatgatagtccataacctggcggcagcgcaaaagatg

SEQ ID NO: 77094 - DNA, 103 bp, Artificial Sequence
  Synthetic Polynucleotide
taatacgactcactataggggtttctgttagattgctatggactattctaaacagaggagatagaatatgccatagcaaaacctggcggcagcgcaaaagatg

SEQ ID NO: 77095 - DNA, 103 bp, Artificial Sequence
  Synthetic Polynucleotide
taatacgactcactatagggtaaacgtttctgttagattgctatggactaaacagaggagatagtccatggcaatctaaaacctggcggcagcgcaaaagatg

SEQ ID NO: 77096 - DNA, 103 bp, Artificial Sequence
  Synthetic Polynucleotide
taatacgactcactatagggatctctaaacgtttctgttagattgctatgaacagaggagacatagcatgctaacagaaaacctggcggcagcgcaaaagatg

SEQ ID NO: 77097 - DNA, 103 bp, Artificial Sequence
  Synthetic Polynucleotide
taatacgactcactatagggatataatctctaaacgtttctgttagattgaacagaggagacaatctatgagaaacgttaacctggcggcagcgcaaaagatg

SEQ ID NO: 77098 - DNA, 103 bp, Artificial Sequence
  Synthetic Polynucleotide
taatacgactcactataggggaaagatataatctctaaacgtttctgttaaacagaggagataacagatgcgtttagagaacctggcggcagcgcaaaagatg

SEQ ID NO: 77099 - DNA, 103 bp, Artificial Sequence
  Synthetic Polynucleotide
taatacgactcactatagggtccgggaaagatataatctctaaacgtttcaacagaggagagaaacgatgagagattataacctggcggcagcgcaaaagatg

SEQ ID NO: 77100 - DNA, 103 bp, Artificial Sequence
  Synthetic Polynucleotide
taatacgactcactatagggttatctccgggaaagatataatctctaaacaacagaggagagtttagatgttatatcttaacctggcggcagcgcaaaagatg

SEQ ID NO: 77101 - DNA, 103 bp, Artificial Sequence
  Synthetic Polynucleotide
taatacgactcactatagggtagtcttatctccgggaaagatataatctcaacagaggagagagattatgtctttcccgaacctggcggcagcgcaaaagatg

SEQ ID NO: 77102 - DNA, 103 bp, Artificial Sequence
  Synthetic Polynucleotide
taatacgactcactatagggttaataactaaattgtagtgtatatatagaaacagaggagatctataatgacactacaaaacctggcggcagcgcaaaagatg

SEQ ID NO: 77103 - DNA, 103 bp, Artificial Sequence
  Synthetic Polynucleotide
taatacgactcactatagggatagctagtcttatctccgggaaagatataaacagaggagatatatcatgcccggagataacctggcggcagcgcaaaagatg

SEQ ID NO: 77104 - DNA, 103 bp, Artificial Sequence
  Synthetic Polynucleotide
taatacgactcactatagggacccaatagctagtcttatctccgggaaagaacagaggagactttccatgagataagacaacctggcggcagcgcaaaagatg

SEQ ID NO: 77105 - DNA, 103 bp, Artificial Sequence
  Synthetic Polynucleotide
taatacgactcactatagggaccacacccaatagctagtcttatctccggaacagaggagaccggagatgagactagctaacctggcggcagcgcaaaagatg

SEQ ID NO: 77106 - DNA, 103 bp, Artificial Sequence
  Synthetic Polynucleotide
taatacgactcactataggggtttaaccacacccaatagctagtcttatcaacagaggagagataagatgagctattggaacctggcggcagcgcaaaagatg

SEQ ID NO: 77107 - DNA, 103 bp, Artificial Sequence
  Synthetic Polynucleotide
taatacgactcactatagggctttcgtttaaccacacccaatagctagtcaacagaggagagactagatgttgggtgtgaacctggcggcagcgcaaaagatg

SEQ ID NO: 77108 - DNA, 103 bp, Artificial Sequence
  Synthetic Polynucleotide
taatacgactcactatagggctatactttcgtttaaccacacccaatagcaacagaggagagctattatgtgtggttaaaacctggcggcagcgcaaaagatg

SEQ ID NO: 77109 - DNA, 103 bp, Artificial Sequence
  Synthetic Polynucleotide
taatacgactcactatagggattagctatactttcgtttaaccacacccaaacagaggagatgggtgatgttaaacgaaaacctggcggcagcgcaaaagatg

SEQ ID NO: 77110 - DNA, 103 bp, Artificial Sequence
  Synthetic Polynucleotide
taatacgactcactataggggcatcattagctatactttcgtttaaccacaacagaggagagtggttatgcgaaagtataacctggcggcagcgcaaaagatg

SEQ ID NO: 77111 - DNA, 103 bp, Artificial Sequence
  Synthetic Polynucleotide
taatacgactcactatagggtatctgcatcattagctatactttcgtttaaacagaggagataaacgatggtatagctaaacctggcggcagcgcaaaagatg

SEQ ID NO: 77112 - DNA, 103 bp, Artificial Sequence
  Synthetic Polynucleotide
taatacgactcactatagggaacgatatctgcatcattagctatactttcaacagaggagagaaagtatggctaatgataacctggcggcagcgcaaaagatg

SEQ ID NO: 77113 - DNA, 103 bp, Artificial Sequence
  Synthetic Polynucleotide
taatacgactcactatagggccacattaataactaaattgtagtgtatataacagaggagaatatacatgacaatttagaacctggcggcagcgcaaaagatg

SEQ ID NO: 77114 - DNA, 103 bp, Artificial Sequence
  Synthetic Polynucleotide
taatacgactcactatagggttaagaacgatatctgcatcattagctataaacagaggagatatagcatgtgatgcagaaacctggcggcagcgcaaaagatg

SEQ ID NO: 77115 - DNA, 103 bp, Artificial Sequence
  Synthetic Polynucleotide
taatacgactcactataggggtctattaagaacgatatctgcatcattagaacagaggagactaatgatgcagatatcgaacctggcggcagcgcaaaagatg

SEQ ID NO: 77116 - DNA, 103 bp, Artificial Sequence
  Synthetic Polynucleotide
taatacgactcactatagggggcgggtctattaagaacgatatctgcatcaacagaggagagatgcaatgatcgttcttaacctggcggcagcgcaaaagatg

SEQ ID NO: 77117 - DNA, 103 bp, Artificial Sequence
  Synthetic Polynucleotide
taatacgactcactataggggtaatggcgggtctattaagaacgatatctaacagaggagaagatatatgtcttaatagaacctggcggcagcgcaaaagatg

SEQ ID NO: 77118 - DNA, 103 bp, Artificial Sequence
  Synthetic Polynucleotide
taatacgactcactatagggacatggtaatggcgggtctattaagaacgaaacagaggagatcgttcatgatagacccgaacctggcggcagcgcaaaagatg

SEQ ID NO: 77119 - DNA, 103 bp, Artificial Sequence
  Synthetic Polynucleotide
taatacgactcactatagggatcatacatggtaatggcgggtctattaagaacagaggagacttaatatgcccgccattaacctggcggcagcgcaaaagatg

SEQ ID NO: 77120 - DNA, 103 bp, Artificial Sequence
  Synthetic Polynucleotide
taatacgactcactatagggattttatcatacatggtaatggcgggtctaaacagaggagatagaccatgcattaccataacctggcggcagcgcaaaagatg

SEQ ID NO: 77121 - DNA, 103 bp, Artificial Sequence
  Synthetic Polynucleotide
taatacgactcactatagggtaagaattttatcatacatggtaatggcggaacagaggagaccgccaatgccatgtatgaacctggcggcagcgcaaaagatg

SEQ ID NO: 77122 - DNA, 103 bp, Artificial Sequence
  Synthetic Polynucleotide
taatacgactcactatagggataactaagaattttatcatacatggtaataacagaggagaattaccatgtatgataaaaacctggcggcagcgcaaaagatg

SEQ ID NO: 77123 - DNA, 103 bp, Artificial Sequence
  Synthetic Polynucleotide
taatacgactcactatagggtatatataactaagaattttatcatacatgaacagaggagacatgtaatgtaaaattctaacctggcggcagcgcaaaagatg

SEQ ID NO: 77124 - DNA, 103 bp, Artificial Sequence
  Synthetic Polynucleotide
taatacgactcactatagggagagtcttcaacgataagtatatcgacataaacagaggagatatgtcatgatacttatcaacctggcggcagcgcaaaagatg

SEQ ID NO: 77125 - DNA, 103 bp, Artificial Sequence
  Synthetic Polynucleotide
taatacgactcactatagggaataaccacattaataactaaattgtagtgaacagaggagacactacatgttagttattaacctggcggcagcgcaaaagatg

SEQ ID NO: 77126 - DNA, 103 bp, Artificial Sequence
  Synthetic Polynucleotide
taatacgactcactatagggcagagtatatataactaagaattttatcataacagaggagaatgataatgttcttagttaacctggcggcagcgcaaaagatg

SEQ ID NO: 77127 - DNA, 103 bp, Artificial Sequence
  Synthetic Polynucleotide
taatacgactcactatagggtatctcagagtatatataactaagaattttaacagaggagaaaaattatgagttatataaacctggcggcagcgcaaaagatg

SEQ ID NO: 77128 - DNA, 103 bp, Artificial Sequence
  Synthetic Polynucleotide
taatacgactcactatagggtgttttatctcagagtatatataactaagaaacagaggagatcttagatgtatatactcaacctggcggcagcgcaaaagatg

SEQ ID NO: 77129 - DNA, 103 bp, Artificial Sequence
  Synthetic Polynucleotide
taatacgactcactataggggtccctgttttatctcagagtatatataacaacagaggagagttataatgactctgagaaacctggcggcagcgcaaaagatg

SEQ ID NO: 77130 - DNA, 103 bp, Artificial Sequence
  Synthetic Polynucleotide
taatacgactcactatagggaacacgtccctgttttatctcagagtatataacagaggagaatatacatggagataaaaaacctggcggcagcgcaaaagatg

SEQ ID NO: 77131 - DNA, 103 bp, Artificial Sequence
  Synthetic Polynucleotide
taatacgactcactatagggttattaacacgtccctgttttatctcagagaacagaggagactctgaatgaaaacagggaacctggcggcagcgcaaaagatg

SEQ ID NO: 77132 - DNA, 103 bp, Artificial Sequence
  Synthetic Polynucleotide
taatacgactcactatagggtgtttttattaacacgtccctgttttatctaacagaggagaagataaatgagggacgtgaacctggcggcagcgcaaaagatg

SEQ ID NO: 77133 - DNA, 103 bp, Artificial Sequence
  Synthetic Polynucleotide
taatacgactcactatagggaagcatgtttttattaacacgtccctgtttaacagaggagaaaacagatgcgtgttaataacctggcggcagcgcaaaagatg

SEQ ID NO: 77134 - DNA, 103 bp, Artificial Sequence
  Synthetic Polynucleotide
taatacgactcactatagggaacttaagcatgtttttattaacacgtcccaacagaggagagggacgatgtaataaaaaaacctggcggcagcgcaaaagatg

SEQ ID NO: 77135 - DNA, 103 bp, Artificial Sequence
  Synthetic Polynucleotide
taatacgactcactatagggaaactaacttaagcatgtttttattaacacaacagaggagagtgttaatgaaaacatgcaacctggcggcagcgcaaaagatg

SEQ ID NO: 77136 - DNA, 103 bp, Artificial Sequence
  Synthetic Polynucleotide
taatacgactcactatagggcaatcaataaccacattaataactaaattgaacagaggagacaatttatgtattaatgtaacctggcggcagcgcaaaagatg

SEQ ID NO: 77137 - DNA, 103 bp, Artificial Sequence
  Synthetic Polynucleotide
taatacgactcactataggggatataaactaacttaagcatgtttttattaacagaggagaaataaaatgatgcttaagaacctggcggcagcgcaaaagatg

SEQ ID NO: 77138 - DNA, 103 bp, Artificial Sequence
  Synthetic Polynucleotide
taatacgactcactatagggtcaaagatataaactaacttaagcatgtttaacagaggagaaaacatatgtaagttagtaacctggcggcagcgcaaaagatg

SEQ ID NO: 77139 - DNA, 103 bp, Artificial Sequence
  Synthetic Polynucleotide
taatacgactcactatagggcaggctcaaagatataaactaacttaagcaaacagaggagatgcttaatgtagtttataaacctggcggcagcgcaaaagatg

SEQ ID NO: 77140 - DNA, 103 bp, Artificial Sequence
  Synthetic Polynucleotide
taatacgactcactatagggtttttcaggctcaaagatataaactaacttaacagaggagaaagttaatgtatatctttaacctggcggcagcgcaaaagatg

SEQ ID NO: 77141 - DNA, 103 bp, Artificial Sequence
  Synthetic Polynucleotide
taatacgactcactatagggatatctttttcaggctcaaagatataaactaacagaggagaagtttaatgctttgagccaacctggcggcagcgcaaaagatg

SEQ ID NO: 77142 - DNA, 103 bp, Artificial Sequence
  Synthetic Polynucleotide
taatacgactcactatagggctctgatatctttttcaggctcaaagatataacagaggagaatatctatgagcctgaaaaacctggcggcagcgcaaaagatg

SEQ ID NO: 77143 - DNA, 103 bp, Artificial Sequence
  Synthetic Polynucleotide
taatacgactcactatagggaagttctctgatatctttttcaggctcaaaaacagaggagatttgagatggaaaaagataacctggcggcagcgcaaaagatg

SEQ ID NO: 77144 - DNA, 103 bp, Artificial Sequence
  Synthetic Polynucleotide
taatacgactcactatagggagcagaagttctctgatatctttttcaggcaacagaggagagcctgaatgagatatcagaacctggcggcagcgcaaaagatg

SEQ ID NO: 77145 - DNA, 103 bp, Artificial Sequence
  Synthetic Polynucleotide
taatacgactcactatagggtttctagcagaagttctctgatatctttttaacagaggagaaaaaagatgtcagagaacaacctggcggcagcgcaaaagatg

SEQ ID NO: 77146 - DNA, 103 bp, Artificial Sequence
  Synthetic Polynucleotide
taatacgactcactatagggtatgatttctagcagaagttctctgatatcaacagaggagagatatcatggaacttctgaacctggcggcagcgcaaaagatg

SEQ ID NO: 77147 - DNA, 103 bp, Artificial Sequence
  Synthetic Polynucleotide
taatacgactcactatagggttatccaatcaataaccacattaataactaaacagaggagatagttaatgatgtggttaaacctggcggcagcgcaaaagatg

SEQ ID NO: 77148 - DNA, 103 bp, Artificial Sequence
  Synthetic Polynucleotide
taatacgactcactatagggtcatatatgatttctagcagaagttctctgaacagaggagacagagaatgtctgctagaaacctggcggcagcgcaaaagatg

SEQ ID NO: 77149 - DNA, 103 bp, Artificial Sequence
  Synthetic Polynucleotide
taatacgactcactataggggaatatcatatatgatttctagcagaagttaacagaggagaaacttcatgtagaaatcaaacctggcggcagcgcaaaagatg

SEQ ID NO: 77150 - DNA, 103 bp, Artificial Sequence
  Synthetic Polynucleotide
taatacgactcactatagggtccaggaatatcatatatgatttctagcagaacagaggagactgctaatgatcatatataacctggcggcagcgcaaaagatg

SEQ ID NO: 77151 - DNA, 103 bp, Artificial Sequence
  Synthetic Polynucleotide
taatacgactcactatagggatatctccaggaatatcatatatgatttctaacagaggagaagaaatatgatatgatataacctggcggcagcgcaaaagatg

SEQ ID NO: 77152 - DNA, 103 bp, Artificial Sequence
  Synthetic Polynucleotide
taatacgactcactatagggataggatatctccaggaatatcatatatgaaacagaggagatcatatatgatattcctgaacctggcggcagcgcaaaagatg

SEQ ID NO: 77153 - DNA, 103 bp, Artificial Sequence
  Synthetic Polynucleotide
taatacgactcactatagggaatagataggatatctccaggaatatcataaacagaggagatatgatatgcctggagataacctggcggcagcgcaaaagatg

SEQ ID NO: 77154 - DNA, 103 bp, Artificial Sequence
  Synthetic Polynucleotide
taatacgactcactatagggtcaataatagataggatatctccaggaataaacagaggagatattccatgagatatcctaacctggcggcagcgcaaaagatg

SEQ ID NO: 77155 - DNA, 103 bp, Artificial Sequence
  Synthetic Polynucleotide
taatacgactcactatagggttgcatcaataatagataggatatctccagaacagaggagactggagatgtcctatctaaacctggcggcagcgcaaaagatg

SEQ ID NO: 77156 - DNA, 103 bp, Artificial Sequence
  Synthetic Polynucleotide
taatacgactcactataggggttttttgcatcaataatagataggatatcaacagaggagagatatcatgtctattattaacctggcggcagcgcaaaagatg

SEQ ID NO: 77157 - DNA, 103 bp, Artificial Sequence
  Synthetic Polynucleotide
taatacgactcactatagggtcgtcgttttttgcatcaataatagataggaacagaggagacctatcatgtattgatgcaacctggcggcagcgcaaaagatg

SEQ ID NO: 77158 - DNA, 103 bp, Artificial Sequence
  Synthetic Polynucleotide
taatacgactcactatagggatcggttatccaatcaataaccacattaataacagaggagaattaatatggttattgataacctggcggcagcgcaaaagatg

SEQ ID NO: 77159 - DNA, 103 bp, Artificial Sequence
  Synthetic Polynucleotide
taatacgactcactatagggtccaatcgtcgttttttgcatcaataatagaacagaggagactattaatgatgcaaaaaaacctggcggcagcgcaaaagatg

SEQ ID NO: 77160 - DNA, 103 bp, Artificial Sequence
  Synthetic Polynucleotide
taatacgactcactatagggttttttccaatcgtcgttttttgcatcaataacagaggagaattgatatgaaaaacgacaacctggcggcagcgcaaaagatg

SEQ ID NO: 77161 - DNA, 103 bp, Artificial Sequence
  Synthetic Polynucleotide
taatacgactcactatagggaaatattttttccaatcgtcgttttttgcaaacagaggagatgcaaaatgcgacgattgaacctggcggcagcgcaaaagatg

SEQ ID NO: 77162 - DNA, 103 bp, Artificial Sequence
  Synthetic Polynucleotide
taatacgactcactatagggtaataaaatattttttccaatcgtcgttttaacagaggagaaaaacgatgattggaaaaaacctggcggcagcgcaaaagatg

SEQ ID NO: 77163 - DNA, 103 bp, Artificial Sequence
  Synthetic Polynucleotide
taatacgactcactatagggaaaactaataaaatattttttccaatcgtcaacagaggagagacgatatgaaaaaatataacctggcggcagcgcaaaagatg

SEQ ID NO: 77164 - DNA, 103 bp, Artificial Sequence
  Synthetic Polynucleotide
taatacgactcactatagggttgtaaaaactaataaaatattttttccaaaacagaggagattggaaatgatattttataacctggcggcagcgcaaaagatg

SEQ ID NO: 77165 - DNA, 103 bp, Artificial Sequence
  Synthetic Polynucleotide
taatacgactcactatagggtagctttgtaaaaactaataaaatatttttaacagaggagaaaaaatatgttattagttaacctggcggcagcgcaaaagatg

SEQ ID NO: 77166 - DNA, 103 bp, Artificial Sequence
  Synthetic Polynucleotide
taatacgactcactatagggaaaattagctttgtaaaaactaataaaataaacagaggagatattttatgagtttttacaacctggcggcagcgcaaaagatg

SEQ ID NO: 77167 - DNA, 103 bp, Artificial Sequence
  Synthetic Polynucleotide
taatacgactcactatagggttaataaaattagctttgtaaaaactaataaacagaggagatattagatgttacaaagcaacctggcggcagcgcaaaagatg

SEQ ID NO: 77168 - DNA, 103 bp, Artificial Sequence
  Synthetic Polynucleotide
taatacgactcactatagggtaccgttaataaaattagctttgtaaaaacaacagaggagagtttttatgaagctaattaacctggcggcagcgcaaaagatg

SEQ ID NO: 77169 - DNA, 103 bp, Artificial Sequence
  Synthetic Polynucleotide
taatacgactcactatagggatcacatcggttatccaatcaataaccacaaacagaggagatgtggtatgtgattggataacctggcggcagcgcaaaagatg

SEQ ID NO: 77170 - DNA, 103 bp, Artificial Sequence
  Synthetic Polynucleotide
taatacgactcactatagggtgtattaccgttaataaaattagctttgtaaacagaggagatacaaaatgaattttattaacctggcggcagcgcaaaagatg

SEQ ID NO: 77171 - DNA, 103 bp, Artificial Sequence
  Synthetic Polynucleotide
taatacgactcactatagggataaatgtattaccgttaataaaattagctaacagaggagaagctaaatgtattaacggaacctggcggcagcgcaaaagatg

SEQ ID NO: 77172 - DNA, 103 bp, Artificial Sequence
  Synthetic Polynucleotide
taatacgactcactatagggcgctaataaatgtattaccgttaataaaataacagaggagaattttaatgacggtaataaacctggcggcagcgcaaaagatg

SEQ ID NO: 77173 - DNA, 103 bp, Artificial Sequence
  Synthetic Polynucleotide
taatacgactcactatagggtctatcgctaataaatgtattaccgttaataacagaggagaattaacatgaatacatttaacctggcggcagcgcaaaagatg

SEQ ID NO: 77174 - DNA, 103 bp, Artificial Sequence
  Synthetic Polynucleotide
taatacgactcactatagggaacgttctatcgctaataaatgtattaccgaacagaggagacggtaaatgatttattagaacctggcggcagcgcaaaagatg

SEQ ID NO: 77175 - DNA, 103 bp, Artificial Sequence
  Synthetic Polynucleotide
taatacgactcactatagggcgttaaacgttctatcgctaataaatgtataacagaggagaatacatatgttagcgataaacctggcggcagcgcaaaagatg

SEQ ID NO: 77176 - DNA, 103 bp, Artificial Sequence
  Synthetic Polynucleotide
taatacgactcactatagggatcctcgttaaacgttctatcgctaataaaaacagaggagatttattatggatagaacgaacctggcggcagcgcaaaagatg

SEQ ID NO: 77177 - DNA, 103 bp, Artificial Sequence
  Synthetic Polynucleotide
taatacgactcactatagggaataaatcctcgttaaacgttctatcgctaaacagaggagatagcgaatgaacgtttaaaacctggcggcagcgcaaaagatg

SEQ ID NO: 77178 - DNA, 103 bp, Artificial Sequence
  Synthetic Polynucleotide
taatacgactcactatagggctctgaataaatcctcgttaaacgttctataacagaggagaatagaaatgttaacgaggaacctggcggcagcgcaaaagatg

SEQ ID NO: 77179 - DNA, 103 bp, Artificial Sequence
  Synthetic Polynucleotide
taatacgactcactatagggaacaactctgaataaatcctcgttaaacgtaacagaggagaacgtttatggaggatttaaacctggcggcagcgcaaaagatg

SEQ ID NO: 77180 - DNA, 103 bp, Artificial Sequence
  Synthetic Polynucleotide
taatacgactcactataggggaacaatcacatcggttatccaatcaataaaacagaggagattattgatgggataaccgaacctggcggcagcgcaaaagatg

SEQ ID NO: 77181 - DNA, 103 bp, Artificial Sequence
  Synthetic Polynucleotide
taatacgactcactatagggtgaacaacaactctgaataaatcctcgttaaacagaggagataacgaatgtttattcagaacctggcggcagcgcaaaagatg

SEQ ID NO: 77182 - DNA, 103 bp, Artificial Sequence
  Synthetic Polynucleotide
taatacgactcactatagggctatttgaacaacaactctgaataaatcctaacagaggagaaggattatgtcagagttgaacctggcggcagcgcaaaagatg

SEQ ID NO: 77183 - DNA, 103 bp, Artificial Sequence
  Synthetic Polynucleotide
taatacgactcactatagggaggatctatttgaacaacaactctgaataaaacagaggagattattcatggttgttgttaacctggcggcagcgcaaaagatg

SEQ ID NO: 77184 - DNA, 103 bp, Artificial Sequence
  Synthetic Polynucleotide
taatacgactcactatagggtattcaggatctatttgaacaacaactctgaacagaggagacagagtatgtgttcaaataacctggcggcagcgcaaaagatg

SEQ ID NO: 77185 - DNA, 103 bp, Artificial Sequence
  Synthetic Polynucleotide
taatacgactcactatagggcaaaatattcaggatctatttgaacaacaaaacagaggagattgttgatgaaatagatcaacctggcggcagcgcaaaagatg

SEQ ID NO: 77186 - DNA, 103 bp, Artificial Sequence
  Synthetic Polynucleotide
taatacgactcactatagggattatcaaaatattcaggatctatttgaacaacagaggagagttcaaatggatcctgaaaacctggcggcagcgcaaaagatg

SEQ ID NO: 77187 - DNA, 103 bp, Artificial Sequence
  Synthetic Polynucleotide
taatacgactcactatagggcgttcattatcaaaatattcaggatctattaacagaggagaaatagaatgtgaatatttaacctggcggcagcgcaaaagatg

SEQ ID NO: 77188 - DNA, 103 bp, Artificial Sequence
  Synthetic Polynucleotide
taatacgactcactatagggtaattcgttcattatcaaaatattcaggataacagaggagaatcctgatgattttgataaacctggcggcagcgcaaaagatg

SEQ ID NO: 77189 - DNA, 103 bp, Artificial Sequence
  Synthetic Polynucleotide
taatacgactcactatagggagacataattcgttcattatcaaaatattcaacagaggagagaatatatggataatgaaaacctggcggcagcgcaaaagatg

SEQ ID NO: 77190 - DNA, 103 bp, Artificial Sequence
  Synthetic Polynucleotide
taatacgactcactatagggaataaagacataattcgttcattatcaaaaaacagaggagattttgaatgtgaacgaataacctggcggcagcgcaaaagatg

SEQ ID NO: 77191 - DNA, 103 bp, Artificial Sequence
  Synthetic Polynucleotide
taatacgactcactatagggtgattgaacaatcacatcggttatccaatcaacagaggagagattggatgaccgatgtgaacctggcggcagcgcaaaagatg

SEQ ID NO: 77192 - DNA, 103 bp, Artificial Sequence
  Synthetic Polynucleotide
taatacgactcactatagggtagagaataaagacataattcgttcattataacagaggagaataatgatggaattatgtaacctggcggcagcgcaaaagatg

SEQ ID NO: 77193 - DNA, 103 bp, Artificial Sequence
  Synthetic Polynucleotide
taatacgactcactatagggactcgtagagaataaagacataattcgttcaacagaggagagaacgaatgatgtctttaaacctggcggcagcgcaaaagatg

SEQ ID NO: 77194 - DNA, 103 bp, Artificial Sequence
  Synthetic Polynucleotide
taatacgactcactatagggacagcactcgtagagaataaagacataattaacagaggagaaattatatgtttattctcaacctggcggcagcgcaaaagatg

SEQ ID NO: 77195 - DNA, 103 bp, Artificial Sequence
  Synthetic Polynucleotide
taatacgactcactatagggtttccacagcactcgtagagaataaagacaaacagaggagatgtcttatgtctctacgaaacctggcggcagcgcaaaagatg

SEQ ID NO: 77196 - DNA, 103 bp, Artificial Sequence
  Synthetic Polynucleotide
taatacgactcactatagggtttaatttccacagcactcgtagagaataaaacagaggagattattcatgacgagtgctaacctggcggcagcgcaaaagatg

SEQ ID NO: 77197 - DNA, 103 bp, Artificial Sequence
  Synthetic Polynucleotide
taatacgactcactatagggaatcgtttaatttccacagcactcgtagagaacagaggagactctacatgtgctgtggaaacctggcggcagcgcaaaagatg

SEQ ID NO: 77198 - DNA, 103 bp, Artificial Sequence
  Synthetic Polynucleotide
taatacgactcactatagggcatcaaatcgtttaatttccacagcactcgaacagaggagacgagtgatgtggaaattaaacctggcggcagcgcaaaagatg

SEQ ID NO: 77199 - DNA, 103 bp, Artificial Sequence
  Synthetic Polynucleotide
taatacgactcactatagggtaactcatcaaatcgtttaatttccacagcaacagaggagagctgtgatgattaaacgaaacctggcggcagcgcaaaagatg

SEQ ID NO: 77200 - DNA, 103 bp, Artificial Sequence
  Synthetic Polynucleotide
taatacgactcactatagggatatctaactcatcaaatcgtttaatttccaacagaggagaggaaatatgacgatttgaaacctggcggcagcgcaaaagatg

SEQ ID NO: 77201 - DNA, 103 bp, Artificial Sequence
  Synthetic Polynucleotide
taatacgactcactatagggtattaatatctaactcatcaaatcgtttaaaacagaggagattaaacatgttgatgagtaacctggcggcagcgcaaaagatg

SEQ ID NO: 77202 - DNA, 103 bp, Artificial Sequence
  Synthetic Polynucleotide
taatacgactcactatagggaatattgattgaacaatcacatcggttatcaacagaggagagataacatgtgtgattgtaacctggcggcagcgcaaaagatg

SEQ ID NO: 77203 - DNA, 103 bp, Artificial Sequence
  Synthetic Polynucleotide
taatacgactcactatagggactgttattaatatctaactcatcaaatcgaacagaggagacgatttatggagttagataacctggcggcagcgcaaaagatg

SEQ ID NO: 77204 - DNA, 103 bp, Artificial Sequence
  Synthetic Polynucleotide
taatacgactcactatagggatataactgttattaatatctaactcatcaaacagaggagatgatgaatgagatattaaaacctggcggcagcgcaaaagatg

SEQ ID NO: 77205 - DNA, 103 bp, Artificial Sequence
  Synthetic Polynucleotide
taatacgactcactatagggtagatatataactgttattaatatctaactaacagaggagaagttagatgttaataacaaacctggcggcagcgcaaaagatg

SEQ ID NO: 77206 - DNA, 103 bp, Artificial Sequence
  Synthetic Polynucleotide
taatacgactcactatagggtatattagatatataactgttattaatatcaacagaggagagatattatgaacagttataacctggcggcagcgcaaaagatg

SEQ ID NO: 77207 - DNA, 103 bp, Artificial Sequence
  Synthetic Polynucleotide
taatacgactcactatagggtaaattatattagatatataactgttattaaacagaggagataataaatgttatatatcaacctggcggcagcgcaaaagatg

SEQ ID NO: 77208 - DNA, 103 bp, Artificial Sequence
  Synthetic Polynucleotide
taatacgactcactatagggcctcataaattatattagatatataactgtaacagaggagaacagttatgtatctaataaacctggcggcagcgcaaaagatg

SEQ ID NO: 77209 - DNA, 103 bp, Artificial Sequence
  Synthetic Polynucleotide
taatacgactcactataggggttcacctcataaattatattagatatataaacagaggagatatataatgaatataattaacctggcggcagcgcaaaagatg

SEQ ID NO: 77210 - DNA, 103 bp, Artificial Sequence
  Synthetic Polynucleotide
taatacgactcactatagggatatcgttcacctcataaattatattagataacagaggagaatctaaatgaatttatgaaacctggcggcagcgcaaaagatg

SEQ ID NO: 77211 - DNA, 103 bp, Artificial Sequence
  Synthetic Polynucleotide
taatacgactcactatagggatgtgatatcgttcacctcataaattatataacagaggagaatataaatgatgaggtgaaacctggcggcagcgcaaaagatg

SEQ ID NO: 77212 - DNA, 103 bp, Artificial Sequence
  Synthetic Polynucleotide
taatacgactcactatagggatctaatgtgatatcgttcacctcataaataacagaggagaatttatatggtgaacgataacctggcggcagcgcaaaagatg

SEQ ID NO: 77213 - DNA, 103 bp, Artificial Sequence
  Synthetic Polynucleotide
taatacgactcactatagggctcttaatattgattgaacaatcacatcggaacagaggagaccgatgatgttgttcaataacctggcggcagcgcaaaagatg

SEQ ID NO: 77214 - DNA, 103 bp, Artificial Sequence
  Synthetic Polynucleotide
taatacgactcactatagggattgtatctaatgtgatatcgttcacctcaaacagaggagatgaggtatgcgatatcacaacctggcggcagcgcaaaagatg

SEQ ID NO: 77215 - DNA, 103 bp, Artificial Sequence
  Synthetic Polynucleotide
taatacgactcactatagggcatccattgtatctaatgtgatatcgttcaaacagaggagatgaacgatgtcacattagaacctggcggcagcgcaaaagatg

SEQ ID NO: 77216 - DNA, 103 bp, Artificial Sequence
  Synthetic Polynucleotide
taatacgactcactatagggcatatcatccattgtatctaatgtgatatcaacagaggagagatatcatgttagatacaaacctggcggcagcgcaaaagatg

SEQ ID NO: 77217 - DNA, 103 bp, Artificial Sequence
  Synthetic Polynucleotide
taatacgactcactatagggttcttcatatcatccattgtatctaatgtgaacagaggagacacattatgtacaatggaaacctggcggcagcgcaaaagatg

SEQ ID NO: 77218 - DNA, 103 bp, Artificial Sequence
  Synthetic Polynucleotide
taatacgactcactatagggggcacttcttcatatcatccattgtatctaaacagaggagatagataatgtggatgataaacctggcggcagcgcaaaagatg

SEQ ID NO: 77219 - DNA, 103 bp, Artificial Sequence
  Synthetic Polynucleotide
taatacgactcactataggggatttggcacttcttcatatcatccattgtaacagaggagaacaatgatggatatgaagaacctggcggcagcgcaaaagatg

SEQ ID NO: 77220 - DNA, 103 bp, Artificial Sequence
  Synthetic Polynucleotide
taatacgactcactatagggttaaagatttggcacttcttcatatcatccaacagaggagaggatgaatggaagaagtgaacctggcggcagcgcaaaagatg

SEQ ID NO: 77221 - DNA, 103 bp, Artificial Sequence
  Synthetic Polynucleotide
taatacgactcactatagggcctcgttaaagatttggcacttcttcatataacagaggagaatatgaatgagtgccaaaaacctggcggcagcgcaaaagatg

SEQ ID NO: 77222 - DNA, 103 bp, Artificial Sequence
  Synthetic Polynucleotide
taatacgactcactatagggtgtatcctcgttaaagatttggcacttcttaacagaggagaaagaagatgcaaatctttaacctggcggcagcgcaaaagatg

SEQ ID NO: 77223 - DNA, 103 bp, Artificial Sequence
  Synthetic Polynucleotide
taatacgactcactatagggtacgatgtatcctcgttaaagatttggcacaacagaggagagtgccaatgctttaacgaaacctggcggcagcgcaaaagatg

SEQ ID NO: 77224 - DNA, 103 bp, Artificial Sequence
  Synthetic Polynucleotide
taatacgactcactatagggcaaccctcttaatattgattgaacaatcacaacagaggagagtgattatgcaatcaataaacctggcggcagcgcaaaagatg

SEQ ID NO: 77225 - DNA, 103 bp, Artificial Sequence
  Synthetic Polynucleotide
taatacgactcactatagggcataatacgatgtatcctcgttaaagatttaacagaggagaaaatctatgacgaggataaacctggcggcagcgcaaaagatg

SEQ ID NO: 77226 - DNA, 103 bp, Artificial Sequence
  Synthetic Polynucleotide
taatacgactcactatagggcttaacataatacgatgtatcctcgttaaaaacagaggagatttaacatggatacatcgaacctggcggcagcgcaaaagatg

SEQ ID NO: 77227 - DNA, 103 bp, Artificial Sequence
  Synthetic Polynucleotide
taatacgactcactatagggtattccttaacataatacgatgtatcctcgaacagaggagacgaggaatgatcgtattaaacctggcggcagcgcaaaagatg

SEQ ID NO: 77228 - DNA, 103 bp, Artificial Sequence
  Synthetic Polynucleotide
taatacgactcactatagggtattgtattccttaacataatacgatgtataacagaggagaatacatatgattatgttaaacctggcggcagcgcaaaagatg

SEQ ID NO: 77229 - DNA, 103 bp, Artificial Sequence
  Synthetic Polynucleotide
taatacgactcactataggggtatgtattgtattccttaacataatacgaaacagaggagatcgtatatggttaaggaaaacctggcggcagcgcaaaagatg

SEQ ID NO: 77230 - DNA, 103 bp, Artificial Sequence
  Synthetic Polynucleotide
taatacgactcactatagggaacaggtatgtattgtattccttaacataaaacagaggagattatgtatgggaatacaaaacctggcggcagcgcaaaagatg

SEQ ID NO: 77231 - DNA, 103 bp, Artificial Sequence
  Synthetic Polynucleotide
taatacgactcactatagggtcaaaaacaggtatgtattgtattccttaaaacagaggagattaaggatgacaatacataacctggcggcagcgcaaaagatg

SEQ ID NO: 77232 - DNA, 103 bp, Artificial Sequence
  Synthetic Polynucleotide
taatacgactcactatagggctcgttcaaaaacaggtatgtattgtattcaacagaggagagaatacatgacatacctgaacctggcggcagcgcaaaagatg

SEQ ID NO: 77233 - DNA, 103 bp, Artificial Sequence
  Synthetic Polynucleotide
taatacgactcactatagggtccgtctcgttcaaaaacaggtatgtattgaacagaggagacaatacatgcctgtttttaacctggcggcagcgcaaaagatg

SEQ ID NO: 77234 - DNA, 103 bp, Artificial Sequence
  Synthetic Polynucleotide
taatacgactcactatagggtgggatccgtctcgttcaaaaacaggtatgaacagaggagacataccatgttttgaacgaacctggcggcagcgcaaaagatg

SEQ ID NO: 77235 - DNA, 103 bp, Artificial Sequence
  Synthetic Polynucleotide
taatacgactcactatagggctggaagagtcttcaacgataagtatatcgaacagaggagacgatatatgtatcgttgaaacctggcggcagcgcaaaagatg

SEQ ID NO: 77236 - DNA, 103 bp, Artificial Sequence
  Synthetic Polynucleotide
taatacgactcactatagggtttaccaaccctcttaatattgattgaacaaacagaggagatgttcaatgaatattaagaacctggcggcagcgcaaaagatg

SEQ ID NO: 77237 - DNA, 103 bp, Artificial Sequence
  Synthetic Polynucleotide
taatacgactcactataggggaccatgggatccgtctcgttcaaaaacagaacagaggagactgtttatgaacgagacgaacctggcggcagcgcaaaagatg

SEQ ID NO: 77238 - DNA, 103 bp, Artificial Sequence
  Synthetic Polynucleotide
taatacgactcactatagggtctatgaccatgggatccgtctcgttcaaaaacagaggagatttgaaatggacggatccaacctggcggcagcgcaaaagatg

SEQ ID NO: 77239 - DNA, 103 bp, Artificial Sequence
  Synthetic Polynucleotide
taatacgactcactatagggcgttctctatgaccatgggatccgtctcgtaacagaggagaacgagaatgatcccatggaacctggcggcagcgcaaaagatg

SEQ ID NO: 77240 - DNA, 103 bp, Artificial Sequence
  Synthetic Polynucleotide
taatacgactcactatagggtattccgttctctatgaccatgggatccgtaacagaggagaacggatatgatggtcataaacctggcggcagcgcaaaagatg

SEQ ID NO: 77241 - DNA, 103 bp, Artificial Sequence
  Synthetic Polynucleotide
taatacgactcactatagggtttagtattccgttctctatgaccatgggaaacagaggagatcccatatgcatagagaaaacctggcggcagcgcaaaagatg

SEQ ID NO: 77242 - DNA, 103 bp, Artificial Sequence
  Synthetic Polynucleotide
taatacgactcactataggggtttctttagtattccgttctctatgaccaaacagaggagatggtcaatgagaacggaaaacctggcggcagcgcaaaagatg

SEQ ID NO: 77243 - DNA, 103 bp, Artificial Sequence
  Synthetic Polynucleotide
taatacgactcactatagggtgacagtttctttagtattccgttctctataacagaggagaatagagatgggaatactaaacctggcggcagcgcaaaagatg

SEQ ID NO: 77244 - DNA, 103 bp, Artificial Sequence
  Synthetic Polynucleotide
taatacgactcactatagggatagatgacagtttctttagtattccgttcaacagaggagagaacggatgactaaagaaaacctggcggcagcgcaaaagatg

SEQ ID NO: 77245 - DNA, 103 bp, Artificial Sequence
  Synthetic Polynucleotide
taatacgactcactatagggattttatagatgacagtttctttagtattcaacagaggagagaatacatgagaaactgtaacctggcggcagcgcaaaagatg

SEQ ID NO: 77246 - DNA, 103 bp, Artificial Sequence
  Synthetic Polynucleotide
taatacgactcactatagggcttggattttatagatgacagtttctttagaacagaggagactaaagatgctgtcatctaacctggcggcagcgcaaaagatg

SEQ ID NO: 77247 - DNA, 103 bp, Artificial Sequence
  Synthetic Polynucleotide
taatacgactcactatagggaccaatttaccaaccctcttaatattgattaacagaggagaaatcaaatgtaagagggtaacctggcggcagcgcaaaagatg

SEQ ID NO: 77248 - DNA, 103 bp, Artificial Sequence
  Synthetic Polynucleotide
taatacgactcactatagggctactcttggattttatagatgacagtttcaacagaggagagaaactatgatctataaaaacctggcggcagcgcaaaagatg

SEQ ID NO: 77249 - DNA, 103 bp, Artificial Sequence
  Synthetic Polynucleotide
taatacgactcactataggggtcgtctactcttggattttatagatgacaaacagaggagatgtcatatgtaaaatccaaacctggcggcagcgcaaaagatg

SEQ ID NO: 77250 - DNA, 103 bp, Artificial Sequence
  Synthetic Polynucleotide
taatacgactcactataggggttcagtcgtctactcttggattttatagaaacagaggagatctataatgtccaagagtaacctggcggcagcgcaaaagatg

SEQ ID NO: 77251 - DNA, 103 bp, Artificial Sequence
  Synthetic Polynucleotide
taatacgactcactatagggaacaagttcagtcgtctactcttggattttaacagaggagaaaaatcatggagtagacgaacctggcggcagcgcaaaagatg

SEQ ID NO: 77252 - DNA, 103 bp, Artificial Sequence
  Synthetic Polynucleotide
taatacgactcactatagggtgctaaacaagttcagtcgtctactcttggaacagaggagaccaagaatggacgactgaaacctggcggcagcgcaaaagatg

SEQ ID NO: 77253 - DNA, 103 bp, Artificial Sequence
  Synthetic Polynucleotide
taatacgactcactataggggtttttgctaaacaagttcagtcgtctactaacagaggagaagtagaatgctgaacttgaacctggcggcagcgcaaaagatg

SEQ ID NO: 77254 - DNA, 103 bp, Artificial Sequence
  Synthetic Polynucleotide
taatacgactcactatagggaaaatgtttttgctaaacaagttcagtcgtaacagaggagaacgactatgcttgtttagaacctggcggcagcgcaaaagatg

SEQ ID NO: 77255 - DNA, 103 bp, Artificial Sequence
  Synthetic Polynucleotide
taatacgactcactatagggattttaaaatgtttttgctaaacaagttcaaacagaggagatgaactatgttagcaaaaaacctggcggcagcgcaaaagatg

SEQ ID NO: 77256 - DNA, 103 bp, Artificial Sequence
  Synthetic Polynucleotide
taatacgactcactatagggataatattttaaaatgtttttgctaaacaaaacagaggagattgtttatgaaaaacattaacctggcggcagcgcaaaagatg

SEQ ID NO: 77257 - DNA, 103 bp, Artificial Sequence
  Synthetic Polynucleotide
taatacgactcactatagggtctaaataatattttaaaatgtttttgctaaacagaggagatagcaaatgcattttaaaaacctggcggcagcgcaaaagatg

SEQ ID NO: 77258 - DNA, 103 bp, Artificial Sequence
  Synthetic Polynucleotide
taatacgactcactatagggtatgtaccaatttaccaaccctcttaatataacagaggagaatattaatggggttggtaaacctggcggcagcgcaaaagatg

SEQ ID NO: 77259 - DNA, 103 bp, Artificial Sequence
  Synthetic Polynucleotide
taatacgactcactataggggtccgtctaaataatattttaaaatgttttaacagaggagaaaaacaatgtaaaatattaacctggcggcagcgcaaaagatg

SEQ ID NO: 77260 - DNA, 103 bp, Artificial Sequence
  Synthetic Polynucleotide
taatacgactcactatagggcaattgtccgtctaaataatattttaaaataacagaggagaattttaatgtattatttaaacctggcggcagcgcaaaagatg

SEQ ID NO: 77261 - DNA, 103 bp, Artificial Sequence
  Synthetic Polynucleotide
taatacgactcactatagggcgagccaattgtccgtctaaataatattttaacagaggagaaaaataatgtttagacggaacctggcggcagcgcaaaagatg

SEQ ID NO: 77262 - DNA, 103 bp, Artificial Sequence
  Synthetic Polynucleotide
taatacgactcactatagggctagacgagccaattgtccgtctaaataataacagaggagaattattatgacggacaataacctggcggcagcgcaaaagatg

SEQ ID NO: 77263 - DNA, 103 bp, Artificial Sequence
  Synthetic Polynucleotide
taatacgactcactatagggaagacctagacgagccaattgtccgtctaaaacagaggagattagacatgcaattggctaacctggcggcagcgcaaaagatg

SEQ ID NO: 77264 - DNA, 103 bp, Artificial Sequence
  Synthetic Polynucleotide
taatacgactcactatagggaacacaagacctagacgagccaattgtccgaacagaggagacggacaatgggctcgtctaacctggcggcagcgcaaaagatg

SEQ ID NO: 77265 - DNA, 103 bp, Artificial Sequence
  Synthetic Polynucleotide
taatacgactcactatagggcatctaacacaagacctagacgagccaattaacagaggagaaattggatggtctaggtcaacctggcggcagcgcaaaagatg

SEQ ID NO: 77266 - DNA, 103 bp, Artificial Sequence
  Synthetic Polynucleotide
taatacgactcactatagggataatcatctaacacaagacctagacgagcaacagaggagagctcgtatgggtcttgtgaacctggcggcagcgcaaaagatg

SEQ ID NO: 77267 - DNA, 103 bp, Artificial Sequence
  Synthetic Polynucleotide
taatacgactcactatagggcctttataatcatctaacacaagacctagaaacagaggagatctaggatgtgtgttagaaacctggcggcagcgcaaaagatg

SEQ ID NO: 77268 - DNA, 103 bp, Artificial Sequence
  Synthetic Polynucleotide
taatacgactcactatagggagtctcctttataatcatctaacacaagacaacagaggagagtcttgatgtagatgattaacctggcggcagcgcaaaagatg

SEQ ID NO: 77269 - DNA, 103 bp, Artificial Sequence
  Synthetic Polynucleotide
taatacgactcactatagggttatctatgtaccaatttaccaaccctcttaacagaggagaaagaggatgggtaaattgaacctggcggcagcgcaaaagatg

SEQ ID NO: 77270 - DNA, 103 bp, Artificial Sequence
  Synthetic Polynucleotide
taatacgactcactatagggtaacaagtctcctttataatcatctaacacaacagaggagagtgttaatggattataaaaacctggcggcagcgcaaaagatg

SEQ ID NO: 77271 - DNA, 103 bp, Artificial Sequence
  Synthetic Polynucleotide
taatacgactcactatagggttaactaacaagtctcctttataatcatctaacagaggagaagatgaatgtaaaggagaaacctggcggcagcgcaaaagatg

SEQ ID NO: 77272 - DNA, 103 bp, Artificial Sequence
  Synthetic Polynucleotide
taatacgactcactatagggtcattttaactaacaagtctcctttataataacagaggagaattataatggagacttgtaacctggcggcagcgcaaaagatg

SEQ ID NO: 77273 - DNA, 103 bp, Artificial Sequence
  Synthetic Polynucleotide
taatacgactcactataggggtttatcattttaactaacaagtctcctttaacagaggagaaaaggaatgttgttagttaacctggcggcagcgcaaaagatg

SEQ ID NO: 77274 - DNA, 103 bp, Artificial Sequence
  Synthetic Polynucleotide
taatacgactcactatagggagatggtttatcattttaactaacaagtctaacagaggagaagacttatgagttaaaataacctggcggcagcgcaaaagatg

SEQ ID NO: 77275 - DNA, 103 bp, Artificial Sequence
  Synthetic Polynucleotide
taatacgactcactatagggacttgagatggtttatcattttaactaacaaacagaggagatgttagatgaaatgataaaacctggcggcagcgcaaaagatg

SEQ ID NO: 77276 - DNA, 103 bp, Artificial Sequence
  Synthetic Polynucleotide
taatacgactcactatagggcacaaacttgagatggtttatcattttaacaacagaggagagttaaaatgataaaccataacctggcggcagcgcaaaagatg

SEQ ID NO: 77277 - DNA, 103 bp, Artificial Sequence
  Synthetic Polynucleotide
taatacgactcactatagggtcctccacaaacttgagatggtttatcattaacagaggagaaatgatatgccatctcaaaacctggcggcagcgcaaaagatg

SEQ ID NO: 77278 - DNA, 103 bp, Artificial Sequence
  Synthetic Polynucleotide
taatacgactcactatagggatacatcctccacaaacttgagatggtttaaacagaggagataaaccatgtcaagtttgaacctggcggcagcgcaaaagatg

SEQ ID NO: 77279 - DNA, 103 bp, Artificial Sequence
  Synthetic Polynucleotide
taatacgactcactatagggtgctgatacatcctccacaaacttgagatgaacagaggagacatctcatgtttgtggagaacctggcggcagcgcaaaagatg

SEQ ID NO: 77280 - DNA, 103 bp, Artificial Sequence
  Synthetic Polynucleotide
taatacgactcactatagggtattattatctatgtaccaatttaccaaccaacagaggagaggttggatgattggtacaaacctggcggcagcgcaaaagatg

SEQ ID NO: 77281 - DNA, 103 bp, Artificial Sequence
  Synthetic Polynucleotide
taatacgactcactatagggacgaatgctgatacatcctccacaaacttgaacagaggagacaagttatgggaggatgtaacctggcggcagcgcaaaagatg

SEQ ID NO: 77282 - DNA, 103 bp, Artificial Sequence
  Synthetic Polynucleotide
taatacgactcactatagggatctaacgaatgctgatacatcctccacaaaacagaggagattgtggatgatgtatcagaacctggcggcagcgcaaaagatg

SEQ ID NO: 77283 - DNA, 103 bp, Artificial Sequence
  Synthetic Polynucleotide
taatacgactcactatagggagaaaatctaacgaatgctgatacatcctcaacagaggagagaggatatgtcagcattcaacctggcggcagcgcaaaagatg

SEQ ID NO: 77284 - DNA, 103 bp, Artificial Sequence
  Synthetic Polynucleotide
taatacgactcactatagggtctgtagaaaatctaacgaatgctgatacaaacagaggagatgtatcatgattcgttagaacctggcggcagcgcaaaagatg

SEQ ID NO: 77285 - DNA, 103 bp, Artificial Sequence
  Synthetic Polynucleotide
taatacgactcactatagggttttatctgtagaaaatctaacgaatgctgaacagaggagacagcatatgttagattttaacctggcggcagcgcaaaagatg

SEQ ID NO: 77286 - DNA, 103 bp, Artificial Sequence
  Synthetic Polynucleotide
taatacgactcactatagggagggtttttatctgtagaaaatctaacgaaaacagaggagattcgttatgttttctacaaacctggcggcagcgcaaaagatg

SEQ ID NO: 77287 - DNA, 103 bp, Artificial Sequence
  Synthetic Polynucleotide
taatacgactcactatagggacactagggtttttatctgtagaaaatctaaacagaggagatagattatgtacagataaaacctggcggcagcgcaaaagatg

SEQ ID NO: 77288 - DNA, 103 bp, Artificial Sequence
  Synthetic Polynucleotide
taatacgactcactataggggaagaacactagggtttttatctgtagaaaaacagaggagatttctaatgataaaaaccaacctggcggcagcgcaaaagatg

SEQ ID NO: 77289 - DNA, 103 bp, Artificial Sequence
  Synthetic Polynucleotide
taatacgactcactatagggcgatggaagaacactagggtttttatctgtaacagaggagaacagatatgaaccctagtaacctggcggcagcgcaaaagatg

SEQ ID NO: 77290 - DNA, 103 bp, Artificial Sequence
  Synthetic Polynucleotide
taatacgactcactatagggattagcgatggaagaacactagggtttttaaacagaggagataaaaaatgtagtgttctaacctggcggcagcgcaaaagatg

SEQ ID NO: 77291 - DNA, 103 bp, Artificial Sequence
  Synthetic Polynucleotide
taatacgactcactatagggataggtattattatctatgtaccaatttacaacagaggagagtaaatatgtacatagataacctggcggcagcgcaaaagatg

SEQ ID NO: 77292 - DNA, 103 bp, Artificial Sequence
  Synthetic Polynucleotide
taatacgactcactatagggtgttgattagcgatggaagaacactagggtaacagaggagaaccctaatgttcttccataacctggcggcagcgcaaaagatg

SEQ ID NO: 77293 - DNA, 103 bp, Artificial Sequence
  Synthetic Polynucleotide
taatacgactcactatagggaatagtgttgattagcgatggaagaacactaacagaggagaagtgttatgccatcgctaaacctggcggcagcgcaaaagatg

SEQ ID NO: 77294 - DNA, 103 bp, Artificial Sequence
  Synthetic Polynucleotide
taatacgactcactataggggctaaaatagtgttgattagcgatggaagaaacagaggagatcttccatggctaatcaaaacctggcggcagcgcaaaagatg

SEQ ID NO: 77295 - DNA, 103 bp, Artificial Sequence
  Synthetic Polynucleotide
taatacgactcactatagggaactagctaaaatagtgttgattagcgatgaacagaggagacatcgcatgtcaacactaaacctggcggcagcgcaaaagatg

SEQ ID NO: 77296 - DNA, 103 bp, Artificial Sequence
  Synthetic Polynucleotide
taatacgactcactatagggattataactagctaaaatagtgttgattagaacagaggagactaatcatgactattttaaacctggcggcagcgcaaaagatg

SEQ ID NO: 77297 - DNA, 103 bp, Artificial Sequence
  Synthetic Polynucleotide
taatacgactcactataggggaaatattataactagctaaaatagtgttgaacagaggagacaacacatgtttagctagaacctggcggcagcgcaaaagatg

SEQ ID NO: 77298 - DNA, 103 bp, Artificial Sequence
  Synthetic Polynucleotide
taatacgactcactatagggtgatggaaatattataactagctaaaatagaacagaggagactatttatgctagttataaacctggcggcagcgcaaaagatg

SEQ ID NO: 77299 - DNA, 103 bp, Artificial Sequence
  Synthetic Polynucleotide
taatacgactcactataggggacaatgatggaaatattataactagctaaaacagaggagattagctatgtataatattaacctggcggcagcgcaaaagatg

SEQ ID NO: 77300 - DNA, 103 bp, Artificial Sequence
  Synthetic Polynucleotide
taatacgactcactatagggaataggacaatgatggaaatattataactaaacagaggagatagttaatgtatttccataacctggcggcagcgcaaaagatg

SEQ ID NO: 77301 - DNA, 103 bp, Artificial Sequence
  Synthetic Polynucleotide
taatacgactcactatagggtttgaaataggacaatgatggaaatattataacagaggagaataataatgccatcattgaacctggcggcagcgcaaaagatg

SEQ ID NO: 77302 - DNA, 103 bp, Artificial Sequence
  Synthetic Polynucleotide
taatacgactcactatagggggagtataggtattattatctatgtaccaaaacagaggagattggtaatgagataataaaacctggcggcagcgcaaaagatg

SEQ ID NO: 77303 - DNA, 103 bp, Artificial Sequence
  Synthetic Polynucleotide
taatacgactcactatagggaaacttttgaaataggacaatgatggaaataacagaggagaatttccatgattgtcctaaacctggcggcagcgcaaaagatg

SEQ ID NO: 77304 - DNA, 103 bp, Artificial Sequence
  Synthetic Polynucleotide
taatacgactcactatagggcttaaaaacttttgaaataggacaatgatgaacagaggagacatcatatgcctatttcaaacctggcggcagcgcaaaagatg

SEQ ID NO: 77305 - DNA, 103 bp, Artificial Sequence
  Synthetic Polynucleotide
taatacgactcactatagggtatctcttaaaaacttttgaaataggacaaaacagaggagattgtccatgttcaaaagtaacctggcggcagcgcaaaagatg

SEQ ID NO: 77306 - DNA, 103 bp, Artificial Sequence
  Synthetic Polynucleotide
taatacgactcactatagggtagattatctcttaaaaacttttgaaatagaacagaggagactatttatgaagtttttaaacctggcggcagcgcaaaagatg

SEQ ID NO: 77307 - DNA, 103 bp, Artificial Sequence
  Synthetic Polynucleotide
taatacgactcactatagggtgatatagattatctcttaaaaacttttgaaacagaggagatcaaaaatgtttaagagaaacctggcggcagcgcaaaagatg

SEQ ID NO: 77308 - DNA, 103 bp, Artificial Sequence
  Synthetic Polynucleotide
taatacgactcactatagggctacatgatatagattatctcttaaaaactaacagaggagaagttttatggagataatcaacctggcggcagcgcaaaagatg

SEQ ID NO: 77309 - DNA, 103 bp, Artificial Sequence
  Synthetic Polynucleotide
taatacgactcactatagggtttttctacatgatatagattatctcttaaaacagaggagattaagaatgaatctatataacctggcggcagcgcaaaagatg

SEQ ID NO: 77310 - DNA, 103 bp, Artificial Sequence
  Synthetic Polynucleotide
taatacgactcactatagggaagaatttttctacatgatatagattatctaacagaggagaagataaatgatatcatgtaacctggcggcagcgcaaaagatg

SEQ ID NO: 77311 - DNA, 103 bp, Artificial Sequence
  Synthetic Polynucleotide
taatacgactcactatagggtatccaagaatttttctacatgatatagataacagaggagaatctatatgatgtagaaaaacctggcggcagcgcaaaagatg

SEQ ID NO: 77312 - DNA, 103 bp, Artificial Sequence
  Synthetic Polynucleotide
taatacgactcactataggggcttttatccaagaatttttctacatgataaacagaggagatatcatatggaaaaattcaacctggcggcagcgcaaaagatg

SEQ ID NO: 77313 - DNA, 103 bp, Artificial Sequence
  Synthetic Polynucleotide
taatacgactcactatagggtatttggagtataggtattattatctatgtaacagaggagaacatagatgataatacctaacctggcggcagcgcaaaagatg

SEQ ID NO: 77314 - DNA, 103 bp, Artificial Sequence
  Synthetic Polynucleotide
taatacgactcactatagggtggatgcttttatccaagaatttttctacaaacagaggagatgtagaatgattcttggaaacctggcggcagcgcaaaagatg

SEQ ID NO: 77315 - DNA, 103 bp, Artificial Sequence
  Synthetic Polynucleotide
taatacgactcactatagggttagatggatgcttttatccaagaatttttaacagaggagaaaaaatatgtggataaaaaacctggcggcagcgcaaaagatg

SEQ ID NO: 77316 - DNA, 103 bp, Artificial Sequence
  Synthetic Polynucleotide
taatacgactcactatagggcttggttagatggatgcttttatccaagaaaacagaggagattcttgatgaaaagcatcaacctggcggcagcgcaaaagatg

SEQ ID NO: 77317 - DNA, 103 bp, Artificial Sequence
  Synthetic Polynucleotide
taatacgactcactatagggtccgtcttggttagatggatgcttttatccaacagaggagaggataaatgcatccatctaacctggcggcagcgcaaaagatg

SEQ ID NO: 77318 - DNA, 103 bp, Artificial Sequence
  Synthetic Polynucleotide
taatacgactcactatagggtcttatccgtcttggttagatggatgctttaacagaggagaaaagcaatgatctaaccaaacctggcggcagcgcaaaagatg

SEQ ID NO: 77319 - DNA, 103 bp, Artificial Sequence
  Synthetic Polynucleotide
taatacgactcactatagggatatttcttatccgtcttggttagatggataacagaggagaatccatatgaccaagacgaacctggcggcagcgcaaaagatg

SEQ ID NO: 77320 - DNA, 103 bp, Artificial Sequence
  Synthetic Polynucleotide
taatacgactcactatagggagtatatatttcttatccgtcttggttagaaacagaggagatctaacatggacggataaaacctggcggcagcgcaaaagatg

SEQ ID NO: 77321 - DNA, 103 bp, Artificial Sequence
  Synthetic Polynucleotide
taatacgactcactatagggattgaagtatatatttcttatccgtcttggaacagaggagaccaagaatgataagaaataacctggcggcagcgcaaaagatg

SEQ ID NO: 77322 - DNA, 103 bp, Artificial Sequence
  Synthetic Polynucleotide
taatacgactcactatagggtatcaattgaagtatatatttcttatccgtaacagaggagaacggatatgaaatatataaacctggcggcagcgcaaaagatg

SEQ ID NO: 77323 - DNA, 103 bp, Artificial Sequence
  Synthetic Polynucleotide
taatacgactcactatagggtgccttatcaattgaagtatatatttcttaaacagaggagataagaaatgtatacttcaaacctggcggcagcgcaaaagatg

SEQ ID NO: 77324 - DNA, 103 bp, Artificial Sequence
  Synthetic Polynucleotide
taatacgactcactataggggggtgtatttggagtataggtattattatcaacagaggagagataatatgacctatactaacctggcggcagcgcaaaagatg

SEQ ID NO: 77325 - DNA, 103 bp, Artificial Sequence
  Synthetic Polynucleotide
taatacgactcactatagggtgccgtgccttatcaattgaagtatatattaacagaggagaaatataatgttcaattgaaacctggcggcagcgcaaaagatg

SEQ ID NO: 77326 - DNA, 103 bp, Artificial Sequence
  Synthetic Polynucleotide
taatacgactcactatagggtgatctgccgtgccttatcaattgaagtataacagaggagaatacttatgttgataaggaacctggcggcagcgcaaaagatg

SEQ ID NO: 77327 - DNA, 103 bp, Artificial Sequence
  Synthetic Polynucleotide
taatacgactcactatagggttctatgatctgccgtgccttatcaattgaaacagaggagatcaattatgaaggcacggaacctggcggcagcgcaaaagatg

SEQ ID NO: 77328 - DNA, 103 bp, Artificial Sequence
  Synthetic Polynucleotide
taatacgactcactataggggtttgttctatgatctgccgtgccttatcaaacagaggagatgataaatgacggcagataacctggcggcagcgcaaaagatg

SEQ ID NO: 77329 - DNA, 103 bp, Artificial Sequence
  Synthetic Polynucleotide
taatacgactcactatagggatttggtttgttctatgatctgccgtgcctaacagaggagaaggcacatgagatcatagaacctggcggcagcgcaaaagatg

SEQ ID NO: 77330 - DNA, 103 bp, Artificial Sequence
  Synthetic Polynucleotide
taatacgactcactatagggaatatatttggtttgttctatgatctgccgaacagaggagacggcagatgatagaacaaaacctggcggcagcgcaaaagatg

SEQ ID NO: 77331 - DNA, 103 bp, Artificial Sequence
  Synthetic Polynucleotide
taatacgactcactatagggttaataatatatttggtttgttctatgatcaacagaggagagatcatatgacaaaccaaaacctggcggcagcgcaaaagatg

SEQ ID NO: 77332 - DNA, 103 bp, Artificial Sequence
  Synthetic Polynucleotide
taatacgactcactatagggaattattaataatatatttggtttgttctaaacagaggagatagaacatgccaaatataaacctggcggcagcgcaaaagatg

SEQ ID NO: 77333 - DNA, 103 bp, Artificial Sequence
  Synthetic Polynucleotide
taatacgactcactatagggatacaaattattaataatatatttggtttgaacagaggagacaaaccatgtatattattaacctggcggcagcgcaaaagatg

SEQ ID NO: 77334 - DNA, 103 bp, Artificial Sequence
  Synthetic Polynucleotide
taatacgactcactatagggtgtatatacaaattattaataatatatttgaacagaggagacaaataatgtattaataaaacctggcggcagcgcaaaagatg

SEQ ID NO: 77335 - DNA, 103 bp, Artificial Sequence
  Synthetic Polynucleotide
taatacgactcactatagggttattgggtgtatttggagtataggtattaaacagaggagataatacatgtactccaaaaacctggcggcagcgcaaaagatg

SEQ ID NO: 77336 - DNA, 103 bp, Artificial Sequence
  Synthetic Polynucleotide
taatacgactcactatagggatctatgtatatacaaattattaataatataacagaggagaatattaatgataatttgtaacctggcggcagcgcaaaagatg

SEQ ID NO: 77337 - DNA, 103 bp, Artificial Sequence
  Synthetic Polynucleotide
taatacgactcactatagggattatatctatgtatatacaaattattaataacagaggagaattaatatgttgtatataaacctggcggcagcgcaaaagatg

SEQ ID NO: 77338 - DNA, 103 bp, Artificial Sequence
  Synthetic Polynucleotide
taatacgactcactatagggtgataattatatctatgtatatacaaattaaacagaggagataatttatgtatacatagaacctggcggcagcgcaaaagatg

SEQ ID NO: 77339 - DNA, 103 bp, Artificial Sequence
  Synthetic Polynucleotide
taatacgactcactatagggatatgtgataattatatctatgtatatacaaacagaggagatgtataatgatagatataaacctggcggcagcgcaaaagatg

SEQ ID NO: 77340 - DNA, 103 bp, Artificial Sequence
  Synthetic Polynucleotide
taatacgactcactatagggttttaatatgtgataattatatctatgtataacagaggagaatacatatgtataattataacctggcggcagcgcaaaagatg

SEQ ID NO: 77341 - DNA, 103 bp, Artificial Sequence
  Synthetic Polynucleotide
taatacgactcactataggggtgaattttaatatgtgataattatatctaaacagaggagatagataatgttatcacataacctggcggcagcgcaaaagatg

SEQ ID NO: 77342 - DNA, 103 bp, Artificial Sequence
  Synthetic Polynucleotide
taatacgactcactatagggaatgtgtgaattttaatatgtgataattataacagaggagaataattatgacatattaaaacctggcggcagcgcaaaagatg

SEQ ID NO: 77343 - DNA, 103 bp, Artificial Sequence
  Synthetic Polynucleotide
taatacgactcactatagggtcaaaaatgtgtgaattttaatatgtgataaacagaggagatatcacatgttaaaattcaacctggcggcagcgcaaaagatg

SEQ ID NO: 77344 - DNA, 103 bp, Artificial Sequence
  Synthetic Polynucleotide
taatacgactcactatagggatttatcaaaaatgtgtgaattttaatatgaacagaggagacatattatgattcacacaaacctggcggcagcgcaaaagatg

SEQ ID NO: 77345 - DNA, 103 bp, Artificial Sequence
  Synthetic Polynucleotide
taatacgactcactatagggttcccatttatcaaaaatgtgtgaattttaaacagaggagataaaatatgcacatttttaacctggcggcagcgcaaaagatg

SEQ ID NO: 77346 - DNA, 103 bp, Artificial Sequence
  Synthetic Polynucleotide
taatacgactcactatagggcgtctctggaagagtcttcaacgataagtaaacagaggagatacttaatgttgaagactaacctggcggcagcgcaaaagatg

SEQ ID NO: 77347 - DNA, 103 bp, Artificial Sequence
  Synthetic Polynucleotide
taatacgactcactatagggttgtattattgggtgtatttggagtataggaacagaggagacctataatgcaaatacacaacctggcggcagcgcaaaagatg

SEQ ID NO: 77348 - DNA, 103 bp, Artificial Sequence
  Synthetic Polynucleotide
taatacgactcactatagggagtagttcccatttatcaaaaatgtgtgaaaacagaggagattcacaatgttttgataaaacctggcggcagcgcaaaagatg

SEQ ID NO: 77349 - DNA, 103 bp, Artificial Sequence
  Synthetic Polynucleotide
taatacgactcactataggggttgcagtagttcccatttatcaaaaatgtaacagaggagaacatttatgataaatgggaacctggcggcagcgcaaaagatg

SEQ ID NO: 77350 - DNA, 103 bp, Artificial Sequence
  Synthetic Polynucleotide
taatacgactcactatagggaaattgttgcagtagttcccatttatcaaaaacagaggagatttgatatgtgggaactaaacctggcggcagcgcaaaagatg

SEQ ID NO: 77351 - DNA, 103 bp, Artificial Sequence
  Synthetic Polynucleotide
taatacgactcactatagggagtctaaattgttgcagtagttcccatttaaacagaggagataaatgatgactactgcaaacctggcggcagcgcaaaagatg

SEQ ID NO: 77352 - DNA, 103 bp, Artificial Sequence
  Synthetic Polynucleotide
taatacgactcactataggggtgggagtctaaattgttgcagtagttcccaacagaggagagggaacatgtgcaacaataacctggcggcagcgcaaaagatg

SEQ ID NO: 77353 - DNA, 103 bp, Artificial Sequence
  Synthetic Polynucleotide
taatacgactcactatagggatttggtgggagtctaaattgttgcagtagaacagaggagactactgatgcaatttagaaacctggcggcagcgcaaaagatg

SEQ ID NO: 77354 - DNA, 103 bp, Artificial Sequence
  Synthetic Polynucleotide
taatacgactcactatagggcattaatttggtgggagtctaaattgttgcaacagaggagagcaacaatgtagactcccaacctggcggcagcgcaaaagatg

SEQ ID NO: 77355 - DNA, 103 bp, Artificial Sequence
  Synthetic Polynucleotide
taatacgactcactatagggttattcattaatttggtgggagtctaaattaacagaggagaaatttaatgtcccaccaaaacctggcggcagcgcaaaagatg

SEQ ID NO: 77356 - DNA, 103 bp, Artificial Sequence
  Synthetic Polynucleotide
taatacgactcactatagggtctctttattcattaatttggtgggagtctaacagaggagaagactcatgccaaattaaaacctggcggcagcgcaaaagatg

SEQ ID NO: 77357 - DNA, 103 bp, Artificial Sequence
  Synthetic Polynucleotide
taatacgactcactatagggtgcattctctttattcattaatttggtgggaacagaggagacccaccatgttaatgaataacctggcggcagcgcaaaagatg

SEQ ID NO: 77358 - DNA, 103 bp, Artificial Sequence
  Synthetic Polynucleotide
taatacgactcactatagggggttgttgtattattgggtgtatttggagtaacagaggagaactccaatgacacccaataacctggcggcagcgcaaaagatg

SEQ ID NO: 77359 - DNA, 103 bp, Artificial Sequence
  Synthetic Polynucleotide
taatacgactcactatagggatttctgcattctctttattcattaatttgaacagaggagacaaattatggaataaagaaacctggcggcagcgcaaaagatg

SEQ ID NO: 77360 - DNA, 103 bp, Artificial Sequence
  Synthetic Polynucleotide
taatacgactcactatagggaaatcatttctgcattctctttattcattaaacagaggagataatgaatgaagagaatgaacctggcggcagcgcaaaagatg

SEQ ID NO: 77361 - DNA, 103 bp, Artificial Sequence
  Synthetic Polynucleotide
taatacgactcactatagggttccaaaatcatttctgcattctctttattaacagaggagaaataaaatgaatgcagaaaacctggcggcagcgcaaaagatg

SEQ ID NO: 77362 - DNA, 103 bp, Artificial Sequence
  Synthetic Polynucleotide
taatacgactcactatagggaatttttccaaaatcatttctgcattctctaacagaggagaagagaaatgagaaatgataacctggcggcagcgcaaaagatg

SEQ ID NO: 77363 - DNA, 103 bp, Artificial Sequence
  Synthetic Polynucleotide
taatacgactcactatagggtcaacaatttttccaaaatcatttctgcataacagaggagaatgcagatgtgattttggaacctggcggcagcgcaaaagatg

SEQ ID NO: 77364 - DNA, 103 bp, Artificial Sequence
  Synthetic Polynucleotide
taatacgactcactatagggtatgatcaacaatttttccaaaatcatttcaacagaggagagaaatgatgttggaaaaaaacctggcggcagcgcaaaagatg

SEQ ID NO: 77365 - DNA, 103 bp, Artificial Sequence
  Synthetic Polynucleotide
taatacgactcactatagggaactatatgatcaacaatttttccaaaatcaacagaggagagattttatgaaaattgttaacctggcggcagcgcaaaagatg

SEQ ID NO: 77366 - DNA, 103 bp, Artificial Sequence
  Synthetic Polynucleotide
taatacgactcactatagggtacataactatatgatcaacaatttttccaaacagaggagatggaaaatgtgttgatcaaacctggcggcagcgcaaaagatg

SEQ ID NO: 77367 - DNA, 103 bp, Artificial Sequence
  Synthetic Polynucleotide
taatacgactcactatagggtaatatacataactatatgatcaacaatttaacagaggagaaaattgatgatcatatagaacctggcggcagcgcaaaagatg

SEQ ID NO: 77368 - DNA, 103 bp, Artificial Sequence
  Synthetic Polynucleotide
taatacgactcactataggggtcactaatatacataactatatgatcaacaacagaggagagttgatatgatagttatgaacctggcggcagcgcaaaagatg

SEQ ID NO: 77369 - DNA, 103 bp, Artificial Sequence
  Synthetic Polynucleotide
taatacgactcactataggggaaatggttgttgtattattgggtgtatttaacagaggagaaaatacatgcaataatacaacctggcggcagcgcaaaagatg

SEQ ID NO: 77370 - DNA, 103 bp, Artificial Sequence
  Synthetic Polynucleotide
taatacgactcactataggggattcgtcactaatatacataactatatgaaacagaggagatcatatatgtatgtatataacctggcggcagcgcaaaagatg

SEQ ID NO: 77371 - DNA, 103 bp, Artificial Sequence
  Synthetic Polynucleotide
taatacgactcactatagggctcttgattcgtcactaatatacataactaaacagaggagatagttaatgatattagtgaacctggcggcagcgcaaaagatg

SEQ ID NO: 77372 - DNA, 103 bp, Artificial Sequence
  Synthetic Polynucleotide
taatacgactcactatagggttcatctcttgattcgtcactaatatacataacagaggagaatgtatatgagtgacgaaaacctggcggcagcgcaaaagatg

SEQ ID NO: 77373 - DNA, 103 bp, Artificial Sequence
  Synthetic Polynucleotide
taatacgactcactatagggttattttcatctcttgattcgtcactaataaacagaggagatattagatgcgaatcaagaacctggcggcagcgcaaaagatg

SEQ ID NO: 77374 - DNA, 103 bp, Artificial Sequence
  Synthetic Polynucleotide
taatacgactcactatagggcaggattattttcatctcttgattcgtcacaacagaggagagtgacgatgcaagagatgaacctggcggcagcgcaaaagatg

SEQ ID NO: 77375 - DNA, 103 bp, Artificial Sequence
  Synthetic Polynucleotide
taatacgactcactatagggatattcaggattattttcatctcttgattcaacagaggagagaatcaatggatgaaaataacctggcggcagcgcaaaagatg

SEQ ID NO: 77376 - DNA, 103 bp, Artificial Sequence
  Synthetic Polynucleotide
taatacgactcactatagggtcaatatattcaggattattttcatctcttaacagaggagaaagagaatgaaataatccaacctggcggcagcgcaaaagatg

SEQ ID NO: 77377 - DNA, 103 bp, Artificial Sequence
  Synthetic Polynucleotide
taatacgactcactataggggaaaatcaatatattcaggattattttcataacagaggagaatgaaaatgatcctgaataacctggcggcagcgcaaaagatg

SEQ ID NO: 77378 - DNA, 103 bp, Artificial Sequence
  Synthetic Polynucleotide
taatacgactcactataggggttacgaaaatcaatatattcaggattattaacagaggagaaataatatggaatatattaacctggcggcagcgcaaaagatg

SEQ ID NO: 77379 - DNA, 103 bp, Artificial Sequence
  Synthetic Polynucleotide
taatacgactcactatagggtatctgttacgaaaatcaatatattcaggaaacagaggagatcctgaatgtattgatttaacctggcggcagcgcaaaagatg

SEQ ID NO: 77380 - DNA, 103 bp, Artificial Sequence
  Synthetic Polynucleotide
taatacgactcactatagggactcagaaatggttgttgtattattgggtgaacagaggagacacccaatgatacaacaaaacctggcggcagcgcaaaagatg

SEQ ID NO: 77381 - DNA, 103 bp, Artificial Sequence
  Synthetic Polynucleotide
taatacgactcactatagggctccgtatctgttacgaaaatcaatatattaacagaggagaaatataatgattttcgtaaacctggcggcagcgcaaaagatg

SEQ ID NO: 77382 - DNA, 103 bp, Artificial Sequence
  Synthetic Polynucleotide
taatacgactcactatagggatagtctccgtatctgttacgaaaatcaataacagaggagaattgatatgcgtaacagaaacctggcggcagcgcaaaagatg

SEQ ID NO: 77383 - DNA, 103 bp, Artificial Sequence
  Synthetic Polynucleotide
taatacgactcactataggggatctatagtctccgtatctgttacgaaaaaacagaggagattttcgatgcagatacggaacctggcggcagcgcaaaagatg

SEQ ID NO: 77384 - DNA, 103 bp, Artificial Sequence
  Synthetic Polynucleotide
taatacgactcactatagggtgaaagatctatagtctccgtatctgttacaacagaggagagtaacaatgacggagactaacctggcggcagcgcaaaagatg

SEQ ID NO: 77385 - DNA, 103 bp, Artificial Sequence
  Synthetic Polynucleotide
taatacgactcactatagggtataatgaaagatctatagtctccgtatctaacagaggagaagatacatggactatagaaacctggcggcagcgcaaaagatg

SEQ ID NO: 77386 - DNA, 103 bp, Artificial Sequence
  Synthetic Polynucleotide
taatacgactcactatagggctttttataatgaaagatctatagtctccgaacagaggagacggagaatgtagatctttaacctggcggcagcgcaaaagatg

SEQ ID NO: 77387 - DNA, 103 bp, Artificial Sequence
  Synthetic Polynucleotide
taatacgactcactataggggatcactttttataatgaaagatctatagtaacagaggagaactataatgctttcattaaacctggcggcagcgcaaaagatg

SEQ ID NO: 77388 - DNA, 103 bp, Artificial Sequence
  Synthetic Polynucleotide
taatacgactcactatagggcccgtgatcactttttataatgaaagatctaacagaggagaagatctatgattataaaaaacctggcggcagcgcaaaagatg

SEQ ID NO: 77389 - DNA, 103 bp, Artificial Sequence
  Synthetic Polynucleotide
taatacgactcactatagggacaaacccgtgatcactttttataatgaaaaacagaggagatttcatatgaaaaagtgaaacctggcggcagcgcaaaagatg

SEQ ID NO: 77390 - DNA, 103 bp, Artificial Sequence
  Synthetic Polynucleotide
taatacgactcactatagggtctttacaaacccgtgatcactttttataaaacagaggagattataaatggtgatcacgaacctggcggcagcgcaaaagatg

SEQ ID NO: 77391 - DNA, 103 bp, Artificial Sequence
  Synthetic Polynucleotide
taatacgactcactatagggatccaactcagaaatggttgttgtattattaacagaggagaaataatatgacaaccattaacctggcggcagcgcaaaagatg

SEQ ID NO: 77392 - DNA, 103 bp, Artificial Sequence
  Synthetic Polynucleotide
taatacgactcactatagggcatgatctttacaaacccgtgatcacttttaacagaggagaaaaagtatgcacgggtttaacctggcggcagcgcaaaagatg

SEQ ID NO: 77393 - DNA, 103 bp, Artificial Sequence
  Synthetic Polynucleotide
taatacgactcactatagggctctgcatgatctttacaaacccgtgatcaaacagaggagatgatcaatggtttgtaaaaacctggcggcagcgcaaaagatg

SEQ ID NO: 77394 - DNA, 103 bp, Artificial Sequence
  Synthetic Polynucleotide
taatacgactcactatagggcttttctctgcatgatctttacaaacccgtaacagaggagaacgggtatgtaaagatcaaacctggcggcagcgcaaaagatg

SEQ ID NO: 77395 - DNA, 103 bp, Artificial Sequence
  Synthetic Polynucleotide
taatacgactcactataggggagaacttttctctgcatgatctttacaaaaacagaggagatttgtaatgatcatgcagaacctggcggcagcgcaaaagatg

SEQ ID NO: 77396 - DNA, 103 bp, Artificial Sequence
  Synthetic Polynucleotide
taatacgactcactatagggttttggagaacttttctctgcatgatctttaacagaggagaaaagatatggcagagaaaaacctggcggcagcgcaaaagatg

SEQ ID NO: 77397 - DNA, 103 bp, Artificial Sequence
  Synthetic Polynucleotide
taatacgactcactatagggtgtgtttttggagaacttttctctgcatgaaacagaggagatcatgcatggaaaagttcaacctggcggcagcgcaaaagatg

SEQ ID NO: 77398 - DNA, 103 bp, Artificial Sequence
  Synthetic Polynucleotide
taatacgactcactatagggtttgttgtgtttttggagaacttttctctgaacagaggagacagagaatggttctccaaaacctggcggcagcgcaaaagatg

SEQ ID NO: 77399 - DNA, 103 bp, Artificial Sequence
  Synthetic Polynucleotide
taatacgactcactatagggtatcatttgttgtgtttttggagaacttttaacagaggagaaaaagtatgccaaaaacaaacctggcggcagcgcaaaagatg

SEQ ID NO: 77400 - DNA, 103 bp, Artificial Sequence
  Synthetic Polynucleotide
taatacgactcactatagggttgattatcatttgttgtgtttttggagaaaacagaggagattctccatgaacacaacaaacctggcggcagcgcaaaagatg

SEQ ID NO: 77401 - DNA, 103 bp, Artificial Sequence
  Synthetic Polynucleotide
taatacgactcactatagggtgtgtttgattatcatttgttgtgtttttgaacagaggagacaaaaaatgaacaaatgaaacctggcggcagcgcaaaagatg

SEQ ID NO: 77402 - DNA, 103 bp, Artificial Sequence
  Synthetic Polynucleotide
taatacgactcactatagggatgatatccaactcagaaatggttgttgtaaacagaggagatacaacatgcatttctgaaacctggcggcagcgcaaaagatg

SEQ ID NO: 77403 - DNA, 103 bp, Artificial Sequence
  Synthetic Polynucleotide
taatacgactcactataggggtagatgtgtttgattatcatttgttgtgtaacagaggagaacacaaatgatgataatcaacctggcggcagcgcaaaagatg

SEQ ID NO: 77404 - DNA, 103 bp, Artificial Sequence
  Synthetic Polynucleotide
taatacgactcactatagggtgttcgtagatgtgtttgattatcatttgtaacagaggagaacaaatatgaatcaaacaaacctggcggcagcgcaaaagatg

SEQ ID NO: 77405 - DNA, 103 bp, Artificial Sequence
  Synthetic Polynucleotide
taatacgactcactataggggatattgttcgtagatgtgtttgattatcaaacagaggagatgataaatgaacacatctaacctggcggcagcgcaaaagatg

SEQ ID NO: 77406 - DNA, 103 bp, Artificial Sequence
  Synthetic Polynucleotide
taatacgactcactatagggaataagatattgttcgtagatgtgtttgataacagaggagaatcaaaatgatctacgaaaacctggcggcagcgcaaaagatg

SEQ ID NO: 77407 - DNA, 103 bp, Artificial Sequence
  Synthetic Polynucleotide
taatacgactcactatagggaccgaaataagatattgttcgtagatgtgtaacagaggagaacacatatgcgaacaataaacctggcggcagcgcaaaagatg

SEQ ID NO: 77408 - DNA, 103 bp, Artificial Sequence
  Synthetic Polynucleotide
taatacgactcactatagggcagataccgaaataagatattgttcgtagaaacagaggagatctacgatgaatatcttaaacctggcggcagcgcaaaagatg

SEQ ID NO: 77409 - DNA, 103 bp, Artificial Sequence
  Synthetic Polynucleotide
taatacgactcactatagggtacttcagataccgaaataagatattgttcaacagaggagagaacaaatgcttatttcgaacctggcggcagcgcaaaagatg

SEQ ID NO: 77410 - DNA, 103 bp, Artificial Sequence
  Synthetic Polynucleotide
taatacgactcactatagggataagtacttcagataccgaaataagatataacagaggagaatatctatgttcggtatcaacctggcggcagcgcaaaagatg

SEQ ID NO: 77411 - DNA, 103 bp, Artificial Sequence
  Synthetic Polynucleotide
taatacgactcactatagggttttaataagtacttcagataccgaaataaaacagaggagattatttatgtatctgaagaacctggcggcagcgcaaaagatg

SEQ ID NO: 77412 - DNA, 103 bp, Artificial Sequence
  Synthetic Polynucleotide
taatacgactcactatagggataggttttaataagtacttcagataccgaaacagaggagatcggtaatggaagtacttaacctggcggcagcgcaaaagatg

SEQ ID NO: 77413 - DNA, 103 bp, Artificial Sequence
  Synthetic Polynucleotide
taatacgactcactatagggttttgatgatatccaactcagaaatggttgaacagaggagacaaccaatgctgagttggaacctggcggcagcgcaaaagatg

SEQ ID NO: 77414 - DNA, 103 bp, Artificial Sequence
  Synthetic Polynucleotide
taatacgactcactatagggatatcataggttttaataagtacttcagataacagaggagaatctgaatgacttattaaaacctggcggcagcgcaaaagatg

SEQ ID NO: 77415 - DNA, 103 bp, Artificial Sequence
  Synthetic Polynucleotide
taatacgactcactatagggcatggatatcataggttttaataagtacttaacagaggagaaagtacatgttaaaacctaacctggcggcagcgcaaaagatg

SEQ ID NO: 77416 - DNA, 103 bp, Artificial Sequence
  Synthetic Polynucleotide
taatacgactcactatagggtcacccatggatatcataggttttaataagaacagaggagacttattatgacctatgataacctggcggcagcgcaaaagatg

SEQ ID NO: 77417 - DNA, 103 bp, Artificial Sequence
  Synthetic Polynucleotide
taatacgactcactatagggttatgtcacccatggatatcataggttttaaacagaggagataaaacatgtgatatccaaacctggcggcagcgcaaaagatg

SEQ ID NO: 77418 - DNA, 103 bp, Artificial Sequence
  Synthetic Polynucleotide
taatacgactcactatagggtgtaattatgtcacccatggatatcataggaacagaggagacctatgatgtccatgggtaacctggcggcagcgcaaaagatg

SEQ ID NO: 77419 - DNA, 103 bp, Artificial Sequence
  Synthetic Polynucleotide
taatacgactcactatagggttatatgtaattatgtcacccatggatatcaacagaggagagatatcatggggtgacataacctggcggcagcgcaaaagatg

SEQ ID NO: 77420 - DNA, 103 bp, Artificial Sequence
  Synthetic Polynucleotide
taatacgactcactatagggatccgttatatgtaattatgtcacccatggaacagaggagaccatggatgacataattaaacctggcggcagcgcaaaagatg

SEQ ID NO: 77421 - DNA, 103 bp, Artificial Sequence
  Synthetic Polynucleotide
taatacgactcactatagggtttacatccgttatatgtaattatgtcaccaacagaggagaggtgacatgattacatataacctggcggcagcgcaaaagatg

SEQ ID NO: 77422 - DNA, 103 bp, Artificial Sequence
  Synthetic Polynucleotide
taatacgactcactatagggttgtctttacatccgttatatgtaattatgaacagaggagacataatatgatataacggaacctggcggcagcgcaaaagatg

SEQ ID NO: 77423 - DNA, 103 bp, Artificial Sequence
  Synthetic Polynucleotide
taatacgactcactatagggatttattgtctttacatccgttatatgtaaaacagaggagattacatatgacggatgtaaacctggcggcagcgcaaaagatg

SEQ ID NO: 77424 - DNA, 103 bp, Artificial Sequence
  Synthetic Polynucleotide
taatacgactcactatagggcagtattttgatgatatccaactcagaaataacagaggagaatttctatgttggatatcaacctggcggcagcgcaaaagatg

SEQ ID NO: 77425 - DNA, 103 bp, Artificial Sequence
  Synthetic Polynucleotide
taatacgactcactatagggcatccatttattgtctttacatccgttataaacagaggagatataacatgtgtaaagacaacctggcggcagcgcaaaagatg

SEQ ID NO: 77426 - DNA, 103 bp, Artificial Sequence
  Synthetic Polynucleotide
taatacgactcactatagggtctagcatccatttattgtctttacatccgaacagaggagacggatgatgagacaataaaacctggcggcagcgcaaaagatg

SEQ ID NO: 77427 - DNA, 103 bp, Artificial Sequence
  Synthetic Polynucleotide
taatacgactcactataggggttgttctagcatccatttattgtctttacaacagaggagagtaaagatgataaatggaaacctggcggcagcgcaaaagatg

SEQ ID NO: 77428 - DNA, 103 bp, Artificial Sequence
  Synthetic Polynucleotide
taatacgactcactatagggagagagttgttctagcatccatttattgtcaacagaggagagacaatatgtggatgctaaacctggcggcagcgcaaaagatg

SEQ ID NO: 77429 - DNA, 103 bp, Artificial Sequence
  Synthetic Polynucleotide
taatacgactcactatagggagggtagagagttgttctagcatccatttaaacagaggagataaatgatggctagaacaaacctggcggcagcgcaaaagatg

SEQ ID NO: 77430 - DNA, 103 bp, Artificial Sequence
  Synthetic Polynucleotide
taatacgactcactatagggagtttagggtagagagttgttctagcatccaacagaggagaggatgcatgaacaactctaacctggcggcagcgcaaaagatg

SEQ ID NO: 77431 - DNA, 103 bp, Artificial Sequence
  Synthetic Polynucleotide
taatacgactcactataggggttaaagtttagggtagagagttgttctagaacagaggagactagaaatgctctctaccaacctggcggcagcgcaaaagatg

SEQ ID NO: 77432 - DNA, 103 bp, Artificial Sequence
  Synthetic Polynucleotide
taatacgactcactatagggagattgttaaagtttagggtagagagttgtaacagaggagaacaactatgtaccctaaaaacctggcggcagcgcaaaagatg

SEQ ID NO: 77433 - DNA, 103 bp, Artificial Sequence
  Synthetic Polynucleotide
taatacgactcactatagggcgtggagattgttaaagtttagggtagagaaacagaggagatctctaatgtaaactttaaacctggcggcagcgcaaaagatg

SEQ ID NO: 77434 - DNA, 103 bp, Artificial Sequence
  Synthetic Polynucleotide
taatacgactcactatagggccatacgtggagattgttaaagtttagggtaacagaggagaaccctaatgtttaacaataacctggcggcagcgcaaaagatg

SEQ ID NO: 77435 - DNA, 103 bp, Artificial Sequence
  Synthetic Polynucleotide
taatacgactcactatagggttatccagtattttgatgatatccaactcaaacagaggagatgagttatgtatcatcaaaacctggcggcagcgcaaaagatg

SEQ ID NO: 77436 - DNA, 103 bp, Artificial Sequence
  Synthetic Polynucleotide
taatacgactcactataggggagttccatacgtggagattgttaaagtttaacagaggagaaaacttatgcaatctccaaacctggcggcagcgcaaaagatg

SEQ ID NO: 77437 - DNA, 103 bp, Artificial Sequence
  Synthetic Polynucleotide
taatacgactcactatagggtacatgagttccatacgtggagattgttaaaacagaggagattaacaatgtccacgtataacctggcggcagcgcaaaagatg

SEQ ID NO: 77438 - DNA, 103 bp, Artificial Sequence
  Synthetic Polynucleotide
taatacgactcactatagggtatgctacatgagttccatacgtggagattaacagaggagaaatctcatggtatggaacaacctggcggcagcgcaaaagatg

SEQ ID NO: 77439 - DNA, 103 bp, Artificial Sequence
  Synthetic Polynucleotide
taatacgactcactatagggttacctatgctacatgagttccatacgtggaacagaggagaccacgtatggaactcatgaacctggcggcagcgcaaaagatg

SEQ ID NO: 77440 - DNA, 103 bp, Artificial Sequence
  Synthetic Polynucleotide
taatacgactcactatagggttacattacctatgctacatgagttccataaacagaggagatatggaatgcatgtagcaaacctggcggcagcgcaaaagatg

SEQ ID NO: 77441 - DNA, 103 bp, Artificial Sequence
  Synthetic Polynucleotide
taatacgactcactatagggacgcgttacattacctatgctacatgagttaacagaggagaaactcaatgagcataggtaacctggcggcagcgcaaaagatg

SEQ ID NO: 77442 - DNA, 103 bp, Artificial Sequence
  Synthetic Polynucleotide
taatacgactcactatagggaatatacgcgttacattacctatgctacataacagaggagaatgtagatgaggtaatgtaacctggcggcagcgcaaaagatg

SEQ ID NO: 77443 - DNA, 103 bp, Artificial Sequence
  Synthetic Polynucleotide
taatacgactcactatagggtataaaatatacgcgttacattacctatgcaacagaggagagcatagatgatgtaacgcaacctggcggcagcgcaaaagatg

SEQ ID NO: 77444 - DNA, 103 bp, Artificial Sequence
  Synthetic Polynucleotide
taatacgactcactatagggaaatgtataaaatatacgcgttacattaccaacagaggagaggtaatatgacgcgtataaacctggcggcagcgcaaaagatg

SEQ ID NO: 77445 - DNA, 103 bp, Artificial Sequence
  Synthetic Polynucleotide
taatacgactcactatagggctaaaaaatgtataaaatatacgcgttacaaacagaggagatgtaacatgtatattttaaacctggcggcagcgcaaaagatg

SEQ ID NO: 77446 - DNA, 103 bp, Artificial Sequence
  Synthetic Polynucleotide
taatacgactcactatagggcgtatttatccagtattttgatgatatccaaacagaggagatggataatgtcaaaatacaacctggcggcagcgcaaaagatg

SEQ ID NO: 77447 - DNA, 103 bp, Artificial Sequence
  Synthetic Polynucleotide
taatacgactcactataggggataactaaaaaatgtataaaatatacgcgaacagaggagacgcgtaatgtttatacataacctggcggcagcgcaaaagatg

SEQ ID NO: 77448 - DNA, 103 bp, Artificial Sequence
  Synthetic Polynucleotide
taatacgactcactatagggcatcagataactaaaaaatgtataaaatataacagaggagaatatttatgacattttttaacctggcggcagcgcaaaagatg

SEQ ID NO: 77449 - DNA, 103 bp, Artificial Sequence
  Synthetic Polynucleotide
taatacgactcactatagggtctttcatcagataactaaaaaatgtataaaacagaggagattatacatgttttagttaaacctggcggcagcgcaaaagatg

SEQ ID NO: 77450 - DNA, 103 bp, Artificial Sequence
  Synthetic Polynucleotide
taatacgactcactataggggtttatctttcatcagataactaaaaaatgaacagaggagacattttatggttatctgaaacctggcggcagcgcaaaagatg

SEQ ID NO: 77451 - DNA, 103 bp, Artificial Sequence
  Synthetic Polynucleotide
taatacgactcactatagggatctagtttatctttcatcagataactaaaaacagaggagatttagtatgctgatgaaaaacctggcggcagcgcaaaagatg

SEQ ID NO: 77452 - DNA, 103 bp, Artificial Sequence
  Synthetic Polynucleotide
taatacgactcactatagggtatatatctagtttatctttcatcagataaaacagaggagattatctatggaaagataaaacctggcggcagcgcaaaagatg

SEQ ID NO: 77453 - DNA, 103 bp, Artificial Sequence
  Synthetic Polynucleotide
taatacgactcactatagggttatttatatatctagtttatctttcatcaaacagaggagatgatgaatgataaactagaacctggcggcagcgcaaaagatg

SEQ ID NO: 77454 - DNA, 103 bp, Artificial Sequence
  Synthetic Polynucleotide
taatacgactcactatagggtgggattatttatatatctagtttatctttaacagaggagaaaagatatgctagatataaacctggcggcagcgcaaaagatg

SEQ ID NO: 77455 - DNA, 103 bp, Artificial Sequence
  Synthetic Polynucleotide
taatacgactcactatagggtagaatgggattatttatatatctagtttaaacagaggagataaactatgtatataaataacctggcggcagcgcaaaagatg

SEQ ID NO: 77456 - DNA, 103 bp, Artificial Sequence
  Synthetic Polynucleotide
taatacgactcactatagggagtattagaatgggattatttatatatctaaacagaggagatagataatgaaataatccaacctggcggcagcgcaaaagatg

SEQ ID NO: 77457 - DNA, 103 bp, Artificial Sequence
  Synthetic Polynucleotide
taatacgactcactataggggctatcgtctctggaagagtcttcaacgataacagaggagaatcgttatggactcttccaacctggcggcagcgcaaaagatg

SEQ ID NO: 77458 - DNA, 103 bp, Artificial Sequence
  Synthetic Polynucleotide
taatacgactcactataggggtcctcgtatttatccagtattttgatgataacagaggagaatcatcatgatactggataacctggcggcagcgcaaaagatg

SEQ ID NO: 77459 - DNA, 103 bp, Artificial Sequence
  Synthetic Polynucleotide
taatacgactcactataggggttaaagtattagaatgggattatttatataacagaggagaatataaatgatcccattcaacctggcggcagcgcaaaagatg

SEQ ID NO: 77460 - DNA, 103 bp, Artificial Sequence
  Synthetic Polynucleotide
taatacgactcactatagggcacatgttaaagtattagaatgggattattaacagaggagaaataatatgattctaataaacctggcggcagcgcaaaagatg

SEQ ID NO: 77461 - DNA, 103 bp, Artificial Sequence
  Synthetic Polynucleotide
taatacgactcactatagggtaatacacatgttaaagtattagaatgggaaacagaggagatcccatatgaatactttaaacctggcggcagcgcaaaagatg

SEQ ID NO: 77462 - DNA, 103 bp, Artificial Sequence
  Synthetic Polynucleotide
taatacgactcactataggggcatgtaatacacatgttaaagtattagaaaacagaggagattctaaatgtttaacatgaacctggcggcagcgcaaaagatg

SEQ ID NO: 77463 - DNA, 103 bp, Artificial Sequence
  Synthetic Polynucleotide
taatacgactcactatagggaagatgcatgtaatacacatgttaaagtataacagaggagaatacttatgcatgtgtataacctggcggcagcgcaaaagatg

SEQ ID NO: 77464 - DNA, 103 bp, Artificial Sequence
  Synthetic Polynucleotide
taatacgactcactatagggctaataagatgcatgtaatacacatgttaaaacagaggagattaacaatggtattacataacctggcggcagcgcaaaagatg

SEQ ID NO: 77465 - DNA, 103 bp, Artificial Sequence
  Synthetic Polynucleotide
taatacgactcactatagggatattctaataagatgcatgtaatacacataacagaggagaatgtgtatgacatgcatcaacctggcggcagcgcaaaagatg

SEQ ID NO: 77466 - DNA, 103 bp, Artificial Sequence
  Synthetic Polynucleotide
taatacgactcactatagggggttaatattctaataagatgcatgtaataaacagaggagatattacatgcatcttattaacctggcggcagcgcaaaagatg

SEQ ID NO: 77467 - DNA, 103 bp, Artificial Sequence
  Synthetic Polynucleotide
taatacgactcactatagggagttaggttaatattctaataagatgcatgaacagaggagacatgcaatgtattagaataacctggcggcagcgcaaaagatg

SEQ ID NO: 77468 - DNA, 103 bp, Artificial Sequence
  Synthetic Polynucleotide
taatacgactcactatagggcttttagttaggttaatattctaataagataacagaggagaatcttaatggaatattaaaacctggcggcagcgcaaaagatg

SEQ ID NO: 77469 - DNA, 103 bp, Artificial Sequence
  Synthetic Polynucleotide
taatacgactcactatagggtatacgtcctcgtatttatccagtattttgaacagaggagacaaaatatgggataaataaacctggcggcagcgcaaaagatg

SEQ ID NO: 77470 - DNA, 103 bp, Artificial Sequence
  Synthetic Polynucleotide
taatacgactcactatagggtatgtcttttagttaggttaatattctaataacagaggagaattagaatgttaacctaaaacctggcggcagcgcaaaagatg

SEQ ID NO: 77471 - DNA, 103 bp, Artificial Sequence
  Synthetic Polynucleotide
taatacgactcactatagggtatattatgtcttttagttaggttaatattaacagaggagaaatattatgctaactaaaaacctggcggcagcgcaaaagatg

SEQ ID NO: 77472 - DNA, 103 bp, Artificial Sequence
  Synthetic Polynucleotide
taatacgactcactataggggtttttatattatgtcttttagttaggttaaacagaggagataacctatgtaaaagacaaacctggcggcagcgcaaaagatg

SEQ ID NO: 77473 - DNA, 103 bp, Artificial Sequence
  Synthetic Polynucleotide
taatacgactcactatagggaataagtttttatattatgtcttttagttaaacagaggagataactaatggacataataaacctggcggcagcgcaaaagatg

SEQ ID NO: 77474 - DNA, 103 bp, Artificial Sequence
  Synthetic Polynucleotide
taatacgactcactatagggtatgtaataagtttttatattatgtcttttaacagaggagaaaaagaatgaatataaaaaacctggcggcagcgcaaaagatg

SEQ ID NO: 77475 - DNA, 103 bp, Artificial Sequence
  Synthetic Polynucleotide
taatacgactcactatagggtcaactatgtaataagtttttatattatgtaacagaggagaacataaatgaaaaacttaaacctggcggcagcgcaaaagatg

SEQ ID NO: 77476 - DNA, 103 bp, Artificial Sequence
  Synthetic Polynucleotide
taatacgactcactatagggttttatcaactatgtaataagtttttatataacagaggagaatataaatgcttattacaaacctggcggcagcgcaaaagatg

SEQ ID NO: 77477 - DNA, 103 bp, Artificial Sequence
  Synthetic Polynucleotide
taatacgactcactatagggccgctttttatcaactatgtaataagttttaacagaggagaaaaactatgtacatagttaacctggcggcagcgcaaaagatg

SEQ ID NO: 77478 - DNA, 103 bp, Artificial Sequence
  Synthetic Polynucleotide
taatacgactcactataggggcctaccgctttttatcaactatgtaataaaacagaggagattattaatgagttgataaaacctggcggcagcgcaaaagatg

SEQ ID NO: 77479 - DNA, 103 bp, Artificial Sequence
  Synthetic Polynucleotide
taatacgactcactatagggttatagcctaccgctttttatcaactatgtaacagaggagaacatagatgataaaaagcaacctggcggcagcgcaaaagatg

SEQ ID NO: 77480 - DNA, 103 bp, Artificial Sequence
  Synthetic Polynucleotide
taatacgactcactatagggctttatatacgtcctcgtatttatccagtaaacagaggagatactggatgaatacgaggaacctggcggcagcgcaaaagatg

SEQ ID NO: 77481 - DNA, 103 bp, Artificial Sequence
  Synthetic Polynucleotide
taatacgactcactatagggaatatttatagcctaccgctttttatcaacaacagaggagagttgatatgaagcggtagaacctggcggcagcgcaaaagatg

SEQ ID NO: 77482 - DNA, 103 bp, Artificial Sequence
  Synthetic Polynucleotide
taatacgactcactataggggccataatatttatagcctaccgctttttaaacagaggagataaaaaatggtaggctataacctggcggcagcgcaaaagatg

SEQ ID NO: 77483 - DNA, 103 bp, Artificial Sequence
  Synthetic Polynucleotide
taatacgactcactatagggctgctgccataatatttatagcctaccgctaacagaggagaagcggtatgctataaataaacctggcggcagcgcaaaagatg

SEQ ID NO: 77484 - DNA, 103 bp, Artificial Sequence
  Synthetic Polynucleotide
taatacgactcactatagggaacgactgctgccataatatttatagcctaaacagaggagataggctatgaatattatgaacctggcggcagcgcaaaagatg

SEQ ID NO: 77485 - DNA, 103 bp, Artificial Sequence
  Synthetic Polynucleotide
taatacgactcactatagggcgcggaacgactgctgccataatatttataaacagaggagatataaaatgtatggcagcaacctggcggcagcgcaaaagatg

SEQ ID NO: 77486 - DNA, 103 bp, Artificial Sequence
  Synthetic Polynucleotide
taatacgactcactatagggcaaaacgcggaacgactgctgccataatataacagaggagaatattaatgcagcagtcgaacctggcggcagcgcaaaagatg

SEQ ID NO: 77487 - DNA, 103 bp, Artificial Sequence
  Synthetic Polynucleotide
taatacgactcactataggggtcatcaaaacgcggaacgactgctgccataacagaggagaatggcaatggtcgttccgaacctggcggcagcgcaaaagatg

SEQ ID NO: 77488 - DNA, 103 bp, Artificial Sequence
  Synthetic Polynucleotide
taatacgactcactatagggtacacgtcatcaaaacgcggaacgactgctaacagaggagaagcagtatgtccgcgtttaacctggcggcagcgcaaaagatg

SEQ ID NO: 77489 - DNA, 103 bp, Artificial Sequence
  Synthetic Polynucleotide
taatacgactcactatagggttttgtacacgtcatcaaaacgcggaacgaaacagaggagatcgttcatggttttgatgaacctggcggcagcgcaaaagatg

SEQ ID NO: 77490 - DNA, 103 bp, Artificial Sequence
  Synthetic Polynucleotide
taatacgactcactatagggtgcatttttgtacacgtcatcaaaacgcggaacagaggagaccgcgtatggatgacgtgaacctggcggcagcgcaaaagatg

SEQ ID NO: 77491 - DNA, 103 bp, Artificial Sequence
  Synthetic Polynucleotide
taatacgactcactatagggacttactttatatacgtcctcgtatttatcaacagaggagagataaaatggaggacgtaaacctggcggcagcgcaaaagatg

SEQ ID NO: 77492 - DNA, 103 bp, Artificial Sequence
  Synthetic Polynucleotide
taatacgactcactatagggcgctgtgcatttttgtacacgtcatcaaaaaacagaggagattttgaatgcgtgtacaaaacctggcggcagcgcaaaagatg

SEQ ID NO: 77493 - DNA, 103 bp, Artificial Sequence
  Synthetic Polynucleotide
taatacgactcactatagggttcttcgctgtgcatttttgtacacgtcataacagaggagaatgacgatgacaaaaatgaacctggcggcagcgcaaaagatg

SEQ ID NO: 77494 - DNA, 103 bp, Artificial Sequence
  Synthetic Polynucleotide
taatacgactcactatagggtagaattcttcgctgtgcatttttgtacacaacagaggagagtgtacatgaatgcacagaacctggcggcagcgcaaaagatg

SEQ ID NO: 77495 - DNA, 103 bp, Artificial Sequence
  Synthetic Polynucleotide
taatacgactcactatagggtgatctagaattcttcgctgtgcatttttgaacagaggagacaaaaaatgacagcgaagaacctggcggcagcgcaaaagatg

SEQ ID NO: 77496 - DNA, 103 bp, Artificial Sequence
  Synthetic Polynucleotide
taatacgactcactatagggtttcttgatctagaattcttcgctgtgcataacagaggagaatgcacatggaagaattcaacctggcggcagcgcaaaagatg

SEQ ID NO: 77497 - DNA, 103 bp, Artificial Sequence
  Synthetic Polynucleotide
taatacgactcactatagggaaatgtttcttgatctagaattcttcgctgaacagaggagacagcgaatgattctagataacctggcggcagcgcaaaagatg

SEQ ID NO: 77498 - DNA, 103 bp, Artificial Sequence
  Synthetic Polynucleotide
taatacgactcactatagggctaaaaaatgtttcttgatctagaattcttaacagaggagaaagaatatgagatcaagaaacctggcggcagcgcaaaagatg

SEQ ID NO: 77499 - DNA, 103 bp, Artificial Sequence
  Synthetic Polynucleotide
taatacgactcactatagggctctactaaaaaatgtttcttgatctagaaaacagaggagattctagatgaagaaacataacctggcggcagcgcaaaagatg

SEQ ID NO: 77500 - DNA, 103 bp, Artificial Sequence
  Synthetic Polynucleotide
taatacgactcactatagggtagacctctactaaaaaatgtttcttgatcaacagaggagagatcaaatgacattttttaacctggcggcagcgcaaaagatg

SEQ ID NO: 77501 - DNA, 103 bp, Artificial Sequence
  Synthetic Polynucleotide
taatacgactcactatagggctacctagacctctactaaaaaatgtttctaacagaggagaagaaacatgttttagtagaacctggcggcagcgcaaaagatg

SEQ ID NO: 77502 - DNA, 103 bp, Artificial Sequence
  Synthetic Polynucleotide
taatacgactcactatagggtctttacttactttatatacgtcctcgtataacagaggagaatacgaatgcgtatataaaacctggcggcagcgcaaaagatg

SEQ ID NO: 77503 - DNA, 103 bp, Artificial Sequence
  Synthetic Polynucleotide
taatacgactcactatagggacggtctacctagacctctactaaaaaatgaacagaggagacattttatggtagaggtcaacctggcggcagcgcaaaagatg

SEQ ID NO: 77504 - DNA, 103 bp, Artificial Sequence
  Synthetic Polynucleotide
taatacgactcactatagggcattaacggtctacctagacctctactaaaaacagaggagatttagtatgggtctaggtaacctggcggcagcgcaaaagatg

SEQ ID NO: 77505 - DNA, 103 bp, Artificial Sequence
  Synthetic Polynucleotide
taatacgactcactatagggttcttcattaacggtctacctagacctctaaacagaggagatagaggatgaggtagaccaacctggcggcagcgcaaaagatg

SEQ ID NO: 77506 - DNA, 103 bp, Artificial Sequence
  Synthetic Polynucleotide
taatacgactcactatagggatgtgttcttcattaacggtctacctagacaacagaggagagtctagatggaccgttaaaacctggcggcagcgcaaaagatg

SEQ ID NO: 77507 - DNA, 103 bp, Artificial Sequence
  Synthetic Polynucleotide
taatacgactcactatagggcaaatatgtgttcttcattaacggtctaccaacagaggagaggtagaatgttaatgaagaacctggcggcagcgcaaaagatg

SEQ ID NO: 77508 - DNA, 103 bp, Artificial Sequence
  Synthetic Polynucleotide
taatacgactcactatagggtcaaacaaatatgtgttcttcattaacggtaacagaggagaaccgttatggaagaacacaacctggcggcagcgcaaaagatg

SEQ ID NO: 77509 - DNA, 103 bp, Artificial Sequence
  Synthetic Polynucleotide
taatacgactcactatagggaattatcaaacaaatatgtgttcttcattaaacagaggagataatgaatgacacatattaacctggcggcagcgcaaaagatg

SEQ ID NO: 77510 - DNA, 103 bp, Artificial Sequence
  Synthetic Polynucleotide
taatacgactcactatagggcgcgtaattatcaaacaaatatgtgttcttaacagaggagaaagaacatgtatttgtttaacctggcggcagcgcaaaagatg

SEQ ID NO: 77511 - DNA, 103 bp, Artificial Sequence
  Synthetic Polynucleotide
taatacgactcactatagggccatacgcgtaattatcaaacaaatatgtgaacagaggagacacataatggtttgataaaacctggcggcagcgcaaaagatg

SEQ ID NO: 77512 - DNA, 103 bp, Artificial Sequence
  Synthetic Polynucleotide
taatacgactcactatagggtccatccatacgcgtaattatcaaacaaataacagaggagaatttgtatgataattacgaacctggcggcagcgcaaaagatg

SEQ ID NO: 77513 - DNA, 103 bp, Artificial Sequence
  Synthetic Polynucleotide
taatacgactcactatagggctttttctttacttactttatatacgtcctaacagaggagaaggacgatgataaagtaaaacctggcggcagcgcaaaagatg

SEQ ID NO: 77514 - DNA, 103 bp, Artificial Sequence
  Synthetic Polynucleotide
taatacgactcactatagggtggtatccatccatacgcgtaattatcaaaaacagaggagatttgatatgtacgcgtataacctggcggcagcgcaaaagatg

SEQ ID NO: 77515 - DNA, 103 bp, Artificial Sequence
  Synthetic Polynucleotide
taatacgactcactataggggtttctggtatccatccatacgcgtaattaaacagaggagataattaatggtatggatgaacctggcggcagcgcaaaagatg

SEQ ID NO: 77516 - DNA, 103 bp, Artificial Sequence
  Synthetic Polynucleotide
taatacgactcactatagggttgccgtttctggtatccatccatacgcgtaacagaggagaacgcgtatggatggatacaacctggcggcagcgcaaaagatg

SEQ ID NO: 77517 - DNA, 103 bp, Artificial Sequence
  Synthetic Polynucleotide
taatacgactcactatagggccaaattgccgtttctggtatccatccataaacagaggagatatggaatgataccagaaaacctggcggcagcgcaaaagatg

SEQ ID NO: 77518 - DNA, 103 bp, Artificial Sequence
  Synthetic Polynucleotide
taatacgactcactatagggctactccaaattgccgtttctggtatccataacagaggagaatggatatgagaaacggcaacctggcggcagcgcaaaagatg

SEQ ID NO: 77519 - DNA, 103 bp, Artificial Sequence
  Synthetic Polynucleotide
taatacgactcactatagggatcgactactccaaattgccgtttctggtaaacagaggagataccagatgcggcaatttaacctggcggcagcgcaaaagatg

SEQ ID NO: 77520 - DNA, 103 bp, Artificial Sequence
  Synthetic Polynucleotide
taatacgactcactatagggtgcgtatcgactactccaaattgccgtttcaacagaggagagaaacgatgatttggagtaacctggcggcagcgcaaaagatg

SEQ ID NO: 77521 - DNA, 103 bp, Artificial Sequence
  Synthetic Polynucleotide
taatacgactcactatagggaggtttgcgtatcgactactccaaattgccaacagaggagaggcaatatggagtagtcgaacctggcggcagcgcaaaagatg

SEQ ID NO: 77522 - DNA, 103 bp, Artificial Sequence
  Synthetic Polynucleotide
taatacgactcactatagggcatctaggtttgcgtatcgactactccaaaaacagaggagatttggaatggtcgatacgaacctggcggcagcgcaaaagatg

SEQ ID NO: 77523 - DNA, 103 bp, Artificial Sequence
  Synthetic Polynucleotide
taatacgactcactatagggacttgcatctaggtttgcgtatcgactactaacagaggagaagtagtatgtacgcaaacaacctggcggcagcgcaaaagatg

SEQ ID NO: 77524 - DNA, 103 bp, Artificial Sequence
  Synthetic Polynucleotide
taatacgactcactatagggacattctttttctttacttactttatatacaacagaggagagtatatatggtaagtaaaaacctggcggcagcgcaaaagatg

SEQ ID NO: 77525 - DNA, 103 bp, Artificial Sequence
  Synthetic Polynucleotide
taatacgactcactatagggtagtcacttgcatctaggtttgcgtatcgaaacagaggagatcgataatgaaacctagaaacctggcggcagcgcaaaagatg

SEQ ID NO: 77526 - DNA, 103 bp, Artificial Sequence
  Synthetic Polynucleotide
taatacgactcactataggggataatagtcacttgcatctaggtttgcgtaacagaggagaacgcaaatgtagatgcaaaacctggcggcagcgcaaaagatg

SEQ ID NO: 77527 - DNA, 103 bp, Artificial Sequence
  Synthetic Polynucleotide
taatacgactcactatagggaatgggataatagtcacttgcatctaggttaacagaggagaaacctaatggcaagtgacaacctggcggcagcgcaaaagatg

SEQ ID NO: 77528 - DNA, 103 bp, Artificial Sequence
  Synthetic Polynucleotide
taatacgactcactatagggaacgaaatgggataatagtcacttgcatctaacagaggagaagatgcatgtgactattaaacctggcggcagcgcaaaagatg

SEQ ID NO: 77529 - DNA, 103 bp, Artificial Sequence
  Synthetic Polynucleotide
taatacgactcactatagggatcccaacgaaatgggataatagtcacttgaacagaggagacaagtgatgattatcccaaacctggcggcagcgcaaaagatg

SEQ ID NO: 77530 - DNA, 103 bp, Artificial Sequence
  Synthetic Polynucleotide
taatacgactcactatagggaagtaatcccaacgaaatgggataatagtcaacagaggagagactatatgcccatttcgaacctggcggcagcgcaaaagatg

SEQ ID NO: 77531 - DNA, 103 bp, Artificial Sequence
  Synthetic Polynucleotide
taatacgactcactatagggtttttaagtaatcccaacgaaatgggataaaacagaggagattatccatgttcgttgggaacctggcggcagcgcaaaagatg

SEQ ID NO: 77532 - DNA, 103 bp, Artificial Sequence
  Synthetic Polynucleotide
taatacgactcactatagggtaaactttttaagtaatcccaacgaaatggaacagaggagaccatttatgtgggattacaacctggcggcagcgcaaaagatg

SEQ ID NO: 77533 - DNA, 103 bp, Artificial Sequence
  Synthetic Polynucleotide
taatacgactcactatagggaaacttaaactttttaagtaatcccaacgaaacagaggagatcgttgatgttacttaaaaacctggcggcagcgcaaaagatg

SEQ ID NO: 77534 - DNA, 103 bp, Artificial Sequence
  Synthetic Polynucleotide
taatacgactcactatagggatgagaaacttaaactttttaagtaatcccaacagaggagagggattatgtaaaaagttaacctggcggcagcgcaaaagatg

SEQ ID NO: 77535 - DNA, 103 bp, Artificial Sequence
  Synthetic Polynucleotide
taatacgactcactatagggattccacattctttttctttacttactttaaacagaggagataaagtatgtaaagaaaaaacctggcggcagcgcaaaagatg

SEQ ID NO: 77536 - DNA, 103 bp, Artificial Sequence
  Synthetic Polynucleotide
taatacgactcactataggggagacatgagaaacttaaactttttaagtaaacagaggagatacttaatgagtttaagtaacctggcggcagcgcaaaagatg

SEQ ID NO: 77537 - DNA, 103 bp, Artificial Sequence
  Synthetic Polynucleotide
taatacgactcactatagggatatagagacatgagaaacttaaactttttaacagaggagaaaaaagatgaagtttctcaacctggcggcagcgcaaaagatg

SEQ ID NO: 77538 - DNA, 103 bp, Artificial Sequence
  Synthetic Polynucleotide
taatacgactcactatagggcctttatatagagacatgagaaacttaaacaacagaggagagtttaaatgtctcatgtcaacctggcggcagcgcaaaagatg

SEQ ID NO: 77539 - DNA, 103 bp, Artificial Sequence
  Synthetic Polynucleotide
taatacgactcactatagggtaggacctttatatagagacatgagaaactaacagaggagaagtttcatgtgtctctataacctggcggcagcgcaaaagatg

SEQ ID NO: 77540 - DNA, 103 bp, Artificial Sequence
  Synthetic Polynucleotide
taatacgactcactatagggtggaataggacctttatatagagacatgagaacagaggagactcatgatgctatataaaaacctggcggcagcgcaaaagatg

SEQ ID NO: 77541 - DNA, 103 bp, Artificial Sequence
  Synthetic Polynucleotide
taatacgactcactatagggtatactggaataggacctttatatagagacaacagaggagagtctctatgtaaaggtccaacctggcggcagcgcaaaagatg

SEQ ID NO: 77542 - DNA, 103 bp, Artificial Sequence
  Synthetic Polynucleotide
taatacgactcactatagggcttcgtatactggaataggacctttatataaacagaggagatatataatggtcctattcaacctggcggcagcgcaaaagatg

SEQ ID NO: 77543 - DNA, 103 bp, Artificial Sequence
  Synthetic Polynucleotide
taatacgactcactatagggtttttcttcgtatactggaataggacctttaacagaggagaaaaggtatgattccagtaaacctggcggcagcgcaaaagatg

SEQ ID NO: 77544 - DNA, 103 bp, Artificial Sequence
  Synthetic Polynucleotide
taatacgactcactatagggtttactttttcttcgtatactggaataggaaacagaggagatcctatatgagtatacgaaacctggcggcagcgcaaaagatg

SEQ ID NO: 77545 - DNA, 103 bp, Artificial Sequence
  Synthetic Polynucleotide
taatacgactcactatagggcagtatttactttttcttcgtatactggaaaacagaggagattccagatgacgaagaaaaacctggcggcagcgcaaaagatg

SEQ ID NO: 77546 - DNA, 103 bp, Artificial Sequence
  Synthetic Polynucleotide
taatacgactcactatagggagcaaattccacattctttttctttacttaaacagaggagataagtaatgaaaaagaataacctggcggcagcgcaaaagatg

SEQ ID NO: 77547 - DNA, 103 bp, Artificial Sequence
  Synthetic Polynucleotide
taatacgactcactataggggaattcagtatttactttttcttcgtatacaacagaggagagtatacatggaaaaagtaaacctggcggcagcgcaaaagatg

SEQ ID NO: 77548 - DNA, 103 bp, Artificial Sequence
  Synthetic Polynucleotide
taatacgactcactataggggctatgaattcagtatttactttttcttcgaacagaggagacgaagaatgagtaaatacaacctggcggcagcgcaaaagatg

SEQ ID NO: 77549 - DNA, 103 bp, Artificial Sequence
  Synthetic Polynucleotide
taatacgactcactatagggcattggctatgaattcagtatttactttttaacagaggagaaaaaagatgatactgaataacctggcggcagcgcaaaagatg

SEQ ID NO: 77550 - DNA, 103 bp, Artificial Sequence
  Synthetic Polynucleotide
taatacgactcactatagggcgatccattggctatgaattcagtatttacaacagaggagagtaaatatggaattcataaacctggcggcagcgcaaaagatg

SEQ ID NO: 77551 - DNA, 103 bp, Artificial Sequence
  Synthetic Polynucleotide
taatacgactcactataggggagaacgatccattggctatgaattcagtaaacagaggagatactgaatgcatagccaaaacctggcggcagcgcaaaagatg

SEQ ID NO: 77552 - DNA, 103 bp, Artificial Sequence
  Synthetic Polynucleotide
taatacgactcactatagggtaccagagaacgatccattggctatgaattaacagaggagaaattcaatgccaatggataacctggcggcagcgcaaaagatg

SEQ ID NO: 77553 - DNA, 103 bp, Artificial Sequence
  Synthetic Polynucleotide
taatacgactcactataggggtatctaccagagaacgatccattggctataacagaggagaatagccatgggatcgttcaacctggcggcagcgcaaaagatg

SEQ ID NO: 77554 - DNA, 103 bp, Artificial Sequence
  Synthetic Polynucleotide
taatacgactcactataggggatacgtatctaccagagaacgatccattgaacagaggagacaatggatggttctctggaacctggcggcagcgcaaaagatg

SEQ ID NO: 77555 - DNA, 103 bp, Artificial Sequence
  Synthetic Polynucleotide
taatacgactcactataggggatatgatacgtatctaccagagaacgatcaacagaggagagatcgtatgctggtagataacctggcggcagcgcaaaagatg

SEQ ID NO: 77556 - DNA, 103 bp, Artificial Sequence
  Synthetic Polynucleotide
taatacgactcactatagggtcgaagatatgatacgtatctaccagagaaaacagaggagattctctatgagatacgtaaacctggcggcagcgcaaaagatg

SEQ ID NO: 77557 - DNA, 103 bp, Artificial Sequence
  Synthetic Polynucleotide
taatacgactcactatagggttcatagcaaattccacattctttttctttaacagaggagaaaagaaatggaatgtggaaacctggcggcagcgcaaaagatg

SEQ ID NO: 77558 - DNA, 103 bp, Artificial Sequence
  Synthetic Polynucleotide
taatacgactcactatagggaactttcgaagatatgatacgtatctaccaaacagaggagatggtagatgcgtatcataaacctggcggcagcgcaaaagatg

SEQ ID NO: 77559 - DNA, 103 bp, Artificial Sequence
  Synthetic Polynucleotide
taatacgactcactatagggcagaaaactttcgaagatatgatacgtatcaacagaggagagatacgatgcatatcttcaacctggcggcagcgcaaaagatg

SEQ ID NO: 77560 - DNA, 103 bp, Artificial Sequence
  Synthetic Polynucleotide
taatacgactcactatagggaagagcagaaaactttcgaagatatgatacaacagaggagagtatcaatgcttcgaaagaacctggcggcagcgcaaaagatg

SEQ ID NO: 77561 - DNA, 103 bp, Artificial Sequence
  Synthetic Polynucleotide
taatacgactcactataggggttggaagagcagaaaactttcgaagatataacagaggagaatatctatgaaagttttcaacctggcggcagcgcaaaagatg

SEQ ID NO: 77562 - DNA, 103 bp, Artificial Sequence
  Synthetic Polynucleotide
taatacgactcactatagggcgtttgttggaagagcagaaaactttcgaaaacagaggagattcgaaatgtttctgctcaacctggcggcagcgcaaaagatg

SEQ ID NO: 77563 - DNA, 103 bp, Artificial Sequence
  Synthetic Polynucleotide
taatacgactcactatagggaaactcgtttgttggaagagcagaaaacttaacagaggagaaagtttatggctcttccaaacctggcggcagcgcaaaagatg

SEQ ID NO: 77564 - DNA, 103 bp, Artificial Sequence
  Synthetic Polynucleotide
taatacgactcactatagggctaataaactcgtttgttggaagagcagaaaacagaggagattctgcatgtccaacaaaaacctggcggcagcgcaaaagatg

SEQ ID NO: 77565 - DNA, 103 bp, Artificial Sequence
  Synthetic Polynucleotide
taatacgactcactatagggaaaaactaataaactcgtttgttggaagagaacagaggagactcttcatgcaaacgagtaacctggcggcagcgcaaaagatg

SEQ ID NO: 77566 - DNA, 103 bp, Artificial Sequence
  Synthetic Polynucleotide
taatacgactcactatagggtaacaaaaaactaataaactcgtttgttggaacagaggagaccaacaatggagtttattaacctggcggcagcgcaaaagatg

SEQ ID NO: 77567 - DNA, 103 bp, Artificial Sequence
  Synthetic Polynucleotide
taatacgactcactataggggtcagtaacaaaaaactaataaactcgtttaacagaggagaaaacgaatgtattagtttaacctggcggcagcgcaaaagatg

SEQ ID NO: 77568 - DNA, 103 bp, Artificial Sequence
  Synthetic Polynucleotide
taatacgactcactatagggaattagctatcgtctctggaagagtcttcaaacagaggagatgaagaatgttccagagaaacctggcggcagcgcaaaagatg

SEQ ID NO: 77569 - DNA, 103 bp, Artificial Sequence
  Synthetic Polynucleotide
taatacgactcactatagggacaacttcatagcaaattccacattcttttaacagaggagaaaaagaatgtggaatttgaacctggcggcagcgcaaaagatg

SEQ ID NO: 77570 - DNA, 103 bp, Artificial Sequence
  Synthetic Polynucleotide
taatacgactcactatagggtggaagtcagtaacaaaaaactaataaactaacagaggagaagtttaatggttttttgtaacctggcggcagcgcaaaagatg

SEQ ID NO: 77571 - DNA, 103 bp, Artificial Sequence
  Synthetic Polynucleotide
taatacgactcactatagggtggaatggaagtcagtaacaaaaaactaataacagaggagaattagtatgttgttactgaacctggcggcagcgcaaaagatg

SEQ ID NO: 77572 - DNA, 103 bp, Artificial Sequence
  Synthetic Polynucleotide
taatacgactcactatagggtagattggaatggaagtcagtaacaaaaaaaacagaggagattttttatgactgacttcaacctggcggcagcgcaaaagatg

SEQ ID NO: 77573 - DNA, 103 bp, Artificial Sequence
  Synthetic Polynucleotide
taatacgactcactatagggtattatagattggaatggaagtcagtaacaaacagaggagatgttacatgcttccattcaacctggcggcagcgcaaaagatg

SEQ ID NO: 77574 - DNA, 103 bp, Artificial Sequence
  Synthetic Polynucleotide
taatacgactcactatagggcaagatattatagattggaatggaagtcagaacagaggagactgactatgattccaatcaacctggcggcagcgcaaaagatg

SEQ ID NO: 77575 - DNA, 103 bp, Artificial Sequence
  Synthetic Polynucleotide
taatacgactcactatagggcagaacaagatattatagattggaatggaaaacagaggagattccatatgaatctataaaacctggcggcagcgcaaaagatg

SEQ ID NO: 77576 - DNA, 103 bp, Artificial Sequence
  Synthetic Polynucleotide
taatacgactcactatagggtaaaccagaacaagatattatagattggaaaacagaggagattccaaatgataatatctaacctggcggcagcgcaaaagatg

SEQ ID NO: 77577 - DNA, 103 bp, Artificial Sequence
  Synthetic Polynucleotide
taatacgactcactatagggatttttaaaccagaacaagatattatagataacagaggagaatctatatgatcttgttcaacctggcggcagcgcaaaagatg

SEQ ID NO: 77578 - DNA, 103 bp, Artificial Sequence
  Synthetic Polynucleotide
taatacgactcactatagggtgagtatttttaaaccagaacaagatattaaacagaggagataatatatggttctggttaacctggcggcagcgcaaaagatg

SEQ ID NO: 77579 - DNA, 103 bp, Artificial Sequence
  Synthetic Polynucleotide
taatacgactcactatagggcaaactgagtatttttaaaccagaacaagaaacagaggagatcttgtatgggtttaaaaaacctggcggcagcgcaaaagatg

SEQ ID NO: 77580 - DNA, 103 bp, Artificial Sequence
  Synthetic Polynucleotide
taatacgactcactatagggagtagacaacttcatagcaaattccacattaacagaggagaaatgtgatgtttgctatgaacctggcggcagcgcaaaagatg

SEQ ID NO: 77581 - DNA, 103 bp, Artificial Sequence
  Synthetic Polynucleotide
taatacgactcactatagggaatatcaaactgagtatttttaaaccagaaaacagaggagattctggatgaaaaatactaacctggcggcagcgcaaaagatg

SEQ ID NO: 77582 - DNA, 103 bp, Artificial Sequence
  Synthetic Polynucleotide
taatacgactcactatagggttagtaatatcaaactgagtatttttaaacaacagaggagagtttaaatgtactcagttaacctggcggcagcgcaaaagatg

SEQ ID NO: 77583 - DNA, 103 bp, Artificial Sequence
  Synthetic Polynucleotide
taatacgactcactatagggtgtgtttagtaatatcaaactgagtattttaacagaggagaaaaataatgagtttgataaacctggcggcagcgcaaaagatg

SEQ ID NO: 77584 - DNA, 103 bp, Artificial Sequence
  Synthetic Polynucleotide
taatacgactcactatagggtaatgtgtgtttagtaatatcaaactgagtaacagaggagaactcagatggatattactaacctggcggcagcgcaaaagatg

SEQ ID NO: 77585 - DNA, 103 bp, Artificial Sequence
  Synthetic Polynucleotide
taatacgactcactatagggctgaataatgtgtgtttagtaatatcaaacaacagaggagagtttgaatgtactaaacaaacctggcggcagcgcaaaagatg

SEQ ID NO: 77586 - DNA, 103 bp, Artificial Sequence
  Synthetic Polynucleotide
taatacgactcactatagggcgtatctgaataatgtgtgtttagtaatataacagaggagaatattaatgaacacacataacctggcggcagcgcaaaagatg

SEQ ID NO: 77587 - DNA, 103 bp, Artificial Sequence
  Synthetic Polynucleotide
taatacgactcactatagggatagacgtatctgaataatgtgtgtttagtaacagaggagaactaaaatgacattattcaacctggcggcagcgcaaaagatg

SEQ ID NO: 77588 - DNA, 103 bp, Artificial Sequence
  Synthetic Polynucleotide
taatacgactcactatagggtctgtatagacgtatctgaataatgtgtgtaacagaggagaacacacatgattcagataaacctggcggcagcgcaaaagatg

SEQ ID NO: 77589 - DNA, 103 bp, Artificial Sequence
  Synthetic Polynucleotide
taatacgactcactatagggcattatctgtatagacgtatctgaataatgaacagaggagacattatatggatacgtctaacctggcggcagcgcaaaagatg

SEQ ID NO: 77590 - DNA, 103 bp, Artificial Sequence
  Synthetic Polynucleotide
taatacgactcactatagggtttggcattatctgtatagacgtatctgaaaacagaggagattcagaatggtctatacaaacctggcggcagcgcaaaagatg

SEQ ID NO: 77591 - DNA, 103 bp, Artificial Sequence
  Synthetic Polynucleotide
taatacgactcactatagggttttgagtagacaacttcatagcaaattccaacagaggagaggaattatgtatgaagttaacctggcggcagcgcaaaagatg

SEQ ID NO: 77592 - DNA, 103 bp, Artificial Sequence
  Synthetic Polynucleotide
taatacgactcactatagggaggtgtttggcattatctgtatagacgtataacagaggagaatacgtatgtacagataaaacctggcggcagcgcaaaagatg

SEQ ID NO: 77593 - DNA, 103 bp, Artificial Sequence
  Synthetic Polynucleotide
taatacgactcactatagggatgccaggtgtttggcattatctgtatagaaacagaggagatctataatgataatgccaaacctggcggcagcgcaaaagatg

SEQ ID NO: 77594 - DNA, 103 bp, Artificial Sequence
  Synthetic Polynucleotide
taatacgactcactatagggagccaatgccaggtgtttggcattatctgtaacagaggagaacagatatggccaaacacaacctggcggcagcgcaaaagatg

SEQ ID NO: 77595 - DNA, 103 bp, Artificial Sequence
  Synthetic Polynucleotide
taatacgactcactatagggtacctagccaatgccaggtgtttggcattaaacagaggagataatgcatgacacctggcaacctggcggcagcgcaaaagatg

SEQ ID NO: 77596 - DNA, 103 bp, Artificial Sequence
  Synthetic Polynucleotide
taatacgactcactataggggcatatacctagccaatgccaggtgtttggaacagaggagaccaaacatgtggcattggaacctggcggcagcgcaaaagatg

SEQ ID NO: 77597 - DNA, 103 bp, Artificial Sequence
  Synthetic Polynucleotide
taatacgactcactatagggttgatgcatatacctagccaatgccaggtgaacagaggagacacctgatgttggctaggaacctggcggcagcgcaaaagatg

SEQ ID NO: 77598 - DNA, 103 bp, Artificial Sequence
  Synthetic Polynucleotide
taatacgactcactatagggcctgtttgatgcatatacctagccaatgccaacagaggagaggcattatgtaggtatataacctggcggcagcgcaaaagatg

SEQ ID NO: 77599 - DNA, 103 bp, Artificial Sequence
  Synthetic Polynucleotide
taatacgactcactatagggagtctcctgtttgatgcatatacctagccaaacagaggagatggctaatgatatgcatcaacctggcggcagcgcaaaagatg

SEQ ID NO: 77600 - DNA, 103 bp, Artificial Sequence
  Synthetic Polynucleotide
taatacgactcactatagggcttatagtctcctgtttgatgcatatacctaacagaggagaaggtatatgcatcaaacaaacctggcggcagcgcaaaagatg

SEQ ID NO: 77601 - DNA, 103 bp, Artificial Sequence
  Synthetic Polynucleotide
taatacgactcactatagggaaaggcttatagtctcctgtttgatgcataaacagaggagatatgcaatgaacaggagaaacctggcggcagcgcaaaagatg

SEQ ID NO: 77602 - DNA, 103 bp, Artificial Sequence
  Synthetic Polynucleotide
taatacgactcactatagggaatcgttttgagtagacaacttcatagcaaaacagaggagattgctaatgagttgtctaaacctggcggcagcgcaaaagatg

SEQ ID NO: 77603 - DNA, 103 bp, Artificial Sequence
  Synthetic Polynucleotide
taatacgactcactatagggtaaacaaaggcttatagtctcctgtttgataacagaggagaatcaaaatggagactataaacctggcggcagcgcaaaagatg

SEQ ID NO: 77604 - DNA, 103 bp, Artificial Sequence
  Synthetic Polynucleotide
taatacgactcactatagggacgactaaacaaaggcttatagtctcctgtaacagaggagaacaggaatgtataagcctaacctggcggcagcgcaaaagatg

SEQ ID NO: 77605 - DNA, 103 bp, Artificial Sequence
  Synthetic Polynucleotide
taatacgactcactatagggttgagacgactaaacaaaggcttatagtctaacagaggagaagactaatggcctttgttaacctggcggcagcgcaaaagatg

SEQ ID NO: 77606 - DNA, 103 bp, Artificial Sequence
  Synthetic Polynucleotide
taatacgactcactatagggtctctttgagacgactaaacaaaggcttataacagaggagaataagcatgtgtttagtcaacctggcggcagcgcaaaagatg

SEQ ID NO: 77607 - DNA, 103 bp, Artificial Sequence
  Synthetic Polynucleotide
taatacgactcactatagggataattctctttgagacgactaaacaaaggaacagaggagacctttgatgagtcgtctcaacctggcggcagcgcaaaagatg

SEQ ID NO: 77608 - DNA, 103 bp, Artificial Sequence
  Synthetic Polynucleotide
taatacgactcactatagggaatatataattctctttgagacgactaaacaacagaggagagtttagatgtctcaaagaaacctggcggcagcgcaaaagatg

SEQ ID NO: 77609 - DNA, 103 bp, Artificial Sequence
  Synthetic Polynucleotide
taatacgactcactatagggcggtaaatatataattctctttgagacgacaacagaggagagtcgtcatgaagagaattaacctggcggcagcgcaaaagatg

SEQ ID NO: 77610 - DNA, 103 bp, Artificial Sequence
  Synthetic Polynucleotide
taatacgactcactataggggggaccggtaaatatataattctctttgagaacagaggagactcaaaatgaattatataaacctggcggcagcgcaaaagatg

SEQ ID NO: 77611 - DNA, 103 bp, Artificial Sequence
  Synthetic Polynucleotide
taatacgactcactatagggggaacgggaccggtaaatatataattctctaacagaggagaagagaaatgtatatttacaacctggcggcagcgcaaaagatg

SEQ ID NO: 77612 - DNA, 103 bp, Artificial Sequence
  Synthetic Polynucleotide
taatacgactcactatagggctattggaacgggaccggtaaatatataataacagaggagaattataatgttaccggtcaacctggcggcagcgcaaaagatg

SEQ ID NO: 77613 - DNA, 103 bp, Artificial Sequence
  Synthetic Polynucleotide
taatacgactcactatagggtttctaatcgttttgagtagacaacttcataacagaggagaatgaagatgtctactcaaaacctggcggcagcgcaaaagatg

SEQ ID NO: 77614 - DNA, 103 bp, Artificial Sequence
  Synthetic Polynucleotide
taatacgactcactataggggatacctattggaacgggaccggtaaatataacagaggagaatatttatgggtcccgttaacctggcggcagcgcaaaagatg

SEQ ID NO: 77615 - DNA, 103 bp, Artificial Sequence
  Synthetic Polynucleotide
taatacgactcactatagggtctttgatacctattggaacgggaccggtaaacagaggagataccggatgcgttccaataacctggcggcagcgcaaaagatg

SEQ ID NO: 77616 - DNA, 103 bp, Artificial Sequence
  Synthetic Polynucleotide
taatacgactcactatagggctatatctttgatacctattggaacgggacaacagaggagagtcccgatgcaataggtaaacctggcggcagcgcaaaagatg

SEQ ID NO: 77617 - DNA, 103 bp, Artificial Sequence
  Synthetic Polynucleotide
taatacgactcactataggggtgatctatatctttgatacctattggaacaacagaggagagttccaatgggtatcaaaaacctggcggcagcgcaaaagatg

SEQ ID NO: 77618 - DNA, 103 bp, Artificial Sequence
  Synthetic Polynucleotide
taatacgactcactatagggttagggtgatctatatctttgatacctattaacagaggagaaataggatgcaaagatataacctggcggcagcgcaaaagatg

SEQ ID NO: 77619 - DNA, 103 bp, Artificial Sequence
  Synthetic Polynucleotide
taatacgactcactatagggtaagattagggtgatctatatctttgatacaacagaggagagtatcaatgatatagatcaacctggcggcagcgcaaaagatg

SEQ ID NO: 77620 - DNA, 103 bp, Artificial Sequence
  Synthetic Polynucleotide
taatacgactcactatagggtctactaagattagggtgatctatatctttaacagaggagaaaagatatggatcaccctaacctggcggcagcgcaaaagatg

SEQ ID NO: 77621 - DNA, 103 bp, Artificial Sequence
  Synthetic Polynucleotide
taatacgactcactatagggcttgctctactaagattagggtgatctataaacagaggagatatagaatgccctaatctaacctggcggcagcgcaaaagatg

SEQ ID NO: 77622 - DNA, 103 bp, Artificial Sequence
  Synthetic Polynucleotide
taatacgactcactataggggacttcttgctctactaagattagggtgataacagaggagaatcaccatgatcttagtaaacctggcggcagcgcaaaagatg

SEQ ID NO: 77623 - DNA, 103 bp, Artificial Sequence
  Synthetic Polynucleotide
taatacgactcactatagggggatggacttcttgctctactaagattaggaacagaggagacctaatatgagtagagcaaacctggcggcagcgcaaaagatg

SEQ ID NO: 77624 - DNA, 103 bp, Artificial Sequence
  Synthetic Polynucleotide
taatacgactcactatagggatcgttttctaatcgttttgagtagacaacaacagaggagagttgtcatgtcaaaacgaaacctggcggcagcgcaaaagatg

SEQ ID NO: 77625 - DNA, 103 bp, Artificial Sequence
  Synthetic Polynucleotide
taatacgactcactatagggtagtcggatggacttcttgctctactaagaaacagaggagatcttagatgagcaagaagaacctggcggcagcgcaaaagatg

SEQ ID NO: 77626 - DNA, 103 bp, Artificial Sequence
  Synthetic Polynucleotide
taatacgactcactatagggtctcatagtcggatggacttcttgctctacaacagaggagagtagagatggaagtccataacctggcggcagcgcaaaagatg

SEQ ID NO: 77627 - DNA, 103 bp, Artificial Sequence
  Synthetic Polynucleotide
taatacgactcactatagggtaatgtctcatagtcggatggacttcttgcaacagaggagagcaagaatgccatccgacaacctggcggcagcgcaaaagatg

SEQ ID NO: 77628 - DNA, 103 bp, Artificial Sequence
  Synthetic Polynucleotide
taatacgactcactatagggttagctaatgtctcatagtcggatggacttaacagaggagaaagtccatgcgactatgaaacctggcggcagcgcaaaagatg

SEQ ID NO: 77629 - DNA, 103 bp, Artificial Sequence
  Synthetic Polynucleotide
taatacgactcactatagggtaatattagctaatgtctcatagtcggatgaacagaggagacatccgatgatgagacataacctggcggcagcgcaaaagatg

SEQ ID NO: 77630 - DNA, 103 bp, Artificial Sequence
  Synthetic Polynucleotide
taatacgactcactatagggagtactaatattagctaatgtctcatagtcaacagaggagagactatatgacattagctaacctggcggcagcgcaaaagatg

SEQ ID NO: 77631 - DNA, 103 bp, Artificial Sequence
  Synthetic Polynucleotide
taatacgactcactatagggaatatagtactaatattagctaatgtctcaaacagaggagatgagacatgagctaatataacctggcggcagcgcaaaagatg

SEQ ID NO: 77632 - DNA, 103 bp, Artificial Sequence
  Synthetic Polynucleotide
taatacgactcactatagggagtacaatatagtactaatattagctaatgaacagaggagacattagatgatattagtaaacctggcggcagcgcaaaagatg

SEQ ID NO: 77633 - DNA, 103 bp, Artificial Sequence
  Synthetic Polynucleotide
taatacgactcactatagggggtaaagtacaatatagtactaatattagcaacagaggagagctaatatgagtactataaacctggcggcagcgcaaaagatg

SEQ ID NO: 77634 - DNA, 103 bp, Artificial Sequence
  Synthetic Polynucleotide
taatacgactcactatagggtacttggtaaagtacaatatagtactaataaacagaggagatattagatgtatattgtaaacctggcggcagcgcaaaagatg

SEQ ID NO: 77635 - DNA, 103 bp, Artificial Sequence
  Synthetic Polynucleotide
taatacgactcactatagggtatcgatcgttttctaatcgttttgagtagaacagaggagactactcatgacgattagaaacctggcggcagcgcaaaagatg

SEQ ID NO: 77636 - DNA, 103 bp, Artificial Sequence
  Synthetic Polynucleotide
taatacgactcactataggggatcatacttggtaaagtacaatatagtacaacagaggagagtactaatgtgtactttaaacctggcggcagcgcaaaagatg

SEQ ID NO: 77637 - DNA, 103 bp, Artificial Sequence
  Synthetic Polynucleotide
taatacgactcactatagggtaccggatcatacttggtaaagtacaatataacagaggagaatattgatgtttaccaagaacctggcggcagcgcaaaagatg

SEQ ID NO: 77638 - DNA, 103 bp, Artificial Sequence
  Synthetic Polynucleotide
taatacgactcactatagggattaataccggatcatacttggtaaagtacaacagaggagagtacttatgcaagtatgaaacctggcggcagcgcaaaagatg

SEQ ID NO: 77639 - DNA, 103 bp, Artificial Sequence
  Synthetic Polynucleotide
taatacgactcactatagggaaaacattaataccggatcatacttggtaaaacagaggagattaccaatgatgatccggaacctggcggcagcgcaaaagatg

SEQ ID NO: 77640 - DNA, 103 bp, Artificial Sequence
  Synthetic Polynucleotide
taatacgactcactatagggcaataaaaacattaataccggatcatacttaacagaggagaaagtatatgccggtattaaacctggcggcagcgcaaaagatg

SEQ ID NO: 77641 - DNA, 103 bp, Artificial Sequence
  Synthetic Polynucleotide
taatacgactcactatagggtaaaacaataaaaacattaataccggatcaaacagaggagatgatccatgattaatgttaacctggcggcagcgcaaaagatg

SEQ ID NO: 77642 - DNA, 103 bp, Artificial Sequence
  Synthetic Polynucleotide
taatacgactcactataggggtacgtaaaacaataaaaacattaataccgaacagaggagacggtatatgtgtttttataacctggcggcagcgcaaaagatg

SEQ ID NO: 77643 - DNA, 103 bp, Artificial Sequence
  Synthetic Polynucleotide
taatacgactcactatagggcccaggtacgtaaaacaataaaaacattaaaacagaggagattaatgatgttattgtttaacctggcggcagcgcaaaagatg

SEQ ID NO: 77644 - DNA, 103 bp, Artificial Sequence
  Synthetic Polynucleotide
taatacgactcactataggggaatacccaggtacgtaaaacaataaaaacaacagaggagagtttttatggttttacgtaacctggcggcagcgcaaaagatg

SEQ ID NO: 77645 - DNA, 103 bp, Artificial Sequence
  Synthetic Polynucleotide
taatacgactcactatagggtaattgaatacccaggtacgtaaaacaataaacagaggagatattgtatgacgtacctgaacctggcggcagcgcaaaagatg

SEQ ID NO: 77646 - DNA, 103 bp, Artificial Sequence
  Synthetic Polynucleotide
taatacgactcactatagggcaaagtatcgatcgttttctaatcgttttgaacagaggagacaaaacatgtagaaaacgaacctggcggcagcgcaaaagatg

SEQ ID NO: 77647 - DNA, 103 bp, Artificial Sequence
  Synthetic Polynucleotide
taatacgactcactatagggtgtagtaattgaatacccaggtacgtaaaaaacagaggagattttacatgcctgggtataacctggcggcagcgcaaaagatg

SEQ ID NO: 77648 - DNA, 103 bp, Artificial Sequence
  Synthetic Polynucleotide
taatacgactcactatagggatttttgtagtaattgaatacccaggtacgaacagaggagacgtaccatggtattcaataacctggcggcagcgcaaaagatg

SEQ ID NO: 77649 - DNA, 103 bp, Artificial Sequence
  Synthetic Polynucleotide
taatacgactcactataggggagtaatttttgtagtaattgaatacccagaacagaggagactgggtatgcaattactaaacctggcggcagcgcaaaagatg

SEQ ID NO: 77650 - DNA, 103 bp, Artificial Sequence
  Synthetic Polynucleotide
taatacgactcactatagggtgctggagtaatttttgtagtaattgaataaacagaggagatattcaatgactacaaaaaacctggcggcagcgcaaaagatg

SEQ ID NO: 77651 - DNA, 103 bp, Artificial Sequence
  Synthetic Polynucleotide
taatacgactcactatagggtctactgctggagtaatttttgtagtaattaacagaggagaaattacatgaaaaattacaacctggcggcagcgcaaaagatg

SEQ ID NO: 77652 - DNA, 103 bp, Artificial Sequence
  Synthetic Polynucleotide
taatacgactcactataggggatactctactgctggagtaatttttgtagaacagaggagactacaaatgttactccagaacctggcggcagcgcaaaagatg

SEQ ID NO: 77653 - DNA, 103 bp, Artificial Sequence
  Synthetic Polynucleotide
taatacgactcactatagggcattagatactctactgctggagtaattttaacagaggagaaaaattatgccagcagtaaacctggcggcagcgcaaaagatg

SEQ ID NO: 77654 - DNA, 103 bp, Artificial Sequence
  Synthetic Polynucleotide
taatacgactcactatagggttatccattagatactctactgctggagtaaacagaggagatactccatgagtagagtaaacctggcggcagcgcaaaagatg

SEQ ID NO: 77655 - DNA, 103 bp, Artificial Sequence
  Synthetic Polynucleotide
taatacgactcactatagggtcagtttatccattagatactctactgctgaacagaggagacagcagatgagtatctaaaacctggcggcagcgcaaaagatg

SEQ ID NO: 77656 - DNA, 103 bp, Artificial Sequence
  Synthetic Polynucleotide
taatacgactcactatagggtagtttcagtttatccattagatactctacaacagaggagagtagagatgctaatggataacctggcggcagcgcaaaagatg

SEQ ID NO: 77657 - DNA, 103 bp, Artificial Sequence
  Synthetic Polynucleotide
taatacgactcactatagggtaaaccaaagtatcgatcgttttctaatcgaacagaggagacgattaatgaacgatcgaaacctggcggcagcgcaaaagatg

SEQ ID NO: 77658 - DNA, 103 bp, Artificial Sequence
  Synthetic Polynucleotide
taatacgactcactatagggtttgttagtttcagtttatccattagatacaacagaggagagtatctatgggataaactaacctggcggcagcgcaaaagatg

SEQ ID NO: 77659 - DNA, 103 bp, Artificial Sequence
  Synthetic Polynucleotide
taatacgactcactatagggcgttctttgttagtttcagtttatccattaaacagaggagataatggatgaactgaaacaacctggcggcagcgcaaaagatg

SEQ ID NO: 77660 - DNA, 103 bp, Artificial Sequence
  Synthetic Polynucleotide
taatacgactcactatagggtacatcgttctttgttagtttcagtttatcaacagaggagagataaaatgaaactaacaaacctggcggcagcgcaaaagatg

SEQ ID NO: 77661 - DNA, 103 bp, Artificial Sequence
  Synthetic Polynucleotide
taatacgactcactatagggagttgtacatcgttctttgttagtttcagtaacagaggagaactgaaatgaacaaagaaaacctggcggcagcgcaaaagatg

SEQ ID NO: 77662 - DNA, 103 bp, Artificial Sequence
  Synthetic Polynucleotide
taatacgactcactatagggacaacagttgtacatcgttctttgttagttaacagaggagaaactaaatgagaacgatgaacctggcggcagcgcaaaagatg

SEQ ID NO: 77663 - DNA, 103 bp, Artificial Sequence
  Synthetic Polynucleotide
taatacgactcactatagggtattcacaacagttgtacatcgttctttgtaacagaggagaacaaagatggatgtacaaaacctggcggcagcgcaaaagatg

SEQ ID NO: 77664 - DNA, 103 bp, Artificial Sequence
  Synthetic Polynucleotide
taatacgactcactatagggtaaaatattcacaacagttgtacatcgttcaacagaggagagaacgaatgacaactgttaacctggcggcagcgcaaaagatg

SEQ ID NO: 77665 - DNA, 103 bp, Artificial Sequence
  Synthetic Polynucleotide
taatacgactcactatagggaagcataaaatattcacaacagttgtacataacagaggagaatgtacatgtgttgtgaaaacctggcggcagcgcaaaagatg

SEQ ID NO: 77666 - DNA, 103 bp, Artificial Sequence
  Synthetic Polynucleotide
taatacgactcactatagggttacgaagcataaaatattcacaacagttgaacagaggagacaactgatgtgaatatttaacctggcggcagcgcaaaagatg

SEQ ID NO: 77667 - DNA, 103 bp, Artificial Sequence
  Synthetic Polynucleotide
taatacgactcactatagggacattttacgaagcataaaatattcacaacaacagaggagagttgtgatgattttatgcaacctggcggcagcgcaaaagatg

SEQ ID NO: 77668 - DNA, 103 bp, Artificial Sequence
  Synthetic Polynucleotide
taatacgactcactatagggtccaataaaccaaagtatcgatcgttttctaacagaggagaagaaaaatgtcgatacttaacctggcggcagcgcaaaagatg

SEQ ID NO: 77669 - DNA, 103 bp, Artificial Sequence
  Synthetic Polynucleotide
taatacgactcactataggggacctacattttacgaagcataaaatattcaacagaggagagaatatatgatgcttcgtaacctggcggcagcgcaaaagatg

SEQ ID NO: 77670 - DNA, 103 bp, Artificial Sequence
  Synthetic Polynucleotide
taatacgactcactatagggttcaagacctacattttacgaagcataaaaaacagaggagattttatatgtcgtaaaataacctggcggcagcgcaaaagatg

SEQ ID NO: 77671 - DNA, 103 bp, Artificial Sequence
  Synthetic Polynucleotide
taatacgactcactatagggtttggttcaagacctacattttacgaagcaaacagaggagatgcttcatgaaatgtaggaacctggcggcagcgcaaaagatg

SEQ ID NO: 77672 - DNA, 103 bp, Artificial Sequence
  Synthetic Polynucleotide
taatacgactcactataggggaatgtttggttcaagacctacattttacgaacagaggagacgtaaaatgtaggtcttgaacctggcggcagcgcaaaagatg

SEQ ID NO: 77673 - DNA, 103 bp, Artificial Sequence
  Synthetic Polynucleotide
taatacgactcactatagggtgaaagaatgtttggttcaagacctacattaacagaggagaaatgtaatgcttgaaccaaacctggcggcagcgcaaaagatg

SEQ ID NO: 77674 - DNA, 103 bp, Artificial Sequence
  Synthetic Polynucleotide
taatacgactcactatagggttctttgaaagaatgtttggttcaagacctaacagaggagaaggtctatgaccaaacataacctggcggcagcgcaaaagatg

SEQ ID NO: 77675 - DNA, 103 bp, Artificial Sequence
  Synthetic Polynucleotide
taatacgactcactatagggtctcattctttgaaagaatgtttggttcaaaacagaggagattgaacatgacattctttaacctggcggcagcgcaaaagatg

SEQ ID NO: 77676 - DNA, 103 bp, Artificial Sequence
  Synthetic Polynucleotide
taatacgactcactatagggatgtatctcattctttgaaagaatgtttggaacagaggagaccaaacatgctttcaaagaacctggcggcagcgcaaaagatg

SEQ ID NO: 77677 - DNA, 103 bp, Artificial Sequence
  Synthetic Polynucleotide
taatacgactcactataggggttttatgtatctcattctttgaaagaatgaacagaggagacattctatgaaagaatgaaacctggcggcagcgcaaaagatg

SEQ ID NO: 77678 - DNA, 103 bp, Artificial Sequence
  Synthetic Polynucleotide
taatacgactcactatagggataaagttttatgtatctcattctttgaaaaacagaggagatttcaaatgatgagatacaacctggcggcagcgcaaaagatg

SEQ ID NO: 77679 - DNA, 103 bp, Artificial Sequence
  Synthetic Polynucleotide
taatacgactcactatagggtactcaattagctatcgtctctggaagagtaacagaggagaactcttatggagacgataaacctggcggcagcgcaaaagatg

SEQ ID NO: 77680 - DNA, 103 bp, Artificial Sequence
  Synthetic Polynucleotide
taatacgactcactatagggacgaatccaataaaccaaagtatcgatcgtaacagaggagaacgatcatgactttggttaacctggcggcagcgcaaaagatg

SEQ ID NO: 77681 - DNA, 103 bp, Artificial Sequence
  Synthetic Polynucleotide
taatacgactcactatagggggataataaagttttatgtatctcattcttaacagaggagaaagaatatgatacataaaaacctggcggcagcgcaaaagatg

SEQ ID NO: 77682 - DNA, 103 bp, Artificial Sequence
  Synthetic Polynucleotide
taatacgactcactatagggctattggataataaagttttatgtatctcaaacagaggagatgagatatgtaaaactttaacctggcggcagcgcaaaagatg

SEQ ID NO: 77683 - DNA, 103 bp, Artificial Sequence
  Synthetic Polynucleotide
taatacgactcactatagggtcaatctattggataataaagttttatgtaaacagaggagatacataatgctttattataacctggcggcagcgcaaaagatg

SEQ ID NO: 77684 - DNA, 103 bp, Artificial Sequence
  Synthetic Polynucleotide
taatacgactcactatagggaatagtcaatctattggataataaagttttaacagaggagaaaaactatgttatccaataacctggcggcagcgcaaaagatg

SEQ ID NO: 77685 - DNA, 103 bp, Artificial Sequence
  Synthetic Polynucleotide
taatacgactcactatagggtccgaaatagtcaatctattggataataaaaacagaggagatttattatgcaatagattaacctggcggcagcgcaaaagatg

SEQ ID NO: 77686 - DNA, 103 bp, Artificial Sequence
  Synthetic Polynucleotide
taatacgactcactatagggtgacgtccgaaatagtcaatctattggataaacagaggagatatccaatggattgactaaacctggcggcagcgcaaaagatg

SEQ ID NO: 77687 - DNA, 103 bp, Artificial Sequence
  Synthetic Polynucleotide
taatacgactcactatagggacgattgacgtccgaaatagtcaatctattaacagaggagaaatagaatgactatttcgaacctggcggcagcgcaaaagatg

SEQ ID NO: 77688 - DNA, 103 bp, Artificial Sequence
  Synthetic Polynucleotide
taatacgactcactatagggtttaaacgattgacgtccgaaatagtcaataacagaggagaattgacatgttcggacgtaacctggcggcagcgcaaaagatg

SEQ ID NO: 77689 - DNA, 103 bp, Artificial Sequence
  Synthetic Polynucleotide
taatacgactcactatagggtttactttaaacgattgacgtccgaaatagaacagaggagactatttatgacgtcaatcaacctggcggcagcgcaaaagatg

SEQ ID NO: 77690 - DNA, 103 bp, Artificial Sequence
  Synthetic Polynucleotide
taatacgactcactatagggcgaagtttactttaaacgattgacgtccgaaacagaggagatcggacatgaatcgtttaaacctggcggcagcgcaaaagatg

SEQ ID NO: 77691 - DNA, 103 bp, Artificial Sequence
  Synthetic Polynucleotide
taatacgactcactatagggattacacgaatccaataaaccaaagtatcgaacagaggagacgatacatgggtttattgaacctggcggcagcgcaaaagatg

SEQ ID NO: 77692 - DNA, 103 bp, Artificial Sequence
  Synthetic Polynucleotide
taatacgactcactatagggttttacgaagtttactttaaacgattgacgaacagaggagacgtcaaatgtttaaagtaaacctggcggcagcgcaaaagatg

SEQ ID NO: 77693 - DNA, 103 bp, Artificial Sequence
  Synthetic Polynucleotide
taatacgactcactataggggaatattttacgaagtttactttaaacgataacagaggagaatcgttatgagtaaacttaacctggcggcagcgcaaaagatg

SEQ ID NO: 77694 - DNA, 103 bp, Artificial Sequence
  Synthetic Polynucleotide
taatacgactcactatagggtcaaagaatattttacgaagtttactttaaaacagaggagattaaagatgacttcgtaaaacctggcggcagcgcaaaagatg

SEQ ID NO: 77695 - DNA, 103 bp, Artificial Sequence
  Synthetic Polynucleotide
taatacgactcactatagggagtgatcaaagaatattttacgaagtttacaacagaggagagtaaacatggtaaaatataacctggcggcagcgcaaaagatg

SEQ ID NO: 77696 - DNA, 103 bp, Artificial Sequence
  Synthetic Polynucleotide
taatacgactcactatagggtcggtagtgatcaaagaatattttacgaagaacagaggagacttcgtatgatattctttaacctggcggcagcgcaaaagatg

SEQ ID NO: 77697 - DNA, 103 bp, Artificial Sequence
  Synthetic Polynucleotide
taatacgactcactatagggtaaactcggtagtgatcaaagaatattttaaacagaggagataaaatatgctttgatcaaacctggcggcagcgcaaaagatg

SEQ ID NO: 77698 - DNA, 103 bp, Artificial Sequence
  Synthetic Polynucleotide
taatacgactcactatagggagttttaaactcggtagtgatcaaagaataaacagaggagatattctatgatcactaccaacctggcggcagcgcaaaagatg

SEQ ID NO: 77699 - DNA, 103 bp, Artificial Sequence
  Synthetic Polynucleotide
taatacgactcactatagggatagaagttttaaactcggtagtgatcaaaaacagaggagatttgatatgtaccgagttaacctggcggcagcgcaaaagatg

SEQ ID NO: 77700 - DNA, 103 bp, Artificial Sequence
  Synthetic Polynucleotide
taatacgactcactatagggtatcgatagaagttttaaactcggtagtgaaacagaggagatcactaatgagtttaaaaaacctggcggcagcgcaaaagatg

SEQ ID NO: 77701 - DNA, 103 bp, Artificial Sequence
  Synthetic Polynucleotide
taatacgactcactatagggacaattatcgatagaagttttaaactcggtaacagaggagaaccgagatgaaaacttctaacctggcggcagcgcaaaagatg

SEQ ID NO: 77702 - DNA, 103 bp, Artificial Sequence
  Synthetic Polynucleotide
taatacgactcactatagggatatgattacacgaatccaataaaccaaagaacagaggagactttggatgattggattcaacctggcggcagcgcaaaagatg

SEQ ID NO: 77703 - DNA, 103 bp, Artificial Sequence
  Synthetic Polynucleotide
taatacgactcactatagggatgaaacaattatcgatagaagttttaaacaacagaggagagtttaaatgttctatcgaaacctggcggcagcgcaaaagatg

SEQ ID NO: 77704 - DNA, 103 bp, Artificial Sequence
  Synthetic Polynucleotide
taatacgactcactatagggaacatatgaaacaattatcgatagaagtttaacagaggagaaaacttatgtcgataattaacctggcggcagcgcaaaagatg

SEQ ID NO: 77705 - DNA, 103 bp, Artificial Sequence
  Synthetic Polynucleotide
taatacgactcactatagggattaaaacatatgaaacaattatcgatagaaacagaggagatctatcatgaattgtttcaacctggcggcagcgcaaaagatg

SEQ ID NO: 77706 - DNA, 103 bp, Artificial Sequence
  Synthetic Polynucleotide
taatacgactcactatagggtaaatattaaaacatatgaaacaattatcgaacagaggagacgataaatgtttcatatgaacctggcggcagcgcaaaagatg

SEQ ID NO: 77707 - DNA, 103 bp, Artificial Sequence
  Synthetic Polynucleotide
taatacgactcactatagggacttgtaaatattaaaacatatgaaacaataacagaggagaattgttatgtatgttttaaacctggcggcagcgcaaaagatg

SEQ ID NO: 77708 - DNA, 103 bp, Artificial Sequence
  Synthetic Polynucleotide
taatacgactcactatagggaaaaaacttgtaaatattaaaacatatgaaaacagaggagattcataatgtttaatattaacctggcggcagcgcaaaagatg

SEQ ID NO: 77709 - DNA, 103 bp, Artificial Sequence
  Synthetic Polynucleotide
taatacgactcactatagggggaccaaaaaacttgtaaatattaaaacataacagaggagaatgtttatgtatttacaaaacctggcggcagcgcaaaagatg

SEQ ID NO: 77710 - DNA, 103 bp, Artificial Sequence
  Synthetic Polynucleotide
taatacgactcactatagggaccatggaccaaaaaacttgtaaatattaaaacagaggagattaataatgacaagttttaacctggcggcagcgcaaaagatg

SEQ ID NO: 77711 - DNA, 103 bp, Artificial Sequence
  Synthetic Polynucleotide
taatacgactcactatagggaatgtaccatggaccaaaaaacttgtaaataacagaggagaatttacatgttttttggtaacctggcggcagcgcaaaagatg

SEQ ID NO: 77712 - DNA, 103 bp, Artificial Sequence
  Synthetic Polynucleotide
taatacgactcactatagggcggctaatgtaccatggaccaaaaaacttgaacagaggagacaagttatgtggtccatgaacctggcggcagcgcaaaagatg

SEQ ID NO: 77713 - DNA, 103 bp, Artificial Sequence
  Synthetic Polynucleotide
taatacgactcactatagggaaaatatatgattacacgaatccaataaacaacagaggagagtttatatgattcgtgtaaacctggcggcagcgcaaaagatg

SEQ ID NO: 77714 - DNA, 103 bp, Artificial Sequence
  Synthetic Polynucleotide
taatacgactcactatagggttgtccggctaatgtaccatggaccaaaaaaacagaggagatttttgatgcatggtacaaacctggcggcagcgcaaaagatg

SEQ ID NO: 77715 - DNA, 103 bp, Artificial Sequence
  Synthetic Polynucleotide
taatacgactcactatagggtatatttgtccggctaatgtaccatggaccaacagaggagaggtccaatgtacattagcaacctggcggcagcgcaaaagatg

SEQ ID NO: 77716 - DNA, 103 bp, Artificial Sequence
  Synthetic Polynucleotide
taatacgactcactatagggttgcatatatttgtccggctaatgtaccataacagaggagaatggtaatgtagccggacaacctggcggcagcgcaaaagatg

SEQ ID NO: 77717 - DNA, 103 bp, Artificial Sequence
  Synthetic Polynucleotide
taatacgactcactatagggttattttgcatatatttgtccggctaatgtaacagaggagaacattaatgggacaaataaacctggcggcagcgcaaaagatg

SEQ ID NO: 77718 - DNA, 103 bp, Artificial Sequence
  Synthetic Polynucleotide
taatacgactcactatagggcgatattattttgcatatatttgtccggctaacagaggagaagccggatgaatatatgcaacctggcggcagcgcaaaagatg

SEQ ID NO: 77719 - DNA, 103 bp, Artificial Sequence
  Synthetic Polynucleotide
taatacgactcactataggggagaacgatattattttgcatatatttgtcaacagaggagagacaaaatgatgcaaaataacctggcggcagcgcaaaagatg

SEQ ID NO: 77720 - DNA, 103 bp, Artificial Sequence
  Synthetic Polynucleotide
taatacgactcactatagggacttggagaacgatattattttgcatatataacagaggagaatatatatgaaataatataacctggcggcagcgcaaaagatg

SEQ ID NO: 77721 - DNA, 103 bp, Artificial Sequence
  Synthetic Polynucleotide
taatacgactcactatagggatagaacttggagaacgatattattttgcaaacagaggagatgcaaaatgatatcgttcaacctggcggcagcgcaaaagatg

SEQ ID NO: 77722 - DNA, 103 bp, Artificial Sequence
  Synthetic Polynucleotide
taatacgactcactatagggagactatagaacttggagaacgatattattaacagaggagaaataatatggttctccaaaacctggcggcagcgcaaaagatg

SEQ ID NO: 77723 - DNA, 103 bp, Artificial Sequence
  Synthetic Polynucleotide
taatacgactcactatagggtccagagactatagaacttggagaacgataaacagaggagatatcgtatgccaagttctaacctggcggcagcgcaaaagatg

SEQ ID NO: 77724 - DNA, 103 bp, Artificial Sequence
  Synthetic Polynucleotide
taatacgactcactatagggtatgcaaaatatatgattacacgaatccaaaacagaggagattggatatgtgtaatcataacctggcggcagcgcaaaagatg

SEQ ID NO: 77725 - DNA, 103 bp, Artificial Sequence
  Synthetic Polynucleotide
taatacgactcactatagggaataatccagagactatagaacttggagaaaacagaggagattctccatgttctatagtaacctggcggcagcgcaaaagatg

SEQ ID NO: 77726 - DNA, 103 bp, Artificial Sequence
  Synthetic Polynucleotide
taatacgactcactatagggataaaaataatccagagactatagaacttgaacagaggagacaagttatgtagtctctgaacctggcggcagcgcaaaagatg

SEQ ID NO: 77727 - DNA, 103 bp, Artificial Sequence
  Synthetic Polynucleotide
taatacgactcactatagggatataataaaaataatccagagactatagaaacagaggagatctataatgtctggattaaacctggcggcagcgcaaaagatg

SEQ ID NO: 77728 - DNA, 103 bp, Artificial Sequence
  Synthetic Polynucleotide
taatacgactcactatagggactgaatataataaaaataatccagagactaacagaggagaagtctcatgattatttttaacctggcggcagcgcaaaagatg

SEQ ID NO: 77729 - DNA, 103 bp, Artificial Sequence
  Synthetic Polynucleotide
taatacgactcactatagggtggttactgaatataataaaaataatccagaacagaggagactggatatgttttattataacctggcggcagcgcaaaagatg

SEQ ID NO: 77730 - DNA, 103 bp, Artificial Sequence
  Synthetic Polynucleotide
taatacgactcactataggggtatttggttactgaatataataaaaataaaacagaggagattatttatgttatattcaaacctggcggcagcgcaaaagatg

SEQ ID NO: 77731 - DNA, 103 bp, Artificial Sequence
  Synthetic Polynucleotide
taatacgactcactatagggaatatgtatttggttactgaatataataaaaacagaggagatttattatgttcagtaacaacctggcggcagcgcaaaagatg

SEQ ID NO: 77732 - DNA, 103 bp, Artificial Sequence
  Synthetic Polynucleotide
taatacgactcactatagggaccctaatatgtatttggttactgaatataaacagaggagatatattatgtaaccaaataacctggcggcagcgcaaaagatg

SEQ ID NO: 77733 - DNA, 103 bp, Artificial Sequence
  Synthetic Polynucleotide
taatacgactcactatagggagataaccctaatatgtatttggttactgaaacagaggagatcagtaatgaaatacataaacctggcggcagcgcaaaagatg

SEQ ID NO: 77734 - DNA, 103 bp, Artificial Sequence
  Synthetic Polynucleotide
taatacgactcactatagggtccgcagataaccctaatatgtatttggttaacagaggagaaaccaaatgcatattaggaacctggcggcagcgcaaaagatg

SEQ ID NO: 77735 - DNA, 103 bp, Artificial Sequence
  Synthetic Polynucleotide
taatacgactcactatagggcatgttatgcaaaatatatgattacacgaaaacagaggagattcgtgatgtcatatattaacctggcggcagcgcaaaagatg

SEQ ID NO: 77736 - DNA, 103 bp, Artificial Sequence
  Synthetic Polynucleotide
taatacgactcactatagggataaatccgcagataaccctaatatgtattaacagaggagaaatacaatgtagggttataacctggcggcagcgcaaaagatg

SEQ ID NO: 77737 - DNA, 103 bp, Artificial Sequence
  Synthetic Polynucleotide
taatacgactcactatagggaaattataaatccgcagataaccctaatataacagaggagaatattaatgttatctgcgaacctggcggcagcgcaaaagatg

SEQ ID NO: 77738 - DNA, 103 bp, Artificial Sequence
  Synthetic Polynucleotide
taatacgactcactatagggcacttaaattataaatccgcagataaccctaacagaggagaagggttatgtgcggatttaacctggcggcagcgcaaaagatg

SEQ ID NO: 77739 - DNA, 103 bp, Artificial Sequence
  Synthetic Polynucleotide
taatacgactcactatagggtgcatcacttaaattataaatccgcagataaacagaggagatatctgatgatttataataacctggcggcagcgcaaaagatg

SEQ ID NO: 77740 - DNA, 103 bp, Artificial Sequence
  Synthetic Polynucleotide
taatacgactcactatagggtcgaatgcatcacttaaattataaatccgcaacagaggagagcggatatgtaatttaagaacctggcggcagcgcaaaagatg

SEQ ID NO: 77741 - DNA, 103 bp, Artificial Sequence
  Synthetic Polynucleotide
taatacgactcactatagggttgagtcgaatgcatcacttaaattataaaaacagaggagatttataatgtaagtgatgaacctggcggcagcgcaaaagatg

SEQ ID NO: 77742 - DNA, 103 bp, Artificial Sequence
  Synthetic Polynucleotide
taatacgactcactatagggttatgttgagtcgaatgcatcacttaaattaacagaggagaaatttaatggatgcattcaacctggcggcagcgcaaaagatg

SEQ ID NO: 77743 - DNA, 103 bp, Artificial Sequence
  Synthetic Polynucleotide
taatacgactcactatagggattatttatgttgagtcgaatgcatcacttaacagaggagaaagtgaatgattcgactcaacctggcggcagcgcaaaagatg

SEQ ID NO: 77744 - DNA, 103 bp, Artificial Sequence
  Synthetic Polynucleotide
taatacgactcactatagggctagaattatttatgttgagtcgaatgcataacagaggagaatgcatatgactcaacataacctggcggcagcgcaaaagatg

SEQ ID NO: 77745 - DNA, 103 bp, Artificial Sequence
  Synthetic Polynucleotide
taatacgactcactatagggctcctctagaattatttatgttgagtcgaaaacagaggagattcgacatgacataaataaacctggcggcagcgcaaaagatg

SEQ ID NO: 77746 - DNA, 103 bp, Artificial Sequence
  Synthetic Polynucleotide
taatacgactcactatagggtgatacatgttatgcaaaatatatgattacaacagaggagagtaatcatgtattttgcaaacctggcggcagcgcaaaagatg

SEQ ID NO: 77747 - DNA, 103 bp, Artificial Sequence
  Synthetic Polynucleotide
taatacgactcactatagggatcgtctcctctagaattatttatgttgagaacagaggagactcaacatgaataattctaacctggcggcagcgcaaaagatg

SEQ ID NO: 77748 - DNA, 103 bp, Artificial Sequence
  Synthetic Polynucleotide
taatacgactcactatagggagtagatcgtctcctctagaattatttatgaacagaggagacataaaatgttctagaggaacctggcggcagcgcaaaagatg

SEQ ID NO: 77749 - DNA, 103 bp, Artificial Sequence
  Synthetic Polynucleotide
taatacgactcactatagggttgatagtagatcgtctcctctagaattataacagaggagaataattatggaggagacgaacctggcggcagcgcaaaagatg

SEQ ID NO: 77750 - DNA, 103 bp, Artificial Sequence
  Synthetic Polynucleotide
taatacgactcactatagggcgaatttgatagtagatcgtctcctctagaaacagaggagatctagaatggacgatctaaacctggcggcagcgcaaaagatg

SEQ ID NO: 77751 - DNA, 103 bp, Artificial Sequence
  Synthetic Polynucleotide
taatacgactcactatagggcgatccgaatttgatagtagatcgtctcctaacagaggagaaggagaatgtctactatcaacctggcggcagcgcaaaagatg

SEQ ID NO: 77752 - DNA, 103 bp, Artificial Sequence
  Synthetic Polynucleotide
taatacgactcactatagggatttacgatccgaatttgatagtagatcgtaacagaggagaacgatcatgtatcaaattaacctggcggcagcgcaaaagatg

SEQ ID NO: 77753 - DNA, 103 bp, Artificial Sequence
  Synthetic Polynucleotide
taatacgactcactatagggaacagatttacgatccgaatttgatagtagaacagaggagactactaatgaattcggataacctggcggcagcgcaaaagatg

SEQ ID NO: 77754 - DNA, 103 bp, Artificial Sequence
  Synthetic Polynucleotide
taatacgactcactatagggttagaaacagatttacgatccgaatttgataacagaggagaatcaaaatgggatcgtaaaacctggcggcagcgcaaaagatg

SEQ ID NO: 77755 - DNA, 103 bp, Artificial Sequence
  Synthetic Polynucleotide
taatacgactcactataggggttctttagaaacagatttacgatccgaataacagaggagaattcggatggtaaatctgaacctggcggcagcgcaaaagatg

SEQ ID NO: 77756 - DNA, 103 bp, Artificial Sequence
  Synthetic Polynucleotide
taatacgactcactatagggtctccgttctttagaaacagatttacgatcaacagaggagagatcgtatgtctgtttctaacctggcggcagcgcaaaagatg

SEQ ID NO: 77757 - DNA, 103 bp, Artificial Sequence
  Synthetic Polynucleotide
taatacgactcactatagggtatattgatacatgttatgcaaaatatatgaacagaggagacatataatgtgcataacaaacctggcggcagcgcaaaagatg

SEQ ID NO: 77758 - DNA, 103 bp, Artificial Sequence
  Synthetic Polynucleotide
taatacgactcactataggggatattctccgttctttagaaacagatttaaacagaggagataaatcatgttctaaagaaacctggcggcagcgcaaaagatg

SEQ ID NO: 77759 - DNA, 103 bp, Artificial Sequence
  Synthetic Polynucleotide
taatacgactcactataggggtatagatattctccgttctttagaaacagaacagaggagactgtttatgaagaacggaaacctggcggcagcgcaaaagatg

SEQ ID NO: 77760 - DNA, 103 bp, Artificial Sequence
  Synthetic Polynucleotide
taatacgactcactatagggggtatgtatagatattctccgttctttagaaacagaggagatctaaaatgcggagaataaacctggcggcagcgcaaaagatg

SEQ ID NO: 77761 - DNA, 103 bp, Artificial Sequence
  Synthetic Polynucleotide
taatacgactcactatagggaatcaggtatgtatagatattctccgttctaacagaggagaagaacgatgaatatctataacctggcggcagcgcaaaagatg

SEQ ID NO: 77762 - DNA, 103 bp, Artificial Sequence
  Synthetic Polynucleotide
taatacgactcactatagggattctaatcaggtatgtatagatattctccaacagaggagaggagaaatgctatacataaacctggcggcagcgcaaaagatg

SEQ ID NO: 77763 - DNA, 103 bp, Artificial Sequence
  Synthetic Polynucleotide
taatacgactcactataggggatgaattctaatcaggtatgtatagatataacagaggagaatatctatgcatacctgaaacctggcggcagcgcaaaagatg

SEQ ID NO: 77764 - DNA, 103 bp, Artificial Sequence
  Synthetic Polynucleotide
taatacgactcactatagggggacggatgaattctaatcaggtatgtataaacagaggagatatacaatgctgattagaaacctggcggcagcgcaaaagatg

SEQ ID NO: 77765 - DNA, 103 bp, Artificial Sequence
  Synthetic Polynucleotide
taatacgactcactatagggctgaaggacggatgaattctaatcaggtataacagaggagaatacctatgtagaattcaaacctggcggcagcgcaaaagatg

SEQ ID NO: 77766 - DNA, 103 bp, Artificial Sequence
  Synthetic Polynucleotide
taatacgactcactataggggttgtctgaaggacggatgaattctaatcaaacagaggagatgattaatgttcatccgtaacctggcggcagcgcaaaagatg

SEQ ID NO: 77767 - DNA, 103 bp, Artificial Sequence
  Synthetic Polynucleotide
taatacgactcactataggggagatgttgtctgaaggacggatgaattctaacagaggagaagaattatgccgtccttcaacctggcggcagcgcaaaagatg

SEQ ID NO: 77768 - DNA, 103 bp, Artificial Sequence
  Synthetic Polynucleotide
taatacgactcactatagggtgccatatattgatacatgttatgcaaaataacagaggagaattttgatgaacatgtataacctggcggcagcgcaaaagatg

SEQ ID NO: 77769 - DNA, 103 bp, Artificial Sequence
  Synthetic Polynucleotide
taatacgactcactatagggtgtctgagatgttgtctgaaggacggatgaaacagaggagatcatccatgcttcagacaaacctggcggcagcgcaaaagatg

SEQ ID NO: 77770 - DNA, 103 bp, Artificial Sequence
  Synthetic Polynucleotide
taatacgactcactatagggcagactgtctgagatgttgtctgaaggacgaacagaggagacgtcctatggacaacatcaacctggcggcagcgcaaaagatg

SEQ ID NO: 77771 - DNA, 103 bp, Artificial Sequence
  Synthetic Polynucleotide
taatacgactcactatagggaagaccagactgtctgagatgttgtctgaaaacagaggagattcagaatgcatctcagaaacctggcggcagcgcaaaagatg

SEQ ID NO: 77772 - DNA, 103 bp, Artificial Sequence
  Synthetic Polynucleotide
taatacgactcactatagggtatacaagaccagactgtctgagatgttgtaacagaggagaacaacaatgcagacagtcaacctggcggcagcgcaaaagatg

SEQ ID NO: 77773 - DNA, 103 bp, Artificial Sequence
  Synthetic Polynucleotide
taatacgactcactatagggtaagatatacaagaccagactgtctgagataacagaggagaatctcaatgagtctggtcaacctggcggcagcgcaaaagatg

SEQ ID NO: 77774 - DNA, 103 bp, Artificial Sequence
  Synthetic Polynucleotide
taatacgactcactatagggatgattaagatatacaagaccagactgtctaacagaggagaagacagatgggtcttgtaaacctggcggcagcgcaaaagatg

SEQ ID NO: 77775 - DNA, 103 bp, Artificial Sequence
  Synthetic Polynucleotide
taatacgactcactatagggagaatatgattaagatatacaagaccagacaacagaggagagtctggatgtgtatatctaacctggcggcagcgcaaaagatg

SEQ ID NO: 77776 - DNA, 103 bp, Artificial Sequence
  Synthetic Polynucleotide
taatacgactcactatagggtcataagaatatgattaagatatacaagacaacagaggagagtcttgatgatcttaatcaacctggcggcagcgcaaaagatg

SEQ ID NO: 77777 - DNA, 103 bp, Artificial Sequence
  Synthetic Polynucleotide
taatacgactcactatagggaagtttcataagaatatgattaagatatacaacagaggagagtatatatgaatcatattaacctggcggcagcgcaaaagatg

SEQ ID NO: 77778 - DNA, 103 bp, Artificial Sequence
  Synthetic Polynucleotide
taatacgactcactatagggtttccaagtttcataagaatatgattaagaaacagaggagatcttaaatgtattcttataacctggcggcagcgcaaaagatg

SEQ ID NO: 77779 - DNA, 103 bp, Artificial Sequence
  Synthetic Polynucleotide
taatacgactcactatagggttctatgccatatattgatacatgttatgcaacagaggagagcataaatggtatcaataaacctggcggcagcgcaaaagatg

SEQ ID NO: 77780 - DNA, 103 bp, Artificial Sequence
  Synthetic Polynucleotide
taatacgactcactatagggagatgtttccaagtttcataagaatatgataacagaggagaatcataatgttatgaaacaacctggcggcagcgcaaaagatg

SEQ ID NO: 77781 - DNA, 103 bp, Artificial Sequence
  Synthetic Polynucleotide
taatacgactcactatagggagaagagatgtttccaagtttcataagaataacagaggagaattcttatgaaacttggaaacctggcggcagcgcaaaagatg

SEQ ID NO: 77782 - DNA, 103 bp, Artificial Sequence
  Synthetic Polynucleotide
taatacgactcactatagggaaactagaagagatgtttccaagtttcataaacagaggagatatgaaatgtggaaacataacctggcggcagcgcaaaagatg

SEQ ID NO: 77783 - DNA, 103 bp, Artificial Sequence
  Synthetic Polynucleotide
taatacgactcactatagggtagtgaaactagaagagatgtttccaagttaacagaggagaaacttgatgacatctcttaacctggcggcagcgcaaaagatg

SEQ ID NO: 77784 - DNA, 103 bp, Artificial Sequence
  Synthetic Polynucleotide
taatacgactcactatagggggtactagtgaaactagaagagatgtttccaacagaggagaggaaacatgtcttctagtaacctggcggcagcgcaaaagatg

SEQ ID NO: 77785 - DNA, 103 bp, Artificial Sequence
  Synthetic Polynucleotide
taatacgactcactatagggataaaggtactagtgaaactagaagagatgaacagaggagacatctcatgtagtttcacaacctggcggcagcgcaaaagatg

SEQ ID NO: 77786 - DNA, 103 bp, Artificial Sequence
  Synthetic Polynucleotide
taatacgactcactatagggaattaataaaggtactagtgaaactagaagaacagaggagacttctaatgtcactagtaaacctggcggcagcgcaaaagatg

SEQ ID NO: 77787 - DNA, 103 bp, Artificial Sequence
  Synthetic Polynucleotide
taatacgactcactataggggagagaattaataaaggtactagtgaaactaacagaggagaagtttcatgagtacctttaacctggcggcagcgcaaaagatg

SEQ ID NO: 77788 - DNA, 103 bp, Artificial Sequence
  Synthetic Polynucleotide
taatacgactcactatagggtacctgagagaattaataaaggtactagtgaacagaggagacactagatgctttattaaaacctggcggcagcgcaaaagatg

SEQ ID NO: 77789 - DNA, 103 bp, Artificial Sequence
  Synthetic Polynucleotide
taatacgactcactatagggatctgtacctgagagaattaataaaggtacaacagaggagagtacctatgttaattctcaacctggcggcagcgcaaaagatg

SEQ ID NO: 77790 - DNA, 103 bp, Artificial Sequence
  Synthetic Polynucleotide
taatacgactcactatagggataaatgcaaaccattctgatgcatcaactaacagaggagaagttgaatgatcagaatgaacctggcggcagcgcaaaagatg

SEQ ID NO: 77791 - DNA, 103 bp, Artificial Sequence
  Synthetic Polynucleotide
taatacgactcactatagggctttgtactcaattagctatcgtctctggaaacagaggagatccagaatggatagctaaaacctggcggcagcgcaaaagatg

SEQ ID NO: 77792 - DNA, 103 bp, Artificial Sequence
  Synthetic Polynucleotide
taatacgactcactatagggtcgtgttctatgccatatattgatacatgtaacagaggagaacatgtatgaatatatggaacctggcggcagcgcaaaagatg

SEQ ID NO: 77793 - DNA, 103 bp, Artificial Sequence
  Synthetic Polynucleotide
taatacgactcactatagggtcaaaatctgtacctgagagaattaataaaaacagaggagatttattatgtctctcaggaacctggcggcagcgcaaaagatg

SEQ ID NO: 77794 - DNA, 103 bp, Artificial Sequence
  Synthetic Polynucleotide
taatacgactcactatagggcgaattcaaaatctgtacctgagagaattaaacagaggagataattcatgcaggtacagaacctggcggcagcgcaaaagatg

SEQ ID NO: 77795 - DNA, 103 bp, Artificial Sequence
  Synthetic Polynucleotide
taatacgactcactatagggatcatcgaattcaaaatctgtacctgagagaacagaggagactctcaatgacagattttaacctggcggcagcgcaaaagatg

SEQ ID NO: 77796 - DNA, 103 bp, Artificial Sequence
  Synthetic Polynucleotide
taatacgactcactatagggtcggcatcatcgaattcaaaatctgtacctaacagaggagaaggtacatgttttgaattaacctggcggcagcgcaaaagatg

SEQ ID NO: 77797 - DNA, 103 bp, Artificial Sequence
  Synthetic Polynucleotide
taatacgactcactatagggaatactcggcatcatcgaattcaaaatctgaacagaggagacagattatgaattcgatgaacctggcggcagcgcaaaagatg

SEQ ID NO: 77798 - DNA, 103 bp, Artificial Sequence
  Synthetic Polynucleotide
taatacgactcactataggggatgaaatactcggcatcatcgaattcaaaaacagaggagatttgaaatggatgatgccaacctggcggcagcgcaaaagatg

SEQ ID NO: 77799 - DNA, 103 bp, Artificial Sequence
  Synthetic Polynucleotide
taatacgactcactatagggacaacgatgaaatactcggcatcatcgaataacagaggagaattcgaatgtgccgagtaaacctggcggcagcgcaaaagatg

SEQ ID NO: 77800 - DNA, 103 bp, Artificial Sequence
  Synthetic Polynucleotide
taatacgactcactatagggaatatacaacgatgaaatactcggcatcataacagaggagaatgatgatgagtatttcaaacctggcggcagcgcaaaagatg

SEQ ID NO: 77801 - DNA, 103 bp, Artificial Sequence
  Synthetic Polynucleotide
taatacgactcactataggggaagaaatatacaacgatgaaatactcggcaacagaggagagccgagatgttcatcgttaacctggcggcagcgcaaaagatg

SEQ ID NO: 77802 - DNA, 103 bp, Artificial Sequence
  Synthetic Polynucleotide
taatacgactcactatagggtcgaagaagaaatatacaacgatgaaatacaacagaggagagtatttatgcgttgtataaacctggcggcagcgcaaaagatg

SEQ ID NO: 77803 - DNA, 103 bp, Artificial Sequence
  Synthetic Polynucleotide
taatacgactcactatagggtctcttcgtgttctatgccatatattgataaacagaggagatatcaaatgatggcatagaacctggcggcagcgcaaaagatg

SEQ ID NO: 77804 - DNA, 103 bp, Artificial Sequence
  Synthetic Polynucleotide
taatacgactcactatagggtgcaatcgaagaagaaatatacaacgatgaaacagaggagatcatcgatgtatatttctaacctggcggcagcgcaaaagatg

SEQ ID NO: 77805 - DNA, 103 bp, Artificial Sequence
  Synthetic Polynucleotide
taatacgactcactataggggattatgcaatcgaagaagaaatatacaacaacagaggagagttgtaatgttcttcttcaacctggcggcagcgcaaaagatg

SEQ ID NO: 77806 - DNA, 103 bp, Artificial Sequence
  Synthetic Polynucleotide
taatacgactcactatagggaatctgattatgcaatcgaagaagaaatataacagaggagaatatttatgcttcgattgaacctggcggcagcgcaaaagatg

SEQ ID NO: 77807 - DNA, 103 bp, Artificial Sequence
  Synthetic Polynucleotide
taatacgactcactatagggataagaatctgattatgcaatcgaagaagaaacagaggagatcttctatgattgcataaaacctggcggcagcgcaaaagatg

SEQ ID NO: 77808 - DNA, 103 bp, Artificial Sequence
  Synthetic Polynucleotide
taatacgactcactatagggggtatataagaatctgattatgcaatcgaaaacagaggagattcgatatgataatcagaaacctggcggcagcgcaaaagatg

SEQ ID NO: 77809 - DNA, 103 bp, Artificial Sequence
  Synthetic Polynucleotide
taatacgactcactataggggaggcggtatataagaatctgattatgcaaaacagaggagattgcatatgcagattcttaacctggcggcagcgcaaaagatg

SEQ ID NO: 77810 - DNA, 103 bp, Artificial Sequence
  Synthetic Polynucleotide
taatacgactcactatagggagtttgaggcggtatataagaatctgattaaacagaggagataatcaatgtcttatataaacctggcggcagcgcaaaagatg

SEQ ID NO: 77811 - DNA, 103 bp, Artificial Sequence
  Synthetic Polynucleotide
taatacgactcactatagggaatagagtttgaggcggtatataagaatctaacagaggagaagattcatgtataccgccaacctggcggcagcgcaaaagatg

SEQ ID NO: 77812 - DNA, 103 bp, Artificial Sequence
  Synthetic Polynucleotide
taatacgactcactatagggtttaaaatagagtttgaggcggtatataagaacagaggagacttataatgcgcctcaaaaacctggcggcagcgcaaaagatg

SEQ ID NO: 77813 - DNA, 103 bp, Artificial Sequence
  Synthetic Polynucleotide
taatacgactcactatagggataattttaaaatagagtttgaggcggtataacagaggagaataccgatgcaaactctaaacctggcggcagcgcaaaagatg

SEQ ID NO: 77814 - DNA, 103 bp, Artificial Sequence
  Synthetic Polynucleotide
taatacgactcactatagggcagtttctcttcgtgttctatgccatatataacagaggagaatatatatgatagaacacaacctggcggcagcgcaaaagatg

SEQ ID NO: 77815 - DNA, 103 bp, Artificial Sequence
  Synthetic Polynucleotide
taatacgactcactataggggtttaataattttaaaatagagtttgaggcaacagaggagagcctcaatgtctattttaaacctggcggcagcgcaaaagatg

SEQ ID NO: 77816 - DNA, 103 bp, Artificial Sequence
  Synthetic Polynucleotide
taatacgactcactataggggtattgtttaataattttaaaatagagtttaacagaggagaaaactcatgtttaaaattaacctggcggcagcgcaaaagatg

SEQ ID NO: 77817 - DNA, 103 bp, Artificial Sequence
  Synthetic Polynucleotide
taatacgactcactataggggtagagtattgtttaataattttaaaatagaacagaggagactatttatgaattattaaaacctggcggcagcgcaaaagatg

SEQ ID NO: 77818 - DNA, 103 bp, Artificial Sequence
  Synthetic Polynucleotide
taatacgactcactatagggtaatagtagagtattgtttaataattttaaaacagaggagattaaaaatgttaaacaataacctggcggcagcgcaaaagatg

SEQ ID NO: 77819 - DNA, 103 bp, Artificial Sequence
  Synthetic Polynucleotide
taatacgactcactatagggctgattaatagtagagtattgtttaataataacagaggagaattattatgcaatactctaacctggcggcagcgcaaaagatg

SEQ ID NO: 77820 - DNA, 103 bp, Artificial Sequence
  Synthetic Polynucleotide
taatacgactcactatagggaacgactgattaatagtagagtattgtttaaacagaggagataaacaatgctctactataacctggcggcagcgcaaaagatg

SEQ ID NO: 77821 - DNA, 103 bp, Artificial Sequence
  Synthetic Polynucleotide
taatacgactcactatagggattagaacgactgattaatagtagagtattaacagaggagaaatactatgctattaatcaacctggcggcagcgcaaaagatg

SEQ ID NO: 77822 - DNA, 103 bp, Artificial Sequence
  Synthetic Polynucleotide
taatacgactcactatagggaaggaattagaacgactgattaatagtagaaacagaggagatctactatgaatcagtcgaacctggcggcagcgcaaaagatg

SEQ ID NO: 77823 - DNA, 103 bp, Artificial Sequence
  Synthetic Polynucleotide
taatacgactcactatagggtagcaaaggaattagaacgactgattaataaacagaggagatattaaatggtcgttctaaacctggcggcagcgcaaaagatg

SEQ ID NO: 77824 - DNA, 103 bp, Artificial Sequence
  Synthetic Polynucleotide
taatacgactcactatagggagaaatagcaaaggaattagaacgactgataacagaggagaatcagtatgtctaattccaacctggcggcagcgcaaaagatg

SEQ ID NO: 77825 - DNA, 103 bp, Artificial Sequence
  Synthetic Polynucleotide
taatacgactcactatagggcgcaccagtttctcttcgtgttctatgccaaacagaggagatggcatatgacacgaagaaacctggcggcagcgcaaaagatg

SEQ ID NO: 77826 - DNA, 103 bp, Artificial Sequence
  Synthetic Polynucleotide
taatacgactcactatagggtccatagaaatagcaaaggaattagaacgaaacagaggagatcgttcatgttcctttgcaacctggcggcagcgcaaaagatg

SEQ ID NO: 77827 - DNA, 103 bp, Artificial Sequence
  Synthetic Polynucleotide
taatacgactcactatagggataagtccatagaaatagcaaaggaattagaacagaggagactaattatgttgctatttaacctggcggcagcgcaaaagatg

SEQ ID NO: 77828 - DNA, 103 bp, Artificial Sequence
  Synthetic Polynucleotide
taatacgactcactatagggtgtagataagtccatagaaatagcaaaggaaacagaggagatcctttatgatttctatgaacctggcggcagcgcaaaagatg

SEQ ID NO: 77829 - DNA, 103 bp, Artificial Sequence
  Synthetic Polynucleotide
taatacgactcactatagggcaagatgtagataagtccatagaaatagcaaacagaggagatgctatatgtatggacttaacctggcggcagcgcaaaagatg

SEQ ID NO: 77830 - DNA, 103 bp, Artificial Sequence
  Synthetic Polynucleotide
taatacgactcactatagggacagtcaagatgtagataagtccatagaaaaacagaggagatttctaatgacttatctaaacctggcggcagcgcaaaagatg

SEQ ID NO: 77831 - DNA, 103 bp, Artificial Sequence
  Synthetic Polynucleotide
taatacgactcactataggggatagacagtcaagatgtagataagtccataacagaggagaatggacatgtctacatctaacctggcggcagcgcaaaagatg

SEQ ID NO: 77832 - DNA, 103 bp, Artificial Sequence
  Synthetic Polynucleotide
taatacgactcactatagggacagagatagacagtcaagatgtagataagaacagaggagacttatcatgatcttgactaacctggcggcagcgcaaaagatg

SEQ ID NO: 77833 - DNA, 103 bp, Artificial Sequence
  Synthetic Polynucleotide
taatacgactcactatagggtgtttacagagatagacagtcaagatgtagaacagaggagactacatatggactgtctaaacctggcggcagcgcaaaagatg

SEQ ID NO: 77834 - DNA, 103 bp, Artificial Sequence
  Synthetic Polynucleotide
taatacgactcactatagggctccgtgtttacagagatagacagtcaagaaacagaggagatcttgaatgtctatctctaacctggcggcagcgcaaaagatg

SEQ ID NO: 77835 - DNA, 103 bp, Artificial Sequence
  Synthetic Polynucleotide
taatacgactcactatagggaccgactccgtgtttacagagatagacagtaacagaggagaactgtcatgctctgtaaaaacctggcggcagcgcaaaagatg

SEQ ID NO: 77836 - DNA, 103 bp, Artificial Sequence
  Synthetic Polynucleotide
taatacgactcactatagggtccgacgcaccagtttctcttcgtgttctaaacagaggagatagaacatgaagagaaacaacctggcggcagcgcaaaagatg

SEQ ID NO: 77837 - DNA, 103 bp, Artificial Sequence
  Synthetic Polynucleotide
taatacgactcactataggggagataccgactccgtgtttacagagatagaacagaggagactatctatgtaaacacggaacctggcggcagcgcaaaagatg

SEQ ID NO: 77838 - DNA, 103 bp, Artificial Sequence
  Synthetic Polynucleotide
taatacgactcactataggggtacggagataccgactccgtgtttacagaaacagaggagatctgtaatgacggagtcgaacctggcggcagcgcaaaagatg

SEQ ID NO: 77839 - DNA, 103 bp, Artificial Sequence
  Synthetic Polynucleotide
taatacgactcactatagggagcgtgtacggagataccgactccgtgtttaacagaggagaaaacacatggtcggtatcaacctggcggcagcgcaaaagatg

SEQ ID NO: 77840 - DNA, 103 bp, Artificial Sequence
  Synthetic Polynucleotide
taatacgactcactatagggttcgtagcgtgtacggagataccgactccgaacagaggagacggagtatgtatctccgtaacctggcggcagcgcaaaagatg

SEQ ID NO: 77841 - DNA, 103 bp, Artificial Sequence
  Synthetic Polynucleotide
taatacgactcactatagggtcgttttcgtagcgtgtacggagataccgaaacagaggagatcggtaatgccgtacacgaacctggcggcagcgcaaaagatg

SEQ ID NO: 77842 - DNA, 103 bp, Artificial Sequence
  Synthetic Polynucleotide
taatacgactcactatagggagatttcgttttcgtagcgtgtacggagataacagaggagaatctccatgcacgctacgaacctggcggcagcgcaaaagatg

SEQ ID NO: 77843 - DNA, 103 bp, Artificial Sequence
  Synthetic Polynucleotide
taatacgactcactatagggattacagatttcgttttcgtagcgtgtacgaacagaggagacgtacaatgtacgaaaacaacctggcggcagcgcaaaagatg

SEQ ID NO: 77844 - DNA, 103 bp, Artificial Sequence
  Synthetic Polynucleotide
taatacgactcactatagggtatagattacagatttcgttttcgtagcgtaacagaggagaacgctaatgaaacgaaataacctggcggcagcgcaaaagatg

SEQ ID NO: 77845 - DNA, 103 bp, Artificial Sequence
  Synthetic Polynucleotide
taatacgactcactatagggttgcctatagattacagatttcgttttcgtaacagaggagaacgaaaatgaaatctgtaaacctggcggcagcgcaaaagatg

SEQ ID NO: 77846 - DNA, 103 bp, Artificial Sequence
  Synthetic Polynucleotide
taatacgactcactatagggcatcgttgcctatagattacagatttcgttaacagaggagaaacgaaatgtgtaatctaaacctggcggcagcgcaaaagatg

SEQ ID NO: 77847 - DNA, 103 bp, Artificial Sequence
  Synthetic Polynucleotide
taatacgactcactatagggaattatccgacgcaccagtttctcttcgtgaacagaggagacacgaaatgaaactggtgaacctggcggcagcgcaaaagatg

SEQ ID NO: 77848 - DNA, 103 bp, Artificial Sequence
  Synthetic Polynucleotide
taatacgactcactataggggaaaacatcgttgcctatagattacagattaacagaggagaaatctgatgtctataggcaacctggcggcagcgcaaaagatg

SEQ ID NO: 77849 - DNA, 103 bp, Artificial Sequence
  Synthetic Polynucleotide
taatacgactcactatagggattgtgaaaacatcgttgcctatagattacaacagaggagagtaatcatgaggcaacgaaacctggcggcagcgcaaaagatg

SEQ ID NO: 77850 - DNA, 103 bp, Artificial Sequence
  Synthetic Polynucleotide
taatacgactcactatagggatccgattgtgaaaacatcgttgcctatagaacagaggagactatagatgacgatgtttaacctggcggcagcgcaaaagatg

SEQ ID NO: 77851 - DNA, 103 bp, Artificial Sequence
  Synthetic Polynucleotide
taatacgactcactatagggtattaatccgattgtgaaaacatcgttgccaacagaggagaggcaacatggttttcacaaacctggcggcagcgcaaaagatg

SEQ ID NO: 77852 - DNA, 103 bp, Artificial Sequence
  Synthetic Polynucleotide
taatacgactcactatagggagagatattaatccgattgtgaaaacatcgaacagaggagacgatgtatgcacaatcggaacctggcggcagcgcaaaagatg

SEQ ID NO: 77853 - DNA, 103 bp, Artificial Sequence
  Synthetic Polynucleotide
taatacgactcactatagggacgatagagatattaatccgattgtgaaaaaacagaggagattttcaatgtcggattaaaacctggcggcagcgcaaaagatg

SEQ ID NO: 77854 - DNA, 103 bp, Artificial Sequence
  Synthetic Polynucleotide
taatacgactcactatagggtatggacgatagagatattaatccgattgtaacagaggagaacaatcatgttaatatctaacctggcggcagcgcaaaagatg

SEQ ID NO: 77855 - DNA, 103 bp, Artificial Sequence
  Synthetic Polynucleotide
taatacgactcactatagggttttatatggacgatagagatattaatccgaacagaggagacggattatgatctctatcaacctggcggcagcgcaaaagatg

SEQ ID NO: 77856 - DNA, 103 bp, Artificial Sequence
  Synthetic Polynucleotide
taatacgactcactatagggatccattttatatggacgatagagatattaaacagaggagataatatatgtatcgtccaaacctggcggcagcgcaaaagatg

SEQ ID NO: 77857 - DNA, 103 bp, Artificial Sequence
  Synthetic Polynucleotide
taatacgactcactatagggaagtaatccattttatatggacgatagagaaacagaggagatctctaatgtccatataaaacctggcggcagcgcaaaagatg

SEQ ID NO: 77858 - DNA, 103 bp, Artificial Sequence
  Synthetic Polynucleotide
taatacgactcactatagggaggacaattatccgacgcaccagtttctctaacagaggagaagagaaatgggtgcgtcgaacctggcggcagcgcaaaagatg

SEQ ID NO: 77859 - DNA, 103 bp, Artificial Sequence
  Synthetic Polynucleotide
taatacgactcactatagggccattaagtaatccattttatatggacgataacagaggagaatcgtcatgataaaatggaacctggcggcagcgcaaaagatg

SEQ ID NO: 77860 - DNA, 103 bp, Artificial Sequence
  Synthetic Polynucleotide
taatacgactcactatagggccaatccattaagtaatccattttatatggaacagaggagaccatatatgatggattacaacctggcggcagcgcaaaagatg

SEQ ID NO: 77861 - DNA, 103 bp, Artificial Sequence
  Synthetic Polynucleotide
taatacgactcactataggggtttgccaatccattaagtaatccattttaaacagaggagataaaatatgttacttaataacctggcggcagcgcaaaagatg

SEQ ID NO: 77862 - DNA, 103 bp, Artificial Sequence
  Synthetic Polynucleotide
taatacgactcactatagggttacggtttgccaatccattaagtaatccaaacagaggagatggattatgtaatggattaacctggcggcagcgcaaaagatg

SEQ ID NO: 77863 - DNA, 103 bp, Artificial Sequence
  Synthetic Polynucleotide
taatacgactcactataggggtatgttacggtttgccaatccattaagtaaacagaggagatacttaatggattggcaaaacctggcggcagcgcaaaagatg

SEQ ID NO: 77864 - DNA, 103 bp, Artificial Sequence
  Synthetic Polynucleotide
taatacgactcactatagggtaacggtatgttacggtttgccaatccattaacagaggagaaatggaatggcaaaccgtaacctggcggcagcgcaaaagatg

SEQ ID NO: 77865 - DNA, 103 bp, Artificial Sequence
  Synthetic Polynucleotide
taatacgactcactatagggttatctaacggtatgttacggtttgccaataacagaggagaattggcatgccgtaacataacctggcggcagcgcaaaagatg

SEQ ID NO: 77866 - DNA, 103 bp, Artificial Sequence
  Synthetic Polynucleotide
taatacgactcactatagggcagagttatctaacggtatgttacggtttgaacagaggagacaaaccatgacataccgtaacctggcggcagcgcaaaagatg

SEQ ID NO: 77867 - DNA, 103 bp, Artificial Sequence
  Synthetic Polynucleotide
taatacgactcactatagggtggagcagagttatctaacggtatgttacgaacagaggagacgtaacatgccgttagataacctggcggcagcgcaaaagatg

SEQ ID NO: 77868 - DNA, 103 bp, Artificial Sequence
  Synthetic Polynucleotide
taatacgactcactatagggctaaatggagcagagttatctaacggtatgaacagaggagacataccatgagataactcaacctggcggcagcgcaaaagatg

SEQ ID NO: 77869 - DNA, 103 bp, Artificial Sequence
  Synthetic Polynucleotide
taatacgactcactatagggcatataggacaattatccgacgcaccagttaacagaggagaaactggatggtcggataaaacctggcggcagcgcaaaagatg

SEQ ID NO: 77870 - DNA, 103 bp, Artificial Sequence
  Synthetic Polynucleotide
taatacgactcactatagggcggtactaaatggagcagagttatctaacgaacagaggagacgttagatgactctgctcaacctggcggcagcgcaaaagatg

SEQ ID NO: 77871 - DNA, 103 bp, Artificial Sequence
  Synthetic Polynucleotide
taatacgactcactatagggagaatcggtactaaatggagcagagttatcaacagaggagagataacatggctccatttaacctggcggcagcgcaaaagatg

SEQ ID NO: 77872 - DNA, 103 bp, Artificial Sequence
  Synthetic Polynucleotide
taatacgactcactatagggtatctagaatcggtactaaatggagcagagaacagaggagactctgcatgatttagtacaacctggcggcagcgcaaaagatg

SEQ ID NO: 77873 - DNA, 103 bp, Artificial Sequence
  Synthetic Polynucleotide
taatacgactcactatagggtcttgtatctagaatcggtactaaatggagaacagaggagactccatatggtaccgattaacctggcggcagcgcaaaagatg

SEQ ID NO: 77874 - DNA, 103 bp, Artificial Sequence
  Synthetic Polynucleotide
taatacgactcactatagggaatgatcttgtatctagaatcggtactaaaaacagaggagatttagtatggattctagaaacctggcggcagcgcaaaagatg

SEQ ID NO: 77875 - DNA, 103 bp, Artificial Sequence
  Synthetic Polynucleotide
taatacgactcactatagggcgtagaatgatcttgtatctagaatcggtaaacagaggagataccgaatgtagatacaaaacctggcggcagcgcaaaagatg

SEQ ID NO: 77876 - DNA, 103 bp, Artificial Sequence
  Synthetic Polynucleotide
taatacgactcactatagggtaggacgtagaatgatcttgtatctagaataacagaggagaattctaatgacaagatcaaacctggcggcagcgcaaaagatg

SEQ ID NO: 77877 - DNA, 103 bp, Artificial Sequence
  Synthetic Polynucleotide
taatacgactcactatagggatccataggacgtagaatgatcttgtatctaacagaggagaagatacatgatcattctaaacctggcggcagcgcaaaagatg

SEQ ID NO: 77878 - DNA, 103 bp, Artificial Sequence
  Synthetic Polynucleotide
taatacgactcactatagggtgcacatccataggacgtagaatgatcttgaacagaggagacaagatatgtctacgtccaacctggcggcagcgcaaaagatg

SEQ ID NO: 77879 - DNA, 103 bp, Artificial Sequence
  Synthetic Polynucleotide
taatacgactcactatagggagagttgcacatccataggacgtagaatgaaacagaggagatcattcatggtcctatggaacctggcggcagcgcaaaagatg

SEQ ID NO: 77880 - DNA, 103 bp, Artificial Sequence
  Synthetic Polynucleotide
taatacgactcactatagggtacgacatataggacaattatccgacgcacaacagaggagagtgcgtatgataattgtcaacctggcggcagcgcaaaagatg

SEQ ID NO: 77881 - DNA, 103 bp, Artificial Sequence
  Synthetic Polynucleotide
taatacgactcactatagggggctaagagttgcacatccataggacgtagaacagaggagactacgtatgatggatgtgaacctggcggcagcgcaaaagatg

SEQ ID NO: 77882 - DNA, 103 bp, Artificial Sequence
  Synthetic Polynucleotide
taatacgactcactataggggcttcggctaagagttgcacatccataggaaacagaggagatcctatatgtgtgcaactaacctggcggcagcgcaaaagatg

SEQ ID NO: 77883 - DNA, 103 bp, Artificial Sequence
  Synthetic Polynucleotide
taatacgactcactatagggcatacgcttcggctaagagttgcacatccaaacagaggagatggatgatgaactcttagaacctggcggcagcgcaaaagatg

SEQ ID NO: 77884 - DNA, 103 bp, Artificial Sequence
  Synthetic Polynucleotide
taatacgactcactatagggatactcatacgcttcggctaagagttgcacaacagaggagagtgcaaatgttagccgaaaacctggcggcagcgcaaaagatg

SEQ ID NO: 77885 - DNA, 103 bp, Artificial Sequence
  Synthetic Polynucleotide
taatacgactcactataggggctctatactcatacgcttcggctaagagtaacagaggagaactcttatgcgaagcgtaaacctggcggcagcgcaaaagatg

SEQ ID NO: 77886 - DNA, 103 bp, Artificial Sequence
  Synthetic Polynucleotide
taatacgactcactatagggatagtgctctatactcatacgcttcggctaaacagaggagatagccgatgcgtatgagtaacctggcggcagcgcaaaagatg

SEQ ID NO: 77887 - DNA, 103 bp, Artificial Sequence
  Synthetic Polynucleotide
taatacgactcactatagggtagaaatagtgctctatactcatacgcttcaacagaggagagaagcgatggagtatagaaacctggcggcagcgcaaaagatg

SEQ ID NO: 77888 - DNA, 103 bp, Artificial Sequence
  Synthetic Polynucleotide
taatacgactcactatagggggatttagaaatagtgctctatactcatacaacagaggagagtatgaatgtagagcactaacctggcggcagcgcaaaagatg

SEQ ID NO: 77889 - DNA, 103 bp, Artificial Sequence
  Synthetic Polynucleotide
taatacgactcactatagggtgatgggatttagaaatagtgctctatactaacagaggagaagtataatgcactatttcaacctggcggcagcgcaaaagatg

SEQ ID NO: 77890 - DNA, 103 bp, Artificial Sequence
  Synthetic Polynucleotide
taatacgactcactatagggtggtctgatgggatttagaaatagtgctctaacagaggagaagagcaatgtttctaaataacctggcggcagcgcaaaagatg

SEQ ID NO: 77891 - DNA, 103 bp, Artificial Sequence
  Synthetic Polynucleotide
taatacgactcactatagggacgggtacgacatataggacaattatccgaaacagaggagatcggatatgtgtcctataaacctggcggcagcgcaaaagatg

SEQ ID NO: 77892 - DNA, 103 bp, Artificial Sequence
  Synthetic Polynucleotide
taatacgactcactataggggtatatggtctgatgggatttagaaatagtaacagaggagaactattatgaaatcccataacctggcggcagcgcaaaagatg

SEQ ID NO: 77893 - DNA, 103 bp, Artificial Sequence
  Synthetic Polynucleotide
taatacgactcactatagggactcagtatatggtctgatgggatttagaaaacagaggagattctaaatgccatcagacaacctggcggcagcgcaaaagatg

SEQ ID NO: 77894 - DNA, 103 bp, Artificial Sequence
  Synthetic Polynucleotide
taatacgactcactatagggagccaactcagtatatggtctgatgggattaacagaggagaaatcccatgagaccatataacctggcggcagcgcaaaagatg

SEQ ID NO: 77895 - DNA, 103 bp, Artificial Sequence
  Synthetic Polynucleotide
taatacgactcactatagggatcatagccaactcagtatatggtctgatgaacagaggagacatcagatgatatactgaaacctggcggcagcgcaaaagatg

SEQ ID NO: 77896 - DNA, 103 bp, Artificial Sequence
  Synthetic Polynucleotide
taatacgactcactatagggacaagatcatagccaactcagtatatggtcaacagaggagagaccatatgctgagttggaacctggcggcagcgcaaaagatg

SEQ ID NO: 77897 - DNA, 103 bp, Artificial Sequence
  Synthetic Polynucleotide
taatacgactcactatagggtacgtacaagatcatagccaactcagtataaacagaggagatatactatgttggctatgaacctggcggcagcgcaaaagatg

SEQ ID NO: 77898 - DNA, 103 bp, Artificial Sequence
  Synthetic Polynucleotide
taatacgactcactatagggcagtatacgtacaagatcatagccaactcaaacagaggagatgagttatgtatgatcttaacctggcggcagcgcaaaagatg

SEQ ID NO: 77899 - DNA, 103 bp, Artificial Sequence
  Synthetic Polynucleotide
taatacgactcactatagggccatgcagtatacgtacaagatcatagccaaacagaggagatggctaatgtcttgtacgaacctggcggcagcgcaaaagatg

SEQ ID NO: 77900 - DNA, 103 bp, Artificial Sequence
  Synthetic Polynucleotide
taatacgactcactatagggtgattccatgcagtatacgtacaagatcataacagaggagaatgatcatgtacgtatacaacctggcggcagcgcaaaagatg

SEQ ID NO: 77901 - DNA, 103 bp, Artificial Sequence
  Synthetic Polynucleotide
taatacgactcactatagggatctatgattccatgcagtatacgtacaagaacagaggagacttgtaatgatactgcataacctggcggcagcgcaaaagatg

SEQ ID NO: 77902 - DNA, 103 bp, Artificial Sequence
  Synthetic Polynucleotide
taatacgactcactatagggttggactttgtactcaattagctatcgtctaacagaggagaagacgaatgctaattgagaacctggcggcagcgcaaaagatg

SEQ ID NO: 77903 - DNA, 103 bp, Artificial Sequence
  Synthetic Polynucleotide
taatacgactcactatagggctaaaacgggtacgacatataggacaattaaacagaggagataattgatgtatatgtcgaacctggcggcagcgcaaaagatg

SEQ ID NO: 77904 - DNA, 103 bp, Artificial Sequence
  Synthetic Polynucleotide
taatacgactcactatagggaggccatctatgattccatgcagtatacgtaacagaggagaacgtatatggcatggaataacctggcggcagcgcaaaagatg

SEQ ID NO: 77905 - DNA, 103 bp, Artificial Sequence
  Synthetic Polynucleotide
taatacgactcactatagggtgaaaaggccatctatgattccatgcagtaaacagaggagatactgcatggaatcatagaacctggcggcagcgcaaaagatg

SEQ ID NO: 77906 - DNA, 103 bp, Artificial Sequence
  Synthetic Polynucleotide
taatacgactcactatagggtcaactgaaaaggccatctatgattccatgaacagaggagacatggaatgatagatggcaacctggcggcagcgcaaaagatg

SEQ ID NO: 77907 - DNA, 103 bp, Artificial Sequence
  Synthetic Polynucleotide
taatacgactcactatagggccagttcaactgaaaaggccatctatgattaacagaggagaaatcatatgtggccttttaacctggcggcagcgcaaaagatg

SEQ ID NO: 77908 - DNA, 103 bp, Artificial Sequence
  Synthetic Polynucleotide
taatacgactcactatagggggctaccagttcaactgaaaaggccatctaaacagaggagatagatgatgttttcagttaacctggcggcagcgcaaaagatg

SEQ ID NO: 77909 - DNA, 103 bp, Artificial Sequence
  Synthetic Polynucleotide
taatacgactcactatagggaaacaggctaccagttcaactgaaaaggccaacagaggagaggccttatgagttgaactaacctggcggcagcgcaaaagatg

SEQ ID NO: 77910 - DNA, 103 bp, Artificial Sequence
  Synthetic Polynucleotide
taatacgactcactatagggtgctaaaacaggctaccagttcaactgaaaaacagaggagatttcagatgaactggtagaacctggcggcagcgcaaaagatg

SEQ ID NO: 77911 - DNA, 103 bp, Artificial Sequence
  Synthetic Polynucleotide
taatacgactcactatagggaaagatgctaaaacaggctaccagttcaacaacagaggagagttgaaatggtagcctgtaacctggcggcagcgcaaaagatg

SEQ ID NO: 77912 - DNA, 103 bp, Artificial Sequence
  Synthetic Polynucleotide
taatacgactcactatagggtataaaaagatgctaaaacaggctaccagtaacagaggagaactggtatgctgttttagaacctggcggcagcgcaaaagatg

SEQ ID NO: 77913 - DNA, 103 bp, Artificial Sequence
  Synthetic Polynucleotide
taatacgactcactatagggccagatataaaaagatgctaaaacaggctaaacagaggagatagcctatgttagcatctaacctggcggcagcgcaaaagatg

SEQ ID NO: 77914 - DNA, 103 bp, Artificial Sequence
  Synthetic Polynucleotide
taatacgactcactatagggtgtttctaaaacgggtacgacatataggacaacagaggagagtcctaatggtcgtacccaacctggcggcagcgcaaaagatg

SEQ ID NO: 77915 - DNA, 103 bp, Artificial Sequence
  Synthetic Polynucleotide
taatacgactcactataggggagagccagatataaaaagatgctaaaacaaacagaggagatgttttatgatctttttaaacctggcggcagcgcaaaagatg

SEQ ID NO: 77916 - DNA, 103 bp, Artificial Sequence
  Synthetic Polynucleotide
taatacgactcactataggggcagagagagccagatataaaaagatgctaaacagaggagatagcatatgtttatatctaacctggcggcagcgcaaaagatg

SEQ ID NO: 77917 - DNA, 103 bp, Artificial Sequence
  Synthetic Polynucleotide
taatacgactcactatagggttttggcagagagagccagatataaaaagaaacagaggagatcttttatgatctggctcaacctggcggcagcgcaaaagatg

SEQ ID NO: 77918 - DNA, 103 bp, Artificial Sequence
  Synthetic Polynucleotide
taatacgactcactatagggaacatttttggcagagagagccagatataaaacagaggagattatatatggctctctctaacctggcggcagcgcaaaagatg

SEQ ID NO: 77919 - DNA, 103 bp, Artificial Sequence
  Synthetic Polynucleotide
taatacgactcactatagggttaagaacatttttggcagagagagccagaaacagaggagatctggcatgctctgccaaaacctggcggcagcgcaaaagatg

SEQ ID NO: 77920 - DNA, 103 bp, Artificial Sequence
  Synthetic Polynucleotide
taatacgactcactataggggactattaagaacatttttggcagagagagaacagaggagactctctatgccaaaaatgaacctggcggcagcgcaaaagatg

SEQ ID NO: 77921 - DNA, 103 bp, Artificial Sequence
  Synthetic Polynucleotide
taatacgactcactatagggtcctagactattaagaacatttttggcagaaacagaggagatctgccatgaatgttcttaacctggcggcagcgcaaaagatg

SEQ ID NO: 77922 - DNA, 103 bp, Artificial Sequence
  Synthetic Polynucleotide
taatacgactcactatagggaccattcctagactattaagaacatttttgaacagaggagacaaaaaatgtcttaatagaacctggcggcagcgcaaaagatg

SEQ ID NO: 77923 - DNA, 103 bp, Artificial Sequence
  Synthetic Polynucleotide
taatacgactcactatagggaaggaaccattcctagactattaagaacataacagaggagaatgttcatgatagtctagaacctggcggcagcgcaaaagatg

SEQ ID NO: 77924 - DNA, 103 bp, Artificial Sequence
  Synthetic Polynucleotide
taatacgactcactatagggaatagaaggaaccattcctagactattaagaacagaggagacttaatatgctaggaatgaacctggcggcagcgcaaaagatg

SEQ ID NO: 77925 - DNA, 103 bp, Artificial Sequence
  Synthetic Polynucleotide
taatacgactcactatagggtgttatgtttctaaaacgggtacgacatataacagaggagaatatgtatgacccgttttaacctggcggcagcgcaaaagatg

SEQ ID NO: 77926 - DNA, 103 bp, Artificial Sequence
  Synthetic Polynucleotide
taatacgactcactatagggagatcaatagaaggaaccattcctagactaaacagaggagatagtctatgaatggttccaacctggcggcagcgcaaaagatg

SEQ ID NO: 77927 - DNA, 103 bp, Artificial Sequence
  Synthetic Polynucleotide
taatacgactcactatagggtcgatagatcaatagaaggaaccattcctaaacagaggagataggaaatgttccttctaaacctggcggcagcgcaaaagatg

SEQ ID NO: 77928 - DNA, 103 bp, Artificial Sequence
  Synthetic Polynucleotide
taatacgactcactatagggaattttcgatagatcaatagaaggaaccataacagaggagaatggttatgtctattgataacctggcggcagcgcaaaagatg

SEQ ID NO: 77929 - DNA, 103 bp, Artificial Sequence
  Synthetic Polynucleotide
taatacgactcactatagggatagcaattttcgatagatcaatagaaggaaacagaggagatccttcatgtgatctatcaacctggcggcagcgcaaaagatg

SEQ ID NO: 77930 - DNA, 103 bp, Artificial Sequence
  Synthetic Polynucleotide
taatacgactcactatagggctgaaatagcaattttcgatagatcaatagaacagaggagactattgatgtatcgaaaaaacctggcggcagcgcaaaagatg

SEQ ID NO: 77931 - DNA, 103 bp, Artificial Sequence
  Synthetic Polynucleotide
taatacgactcactatagggcatctctgaaatagcaattttcgatagatcaacagaggagagatctaatgaaaattgctaacctggcggcagcgcaaaagatg

SEQ ID NO: 77932 - DNA, 103 bp, Artificial Sequence
  Synthetic Polynucleotide
taatacgactcactatagggaacctcatctctgaaatagcaattttcgataacagaggagaatcgaaatgtgctatttcaacctggcggcagcgcaaaagatg

SEQ ID NO: 77933 - DNA, 103 bp, Artificial Sequence
  Synthetic Polynucleotide
taatacgactcactatagggtacctaacctcatctctgaaatagcaatttaacagaggagaaaattgatgtttcagagaaacctggcggcagcgcaaaagatg

SEQ ID NO: 77934 - DNA, 103 bp, Artificial Sequence
  Synthetic Polynucleotide
taatacgactcactatagggtagactacctaacctcatctctgaaatagcaacagaggagagctattatggagatgaggaacctggcggcagcgcaaaagatg

SEQ ID NO: 77935 - DNA, 103 bp, Artificial Sequence
  Synthetic Polynucleotide
taatacgactcactataggggaacctagactacctaacctcatctctgaaaacagaggagattcagaatggaggttaggaacctggcggcagcgcaaaagatg

SEQ ID NO: 77936 - DNA, 103 bp, Artificial Sequence
  Synthetic Polynucleotide
taatacgactcactatagggctcattgttatgtttctaaaacgggtacgaaacagaggagatcgtacatgttttagaaaaacctggcggcagcgcaaaagatg

SEQ ID NO: 77937 - DNA, 103 bp, Artificial Sequence
  Synthetic Polynucleotide
taatacgactcactatagggattgtgaacctagactacctaacctcatctaacagaggagaagatgaatgtaggtagtcaacctggcggcagcgcaaaagatg

SEQ ID NO: 77938 - DNA, 103 bp, Artificial Sequence
  Synthetic Polynucleotide
taatacgactcactatagggggttcattgtgaacctagactacctaacctaacagaggagaaggttaatgagtctaggtaacctggcggcagcgcaaaagatg

SEQ ID NO: 77939 - DNA, 103 bp, Artificial Sequence
  Synthetic Polynucleotide
taatacgactcactatagggattacggttcattgtgaacctagactacctaacagaggagaaggtagatgaggttcacaaacctggcggcagcgcaaaagatg

SEQ ID NO: 77940 - DNA, 103 bp, Artificial Sequence
  Synthetic Polynucleotide
taatacgactcactataggggatatattacggttcattgtgaacctagacaacagaggagagtctagatgcacaatgaaaacctggcggcagcgcaaaagatg

SEQ ID NO: 77941 - DNA, 103 bp, Artificial Sequence
  Synthetic Polynucleotide
taatacgactcactataggggcctagatatattacggttcattgtgaaccaacagaggagaggttcaatgtgaaccgtaaacctggcggcagcgcaaaagatg

SEQ ID NO: 77942 - DNA, 103 bp, Artificial Sequence
  Synthetic Polynucleotide
taatacgactcactatagggccaccgcctagatatattacggttcattgtaacagaggagaacaatgatgcgtaatataaacctggcggcagcgcaaaagatg

SEQ ID NO: 77943 - DNA, 103 bp, Artificial Sequence
  Synthetic Polynucleotide
taatacgactcactatagggaatatccaccgcctagatatattacggttcaacagaggagagaaccgatgtatatctagaacctggcggcagcgcaaaagatg

SEQ ID NO: 77944 - DNA, 103 bp, Artificial Sequence
  Synthetic Polynucleotide
taatacgactcactatagggtcagaaatatccaccgcctagatatattacaacagaggagagtaataatgctaggcggtaacctggcggcagcgcaaaagatg

SEQ ID NO: 77945 - DNA, 103 bp, Artificial Sequence
  Synthetic Polynucleotide
taatacgactcactatagggttgcttcagaaatatccaccgcctagatataacagaggagaatatctatgcggtggataaacctggcggcagcgcaaaagatg

SEQ ID NO: 77946 - DNA, 103 bp, Artificial Sequence
  Synthetic Polynucleotide
taatacgactcactatagggagctcttgcttcagaaatatccaccgcctaaacagaggagataggcgatggatatttctaacctggcggcagcgcaaaagatg

SEQ ID NO: 77947 - DNA, 103 bp, Artificial Sequence
  Synthetic Polynucleotide
taatacgactcactatagggacttactcattgttatgtttctaaaacgggaacagaggagacccgttatggaaacataaaacctggcggcagcgcaaaagatg

SEQ ID NO: 77948 - DNA, 103 bp, Artificial Sequence
  Synthetic Polynucleotide
taatacgactcactatagggtaatcagctcttgcttcagaaatatccaccaacagaggagaggtggaatgttctgaagcaacctggcggcagcgcaaaagatg

SEQ ID NO: 77949 - DNA, 103 bp, Artificial Sequence
  Synthetic Polynucleotide
taatacgactcactatagggataaataatcagctcttgcttcagaaatataacagaggagaatatttatgaagcaagagaacctggcggcagcgcaaaagatg

SEQ ID NO: 77950 - DNA, 103 bp, Artificial Sequence
  Synthetic Polynucleotide
taatacgactcactatagggaagaaataaataatcagctcttgcttcagaaacagaggagatctgaaatgagagctgataacctggcggcagcgcaaaagatg

SEQ ID NO: 77951 - DNA, 103 bp, Artificial Sequence
  Synthetic Polynucleotide
taatacgactcactatagggggaagaagaaataaataatcagctcttgctaacagaggagaagcaagatgtgattatttaacctggcggcagcgcaaaagatg

SEQ ID NO: 77952 - DNA, 103 bp, Artificial Sequence
  Synthetic Polynucleotide
taatacgactcactatagggagattggaagaagaaataaataatcagctcaacagaggagagagctgatgatttatttcaacctggcggcagcgcaaaagatg

SEQ ID NO: 77953 - DNA, 103 bp, Artificial Sequence
  Synthetic Polynucleotide
taatacgactcactataggggcaatagattggaagaagaaataaataatcaacagaggagagattatatgtttcttcttaacctggcggcagcgcaaaagatg

SEQ ID NO: 77954 - DNA, 103 bp, Artificial Sequence
  Synthetic Polynucleotide
taatacgactcactatagggtagtagcaatagattggaagaagaaataaaaacagaggagatttattatgtcttccaataacctggcggcagcgcaaaagatg

SEQ ID NO: 77955 - DNA, 103 bp, Artificial Sequence
  Synthetic Polynucleotide
taatacgactcactataggggttgttagtagcaatagattggaagaagaaaacagaggagattcttcatgcaatctattaacctggcggcagcgcaaaagatg

SEQ ID NO: 77956 - DNA, 103 bp, Artificial Sequence
  Synthetic Polynucleotide
taatacgactcactataggggtgtcgttgttagtagcaatagattggaagaacagaggagacttccaatgtattgctacaacctggcggcagcgcaaaagatg

SEQ ID NO: 77957 - DNA, 103 bp, Artificial Sequence
  Synthetic Polynucleotide
taatacgactcactatagggagtcggtgtcgttgttagtagcaatagattaacagaggagaaatctaatgctactaacaaacctggcggcagcgcaaaagatg

SEQ ID NO: 77958 - DNA, 103 bp, Artificial Sequence
  Synthetic Polynucleotide
taatacgactcactatagggatagaacttactcattgttatgtttctaaaaacagaggagatttagaatgataacaatgaacctggcggcagcgcaaaagatg

SEQ ID NO: 77959 - DNA, 103 bp, Artificial Sequence
  Synthetic Polynucleotide
taatacgactcactatagggacattagtcggtgtcgttgttagtagcaataacagaggagaattgctatgaacaacgacaacctggcggcagcgcaaaagatg

SEQ ID NO: 77960 - DNA, 103 bp, Artificial Sequence
  Synthetic Polynucleotide
taatacgactcactatagggcggaaacattagtcggtgtcgttgttagtaaacagaggagatactaaatgcgacaccgaaacctggcggcagcgcaaaagatg

SEQ ID NO: 77961 - DNA, 103 bp, Artificial Sequence
  Synthetic Polynucleotide
taatacgactcactatagggatctccggaaacattagtcggtgtcgttgtaacagaggagaacaacgatgccgactaataacctggcggcagcgcaaaagatg

SEQ ID NO: 77962 - DNA, 103 bp, Artificial Sequence
  Synthetic Polynucleotide
taatacgactcactatagggaatctatctccggaaacattagtcggtgtcaacagaggagagacaccatgtaatgtttcaacctggcggcagcgcaaaagatg

SEQ ID NO: 77963 - DNA, 103 bp, Artificial Sequence
  Synthetic Polynucleotide
taatacgactcactatagggttggaaatctatctccggaaacattagtcgaacagaggagacgactaatgtttccggagaacctggcggcagcgcaaaagatg

SEQ ID NO: 77964 - DNA, 103 bp, Artificial Sequence
  Synthetic Polynucleotide
taatacgactcactatagggtatctttggaaatctatctccggaaacattaacagaggagaaatgttatgggagatagaaacctggcggcagcgcaaaagatg

SEQ ID NO: 77965 - DNA, 103 bp, Artificial Sequence
  Synthetic Polynucleotide
taatacgactcactataggggtgtgtatctttggaaatctatctccggaaaacagaggagattccggatgtagatttccaacctggcggcagcgcaaaagatg

SEQ ID NO: 77966 - DNA, 103 bp, Artificial Sequence
  Synthetic Polynucleotide
taatacgactcactatagggctaatgtgtgtatctttggaaatctatctcaacagaggagagagataatgttccaaagaaacctggcggcagcgcaaaagatg

SEQ ID NO: 77967 - DNA, 103 bp, Artificial Sequence
  Synthetic Polynucleotide
taatacgactcactataggggtatcctaatgtgtgtatctttggaaatctaacagaggagaagatttatgaagatacacaacctggcggcagcgcaaaagatg

SEQ ID NO: 77968 - DNA, 103 bp, Artificial Sequence
  Synthetic Polynucleotide
taatacgactcactatagggagtctgtatcctaatgtgtgtatctttggaaacagaggagatccaaaatgacacacattaacctggcggcagcgcaaaagatg

SEQ ID NO: 77969 - DNA, 103 bp, Artificial Sequence
  Synthetic Polynucleotide
taatacgactcactatagggagcttatagaacttactcattgttatgtttaacagaggagaaaacatatgaatgagtaaaacctggcggcagcgcaaaagatg

SEQ ID NO: 77970 - DNA, 103 bp, Artificial Sequence
  Synthetic Polynucleotide
taatacgactcactatagggataacagtctgtatcctaatgtgtgtatctaacagaggagaagatacatgcattaggataacctggcggcagcgcaaaagatg

SEQ ID NO: 77971 - DNA, 103 bp, Artificial Sequence
  Synthetic Polynucleotide
taatacgactcactatagggtgattataacagtctgtatcctaatgtgtgaacagaggagacacacaatgggatacagaaacctggcggcagcgcaaaagatg

SEQ ID NO: 77972 - DNA, 103 bp, Artificial Sequence
  Synthetic Polynucleotide
taatacgactcactatagggatctttgattataacagtctgtatcctaataacagaggagaattaggatgcagactgttaacctggcggcagcgcaaaagatg

SEQ ID NO: 77973 - DNA, 103 bp, Artificial Sequence
  Synthetic Polynucleotide
taatacgactcactatagggtattaatctttgattataacagtctgtatcaacagaggagagatacaatgtgttataataacctggcggcagcgcaaaagatg

SEQ ID NO: 77974 - DNA, 103 bp, Artificial Sequence
  Synthetic Polynucleotide
taatacgactcactatagggtaatgtattaatctttgattataacagtctaacagaggagaagactgatgtaatcaaagaacctggcggcagcgcaaaagatg

SEQ ID NO: 77975 - DNA, 103 bp, Artificial Sequence
  Synthetic Polynucleotide
taatacgactcactatagggagtaataatgtattaatctttgattataacaacagaggagagttataatgaaagattaaaacctggcggcagcgcaaaagatg

SEQ ID NO: 77976 - DNA, 103 bp, Artificial Sequence
  Synthetic Polynucleotide
taatacgactcactatagggtgtttagtaataatgtattaatctttgattaacagaggagaaatcaaatgttaatacataacctggcggcagcgcaaaagatg

SEQ ID NO: 77977 - DNA, 103 bp, Artificial Sequence
  Synthetic Polynucleotide
taatacgactcactatagggaaaaatgtttagtaataatgtattaatcttaacagaggagaaagattatgacattattaaacctggcggcagcgcaaaagatg

SEQ ID NO: 77978 - DNA, 103 bp, Artificial Sequence
  Synthetic Polynucleotide
taatacgactcactatagggaaacaaaaaatgtttagtaataatgtattaaacagaggagataatacatgattactaaaaacctggcggcagcgcaaaagatg

SEQ ID NO: 77979 - DNA, 103 bp, Artificial Sequence
  Synthetic Polynucleotide
taatacgactcactatagggctccaaaacaaaaaatgtttagtaataatgaacagaggagacattatatgtaaacatttaacctggcggcagcgcaaaagatg

SEQ ID NO: 77980 - DNA, 103 bp, Artificial Sequence
  Synthetic Polynucleotide
taatacgactcactatagggtaactagcttatagaacttactcattgttaaacagaggagataacaaatggtaagttctaacctggcggcagcgcaaaagatg

SEQ ID NO: 77981 - DNA, 103 bp, Artificial Sequence
  Synthetic Polynucleotide
taatacgactcactatagggatttgctccaaaacaaaaaatgtttagtaaaacagaggagattactaatgattttttgtaacctggcggcagcgcaaaagatg

SEQ ID NO: 77982 - DNA, 103 bp, Artificial Sequence
  Synthetic Polynucleotide
taatacgactcactatagggaaggtatttgctccaaaacaaaaaatgtttaacagaggagaaaacatatgttgttttggaacctggcggcagcgcaaaagatg

SEQ ID NO: 77983 - DNA, 103 bp, Artificial Sequence
  Synthetic Polynucleotide
taatacgactcactataggggcggtaaggtatttgctccaaaacaaaaaaaacagaggagattttttatgttggagcaaaacctggcggcagcgcaaaagatg

SEQ ID NO: 77984 - DNA, 103 bp, Artificial Sequence
  Synthetic Polynucleotide
taatacgactcactatagggtgaaggcggtaaggtatttgctccaaaacaaacagaggagatgttttatggcaaataccaacctggcggcagcgcaaaagatg

SEQ ID NO: 77985 - DNA, 103 bp, Artificial Sequence
  Synthetic Polynucleotide
taatacgactcactatagggccttatgaaggcggtaaggtatttgctccaaacagaggagatggagcatgtaccttaccaacctggcggcagcgcaaaagatg

SEQ ID NO: 77986 - DNA, 103 bp, Artificial Sequence
  Synthetic Polynucleotide
taatacgactcactatagggagtttccttatgaaggcggtaaggtatttgaacagaggagacaaataatgtaccgccttaacctggcggcagcgcaaaagatg

SEQ ID NO: 77987 - DNA, 103 bp, Artificial Sequence
  Synthetic Polynucleotide
taatacgactcactatagggacaaaagtttccttatgaaggcggtaaggtaacagaggagaaccttaatgccttcataaaacctggcggcagcgcaaaagatg

SEQ ID NO: 77988 - DNA, 103 bp, Artificial Sequence
  Synthetic Polynucleotide
taatacgactcactatagggacaaaacaaaagtttccttatgaaggcggtaacagaggagaaccgccatgataaggaaaaacctggcggcagcgcaaaagatg

SEQ ID NO: 77989 - DNA, 103 bp, Artificial Sequence
  Synthetic Polynucleotide
taatacgactcactatagggcagaaacaaaacaaaagtttccttatgaagaacagaggagacttcatatggaaacttttaacctggcggcagcgcaaaagatg

SEQ ID NO: 77990 - DNA, 103 bp, Artificial Sequence
  Synthetic Polynucleotide
taatacgactcactatagggtagatcagaaacaaaacaaaagtttccttaaacagaggagataaggaatgttttgttttaacctggcggcagcgcaaaagatg

SEQ ID NO: 77991 - DNA, 103 bp, Artificial Sequence
  Synthetic Polynucleotide
taatacgactcactatagggttagttaactagcttatagaacttactcataacagaggagaatgagtatgttctataagaacctggcggcagcgcaaaagatg

SEQ ID NO: 77992 - DNA, 103 bp, Artificial Sequence
  Synthetic Polynucleotide
taatacgactcactatagggttagttagatcagaaacaaaacaaaagtttaacagaggagaaaacttatgttttgtttcaacctggcggcagcgcaaaagatg

SEQ ID NO: 77993 - DNA, 103 bp, Artificial Sequence
  Synthetic Polynucleotide
taatacgactcactatagggctatcttagttagatcagaaacaaaacaaaaacagaggagatttgttatgtttctgatcaacctggcggcagcgcaaaagatg

SEQ ID NO: 77994 - DNA, 103 bp, Artificial Sequence
  Synthetic Polynucleotide
taatacgactcactatagggtaaaactatcttagttagatcagaaacaaaaacagaggagatttgttatggatctaactaacctggcggcagcgcaaaagatg

SEQ ID NO: 77995 - DNA, 103 bp, Artificial Sequence
  Synthetic Polynucleotide
taatacgactcactataggggaaactaaaactatcttagttagatcagaaaacagaggagattctgaatgaactaagataacctggcggcagcgcaaaagatg

SEQ ID NO: 77996 - DNA, 103 bp, Artificial Sequence
  Synthetic Polynucleotide
taatacgactcactatagggtgttggaaactaaaactatcttagttagataacagaggagaatctaaatgagatagtttaacctggcggcagcgcaaaagatg

SEQ ID NO: 77997 - DNA, 103 bp, Artificial Sequence
  Synthetic Polynucleotide
taatacgactcactataggggctattgttggaaactaaaactatcttagtaacagaggagaactaagatggttttagttaacctggcggcagcgcaaaagatg

SEQ ID NO: 77998 - DNA, 103 bp, Artificial Sequence
  Synthetic Polynucleotide
taatacgactcactatagggttaaagctattgttggaaactaaaactatcaacagaggagagatagtatgagtttccaaaacctggcggcagcgcaaaagatg

SEQ ID NO: 77999 - DNA, 103 bp, Artificial Sequence
  Synthetic Polynucleotide
taatacgactcactatagggcactgttaaagctattgttggaaactaaaaaacagaggagattttagatgccaacaataaacctggcggcagcgcaaaagatg

SEQ ID NO: 78000 - DNA, 103 bp, Artificial Sequence
  Synthetic Polynucleotide
taatacgactcactataggggggtccactgttaaagctattgttggaaacaacagaggagagtttccatgaatagctttaacctggcggcagcgcaaaagatg

SEQ ID NO: 78001 - DNA, 103 bp, Artificial Sequence
  Synthetic Polynucleotide
taatacgactcactatagggatcaagggtccactgttaaagctattgttgaacagaggagacaacaaatgctttaacagaacctggcggcagcgcaaaagatg

SEQ ID NO: 78002 - DNA, 103 bp, Artificial Sequence
  Synthetic Polynucleotide
taatacgactcactatagggatttattagttaactagcttatagaacttaaacagaggagataagttatgtaagctagtaacctggcggcagcgcaaaagatg

SEQ ID NO: 78003 - DNA, 103 bp, Artificial Sequence
  Synthetic Polynucleotide
taatacgactcactatagggcagtcatcaagggtccactgttaaagctataacagaggagaatagctatgacagtggacaacctggcggcagcgcaaaagatg

SEQ ID NO: 78004 - DNA, 103 bp, Artificial Sequence
  Synthetic Polynucleotide
taatacgactcactataggggagtacagtcatcaagggtccactgttaaaaacagaggagatttaacatgggacccttgaacctggcggcagcgcaaaagatg

SEQ ID NO: 78005 - DNA, 103 bp, Artificial Sequence
  Synthetic Polynucleotide
taatacgactcactatagggaaagcgagtacagtcatcaagggtccactgaacagaggagacagtggatgcttgatgacaacctggcggcagcgcaaaagatg

SEQ ID NO: 78006 - DNA, 103 bp, Artificial Sequence
  Synthetic Polynucleotide
taatacgactcactatagggggtataaagcgagtacagtcatcaagggtcaacagaggagagaccctatgtgactgtacaacctggcggcagcgcaaaagatg

SEQ ID NO: 78007 - DNA, 103 bp, Artificial Sequence
  Synthetic Polynucleotide
taatacgactcactatagggattcgggtataaagcgagtacagtcatcaaaacagaggagattgatgatggtactcgctaacctggcggcagcgcaaaagatg

SEQ ID NO: 78008 - DNA, 103 bp, Artificial Sequence
  Synthetic Polynucleotide
taatacgactcactatagggatggtattcgggtataaagcgagtacagtcaacagaggagagactgtatgcgctttataaacctggcggcagcgcaaaagatg

SEQ ID NO: 78009 - DNA, 103 bp, Artificial Sequence
  Synthetic Polynucleotide
taatacgactcactatagggaatccatggtattcgggtataaagcgagtaaacagaggagatactcgatgtatacccgaaacctggcggcagcgcaaaagatg

SEQ ID NO: 78010 - DNA, 103 bp, Artificial Sequence
  Synthetic Polynucleotide
taatacgactcactatagggtcctcaatccatggtattcgggtataaagcaacagaggagagctttaatgccgaataccaacctggcggcagcgcaaaagatg

SEQ ID NO: 78011 - DNA, 103 bp, Artificial Sequence
  Synthetic Polynucleotide
taatacgactcactataggggtgcttcctcaatccatggtattcgggtataacagaggagaatacccatgtaccatggaaacctggcggcagcgcaaaagatg

SEQ ID NO: 78012 - DNA, 103 bp, Artificial Sequence
  Synthetic Polynucleotide
taatacgactcactatagggcatatgtgcttcctcaatccatggtattcgaacagaggagacgaataatgtggattgagaacctggcggcagcgcaaaagatg

SEQ ID NO: 78013 - DNA, 103 bp, Artificial Sequence
  Synthetic Polynucleotide
taatacgactcactatagggaatcattggactttgtactcaattagctataacagaggagaatagctatgtgagtacaaaacctggcggcagcgcaaaagatg

SEQ ID NO: 78014 - DNA, 103 bp, Artificial Sequence
  Synthetic Polynucleotide
taatacgactcactatagggtttttatttattagttaactagcttatagaaacagaggagatctataatgtagttaactaacctggcggcagcgcaaaagatg

SEQ ID NO: 78015 - DNA, 103 bp, Artificial Sequence
  Synthetic Polynucleotide
taatacgactcactataggggtcaacatatgtgcttcctcaatccatggtaacagaggagaaccatgatgtgaggaagcaacctggcggcagcgcaaaagatg

SEQ ID NO: 78016 - DNA, 103 bp, Artificial Sequence
  Synthetic Polynucleotide
taatacgactcactatagggggtgcgtcaacatatgtgcttcctcaatccaacagaggagaggattgatgaagcacataaacctggcggcagcgcaaaagatg

SEQ ID NO: 78017 - DNA, 103 bp, Artificial Sequence
  Synthetic Polynucleotide
taatacgactcactatagggacgcgggtgcgtcaacatatgtgcttcctcaacagaggagagaggaaatgcatatgttgaacctggcggcagcgcaaaagatg

SEQ ID NO: 78018 - DNA, 103 bp, Artificial Sequence
  Synthetic Polynucleotide
taatacgactcactatagggaacagacgcgggtgcgtcaacatatgtgctaacagaggagaagcacaatggttgacgcaaacctggcggcagcgcaaaagatg

SEQ ID NO: 78019 - DNA, 103 bp, Artificial Sequence
  Synthetic Polynucleotide
taatacgactcactatagggacaaaaacagacgcgggtgcgtcaacatataacagaggagaatatgtatgcgcacccgcaacctggcggcagcgcaaaagatg

SEQ ID NO: 78020 - DNA, 103 bp, Artificial Sequence
  Synthetic Polynucleotide
taatacgactcactatagggtagaaacaaaaacagacgcgggtgcgtcaaaacagaggagattgacgatgccgcgtctgaacctggcggcagcgcaaaagatg

SEQ ID NO: 78021 - DNA, 103 bp, Artificial Sequence
  Synthetic Polynucleotide
taatacgactcactatagggtggagtagaaacaaaaacagacgcgggtgcaacagaggagagcacccatgtctgtttttaacctggcggcagcgcaaaagatg

SEQ ID NO: 78022 - DNA, 103 bp, Artificial Sequence
  Synthetic Polynucleotide
taatacgactcactatagggtattatggagtagaaacaaaaacagacgcgaacagaggagacgcgtcatgttttgtttcaacctggcggcagcgcaaaagatg

SEQ ID NO: 78023 - DNA, 103 bp, Artificial Sequence
  Synthetic Polynucleotide
taatacgactcactataggggggagtattatggagtagaaacaaaaacagaacagaggagactgtttatgtttctactcaacctggcggcagcgcaaaagatg

SEQ ID NO: 78024 - DNA, 103 bp, Artificial Sequence
  Synthetic Polynucleotide
taatacgactcactatagggtttgtgggagtattatggagtagaaacaaaaacagaggagatttgttatgactccataaaacctggcggcagcgcaaaagatg

SEQ ID NO: 78025 - DNA, 103 bp, Artificial Sequence
  Synthetic Polynucleotide
taatacgactcactatagggtaaactttttatttattagttaactagcttaacagaggagaaagctaatgaactaataaaacctggcggcagcgcaaaagatg

SEQ ID NO: 78026 - DNA, 103 bp, Artificial Sequence
  Synthetic Polynucleotide
taatacgactcactatagggcagtatttgtgggagtattatggagtagaaaacagaggagattctacatgataatactcaacctggcggcagcgcaaaagatg

SEQ ID NO: 78027 - DNA, 103 bp, Artificial Sequence
  Synthetic Polynucleotide
taatacgactcactatagggtgtgtcagtatttgtgggagtattatggagaacagaggagactccatatgactcccacaaacctggcggcagcgcaaaagatg

SEQ ID NO: 78028 - DNA, 103 bp, Artificial Sequence
  Synthetic Polynucleotide
taatacgactcactatagggttgcttgtgtcagtatttgtgggagtattaaacagaggagataatacatgcacaaatacaacctggcggcagcgcaaaagatg

SEQ ID NO: 78029 - DNA, 103 bp, Artificial Sequence
  Synthetic Polynucleotide
taatacgactcactataggggatgcttgcttgtgtcagtatttgtgggagaacagaggagactcccaatgatactgacaaacctggcggcagcgcaaaagatg

SEQ ID NO: 78030 - DNA, 103 bp, Artificial Sequence
  Synthetic Polynucleotide
taatacgactcactatagggttcatgatgcttgcttgtgtcagtatttgtaacagaggagaacaaatatggacacaagcaacctggcggcagcgcaaaagatg

SEQ ID NO: 78031 - DNA, 103 bp, Artificial Sequence
  Synthetic Polynucleotide
taatacgactcactatagggctgtattcatgatgcttgcttgtgtcagtaaacagaggagatactgaatgaagcaagcaaacctggcggcagcgcaaaagatg

SEQ ID NO: 78032 - DNA, 103 bp, Artificial Sequence
  Synthetic Polynucleotide
taatacgactcactatagggagatactgtattcatgatgcttgcttgtgtaacagaggagaacacaaatgagcatcatgaacctggcggcagcgcaaaagatg

SEQ ID NO: 78033 - DNA, 103 bp, Artificial Sequence
  Synthetic Polynucleotide
taatacgactcactatagggtggctagatactgtattcatgatgcttgctaacagaggagaagcaagatgcatgaatacaacctggcggcagcgcaaaagatg

SEQ ID NO: 78034 - DNA, 103 bp, Artificial Sequence
  Synthetic Polynucleotide
taatacgactcactatagggagatatggctagatactgtattcatgatgcaacagaggagagcatcaatgatacagtataacctggcggcagcgcaaaagatg

SEQ ID NO: 78035 - DNA, 103 bp, Artificial Sequence
  Synthetic Polynucleotide
taatacgactcactataggggctttagatatggctagatactgtattcataacagaggagaatgaatatggtatctagcaacctggcggcagcgcaaaagatg

SEQ ID NO: 78036 - DNA, 103 bp, Artificial Sequence
  Synthetic Polynucleotide
taatacgactcactatagggcaaattaaactttttatttattagttaactaacagaggagaagttaaatgataaataaaaacctggcggcagcgcaaaagatg

SEQ ID NO: 78037 - DNA, 103 bp, Artificial Sequence
  Synthetic Polynucleotide
taatacgactcactatagggacatagctttagatatggctagatactgtaaacagaggagatacagtatgtagccatataacctggcggcagcgcaaaagatg

SEQ ID NO: 78038 - DNA, 103 bp, Artificial Sequence
  Synthetic Polynucleotide
taatacgactcactatagggtctaaacatagctttagatatggctagataaacagaggagatatctaatgatatctaaaaacctggcggcagcgcaaaagatg

SEQ ID NO: 78039 - DNA, 103 bp, Artificial Sequence
  Synthetic Polynucleotide
taatacgactcactatagggtataatctaaacatagctttagatatggctaacagaggagaagccatatgtaaagctataacctggcggcagcgcaaaagatg

SEQ ID NO: 78040 - DNA, 103 bp, Artificial Sequence
  Synthetic Polynucleotide
taatacgactcactatagggaggattataatctaaacatagctttagataaacagaggagatatctaatgctatgtttaaacctggcggcagcgcaaaagatg

SEQ ID NO: 78041 - DNA, 103 bp, Artificial Sequence
  Synthetic Polynucleotide
taatacgactcactataggggtataaggattataatctaaacatagctttaacagaggagaaaagctatgtttagattaaacctggcggcagcgcaaaagatg

SEQ ID NO: 78042 - DNA, 103 bp, Artificial Sequence
  Synthetic Polynucleotide
taatacgactcactatagggcagatgtataaggattataatctaaacataaacagaggagatatgttatgattataatcaacctggcggcagcgcaaaagatg

SEQ ID NO: 78043 - DNA, 103 bp, Artificial Sequence
  Synthetic Polynucleotide
taatacgactcactatagggtagcacagatgtataaggattataatctaaaacagaggagattagatatgaatccttataacctggcggcagcgcaaaagatg

SEQ ID NO: 78044 - DNA, 103 bp, Artificial Sequence
  Synthetic Polynucleotide
taatacgactcactatagggtgatctagcacagatgtataaggattataaaacagaggagattataaatgttatacatcaacctggcggcagcgcaaaagatg

SEQ ID NO: 78045 - DNA, 103 bp, Artificial Sequence
  Synthetic Polynucleotide
taatacgactcactataggggacgttgatctagcacagatgtataaggataacagaggagaatccttatgcatctgtgcaacctggcggcagcgcaaaagatg

SEQ ID NO: 78046 - DNA, 103 bp, Artificial Sequence
  Synthetic Polynucleotide
taatacgactcactatagggaggatgacgttgatctagcacagatgtataaacagaggagatatacaatggtgctagataacctggcggcagcgcaaaagatg

SEQ ID NO: 78047 - DNA, 103 bp, Artificial Sequence
  Synthetic Polynucleotide
taatacgactcactataggggtcaacaaattaaactttttatttattagtaacagaggagaactaatatgtaaaaagttaacctggcggcagcgcaaaagatg

SEQ ID NO: 78048 - DNA, 103 bp, Artificial Sequence
  Synthetic Polynucleotide
taatacgactcactatagggcggaaaggatgacgttgatctagcacagataacagaggagaatctgtatgagatcaacgaacctggcggcagcgcaaaagatg

SEQ ID NO: 78049 - DNA, 103 bp, Artificial Sequence
  Synthetic Polynucleotide
taatacgactcactatagggtcgttcggaaaggatgacgttgatctagcaaacagaggagatgctagatgaacgtcatcaacctggcggcagcgcaaaagatg

SEQ ID NO: 78050 - DNA, 103 bp, Artificial Sequence
  Synthetic Polynucleotide
taatacgactcactatagggaattatcgttcggaaaggatgacgttgatcaacagaggagagatcaaatgcatcctttcaacctggcggcagcgcaaaagatg

SEQ ID NO: 78051 - DNA, 103 bp, Artificial Sequence
  Synthetic Polynucleotide
taatacgactcactataggggtataaattatcgttcggaaaggatgacgtaacagaggagaacgtcaatgtttccgaacaacctggcggcagcgcaaaagatg

SEQ ID NO: 78052 - DNA, 103 bp, Artificial Sequence
  Synthetic Polynucleotide
taatacgactcactataggggatacgtataaattatcgttcggaaaggataacagaggagaatccttatggaacgataaaacctggcggcagcgcaaaagatg

SEQ ID NO: 78053 - DNA, 103 bp, Artificial Sequence
  Synthetic Polynucleotide
taatacgactcactatagggcaaatgatacgtataaattatcgttcggaaaacagaggagattccgaatgataatttataacctggcggcagcgcaaaagatg

SEQ ID NO: 78054 - DNA, 103 bp, Artificial Sequence
  Synthetic Polynucleotide
taatacgactcactatagggtttaacaaatgatacgtataaattatcgttaacagaggagaaacgatatgttatacgtaaacctggcggcagcgcaaaagatg

SEQ ID NO: 78055 - DNA, 103 bp, Artificial Sequence
  Synthetic Polynucleotide
taatacgactcactatagggcccactttaacaaatgatacgtataaattaaacagaggagataatttatgcgtatcattaacctggcggcagcgcaaaagatg

SEQ ID NO: 78056 - DNA, 103 bp, Artificial Sequence
  Synthetic Polynucleotide
taatacgactcactatagggcatgtcccactttaacaaatgatacgtataaacagaggagatatacgatgcatttgttaaacctggcggcagcgcaaaagatg

SEQ ID NO: 78057 - DNA, 103 bp, Artificial Sequence
  Synthetic Polynucleotide
taatacgactcactatagggactatcatgtcccactttaacaaatgatacaacagaggagagtatcaatggttaaagtgaacctggcggcagcgcaaaagatg

SEQ ID NO: 78058 - DNA, 103 bp, Artificial Sequence
  Synthetic Polynucleotide
taatacgactcactatagggatgtcgtcaacaaattaaactttttatttaaacagaggagataaataatgagtttaattaacctggcggcagcgcaaaagatg

SEQ ID NO: 78059 - DNA, 103 bp, Artificial Sequence
  Synthetic Polynucleotide
taatacgactcactataggggttgtactatcatgtcccactttaacaaataacagaggagaatttgtatgagtgggacaaacctggcggcagcgcaaaagatg

SEQ ID NO: 78060 - DNA, 103 bp, Artificial Sequence
  Synthetic Polynucleotide
taatacgactcactatagggtcaaagttgtactatcatgtcccactttaaaacagaggagattaaagatggacatgataaacctggcggcagcgcaaaagatg

SEQ ID NO: 78061 - DNA, 103 bp, Artificial Sequence
  Synthetic Polynucleotide
taatacgactcactatagggtggattcaaagttgtactatcatgtcccacaacagaggagagtgggaatggatagtacaaacctggcggcagcgcaaaagatg

SEQ ID NO: 78062 - DNA, 103 bp, Artificial Sequence
  Synthetic Polynucleotide
taatacgactcactataggggaaaatggattcaaagttgtactatcatgtaacagaggagaacatgaatgtacaactttaacctggcggcagcgcaaaagatg

SEQ ID NO: 78063 - DNA, 103 bp, Artificial Sequence
  Synthetic Polynucleotide
taatacgactcactatagggtttgggaaaatggattcaaagttgtactataacagaggagaatagtaatgctttgaatcaacctggcggcagcgcaaaagatg

SEQ ID NO: 78064 - DNA, 103 bp, Artificial Sequence
  Synthetic Polynucleotide
taatacgactcactatagggagatatttgggaaaatggattcaaagttgtaacagaggagaacaactatgaatccatttaacctggcggcagcgcaaaagatg

SEQ ID NO: 78065 - DNA, 103 bp, Artificial Sequence
  Synthetic Polynucleotide
taatacgactcactatagggcataaagatatttgggaaaatggattcaaaaacagaggagatttgaaatgattttcccaaacctggcggcagcgcaaaagatg

SEQ ID NO: 78066 - DNA, 103 bp, Artificial Sequence
  Synthetic Polynucleotide
taatacgactcactatagggtaattcataaagatatttgggaaaatggataacagaggagaatccatatgcccaaatataacctggcggcagcgcaaaagatg

SEQ ID NO: 78067 - DNA, 103 bp, Artificial Sequence
  Synthetic Polynucleotide
taatacgactcactatagggtaaagtaattcataaagatatttgggaaaaaacagaggagattttccatgatatctttaaacctggcggcagcgcaaaagatg

SEQ ID NO: 78068 - DNA, 103 bp, Artificial Sequence
  Synthetic Polynucleotide
taatacgactcactatagggatatgtaaagtaattcataaagatatttggaacagaggagaccaaatatgtttatgaataacctggcggcagcgcaaaagatg

SEQ ID NO: 78069 - DNA, 103 bp, Artificial Sequence
  Synthetic Polynucleotide
taatacgactcactataggggatatatgtcgtcaacaaattaaactttttaacagaggagaaaaaagatgaatttgttgaacctggcggcagcgcaaaagatg

SEQ ID NO: 78070 - DNA, 103 bp, Artificial Sequence
  Synthetic Polynucleotide
taatacgactcactatagggatattatatgtaaagtaattcataaagataaacagaggagatatcttatggaattacttaacctggcggcagcgcaaaagatg

SEQ ID NO: 78071 - DNA, 103 bp, Artificial Sequence
  Synthetic Polynucleotide
taatacgactcactatagggtgatgatattatatgtaaagtaattcataaaacagaggagattatgaatgactttacataacctggcggcagcgcaaaagatg

SEQ ID NO: 78072 - DNA, 103 bp, Artificial Sequence
  Synthetic Polynucleotide
taatacgactcactatagggacggttgatgatattatatgtaaagtaattaacagaggagaaattacatgacatataataacctggcggcagcgcaaaagatg

SEQ ID NO: 78073 - DNA, 103 bp, Artificial Sequence
  Synthetic Polynucleotide
taatacgactcactatagggatgtgacggttgatgatattatatgtaaagaacagaggagactttacatgtaatatcataacctggcggcagcgcaaaagatg

SEQ ID NO: 78074 - DNA, 103 bp, Artificial Sequence
  Synthetic Polynucleotide
taatacgactcactatagggtaattatgtgacggttgatgatattatatgaacagaggagacatataatgtcatcaaccaacctggcggcagcgcaaaagatg

SEQ ID NO: 78075 - DNA, 103 bp, Artificial Sequence
  Synthetic Polynucleotide
taatacgactcactatagggacaggtaattatgtgacggttgatgatattaacagaggagaaatatcatgaaccgtcacaacctggcggcagcgcaaaagatg

SEQ ID NO: 78076 - DNA, 103 bp, Artificial Sequence
  Synthetic Polynucleotide
taatacgactcactatagggtaaccacaggtaattatgtgacggttgatgaacagaggagacatcaaatgtcacataataacctggcggcagcgcaaaagatg

SEQ ID NO: 78077 - DNA, 103 bp, Artificial Sequence
  Synthetic Polynucleotide
taatacgactcactatagggggttttaaccacaggtaattatgtgacggtaacagaggagaaccgtcatgtaattacctaacctggcggcagcgcaaaagatg

SEQ ID NO: 78078 - DNA, 103 bp, Artificial Sequence
  Synthetic Polynucleotide
taatacgactcactataggggcaaaggttttaaccacaggtaattatgtgaacagaggagacacataatgacctgtggtaacctggcggcagcgcaaaagatg

SEQ ID NO: 78079 - DNA, 103 bp, Artificial Sequence
  Synthetic Polynucleotide
taatacgactcactatagggtatttgcaaaggttttaaccacaggtaattaacagaggagaaattacatgtggttaaaaaacctggcggcagcgcaaaagatg

SEQ ID NO: 78080 - DNA, 103 bp, Artificial Sequence
  Synthetic Polynucleotide
taatacgactcactatagggataacgatatatgtcgtcaacaaattaaacaacagaggagagtttaaatggttgacgacaacctggcggcagcgcaaaagatg

SEQ ID NO: 78081 - DNA, 103 bp, Artificial Sequence
  Synthetic Polynucleotide
taatacgactcactatagggcgctgtatttgcaaaggttttaaccacaggaacagaggagacctgtgatgaaaacctttaacctggcggcagcgcaaaagatg

SEQ ID NO: 78082 - DNA, 103 bp, Artificial Sequence
  Synthetic Polynucleotide
taatacgactcactatagggaaagccgctgtatttgcaaaggttttaaccaacagaggagaggttaaatgctttgcaaaaacctggcggcagcgcaaaagatg

SEQ ID NO: 78083 - DNA, 103 bp, Artificial Sequence
  Synthetic Polynucleotide
taatacgactcactatagggaaggcaaagccgctgtatttgcaaaggtttaacagaggagaaaacctatgcaaatacagaacctggcggcagcgcaaaagatg

SEQ ID NO: 78084 - DNA, 103 bp, Artificial Sequence
  Synthetic Polynucleotide
taatacgactcactatagggcgctaaaggcaaagccgctgtatttgcaaaaacagaggagatttgcaatgacagcggctaacctggcggcagcgcaaaagatg

SEQ ID NO: 78085 - DNA, 103 bp, Artificial Sequence
  Synthetic Polynucleotide
taatacgactcactatagggacggacgctaaaggcaaagccgctgtatttaacagaggagaaaatacatgggctttgccaacctggcggcagcgcaaaagatg

SEQ ID NO: 78086 - DNA, 103 bp, Artificial Sequence
  Synthetic Polynucleotide
taatacgactcactatagggatactacggacgctaaaggcaaagccgctgaacagaggagacagcggatgtgcctttagaacctggcggcagcgcaaaagatg

SEQ ID NO: 78087 - DNA, 103 bp, Artificial Sequence
  Synthetic Polynucleotide
taatacgactcactatagggtgacgatactacggacgctaaaggcaaagcaacagaggagagctttgatgttagcgtccaacctggcggcagcgcaaaagatg

SEQ ID NO: 78088 - DNA, 103 bp, Artificial Sequence
  Synthetic Polynucleotide
taatacgactcactatagggatcggtgacgatactacggacgctaaaggcaacagaggagagcctttatggtccgtagtaacctggcggcagcgcaaaagatg

SEQ ID NO: 78089 - DNA, 103 bp, Artificial Sequence
  Synthetic Polynucleotide
taatacgactcactatagggcgttcatcggtgacgatactacggacgctaaacagaggagatagcgtatgtagtatcgtaacctggcggcagcgcaaaagatg

SEQ ID NO: 78090 - DNA, 103 bp, Artificial Sequence
  Synthetic Polynucleotide
taatacgactcactatagggaatgacgttcatcggtgacgatactacggaaacagaggagatccgtaatgtcgtcaccgaacctggcggcagcgcaaaagatg

SEQ ID NO: 78091 - DNA, 103 bp, Artificial Sequence
  Synthetic Polynucleotide
taatacgactcactataggggaaaaataacgatatatgtcgtcaacaaataacagaggagaatttgtatgcgacatataaacctggcggcagcgcaaaagatg

SEQ ID NO: 78092 - DNA, 103 bp, Artificial Sequence
  Synthetic Polynucleotide
taatacgactcactatagggagagaaatgacgttcatcggtgacgatactaacagaggagaagtatcatgaccgatgaaaacctggcggcagcgcaaaagatg

SEQ ID NO: 78093 - DNA, 103 bp, Artificial Sequence
  Synthetic Polynucleotide
taatacgactcactataggggagttagagaaatgacgttcatcggtgacgaacagaggagacgtcacatgtgaacgtcaaacctggcggcagcgcaaaagatg

SEQ ID NO: 78094 - DNA, 103 bp, Artificial Sequence
  Synthetic Polynucleotide
taatacgactcactatagggtagaggagttagagaaatgacgttcatcggaacagaggagaccgatgatggtcatttctaacctggcggcagcgcaaaagatg

SEQ ID NO: 78095 - DNA, 103 bp, Artificial Sequence
  Synthetic Polynucleotide
taatacgactcactatagggttaaatagaggagttagagaaatgacgttcaacagaggagagaacgtatgttctctaacaacctggcggcagcgcaaaagatg

SEQ ID NO: 78096 - DNA, 103 bp, Artificial Sequence
  Synthetic Polynucleotide
taatacgactcactatagggaagtattaaatagaggagttagagaaatgaaacagaggagatcatttatgtaactcctcaacctggcggcagcgcaaaagatg

SEQ ID NO: 78097 - DNA, 103 bp, Artificial Sequence
  Synthetic Polynucleotide
taatacgactcactataggggggtaaagtattaaatagaggagttagagaaacagaggagatctctaatgcctctatttaacctggcggcagcgcaaaagatg

SEQ ID NO: 78098 - DNA, 103 bp, Artificial Sequence
  Synthetic Polynucleotide
taatacgactcactatagggtgcatgggtaaagtattaaatagaggagttaacagaggagaaactccatgatttaatacaacctggcggcagcgcaaaagatg

SEQ ID NO: 78099 - DNA, 103 bp, Artificial Sequence
  Synthetic Polynucleotide
taatacgactcactatagggttagttgcatgggtaaagtattaaatagagaacagaggagactctatatgatactttacaacctggcggcagcgcaaaagatg

SEQ ID NO: 78100 - DNA, 103 bp, Artificial Sequence
  Synthetic Polynucleotide
taatacgactcactatagggcgcgtttagttgcatgggtaaagtattaaaaacagaggagatttaatatgttacccatgaacctggcggcagcgcaaaagatg

SEQ ID NO: 78101 - DNA, 103 bp, Artificial Sequence
  Synthetic Polynucleotide
taatacgactcactatagggaagaacgcgtttagttgcatgggtaaagtaaacagaggagatactttatgcatgcaactaacctggcggcagcgcaaaagatg

SEQ ID NO: 78102 - DNA, 103 bp, Artificial Sequence
  Synthetic Polynucleotide
taatacgactcactatagggtacgagaaaaataacgatatatgtcgtcaaaacagaggagattgacgatgtatatcgttaacctggcggcagcgcaaaagatg

SEQ ID NO: 78103 - DNA, 103 bp, Artificial Sequence
  Synthetic Polynucleotide
taatacgactcactatagggtatccaagaacgcgtttagttgcatgggtaaacagaggagatacccaatgaactaaacgaacctggcggcagcgcaaaagatg

SEQ ID NO: 78104 - DNA, 103 bp, Artificial Sequence
  Synthetic Polynucleotide
taatacgactcactatagggttctatatccaagaacgcgtttagttgcataacagaggagaatgcaaatgaacgcgttcaacctggcggcagcgcaaaagatg

SEQ ID NO: 78105 - DNA, 103 bp, Artificial Sequence
  Synthetic Polynucleotide
taatacgactcactatagggttggattctatatccaagaacgcgtttagtaacagaggagaactaaaatggttcttggaaacctggcggcagcgcaaaagatg

SEQ ID NO: 78106 - DNA, 103 bp, Artificial Sequence
  Synthetic Polynucleotide
taatacgactcactatagggacaaattggattctatatccaagaacgcgtaacagaggagaacgcgtatgtggatatagaacctggcggcagcgcaaaagatg

SEQ ID NO: 78107 - DNA, 103 bp, Artificial Sequence
  Synthetic Polynucleotide
taatacgactcactatagggttcgtacaaattggattctatatccaagaaaacagaggagattcttgatgatagaatccaacctggcggcagcgcaaaagatg

SEQ ID NO: 78108 - DNA, 103 bp, Artificial Sequence
  Synthetic Polynucleotide
taatacgactcactatagggttggattcgtacaaattggattctatatccaacagaggagaggatatatgatccaatttaacctggcggcagcgcaaaagatg

SEQ ID NO: 78109 - DNA, 103 bp, Artificial Sequence
  Synthetic Polynucleotide
taatacgactcactatagggaaaaattggattcgtacaaattggattctaaacagaggagatagaatatgatttgtacgaacctggcggcagcgcaaaagatg

SEQ ID NO: 78110 - DNA, 103 bp, Artificial Sequence
  Synthetic Polynucleotide
taatacgactcactatagggatctgaaaaattggattcgtacaaattggaaacagaggagatccaatatgtacgaatccaacctggcggcagcgcaaaagatg

SEQ ID NO: 78111 - DNA, 103 bp, Artificial Sequence
  Synthetic Polynucleotide
taatacgactcactatagggcaaaaatctgaaaaattggattcgtacaaaaacagaggagatttgtaatgatccaatttaacctggcggcagcgcaaaagatg

SEQ ID NO: 78112 - DNA, 103 bp, Artificial Sequence
  Synthetic Polynucleotide
taatacgactcactatagggtcattcaaaaatctgaaaaattggattcgtaacagaggagaacgaatatgatttttcagaacctggcggcagcgcaaaagatg

SEQ ID NO: 78113 - DNA, 103 bp, Artificial Sequence
  Synthetic Polynucleotide
taatacgactcactatagggtttcatacgagaaaaataacgatatatgtcaacagaggagagacataatgcgttattttaacctggcggcagcgcaaaagatg

SEQ ID NO: 78114 - DNA, 103 bp, Artificial Sequence
  Synthetic Polynucleotide
taatacgactcactatagggttcattcattcaaaaatctgaaaaattggaaacagaggagatccaatatgtcagattttaacctggcggcagcgcaaaagatg

SEQ ID NO: 78115 - DNA, 103 bp, Artificial Sequence
  Synthetic Polynucleotide
taatacgactcactatagggctgtattcattcattcaaaaatctgaaaaaaacagaggagatttttcatgtttttgaataacctggcggcagcgcaaaagatg

SEQ ID NO: 78116 - DNA, 103 bp, Artificial Sequence
  Synthetic Polynucleotide
taatacgactcactatagggttgatctgtattcattcattcaaaaatctgaacagaggagacagattatggaatgaatgaacctggcggcagcgcaaaagatg

SEQ ID NO: 78117 - DNA, 103 bp, Artificial Sequence
  Synthetic Polynucleotide
taatacgactcactatagggattttttgatctgtattcattcattcaaaaaacagaggagattttgaatgaatgaatacaacctggcggcagcgcaaaagatg

SEQ ID NO: 78118 - DNA, 103 bp, Artificial Sequence
  Synthetic Polynucleotide
taatacgactcactatagggactatattttttgatctgtattcattcattaacagaggagaaatgaaatgatacagatcaacctggcggcagcgcaaaagatg

SEQ ID NO: 78119 - DNA, 103 bp, Artificial Sequence
  Synthetic Polynucleotide
taatacgactcactatagggatggaactatattttttgatctgtattcataacagaggagaatgaatatggatcaaaaaaacctggcggcagcgcaaaagatg

SEQ ID NO: 78120 - DNA, 103 bp, Artificial Sequence
  Synthetic Polynucleotide
taatacgactcactatagggcaataatggaactatattttttgatctgtaaacagaggagatacagaatgaaaaatataaacctggcggcagcgcaaaagatg

SEQ ID NO: 78121 - DNA, 103 bp, Artificial Sequence
  Synthetic Polynucleotide
taatacgactcactatagggaataacaataatggaactatattttttgataacagaggagaatcaaaatgtatagttccaacctggcggcagcgcaaaagatg

SEQ ID NO: 78122 - DNA, 103 bp, Artificial Sequence
  Synthetic Polynucleotide
taatacgactcactatagggacgttaataacaataatggaactatattttaacagaggagaaaaataatgttccattataacctggcggcagcgcaaaagatg

SEQ ID NO: 78123 - DNA, 103 bp, Artificial Sequence
  Synthetic Polynucleotide
taatacgactcactataggggtttcacgttaataacaataatggaactataacagaggagaatagttatgttattgttaaacctggcggcagcgcaaaagatg

SEQ ID NO: 78124 - DNA, 103 bp, Artificial Sequence
  Synthetic Polynucleotide
taatacgactcactatagggtgtgcaatcattggactttgtactcaattaaacagaggagataattgatgacaaagtccaacctggcggcagcgcaaaagatg

SEQ ID NO: 78125 - DNA, 103 bp, Artificial Sequence
  Synthetic Polynucleotide
taatacgactcactatagggtaatctttcatacgagaaaaataacgatataacagaggagaatatcgatgtttttctcgaacctggcggcagcgcaaaagatg

SEQ ID NO: 78126 - DNA, 103 bp, Artificial Sequence
  Synthetic Polynucleotide
taatacgactcactatagggactacgtttcacgttaataacaataatggaaacagaggagatccattatggttattaacaacctggcggcagcgcaaaagatg

SEQ ID NO: 78127 - DNA, 103 bp, Artificial Sequence
  Synthetic Polynucleotide
taatacgactcactatagggccaatactacgtttcacgttaataacaataaacagaggagatattgtatgtaacgtgaaaacctggcggcagcgcaaaagatg

SEQ ID NO: 78128 - DNA, 103 bp, Artificial Sequence
  Synthetic Polynucleotide
taatacgactcactatagggcatggccaatactacgtttcacgttaataaaacagaggagattattaatgtgaaacgtaaacctggcggcagcgcaaaagatg

SEQ ID NO: 78129 - DNA, 103 bp, Artificial Sequence
  Synthetic Polynucleotide
taatacgactcactatagggggtggcatggccaatactacgtttcacgttaacagaggagaaacgtgatgcgtagtattaacctggcggcagcgcaaaagatg

SEQ ID NO: 78130 - DNA, 103 bp, Artificial Sequence
  Synthetic Polynucleotide
taatacgactcactataggggggtaggtggcatggccaatactacgtttcaacagaggagagaaacgatgtattggccaaacctggcggcagcgcaaaagatg

SEQ ID NO: 78131 - DNA, 103 bp, Artificial Sequence
  Synthetic Polynucleotide
taatacgactcactatagggcaagggggtaggtggcatggccaatactacaacagaggagagtagtaatggccatgccaaacctggcggcagcgcaaaagatg

SEQ ID NO: 78132 - DNA, 103 bp, Artificial Sequence
  Synthetic Polynucleotide
taatacgactcactatagggagtcacaagggggtaggtggcatggccaataacagaggagaattggcatggccacctacaacctggcggcagcgcaaaagatg

SEQ ID NO: 78133 - DNA, 103 bp, Artificial Sequence
  Synthetic Polynucleotide
taatacgactcactatagggagtctagtcacaagggggtaggtggcatggaacagaggagaccatgcatgctaccccctaacctggcggcagcgcaaaagatg

SEQ ID NO: 78134 - DNA, 103 bp, Artificial Sequence
  Synthetic Polynucleotide
taatacgactcactatagggaaatcagtctagtcacaagggggtaggtggaacagaggagaccacctatgcccttgtgaaacctggcggcagcgcaaaagatg

SEQ ID NO: 78135 - DNA, 103 bp, Artificial Sequence
  Synthetic Polynucleotide
taatacgactcactataggggagagaaatcagtctagtcacaagggggtaaacagaggagataccccatggtgactagaaacctggcggcagcgcaaaagatg

SEQ ID NO: 78136 - DNA, 103 bp, Artificial Sequence
  Synthetic Polynucleotide
taatacgactcactatagggcaaattaatctttcatacgagaaaaataacaacagaggagagttattatgctcgtatgaaacctggcggcagcgcaaaagatg

SEQ ID NO: 78137 - DNA, 103 bp, Artificial Sequence
  Synthetic Polynucleotide
taatacgactcactatagggtttatgagagaaatcagtctagtcacaaggaacagaggagaccttgtatgtagactgataacctggcggcagcgcaaaagatg

SEQ ID NO: 78138 - DNA, 103 bp, Artificial Sequence
  Synthetic Polynucleotide
taatacgactcactatagggctgtatttatgagagaaatcagtctagtcaaacagaggagatgactaatgtgatttctcaacctggcggcagcgcaaaagatg

SEQ ID NO: 78139 - DNA, 103 bp, Artificial Sequence
  Synthetic Polynucleotide
taatacgactcactatagggcatctctgtatttatgagagaaatcagtctaacagaggagaagactgatgtctctcataaacctggcggcagcgcaaaagatg

SEQ ID NO: 78140 - DNA, 103 bp, Artificial Sequence
  Synthetic Polynucleotide
taatacgactcactatagggctgtacatctctgtatttatgagagaaatcaacagaggagagatttcatgcataaatacaacctggcggcagcgcaaaagatg

SEQ ID NO: 78141 - DNA, 103 bp, Artificial Sequence
  Synthetic Polynucleotide
taatacgactcactatagggggaagctgtacatctctgtatttatgagagaacagaggagactctcaatgatacagagaaacctggcggcagcgcaaaagatg

SEQ ID NO: 78142 - DNA, 103 bp, Artificial Sequence
  Synthetic Polynucleotide
taatacgactcactatagggaaaaaggaagctgtacatctctgtatttataacagaggagaataaatatggagatgtacaacctggcggcagcgcaaaagatg

SEQ ID NO: 78143 - DNA, 103 bp, Artificial Sequence
  Synthetic Polynucleotide
taatacgactcactatagggcagacaaaaaggaagctgtacatctctgtaaacagaggagatacagaatggtacagcttaacctggcggcagcgcaaaagatg

SEQ ID NO: 78144 - DNA, 103 bp, Artificial Sequence
  Synthetic Polynucleotide
taatacgactcactatagggatctccagacaaaaaggaagctgtacatctaacagaggagaagatgtatggcttcctttaacctggcggcagcgcaaaagatg

SEQ ID NO: 78145 - DNA, 103 bp, Artificial Sequence
  Synthetic Polynucleotide
taatacgactcactatagggtttagatctccagacaaaaaggaagctgtaaacagaggagatacagcatgctttttgtcaacctggcggcagcgcaaaagatg

SEQ ID NO: 78146 - DNA, 103 bp, Artificial Sequence
  Synthetic Polynucleotide
taatacgactcactatagggttatctttagatctccagacaaaaaggaagaacagaggagacttcctatgtgtctggagaacctggcggcagcgcaaaagatg

SEQ ID NO: 78147 - DNA, 103 bp, Artificial Sequence
  Synthetic Polynucleotide
taatacgactcactatagggagaatcaaattaatctttcatacgagaaaaaacagaggagattttctatgatgaaagataacctggcggcagcgcaaaagatg

SEQ ID NO: 78148 - DNA, 103 bp, Artificial Sequence
  Synthetic Polynucleotide
taatacgactcactataggggaagattatctttagatctccagacaaaaaaacagaggagatttttgatgggagatctaaacctggcggcagcgcaaaagatg

SEQ ID NO: 78149 - DNA, 103 bp, Artificial Sequence
  Synthetic Polynucleotide
taatacgactcactatagggggagagaagattatctttagatctccagacaacagaggagagtctggatgtctaaagataacctggcggcagcgcaaaagatg

SEQ ID NO: 78150 - DNA, 103 bp, Artificial Sequence
  Synthetic Polynucleotide
taatacgactcactatagggtaaccggagagaagattatctttagatctcaacagaggagagagatcatgagataatctaacctggcggcagcgcaaaagatg

SEQ ID NO: 78151 - DNA, 103 bp, Artificial Sequence
  Synthetic Polynucleotide
taatacgactcactatagggattattaaccggagagaagattatctttagaacagaggagactaaagatgatcttctctaacctggcggcagcgcaaaagatg

SEQ ID NO: 78152 - DNA, 103 bp, Artificial Sequence
  Synthetic Polynucleotide
taatacgactcactatagggctagaattattaaccggagagaagattatcaacagaggagagataatatgctctccggtaacctggcggcagcgcaaaagatg

SEQ ID NO: 78153 - DNA, 103 bp, Artificial Sequence
  Synthetic Polynucleotide
taatacgactcactatagggatcgtctagaattattaaccggagagaagaaacagaggagatcttctatgcggttaataaacctggcggcagcgcaaaagatg

SEQ ID NO: 78154 - DNA, 103 bp, Artificial Sequence
  Synthetic Polynucleotide
taatacgactcactatagggtactaatcgtctagaattattaaccggagaaacagaggagatctccgatgaataattctaacctggcggcagcgcaaaagatg

SEQ ID NO: 78155 - DNA, 103 bp, Artificial Sequence
  Synthetic Polynucleotide
taatacgactcactatagggtatattactaatcgtctagaattattaaccaacagaggagaggttaaatgttctagacgaacctggcggcagcgcaaaagatg

SEQ ID NO: 78156 - DNA, 103 bp, Artificial Sequence
  Synthetic Polynucleotide
taatacgactcactatagggtgagatatattactaatcgtctagaattataacagaggagaataattatggacgattagaacctggcggcagcgcaaaagatg

SEQ ID NO: 78157 - DNA, 103 bp, Artificial Sequence
  Synthetic Polynucleotide
taatacgactcactatagggtgatctgagatatattactaatcgtctagaaacagaggagatctagaatgttagtaataaacctggcggcagcgcaaaagatg

SEQ ID NO: 78158 - DNA, 103 bp, Artificial Sequence
  Synthetic Polynucleotide
taatacgactcactatagggatattagaatcaaattaatctttcatacgaaacagaggagatcgtatatgagattaattaacctggcggcagcgcaaaagatg

SEQ ID NO: 78159 - DNA, 103 bp, Artificial Sequence
  Synthetic Polynucleotide
taatacgactcactatagggaactttgatctgagatatattactaatcgtaacagaggagaacgattatgaatatatctaacctggcggcagcgcaaaagatg

SEQ ID NO: 78160 - DNA, 103 bp, Artificial Sequence
  Synthetic Polynucleotide
taatacgactcactataggggacataactttgatctgagatatattactaaacagaggagatagtaaatgatctcagataacctggcggcagcgcaaaagatg

SEQ ID NO: 78161 - DNA, 103 bp, Artificial Sequence
  Synthetic Polynucleotide
taatacgactcactatagggtaacggacataactttgatctgagatatataacagaggagaatatatatgagatcaaagaacctggcggcagcgcaaaagatg

SEQ ID NO: 78162 - DNA, 103 bp, Artificial Sequence
  Synthetic Polynucleotide
taatacgactcactatagggacctttaacggacataactttgatctgagaaacagaggagatctcagatgaaagttatgaacctggcggcagcgcaaaagatg

SEQ ID NO: 78163 - DNA, 103 bp, Artificial Sequence
  Synthetic Polynucleotide
taatacgactcactatagggttgttacctttaacggacataactttgatcaacagaggagagatcaaatgtatgtccgtaacctggcggcagcgcaaaagatg

SEQ ID NO: 78164 - DNA, 103 bp, Artificial Sequence
  Synthetic Polynucleotide
taatacgactcactatagggctatattgttacctttaacggacataacttaacagaggagaaagttaatgccgttaaagaacctggcggcagcgcaaaagatg

SEQ ID NO: 78165 - DNA, 103 bp, Artificial Sequence
  Synthetic Polynucleotide
taatacgactcactatagggttcgactatattgttacctttaacggacataacagaggagaatgtccatgaaaggtaacaacctggcggcagcgcaaaagatg

SEQ ID NO: 78166 - DNA, 103 bp, Artificial Sequence
  Synthetic Polynucleotide
taatacgactcactatagggtaacgttcgactatattgttacctttaacgaacagaggagacgttaaatgtaacaatataacctggcggcagcgcaaaagatg

SEQ ID NO: 78167 - DNA, 103 bp, Artificial Sequence
  Synthetic Polynucleotide
taatacgactcactatagggggaactaacgttcgactatattgttaccttaacagaggagaaaggtaatgatatagtcgaacctggcggcagcgcaaaagatg

SEQ ID NO: 78168 - DNA, 103 bp, Artificial Sequence
  Synthetic Polynucleotide
taatacgactcactatagggttgttggaactaacgttcgactatattgttaacagaggagaaacaatatggtcgaacgtaacctggcggcagcgcaaaagatg

SEQ ID NO: 78169 - DNA, 103 bp, Artificial Sequence
  Synthetic Polynucleotide
taatacgactcactatagggagattatattagaatcaaattaatctttcaaacagaggagatgaaagatgaatttgattaacctggcggcagcgcaaaagatg

SEQ ID NO: 78170 - DNA, 103 bp, Artificial Sequence
  Synthetic Polynucleotide
taatacgactcactatagggaacaattgttggaactaacgttcgactataaacagaggagatatagtatgacgttagttaacctggcggcagcgcaaaagatg

SEQ ID NO: 78171 - DNA, 103 bp, Artificial Sequence
  Synthetic Polynucleotide
taatacgactcactatagggagctaaacaattgttggaactaacgttcgaaacagaggagatcgaacatgagttccaacaacctggcggcagcgcaaaagatg

SEQ ID NO: 78172 - DNA, 103 bp, Artificial Sequence
  Synthetic Polynucleotide
taatacgactcactatagggcaaatagctaaacaattgttggaactaacgaacagaggagacgttagatgcaacaattgaacctggcggcagcgcaaaagatg

SEQ ID NO: 78173 - DNA, 103 bp, Artificial Sequence
  Synthetic Polynucleotide
taatacgactcactatagggtgctacaaatagctaaacaattgttggaacaacagaggagagttccaatgattgtttagaacctggcggcagcgcaaaagatg

SEQ ID NO: 78174 - DNA, 103 bp, Artificial Sequence
  Synthetic Polynucleotide
taatacgactcactatagggagttttgctacaaatagctaaacaattgttaacagaggagaaacaatatgttagctattaacctggcggcagcgcaaaagatg

SEQ ID NO: 78175 - DNA, 103 bp, Artificial Sequence
  Synthetic Polynucleotide
taatacgactcactataggggaaatagttttgctacaaatagctaaacaaaacagaggagattgtttatgtatttgtagaacctggcggcagcgcaaaagatg

SEQ ID NO: 78176 - DNA, 103 bp, Artificial Sequence
  Synthetic Polynucleotide
taatacgactcactataggggttctgaaatagttttgctacaaatagctaaacagaggagatagctaatggtagcaaaaaacctggcggcagcgcaaaagatg

SEQ ID NO: 78177 - DNA, 103 bp, Artificial Sequence
  Synthetic Polynucleotide
taatacgactcactatagggtctgtgttctgaaatagttttgctacaaataacagaggagaatttgtatgaaaactattaacctggcggcagcgcaaaagatg

SEQ ID NO: 78178 - DNA, 103 bp, Artificial Sequence
  Synthetic Polynucleotide
taatacgactcactatagggctagttctgtgttctgaaatagttttgctaaacagaggagatagcaaatgtatttcagaaacctggcggcagcgcaaaagatg

SEQ ID NO: 78179 - DNA, 103 bp, Artificial Sequence
  Synthetic Polynucleotide
taatacgactcactataggggagaactagttctgtgttctgaaatagtttaacagaggagaaaactaatgcagaacacaaacctggcggcagcgcaaaagatg

SEQ ID NO: 78180 - DNA, 103 bp, Artificial Sequence
  Synthetic Polynucleotide
taatacgactcactatagggactaaagattatattagaatcaaattaatcaacagaggagagattaaatggattctaataacctggcggcagcgcaaaagatg

SEQ ID NO: 78181 - DNA, 103 bp, Artificial Sequence
  Synthetic Polynucleotide
taatacgactcactatagggtgagagagaactagttctgtgttctgaaataacagaggagaatttcaatgcacagaactaacctggcggcagcgcaaaagatg

SEQ ID NO: 78182 - DNA, 103 bp, Artificial Sequence
  Synthetic Polynucleotide
taatacgactcactataggggattatgagagagaactagttctgtgttctaacagaggagaagaacaatgaactagttcaacctggcggcagcgcaaaagatg

SEQ ID NO: 78183 - DNA, 103 bp, Artificial Sequence
  Synthetic Polynucleotide
taatacgactcactatagggaaatggattatgagagagaactagttctgtaacagaggagaacagaaatggttctctctaacctggcggcagcgcaaaagatg

SEQ ID NO: 78184 - DNA, 103 bp, Artificial Sequence
  Synthetic Polynucleotide
taatacgactcactataggggatggaaatggattatgagagagaactagtaacagaggagaactagtatgctctcataaaacctggcggcagcgcaaaagatg

SEQ ID NO: 78185 - DNA, 103 bp, Artificial Sequence
  Synthetic Polynucleotide
taatacgactcactatagggtcactgatggaaatggattatgagagagaaaacagaggagattctctatgataatccataacctggcggcagcgcaaaagatg

SEQ ID NO: 78186 - DNA, 103 bp, Artificial Sequence
  Synthetic Polynucleotide
taatacgactcactatagggtacagtcactgatggaaatggattatgagaaacagaggagatctcatatgccatttccaaacctggcggcagcgcaaaagatg

SEQ ID NO: 78187 - DNA, 103 bp, Artificial Sequence
  Synthetic Polynucleotide
taatacgactcactataggggaggatacagtcactgatggaaatggattaaacagaggagataatccatgtccatcagtaacctggcggcagcgcaaaagatg

SEQ ID NO: 78188 - DNA, 103 bp, Artificial Sequence
  Synthetic Polynucleotide
taatacgactcactatagggtgtttgaggatacagtcactgatggaaatgaacagaggagacatttcatgcagtgactgaacctggcggcagcgcaaaagatg

SEQ ID NO: 78189 - DNA, 103 bp, Artificial Sequence
  Synthetic Polynucleotide
taatacgactcactataggggaggatgtttgaggatacagtcactgatggaacagaggagaccatcaatgactgtatccaacctggcggcagcgcaaaagatg

SEQ ID NO: 78190 - DNA, 103 bp, Artificial Sequence
  Synthetic Polynucleotide
taatacgactcactatagggcgatagaggatgtttgaggatacagtcactaacagaggagaagtgacatgatcctcaaaaacctggcggcagcgcaaaagatg

SEQ ID NO: 78191 - DNA, 103 bp, Artificial Sequence
  Synthetic Polynucleotide
taatacgactcactatagggctaatactaaagattatattagaatcaaataacagaggagaatttgaatgtaatataataacctggcggcagcgcaaaagatg

SEQ ID NO: 78192 - DNA, 103 bp, Artificial Sequence
  Synthetic Polynucleotide
taatacgactcactataggggccgtcgatagaggatgtttgaggatacagaacagaggagactgtatatgcaaacatccaacctggcggcagcgcaaaagatg

SEQ ID NO: 78193 - DNA, 103 bp, Artificial Sequence
  Synthetic Polynucleotide
taatacgactcactatagggaagaagccgtcgatagaggatgtttgaggaaacagaggagatcctcaatgatcctctataacctggcggcagcgcaaaagatg

SEQ ID NO: 78194 - DNA, 103 bp, Artificial Sequence
  Synthetic Polynucleotide
taatacgactcactatagggaatacaagaagccgtcgatagaggatgtttaacagaggagaaaacatatgctatcgacgaacctggcggcagcgcaaaagatg

SEQ ID NO: 78195 - DNA, 103 bp, Artificial Sequence
  Synthetic Polynucleotide
taatacgactcactatagggcaggaaatacaagaagccgtcgatagaggaaacagaggagatcctctatggacggcttcaacctggcggcagcgcaaaagatg

SEQ ID NO: 78196 - DNA, 103 bp, Artificial Sequence
  Synthetic Polynucleotide
taatacgactcactatagggcggaacaggaaatacaagaagccgtcgataaacagaggagatatcgaatgcttcttgtaaacctggcggcagcgcaaaagatg

SEQ ID NO: 78197 - DNA, 103 bp, Artificial Sequence
  Synthetic Polynucleotide
taatacgactcactataggggttaacggaacaggaaatacaagaagccgtaacagaggagaacggctatgtgtatttccaacctggcggcagcgcaaaagatg

SEQ ID NO: 78198 - DNA, 103 bp, Artificial Sequence
  Synthetic Polynucleotide
taatacgactcactataggggagatgttaacggaacaggaaatacaagaaaacagaggagattcttgatgttcctgttcaacctggcggcagcgcaaaagatg

SEQ ID NO: 78199 - DNA, 103 bp, Artificial Sequence
  Synthetic Polynucleotide
taatacgactcactatagggatgaagagatgttaacggaacaggaaatacaacagaggagagtatttatggttccgttaaacctggcggcagcgcaaaagatg

SEQ ID NO: 78200 - DNA, 103 bp, Artificial Sequence
  Synthetic Polynucleotide
taatacgactcactatagggtattaatgaagagatgttaacggaacaggaaacagaggagatcctgtatggttaacatcaacctggcggcagcgcaaaagatg

SEQ ID NO: 78201 - DNA, 103 bp, Artificial Sequence
  Synthetic Polynucleotide
taatacgactcactatagggacgcttattaatgaagagatgttaacggaaaacagaggagattccgtatgcatctcttcaacctggcggcagcgcaaaagatg

SEQ ID NO: 78202 - DNA, 103 bp, Artificial Sequence
  Synthetic Polynucleotide
taatacgactcactatagggttcatctaatactaaagattatattagaataacagaggagaattctaatgtaatctttaaacctggcggcagcgcaaaagatg

SEQ ID NO: 78203 - DNA, 103 bp, Artificial Sequence
  Synthetic Polynucleotide
taatacgactcactatagggtgtttacgcttattaatgaagagatgttaaaacagaggagattaacaatgcttcattaaaacctggcggcagcgcaaaagatg

SEQ ID NO: 78204 - DNA, 103 bp, Artificial Sequence
  Synthetic Polynucleotide
taatacgactcactatagggattattgtttacgcttattaatgaagagataacagaggagaatctctatgttaataagcaacctggcggcagcgcaaaagatg

SEQ ID NO: 78205 - DNA, 103 bp, Artificial Sequence
  Synthetic Polynucleotide
taatacgactcactatagggaaacgattattgtttacgcttattaatgaaaacagaggagattcattatgaagcgtaaaaacctggcggcagcgcaaaagatg

SEQ ID NO: 78206 - DNA, 103 bp, Artificial Sequence
  Synthetic Polynucleotide
taatacgactcactataggggtggtaaacgattattgtttacgcttattaaacagaggagataataaatgtaaacaataaacctggcggcagcgcaaaagatg

SEQ ID NO: 78207 - DNA, 103 bp, Artificial Sequence
  Synthetic Polynucleotide
taatacgactcactatagggtttaagtggtaaacgattattgtttacgctaacagaggagaagcgtaatgaataatcgtaacctggcggcagcgcaaaagatg

SEQ ID NO: 78208 - DNA, 103 bp, Artificial Sequence
  Synthetic Polynucleotide
taatacgactcactatagggatcgatttaagtggtaaacgattattgtttaacagaggagaaaacaaatgtcgtttaccaacctggcggcagcgcaaaagatg

SEQ ID NO: 78209 - DNA, 103 bp, Artificial Sequence
  Synthetic Polynucleotide
taatacgactcactataggggttatatcgatttaagtggtaaacgattataacagaggagaataatcatgtaccacttaaacctggcggcagcgcaaaagatg

SEQ ID NO: 78210 - DNA, 103 bp, Artificial Sequence
  Synthetic Polynucleotide
taatacgactcactatagggttactgttatatcgatttaagtggtaaacgaacagaggagacgtttaatgcttaaatcgaacctggcggcagcgcaaaagatg

SEQ ID NO: 78211 - DNA, 103 bp, Artificial Sequence
  Synthetic Polynucleotide
taatacgactcactatagggacaagttactgttatatcgatttaagtggtaacagaggagaaccactatgatcgatataaacctggcggcagcgcaaaagatg

SEQ ID NO: 78212 - DNA, 103 bp, Artificial Sequence
  Synthetic Polynucleotide
taatacgactcactatagggctcatacaagttactgttatatcgatttaaaacagaggagattaaatatgtataacagtaacctggcggcagcgcaaaagatg

SEQ ID NO: 78213 - DNA, 103 bp, Artificial Sequence
  Synthetic Polynucleotide
taatacgactcactatagggtaaagttcatctaatactaaagattatattaacagaggagaaatataatgtttagtattaacctggcggcagcgcaaaagatg

SEQ ID NO: 78214 - DNA, 103 bp, Artificial Sequence
  Synthetic Polynucleotide
taatacgactcactatagggaatctctcatacaagttactgttatatcgaaacagaggagatcgataatgcagtaacttaacctggcggcagcgcaaaagatg

SEQ ID NO: 78215 - DNA, 103 bp, Artificial Sequence
  Synthetic Polynucleotide
taatacgactcactatagggaacccaatctctcatacaagttactgttataacagaggagaataacaatgacttgtatgaacctggcggcagcgcaaaagatg

SEQ ID NO: 78216 - DNA, 103 bp, Artificial Sequence
  Synthetic Polynucleotide
taatacgactcactatagggttattaacccaatctctcatacaagttactaacagaggagaagtaacatgtatgagagaaacctggcggcagcgcaaaagatg

SEQ ID NO: 78217 - DNA, 103 bp, Artificial Sequence
  Synthetic Polynucleotide
taatacgactcactatagggtgtatttattaacccaatctctcatacaagaacagaggagacttgtaatggagattgggaacctggcggcagcgcaaaagatg

SEQ ID NO: 78218 - DNA, 103 bp, Artificial Sequence
  Synthetic Polynucleotide
taatacgactcactatagggccttctgtatttattaacccaatctctcataacagaggagaatgagaatgtgggttaataacctggcggcagcgcaaaagatg

SEQ ID NO: 78219 - DNA, 103 bp, Artificial Sequence
  Synthetic Polynucleotide
taatacgactcactatagggagtttccttctgtatttattaacccaatctaacagaggagaagattgatgtaataaataaacctggcggcagcgcaaaagatg

SEQ ID NO: 78220 - DNA, 103 bp, Artificial Sequence
  Synthetic Polynucleotide
taatacgactcactatagggtaagaagtttccttctgtatttattaacccaacagaggagagggttaatgaatacagaaaacctggcggcagcgcaaaagatg

SEQ ID NO: 78221 - DNA, 103 bp, Artificial Sequence
  Synthetic Polynucleotide
taatacgactcactatagggttcgataagaagtttccttctgtatttattaacagaggagaaataaaatgagaaggaaaaacctggcggcagcgcaaaagatg

SEQ ID NO: 78222 - DNA, 103 bp, Artificial Sequence
  Synthetic Polynucleotide
taatacgactcactataggggtcacttcgataagaagtttccttctgtataacagaggagaatacagatggaaacttctaacctggcggcagcgcaaaagatg

SEQ ID NO: 78223 - DNA, 103 bp, Artificial Sequence
  Synthetic Polynucleotide
taatacgactcactatagggagagtgtcacttcgataagaagtttccttcaacagaggagagaaggaatgttcttatcgaacctggcggcagcgcaaaagatg

SEQ ID NO: 78224 - DNA, 103 bp, Artificial Sequence
  Synthetic Polynucleotide
taatacgactcactatagggtgaattaaagttcatctaatactaaagattaacagaggagaaatcttatgtattagatgaacctggcggcagcgcaaaagatg

SEQ ID NO: 78225 - DNA, 103 bp, Artificial Sequence
  Synthetic Polynucleotide
taatacgactcactataggggatatagagtgtcacttcgataagaagtttaacagaggagaaaacttatgatcgaagtgaacctggcggcagcgcaaaagatg

SEQ ID NO: 78226 - DNA, 103 bp, Artificial Sequence
  Synthetic Polynucleotide
taatacgactcactatagggttctagatatagagtgtcacttcgataagaaacagaggagatcttatatgagtgacactaacctggcggcagcgcaaaagatg

SEQ ID NO: 78227 - DNA, 103 bp, Artificial Sequence
  Synthetic Polynucleotide
taatacgactcactatagggcttatttctagatatagagtgtcacttcgaaacagaggagatcgaagatgcactctataaacctggcggcagcgcaaaagatg

SEQ ID NO: 78228 - DNA, 103 bp, Artificial Sequence
  Synthetic Polynucleotide
taatacgactcactatagggtcgtacttatttctagatatagagtgtcacaacagaggagagtgacaatgtatatctagaacctggcggcagcgcaaaagatg

SEQ ID NO: 78229 - DNA, 103 bp, Artificial Sequence
  Synthetic Polynucleotide
taatacgactcactatagggcaagatcgtacttatttctagatatagagtaacagaggagaactctaatgctagaaataaacctggcggcagcgcaaaagatg

SEQ ID NO: 78230 - DNA, 103 bp, Artificial Sequence
  Synthetic Polynucleotide
taatacgactcactatagggtatcccaagatcgtacttatttctagatataacagaggagaatatctatgaataagtacaacctggcggcagcgcaaaagatg

SEQ ID NO: 78231 - DNA, 103 bp, Artificial Sequence
  Synthetic Polynucleotide
taatacgactcactatagggttcgatatcccaagatcgtacttatttctaaacagaggagatagaaaatggtacgatctaacctggcggcagcgcaaaagatg

SEQ ID NO: 78232 - DNA, 103 bp, Artificial Sequence
  Synthetic Polynucleotide
taatacgactcactatagggctagattcgatatcccaagatcgtacttataacagaggagaataagtatgatcttgggaaacctggcggcagcgcaaaagatg

SEQ ID NO: 78233 - DNA, 103 bp, Artificial Sequence
  Synthetic Polynucleotide
taatacgactcactatagggaatacctagattcgatatcccaagatcgtaaacagaggagatacgatatggggatatcgaacctggcggcagcgcaaaagatg

SEQ ID NO: 78234 - DNA, 103 bp, Artificial Sequence
  Synthetic Polynucleotide
taatacgactcactatagggaaagaaatacctagattcgatatcccaagaaacagaggagatcttggatgatcgaatctaacctggcggcagcgcaaaagatg

SEQ ID NO: 78235 - DNA, 103 bp, Artificial Sequence
  Synthetic Polynucleotide
taatacgactcactatagggaactttgtgcaatcattggactttgtactcaacagaggagagagtacatggtccaatgaaacctggcggcagcgcaaaagatg

SEQ ID NO: 78236 - DNA, 103 bp, Artificial Sequence
  Synthetic Polynucleotide
taatacgactcactatagggaaatttgaattaaagttcatctaatactaaaacagaggagattagtaatggatgaacttaacctggcggcagcgcaaaagatg

SEQ ID NO: 78237 - DNA, 103 bp, Artificial Sequence
  Synthetic Polynucleotide
taatacgactcactatagggtcgctaaagaaatacctagattcgatatccaacagaggagaggatatatgatctaggtaaacctggcggcagcgcaaaagatg

SEQ ID NO: 78238 - DNA, 103 bp, Artificial Sequence
  Synthetic Polynucleotide
taatacgactcactatagggctgtttcgctaaagaaatacctagattcgaaacagaggagatcgaatatgggtatttctaacctggcggcagcgcaaaagatg

SEQ ID NO: 78239 - DNA, 103 bp, Artificial Sequence
  Synthetic Polynucleotide
taatacgactcactatagggcgtaactgtttcgctaaagaaatacctagaaacagaggagatctaggatgttctttagcaacctggcggcagcgcaaaagatg

SEQ ID NO: 78240 - DNA, 103 bp, Artificial Sequence
  Synthetic Polynucleotide
taatacgactcactatagggatccacgtaactgtttcgctaaagaaatacaacagaggagagtatttatgtagcgaaacaacctggcggcagcgcaaaagatg

SEQ ID NO: 78241 - DNA, 103 bp, Artificial Sequence
  Synthetic Polynucleotide
taatacgactcactatagggtggcgatccacgtaactgtttcgctaaagaaacagaggagatctttaatgaaacagttaaacctggcggcagcgcaaaagatg

SEQ ID NO: 78242 - DNA, 103 bp, Artificial Sequence
  Synthetic Polynucleotide
taatacgactcactatagggcattgtggcgatccacgtaactgtttcgctaacagaggagaagcgaaatggttacgtggaacctggcggcagcgcaaaagatg

SEQ ID NO: 78243 - DNA, 103 bp, Artificial Sequence
  Synthetic Polynucleotide
taatacgactcactataggggttatcattgtggcgatccacgtaactgttaacagaggagaaacagtatggtggatcgcaacctggcggcagcgcaaaagatg

SEQ ID NO: 78244 - DNA, 103 bp, Artificial Sequence
  Synthetic Polynucleotide
taatacgactcactatagggtggatgttatcattgtggcgatccacgtaaaacagaggagattacgtatgtcgccacaaaacctggcggcagcgcaaaagatg

SEQ ID NO: 78245 - DNA, 103 bp, Artificial Sequence
  Synthetic Polynucleotide
taatacgactcactatagggaacaatggatgttatcattgtggcgatccaaacagaggagatggatcatgacaatgataaacctggcggcagcgcaaaagatg

SEQ ID NO: 78246 - DNA, 103 bp, Artificial Sequence
  Synthetic Polynucleotide
taatacgactcactatagggagattaacaatggatgttatcattgtggcgaacagaggagacgccacatggataacatcaacctggcggcagcgcaaaagatg

SEQ ID NO: 78247 - DNA, 103 bp, Artificial Sequence
  Synthetic Polynucleotide
taatacgactcactatagggaatggaaatttgaattaaagttcatctaataacagaggagaattagaatgactttaattaacctggcggcagcgcaaaagatg

SEQ ID NO: 78248 - DNA, 103 bp, Artificial Sequence
  Synthetic Polynucleotide
taatacgactcactatagggaacaaagattaacaatggatgttatcattgaacagaggagacaatgaatgcatccattgaacctggcggcagcgcaaaagatg

SEQ ID NO: 78249 - DNA, 103 bp, Artificial Sequence
  Synthetic Polynucleotide
taatacgactcactatagggtatttaacaaagattaacaatggatgttataacagaggagaataacaatgattgttaataacctggcggcagcgcaaaagatg

SEQ ID NO: 78250 - DNA, 103 bp, Artificial Sequence
  Synthetic Polynucleotide
taatacgactcactatagggatcaatatttaacaaagattaacaatggataacagaggagaatccatatgtaatctttgaacctggcggcagcgcaaaagatg

SEQ ID NO: 78251 - DNA, 103 bp, Artificial Sequence
  Synthetic Polynucleotide
taatacgactcactatagggggacgatcaatatttaacaaagattaacaaaacagaggagattgttaatgtttgttaaaaacctggcggcagcgcaaaagatg

SEQ ID NO: 78252 - DNA, 103 bp, Artificial Sequence
  Synthetic Polynucleotide
taatacgactcactatagggtcgttggacgatcaatatttaacaaagattaacagaggagaaatcttatgtaaatattgaacctggcggcagcgcaaaagatg

SEQ ID NO: 78253 - DNA, 103 bp, Artificial Sequence
  Synthetic Polynucleotide
taatacgactcactataggggttattcgttggacgatcaatatttaacaaaacagaggagattgttaatgattgatcgtaacctggcggcagcgcaaaagatg

SEQ ID NO: 78254 - DNA, 103 bp, Artificial Sequence
  Synthetic Polynucleotide
taatacgactcactatagggcggatgttattcgttggacgatcaatatttaacagaggagaaaatatatgtcgtccaacaacctggcggcagcgcaaaagatg

SEQ ID NO: 78255 - DNA, 103 bp, Artificial Sequence
  Synthetic Polynucleotide
taatacgactcactatagggccagacggatgttattcgttggacgatcaaaacagaggagattgatcatgcaacgaataaacctggcggcagcgcaaaagatg

SEQ ID NO: 78256 - DNA, 103 bp, Artificial Sequence
  Synthetic Polynucleotide
taatacgactcactatagggtatctccagacggatgttattcgttggacgaacagaggagacgtccaatgaataacatcaacctggcggcagcgcaaaagatg

SEQ ID NO: 78257 - DNA, 103 bp, Artificial Sequence
  Synthetic Polynucleotide
taatacgactcactatagggcgggatatctccagacggatgttattcgttaacagaggagaaacgaaatgcatccgtctaacctggcggcagcgcaaaagatg

SEQ ID NO: 78258 - DNA, 103 bp, Artificial Sequence
  Synthetic Polynucleotide
taatacgactcactatagggaatctaatggaaatttgaattaaagttcataacagaggagaatgaacatgaattcaaataacctggcggcagcgcaaaagatg

SEQ ID NO: 78259 - DNA, 103 bp, Artificial Sequence
  Synthetic Polynucleotide
taatacgactcactatagggtctaacgggatatctccagacggatgttataacagaggagaataacaatggtctggagaaacctggcggcagcgcaaaagatg

SEQ ID NO: 78260 - DNA, 103 bp, Artificial Sequence
  Synthetic Polynucleotide
taatacgactcactatagggatatttctaacgggatatctccagacggataacagaggagaatccgtatggagatatccaacctggcggcagcgcaaaagatg

SEQ ID NO: 78261 - DNA, 103 bp, Artificial Sequence
  Synthetic Polynucleotide
taatacgactcactataggggttttatatttctaacgggatatctccagaaacagaggagatctggaatgatcccgttaaacctggcggcagcgcaaaagatg

SEQ ID NO: 78262 - DNA, 103 bp, Artificial Sequence
  Synthetic Polynucleotide
taatacgactcactatagggagttggttttatatttctaacgggatatctaacagaggagaagatatatggttagaaataacctggcggcagcgcaaaagatg

SEQ ID NO: 78263 - DNA, 103 bp, Artificial Sequence
  Synthetic Polynucleotide
taatacgactcactatagggatattagttggttttatatttctaacgggaaacagaggagatcccgtatgaaatataaaaacctggcggcagcgcaaaagatg

SEQ ID NO: 78264 - DNA, 103 bp, Artificial Sequence
  Synthetic Polynucleotide
taatacgactcactatagggtctcaatattagttggttttatatttctaaaacagaggagattagaaatgtaaaaccaaaacctggcggcagcgcaaaagatg

SEQ ID NO: 78265 - DNA, 103 bp, Artificial Sequence
  Synthetic Polynucleotide
taatacgactcactataggggaatttctcaatattagttggttttatattaacagaggagaaatataatgccaactaataacctggcggcagcgcaaaagatg

SEQ ID NO: 78266 - DNA, 103 bp, Artificial Sequence
  Synthetic Polynucleotide
taatacgactcactatagggtggatgaatttctcaatattagttggttttaacagaggagaaaaaccatgtaatattgaaacctggcggcagcgcaaaagatg

SEQ ID NO: 78267 - DNA, 103 bp, Artificial Sequence
  Synthetic Polynucleotide
taatacgactcactatagggcactatggatgaatttctcaatattagttgaacagaggagacaactaatgttgagaaataacctggcggcagcgcaaaagatg

SEQ ID NO: 78268 - DNA, 103 bp, Artificial Sequence
  Synthetic Polynucleotide
taatacgactcactatagggaacgccactatggatgaatttctcaatattaacagaggagaaatattatgaaattcatcaacctggcggcagcgcaaaagatg

SEQ ID NO: 78269 - DNA, 103 bp, Artificial Sequence
  Synthetic Polynucleotide
taatacgactcactataggggatataatctaatggaaatttgaattaaagaacagaggagactttaaatgaaatttccaaacctggcggcagcgcaaaagatg

SEQ ID NO: 78270 - DNA, 103 bp, Artificial Sequence
  Synthetic Polynucleotide
taatacgactcactatagggtacaaaacgccactatggatgaatttctcaaacagaggagatgagaaatgcatccatagaacctggcggcagcgcaaaagatg

SEQ ID NO: 78271 - DNA, 103 bp, Artificial Sequence
  Synthetic Polynucleotide
taatacgactcactatagggcaacatacaaaacgccactatggatgaattaacagaggagaaattcaatgatagtggcgaacctggcggcagcgcaaaagatg

SEQ ID NO: 78272 - DNA, 103 bp, Artificial Sequence
  Synthetic Polynucleotide
taatacgactcactatagggaaacgcaacatacaaaacgccactatggataacagaggagaatccatatgggcgttttgaacctggcggcagcgcaaaagatg

SEQ ID NO: 78273 - DNA, 103 bp, Artificial Sequence
  Synthetic Polynucleotide
taatacgactcactatagggcaaagaaacgcaacatacaaaacgccactaaacagaggagatagtggatgtttgtatgtaacctggcggcagcgcaaaagatg

SEQ ID NO: 78274 - DNA, 103 bp, Artificial Sequence
  Synthetic Polynucleotide
taatacgactcactatagggagagccaaagaaacgcaacatacaaaacgcaacagaggagagcgtttatgatgttgcgtaacctggcggcagcgcaaaagatg

SEQ ID NO: 78275 - DNA, 103 bp, Artificial Sequence
  Synthetic Polynucleotide
taatacgactcactatagggatagaagagccaaagaaacgcaacatacaaaacagaggagattgtatatggcgtttcttaacctggcggcagcgcaaaagatg

SEQ ID NO: 78276 - DNA, 103 bp, Artificial Sequence
  Synthetic Polynucleotide
taatacgactcactatagggggttaatagaagagccaaagaaacgcaacaaacagaggagatgttgcatgtctttggctaacctggcggcagcgcaaaagatg

SEQ ID NO: 78277 - DNA, 103 bp, Artificial Sequence
  Synthetic Polynucleotide
taatacgactcactatagggtatgtggttaatagaagagccaaagaaacgaacagaggagacgtttcatgggctcttctaacctggcggcagcgcaaaagatg

SEQ ID NO: 78278 - DNA, 103 bp, Artificial Sequence
  Synthetic Polynucleotide
taatacgactcactataggggcagatatgtggttaatagaagagccaaagaacagaggagactttggatgttctattaaaacctggcggcagcgcaaaagatg

SEQ ID NO: 78279 - DNA, 103 bp, Artificial Sequence
  Synthetic Polynucleotide
taatacgactcactatagggccgtcgcagatatgtggttaatagaagagcaacagaggagagctcttatgttaaccacaaacctggcggcagcgcaaaagatg

SEQ ID NO: 78280 - DNA, 103 bp, Artificial Sequence
  Synthetic Polynucleotide
taatacgactcactatagggtttatgatataatctaatggaaatttgaataacagaggagaattcaaatgtccattagaaacctggcggcagcgcaaaagatg

SEQ ID NO: 78281 - DNA, 103 bp, Artificial Sequence
  Synthetic Polynucleotide
taatacgactcactatagggatgctccgtcgcagatatgtggttaatagaaacagaggagatctattatgcacatatctaacctggcggcagcgcaaaagatg

SEQ ID NO: 78282 - DNA, 103 bp, Artificial Sequence
  Synthetic Polynucleotide
taatacgactcactatagggagaaaatgctccgtcgcagatatgtggttaaacagaggagataaccaatgatctgcgacaacctggcggcagcgcaaaagatg

SEQ ID NO: 78283 - DNA, 103 bp, Artificial Sequence
  Synthetic Polynucleotide
taatacgactcactatagggaagatagaaaatgctccgtcgcagatatgtaacagaggagaacatatatgcgacggagcaacctggcggcagcgcaaaagatg

SEQ ID NO: 78284 - DNA, 103 bp, Artificial Sequence
  Synthetic Polynucleotide
taatacgactcactatagggtattaaagatagaaaatgctccgtcgcagaaacagaggagatctgcgatggagcattttaacctggcggcagcgcaaaagatg

SEQ ID NO: 78285 - DNA, 103 bp, Artificial Sequence
  Synthetic Polynucleotide
taatacgactcactatagggctagatattaaagatagaaaatgctccgtcaacagaggagagacggaatgttttctatcaacctggcggcagcgcaaaagatg

SEQ ID NO: 78286 - DNA, 103 bp, Artificial Sequence
  Synthetic Polynucleotide
taatacgactcactatagggataatctagatattaaagatagaaaatgctaacagaggagaagcattatgtatctttaaaacctggcggcagcgcaaaagatg

SEQ ID NO: 78287 - DNA, 103 bp, Artificial Sequence
  Synthetic Polynucleotide
taatacgactcactatagggaagttataatctagatattaaagatagaaaaacagaggagatttctaatgttaatatctaacctggcggcagcgcaaaagatg

SEQ ID NO: 78288 - DNA, 103 bp, Artificial Sequence
  Synthetic Polynucleotide
taatacgactcactatagggacaataagttataatctagatattaaagataacagaggagaatctttatgatctagattaacctggcggcagcgcaaaagatg

SEQ ID NO: 78289 - DNA, 103 bp, Artificial Sequence
  Synthetic Polynucleotide
taatacgactcactatagggacgagacaataagttataatctagatattaaacagaggagataatatatggattataacaacctggcggcagcgcaaaagatg

SEQ ID NO: 78290 - DNA, 103 bp, Artificial Sequence
  Synthetic Polynucleotide
taatacgactcactatagggcattgacgagacaataagttataatctagaaacagaggagatctagaatgtaacttattaacctggcggcagcgcaaaagatg

SEQ ID NO: 78291 - DNA, 103 bp, Artificial Sequence
  Synthetic Polynucleotide
taatacgactcactatagggttttatttatgatataatctaatggaaattaacagaggagaaatttcatgtagattataaacctggcggcagcgcaaaagatg

SEQ ID NO: 78292 - DNA, 103 bp, Artificial Sequence
  Synthetic Polynucleotide
taatacgactcactatagggatagacattgacgagacaataagttataataacagaggagaattataatgtattgtctcaacctggcggcagcgcaaaagatg

SEQ ID NO: 78293 - DNA, 103 bp, Artificial Sequence
  Synthetic Polynucleotide
taatacgactcactataggggaactatagacattgacgagacaataagttaacagaggagaaacttaatgtctcgtcaaaacctggcggcagcgcaaaagatg

SEQ ID NO: 78294 - DNA, 103 bp, Artificial Sequence
  Synthetic Polynucleotide
taatacgactcactataggggatgagaactatagacattgacgagacaataacagaggagaattgtcatgtcaatgtctaacctggcggcagcgcaaaagatg

SEQ ID NO: 78295 - DNA, 103 bp, Artificial Sequence
  Synthetic Polynucleotide
taatacgactcactatagggggaaagatgagaactatagacattgacgagaacagaggagactcgtcatggtctatagtaacctggcggcagcgcaaaagatg

SEQ ID NO: 78296 - DNA, 103 bp, Artificial Sequence
  Synthetic Polynucleotide
taatacgactcactatagggcaatgggaaagatgagaactatagacattgaacagaggagacaatgtatgtagttctcaaacctggcggcagcgcaaaagatg

SEQ ID NO: 78297 - DNA, 103 bp, Artificial Sequence
  Synthetic Polynucleotide
taatacgactcactataggggaggccaatgggaaagatgagaactatagaaacagaggagatctataatgctcatctttaacctggcggcagcgcaaaagatg

SEQ ID NO: 78298 - DNA, 103 bp, Artificial Sequence
  Synthetic Polynucleotide
taatacgactcactatagggaatgcgaggccaatgggaaagatgagaactaacagaggagaagttctatgctttcccataacctggcggcagcgcaaaagatg

SEQ ID NO: 78299 - DNA, 103 bp, Artificial Sequence
  Synthetic Polynucleotide
taatacgactcactatagggcatttaatgcgaggccaatgggaaagatgaaacagaggagatcatctatgccattggccaacctggcggcagcgcaaaagatg

SEQ ID NO: 78300 - DNA, 103 bp, Artificial Sequence
  Synthetic Polynucleotide
taatacgactcactatagggtcctccatttaatgcgaggccaatgggaaaaacagaggagatttcccatgggcctcgcaaacctggcggcagcgcaaaagatg

SEQ ID NO: 78301 - DNA, 103 bp, Artificial Sequence
  Synthetic Polynucleotide
taatacgactcactataggggctcctcctccatttaatgcgaggccaatgaacagaggagacattggatgcgcattaaaaacctggcggcagcgcaaaagatg

SEQ ID NO: 78302 - DNA, 103 bp, Artificial Sequence
  Synthetic Polynucleotide
taatacgactcactatagggactatttttatttatgatataatctaatggaacagaggagaccattaatgtatatcataaacctggcggcagcgcaaaagatg

SEQ ID NO: 78303 - DNA, 103 bp, Artificial Sequence
  Synthetic Polynucleotide
taatacgactcactatagggcattggctcctcctccatttaatgcgaggcaacagaggagagcctcgatgtaaatggagaacctggcggcagcgcaaaagatg

SEQ ID NO: 78304 - DNA, 103 bp, Artificial Sequence
  Synthetic Polynucleotide
taatacgactcactatagggtcagtcattggctcctcctccatttaatgcaacagaggagagcattaatgggaggaggaaacctggcggcagcgcaaaagatg

SEQ ID NO: 78305 - DNA, 103 bp, Artificial Sequence
  Synthetic Polynucleotide
taatacgactcactatagggatatatcagtcattggctcctcctccatttaacagaggagaaaatggatgaggagccaaaacctggcggcagcgcaaaagatg

SEQ ID NO: 78306 - DNA, 103 bp, Artificial Sequence
  Synthetic Polynucleotide
taatacgactcactatagggacgaaatatatcagtcattggctcctcctcaacagaggagagaggagatgccaatgactaacctggcggcagcgcaaaagatg

SEQ ID NO: 78307 - DNA, 103 bp, Artificial Sequence
  Synthetic Polynucleotide
taatacgactcactataggggacagacgaaatatatcagtcattggctccaacagaggagaggagccatggactgatataacctggcggcagcgcaaaagatg

SEQ ID NO: 78308 - DNA, 103 bp, Artificial Sequence
  Synthetic Polynucleotide
taatacgactcactataggggtagtgacagacgaaatatatcagtcattgaacagaggagacaatgaatgatatatttcaacctggcggcagcgcaaaagatg

SEQ ID NO: 78309 - DNA, 103 bp, Artificial Sequence
  Synthetic Polynucleotide
taatacgactcactatagggattacgtagtgacagacgaaatatatcagtaacagaggagaactgatatgtttcgtctgaacctggcggcagcgcaaaagatg

SEQ ID NO: 78310 - DNA, 103 bp, Artificial Sequence
  Synthetic Polynucleotide
taatacgactcactatagggcttttattacgtagtgacagacgaaatataaacagaggagatatattatgtctgtcactaacctggcggcagcgcaaaagatg

SEQ ID NO: 78311 - DNA, 103 bp, Artificial Sequence
  Synthetic Polynucleotide
taatacgactcactatagggcattacttttattacgtagtgacagacgaaaacagaggagattcgtcatgcactacgtaaacctggcggcagcgcaaaagatg

SEQ ID NO: 78312 - DNA, 103 bp, Artificial Sequence
  Synthetic Polynucleotide
taatacgactcactatagggttcctcattacttttattacgtagtgacagaacagaggagactgtcaatgcgtaataaaaacctggcggcagcgcaaaagatg

SEQ ID NO: 78313 - DNA, 103 bp, Artificial Sequence
  Synthetic Polynucleotide
taatacgactcactataggggtgctactatttttatttatgatataatctaacagaggagaagattaatgcataaataaaacctggcggcagcgcaaaagatg

SEQ ID NO: 78314 - DNA, 103 bp, Artificial Sequence
  Synthetic Polynucleotide
taatacgactcactatagggacgatttcctcattacttttattacgtagtaacagaggagaactacgatgtaaaagtaaaacctggcggcagcgcaaaagatg

SEQ ID NO: 78315 - DNA, 103 bp, Artificial Sequence
  Synthetic Polynucleotide
taatacgactcactatagggtttatacgatttcctcattacttttattacaacagaggagagtaataatggtaatgaggaacctggcggcagcgcaaaagatg

SEQ ID NO: 78316 - DNA, 103 bp, Artificial Sequence
  Synthetic Polynucleotide
taatacgactcactatagggcagtatttatacgatttcctcattacttttaacagaggagaaaaagtatggaggaaatcaacctggcggcagcgcaaaagatg

SEQ ID NO: 78317 - DNA, 103 bp, Artificial Sequence
  Synthetic Polynucleotide
taatacgactcactatagggcgagacagtatttatacgatttcctcattaaacagaggagataatgaatgaatcgtataaacctggcggcagcgcaaaagatg

SEQ ID NO: 78318 - DNA, 103 bp, Artificial Sequence
  Synthetic Polynucleotide
taatacgactcactatagggaatggcgagacagtatttatacgatttcctaacagaggagaaggaaaatgtataaatacaacctggcggcagcgcaaaagatg

SEQ ID NO: 78319 - DNA, 103 bp, Artificial Sequence
  Synthetic Polynucleotide
taatacgactcactataggggtcgaaatggcgagacagtatttatacgataacagaggagaatcgtaatgatactgtctaacctggcggcagcgcaaaagatg

SEQ ID NO: 78320 - DNA, 103 bp, Artificial Sequence
  Synthetic Polynucleotide
taatacgactcactatagggcagatgtcgaaatggcgagacagtatttataacagaggagaataaatatggtctcgccaaacctggcggcagcgcaaaagatg

SEQ ID NO: 78321 - DNA, 103 bp, Artificial Sequence
  Synthetic Polynucleotide
taatacgactcactatagggaaatccagatgtcgaaatggcgagacagtaaacagaggagatactgtatggccatttcgaacctggcggcagcgcaaaagatg

SEQ ID NO: 78322 - DNA, 103 bp, Artificial Sequence
  Synthetic Polynucleotide
taatacgactcactatagggatctgaaatccagatgtcgaaatggcgagaaacagaggagatctcgcatgttcgacatcaacctggcggcagcgcaaaagatg

SEQ ID NO: 78323 - DNA, 103 bp, Artificial Sequence
  Synthetic Polynucleotide
taatacgactcactatagggtttatatctgaaatccagatgtcgaaatggaacagaggagaccatttatgcatctggataacctggcggcagcgcaaaagatg

SEQ ID NO: 78324 - DNA, 103 bp, Artificial Sequence
  Synthetic Polynucleotide
taatacgactcactatagggagcacgtgctactatttttatttatgatataacagaggagaatatcaatgataaaaataaacctggcggcagcgcaaaagatg

SEQ ID NO: 78325 - DNA, 103 bp, Artificial Sequence
  Synthetic Polynucleotide
taatacgactcactatagggagatttttatatctgaaatccagatgtcgaaacagaggagatcgacaatgggatttcagaacctggcggcagcgcaaaagatg

SEQ ID NO: 78326 - DNA, 103 bp, Artificial Sequence
  Synthetic Polynucleotide
taatacgactcactatagggaaaacagatttttatatctgaaatccagataacagaggagaatctggatgtcagatataaacctggcggcagcgcaaaagatg

SEQ ID NO: 78327 - DNA, 103 bp, Artificial Sequence
  Synthetic Polynucleotide
taatacgactcactatagggtggtgaaaacagatttttatatctgaaatcaacagaggagagatttcatgtataaaaataacctggcggcagcgcaaaagatg

SEQ ID NO: 78328 - DNA, 103 bp, Artificial Sequence
  Synthetic Polynucleotide
taatacgactcactatagggagtcatggtgaaaacagatttttatatctgaacagaggagacagataatgaaatctgttaacctggcggcagcgcaaaagatg

SEQ ID NO: 78329 - DNA, 103 bp, Artificial Sequence
  Synthetic Polynucleotide
taatacgactcactatagggtcgaaagtcatggtgaaaacagatttttataacagaggagaataaaaatgtgttttcacaacctggcggcagcgcaaaagatg

SEQ ID NO: 78330 - DNA, 103 bp, Artificial Sequence
  Synthetic Polynucleotide
taatacgactcactatagggttggttcgaaagtcatggtgaaaacagattaacagaggagaaatctgatgtcaccatgaaacctggcggcagcgcaaaagatg

SEQ ID NO: 78331 - DNA, 103 bp, Artificial Sequence
  Synthetic Polynucleotide
taatacgactcactatagggattaattggttcgaaagtcatggtgaaaacaacagaggagagttttcatgatgactttcaacctggcggcagcgcaaaagatg

SEQ ID NO: 78332 - DNA, 103 bp, Artificial Sequence
  Synthetic Polynucleotide
taatacgactcactatagggggtgtattaattggttcgaaagtcatggtgaacagaggagacaccatatgtttcgaaccaacctggcggcagcgcaaaagatg

SEQ ID NO: 78333 - DNA, 103 bp, Artificial Sequence
  Synthetic Polynucleotide
taatacgactcactatagggtgttcggtgtattaattggttcgaaagtcaaacagaggagatgacttatgaaccaattaaacctggcggcagcgcaaaagatg

SEQ ID NO: 78334 - DNA, 103 bp, Artificial Sequence
  Synthetic Polynucleotide
taatacgactcactatagggatggatgttcggtgtattaattggttcgaaaacagaggagattcgaaatgattaatacaaacctggcggcagcgcaaaagatg

SEQ ID NO: 78335 - DNA, 103 bp, Artificial Sequence
  Synthetic Polynucleotide
taatacgactcactatagggaaagtagcacgtgctactatttttatttataacagaggagaataaatatgaatagtagcaacctggcggcagcgcaaaagatg

SEQ ID NO: 78336 - DNA, 103 bp, Artificial Sequence
  Synthetic Polynucleotide
taatacgactcactatagggtagaaatggatgttcggtgtattaattggtaacagaggagaaccaatatgtacaccgaaaacctggcggcagcgcaaaagatg

SEQ ID NO: 78337 - DNA, 103 bp, Artificial Sequence
  Synthetic Polynucleotide
taatacgactcactatagggaattctagaaatggatgttcggtgtattaaaacagaggagattaataatgcgaacatccaacctggcggcagcgcaaaagatg

SEQ ID NO: 78338 - DNA, 103 bp, Artificial Sequence
  Synthetic Polynucleotide
taatacgactcactatagggttctaaattctagaaatggatgttcggtgtaacagaggagaacaccgatgatccatttcaacctggcggcagcgcaaaagatg

SEQ ID NO: 78339 - DNA, 103 bp, Artificial Sequence
  Synthetic Polynucleotide
taatacgactcactatagggtatatttctaaattctagaaatggatgttcaacagaggagagaacatatgtttctagaaaacctggcggcagcgcaaaagatg

SEQ ID NO: 78340 - DNA, 103 bp, Artificial Sequence
  Synthetic Polynucleotide
taatacgactcactataggggaaaatatatttctaaattctagaaatggaaacagaggagatccattatgagaatttagaacctggcggcagcgcaaaagatg

SEQ ID NO: 78341 - DNA, 103 bp, Artificial Sequence
  Synthetic Polynucleotide
taatacgactcactatagggtaaatgaaaatatatttctaaattctagaaaacagaggagattctagatgttagaaataaacctggcggcagcgcaaaagatg

SEQ ID NO: 78342 - DNA, 103 bp, Artificial Sequence
  Synthetic Polynucleotide
taatacgactcactatagggtcatttaaatgaaaatatatttctaaattcaacagaggagagaatttatgaatatatttaacctggcggcagcgcaaaagatg

SEQ ID NO: 78343 - DNA, 103 bp, Artificial Sequence
  Synthetic Polynucleotide
taatacgactcactataggggggattcatttaaatgaaaatatatttctaaacagaggagatagaaaatgattttcattaacctggcggcagcgcaaaagatg

SEQ ID NO: 78344 - DNA, 103 bp, Artificial Sequence
  Synthetic Polynucleotide
taatacgactcactatagggtgtttgggattcatttaaatgaaaatatataacagaggagaatatatatgcatttaaataacctggcggcagcgcaaaagatg

SEQ ID NO: 78345 - DNA, 103 bp, Artificial Sequence
  Synthetic Polynucleotide
taatacgactcactatagggcccaatgtttgggattcatttaaatgaaaaaacagaggagattttcaatgaaatgaatcaacctggcggcagcgcaaaagatg

SEQ ID NO: 78346 - DNA, 103 bp, Artificial Sequence
  Synthetic Polynucleotide
taatacgactcactatagggcaaagaactttgtgcaatcattggactttgaacagaggagacaaagtatgatgattgcaaacctggcggcagcgcaaaagatg

SEQ ID NO: 78347 - DNA, 103 bp, Artificial Sequence
  Synthetic Polynucleotide
taatacgactcactatagggtggctaaagtagcacgtgctactatttttaaacagaggagataaaaaatgtagcacgtgaacctggcggcagcgcaaaagatg

SEQ ID NO: 78348 - DNA, 103 bp, Artificial Sequence
  Synthetic Polynucleotide
taatacgactcactatagggtcttccccaatgtttgggattcatttaaataacagaggagaatttaaatgaatcccaaaaacctggcggcagcgcaaaagatg

SEQ ID NO: 78349 - DNA, 103 bp, Artificial Sequence
  Synthetic Polynucleotide
taatacgactcactataggggcggctcttccccaatgtttgggattcattaacagaggagaaatgaaatgcaaacattgaacctggcggcagcgcaaaagatg

SEQ ID NO: 78350 - DNA, 103 bp, Artificial Sequence
  Synthetic Polynucleotide
taatacgactcactatagggtccaagcggctcttccccaatgtttgggataacagaggagaatcccaatgattggggaaaacctggcggcagcgcaaaagatg

SEQ ID NO: 78351 - DNA, 103 bp, Artificial Sequence
  Synthetic Polynucleotide
taatacgactcactatagggaatggtccaagcggctcttccccaatgtttaacagaggagaaaacatatgggaagagccaacctggcggcagcgcaaaagatg

SEQ ID NO: 78352 - DNA, 103 bp, Artificial Sequence
  Synthetic Polynucleotide
taatacgactcactatagggaaaataatggtccaagcggctcttccccaaaacagaggagattggggatgagccgcttgaacctggcggcagcgcaaaagatg

SEQ ID NO: 78353 - DNA, 103 bp, Artificial Sequence
  Synthetic Polynucleotide
taatacgactcactatagggctataaaaataatggtccaagcggctcttcaacagaggagagaagagatgcttggaccaaacctggcggcagcgcaaaagatg

SEQ ID NO: 78354 - DNA, 103 bp, Artificial Sequence
  Synthetic Polynucleotide
taatacgactcactatagggaagtactataaaaataatggtccaagcggcaacagaggagagccgctatgaccattattaacctggcggcagcgcaaaagatg

SEQ ID NO: 78355 - DNA, 103 bp, Artificial Sequence
  Synthetic Polynucleotide
taatacgactcactatagggtgtgaaagtactataaaaataatggtccaaaacagaggagattggacatgtatttttataacctggcggcagcgcaaaagatg

SEQ ID NO: 78356 - DNA, 103 bp, Artificial Sequence
  Synthetic Polynucleotide
taatacgactcactatagggccgcttgtgaaagtactataaaaataatggaacagaggagaccattaatgttatagtacaacctggcggcagcgcaaaagatg

SEQ ID NO: 78357 - DNA, 103 bp, Artificial Sequence
  Synthetic Polynucleotide
taatacgactcactatagggtaaacccgcttgtgaaagtactataaaaataacagaggagaatttttatggtactttcaaacctggcggcagcgcaaaagatg

SEQ ID NO: 78358 - DNA, 103 bp, Artificial Sequence
  Synthetic Polynucleotide
taatacgactcactatagggatatttggctaaagtagcacgtgctactataacagaggagaatagtaatgcgtgctactaacctggcggcagcgcaaaagatg

SEQ ID NO: 78359 - DNA, 103 bp, Artificial Sequence
  Synthetic Polynucleotide
taatacgactcactatagggccgtctaaacccgcttgtgaaagtactataaacagaggagatatagtatgttcacaagcaacctggcggcagcgcaaaagatg

SEQ ID NO: 78360 - DNA, 103 bp, Artificial Sequence
  Synthetic Polynucleotide
taatacgactcactatagggtgttgccgtctaaacccgcttgtgaaagtaaacagaggagatactttatgaagcgggttaacctggcggcagcgcaaaagatg

SEQ ID NO: 78361 - DNA, 103 bp, Artificial Sequence
  Synthetic Polynucleotide
taatacgactcactatagggttctatgttgccgtctaaacccgcttgtgaaacagaggagatcacaaatgggtttagacaacctggcggcagcgcaaaagatg

SEQ ID NO: 78362 - DNA, 103 bp, Artificial Sequence
  Synthetic Polynucleotide
taatacgactcactatagggcacgcttctatgttgccgtctaaacccgctaacagaggagaagcgggatgagacggcaaaacctggcggcagcgcaaaagatg

SEQ ID NO: 78363 - DNA, 103 bp, Artificial Sequence
  Synthetic Polynucleotide
taatacgactcactataggggtttacacgcttctatgttgccgtctaaacaacagaggagagtttagatggcaacatagaacctggcggcagcgcaaaagatg

SEQ ID NO: 78364 - DNA, 103 bp, Artificial Sequence
  Synthetic Polynucleotide
taatacgactcactatagggttttcgtttacacgcttctatgttgccgtcaacagaggagagacggcatgatagaagcgaacctggcggcagcgcaaaagatg

SEQ ID NO: 78365 - DNA, 103 bp, Artificial Sequence
  Synthetic Polynucleotide
taatacgactcactatagggtatagttttcgtttacacgcttctatgttgaacagaggagacaacatatgagcgtgtaaaacctggcggcagcgcaaaagatg

SEQ ID NO: 78366 - DNA, 103 bp, Artificial Sequence
  Synthetic Polynucleotide
taatacgactcactatagggtagtatatagttttcgtttacacgcttctaaacagaggagatagaagatggtaaacgaaaacctggcggcagcgcaaaagatg

SEQ ID NO: 78367 - DNA, 103 bp, Artificial Sequence
  Synthetic Polynucleotide
taatacgactcactataggggactatagtatatagttttcgtttacacgcaacagaggagagcgtgtatgcgaaaactaaacctggcggcagcgcaaaagatg

SEQ ID NO: 78368 - DNA, 103 bp, Artificial Sequence
  Synthetic Polynucleotide
taatacgactcactataggggtgctgactatagtatatagttttcgtttaaacagaggagataaacgatgactatatacaacctggcggcagcgcaaaagatg

SEQ ID NO: 78369 - DNA, 103 bp, Artificial Sequence
  Synthetic Polynucleotide
taatacgactcactatagggaaagaatatttggctaaagtagcacgtgctaacagaggagaagcacgatgtactttagcaacctggcggcagcgcaaaagatg

SEQ ID NO: 78370 - DNA, 103 bp, Artificial Sequence
  Synthetic Polynucleotide
taatacgactcactataggggaagagtgctgactatagtatatagttttcaacagaggagagaaaacatgatactatagaacctggcggcagcgcaaaagatg

SEQ ID NO: 78371 - DNA, 103 bp, Artificial Sequence
  Synthetic Polynucleotide
taatacgactcactatagggacatggaagagtgctgactatagtatatagaacagaggagactatatatgatagtcagcaacctggcggcagcgcaaaagatg

SEQ ID NO: 78372 - DNA, 103 bp, Artificial Sequence
  Synthetic Polynucleotide
taatacgactcactataggggcaggacatggaagagtgctgactatagtaaacagaggagatactatatgcagcactctaacctggcggcagcgcaaaagatg

SEQ ID NO: 78373 - DNA, 103 bp, Artificial Sequence
  Synthetic Polynucleotide
taatacgactcactatagggtgcaggcaggacatggaagagtgctgactaaacagaggagatagtcaatgctcttccataacctggcggcagcgcaaaagatg

SEQ ID NO: 78374 - DNA, 103 bp, Artificial Sequence
  Synthetic Polynucleotide
taatacgactcactatagggtcgtctgcaggcaggacatggaagagtgctaacagaggagaagcactatgccatgtcctaacctggcggcagcgcaaaagatg

SEQ ID NO: 78375 - DNA, 103 bp, Artificial Sequence
  Synthetic Polynucleotide
taatacgactcactataggggcgtgtcgtctgcaggcaggacatggaagaaacagaggagatcttccatgtcctgcctgaacctggcggcagcgcaaaagatg

SEQ ID NO: 78376 - DNA, 103 bp, Artificial Sequence
  Synthetic Polynucleotide
taatacgactcactatagggtagttgcgtgtcgtctgcaggcaggacatgaacagaggagacatgtcatgcctgcagacaacctggcggcagcgcaaaagatg

SEQ ID NO: 78377 - DNA, 103 bp, Artificial Sequence
  Synthetic Polynucleotide
taatacgactcactatagggagcgatagttgcgtgtcgtctgcaggcaggaacagaggagacctgccatgagacgacacaacctggcggcagcgcaaaagatg

SEQ ID NO: 78378 - DNA, 103 bp, Artificial Sequence
  Synthetic Polynucleotide
taatacgactcactatagggtctatagcgatagttgcgtgtcgtctgcagaacagaggagactgcagatgacacgcaacaacctggcggcagcgcaaaagatg

SEQ ID NO: 78379 - DNA, 103 bp, Artificial Sequence
  Synthetic Polynucleotide
taatacgactcactatagggtgtcctctatagcgatagttgcgtgtcgtcaacagaggagagacgacatgcaactatcgaacctggcggcagcgcaaaagatg

SEQ ID NO: 78380 - DNA, 103 bp, Artificial Sequence
  Synthetic Polynucleotide
taatacgactcactatagggtcaaaaaagaatatttggctaaagtagcacaacagaggagagtgctaatgtagccaaataacctggcggcagcgcaaaagatg

SEQ ID NO: 78381 - DNA, 103 bp, Artificial Sequence
  Synthetic Polynucleotide
taatacgactcactatagggattattgtcctctatagcgatagttgcgtgaacagaggagacacgcaatgatcgctataaacctggcggcagcgcaaaagatg

SEQ ID NO: 78382 - DNA, 103 bp, Artificial Sequence
  Synthetic Polynucleotide
taatacgactcactatagggataatattattgtcctctatagcgatagttaacagaggagaaactatatgtatagaggaaacctggcggcagcgcaaaagatg

SEQ ID NO: 78383 - DNA, 103 bp, Artificial Sequence
  Synthetic Polynucleotide
taatacgactcactatagggtagacataatattattgtcctctatagcgaaacagaggagatcgctaatgaggacaataaacctggcggcagcgcaaaagatg

SEQ ID NO: 78384 - DNA, 103 bp, Artificial Sequence
  Synthetic Polynucleotide
taatacgactcactatagggattgctagacataatattattgtcctctataacagaggagaatagagatgaataatattaacctggcggcagcgcaaaagatg

SEQ ID NO: 78385 - DNA, 103 bp, Artificial Sequence
  Synthetic Polynucleotide
taatacgactcactatagggagatcattgctagacataatattattgtccaacagaggagaggacaaatgtattatgtcaacctggcggcagcgcaaaagatg

SEQ ID NO: 78386 - DNA, 103 bp, Artificial Sequence
  Synthetic Polynucleotide
taatacgactcactatagggaatttagatcattgctagacataatattataacagaggagaataataatgtgtctagcaaacctggcggcagcgcaaaagatg

SEQ ID NO: 78387 - DNA, 103 bp, Artificial Sequence
  Synthetic Polynucleotide
taatacgactcactatagggaatataatttagatcattgctagacataataacagaggagaattatgatgagcaatgataacctggcggcagcgcaaaagatg

SEQ ID NO: 78388 - DNA, 103 bp, Artificial Sequence
  Synthetic Polynucleotide
taatacgactcactatagggtaataaatataatttagatcattgctagacaacagaggagagtctagatgtgatctaaaaacctggcggcagcgcaaaagatg

SEQ ID NO: 78389 - DNA, 103 bp, Artificial Sequence
  Synthetic Polynucleotide
taatacgactcactatagggaaaaataataaatataatttagatcattgcaacagaggagagcaatgatgtaaattataaacctggcggcagcgcaaaagatg

SEQ ID NO: 78390 - DNA, 103 bp, Artificial Sequence
  Synthetic Polynucleotide
taatacgactcactataggggatgaaaaaataataaatataatttagatcaacagaggagagatctaatgtatatttataacctggcggcagcgcaaaagatg

SEQ ID NO: 78391 - DNA, 103 bp, Artificial Sequence
  Synthetic Polynucleotide
taatacgactcactataggggcgtttcaaaaaagaatatttggctaaagtaacagaggagaactttaatgaaatattctaacctggcggcagcgcaaaagatg

SEQ ID NO: 78392 - DNA, 103 bp, Artificial Sequence
  Synthetic Polynucleotide
taatacgactcactatagggaatctgatgaaaaaataataaatataatttaacagaggagaaaattaatgttattatttaacctggcggcagcgcaaaagatg

SEQ ID NO: 78393 - DNA, 103 bp, Artificial Sequence
  Synthetic Polynucleotide
taatacgactcactatagggtaaataatctgatgaaaaaataataaatataacagaggagaatatttatgattttttcaaacctggcggcagcgcaaaagatg

SEQ ID NO: 78394 - DNA, 103 bp, Artificial Sequence
  Synthetic Polynucleotide
taatacgactcactatagggattgttaaataatctgatgaaaaaataataaacagaggagatattatatgttcatcagaaacctggcggcagcgcaaaagatg

SEQ ID NO: 78395 - DNA, 103 bp, Artificial Sequence
  Synthetic Polynucleotide
taatacgactcactataggggccaaattgttaaataatctgatgaaaaaaaacagaggagattttttatgcagattattaacctggcggcagcgcaaaagatg

SEQ ID NO: 78396 - DNA, 103 bp, Artificial Sequence
  Synthetic Polynucleotide
taatacgactcactatagggcagatgccaaattgttaaataatctgatgaaacagaggagatcatcaatgtatttaacaaacctggcggcagcgcaaaagatg

SEQ ID NO: 78397 - DNA, 103 bp, Artificial Sequence
  Synthetic Polynucleotide
taatacgactcactataggggggatcagatgccaaattgttaaataatctaacagaggagaagattaatgaacaatttgaacctggcggcagcgcaaaagatg

SEQ ID NO: 78398 - DNA, 103 bp, Artificial Sequence
  Synthetic Polynucleotide
taatacgactcactatagggtatttgggatcagatgccaaattgttaaataacagaggagaatttaaatgtttggcatcaacctggcggcagcgcaaaagatg

SEQ ID NO: 78399 - DNA, 103 bp, Artificial Sequence
  Synthetic Polynucleotide
taatacgactcactatagggttgcgtatttgggatcagatgccaaattgtaacagaggagaacaattatgcatctgatcaacctggcggcagcgcaaaagatg

SEQ ID NO: 78400 - DNA, 103 bp, Artificial Sequence
  Synthetic Polynucleotide
taatacgactcactatagggatcgattgcgtatttgggatcagatgccaaaacagaggagattggcaatggatcccaaaaacctggcggcagcgcaaaagatg

SEQ ID NO: 78401 - DNA, 103 bp, Artificial Sequence
  Synthetic Polynucleotide
taatacgactcactataggggacacatcgattgcgtatttgggatcagataacagaggagaatctgaatgcaaatacgcaacctggcggcagcgcaaaagatg

SEQ ID NO: 78402 - DNA, 103 bp, Artificial Sequence
  Synthetic Polynucleotide
taatacgactcactatagggaaatggcgtttcaaaaaagaatatttggctaacagaggagaagccaaatgttcttttttaacctggcggcagcgcaaaagatg

SEQ ID NO: 78403 - DNA, 103 bp, Artificial Sequence
  Synthetic Polynucleotide
taatacgactcactatagggcctttgacacatcgattgcgtatttgggataacagaggagaatcccaatgacgcaatcgaacctggcggcagcgcaaaagatg

SEQ ID NO: 78404 - DNA, 103 bp, Artificial Sequence
  Synthetic Polynucleotide
taatacgactcactatagggtttaacctttgacacatcgattgcgtatttaacagaggagaaaatacatgatcgatgtgaacctggcggcagcgcaaaagatg

SEQ ID NO: 78405 - DNA, 103 bp, Artificial Sequence
  Synthetic Polynucleotide
taatacgactcactatagggaaaggtttaacctttgacacatcgattgcgaacagaggagacgcaatatgtgtgtcaaaaacctggcggcagcgcaaaagatg

SEQ ID NO: 78406 - DNA, 103 bp, Artificial Sequence
  Synthetic Polynucleotide
taatacgactcactatagggtttataaaggtttaacctttgacacatcgaaacagaggagatcgatgatgcaaaggttaaacctggcggcagcgcaaaagatg

SEQ ID NO: 78407 - DNA, 103 bp, Artificial Sequence
  Synthetic Polynucleotide
taatacgactcactatagggttaagtttataaaggtttaacctttgacacaacagaggagagtgtcaatggttaaacctaacctggcggcagcgcaaaagatg

SEQ ID NO: 78408 - DNA, 103 bp, Artificial Sequence
  Synthetic Polynucleotide
taatacgactcactatagggatgggttaagtttataaaggtttaacctttaacagaggagaaaaggtatgacctttataaacctggcggcagcgcaaaagatg

SEQ ID NO: 78409 - DNA, 103 bp, Artificial Sequence
  Synthetic Polynucleotide
taatacgactcactatagggttataatgggttaagtttataaaggtttaaaacagaggagattaaacatgtataaacttaacctggcggcagcgcaaaagatg

SEQ ID NO: 78410 - DNA, 103 bp, Artificial Sequence
  Synthetic Polynucleotide
taatacgactcactatagggaagttttataatgggttaagtttataaaggaacagaggagacctttaatgacttaacccaacctggcggcagcgcaaaagatg

SEQ ID NO: 78411 - DNA, 103 bp, Artificial Sequence
  Synthetic Polynucleotide
taatacgactcactatagggatcataagttttataatgggttaagtttataacagaggagaataaacatgacccattataacctggcggcagcgcaaaagatg

SEQ ID NO: 78412 - DNA, 103 bp, Artificial Sequence
  Synthetic Polynucleotide
taatacgactcactatagggaactaatcataagttttataatgggttaagaacagaggagacttaacatgttataaaacaacctggcggcagcgcaaaagatg

SEQ ID NO: 78413 - DNA, 103 bp, Artificial Sequence
  Synthetic Polynucleotide
taatacgactcactatagggacgctaaatggcgtttcaaaaaagaatattaacagaggagaaatattatgttttgaaacaacctggcggcagcgcaaaagatg

SEQ ID NO: 78414 - DNA, 103 bp, Artificial Sequence
  Synthetic Polynucleotide
taatacgactcactataggggtcgtaactaatcataagttttataatgggaacagaggagacccattatgaaacttatgaacctggcggcagcgcaaaagatg

SEQ ID NO: 78415 - DNA, 103 bp, Artificial Sequence
  Synthetic Polynucleotide
taatacgactcactatagggtttcagtcgtaactaatcataagttttataaacagaggagatataaaatgtatgattagaacctggcggcagcgcaaaagatg

SEQ ID NO: 78416 - DNA, 103 bp, Artificial Sequence
  Synthetic Polynucleotide
taatacgactcactatagggggttatttcagtcgtaactaatcataagttaacagaggagaaacttaatgttagttacgaacctggcggcagcgcaaaagatg

SEQ ID NO: 78417 - DNA, 103 bp, Artificial Sequence
  Synthetic Polynucleotide
taatacgactcactatagggcatgcggttatttcagtcgtaactaatcataacagaggagaatgattatgtacgactgaaacctggcggcagcgcaaaagatg

SEQ ID NO: 78418 - DNA, 103 bp, Artificial Sequence
  Synthetic Polynucleotide
taatacgactcactatagggataatcatgcggttatttcagtcgtaactaaacagaggagatagttaatgctgaaataaaacctggcggcagcgcaaaagatg

SEQ ID NO: 78419 - DNA, 103 bp, Artificial Sequence
  Synthetic Polynucleotide
taatacgactcactatagggaaaaaataatcatgcggttatttcagtcgtaacagaggagaacgactatgataaccgcaaacctggcggcagcgcaaaagatg

SEQ ID NO: 78420 - DNA, 103 bp, Artificial Sequence
  Synthetic Polynucleotide
taatacgactcactatagggataccaaaaaataatcatgcggttatttcaaacagaggagatgaaatatgcgcatgattaacctggcggcagcgcaaaagatg

SEQ ID NO: 78421 - DNA, 103 bp, Artificial Sequence
  Synthetic Polynucleotide
taatacgactcactataggggaattataccaaaaaataatcatgcggttaaacagaggagataaccgatggattattttaacctggcggcagcgcaaaagatg

SEQ ID NO: 78422 - DNA, 103 bp, Artificial Sequence
  Synthetic Polynucleotide
taatacgactcactataggggtgtagaattataccaaaaaataatcatgcaacagaggagagcatgaatgttttttggtaacctggcggcagcgcaaaagatg

SEQ ID NO: 78423 - DNA, 103 bp, Artificial Sequence
  Synthetic Polynucleotide
taatacgactcactatagggatgccgtgtagaattataccaaaaaataataacagaggagaattattatgtggtataataacctggcggcagcgcaaaagatg

SEQ ID NO: 78424 - DNA, 103 bp, Artificial Sequence
  Synthetic Polynucleotide
taatacgactcactatagggtcactacgctaaatggcgtttcaaaaaagaaacagaggagatcttttatgaaacgccataacctggcggcagcgcaaaagatg

SEQ ID NO: 78425 - DNA, 103 bp, Artificial Sequence
  Synthetic Polynucleotide
taatacgactcactatagggaaactatgccgtgtagaattataccaaaaaaacagaggagatttttgatgtaattctacaacctggcggcagcgcaaaagatg

SEQ ID NO: 78426 - DNA, 103 bp, Artificial Sequence
  Synthetic Polynucleotide
taatacgactcactatagggtacagaaactatgccgtgtagaattataccaacagaggagaggtataatgctacacggcaacctggcggcagcgcaaaagatg

SEQ ID NO: 78427 - DNA, 103 bp, Artificial Sequence
  Synthetic Polynucleotide
taatacgactcactatagggatagttacagaaactatgccgtgtagaattaacagaggagaaattctatgcggcatagtaacctggcggcagcgcaaaagatg

SEQ ID NO: 78428 - DNA, 103 bp, Artificial Sequence
  Synthetic Polynucleotide
taatacgactcactatagggaattcatagttacagaaactatgccgtgtaaacagaggagatacacgatgtagtttctgaacctggcggcagcgcaaaagatg

SEQ ID NO: 78429 - DNA, 103 bp, Artificial Sequence
  Synthetic Polynucleotide
taatacgactcactatagggggtagaattcatagttacagaaactatgccaacagaggagaggcataatgtctgtaactaacctggcggcagcgcaaaagatg

SEQ ID NO: 78430 - DNA, 103 bp, Artificial Sequence
  Synthetic Polynucleotide
taatacgactcactatagggacgggggtagaattcatagttacagaaactaacagaggagaagtttcatgaactatgaaaacctggcggcagcgcaaaagatg

SEQ ID NO: 78431 - DNA, 103 bp, Artificial Sequence
  Synthetic Polynucleotide
taatacgactcactatagggatgtaacgggggtagaattcatagttacagaacagaggagactgtaaatgtgaattctaaacctggcggcagcgcaaaagatg

SEQ ID NO: 78432 - DNA, 103 bp, Artificial Sequence
  Synthetic Polynucleotide
taatacgactcactatagggtacaaatgtaacgggggtagaattcatagtaacagaggagaactatgatgtctacccccaacctggcggcagcgcaaaagatg

SEQ ID NO: 78433 - DNA, 103 bp, Artificial Sequence
  Synthetic Polynucleotide
taatacgactcactataggggattatacaaatgtaacgggggtagaattcaacagaggagagaattcatgccccgttacaacctggcggcagcgcaaaagatg

SEQ ID NO: 78434 - DNA, 103 bp, Artificial Sequence
  Synthetic Polynucleotide
taatacgactcactatagggttaaagattatacaaatgtaacgggggtagaacagaggagactacccatgttacatttgaacctggcggcagcgcaaaagatg

SEQ ID NO: 78435 - DNA, 103 bp, Artificial Sequence
  Synthetic Polynucleotide
taatacgactcactatagggtgtcctcactacgctaaatggcgtttcaaaaacagaggagatttgaaatgccatttagcaacctggcggcagcgcaaaagatg

SEQ ID NO: 78436 - DNA, 103 bp, Artificial Sequence
  Synthetic Polynucleotide
taatacgactcactataggggtttgttaaagattatacaaatgtaacgggaacagaggagacccgttatgtttgtataaaacctggcggcagcgcaaaagatg

SEQ ID NO: 78437 - DNA, 103 bp, Artificial Sequence
  Synthetic Polynucleotide
taatacgactcactatagggttactgtttgttaaagattatacaaatgtaaacagaggagatacattatgataatctttaacctggcggcagcgcaaaagatg

SEQ ID NO: 78438 - DNA, 103 bp, Artificial Sequence
  Synthetic Polynucleotide
taatacgactcactatagggagcccttactgtttgttaaagattatacaaaacagaggagattgtatatgctttaacaaaacctggcggcagcgcaaaagatg

SEQ ID NO: 78439 - DNA, 103 bp, Artificial Sequence
  Synthetic Polynucleotide
taatacgactcactatagggtgacgagcccttactgtttgttaaagattaaacagaggagataatctatgacaaacagtaacctggcggcagcgcaaaagatg

SEQ ID NO: 78440 - DNA, 103 bp, Artificial Sequence
  Synthetic Polynucleotide
taatacgactcactataggggtatttgacgagcccttactgtttgttaaaaacagaggagatttaacatgcagtaagggaacctggcggcagcgcaaaagatg

SEQ ID NO: 78441 - DNA, 103 bp, Artificial Sequence
  Synthetic Polynucleotide
taatacgactcactatagggtttacgtatttgacgagcccttactgtttgaacagaggagacaaacaatgagggctcgtaacctggcggcagcgcaaaagatg

SEQ ID NO: 78442 - DNA, 103 bp, Artificial Sequence
  Synthetic Polynucleotide
taatacgactcactatagggtgagttttacgtatttgacgagcccttactaacagaggagaagtaagatgtcgtcaaataacctggcggcagcgcaaaagatg

SEQ ID NO: 78443 - DNA, 103 bp, Artificial Sequence
  Synthetic Polynucleotide
taatacgactcactatagggagtaatgagttttacgtatttgacgagcccaacagaggagagggctcatgaaatacgtaaacctggcggcagcgcaaaagatg

SEQ ID NO: 78444 - DNA, 103 bp, Artificial Sequence
  Synthetic Polynucleotide
taatacgactcactatagggtcgtaagtaatgagttttacgtatttgacgaacagaggagacgtcaaatgcgtaaaactaacctggcggcagcgcaaaagatg

SEQ ID NO: 78445 - DNA, 103 bp, Artificial Sequence
  Synthetic Polynucleotide
taatacgactcactatagggttctatcgtaagtaatgagttttacgtattaacagaggagaaatacgatgaactcattaaacctggcggcagcgcaaaagatg

SEQ ID NO: 78446 - DNA, 103 bp, Artificial Sequence
  Synthetic Polynucleotide
taatacgactcactatagggacttgtgtcctcactacgctaaatggcgttaacagaggagaaacgccatgtagcgtagtaacctggcggcagcgcaaaagatg

SEQ ID NO: 78447 - DNA, 103 bp, Artificial Sequence
  Synthetic Polynucleotide
taatacgactcactatagggtctatttctatcgtaagtaatgagttttacaacagaggagagtaaaaatgattacttacaacctggcggcagcgcaaaagatg

SEQ ID NO: 78448 - DNA, 103 bp, Artificial Sequence
  Synthetic Polynucleotide
taatacgactcactatagggagggatctatttctatcgtaagtaatgagtaacagaggagaactcatatgttacgatagaacctggcggcagcgcaaaagatg

SEQ ID NO: 78449 - DNA, 103 bp, Artificial Sequence
  Synthetic Polynucleotide
taatacgactcactatagggtgataagggatctatttctatcgtaagtaaaacagaggagattacttatgatagaaataaacctggcggcagcgcaaaagatg

SEQ ID NO: 78450 - DNA, 103 bp, Artificial Sequence
  Synthetic Polynucleotide
taatacgactcactatagggaagtgtgataagggatctatttctatcgtaaacagaggagatacgatatgaatagatccaacctggcggcagcgcaaaagatg

SEQ ID NO: 78451 - DNA, 103 bp, Artificial Sequence
  Synthetic Polynucleotide
taatacgactcactatagggattttaagtgtgataagggatctatttctaaacagaggagatagaaaatgatcccttataacctggcggcagcgcaaaagatg

SEQ ID NO: 78452 - DNA, 103 bp, Artificial Sequence
  Synthetic Polynucleotide
taatacgactcactatagggtttttattttaagtgtgataagggatctataacagaggagaatagatatgttatcacacaacctggcggcagcgcaaaagatg

SEQ ID NO: 78453 - DNA, 103 bp, Artificial Sequence
  Synthetic Polynucleotide
taatacgactcactataggggatattttttattttaagtgtgataagggaaacagaggagatcccttatgacacttaaaaacctggcggcagcgcaaaagatg

SEQ ID NO: 78454 - DNA, 103 bp, Artificial Sequence
  Synthetic Polynucleotide
taatacgactcactatagggataaggatattttttattttaagtgtgataaacagaggagatatcacatgtaaaataaaaacctggcggcagcgcaaaagatg

SEQ ID NO: 78455 - DNA, 103 bp, Artificial Sequence
  Synthetic Polynucleotide
taatacgactcactatagggaaaggataaggatattttttattttaagtgaacagaggagacacttaatgtaaaaaataaacctggcggcagcgcaaaagatg

SEQ ID NO: 78456 - DNA, 103 bp, Artificial Sequence
  Synthetic Polynucleotide
taatacgactcactataggggtggtaaaggataaggatattttttattttaacagaggagaaaaataatgaatatccttaacctggcggcagcgcaaaagatg

SEQ ID NO: 78457 - DNA, 103 bp, Artificial Sequence
  Synthetic Polynucleotide
taatacgactcactatagggaccgccaaagaactttgtgcaatcattggaaacagaggagatccaatatgtgcacaaagaacctggcggcagcgcaaaagatg

SEQ ID NO: 78458 - DNA, 103 bp, Artificial Sequence
  Synthetic Polynucleotide
taatacgactcactatagggggttcacttgtgtcctcactacgctaaatgaacagaggagacatttaatgtagtgaggaaacctggcggcagcgcaaaagatg

SEQ ID NO: 78459 - DNA, 103 bp, Artificial Sequence
  Synthetic Polynucleotide
taatacgactcactatagggatttggtggtaaaggataaggatattttttaacagaggagaaaaaaaatgccttatcctaacctggcggcagcgcaaaagatg

SEQ ID NO: 78460 - DNA, 103 bp, Artificial Sequence
  Synthetic Polynucleotide
taatacgactcactatagggattttatttggtggtaaaggataaggatataacagaggagaatatccatgtcctttaccaacctggcggcagcgcaaaagatg

SEQ ID NO: 78461 - DNA, 103 bp, Artificial Sequence
  Synthetic Polynucleotide
taatacgactcactatagggtcagaattttatttggtggtaaaggataagaacagaggagacttatcatgtaccaccaaaacctggcggcagcgcaaaagatg

SEQ ID NO: 78462 - DNA, 103 bp, Artificial Sequence
  Synthetic Polynucleotide
taatacgactcactatagggaccaatcagaattttatttggtggtaaaggaacagaggagacctttaatgccaaataaaaacctggcggcagcgcaaaagatg

SEQ ID NO: 78463 - DNA, 103 bp, Artificial Sequence
  Synthetic Polynucleotide
taatacgactcactatagggcattgaccaatcagaattttatttggtggtaacagaggagaaccaccatgtaaaattctaacctggcggcagcgcaaaagatg

SEQ ID NO: 78464 - DNA, 103 bp, Artificial Sequence
  Synthetic Polynucleotide
taatacgactcactatagggattcacattgaccaatcagaattttatttgaacagaggagacaaataatgttctgattgaacctggcggcagcgcaaaagatg

SEQ ID NO: 78465 - DNA, 103 bp, Artificial Sequence
  Synthetic Polynucleotide
taatacgactcactatagggaatacattcacattgaccaatcagaattttaacagaggagaaaaattatgattggtcaaaacctggcggcagcgcaaaagatg

SEQ ID NO: 78466 - DNA, 103 bp, Artificial Sequence
  Synthetic Polynucleotide
taatacgactcactatagggaagtgaatacattcacattgaccaatcagaaacagaggagatctgatatgtcaatgtgaaacctggcggcagcgcaaaagatg

SEQ ID NO: 78467 - DNA, 103 bp, Artificial Sequence
  Synthetic Polynucleotide
taatacgactcactatagggttgttaagtgaatacattcacattgaccaaaacagaggagattggtcatggtgaatgtaaacctggcggcagcgcaaaagatg

SEQ ID NO: 78468 - DNA, 103 bp, Artificial Sequence
  Synthetic Polynucleotide
taatacgactcactatagggtggaattgttaagtgaatacattcacattgaacagaggagacaatgtatgtgtattcacaacctggcggcagcgcaaaagatg

SEQ ID NO: 78469 - DNA, 103 bp, Artificial Sequence
  Synthetic Polynucleotide
taatacgactcactatagggttataggttcacttgtgtcctcactacgctaacagaggagaagcgtaatgaggacacaaaacctggcggcagcgcaaaagatg

SEQ ID NO: 78470 - DNA, 103 bp, Artificial Sequence
  Synthetic Polynucleotide
taatacgactcactatagggatttgtggaattgttaagtgaatacattcaaacagaggagatgaatgatgtcacttaacaacctggcggcagcgcaaaagatg

SEQ ID NO: 78471 - DNA, 103 bp, Artificial Sequence
  Synthetic Polynucleotide
taatacgactcactatagggaataaatttgtggaattgttaagtgaatacaacagaggagagtattcatgtaacaattcaacctggcggcagcgcaaaagatg

SEQ ID NO: 78472 - DNA, 103 bp, Artificial Sequence
  Synthetic Polynucleotide
taatacgactcactatagggtaataaataaatttgtggaattgttaagtgaacagaggagacacttaatgattccacaaaacctggcggcagcgcaaaagatg

SEQ ID NO: 78473 - DNA, 103 bp, Artificial Sequence
  Synthetic Polynucleotide
taatacgactcactatagggggagttaataaataaatttgtggaattgttaacagaggagaaacaatatgacaaatttaaacctggcggcagcgcaaaagatg

SEQ ID NO: 78474 - DNA, 103 bp, Artificial Sequence
  Synthetic Polynucleotide
taatacgactcactataggggcctcggagttaataaataaatttgtggaaaacagaggagattccacatgtttatttataacctggcggcagcgcaaaagatg

SEQ ID NO: 78475 - DNA, 103 bp, Artificial Sequence
  Synthetic Polynucleotide
taatacgactcactatagggtatgtgcctcggagttaataaataaatttgaacagaggagacaaattatgttattaactaacctggcggcagcgcaaaagatg

SEQ ID NO: 78476 - DNA, 103 bp, Artificial Sequence
  Synthetic Polynucleotide
taatacgactcactatagggcgatgtatgtgcctcggagttaataaataaaacagaggagattatttatgaactccgagaacctggcggcagcgcaaaagatg

SEQ ID NO: 78477 - DNA, 103 bp, Artificial Sequence
  Synthetic Polynucleotide
taatacgactcactatagggaccgacgatgtatgtgcctcggagttaataaacagaggagatattaaatgcgaggcacaaacctggcggcagcgcaaaagatg

SEQ ID NO: 78478 - DNA, 103 bp, Artificial Sequence
  Synthetic Polynucleotide
taatacgactcactatagggaaaataccgacgatgtatgtgcctcggagtaacagaggagaactccgatgcacatacataacctggcggcagcgcaaaagatg

SEQ ID NO: 78479 - DNA, 103 bp, Artificial Sequence
  Synthetic Polynucleotide
taatacgactcactatagggcataaaaaataccgacgatgtatgtgcctcaacagaggagagaggcaatgacatcgtcgaacctggcggcagcgcaaaagatg

SEQ ID NO: 78480 - DNA, 103 bp, Artificial Sequence
  Synthetic Polynucleotide
taatacgactcactataggggctcattataggttcacttgtgtcctcactaacagaggagaagtgagatgacaagtgaaaacctggcggcagcgcaaaagatg

SEQ ID NO: 78481 - DNA, 103 bp, Artificial Sequence
  Synthetic Polynucleotide
taatacgactcactatagggtttgtcataaaaaataccgacgatgtatgtaacagaggagaacatacatggtcggtattaacctggcggcagcgcaaaagatg

SEQ ID NO: 78482 - DNA, 103 bp, Artificial Sequence
  Synthetic Polynucleotide
taatacgactcactatagggtaaagtttgtcataaaaaataccgacgatgaacagaggagacatcgtatgtattttttaaacctggcggcagcgcaaaagatg

SEQ ID NO: 78483 - DNA, 103 bp, Artificial Sequence
  Synthetic Polynucleotide
taatacgactcactatagggaagagtaaagtttgtcataaaaaataccgaaacagaggagatcggtaatgtttatgacaaacctggcggcagcgcaaaagatg

SEQ ID NO: 78484 - DNA, 103 bp, Artificial Sequence
  Synthetic Polynucleotide
taatacgactcactataggggctggaagagtaaagtttgtcataaaaaataacagaggagaatttttatggacaaacttaacctggcggcagcgcaaaagatg

SEQ ID NO: 78485 - DNA, 103 bp, Artificial Sequence
  Synthetic Polynucleotide
taatacgactcactatagggcggatgctggaagagtaaagtttgtcataaaacagaggagattatgaatgactttactcaacctggcggcagcgcaaaagatg

SEQ ID NO: 78486 - DNA, 103 bp, Artificial Sequence
  Synthetic Polynucleotide
taatacgactcactatagggagaaacggatgctggaagagtaaagtttgtaacagaggagaacaaacatgactcttccaaacctggcggcagcgcaaaagatg

SEQ ID NO: 78487 - DNA, 103 bp, Artificial Sequence
  Synthetic Polynucleotide
taatacgactcactatagggtttttagaaacggatgctggaagagtaaagaacagaggagactttacatgtccagcatcaacctggcggcagcgcaaaagatg

SEQ ID NO: 78488 - DNA, 103 bp, Artificial Sequence
  Synthetic Polynucleotide
taatacgactcactatagggatatttttttagaaacggatgctggaagagaacagaggagactcttcatgcatccgtttaacctggcggcagcgcaaaagatg

SEQ ID NO: 78489 - DNA, 103 bp, Artificial Sequence
  Synthetic Polynucleotide
taatacgactcactatagggcgttaatatttttttagaaacggatgctggaacagaggagaccagcaatggtttctaaaaacctggcggcagcgcaaaagatg

SEQ ID NO: 78490 - DNA, 103 bp, Artificial Sequence
  Synthetic Polynucleotide
taatacgactcactataggggaactcgttaatatttttttagaaacggataacagaggagaatccgtatgtaaaaaaataacctggcggcagcgcaaaagatg

SEQ ID NO: 78491 - DNA, 103 bp, Artificial Sequence
  Synthetic Polynucleotide
taatacgactcactatagggaatttgctcattataggttcacttgtgtccaacagaggagaggacacatgtgaacctataacctggcggcagcgcaaaagatg

SEQ ID NO: 78492 - DNA, 103 bp, Artificial Sequence
  Synthetic Polynucleotide
taatacgactcactatagggaaatggaactcgttaatatttttttagaaaaacagaggagatttctaatgaaatattaaaacctggcggcagcgcaaaagatg

SEQ ID NO: 78493 - DNA, 103 bp, Artificial Sequence
  Synthetic Polynucleotide
taatacgactcactataggggatataaatggaactcgttaatatttttttaacagaggagaaaaaaaatgttaacgagtaacctggcggcagcgcaaaagatg

SEQ ID NO: 78494 - DNA, 103 bp, Artificial Sequence
  Synthetic Polynucleotide
taatacgactcactatagggtggatgatataaatggaactcgttaatattaacagaggagaaatattatggagttccataacctggcggcagcgcaaaagatg

SEQ ID NO: 78495 - DNA, 103 bp, Artificial Sequence
  Synthetic Polynucleotide
taatacgactcactatagggaatattggatgatataaatggaactcgttaaacagaggagataacgaatgccatttataaacctggcggcagcgcaaaagatg

SEQ ID NO: 78496 - DNA, 103 bp, Artificial Sequence
  Synthetic Polynucleotide
taatacgactcactatagggtcaataatattggatgatataaatggaactaacagaggagaagttccatgtatatcatcaacctggcggcagcgcaaaagatg

SEQ ID NO: 78497 - DNA, 103 bp, Artificial Sequence
  Synthetic Polynucleotide
taatacgactcactatagggtcatttcaataatattggatgatataaatgaacagaggagacatttaatgcatccaataaacctggcggcagcgcaaaagatg

SEQ ID NO: 78498 - DNA, 103 bp, Artificial Sequence
  Synthetic Polynucleotide
taatacgactcactatagggcaacgtcatttcaataatattggatgatataacagaggagaatatcaatgaatattattaacctggcggcagcgcaaaagatg

SEQ ID NO: 78499 - DNA, 103 bp, Artificial Sequence
  Synthetic Polynucleotide
taatacgactcactatagggtccatcaacgtcatttcaataatattggataacagaggagaatccaaatgtattgaaataacctggcggcagcgcaaaagatg

SEQ ID NO: 78500 - DNA, 103 bp, Artificial Sequence
  Synthetic Polynucleotide
taatacgactcactatagggatctgtccatcaacgtcatttcaataatataacagaggagaatattaatgaaatgacgtaacctggcggcagcgcaaaagatg

SEQ ID NO: 78501 - DNA, 103 bp, Artificial Sequence
  Synthetic Polynucleotide
taatacgactcactataggggcatcatctgtccatcaacgtcatttcaataacagaggagaattgaaatgacgttgatgaacctggcggcagcgcaaaagatg

SEQ ID NO: 78502 - DNA, 103 bp, Artificial Sequence
  Synthetic Polynucleotide
taatacgactcactatagggtaataaatttgctcattataggttcacttgaacagaggagacaagtgatgctataatgaaacctggcggcagcgcaaaagatg

SEQ ID NO: 78503 - DNA, 103 bp, Artificial Sequence
  Synthetic Polynucleotide
taatacgactcactatagggtatttgcatcatctgtccatcaacgtcattaacagaggagaaatgacatggatggacagaacctggcggcagcgcaaaagatg

SEQ ID NO: 78504 - DNA, 103 bp, Artificial Sequence
  Synthetic Polynucleotide
taatacgactcactatagggcttcttatttgcatcatctgtccatcaacgaacagaggagacgttgaatgacagatgataacctggcggcagcgcaaaagatg

SEQ ID NO: 78505 - DNA, 103 bp, Artificial Sequence
  Synthetic Polynucleotide
taatacgactcactatagggtgtaccttcttatttgcatcatctgtccataacagaggagaatggacatgtgatgcaaaaacctggcggcagcgcaaaagatg

SEQ ID NO: 78506 - DNA, 103 bp, Artificial Sequence
  Synthetic Polynucleotide
taatacgactcactatagggggtattgtaccttcttatttgcatcatctgaacagaggagacagatgatgcaaataagaaacctggcggcagcgcaaaagatg

SEQ ID NO: 78507 - DNA, 103 bp, Artificial Sequence
  Synthetic Polynucleotide
taatacgactcactatagggacaaaggtattgtaccttcttatttgcatcaacagaggagagatgcaatgaagaaggtaaacctggcggcagcgcaaaagatg

SEQ ID NO: 78508 - DNA, 103 bp, Artificial Sequence
  Synthetic Polynucleotide
taatacgactcactatagggggtagacaaaggtattgtaccttcttatttaacagaggagaaaataaatgggtacaataaacctggcggcagcgcaaaagatg

SEQ ID NO: 78509 - DNA, 103 bp, Artificial Sequence
  Synthetic Polynucleotide
taatacgactcactataggggagatggtagacaaaggtattgtaccttctaacagaggagaagaaggatgaatacctttaacctggcggcagcgcaaaagatg

SEQ ID NO: 78510 - DNA, 103 bp, Artificial Sequence
  Synthetic Polynucleotide
taatacgactcactatagggtggaggagatggtagacaaaggtattgtacaacagaggagagtacaaatgctttgtctaaacctggcggcagcgcaaaagatg

SEQ ID NO: 78511 - DNA, 103 bp, Artificial Sequence
  Synthetic Polynucleotide
taatacgactcactatagggtgaattggaggagatggtagacaaaggtataacagaggagaatacctatgtctaccatcaacctggcggcagcgcaaaagatg

SEQ ID NO: 78512 - DNA, 103 bp, Artificial Sequence
  Synthetic Polynucleotide
taatacgactcactataggggagcatgaattggaggagatggtagacaaaaacagaggagatttgtcatgcatctcctcaacctggcggcagcgcaaaagatg

SEQ ID NO: 78513 - DNA, 103 bp, Artificial Sequence
  Synthetic Polynucleotide
taatacgactcactataggggatactaataaatttgctcattataggttcaacagaggagagaacctatgatgagcaaaaacctggcggcagcgcaaaagatg

SEQ ID NO: 78514 - DNA, 103 bp, Artificial Sequence
  Synthetic Polynucleotide
taatacgactcactatagggaaatagagcatgaattggaggagatggtagaacagaggagactaccaatgcctccaattaacctggcggcagcgcaaaagatg

SEQ ID NO: 78515 - DNA, 103 bp, Artificial Sequence
  Synthetic Polynucleotide
taatacgactcactatagggtgacaaaatagagcatgaattggaggagataacagaggagaatctccatgaattcatgcaacctggcggcagcgcaaaagatg

SEQ ID NO: 78516 - DNA, 103 bp, Artificial Sequence
  Synthetic Polynucleotide
taatacgactcactataggggttaatgacaaaatagagcatgaattggagaacagaggagactccaaatgatgctctataacctggcggcagcgcaaaagatg

SEQ ID NO: 78517 - DNA, 103 bp, Artificial Sequence
  Synthetic Polynucleotide
taatacgactcactatagggttaaagttaatgacaaaatagagcatgaataacagaggagaattcatatgctattttgtaacctggcggcagcgcaaaagatg

SEQ ID NO: 78518 - DNA, 103 bp, Artificial Sequence
  Synthetic Polynucleotide
taatacgactcactatagggacacattaaagttaatgacaaaatagagcaaacagaggagatgctctatgttgtcattaaacctggcggcagcgcaaaagatg

SEQ ID NO: 78519 - DNA, 103 bp, Artificial Sequence
  Synthetic Polynucleotide
taatacgactcactatagggttttcacacattaaagttaatgacaaaataaacagaggagatattttatgattaactttaacctggcggcagcgcaaaagatg

SEQ ID NO: 78520 - DNA, 103 bp, Artificial Sequence
  Synthetic Polynucleotide
taatacgactcactatagggtactgttttcacacattaaagttaatgacaaacagaggagatgtcatatgctttaatgtaacctggcggcagcgcaaaagatg

SEQ ID NO: 78521 - DNA, 103 bp, Artificial Sequence
  Synthetic Polynucleotide
taatacgactcactatagggtggcgtactgttttcacacattaaagttaaaacagaggagattaactatgatgtgtgaaaacctggcggcagcgcaaaagatg

SEQ ID NO: 78522 - DNA, 103 bp, Artificial Sequence
  Synthetic Polynucleotide
taatacgactcactataggggcatgtggcgtactgttttcacacattaaaaacagaggagatttaatatgtgaaaacagaacctggcggcagcgcaaaagatg

SEQ ID NO: 78523 - DNA, 103 bp, Artificial Sequence
  Synthetic Polynucleotide
taatacgactcactatagggtggaagcatgtggcgtactgttttcacacaaacagaggagatgtgtgatgacagtacgcaacctggcggcagcgcaaaagatg

SEQ ID NO: 78524 - DNA, 103 bp, Artificial Sequence
  Synthetic Polynucleotide
taatacgactcactatagggtaaccgatactaataaatttgctcattataaacagaggagatataatatgcaaatttataacctggcggcagcgcaaaagatg

SEQ ID NO: 78525 - DNA, 103 bp, Artificial Sequence
  Synthetic Polynucleotide
taatacgactcactatagggtgttatggaagcatgtggcgtactgttttcaacagaggagagaaaacatgacgccacataacctggcggcagcgcaaaagatg

SEQ ID NO: 78526 - DNA, 103 bp, Artificial Sequence
  Synthetic Polynucleotide
taatacgactcactatagggcacactgttatggaagcatgtggcgtactgaacagaggagacagtacatgacatgcttcaacctggcggcagcgcaaaagatg

SEQ ID NO: 78527 - DNA, 103 bp, Artificial Sequence
  Synthetic Polynucleotide
taatacgactcactatagggtgttacacactgttatggaagcatgtggcgaacagaggagacgccacatgcttccataaaacctggcggcagcgcaaaagatg

SEQ ID NO: 78528 - DNA, 103 bp, Artificial Sequence
  Synthetic Polynucleotide
taatacgactcactatagggaaaagtgttacacactgttatggaagcatgaacagaggagacatgctatgataacagtgaacctggcggcagcgcaaaagatg

SEQ ID NO: 78529 - DNA, 103 bp, Artificial Sequence
  Synthetic Polynucleotide
taatacgactcactataggggtattaaaagtgttacacactgttatggaaaacagaggagattccatatgagtgtgtaaaacctggcggcagcgcaaaagatg

SEQ ID NO: 78530 - DNA, 103 bp, Artificial Sequence
  Synthetic Polynucleotide
taatacgactcactatagggatttcgtattaaaagtgttacacactgttaaacagaggagataacagatggtaacacttaacctggcggcagcgcaaaagatg

SEQ ID NO: 78531 - DNA, 103 bp, Artificial Sequence
  Synthetic Polynucleotide
taatacgactcactatagggcagacatttcgtattaaaagtgttacacacaacagaggagagtgtgtatgacttttaataacctggcggcagcgcaaaagatg

SEQ ID NO: 78532 - DNA, 103 bp, Artificial Sequence
  Synthetic Polynucleotide
taatacgactcactataggggccatcagacatttcgtattaaaagtgttaaacagaggagataacacatgtaatacgaaaacctggcggcagcgcaaaagatg

SEQ ID NO: 78533 - DNA, 103 bp, Artificial Sequence
  Synthetic Polynucleotide
taatacgactcactatagggatgtcgccatcagacatttcgtattaaaagaacagaggagacttttaatgcgaaatgtcaacctggcggcagcgcaaaagatg

SEQ ID NO: 78534 - DNA, 103 bp, Artificial Sequence
  Synthetic Polynucleotide
taatacgactcactatagggcaattatgtcgccatcagacatttcgtattaacagaggagaaatacgatgtgtctgatgaacctggcggcagcgcaaaagatg

SEQ ID NO: 78535 - DNA, 103 bp, Artificial Sequence
  Synthetic Polynucleotide
taatacgactcactatagggtcatgtaaccgatactaataaatttgctcaaacagaggagatgagcaatgttattagtaaacctggcggcagcgcaaaagatg

SEQ ID NO: 78536 - DNA, 103 bp, Artificial Sequence
  Synthetic Polynucleotide
taatacgactcactatagggttgaacaattatgtcgccatcagacatttcaacagaggagagaaatgatggatggcgacaacctggcggcagcgcaaaagatg

SEQ ID NO: 78537 - DNA, 103 bp, Artificial Sequence
  Synthetic Polynucleotide
taatacgactcactatagggcagttttgaacaattatgtcgccatcagacaacagaggagagtctgaatgcgacataataacctggcggcagcgcaaaagatg

SEQ ID NO: 78538 - DNA, 103 bp, Artificial Sequence
  Synthetic Polynucleotide
taatacgactcactatagggattggcagttttgaacaattatgtcgccataacagaggagaatggcgatgtaattgttcaacctggcggcagcgcaaaagatg

SEQ ID NO: 78539 - DNA, 103 bp, Artificial Sequence
  Synthetic Polynucleotide
taatacgactcactatagggtatagattggcagttttgaacaattatgtcaacagaggagagacataatggttcaaaacaacctggcggcagcgcaaaagatg

SEQ ID NO: 78540 - DNA, 103 bp, Artificial Sequence
  Synthetic Polynucleotide
taatacgactcactatagggtctattatagattggcagttttgaacaattaacagaggagaaattgtatgaaactgccaaacctggcggcagcgcaaaagatg

SEQ ID NO: 78541 - DNA, 103 bp, Artificial Sequence
  Synthetic Polynucleotide
taatacgactcactatagggcaccatctattatagattggcagttttgaaaacagaggagattcaaaatggccaatctaaacctggcggcagcgcaaaagatg

SEQ ID NO: 78542 - DNA, 103 bp, Artificial Sequence
  Synthetic Polynucleotide
taatacgactcactataggggtggccaccatctattatagattggcagttaacagaggagaaactgcatgtctataataaacctggcggcagcgcaaaagatg

SEQ ID NO: 78543 - DNA, 103 bp, Artificial Sequence
  Synthetic Polynucleotide
taatacgactcactatagggatattgtggccaccatctattatagattggaacagaggagaccaatcatgaatagatggaacctggcggcagcgcaaaagatg

SEQ ID NO: 78544 - DNA, 103 bp, Artificial Sequence
  Synthetic Polynucleotide
taatacgactcactatagggagaatatattgtggccaccatctattatagaacagaggagactataaatgatggtggccaacctggcggcagcgcaaaagatg

SEQ ID NO: 78545 - DNA, 103 bp, Artificial Sequence
  Synthetic Polynucleotide
taatacgactcactatagggatcatagaatatattgtggccaccatctataacagaggagaatagatatgggccacaataacctggcggcagcgcaaaagatg

SEQ ID NO: 78546 - DNA, 103 bp, Artificial Sequence
  Synthetic Polynucleotide
taatacgactcactataggggtccttcatgtaaccgatactaataaatttaacagaggagaaaatttatgagtatcggtaacctggcggcagcgcaaaagatg

SEQ ID NO: 78547 - DNA, 103 bp, Artificial Sequence
  Synthetic Polynucleotide
taatacgactcactatagggataccatcatagaatatattgtggccaccaaacagaggagatggtggatgcaatatattaacctggcggcagcgcaaaagatg

SEQ ID NO: 78548 - DNA, 103 bp, Artificial Sequence
  Synthetic Polynucleotide
taatacgactcactatagggcttcaataccatcatagaatatattgtggcaacagaggagagccacaatgtattctatgaacctggcggcagcgcaaaagatg

SEQ ID NO: 78549 - DNA, 103 bp, Artificial Sequence
  Synthetic Polynucleotide
taatacgactcactatagggatcttcttcaataccatcatagaatatattaacagaggagaaatataatgtatgatggtaacctggcggcagcgcaaaagatg

SEQ ID NO: 78550 - DNA, 103 bp, Artificial Sequence
  Synthetic Polynucleotide
taatacgactcactatagggttgttatcttcttcaataccatcatagaataacagaggagaattctaatgtggtattgaaacctggcggcagcgcaaaagatg

SEQ ID NO: 78551 - DNA, 103 bp, Artificial Sequence
  Synthetic Polynucleotide
taatacgactcactatagggcaaggttgttatcttcttcaataccatcataacagaggagaatgatgatgttgaagaagaacctggcggcagcgcaaaagatg

SEQ ID NO: 78552 - DNA, 103 bp, Artificial Sequence
  Synthetic Polynucleotide
taatacgactcactatagggtatgccaaggttgttatcttcttcaataccaacagaggagaggtattatggaagataacaacctggcggcagcgcaaaagatg

SEQ ID NO: 78553 - DNA, 103 bp, Artificial Sequence
  Synthetic Polynucleotide
taatacgactcactatagggatcaatatgccaaggttgttatcttcttcaaacagaggagatgaagaatgtaacaacctaacctggcggcagcgcaaaagatg

SEQ ID NO: 78554 - DNA, 103 bp, Artificial Sequence
  Synthetic Polynucleotide
taatacgactcactatagggaaatgatcaatatgccaaggttgttatcttaacagaggagaaagataatgaccttggcaaacctggcggcagcgcaaaagatg

SEQ ID NO: 78555 - DNA, 103 bp, Artificial Sequence
  Synthetic Polynucleotide
taatacgactcactataggggtatcaaatgatcaatatgccaaggttgttaacagaggagaaacaacatgggcatattgaacctggcggcagcgcaaaagatg

SEQ ID NO: 78556 - DNA, 103 bp, Artificial Sequence
  Synthetic Polynucleotide
taatacgactcactatagggtgtccgtatcaaatgatcaatatgccaaggaacagaggagaccttggatgattgatcataacctggcggcagcgcaaaagatg

SEQ ID NO: 78557 - DNA, 103 bp, Artificial Sequence
  Synthetic Polynucleotide
taatacgactcactataggggtaaagtccttcatgtaaccgatactaataaacagaggagatattagatgcggttacataacctggcggcagcgcaaaagatg

SEQ ID NO: 78558 - DNA, 103 bp, Artificial Sequence
  Synthetic Polynucleotide
taatacgactcactatagggtaccatgtccgtatcaaatgatcaatatgcaacagaggagagcatatatgtcatttgataacctggcggcagcgcaaaagatg

SEQ ID NO: 78559 - DNA, 103 bp, Artificial Sequence
  Synthetic Polynucleotide
taatacgactcactataggggttgataccatgtccgtatcaaatgatcaaaacagaggagattgatcatgtgatacggaaacctggcggcagcgcaaaagatg

SEQ ID NO: 78560 - DNA, 103 bp, Artificial Sequence
  Synthetic Polynucleotide
taatacgactcactatagggtatctgttgataccatgtccgtatcaaatgaacagaggagacatttgatgcggacatggaacctggcggcagcgcaaaagatg

SEQ ID NO: 78561 - DNA, 103 bp, Artificial Sequence
  Synthetic Polynucleotide
taatacgactcactatagggcaagctatctgttgataccatgtccgtatcaacagaggagagatacgatgatggtatcaaacctggcggcagcgcaaaagatg

SEQ ID NO: 78562 - DNA, 103 bp, Artificial Sequence
  Synthetic Polynucleotide
taatacgactcactatagggtcattcaagctatctgttgataccatgtccaacagaggagaggacatatgatcaacagaaacctggcggcagcgcaaaagatg

SEQ ID NO: 78563 - DNA, 103 bp, Artificial Sequence
  Synthetic Polynucleotide
taatacgactcactatagggctctttcattcaagctatctgttgataccaaacagaggagatggtatatgcagatagctaacctggcggcagcgcaaaagatg

SEQ ID NO: 78564 - DNA, 103 bp, Artificial Sequence
  Synthetic Polynucleotide
taatacgactcactatagggtgagtctctttcattcaagctatctgttgaaacagaggagatcaacaatgagcttgaataacctggcggcagcgcaaaagatg

SEQ ID NO: 78565 - DNA, 103 bp, Artificial Sequence
  Synthetic Polynucleotide
taatacgactcactatagggattactgagtctctttcattcaagctatctaacagaggagaagatagatggaatgaaagaacctggcggcagcgcaaaagatg

SEQ ID NO: 78566 - DNA, 103 bp, Artificial Sequence
  Synthetic Polynucleotide
taatacgactcactatagggttccgattactgagtctctttcattcaagcaacagaggagagcttgaatgaaagagactaacctggcggcagcgcaaaagatg

SEQ ID NO: 78567 - DNA, 103 bp, Artificial Sequence
  Synthetic Polynucleotide
taatacgactcactatagggacttattccgattactgagtctctttcattaacagaggagaaatgaaatggactcagtaaacctggcggcagcgcaaaagatg

SEQ ID NO: 78568 - DNA, 103 bp, Artificial Sequence
  Synthetic Polynucleotide
taatacgactcactatagggtgaaaaccgccaaagaactttgtgcaatcaaacagaggagatgattgatgaaagttcttaacctggcggcagcgcaaaagatg

SEQ ID NO: 78569 - DNA, 103 bp, Artificial Sequence
  Synthetic Polynucleotide
taatacgactcactatagggtctacgtaaagtccttcatgtaaccgatacaacagaggagagtatcgatgacatgaaggaacctggcggcagcgcaaaagatg

SEQ ID NO: 78570 - DNA, 103 bp, Artificial Sequence
  Synthetic Polynucleotide
taatacgactcactatagggaaaacacttattccgattactgagtctcttaacagaggagaaagagaatgagtaatcggaacctggcggcagcgcaaaagatg

SEQ ID NO: 78571 - DNA, 103 bp, Artificial Sequence
  Synthetic Polynucleotide
taatacgactcactatagggttgagaaaacacttattccgattactgagtaacagaggagaactcagatgtcggaataaaacctggcggcagcgcaaaagatg

SEQ ID NO: 78572 - DNA, 103 bp, Artificial Sequence
  Synthetic Polynucleotide
taatacgactcactatagggctccattgagaaaacacttattccgattacaacagaggagagtaatcatgataagtgttaacctggcggcagcgcaaaagatg

SEQ ID NO: 78573 - DNA, 103 bp, Artificial Sequence
  Synthetic Polynucleotide
taatacgactcactatagggggacactccattgagaaaacacttattccgaacagaggagacggaatatgtgttttctcaacctggcggcagcgcaaaagatg

SEQ ID NO: 78574 - DNA, 103 bp, Artificial Sequence
  Synthetic Polynucleotide
taatacgactcactatagggtatacggacactccattgagaaaacacttaaacagaggagataagtgatgtctcaatggaacctggcggcagcgcaaaagatg

SEQ ID NO: 78575 - DNA, 103 bp, Artificial Sequence
  Synthetic Polynucleotide
taatacgactcactataggggttggtatacggacactccattgagaaaacaacagaggagagttttcatgatggagtgtaacctggcggcagcgcaaaagatg

SEQ ID NO: 78576 - DNA, 103 bp, Artificial Sequence
  Synthetic Polynucleotide
taatacgactcactataggggacatgttggtatacggacactccattgagaacagaggagactcaatatggtgtccgtaaacctggcggcagcgcaaaagatg

SEQ ID NO: 78577 - DNA, 103 bp, Artificial Sequence
  Synthetic Polynucleotide
taatacgactcactatagggtatcagacatgttggtatacggacactccaaacagaggagatggagtatgcgtataccaaacctggcggcagcgcaaaagatg

SEQ ID NO: 78578 - DNA, 103 bp, Artificial Sequence
  Synthetic Polynucleotide
taatacgactcactatagggcaaaatatcagacatgttggtatacggacaaacagaggagatgtccgatgaccaacatgaacctggcggcagcgcaaaagatg

SEQ ID NO: 78579 - DNA, 103 bp, Artificial Sequence
  Synthetic Polynucleotide
taatacgactcactatagggtacatcaaaatatcagacatgttggtatacaacagaggagagtatacatgcatgtctgaaacctggcggcagcgcaaaagatg

SEQ ID NO: 78580 - DNA, 103 bp, Artificial Sequence
  Synthetic Polynucleotide
taatacgactcactatagggaccactctacgtaaagtccttcatgtaaccaacagaggagaggttacatgaaggactttaacctggcggcagcgcaaaagatg

SEQ ID NO: 78581 - DNA, 103 bp, Artificial Sequence
  Synthetic Polynucleotide
taatacgactcactatagggtggtgtacatcaaaatatcagacatgttggaacagaggagaccaacaatgctgatatttaacctggcggcagcgcaaaagatg

SEQ ID NO: 78582 - DNA, 103 bp, Artificial Sequence
  Synthetic Polynucleotide
taatacgactcactatagggtttgatggtgtacatcaaaatatcagacataacagaggagaatgtctatgattttgatgaacctggcggcagcgcaaaagatg

SEQ ID NO: 78583 - DNA, 103 bp, Artificial Sequence
  Synthetic Polynucleotide
taatacgactcactatagggaacaatttgatggtgtacatcaaaatatcaaacagaggagatgatatatggatgtacacaacctggcggcagcgcaaaagatg

SEQ ID NO: 78584 - DNA, 103 bp, Artificial Sequence
  Synthetic Polynucleotide
taatacgactcactatagggaactaaacaatttgatggtgtacatcaaaaaacagaggagattttgaatgacaccatcaaacctggcggcagcgcaaaagatg

SEQ ID NO: 78585 - DNA, 103 bp, Artificial Sequence
  Synthetic Polynucleotide
taatacgactcactataggggagaaaactaaacaatttgatggtgtacataacagaggagaatgtacatgatcaaattgaacctggcggcagcgcaaaagatg

SEQ ID NO: 78586 - DNA, 103 bp, Artificial Sequence
  Synthetic Polynucleotide
taatacgactcactatagggaaaaagagaaaactaaacaatttgatggtgaacagaggagacaccatatgattgtttagaacctggcggcagcgcaaaagatg

SEQ ID NO: 78587 - DNA, 103 bp, Artificial Sequence
  Synthetic Polynucleotide
taatacgactcactatagggaggataaaaagagaaaactaaacaatttgaaacagaggagatcaaatatgttagttttcaacctggcggcagcgcaaaagatg

SEQ ID NO: 78588 - DNA, 103 bp, Artificial Sequence
  Synthetic Polynucleotide
taatacgactcactatagggtaatgaggataaaaagagaaaactaaacaaaacagaggagattgtttatgtttctctttaacctggcggcagcgcaaaagatg

SEQ ID NO: 78589 - DNA, 103 bp, Artificial Sequence
  Synthetic Polynucleotide
taatacgactcactatagggctgtttaatgaggataaaaagagaaaactaaacagaggagatagtttatgctttttatcaacctggcggcagcgcaaaagatg

SEQ ID NO: 78590 - DNA, 103 bp, Artificial Sequence
  Synthetic Polynucleotide
taatacgactcactatagggaaatgctgtttaatgaggataaaaagagaaaacagaggagattctctatgtatcctcataacctggcggcagcgcaaaagatg

SEQ ID NO: 78591 - DNA, 103 bp, Artificial Sequence
  Synthetic Polynucleotide
taatacgactcactataggggaatcaccactctacgtaaagtccttcatgaacagaggagacatgaaatgctttacgtaaacctggcggcagcgcaaaagatg

SEQ ID NO: 78592 - DNA, 103 bp, Artificial Sequence
  Synthetic Polynucleotide
taatacgactcactataggggacagaaatgctgtttaatgaggataaaaaaacagaggagatttttaatgtcattaaacaacctggcggcagcgcaaaagatg

SEQ ID NO: 78593 - DNA, 103 bp, Artificial Sequence
  Synthetic Polynucleotide
taatacgactcactatagggccattgacagaaatgctgtttaatgaggataacagaggagaatcctcatgaaacagcataacctggcggcagcgcaaaagatg

SEQ ID NO: 78594 - DNA, 103 bp, Artificial Sequence
  Synthetic Polynucleotide
taatacgactcactatagggggggtccattgacagaaatgctgtttaatgaacagaggagacattaaatggcatttctgaacctggcggcagcgcaaaagatg

SEQ ID NO: 78595 - DNA, 103 bp, Artificial Sequence
  Synthetic Polynucleotide
taatacgactcactatagggatgttggggtccattgacagaaatgctgttaacagaggagaaacagcatgtctgtcaataacctggcggcagcgcaaaagatg

SEQ ID NO: 78596 - DNA, 103 bp, Artificial Sequence
  Synthetic Polynucleotide
taatacgactcactatagggcaaagatgttggggtccattgacagaaatgaacagaggagacatttcatgcaatggaccaacctggcggcagcgcaaaagatg

SEQ ID NO: 78597 - DNA, 103 bp, Artificial Sequence
  Synthetic Polynucleotide
taatacgactcactatagggtcggtcaaagatgttggggtccattgacagaacagaggagactgtcaatggaccccaacaacctggcggcagcgcaaaagatg

SEQ ID NO: 78598 - DNA, 103 bp, Artificial Sequence
  Synthetic Polynucleotide
taatacgactcactatagggcttaatcggtcaaagatgttggggtccattaacagaggagaaatggaatgcaacatcttaacctggcggcagcgcaaaagatg

SEQ ID NO: 78599 - DNA, 103 bp, Artificial Sequence
  Synthetic Polynucleotide
taatacgactcactatagggcaaaacttaatcggtcaaagatgttggggtaacagaggagaaccccaatgtctttgaccaacctggcggcagcgcaaaagatg

SEQ ID NO: 78600 - DNA, 103 bp, Artificial Sequence
  Synthetic Polynucleotide
taatacgactcactatagggtcaatcaaaacttaatcggtcaaagatgttaacagaggagaaacatcatggaccgattaaacctggcggcagcgcaaaagatg

SEQ ID NO: 78601 - DNA, 103 bp, Artificial Sequence
  Synthetic Polynucleotide
taatacgactcactatagggaagaatcaatcaaaacttaatcggtcaaagaacagaggagactttgaatgattaagtttaacctggcggcagcgcaaaagatg

SEQ ID NO: 78602 - DNA, 103 bp, Artificial Sequence
  Synthetic Polynucleotide
taatacgactcactatagggtggtggaatcaccactctacgtaaagtcctaacagaggagaaggactatgcgtagagtgaacctggcggcagcgcaaaagatg

SEQ ID NO: 78603 - DNA, 103 bp, Artificial Sequence
  Synthetic Polynucleotide
taatacgactcactatagggcatggaagaatcaatcaaaacttaatcggtaacagaggagaaccgatatggttttgattaacctggcggcagcgcaaaagatg

SEQ ID NO: 78604 - DNA, 103 bp, Artificial Sequence
  Synthetic Polynucleotide
taatacgactcactatagggccttacatggaagaatcaatcaaaacttaaaacagaggagattaagtatggattgattcaacctggcggcagcgcaaaagatg

SEQ ID NO: 78605 - DNA, 103 bp, Artificial Sequence
  Synthetic Polynucleotide
taatacgactcactatagggatacgccttacatggaagaatcaatcaaaaaacagaggagattttgaatgattcttccaaacctggcggcagcgcaaaagatg

SEQ ID NO: 78606 - DNA, 103 bp, Artificial Sequence
  Synthetic Polynucleotide
taatacgactcactatagggactagatacgccttacatggaagaatcaataacagaggagaattgatatgtccatgtaaaacctggcggcagcgcaaaagatg

SEQ ID NO: 78607 - DNA, 103 bp, Artificial Sequence
  Synthetic Polynucleotide
taatacgactcactatagggatctgactagatacgccttacatggaagaaaacagaggagattcttcatggtaaggcgtaacctggcggcagcgcaaaagatg

SEQ ID NO: 78608 - DNA, 103 bp, Artificial Sequence
  Synthetic Polynucleotide
taatacgactcactatagggatacgatctgactagatacgccttacatggaacagaggagaccatgtatggcgtatctaaacctggcggcagcgcaaaagatg

SEQ ID NO: 78609 - DNA, 103 bp, Artificial Sequence
  Synthetic Polynucleotide
taatacgactcactatagggagattatacgatctgactagatacgccttaaacagaggagataaggcatgtctagtcagaacctggcggcagcgcaaaagatg

SEQ ID NO: 78610 - DNA, 103 bp, Artificial Sequence
  Synthetic Polynucleotide
taatacgactcactatagggtggctagattatacgatctgactagatacgaacagaggagacgtatcatgtcagatcgtaacctggcggcagcgcaaaagatg

SEQ ID NO: 78611 - DNA, 103 bp, Artificial Sequence
  Synthetic Polynucleotide
taatacgactcactatagggattgttggctagattatacgatctgactagaacagaggagactagtcatgtcgtataataacctggcggcagcgcaaaagatg

SEQ ID NO: 78612 - DNA, 103 bp, Artificial Sequence
  Synthetic Polynucleotide
taatacgactcactataggggatggattgttggctagattatacgatctgaacagaggagacagatcatgtaatctagcaacctggcggcagcgcaaaagatg

SEQ ID NO: 78613 - DNA, 103 bp, Artificial Sequence
  Synthetic Polynucleotide
taatacgactcactatagggacagatggtggaatcaccactctacgtaaaaacagaggagatttacgatgagtggtgataacctggcggcagcgcaaaagatg

SEQ ID NO: 78614 - DNA, 103 bp, Artificial Sequence
  Synthetic Polynucleotide
taatacgactcactatagggccgacgatggattgttggctagattatacgaacagaggagacgtataatgtagccaacaaacctggcggcagcgcaaaagatg

SEQ ID NO: 78615 - DNA, 103 bp, Artificial Sequence
  Synthetic Polynucleotide
taatacgactcactatagggaaacaccgacgatggattgttggctagattaacagaggagaaatctaatgaacaatccaaacctggcggcagcgcaaaagatg

SEQ ID NO: 78616 - DNA, 103 bp, Artificial Sequence
  Synthetic Polynucleotide
taatacgactcactataggggacctaaacaccgacgatggattgttggctaacagaggagaagccaaatgtccatcgtcaacctggcggcagcgcaaaagatg

SEQ ID NO: 78617 - DNA, 103 bp, Artificial Sequence
  Synthetic Polynucleotide
taatacgactcactataggggatgtgacctaaacaccgacgatggattgtaacagaggagaacaatcatgcgtcggtgtaacctggcggcagcgcaaaagatg

SEQ ID NO: 78618 - DNA, 103 bp, Artificial Sequence
  Synthetic Polynucleotide
taatacgactcactatagggtatacgatgtgacctaaacaccgacgatggaacagaggagaccatcgatggtgtttaggaacctggcggcagcgcaaaagatg

SEQ ID NO: 78619 - DNA, 103 bp, Artificial Sequence
  Synthetic Polynucleotide
taatacgactcactatagggaaaagtatacgatgtgacctaaacaccgacaacagaggagagtcggtatgtaggtcacaaacctggcggcagcgcaaaagatg

SEQ ID NO: 78620 - DNA, 103 bp, Artificial Sequence
  Synthetic Polynucleotide
taatacgactcactatagggaattaaaaagtatacgatgtgacctaaacaaacagaggagatgtttaatgcacatcgtaaacctggcggcagcgcaaaagatg

SEQ ID NO: 78621 - DNA, 103 bp, Artificial Sequence
  Synthetic Polynucleotide
taatacgactcactatagggtagagaattaaaaagtatacgatgtgacctaacagaggagaaggtcaatgcgtatacttaacctggcggcagcgcaaaagatg

SEQ ID NO: 78622 - DNA, 103 bp, Artificial Sequence
  Synthetic Polynucleotide
taatacgactcactatagggttctatagagaattaaaaagtatacgatgtaacagaggagaacatcgatgactttttaaaacctggcggcagcgcaaaagatg

SEQ ID NO: 78623 - DNA, 103 bp, Artificial Sequence
  Synthetic Polynucleotide
taatacgactcactatagggctctcttctatagagaattaaaaagtatacaacagaggagagtatacatgttaattctcaacctggcggcagcgcaaaagatg

SEQ ID NO: 78624 - DNA, 103 bp, Artificial Sequence
  Synthetic Polynucleotide
taatacgactcactataggggtaccacagatggtggaatcaccactctacaacagaggagagtagagatgtgattccacaacctggcggcagcgcaaaagatg

SEQ ID NO: 78625 - DNA, 103 bp, Artificial Sequence
  Synthetic Polynucleotide
taatacgactcactatagggtgtgtctctcttctatagagaattaaaaagaacagaggagactttttatgtctctatagaacctggcggcagcgcaaaagatg

SEQ ID NO: 78626 - DNA, 103 bp, Artificial Sequence
  Synthetic Polynucleotide
taatacgactcactatagggaggtgtgtgtctctcttctatagagaattaaacagaggagataattcatgatagaagagaacctggcggcagcgcaaaagatg

SEQ ID NO: 78627 - DNA, 103 bp, Artificial Sequence
  Synthetic Polynucleotide
taatacgactcactataggggttccaggtgtgtgtctctcttctatagagaacagaggagactctatatgagagagacaaacctggcggcagcgcaaaagatg

SEQ ID NO: 78628 - DNA, 103 bp, Artificial Sequence
  Synthetic Polynucleotide
taatacgactcactatagggtaattgttccaggtgtgtgtctctcttctaaacagaggagatagaagatggacacacacaacctggcggcagcgcaaaagatg

SEQ ID NO: 78629 - DNA, 103 bp, Artificial Sequence
  Synthetic Polynucleotide
taatacgactcactataggggtctgtaattgttccaggtgtgtgtctctcaacagaggagagagagaatgacacctggaaacctggcggcagcgcaaaagatg

SEQ ID NO: 78630 - DNA, 103 bp, Artificial Sequence
  Synthetic Polynucleotide
taatacgactcactatagggttactgtctgtaattgttccaggtgtgtgtaacagaggagaacacacatgtggaacaataacctggcggcagcgcaaaagatg

SEQ ID NO: 78631 - DNA, 103 bp, Artificial Sequence
  Synthetic Polynucleotide
taatacgactcactatagggagaaattactgtctgtaattgttccaggtgaacagaggagacacctgatgcaattacagaacctggcggcagcgcaaaagatg

SEQ ID NO: 78632 - DNA, 103 bp, Artificial Sequence
  Synthetic Polynucleotide
taatacgactcactatagggaataaagaaattactgtctgtaattgttccaacagaggagaggaacaatgacagacagtaacctggcggcagcgcaaaagatg

SEQ ID NO: 78633 - DNA, 103 bp, Artificial Sequence
  Synthetic Polynucleotide
taatacgactcactatagggtagataataaagaaattactgtctgtaattaacagaggagaaattacatgcagtaatttaacctggcggcagcgcaaaagatg

SEQ ID NO: 78634 - DNA, 103 bp, Artificial Sequence
  Synthetic Polynucleotide
taatacgactcactatagggatctgtagataataaagaaattactgtctgaacagaggagacagacaatgatttctttaaacctggcggcagcgcaaaagatg

SEQ ID NO: 78635 - DNA, 103 bp, Artificial Sequence
  Synthetic Polynucleotide
taatacgactcactatagggcattcgtaccacagatggtggaatcaccacaacagaggagagtggtgatgccaccatctaacctggcggcagcgcaaaagatg

SEQ ID NO: 78636 - DNA, 103 bp, Artificial Sequence
  Synthetic Polynucleotide
taatacgactcactatagggcttacatctgtagataataaagaaattactaacagaggagaagtaatatgtttattatcaacctggcggcagcgcaaaagatg

SEQ ID NO: 78637 - DNA, 103 bp, Artificial Sequence
  Synthetic Polynucleotide
taatacgactcactatagggagtatcttacatctgtagataataaagaaaaacagaggagatttcttatgtatctacagaacctggcggcagcgcaaaagatg

SEQ ID NO: 78638 - DNA, 103 bp, Artificial Sequence
  Synthetic Polynucleotide
taatacgactcactatagggcttcaagtatcttacatctgtagataataaaacagaggagattattaatgacagatgtaaacctggcggcagcgcaaaagatg

SEQ ID NO: 78639 - DNA, 103 bp, Artificial Sequence
  Synthetic Polynucleotide
taatacgactcactatagggaatgtcttcaagtatcttacatctgtagataacagaggagaatctacatgtgtaagataaacctggcggcagcgcaaaagatg

SEQ ID NO: 78640 - DNA, 103 bp, Artificial Sequence
  Synthetic Polynucleotide
taatacgactcactatagggataggaatgtcttcaagtatcttacatctgaacagaggagacagatgatggatacttgaaacctggcggcagcgcaaaagatg

SEQ ID NO: 78641 - DNA, 103 bp, Artificial Sequence
  Synthetic Polynucleotide
taatacgactcactatagggtcatcataggaatgtcttcaagtatcttacaacagaggagagtaagaatgttgaagacaaacctggcggcagcgcaaaagatg

SEQ ID NO: 78642 - DNA, 103 bp, Artificial Sequence
  Synthetic Polynucleotide
taatacgactcactatagggctacatcatcataggaatgtcttcaagtataacagaggagaatacttatggacattcctaacctggcggcagcgcaaaagatg

SEQ ID NO: 78643 - DNA, 103 bp, Artificial Sequence
  Synthetic Polynucleotide
taatacgactcactatagggaaattctacatcatcataggaatgtcttcaaacagaggagatgaagaatgtcctatgataacctggcggcagcgcaaaagatg

SEQ ID NO: 78644 - DNA, 103 bp, Artificial Sequence
  Synthetic Polynucleotide
taatacgactcactatagggatcaaaaattctacatcatcataggaatgtaacagaggagaacattcatgtgatgatgtaacctggcggcagcgcaaaagatg

SEQ ID NO: 78645 - DNA, 103 bp, Artificial Sequence
  Synthetic Polynucleotide
taatacgactcactataggggtgttatcaaaaattctacatcatcataggaacagaggagacctatgatgatgtagaataacctggcggcagcgcaaaagatg

SEQ ID NO: 78646 - DNA, 103 bp, Artificial Sequence
  Synthetic Polynucleotide
taatacgactcactataggggaaaccattcgtaccacagatggtggaatcaacagaggagagattccatgatctgtggtaacctggcggcagcgcaaaagatg

SEQ ID NO: 78647 - DNA, 103 bp, Artificial Sequence
  Synthetic Polynucleotide
taatacgactcactatagggatacagtgttatcaaaaattctacatcatcaacagaggagagatgatatggaatttttgaacctggcggcagcgcaaaagatg

SEQ ID NO: 78648 - DNA, 103 bp, Artificial Sequence
  Synthetic Polynucleotide
taatacgactcactatagggcatcaatacagtgttatcaaaaattctacaaacagaggagatgtagaatgtttgataacaacctggcggcagcgcaaaagatg

SEQ ID NO: 78649 - DNA, 103 bp, Artificial Sequence
  Synthetic Polynucleotide
taatacgactcactataggggataccatcaatacagtgttatcaaaaattaacagaggagaaattttatgtaacactgtaacctggcggcagcgcaaaagatg

SEQ ID NO: 78650 - DNA, 103 bp, Artificial Sequence
  Synthetic Polynucleotide
taatacgactcactatagggtaacagataccatcaatacagtgttatcaaaacagaggagattgataatgctgtattgaaacctggcggcagcgcaaaagatg

SEQ ID NO: 78651 - DNA, 103 bp, Artificial Sequence
  Synthetic Polynucleotide
taatacgactcactatagggtatggtaacagataccatcaatacagtgttaacagaggagaaacactatgttgatggtaaacctggcggcagcgcaaaagatg

SEQ ID NO: 78652 - DNA, 103 bp, Artificial Sequence
  Synthetic Polynucleotide
taatacgactcactatagggggtattatggtaacagataccatcaatacaaacagaggagatgtattatgggtatctgtaacctggcggcagcgcaaaagatg

SEQ ID NO: 78653 - DNA, 103 bp, Artificial Sequence
  Synthetic Polynucleotide
taatacgactcactatagggtaaaaggtattatggtaacagataccatcaaacagaggagatgatggatgctgttaccaaacctggcggcagcgcaaaagatg

SEQ ID NO: 78654 - DNA, 103 bp, Artificial Sequence
  Synthetic Polynucleotide
taatacgactcactatagggcgccataaaaggtattatggtaacagatacaacagaggagagtatctatgaccataataaacctggcggcagcgcaaaagatg

SEQ ID NO: 78655 - DNA, 103 bp, Artificial Sequence
  Synthetic Polynucleotide
taatacgactcactatagggctgtccgccataaaaggtattatggtaacaaacagaggagatgttacatgaatacctttaacctggcggcagcgcaaaagatg

SEQ ID NO: 78656 - DNA, 103 bp, Artificial Sequence
  Synthetic Polynucleotide
taatacgactcactatagggtgacactgtccgccataaaaggtattatggaacagaggagaccataaatgcttttatggaacctggcggcagcgcaaaagatg

SEQ ID NO: 78657 - DNA, 103 bp, Artificial Sequence
  Synthetic Polynucleotide
taatacgactcactatagggaagatgaaaccattcgtaccacagatggtgaacagaggagacaccatatgtggtacgaaaacctggcggcagcgcaaaagatg

SEQ ID NO: 78658 - DNA, 103 bp, Artificial Sequence
  Synthetic Polynucleotide
taatacgactcactatagggtgctctgacactgtccgccataaaaggtataacagaggagaatacctatgatggcggacaacctggcggcagcgcaaaagatg

SEQ ID NO: 78659 - DNA, 103 bp, Artificial Sequence
  Synthetic Polynucleotide
taatacgactcactatagggtcctgtgctctgacactgtccgccataaaaaacagaggagattttatatgggacagtgtaacctggcggcagcgcaaaagatg

SEQ ID NO: 78660 - DNA, 103 bp, Artificial Sequence
  Synthetic Polynucleotide
taatacgactcactatagggggaaatcctgtgctctgacactgtccgccaaacagaggagatggcggatggtgtcagagaacctggcggcagcgcaaaagatg

SEQ ID NO: 78661 - DNA, 103 bp, Artificial Sequence
  Synthetic Polynucleotide
taatacgactcactatagggagattggaaatcctgtgctctgacactgtcaacagaggagagacagtatgagagcacagaacctggcggcagcgcaaaagatg

SEQ ID NO: 78662 - DNA, 103 bp, Artificial Sequence
  Synthetic Polynucleotide
taatacgactcactataggggcaaaagattggaaatcctgtgctctgacaaacagaggagatgtcagatgacaggatttaacctggcggcagcgcaaaagatg

SEQ ID NO: 78663 - DNA, 103 bp, Artificial Sequence
  Synthetic Polynucleotide
taatacgactcactatagggaaattgcaaaagattggaaatcctgtgctcaacagaggagagagcacatgatttccaataacctggcggcagcgcaaaagatg

SEQ ID NO: 78664 - DNA, 103 bp, Artificial Sequence
  Synthetic Polynucleotide
taatacgactcactatagggactgaaaattgcaaaagattggaaatcctgaacagaggagacaggatatgcaatcttttaacctggcggcagcgcaaaagatg

SEQ ID NO: 78665 - DNA, 103 bp, Artificial Sequence
  Synthetic Polynucleotide
taatacgactcactatagggatggtactgaaaattgcaaaagattggaaaaacagaggagatttccaatgttttgcaataacctggcggcagcgcaaaagatg

SEQ ID NO: 78666 - DNA, 103 bp, Artificial Sequence
  Synthetic Polynucleotide
taatacgactcactatagggagataatggtactgaaaattgcaaaagattaacagaggagaaatcttatgcaattttcaaacctggcggcagcgcaaaagatg

SEQ ID NO: 78667 - DNA, 103 bp, Artificial Sequence
  Synthetic Polynucleotide
taatacgactcactatagggaacaaagataatggtactgaaaattgcaaaaacagaggagatttgcaatgttcagtaccaacctggcggcagcgcaaaagatg

SEQ ID NO: 78668 - DNA, 103 bp, Artificial Sequence
  Synthetic Polynucleotide
taatacgactcactatagggcaaagaagatgaaaccattcgtaccacagaaacagaggagatctgtgatgcgaatggttaacctggcggcagcgcaaaagatg

SEQ ID NO: 78669 - DNA, 103 bp, Artificial Sequence
  Synthetic Polynucleotide
taatacgactcactatagggatcaaaacaaagataatggtactgaaaattaacagaggagaaattttatgtaccattataacctggcggcagcgcaaaagatg

SEQ ID NO: 78670 - DNA, 103 bp, Artificial Sequence
  Synthetic Polynucleotide
taatacgactcactatagggtagatatcaaaacaaagataatggtactgaaacagaggagatcagtaatgttatctttgaacctggcggcagcgcaaaagatg

SEQ ID NO: 78671 - DNA, 103 bp, Artificial Sequence
  Synthetic Polynucleotide
taatacgactcactatagggtaatatagatatcaaaacaaagataatggtaacagaggagaaccattatgtttgttttgaacctggcggcagcgcaaaagatg

SEQ ID NO: 78672 - DNA, 103 bp, Artificial Sequence
  Synthetic Polynucleotide
taatacgactcactatagggctatctaatatagatatcaaaacaaagataaacagaggagatatcttatgtttgatatcaacctggcggcagcgcaaaagatg

SEQ ID NO: 78673 - DNA, 103 bp, Artificial Sequence
  Synthetic Polynucleotide
taatacgactcactatagggccatgctatctaatatagatatcaaaacaaaacagaggagattgtttatgtatctatataacctggcggcagcgcaaaagatg

SEQ ID NO: 78674 - DNA, 103 bp, Artificial Sequence
  Synthetic Polynucleotide
taatacgactcactatagggacgcaccatgctatctaatatagatatcaaaacagaggagattgataatgatattagataacctggcggcagcgcaaaagatg

SEQ ID NO: 78675 - DNA, 103 bp, Artificial Sequence
  Synthetic Polynucleotide
taatacgactcactataggggtcagacgcaccatgctatctaatatagataacagaggagaatctatatgagatagcataacctggcggcagcgcaaaagatg

SEQ ID NO: 78676 - DNA, 103 bp, Artificial Sequence
  Synthetic Polynucleotide
taatacgactcactataggggtgttgtcagacgcaccatgctatctaataaacagaggagatattagatggcatggtgcaacctggcggcagcgcaaaagatg

SEQ ID NO: 78677 - DNA, 103 bp, Artificial Sequence
  Synthetic Polynucleotide
taatacgactcactatagggtccctgtgttgtcagacgcaccatgctatcaacagaggagagatagcatggtgcgtctgaacctggcggcagcgcaaaagatg

SEQ ID NO: 78678 - DNA, 103 bp, Artificial Sequence
  Synthetic Polynucleotide
taatacgactcactatagggcttaatccctgtgttgtcagacgcaccatgaacagaggagacatggtatgtctgacaacaacctggcggcagcgcaaaagatg

SEQ ID NO: 78679 - DNA, 103 bp, Artificial Sequence
  Synthetic Polynucleotide
taatacgactcactatagggctccatgaaaaccgccaaagaactttgtgcaacagaggagagcacaaatgtctttggcgaacctggcggcagcgcaaaagatg

SEQ ID NO: 78680 - DNA, 103 bp, Artificial Sequence
  Synthetic Polynucleotide
taatacgactcactatagggggcatcaaagaagatgaaaccattcgtaccaacagaggagaggtacgatgggtttcatcaacctggcggcagcgcaaaagatg

SEQ ID NO: 78681 - DNA, 103 bp, Artificial Sequence
  Synthetic Polynucleotide
taatacgactcactatagggttcgtcttaatccctgtgttgtcagacgcaaacagaggagatgcgtcatgcaacacaggaacctggcggcagcgcaaaagatg

SEQ ID NO: 78682 - DNA, 103 bp, Artificial Sequence
  Synthetic Polynucleotide
taatacgactcactatagggatcttttcgtcttaatccctgtgttgtcagaacagaggagactgacaatgcagggattaaacctggcggcagcgcaaaagatg

SEQ ID NO: 78683 - DNA, 103 bp, Artificial Sequence
  Synthetic Polynucleotide
taatacgactcactatagggatttcatcttttcgtcttaatccctgtgttaacagaggagaaacacaatgattaagacgaacctggcggcagcgcaaaagatg

SEQ ID NO: 78684 - DNA, 103 bp, Artificial Sequence
  Synthetic Polynucleotide
taatacgactcactataggggaatcatttcatcttttcgtcttaatccctaacagaggagaagggatatggacgaaaagaacctggcggcagcgcaaaagatg

SEQ ID NO: 78685 - DNA, 103 bp, Artificial Sequence
  Synthetic Polynucleotide
taatacgactcactatagggagatagaatcatttcatcttttcgtcttaaaacagaggagattaagaatgaaagatgaaaacctggcggcagcgcaaaagatg

SEQ ID NO: 78686 - DNA, 103 bp, Artificial Sequence
  Synthetic Polynucleotide
taatacgactcactataggggatgtagatagaatcatttcatcttttcgtaacagaggagaacgaaaatgtgaaatgataacctggcggcagcgcaaaagatg

SEQ ID NO: 78687 - DNA, 103 bp, Artificial Sequence
  Synthetic Polynucleotide
taatacgactcactatagggttgaagatgtagatagaatcatttcatcttaacagaggagaaagatgatgtgattctataacctggcggcagcgcaaaagatg

SEQ ID NO: 78688 - DNA, 103 bp, Artificial Sequence
  Synthetic Polynucleotide
taatacgactcactatagggatctattgaagatgtagatagaatcatttcaacagaggagagaaatgatgctatctacaaacctggcggcagcgcaaaagatg

SEQ ID NO: 78689 - DNA, 103 bp, Artificial Sequence
  Synthetic Polynucleotide
taatacgactcactatagggaaggtatctattgaagatgtagatagaatcaacagaggagagattctatgtacatcttcaacctggcggcagcgcaaaagatg

SEQ ID NO: 78690 - DNA, 103 bp, Artificial Sequence
  Synthetic Polynucleotide
taatacgactcactatagggatagcaaggtatctattgaagatgtagataaacagaggagatatctaatgcttcaatagaacctggcggcagcgcaaaagatg

SEQ ID NO: 78691 - DNA, 103 bp, Artificial Sequence
  Synthetic Polynucleotide
taatacgactcactataggggtgatggcatcaaagaagatgaaaccattcaacagaggagagaatggatgcatcttcttaacctggcggcagcgcaaaagatg

SEQ ID NO: 78692 - DNA, 103 bp, Artificial Sequence
  Synthetic Polynucleotide
taatacgactcactatagggaaaaaatagcaaggtatctattgaagatgtaacagaggagaacatctatgatagataccaacctggcggcagcgcaaaagatg

SEQ ID NO: 78693 - DNA, 103 bp, Artificial Sequence
  Synthetic Polynucleotide
taatacgactcactataggggccagaaaaaatagcaaggtatctattgaaaacagaggagattcaatatgtaccttgctaacctggcggcagcgcaaaagatg

SEQ ID NO: 78694 - DNA, 103 bp, Artificial Sequence
  Synthetic Polynucleotide
taatacgactcactatagggataatgccagaaaaaatagcaaggtatctaaacagaggagatagataatgtgctattttaacctggcggcagcgcaaaagatg

SEQ ID NO: 78695 - DNA, 103 bp, Artificial Sequence
  Synthetic Polynucleotide
taatacgactcactatagggtatagataatgccagaaaaaatagcaaggtaacagaggagaaccttgatgttttttctgaacctggcggcagcgcaaaagatg

SEQ ID NO: 78696 - DNA, 103 bp, Artificial Sequence
  Synthetic Polynucleotide
taatacgactcactatagggtcacatatagataatgccagaaaaaatagcaacagaggagagctattatgtctggcattaacctggcggcagcgcaaaagatg

SEQ ID NO: 78697 - DNA, 103 bp, Artificial Sequence
  Synthetic Polynucleotide
taatacgactcactatagggttctctcacatatagataatgccagaaaaaaacagaggagatttttcatgcattatctaaacctggcggcagcgcaaaagatg

SEQ ID NO: 78698 - DNA, 103 bp, Artificial Sequence
  Synthetic Polynucleotide
taatacgactcactatagggggatattctctcacatatagataatgccagaacagaggagactggcaatgtctatatgtaacctggcggcagcgcaaaagatg

SEQ ID NO: 78699 - DNA, 103 bp, Artificial Sequence
  Synthetic Polynucleotide
taatacgactcactatagggctagaggatattctctcacatatagataataacagaggagaattatcatgatgtgagagaacctggcggcagcgcaaaagatg

SEQ ID NO: 78700 - DNA, 103 bp, Artificial Sequence
  Synthetic Polynucleotide
taatacgactcactatagggattctctagaggatattctctcacatatagaacagaggagactatatatgagagaatataacctggcggcagcgcaaaagatg

SEQ ID NO: 78701 - DNA, 103 bp, Artificial Sequence
  Synthetic Polynucleotide
taatacgactcactatagggtactgattctctagaggatattctctcacaaacagaggagatgtgagatgatatcctctaacctggcggcagcgcaaaagatg

SEQ ID NO: 78702 - DNA, 103 bp, Artificial Sequence
  Synthetic Polynucleotide
taatacgactcactatagggtctgggtgatggcatcaaagaagatgaaacaacagaggagagtttcaatgtctttgatgaacctggcggcagcgcaaaagatg

SEQ ID NO: 78703 - DNA, 103 bp, Artificial Sequence
  Synthetic Polynucleotide
taatacgactcactatagggaaggatactgattctctagaggatattctcaacagaggagagagaatatgctctagagaaacctggcggcagcgcaaaagatg

SEQ ID NO: 78704 - DNA, 103 bp, Artificial Sequence
  Synthetic Polynucleotide
taatacgactcactatagggtcaaaaaggatactgattctctagaggataaacagaggagatatcctatggagaatcagaacctggcggcagcgcaaaagatg

SEQ ID NO: 78705 - DNA, 103 bp, Artificial Sequence
  Synthetic Polynucleotide
taatacgactcactatagggtattatcaaaaaggatactgattctctagaaacagaggagatctagaatgtcagtatccaacctggcggcagcgcaaaagatg

SEQ ID NO: 78706 - DNA, 103 bp, Artificial Sequence
  Synthetic Polynucleotide
taatacgactcactatagggtccactattatcaaaaaggatactgattctaacagaggagaagaatcatgatcctttttaacctggcggcagcgcaaaagatg

SEQ ID NO: 78707 - DNA, 103 bp, Artificial Sequence
  Synthetic Polynucleotide
taatacgactcactatagggtgagatccactattatcaaaaaggatactgaacagaggagacagtatatgttttgataaaacctggcggcagcgcaaaagatg

SEQ ID NO: 78708 - DNA, 103 bp, Artificial Sequence
  Synthetic Polynucleotide
taatacgactcactataggggtcattgagatccactattatcaaaaaggaaacagaggagatcctttatgataatagtgaacctggcggcagcgcaaaagatg

SEQ ID NO: 78709 - DNA, 103 bp, Artificial Sequence
  Synthetic Polynucleotide
taatacgactcactatagggcccatgtcattgagatccactattatcaaaaacagaggagatttgatatgagtggatctaacctggcggcagcgcaaaagatg

SEQ ID NO: 78710 - DNA, 103 bp, Artificial Sequence
  Synthetic Polynucleotide
taatacgactcactataggggacgtcccatgtcattgagatccactattaaacagaggagataatagatgatctcaatgaacctggcggcagcgcaaaagatg

SEQ ID NO: 78711 - DNA, 103 bp, Artificial Sequence
  Synthetic Polynucleotide
taatacgactcactataggggtttagacgtcccatgtcattgagatccacaacagaggagagtggatatgaatgacatgaacctggcggcagcgcaaaagatg

SEQ ID NO: 78712 - DNA, 103 bp, Artificial Sequence
  Synthetic Polynucleotide
taatacgactcactatagggagaaggtttagacgtcccatgtcattgagaaacagaggagatctcaaatgcatgggacgaacctggcggcagcgcaaaagatg

SEQ ID NO: 78713 - DNA, 103 bp, Artificial Sequence
  Synthetic Polynucleotide
taatacgactcactataggggaacatctgggtgatggcatcaaagaagataacagaggagaatcttcatggatgccatcaacctggcggcagcgcaaaagatg

SEQ ID NO: 78714 - DNA, 103 bp, Artificial Sequence
  Synthetic Polynucleotide
taatacgactcactatagggaaataagaaggtttagacgtcccatgtcataacagaggagaatgacaatggacgtctaaaacctggcggcagcgcaaaagatg

SEQ ID NO: 78715 - DNA, 103 bp, Artificial Sequence
  Synthetic Polynucleotide
taatacgactcactatagggtgataaaataagaaggtttagacgtcccataacagaggagaatgggaatgctaaaccttaacctggcggcagcgcaaaagatg

SEQ ID NO: 78716 - DNA, 103 bp, Artificial Sequence
  Synthetic Polynucleotide
taatacgactcactatagggacaggtgataaaataagaaggtttagacgtaacagaggagaacgtctatgccttcttataacctggcggcagcgcaaaagatg

SEQ ID NO: 78717 - DNA, 103 bp, Artificial Sequence
  Synthetic Polynucleotide
taatacgactcactatagggtgcaaacaggtgataaaataagaaggtttaaacagaggagataaaccatgttattttataacctggcggcagcgcaaaagatg

SEQ ID NO: 78718 - DNA, 103 bp, Artificial Sequence
  Synthetic Polynucleotide
taatacgactcactatagggcaccatgcaaacaggtgataaaataagaagaacagaggagacttcttatgttatcacctaacctggcggcagcgcaaaagatg

SEQ ID NO: 78719 - DNA, 103 bp, Artificial Sequence
  Synthetic Polynucleotide
taatacgactcactatagggcaaatcaccatgcaaacaggtgataaaataaacagaggagatattttatgacctgtttgaacctggcggcagcgcaaaagatg

SEQ ID NO: 78720 - DNA, 103 bp, Artificial Sequence
  Synthetic Polynucleotide
taatacgactcactataggggcagacaaatcaccatgcaaacaggtgataaacagaggagatatcacatgtttgcatggaacctggcggcagcgcaaaagatg

SEQ ID NO: 78721 - DNA, 103 bp, Artificial Sequence
  Synthetic Polynucleotide
taatacgactcactatagggagaaagcagacaaatcaccatgcaaacaggaacagaggagacctgttatgatggtgattaacctggcggcagcgcaaaagatg

SEQ ID NO: 78722 - DNA, 103 bp, Artificial Sequence
  Synthetic Polynucleotide
taatacgactcactatagggttaaaagaaagcagacaaatcaccatgcaaaacagaggagattgcatatggatttgtctaacctggcggcagcgcaaaagatg

SEQ ID NO: 78723 - DNA, 103 bp, Artificial Sequence
  Synthetic Polynucleotide
taatacgactcactatagggtcatgttaaaagaaagcagacaaatcaccaaacagaggagatggtgaatggtctgctttaacctggcggcagcgcaaaagatg

SEQ ID NO: 78724 - DNA, 103 bp, Artificial Sequence
  Synthetic Polynucleotide
taatacgactcactatagggttatagaacatctgggtgatggcatcaaagaacagaggagactttgaatgcatcacccaaacctggcggcagcgcaaaagatg

SEQ ID NO: 78725 - DNA, 103 bp, Artificial Sequence
  Synthetic Polynucleotide
taatacgactcactatagggttacatcatgttaaaagaaagcagacaaataacagaggagaatttgtatgctttcttttaacctggcggcagcgcaaaagatg

SEQ ID NO: 78726 - DNA, 103 bp, Artificial Sequence
  Synthetic Polynucleotide
taatacgactcactatagggagagattacatcatgttaaaagaaagcagaaacagaggagatctgctatgttttaacataacctggcggcagcgcaaaagatg

SEQ ID NO: 78727 - DNA, 103 bp, Artificial Sequence
  Synthetic Polynucleotide
taatacgactcactatagggaatttagagattacatcatgttaaaagaaaaacagaggagatttcttatgacatgatgtaacctggcggcagcgcaaaagatg

SEQ ID NO: 78728 - DNA, 103 bp, Artificial Sequence
  Synthetic Polynucleotide
taatacgactcactatagggcaatgaatttagagattacatcatgttaaaaacagaggagatttaacatgatgtaatctaacctggcggcagcgcaaaagatg

SEQ ID NO: 78729 - DNA, 103 bp, Artificial Sequence
  Synthetic Polynucleotide
taatacgactcactatagggtttgccaatgaatttagagattacatcatgaacagaggagacatgatatgatctctaaaaacctggcggcagcgcaaaagatg

SEQ ID NO: 78730 - DNA, 103 bp, Artificial Sequence
  Synthetic Polynucleotide
taatacgactcactataggggacaatttgccaatgaatttagagattacaaacagaggagatgtaatatgtaaattcataacctggcggcagcgcaaaagatg

SEQ ID NO: 78731 - DNA, 103 bp, Artificial Sequence
  Synthetic Polynucleotide
taatacgactcactatagggatatagacaatttgccaatgaatttagagaaacagaggagatctctaatgtcattggcaaacctggcggcagcgcaaaagatg

SEQ ID NO: 78732 - DNA, 103 bp, Artificial Sequence
  Synthetic Polynucleotide
taatacgactcactatagggtttagatatagacaatttgccaatgaatttaacagaggagaaaattcatgggcaaattgaacctggcggcagcgcaaaagatg

SEQ ID NO: 78733 - DNA, 103 bp, Artificial Sequence
  Synthetic Polynucleotide
taatacgactcactatagggatgattttagatatagacaatttgccaatgaacagaggagacattggatgattgtctataacctggcggcagcgcaaaagatg

SEQ ID NO: 78734 - DNA, 103 bp, Artificial Sequence
  Synthetic Polynucleotide
taatacgactcactatagggatattatgattttagatatagacaatttgcaacagaggagagcaaatatgctatatctaaacctggcggcagcgcaaaagatg

SEQ ID NO: 78735 - DNA, 103 bp, Artificial Sequence
  Synthetic Polynucleotide
taatacgactcactatagggcaagtttatagaacatctgggtgatggcataacagaggagaatgccaatgcccagatgtaacctggcggcagcgcaaaagatg

SEQ ID NO: 78736 - DNA, 103 bp, Artificial Sequence
  Synthetic Polynucleotide
taatacgactcactatagggatctcatattatgattttagatatagacaaaacagaggagattgtctatgtctaaaatcaacctggcggcagcgcaaaagatg

SEQ ID NO: 78737 - DNA, 103 bp, Artificial Sequence
  Synthetic Polynucleotide
taatacgactcactatagggtaaacatctcatattatgattttagatataaacagaggagatatatcatgaatcataataacctggcggcagcgcaaaagatg

SEQ ID NO: 78738 - DNA, 103 bp, Artificial Sequence
  Synthetic Polynucleotide
taatacgactcactatagggagaggtaaacatctcatattatgattttagaacagaggagactaaaaatgtaatatgagaacctggcggcagcgcaaaagatg

SEQ ID NO: 78739 - DNA, 103 bp, Artificial Sequence
  Synthetic Polynucleotide
taatacgactcactatagggtttgtagaggtaaacatctcatattatgataacagaggagaatcataatgtgagatgttaacctggcggcagcgcaaaagatg

SEQ ID NO: 78740 - DNA, 103 bp, Artificial Sequence
  Synthetic Polynucleotide
taatacgactcactatagggagatatttgtagaggtaaacatctcatattaacagaggagaaatatgatgtgtttacctaacctggcggcagcgcaaaagatg

SEQ ID NO: 78741 - DNA, 103 bp, Artificial Sequence
  Synthetic Polynucleotide
taatacgactcactatagggcgaacagatatttgtagaggtaaacatctcaacagaggagagagatgatgacctctacaaacctggcggcagcgcaaaagatg

SEQ ID NO: 78742 - DNA, 103 bp, Artificial Sequence
  Synthetic Polynucleotide
taatacgactcactatagggttggacgaacagatatttgtagaggtaaacaacagaggagagtttacatgtacaaatataacctggcggcagcgcaaaagatg

SEQ ID NO: 78743 - DNA, 103 bp, Artificial Sequence
  Synthetic Polynucleotide
taatacgactcactatagggtaacattggacgaacagatatttgtagaggaacagaggagacctctaatgatatctgttaacctggcggcagcgcaaaagatg

SEQ ID NO: 78744 - DNA, 103 bp, Artificial Sequence
  Synthetic Polynucleotide
taatacgactcactatagggtactctaacattggacgaacagatatttgtaacagaggagaacaaatatgtgttcgtccaacctggcggcagcgcaaaagatg

SEQ ID NO: 78745 - DNA, 103 bp, Artificial Sequence
  Synthetic Polynucleotide
taatacgactcactataggggtagatactctaacattggacgaacagataaacagaggagatatctgatggtccaatgtaacctggcggcagcgcaaaagatg

SEQ ID NO: 78746 - DNA, 103 bp, Artificial Sequence
  Synthetic Polynucleotide
taatacgactcactatagggtatgccaagtttatagaacatctgggtgataacagaggagaatcaccatgatgttctataacctggcggcagcgcaaaagatg

SEQ ID NO: 78747 - DNA, 103 bp, Artificial Sequence
  Synthetic Polynucleotide
taatacgactcactatagggctgatgtagatactctaacattggacgaacaacagaggagagttcgtatgatgttagagaacctggcggcagcgcaaaagatg

SEQ ID NO: 78748 - DNA, 103 bp, Artificial Sequence
  Synthetic Polynucleotide
taatacgactcactatagggcaagactgatgtagatactctaacattggaaacagaggagatccaatatgagagtatctaacctggcggcagcgcaaaagatg

SEQ ID NO: 78749 - DNA, 103 bp, Artificial Sequence
  Synthetic Polynucleotide
taatacgactcactataggggaatacaagactgatgtagatactctaacaaacagaggagatgttagatgatctacatcaacctggcggcagcgcaaaagatg

SEQ ID NO: 78750 - DNA, 103 bp, Artificial Sequence
  Synthetic Polynucleotide
taatacgactcactatagggatttggaatacaagactgatgtagatactcaacagaggagagagtatatgcatcagtctaacctggcggcagcgcaaaagatg

SEQ ID NO: 78751 - DNA, 103 bp, Artificial Sequence
  Synthetic Polynucleotide
taatacgactcactataggggtttaatttggaatacaagactgatgtagaaacagaggagatctacaatggtcttgtataacctggcggcagcgcaaaagatg

SEQ ID NO: 78752 - DNA, 103 bp, Artificial Sequence
  Synthetic Polynucleotide
taatacgactcactataggggccatgtttaatttggaatacaagactgataacagaggagaatcagtatggtattccaaaacctggcggcagcgcaaaagatg

SEQ ID NO: 78753 - DNA, 103 bp, Artificial Sequence
  Synthetic Polynucleotide
taatacgactcactatagggccgttgccatgtttaatttggaatacaagaaacagaggagatcttgtatgccaaattaaaacctggcggcagcgcaaaagatg

SEQ ID NO: 78754 - DNA, 103 bp, Artificial Sequence
  Synthetic Polynucleotide
taatacgactcactatagggtaaatccgttgccatgtttaatttggaataaacagaggagatattccatgttaaacatgaacctggcggcagcgcaaaagatg

SEQ ID NO: 78755 - DNA, 103 bp, Artificial Sequence
  Synthetic Polynucleotide
taatacgactcactatagggaaaattaaatccgttgccatgtttaatttgaacagaggagacaaattatgcatggcaacaacctggcggcagcgcaaaagatg

SEQ ID NO: 78756 - DNA, 103 bp, Artificial Sequence
  Synthetic Polynucleotide
taatacgactcactatagggaatataaaattaaatccgttgccatgtttaaacagaggagataaacaatgcaacggattaacctggcggcagcgcaaaagatg

SEQ ID NO: 78757 - DNA, 103 bp, Artificial Sequence
  Synthetic Polynucleotide
taatacgactcactatagggacgagtatgccaagtttatagaacatctggaacagaggagaccagatatgctataaactaacctggcggcagcgcaaaagatg

SEQ ID NO: 78758 - DNA, 103 bp, Artificial Sequence
  Synthetic Polynucleotide
taatacgactcactatagggagaggaatataaaattaaatccgttgccataacagaggagaatggcaatggatttaattaacctggcggcagcgcaaaagatg

SEQ ID NO: 78759 - DNA, 103 bp, Artificial Sequence
  Synthetic Polynucleotide
taatacgactcactatagggctaatagaggaatataaaattaaatccgttaacagaggagaaacggaatgaattttataaacctggcggcagcgcaaaagatg

SEQ ID NO: 78760 - DNA, 103 bp, Artificial Sequence
  Synthetic Polynucleotide
taatacgactcactatagggaggacctaatagaggaatataaaattaaataacagaggagaatttaaatgtatattcctaacctggcggcagcgcaaaagatg

SEQ ID NO: 78761 - DNA, 103 bp, Artificial Sequence
  Synthetic Polynucleotide
taatacgactcactatagggcgacaaggacctaatagaggaatataaaataacagaggagaattttaatgtcctctattaacctggcggcagcgcaaaagatg

SEQ ID NO: 78762 - DNA, 103 bp, Artificial Sequence
  Synthetic Polynucleotide
taatacgactcactatagggattgtcgacaaggacctaatagaggaatataacagaggagaatattcatgtattaggtcaacctggcggcagcgcaaaagatg

SEQ ID NO: 78763 - DNA, 103 bp, Artificial Sequence
  Synthetic Polynucleotide
taatacgactcactatagggctgttattgtcgacaaggacctaatagaggaacagaggagacctctaatgggtccttgtaacctggcggcagcgcaaaagatg

SEQ ID NO: 78764 - DNA, 103 bp, Artificial Sequence
  Synthetic Polynucleotide
taatacgactcactataggggcactctgttattgtcgacaaggacctaataacagaggagaattaggatgttgtcgacaaacctggcggcagcgcaaaagatg

SEQ ID NO: 78765 - DNA, 103 bp, Artificial Sequence
  Synthetic Polynucleotide
taatacgactcactatagggtatctgcactctgttattgtcgacaaggacaacagaggagagtccttatggacaataacaacctggcggcagcgcaaaagatg

SEQ ID NO: 78766 - DNA, 103 bp, Artificial Sequence
  Synthetic Polynucleotide
taatacgactcactatagggatgattatctgcactctgttattgtcgacaaacagaggagatgtcgaatgtaacagagtaacctggcggcagcgcaaaagatg

SEQ ID NO: 78767 - DNA, 103 bp, Artificial Sequence
  Synthetic Polynucleotide
taatacgactcactatagggattaaatgattatctgcactctgttattgtaacagaggagaacaataatggagtgcagaaacctggcggcagcgcaaaagatg

SEQ ID NO: 78768 - DNA, 103 bp, Artificial Sequence
  Synthetic Polynucleotide
taatacgactcactatagggatcggacgagtatgccaagtttatagaacaaacagaggagatgttctatgaacttggcaaacctggcggcagcgcaaaagatg

SEQ ID NO: 78769 - DNA, 103 bp, Artificial Sequence
  Synthetic Polynucleotide
taatacgactcactataggggacggattaaatgattatctgcactctgttaacagaggagaaacagaatgcagataatcaacctggcggcagcgcaaaagatg

SEQ ID NO: 78770 - DNA, 103 bp, Artificial Sequence
  Synthetic Polynucleotide
taatacgactcactatagggtgtacgacggattaaatgattatctgcactaacagaggagaagtgcaatgaatcatttaaacctggcggcagcgcaaaagatg

SEQ ID NO: 78771 - DNA, 103 bp, Artificial Sequence
  Synthetic Polynucleotide
taatacgactcactatagggaaccatgtacgacggattaaatgattatctaacagaggagaagataaatgtttaatccgaacctggcggcagcgcaaaagatg

SEQ ID NO: 78772 - DNA, 103 bp, Artificial Sequence
  Synthetic Polynucleotide
taatacgactcactatagggcttccaaccatgtacgacggattaaatgataacagaggagaatcattatgtccgtcgtaaacctggcggcagcgcaaaagatg

SEQ ID NO: 78773 - DNA, 103 bp, Artificial Sequence
  Synthetic Polynucleotide
taatacgactcactatagggcgcatcttccaaccatgtacgacggattaaaacagaggagattaatcatgcgtacatggaacctggcggcagcgcaaaagatg

SEQ ID NO: 78774 - DNA, 103 bp, Artificial Sequence
  Synthetic Polynucleotide
taatacgactcactatagggtaatgcgcatcttccaaccatgtacgacggaacagaggagaccgtcgatgatggttggaaacctggcggcagcgcaaaagatg

SEQ ID NO: 78775 - DNA, 103 bp, Artificial Sequence
  Synthetic Polynucleotide
taatacgactcactatagggtttgttaatgcgcatcttccaaccatgtacaacagaggagagtacatatgtggaagatgaacctggcggcagcgcaaaagatg

SEQ ID NO: 78776 - DNA, 103 bp, Artificial Sequence
  Synthetic Polynucleotide
taatacgactcactatagggaagattttgttaatgcgcatcttccaaccaaacagaggagatggttgatggatgcgcataacctggcggcagcgcaaaagatg

SEQ ID NO: 78777 - DNA, 103 bp, Artificial Sequence
  Synthetic Polynucleotide
taatacgactcactatagggaattaaagattttgttaatgcgcatcttccaacagaggagaggaagaatggcattaacaaacctggcggcagcgcaaaagatg

SEQ ID NO: 78778 - DNA, 103 bp, Artificial Sequence
  Synthetic Polynucleotide
taatacgactcactatagggaagacaattaaagattttgttaatgcgcataacagaggagaatgcgcatgaacaaaatcaacctggcggcagcgcaaaagatg

SEQ ID NO: 78779 - DNA, 103 bp, Artificial Sequence
  Synthetic Polynucleotide
taatacgactcactatagggatgaaatcggacgagtatgccaagtttataaacagaggagatataaaatgggcatactcaacctggcggcagcgcaaaagatg

SEQ ID NO: 78780 - DNA, 103 bp, Artificial Sequence
  Synthetic Polynucleotide
taatacgactcactatagggtcatcaagacaattaaagattttgttaatgaacagaggagacattaaatgaatctttaaaacctggcggcagcgcaaaagatg

SEQ ID NO: 78781 - DNA, 103 bp, Artificial Sequence
  Synthetic Polynucleotide
taatacgactcactatagggcaccttcatcaagacaattaaagattttgtaacagaggagaacaaaaatgttaattgtcaacctggcggcagcgcaaaagatg

SEQ ID NO: 78782 - DNA, 103 bp, Artificial Sequence
  Synthetic Polynucleotide
taatacgactcactatagggagtcccaccttcatcaagacaattaaagataacagaggagaatctttatgtgtcttgataacctggcggcagcgcaaaagatg

SEQ ID NO: 78783 - DNA, 103 bp, Artificial Sequence
  Synthetic Polynucleotide
taatacgactcactataggggatatagtcccaccttcatcaagacaattaaacagaggagataattgatgtgatgaaggaacctggcggcagcgcaaaagatg

SEQ ID NO: 78784 - DNA, 103 bp, Artificial Sequence
  Synthetic Polynucleotide
taatacgactcactatagggtgttagatatagtcccaccttcatcaagacaacagaggagagtcttgatgaaggtgggaaacctggcggcagcgcaaaagatg

SEQ ID NO: 78785 - DNA, 103 bp, Artificial Sequence
  Synthetic Polynucleotide
taatacgactcactatagggcaagatgttagatatagtcccaccttcatcaacagaggagagatgaaatggggactataaacctggcggcagcgcaaaagatg

SEQ ID NO: 78786 - DNA, 103 bp, Artificial Sequence
  Synthetic Polynucleotide
taatacgactcactatagggttaatcaagatgttagatatagtcccacctaacagaggagaaggtggatgtatatctaaaacctggcggcagcgcaaaagatg

SEQ ID NO: 78787 - DNA, 103 bp, Artificial Sequence
  Synthetic Polynucleotide
taatacgactcactatagggttttattaatcaagatgttagatatagtccaacagaggagaggactaatgctaacatctaacctggcggcagcgcaaaagatg

SEQ ID NO: 78788 - DNA, 103 bp, Artificial Sequence
  Synthetic Polynucleotide
taatacgactcactatagggataaattttattaatcaagatgttagatataacagaggagaatatctatgatcttgattaacctggcggcagcgcaaaagatg

SEQ ID NO: 78789 - DNA, 103 bp, Artificial Sequence
  Synthetic Polynucleotide
taatacgactcactatagggatgttataaattttattaatcaagatgttaaacagaggagataacatatggattaataaaacctggcggcagcgcaaaagatg

SEQ ID NO: 78790 - DNA, 103 bp, Artificial Sequence
  Synthetic Polynucleotide
taatacgactcactatagggaatgactccatgaaaaccgccaaagaacttaacagaggagaaagttcatgggcggttttaacctggcggcagcgcaaaagatg

SEQ ID NO: 78791 - DNA, 103 bp, Artificial Sequence
  Synthetic Polynucleotide
taatacgactcactatagggaggatatgaaatcggacgagtatgccaagtaacagaggagaacttggatgactcgtccgaacctggcggcagcgcaaaagatg

SEQ ID NO: 78792 - DNA, 103 bp, Artificial Sequence
  Synthetic Polynucleotide
taatacgactcactatagggggaaaatgttataaattttattaatcaagaaacagaggagatcttgaatgataaaatttaacctggcggcagcgcaaaagatg

SEQ ID NO: 78793 - DNA, 103 bp, Artificial Sequence
  Synthetic Polynucleotide
taatacgactcactatagggcctatggaaaatgttataaattttattaataacagaggagaattaatatgatttataacaacctggcggcagcgcaaaagatg

SEQ ID NO: 78794 - DNA, 103 bp, Artificial Sequence
  Synthetic Polynucleotide
taatacgactcactatagggagtatcctatggaaaatgttataaattttaaacagaggagataaaatatgtaacattttaacctggcggcagcgcaaaagatg

SEQ ID NO: 78795 - DNA, 103 bp, Artificial Sequence
  Synthetic Polynucleotide
taatacgactcactatagggtacaaagtatcctatggaaaatgttataaaaacagaggagatttataatgttttccataaacctggcggcagcgcaaaagatg

SEQ ID NO: 78796 - DNA, 103 bp, Artificial Sequence
  Synthetic Polynucleotide
taatacgactcactatagggctagttacaaagtatcctatggaaaatgttaacagaggagaaacattatgcataggataaacctggcggcagcgcaaaagatg

SEQ ID NO: 78797 - DNA, 103 bp, Artificial Sequence
  Synthetic Polynucleotide
taatacgactcactatagggtaaagctagttacaaagtatcctatggaaaaacagaggagatttccaatggatactttgaacctggcggcagcgcaaaagatg

SEQ ID NO: 78798 - DNA, 103 bp, Artificial Sequence
  Synthetic Polynucleotide
taatacgactcactataggggtgtataaagctagttacaaagtatcctataacagaggagaataggaatgtttgtaactaacctggcggcagcgcaaaagatg

SEQ ID NO: 78799 - DNA, 103 bp, Artificial Sequence
  Synthetic Polynucleotide
taatacgactcactataggggagatgtgtataaagctagttacaaagtataacagaggagaatacttatgaactagcttaacctggcggcagcgcaaaagatg

SEQ ID NO: 78800 - DNA, 103 bp, Artificial Sequence
  Synthetic Polynucleotide
taatacgactcactatagggatgaagagatgtgtataaagctagttacaaaacagaggagattgtaaatggctttatacaacctggcggcagcgcaaaagatg

SEQ ID NO: 78801 - DNA, 103 bp, Artificial Sequence
  Synthetic Polynucleotide
taatacgactcactatagggtacagatgaagagatgtgtataaagctagtaacagaggagaactagcatgatacacatcaacctggcggcagcgcaaaagatg

SEQ ID NO: 78802 - DNA, 103 bp, Artificial Sequence
  Synthetic Polynucleotide
taatacgactcactatagggggcaaaggatatgaaatcggacgagtatgcaacagaggagagcatacatgtccgatttcaacctggcggcagcgcaaaagatg

SEQ ID NO: 78803 - DNA, 103 bp, Artificial Sequence
  Synthetic Polynucleotide
taatacgactcactatagggaaacttacagatgaagagatgtgtataaagaacagaggagactttatatgcatctcttcaacctggcggcagcgcaaaagatg

SEQ ID NO: 78804 - DNA, 103 bp, Artificial Sequence
  Synthetic Polynucleotide
taatacgactcactatagggtgtctaaacttacagatgaagagatgtgtaaacagaggagatacacaatgcttcatctgaacctggcggcagcgcaaaagatg

SEQ ID NO: 78805 - DNA, 103 bp, Artificial Sequence
  Synthetic Polynucleotide
taatacgactcactatagggtattctgtctaaacttacagatgaagagataacagaggagaatctctatgtctgtaagtaacctggcggcagcgcaaaagatg

SEQ ID NO: 78806 - DNA, 103 bp, Artificial Sequence
  Synthetic Polynucleotide
taatacgactcactatagggcacgatattctgtctaaacttacagatgaaaacagaggagattcatcatgaagtttagaaacctggcggcagcgcaaaagatg

SEQ ID NO: 78807 - DNA, 103 bp, Artificial Sequence
  Synthetic Polynucleotide
taatacgactcactatagggctgttcacgatattctgtctaaacttacagaacagaggagactgtaaatgtagacagaaaacctggcggcagcgcaaaagatg

SEQ ID NO: 78808 - DNA, 103 bp, Artificial Sequence
  Synthetic Polynucleotide
taatacgactcactatagggaccacctgttcacgatattctgtctaaactaacagaggagaagtttaatgagaatatcgaacctggcggcagcgcaaaagatg

SEQ ID NO: 78809 - DNA, 103 bp, Artificial Sequence
  Synthetic Polynucleotide
taatacgactcactatagggaatataccacctgttcacgatattctgtctaacagaggagaagacagatgatcgtgaacaacctggcggcagcgcaaaagatg

SEQ ID NO: 78810 - DNA, 103 bp, Artificial Sequence
  Synthetic Polynucleotide
taatacgactcactatagggaatataatataccacctgttcacgatattcaacagaggagagaatatatggaacaggtgaacctggcggcagcgcaaaagatg

SEQ ID NO: 78811 - DNA, 103 bp, Artificial Sequence
  Synthetic Polynucleotide
taatacgactcactatagggtgatgaatataatataccacctgttcacgaaacagaggagatcgtgaatgggtggtataaacctggcggcagcgcaaaagatg

SEQ ID NO: 78812 - DNA, 103 bp, Artificial Sequence
  Synthetic Polynucleotide
taatacgactcactatagggatatctgatgaatataatataccacctgttaacagaggagaaacaggatgtatattataaacctggcggcagcgcaaaagatg

SEQ ID NO: 78813 - DNA, 103 bp, Artificial Sequence
  Synthetic Polynucleotide
taatacgactcactatagggtggttggcaaaggatatgaaatcggacgagaacagaggagactcgtcatgtttcatatcaacctggcggcagcgcaaaagatg

SEQ ID NO: 78814 - DNA, 103 bp, Artificial Sequence
  Synthetic Polynucleotide
taatacgactcactatagggttcgtatatctgatgaatataatataccacaacagaggagagtggtaatgtatattcataacctggcggcagcgcaaaagatg

SEQ ID NO: 78815 - DNA, 103 bp, Artificial Sequence
  Synthetic Polynucleotide
taatacgactcactatagggtattcttcgtatatctgatgaatataatataacagaggagaatattaatgtcatcagataacctggcggcagcgcaaaagatg

SEQ ID NO: 78816 - DNA, 103 bp, Artificial Sequence
  Synthetic Polynucleotide
taatacgactcactatagggaacattattcttcgtatatctgatgaatataacagaggagaatattcatgagatatacgaacctggcggcagcgcaaaagatg

SEQ ID NO: 78817 - DNA, 103 bp, Artificial Sequence
  Synthetic Polynucleotide
taatacgactcactatagggatttgaacattattcttcgtatatctgatgaacagaggagacatcagatgtacgaagaaaacctggcggcagcgcaaaagatg

SEQ ID NO: 78818 - DNA, 103 bp, Artificial Sequence
  Synthetic Polynucleotide
taatacgactcactatagggtctagatttgaacattattcttcgtatatcaacagaggagagatataatgagaataatgaacctggcggcagcgcaaaagatg

SEQ ID NO: 78819 - DNA, 103 bp, Artificial Sequence
  Synthetic Polynucleotide
taatacgactcactatagggaacaatctagatttgaacattattcttcgtaacagaggagaacgaagatgaatgttcaaaacctggcggcagcgcaaaagatg

SEQ ID NO: 78820 - DNA, 103 bp, Artificial Sequence
  Synthetic Polynucleotide
taatacgactcactatagggtattaaacaatctagatttgaacattattcaacagaggagagaataaatgtcaaatctaaacctggcggcagcgcaaaagatg

SEQ ID NO: 78821 - DNA, 103 bp, Artificial Sequence
  Synthetic Polynucleotide
taatacgactcactatagggtaatatattaaacaatctagatttgaacataacagaggagaatgttcatgtctagattgaacctggcggcagcgcaaaagatg

SEQ ID NO: 78822 - DNA, 103 bp, Artificial Sequence
  Synthetic Polynucleotide
taatacgactcactatagggctatataatatattaaacaatctagatttgaacagaggagacaaatcatgattgtttaaaacctggcggcagcgcaaaagatg

SEQ ID NO: 78823 - DNA, 103 bp, Artificial Sequence
  Synthetic Polynucleotide
taatacgactcactatagggtacatctatataatatattaaacaatctagaacagaggagactagatatgttaatatataacctggcggcagcgcaaaagatg

SEQ ID NO: 78824 - DNA, 103 bp, Artificial Sequence
  Synthetic Polynucleotide
taatacgactcactatagggtgtattggttggcaaaggatatgaaatcggaacagaggagaccgattatgtatcctttgaacctggcggcagcgcaaaagatg

SEQ ID NO: 78825 - DNA, 103 bp, Artificial Sequence
  Synthetic Polynucleotide
taatacgactcactatagggtacactacatctatataatatattaaacaaaacagaggagattgtttatgatattatataacctggcggcagcgcaaaagatg

SEQ ID NO: 78826 - DNA, 103 bp, Artificial Sequence
  Synthetic Polynucleotide
taatacgactcactatagggggagctacactacatctatataatatattaaacagaggagataatatatgatatagatgaacctggcggcagcgcaaaagatg

SEQ ID NO: 78827 - DNA, 103 bp, Artificial Sequence
  Synthetic Polynucleotide
taatacgactcactatagggctgtaggagctacactacatctatataataaacagaggagatattatatggatgtagtgaacctggcggcagcgcaaaagatg

SEQ ID NO: 78828 - DNA, 103 bp, Artificial Sequence
  Synthetic Polynucleotide
taatacgactcactatagggtattcctgtaggagctacactacatctataaacagaggagatatagaatgagtgtagctaacctggcggcagcgcaaaagatg

SEQ ID NO: 78829 - DNA, 103 bp, Artificial Sequence
  Synthetic Polynucleotide
taatacgactcactatagggaaagatattcctgtaggagctacactacataacagaggagaatgtagatgagctcctacaacctggcggcagcgcaaaagatg

SEQ ID NO: 78830 - DNA, 103 bp, Artificial Sequence
  Synthetic Polynucleotide
taatacgactcactatagggtagttaaagatattcctgtaggagctacacaacagaggagagtgtagatgctacaggaaaacctggcggcagcgcaaaagatg

SEQ ID NO: 78831 - DNA, 103 bp, Artificial Sequence
  Synthetic Polynucleotide
taatacgactcactatagggtgacttagttaaagatattcctgtaggagcaacagaggagagctcctatgggaatatctaacctggcggcagcgcaaaagatg

SEQ ID NO: 78832 - DNA, 103 bp, Artificial Sequence
  Synthetic Polynucleotide
taatacgactcactatagggataattgacttagttaaagatattcctgtaaacagaggagatacaggatgatctttaacaacctggcggcagcgcaaaagatg

SEQ ID NO: 78833 - DNA, 103 bp, Artificial Sequence
  Synthetic Polynucleotide
taatacgactcactatagggatgaaataattgacttagttaaagatattcaacagaggagagaatatatgtaactaagtaacctggcggcagcgcaaaagatg

SEQ ID NO: 78834 - DNA, 103 bp, Artificial Sequence
  Synthetic Polynucleotide
taatacgactcactatagggggttgatgaaataattgacttagttaaagaaacagaggagatctttaatgaagtcaattaacctggcggcagcgcaaaagatg

SEQ ID NO: 78835 - DNA, 103 bp, Artificial Sequence
  Synthetic Polynucleotide
taatacgactcactatagggctatatgtattggttggcaaaggatatgaaaacagaggagattcataatgtttgccaacaacctggcggcagcgcaaaagatg

SEQ ID NO: 78836 - DNA, 103 bp, Artificial Sequence
  Synthetic Polynucleotide
taatacgactcactatagggctaacggttgatgaaataattgacttagttaacagaggagaaactaaatgaattatttcaacctggcggcagcgcaaaagatg

SEQ ID NO: 78837 - DNA, 103 bp, Artificial Sequence
  Synthetic Polynucleotide
taatacgactcactatagggtagatctaacggttgatgaaataattgactaacagaggagaagtcaaatgtttcatcaaaacctggcggcagcgcaaaagatg

SEQ ID NO: 78838 - DNA, 103 bp, Artificial Sequence
  Synthetic Polynucleotide
taatacgactcactatagggtaaaatagatctaacggttgatgaaataataacagaggagaattattatgtcaaccgttaacctggcggcagcgcaaaagatg

SEQ ID NO: 78839 - DNA, 103 bp, Artificial Sequence
  Synthetic Polynucleotide
taatacgactcactatagggaactttaaaatagatctaacggttgatgaaaacagaggagattcatcatgcgttagatcaacctggcggcagcgcaaaagatg

SEQ ID NO: 78840 - DNA, 103 bp, Artificial Sequence
  Synthetic Polynucleotide
taatacgactcactatagggtgattaactttaaaatagatctaacggttgaacagaggagacaaccgatggatctatttaacctggcggcagcgcaaaagatg

SEQ ID NO: 78841 - DNA, 103 bp, Artificial Sequence
  Synthetic Polynucleotide
taatacgactcactatagggctatatgattaactttaaaatagatctaacaacagaggagagttagaatgattttaaagaacctggcggcagcgcaaaagatg

SEQ ID NO: 78842 - DNA, 103 bp, Artificial Sequence
  Synthetic Polynucleotide
taatacgactcactatagggaatgcctatatgattaactttaaaatagataacagaggagaatctatatgaaagttaataacctggcggcagcgcaaaagatg

SEQ ID NO: 78843 - DNA, 103 bp, Artificial Sequence
  Synthetic Polynucleotide
taatacgactcactatagggaaatcaatgcctatatgattaactttaaaaaacagaggagattttaaatgtaatcatataacctggcggcagcgcaaaagatg

SEQ ID NO: 78844 - DNA, 103 bp, Artificial Sequence
  Synthetic Polynucleotide
taatacgactcactatagggtttaaaaatcaatgcctatatgattaacttaacagaggagaaagttaatgatataggcaaacctggcggcagcgcaaaagatg

SEQ ID NO: 78845 - DNA, 103 bp, Artificial Sequence
  Synthetic Polynucleotide
taatacgactcactatagggtaccttttaaaaatcaatgcctatatgattaacagaggagaaatcatatgggcattgataacctggcggcagcgcaaaagatg

SEQ ID NO: 78846 - DNA, 103 bp, Artificial Sequence
  Synthetic Polynucleotide
taatacgactcactatagggtttagctatatgtattggttggcaaaggataacagaggagaatccttatgcaaccaataaacctggcggcagcgcaaaagatg

SEQ ID NO: 78847 - DNA, 103 bp, Artificial Sequence
  Synthetic Polynucleotide
taatacgactcactatagggctacataccttttaaaaatcaatgcctataaacagaggagatataggatgtgatttttaaacctggcggcagcgcaaaagatg

SEQ ID NO: 78848 - DNA, 103 bp, Artificial Sequence
  Synthetic Polynucleotide
taatacgactcactatagggcaaggctacataccttttaaaaatcaatgcaacagaggagagcattgatgtttaaaaggaacctggcggcagcgcaaaagatg

SEQ ID NO: 78849 - DNA, 103 bp, Artificial Sequence
  Synthetic Polynucleotide
taatacgactcactataggggtaatcaaggctacataccttttaaaaatcaacagaggagagattttatgaaggtatgtaacctggcggcagcgcaaaagatg

SEQ ID NO: 78850 - DNA, 103 bp, Artificial Sequence
  Synthetic Polynucleotide
taatacgactcactatagggagaatgtaatcaaggctacataccttttaaaacagaggagattaaaaatgatgtagcctaacctggcggcagcgcaaaagatg

SEQ ID NO: 78851 - DNA, 103 bp, Artificial Sequence
  Synthetic Polynucleotide
taatacgactcactatagggtaatgagaatgtaatcaaggctacatacctaacagaggagaaggtatatggccttgattaacctggcggcagcgcaaaagatg

SEQ ID NO: 78852 - DNA, 103 bp, Artificial Sequence
  Synthetic Polynucleotide
taatacgactcactatagggttaattaatgagaatgtaatcaaggctacaaacagaggagatgtagcatggattacattaacctggcggcagcgcaaaagatg

SEQ ID NO: 78853 - DNA, 103 bp, Artificial Sequence
  Synthetic Polynucleotide
taatacgactcactatagggaatggttaattaatgagaatgtaatcaaggaacagaggagaccttgaatgcattctcataacctggcggcagcgcaaaagatg

SEQ ID NO: 78854 - DNA, 103 bp, Artificial Sequence
  Synthetic Polynucleotide
taatacgactcactatagggcttggaatggttaattaatgagaatgtaataacagaggagaattacaatgtcattaattaacctggcggcagcgcaaaagatg

SEQ ID NO: 78855 - DNA, 103 bp, Artificial Sequence
  Synthetic Polynucleotide
taatacgactcactatagggagtgacttggaatggttaattaatgagaataacagaggagaattctcatgaattaaccaaacctggcggcagcgcaaaagatg

SEQ ID NO: 78856 - DNA, 103 bp, Artificial Sequence
  Synthetic Polynucleotide
taatacgactcactatagggcacatagtgacttggaatggttaattaatgaacagaggagacattaaatgaccattccaaacctggcggcagcgcaaaagatg

SEQ ID NO: 78857 - DNA, 103 bp, Artificial Sequence
  Synthetic Polynucleotide
taatacgactcactatagggctaagtttagctatatgtattggttggcaaaacagaggagattgccaatgaatacatataacctggcggcagcgcaaaagatg

SEQ ID NO: 78858 - DNA, 103 bp, Artificial Sequence
  Synthetic Polynucleotide
taatacgactcactatagggtcttacacatagtgacttggaatggttaataacagaggagaattaacatgtccaagtcaaacctggcggcagcgcaaaagatg

SEQ ID NO: 78859 - DNA, 103 bp, Artificial Sequence
  Synthetic Polynucleotide
taatacgactcactatagggaatcttcttacacatagtgacttggaatggaacagaggagaccattcatggtcactatgaacctggcggcagcgcaaaagatg

SEQ ID NO: 78860 - DNA, 103 bp, Artificial Sequence
  Synthetic Polynucleotide
taatacgactcactatagggaatataatcttcttacacatagtgacttggaacagaggagaccaagtatgtatgtgtaaaacctggcggcagcgcaaaagatg

SEQ ID NO: 78861 - DNA, 103 bp, Artificial Sequence
  Synthetic Polynucleotide
taatacgactcactataggggatagaatataatcttcttacacatagtgaaacagaggagatcactaatggtaagaagaaacctggcggcagcgcaaaagatg

SEQ ID NO: 78862 - DNA, 103 bp, Artificial Sequence
  Synthetic Polynucleotide
taatacgactcactatagggcttatgatagaatataatcttcttacacataacagaggagaatgtgtatgaagattataaacctggcggcagcgcaaaagatg

SEQ ID NO: 78863 - DNA, 103 bp, Artificial Sequence
  Synthetic Polynucleotide
taatacgactcactatagggtcaagcttatgatagaatataatcttcttaaacagaggagataagaaatgtatattctaaacctggcggcagcgcaaaagatg

SEQ ID NO: 78864 - DNA, 103 bp, Artificial Sequence
  Synthetic Polynucleotide
taatacgactcactatagggtgtagtcaagcttatgatagaatataatctaacagaggagaagattaatgtctatcataaacctggcggcagcgcaaaagatg

SEQ ID NO: 78865 - DNA, 103 bp, Artificial Sequence
  Synthetic Polynucleotide
taatacgactcactatagggccaaatgtagtcaagcttatgatagaatataacagaggagaatattcatgcataagcttaacctggcggcagcgcaaaagatg

SEQ ID NO: 78866 - DNA, 103 bp, Artificial Sequence
  Synthetic Polynucleotide
taatacgactcactatagggcgggaccaaatgtagtcaagcttatgatagaacagaggagactatcaatggcttgactaaacctggcggcagcgcaaaagatg

SEQ ID NO: 78867 - DNA, 103 bp, Artificial Sequence
  Synthetic Polynucleotide
taatacgactcactatagggggtatcgggaccaaatgtagtcaagcttataacagaggagaataagcatgactacatttaacctggcggcagcgcaaaagatg

SEQ ID NO: 78868 - DNA, 103 bp, Artificial Sequence
  Synthetic Polynucleotide
taatacgactcactatagggtatgcctaagtttagctatatgtattggttaacagaggagaaaccaaatgatatagctaaacctggcggcagcgcaaaagatg

SEQ ID NO: 78869 - DNA, 103 bp, Artificial Sequence
  Synthetic Polynucleotide
taatacgactcactatagggttaatggtatcgggaccaaatgtagtcaagaacagaggagacttgacatgatttggtccaacctggcggcagcgcaaaagatg

SEQ ID NO: 78870 - DNA, 103 bp, Artificial Sequence
  Synthetic Polynucleotide
taatacgactcactatagggattctttaatggtatcgggaccaaatgtagaacagaggagactacatatggtcccgataaacctggcggcagcgcaaaagatg

SEQ ID NO: 78871 - DNA, 103 bp, Artificial Sequence
  Synthetic Polynucleotide
taatacgactcactatagggtaagaattctttaatggtatcgggaccaaaaacagaggagatttggtatggataccattaacctggcggcagcgcaaaagatg

SEQ ID NO: 78872 - DNA, 103 bp, Artificial Sequence
  Synthetic Polynucleotide
taatacgactcactatagggtatcataagaattctttaatggtatcgggaaacagaggagatcccgaatgcattaaagaaacctggcggcagcgcaaaagatg

SEQ ID NO: 78873 - DNA, 103 bp, Artificial Sequence
  Synthetic Polynucleotide
taatacgactcactatagggccttatatcataagaattctttaatggtataacagaggagaataccaatgaagaattctaacctggcggcagcgcaaaagatg

SEQ ID NO: 78874 - DNA, 103 bp, Artificial Sequence
  Synthetic Polynucleotide
taatacgactcactatagggtgtttccttatatcataagaattctttaataacagaggagaattaaaatgttcttatgaaacctggcggcagcgcaaaagatg

SEQ ID NO: 78875 - DNA, 103 bp, Artificial Sequence
  Synthetic Polynucleotide
taatacgactcactatagggaaagctgtttccttatatcataagaattctaacagaggagaagaattatgatgatataaaacctggcggcagcgcaaaagatg

SEQ ID NO: 78876 - DNA, 103 bp, Artificial Sequence
  Synthetic Polynucleotide
taatacgactcactatagggacctaaaagctgtttccttatatcataagaaacagaggagatcttatatgataaggaaaaacctggcggcagcgcaaaagatg

SEQ ID NO: 78877 - DNA, 103 bp, Artificial Sequence
  Synthetic Polynucleotide
taatacgactcactatagggtgagtacctaaaagctgtttccttatatcaaacagaggagatgatatatggaaacagctaacctggcggcagcgcaaaagatg

SEQ ID NO: 78878 - DNA, 103 bp, Artificial Sequence
  Synthetic Polynucleotide
taatacgactcactataggggtagatgagtacctaaaagctgtttccttaaacagaggagataaggaatgagcttttagaacctggcggcagcgcaaaagatg

SEQ ID NO: 78879 - DNA, 103 bp, Artificial Sequence
  Synthetic Polynucleotide
taatacgactcactataggggaacatatgcctaagtttagctatatgtataacagaggagaatacatatggctaaacttaacctggcggcagcgcaaaagatg

SEQ ID NO: 78880 - DNA, 103 bp, Artificial Sequence
  Synthetic Polynucleotide
taatacgactcactataggggtagagtagatgagtacctaaaagctgtttaacagaggagaaaacagatgttaggtactaacctggcggcagcgcaaaagatg

SEQ ID NO: 78881 - DNA, 103 bp, Artificial Sequence
  Synthetic Polynucleotide
taatacgactcactatagggttcttgtagagtagatgagtacctaaaagcaacagaggagagcttttatgtactcatctaacctggcggcagcgcaaaagatg

SEQ ID NO: 78882 - DNA, 103 bp, Artificial Sequence
  Synthetic Polynucleotide
taatacgactcactatagggcaaaattcttgtagagtagatgagtacctaaacagaggagataggtaatgatctactctaacctggcggcagcgcaaaagatg

SEQ ID NO: 78883 - DNA, 103 bp, Artificial Sequence
  Synthetic Polynucleotide
taatacgactcactatagggctctccaaaattcttgtagagtagatgagtaacagaggagaactcatatgctctacaagaacctggcggcagcgcaaaagatg

SEQ ID NO: 78884 - DNA, 103 bp, Artificial Sequence
  Synthetic Polynucleotide
taatacgactcactatagggtaaggctctccaaaattcttgtagagtagaaacagaggagatctactatgcaagaatttaacctggcggcagcgcaaaagatg

SEQ ID NO: 78885 - DNA, 103 bp, Artificial Sequence
  Synthetic Polynucleotide
taatacgactcactatagggatcgttaaggctctccaaaattcttgtagaaacagaggagatctacaatgattttggagaacctggcggcagcgcaaaagatg

SEQ ID NO: 78886 - DNA, 103 bp, Artificial Sequence
  Synthetic Polynucleotide
taatacgactcactatagggctgatatcgttaaggctctccaaaattcttaacagaggagaaagaatatgggagagcctaacctggcggcagcgcaaaagatg

SEQ ID NO: 78887 - DNA, 103 bp, Artificial Sequence
  Synthetic Polynucleotide
taatacgactcactatagggcgtcactgatatcgttaaggctctccaaaaaacagaggagattttggatggccttaacgaacctggcggcagcgcaaaagatg

SEQ ID NO: 78888 - DNA, 103 bp, Artificial Sequence
  Synthetic Polynucleotide
taatacgactcactatagggataaacgtcactgatatcgttaaggctctcaacagaggagagagagcatgaacgatatcaacctggcggcagcgcaaaagatg

SEQ ID NO: 78889 - DNA, 103 bp, Artificial Sequence
  Synthetic Polynucleotide
taatacgactcactatagggaaataataaacgtcactgatatcgttaaggaacagaggagaccttaaatgtatcagtgaaacctggcggcagcgcaaaagatg

SEQ ID NO: 78890 - DNA, 103 bp, Artificial Sequence
  Synthetic Polynucleotide
taatacgactcactataggggtgtggaacatatgcctaagtttagctataaacagaggagatatagcatgacttaggcaaacctggcggcagcgcaaaagatg

SEQ ID NO: 78891 - DNA, 103 bp, Artificial Sequence
  Synthetic Polynucleotide
taatacgactcactatagggtcctgaaataataaacgtcactgatatcgtaacagaggagaacgataatggtgacgtttaacctggcggcagcgcaaaagatg

SEQ ID NO: 78892 - DNA, 103 bp, Artificial Sequence
  Synthetic Polynucleotide
taatacgactcactatagggtttcctcctgaaataataaacgtcactgataacagaggagaatcagtatggtttattataacctggcggcagcgcaaaagatg

SEQ ID NO: 78893 - DNA, 103 bp, Artificial Sequence
  Synthetic Polynucleotide
taatacgactcactatagggggttttttcctcctgaaataataaacgtcaaacagaggagatgacgtatgttatttcagaacctggcggcagcgcaaaagatg

SEQ ID NO: 78894 - DNA, 103 bp, Artificial Sequence
  Synthetic Polynucleotide
taatacgactcactatagggtgttaggttttttcctcctgaaataataaaaacagaggagatttattatgtcaggaggaaacctggcggcagcgcaaaagatg

SEQ ID NO: 78895 - DNA, 103 bp, Artificial Sequence
  Synthetic Polynucleotide
taatacgactcactatagggctcaatgttaggttttttcctcctgaaataaacagaggagatatttcatgaggaaaaaaaacctggcggcagcgcaaaagatg

SEQ ID NO: 78896 - DNA, 103 bp, Artificial Sequence
  Synthetic Polynucleotide
taatacgactcactatagggacattctcaatgttaggttttttcctcctgaacagaggagacaggagatgaaaacctaaaacctggcggcagcgcaaaagatg

SEQ ID NO: 78897 - DNA, 103 bp, Artificial Sequence
  Synthetic Polynucleotide
taatacgactcactatagggctccgacattctcaatgttaggttttttccaacagaggagaggaaaaatgctaacattgaacctggcggcagcgcaaaagatg

SEQ ID NO: 78898 - DNA, 103 bp, Artificial Sequence
  Synthetic Polynucleotide
taatacgactcactatagggattaactccgacattctcaatgttaggtttaacagaggagaaaacctatgattgagaataacctggcggcagcgcaaaagatg

SEQ ID NO: 78899 - DNA, 103 bp, Artificial Sequence
  Synthetic Polynucleotide
taatacgactcactatagggaagctattaactccgacattctcaatgttaaacagaggagataacatatggaatgtcggaacctggcggcagcgcaaaagatg

SEQ ID NO: 78900 - DNA, 103 bp, Artificial Sequence
  Synthetic Polynucleotide
taatacgactcactatagggtctggaagctattaactccgacattctcaaaacagaggagattgagaatgtcggagttaaacctggcggcagcgcaaaagatg

SEQ ID NO: 78901 - DNA, 103 bp, Artificial Sequence
  Synthetic Polynucleotide
taatacgactcactatagggaagtttgtcagctcacacaggcgaactactaacagaggagaagtagtatgcctgtgtgaaacctggcggcagcgcaaaagatg

SEQ ID NO: 78902 - DNA, 103 bp, Artificial Sequence
  Synthetic Polynucleotide
taatacgactcactatagggcagctcgcactgtgttaattgttgttaatcaacagaggagagattaaatgcaattaacaaacctggcggcagcgcaaaagatg

SEQ ID NO: 78903 - DNA, 103 bp, Artificial Sequence
  Synthetic Polynucleotide
taatacgactcactatagggtgtgacgtcagtagcatttaccgtcatcataacagaggagaatgatgatggtaaatgctaacctggcggcagcgcaaaagatg

SEQ ID NO: 78904 - DNA, 103 bp, Artificial Sequence
  Synthetic Polynucleotide
taatacgactcactatagggtggtgagcctgatgttccagtggggaagtcaacagaggagagacttcatgactggaacaaacctggcggcagcgcaaaagatg

SEQ ID NO: 78905 - DNA, 103 bp, Artificial Sequence
  Synthetic Polynucleotide
taatacgactcactatagggactattggtgagcctgatgttccagtggggaacagaggagaccccacatgaacatcaggaacctggcggcagcgcaaaagatg

SEQ ID NO: 78906 - DNA, 103 bp, Artificial Sequence
  Synthetic Polynucleotide
taatacgactcactatagggtgtccactattggtgagcctgatgttccagaacagaggagactggaaatgcaggctcacaacctggcggcagcgcaaaagatg

SEQ ID NO: 78907 - DNA, 103 bp, Artificial Sequence
  Synthetic Polynucleotide
taatacgactcactataggggtttttgtccactattggtgagcctgatgtaacagaggagaacatcaatgtcaccaataaacctggcggcagcgcaaaagatg

SEQ ID NO: 78908 - DNA, 103 bp, Artificial Sequence
  Synthetic Polynucleotide
taatacgactcactatagggtcaccgtttttgtccactattggtgagcctaacagaggagaaggctcatgaatagtggaaacctggcggcagcgcaaaagatg

SEQ ID NO: 78909 - DNA, 103 bp, Artificial Sequence
  Synthetic Polynucleotide
taatacgactcactatagggtcacatcaccgtttttgtccactattggtgaacagaggagacaccaaatgtggacaaaaaacctggcggcagcgcaaaagatg

SEQ ID NO: 78910 - DNA, 103 bp, Artificial Sequence
  Synthetic Polynucleotide
taatacgactcactatagggcccaatcacatcaccgtttttgtccactataacagaggagaatagtgatgaaaaacggtaacctggcggcagcgcaaaagatg

SEQ ID NO: 78911 - DNA, 103 bp, Artificial Sequence
  Synthetic Polynucleotide
taatacgactcactatagggtaaagcccaatcacatcaccgtttttgtccaacagaggagaggacaaatgcggtgatgtaacctggcggcagcgcaaaagatg

SEQ ID NO: 78912 - DNA, 103 bp, Artificial Sequence
  Synthetic Polynucleotide
taatacgactcactatagggtgccataaagcccaatcacatcaccgttttaacagaggagaaaaacgatgatgtgattgaacctggcggcagcgcaaaagatg

SEQ ID NO: 78913 - DNA, 103 bp, Artificial Sequence
  Synthetic Polynucleotide
taatacgactcactatagggtccattgccataaagcccaatcacatcaccaacagaggagaggtgatatgattgggcttaacctggcggcagcgcaaaagatg

SEQ ID NO: 78914 - DNA, 103 bp, Artificial Sequence
  Synthetic Polynucleotide
taatacgactcactatagggacatctgtgacgtcagtagcatttaccgtcaacagaggagagacggtatgtgctactgaaacctggcggcagcgcaaaagatg

SEQ ID NO: 78915 - DNA, 103 bp, Artificial Sequence
  Synthetic Polynucleotide
taatacgactcactatagggatgactccattgccataaagcccaatcacaaacagaggagatgtgatatggctttatggaacctggcggcagcgcaaaagatg

SEQ ID NO: 78916 - DNA, 103 bp, Artificial Sequence
  Synthetic Polynucleotide
taatacgactcactataggggcattatgactccattgccataaagcccaaaacagaggagattgggcatgatggcaatgaacctggcggcagcgcaaaagatg

SEQ ID NO: 78917 - DNA, 103 bp, Artificial Sequence
  Synthetic Polynucleotide
taatacgactcactataggggttgggcattatgactccattgccataaagaacagaggagactttatatgaatggagtcaacctggcggcagcgcaaaagatg

SEQ ID NO: 78918 - DNA, 103 bp, Artificial Sequence
  Synthetic Polynucleotide
taatacgactcactataggggagccgttgggcattatgactccattgccaaacagaggagatggcaaatgagtcataataacctggcggcagcgcaaaagatg

SEQ ID NO: 78919 - DNA, 103 bp, Artificial Sequence
  Synthetic Polynucleotide
taatacgactcactatagggtgtatgagccgttgggcattatgactccataacagaggagaatggagatgtaatgcccaaacctggcggcagcgcaaaagatg

SEQ ID NO: 78920 - DNA, 103 bp, Artificial Sequence
  Synthetic Polynucleotide
taatacgactcactataggggcttatgtatgagccgttgggcattatgacaacagaggagagtcataatgcccaacggcaacctggcggcagcgcaaaagatg

SEQ ID NO: 78921 - DNA, 103 bp, Artificial Sequence
  Synthetic Polynucleotide
taatacgactcactatagggatcgcgcttatgtatgagccgttgggcattaacagaggagaaatgccatgcggctcataaacctggcggcagcgcaaaagatg

SEQ ID NO: 78922 - DNA, 103 bp, Artificial Sequence
  Synthetic Polynucleotide
taatacgactcactataggggcactatcgcgcttatgtatgagccgttggaacagaggagaccaacgatgcatacataaaacctggcggcagcgcaaaagatg

SEQ ID NO: 78923 - DNA, 103 bp, Artificial Sequence
  Synthetic Polynucleotide
taatacgactcactatagggaccctgcactatcgcgcttatgtatgagccaacagaggagaggctcaatgataagcgcgaacctggcggcagcgcaaaagatg

SEQ ID NO: 78924 - DNA, 103 bp, Artificial Sequence
  Synthetic Polynucleotide
taatacgactcactatagggctttcaccctgcactatcgcgcttatgtataacagaggagaatacatatgcgcgatagtaacctggcggcagcgcaaaagatg

SEQ ID NO: 78925 - DNA, 103 bp, Artificial Sequence
  Synthetic Polynucleotide
taatacgactcactatagggtgatgacatctgtgacgtcagtagcatttaaacagaggagataaatgatgctgacgtcaaacctggcggcagcgcaaaagatg

SEQ ID NO: 78926 - DNA, 103 bp, Artificial Sequence
  Synthetic Polynucleotide
taatacgactcactatagggccatcctttcaccctgcactatcgcgcttaaacagaggagataagcgatgtagtgcaggaacctggcggcagcgcaaaagatg

SEQ ID NO: 78927 - DNA, 103 bp, Artificial Sequence
  Synthetic Polynucleotide
taatacgactcactatagggctcatccatcctttcaccctgcactatcgcaacagaggagagcgataatgcagggtgaaaacctggcggcagcgcaaaagatg

SEQ ID NO: 78928 - DNA, 103 bp, Artificial Sequence
  Synthetic Polynucleotide
taatacgactcactatagggattggctcatccatcctttcaccctgcactaacagaggagaagtgcaatgtgaaaggataacctggcggcagcgcaaaagatg

SEQ ID NO: 78929 - DNA, 103 bp, Artificial Sequence
  Synthetic Polynucleotide
taatacgactcactatagggctgggattggctcatccatcctttcaccctaacagaggagaagggtgatgggatggatgaacctggcggcagcgcaaaagatg

SEQ ID NO: 78930 - DNA, 103 bp, Artificial Sequence
  Synthetic Polynucleotide
taatacgactcactatagggtccggctgggattggctcatccatcctttcaacagaggagagaaaggatggatgagccaaacctggcggcagcgcaaaagatg

SEQ ID NO: 78931 - DNA, 103 bp, Artificial Sequence
  Synthetic Polynucleotide
taatacgactcactatagggtcgaatccggctgggattggctcatccatcaacagaggagagatggaatggccaatcccaacctggcggcagcgcaaaagatg

SEQ ID NO: 78932 - DNA, 103 bp, Artificial Sequence
  Synthetic Polynucleotide
taatacgactcactatagggcaggttcgaatccggctgggattggctcataacagaggagaatgagcatgtcccagccgaacctggcggcagcgcaaaagatg

SEQ ID NO: 78933 - DNA, 103 bp, Artificial Sequence
  Synthetic Polynucleotide
taatacgactcactatagggcatctcaggttcgaatccggctgggattggaacagaggagaccaatcatggccggattcaacctggcggcagcgcaaaagatg

SEQ ID NO: 78934 - DNA, 103 bp, Artificial Sequence
  Synthetic Polynucleotide
taatacgactcactatagggctcagcatctcaggttcgaatccggctgggaacagaggagacccagcatgattcgaaccaacctggcggcagcgcaaaagatg

SEQ ID NO: 78935 - DNA, 103 bp, Artificial Sequence
  Synthetic Polynucleotide
taatacgactcactatagggttttcctcagcatctcaggttcgaatccggaacagaggagaccggatatgaacctgagaaacctggcggcagcgcaaaagatg

SEQ ID NO: 78936 - DNA, 103 bp, Artificial Sequence
  Synthetic Polynucleotide
taatacgactcactatagggaatcgtgatgacatctgtgacgtcagtagcaacagaggagagctactatggtcacagataacctggcggcagcgcaaaagatg

SEQ ID NO: 78937 - DNA, 103 bp, Artificial Sequence
  Synthetic Polynucleotide
taatacgactcactatagggctgttttttcctcagcatctcaggttcgaaaacagaggagattcgaaatggagatgctgaacctggcggcagcgcaaaagatg

SEQ ID NO: 78938 - DNA, 103 bp, Artificial Sequence
  Synthetic Polynucleotide
taatacgactcactataggggtgatctgttttttcctcagcatctcaggtaacagaggagaacctgaatggctgaggaaaacctggcggcagcgcaaaagatg

SEQ ID NO: 78939 - DNA, 103 bp, Artificial Sequence
  Synthetic Polynucleotide
taatacgactcactataggggtacagtgatctgttttttcctcagcatctaacagaggagaagatgcatgggaaaaaacaacctggcggcagcgcaaaagatg

SEQ ID NO: 78940 - DNA, 103 bp, Artificial Sequence
  Synthetic Polynucleotide
taatacgactcactatagggatccagtacagtgatctgttttttcctcagaacagaggagactgaggatgaaacagatcaacctggcggcagcgcaaaagatg

SEQ ID NO: 78941 - DNA, 103 bp, Artificial Sequence
  Synthetic Polynucleotide
taatacgactcactatagggtggagatccagtacagtgatctgttttttcaacagaggagagaaaaaatggatcactgtaacctggcggcagcgcaaaagatg

SEQ ID NO: 78942 - DNA, 103 bp, Artificial Sequence
  Synthetic Polynucleotide
taatacgactcactatagggcgggatggagatccagtacagtgatctgttaacagaggagaaacagaatgctgtactggaacctggcggcagcgcaaaagatg

SEQ ID NO: 78943 - DNA, 103 bp, Artificial Sequence
  Synthetic Polynucleotide
taatacgactcactatagggggcgccgggatggagatccagtacagtgataacagaggagaatcactatgctggatctcaacctggcggcagcgcaaaagatg

SEQ ID NO: 78944 - DNA, 103 bp, Artificial Sequence
  Synthetic Polynucleotide
taatacgactcactatagggttaccggcgccgggatggagatccagtacaaacagaggagatgtactatgtctccatccaacctggcggcagcgcaaaagatg

SEQ ID NO: 78945 - DNA, 103 bp, Artificial Sequence
  Synthetic Polynucleotide
taatacgactcactatagggttgttttaccggcgccgggatggagatccaaacagaggagatggatcatgatcccggcgaacctggcggcagcgcaaaagatg

SEQ ID NO: 78946 - DNA, 103 bp, Artificial Sequence
  Synthetic Polynucleotide
taatacgactcactatagggcctccttgttttaccggcgccgggatggagaacagaggagactccatatgggcgccggtaacctggcggcagcgcaaaagatg

SEQ ID NO: 78947 - DNA, 103 bp, Artificial Sequence
  Synthetic Polynucleotide
taatacgactcactataggggttggaatcgtgatgacatctgtgacgtcaaacagaggagatgacgtatgagatgtcataacctggcggcagcgcaaaagatg

SEQ ID NO: 78948 - DNA, 103 bp, Artificial Sequence
  Synthetic Polynucleotide
taatacgactcactatagggagaatcctccttgttttaccggcgccgggaaacagaggagatcccggatgcggtaaaacaacctggcggcagcgcaaaagatg

SEQ ID NO: 78949 - DNA, 103 bp, Artificial Sequence
  Synthetic Polynucleotide
taatacgactcactataggggtggcagaatcctccttgttttaccggcgcaacagaggagagcgccgatgaaacaaggaaacctggcggcagcgcaaaagatg

SEQ ID NO: 78950 - DNA, 103 bp, Artificial Sequence
  Synthetic Polynucleotide
taatacgactcactataggggatctgtggcagaatcctccttgttttaccaacagaggagaggtaaaatgaggaggattaacctggcggcagcgcaaaagatg

SEQ ID NO: 78951 - DNA, 103 bp, Artificial Sequence
  Synthetic Polynucleotide
taatacgactcactatagggttgatgatctgtggcagaatcctccttgttaacagaggagaaacaagatggattctgccaacctggcggcagcgcaaaagatg

SEQ ID NO: 78952 - DNA, 103 bp, Artificial Sequence
  Synthetic Polynucleotide
taatacgactcactatagggcctctttgatgatctgtggcagaatcctccaacagaggagaggaggaatgtgccacagaaacctggcggcagcgcaaaagatg

SEQ ID NO: 78953 - DNA, 103 bp, Artificial Sequence
  Synthetic Polynucleotide
taatacgactcactatagggtatggcctctttgatgatctgtggcagaataacagaggagaattctgatgcagatcatcaacctggcggcagcgcaaaagatg

SEQ ID NO: 78954 - DNA, 103 bp, Artificial Sequence
  Synthetic Polynucleotide
taatacgactcactatagggctgtttatggcctctttgatgatctgtggcaacagaggagagccacaatgcatcaaagaaacctggcggcagcgcaaaagatg

SEQ ID NO: 78955 - DNA, 103 bp, Artificial Sequence
  Synthetic Polynucleotide
taatacgactcactataggggtcttctgtttatggcctctttgatgatctaacagaggagaagatcaatgaagaggccaaacctggcggcagcgcaaaagatg

SEQ ID NO: 78956 - DNA, 103 bp, Artificial Sequence
  Synthetic Polynucleotide
taatacgactcactatagggtctcagtcttctgtttatggcctctttgataacagaggagaatcaaaatggccataaacaacctggcggcagcgcaaaagatg

SEQ ID NO: 78957 - DNA, 103 bp, Artificial Sequence
  Synthetic Polynucleotide
taatacgactcactataggggctgttctcagtcttctgtttatggcctctaacagaggagaagaggcatgaaacagaagaacctggcggcagcgcaaaagatg

SEQ ID NO: 78958 - DNA, 103 bp, Artificial Sequence
  Synthetic Polynucleotide
taatacgactcactatagggcagctgttggaatcgtgatgacatctgtgaaacagaggagatcacagatgtcatcacgaaacctggcggcagcgcaaaagatg

SEQ ID NO: 78959 - DNA, 103 bp, Artificial Sequence
  Synthetic Polynucleotide
taatacgactcactataggggcacggctgttctcagtcttctgtttatggaacagaggagaccataaatggaagactgaaacctggcggcagcgcaaaagatg

SEQ ID NO: 78960 - DNA, 103 bp, Artificial Sequence
  Synthetic Polynucleotide
taatacgactcactatagggcgctagcacggctgttctcagtcttctgttaacagaggagaaacagaatgctgagaacaaacctggcggcagcgcaaaagatg

SEQ ID NO: 78961 - DNA, 103 bp, Artificial Sequence
  Synthetic Polynucleotide
taatacgactcactataggggttggcgctagcacggctgttctcagtcttaacagaggagaaagactatgaacagccgtaacctggcggcagcgcaaaagatg

SEQ ID NO: 78962 - DNA, 103 bp, Artificial Sequence
  Synthetic Polynucleotide
taatacgactcactatagggccctggttggcgctagcacggctgttctcaaacagaggagatgagaaatgccgtgctagaacctggcggcagcgcaaaagatg

SEQ ID NO: 78963 - DNA, 103 bp, Artificial Sequence
  Synthetic Polynucleotide
taatacgactcactatagggcacaaccctggttggcgctagcacggctgtaacagaggagaacagccatgctagcgccaaacctggcggcagcgcaaaagatg

SEQ ID NO: 78964 - DNA, 103 bp, Artificial Sequence
  Synthetic Polynucleotide
taatacgactcactataggggcagccacaaccctggttggcgctagcacgaacagaggagacgtgctatggccaaccagaacctggcggcagcgcaaaagatg

SEQ ID NO: 78965 - DNA, 103 bp, Artificial Sequence
  Synthetic Polynucleotide
taatacgactcactatagggtctcagcagccacaaccctggttggcgctaaacagaggagatagcgcatgccagggttgaacctggcggcagcgcaaaagatg

SEQ ID NO: 78966 - DNA, 103 bp, Artificial Sequence
  Synthetic Polynucleotide
taatacgactcactatagggagccatctcagcagccacaaccctggttggaacagaggagaccaaccatggttgtggctaacctggcggcagcgcaaaagatg

SEQ ID NO: 78967 - DNA, 103 bp, Artificial Sequence
  Synthetic Polynucleotide
taatacgactcactataggggcttcagccatctcagcagccacaaccctgaacagaggagacagggtatgggctgctgaaacctggcggcagcgcaaaagatg

SEQ ID NO: 78968 - DNA, 103 bp, Artificial Sequence
  Synthetic Polynucleotide
taatacgactcactatagggtcagtgcttcagccatctcagcagccacaaaacagaggagattgtggatgctgagatggaacctggcggcagcgcaaaagatg

SEQ ID NO: 78969 - DNA, 103 bp, Artificial Sequence
  Synthetic Polynucleotide
taatacgactcactatagggtccagcagctgttggaatcgtgatgacatcaacagaggagagatgtcatgacgattccaaacctggcggcagcgcaaaagatg

SEQ ID NO: 78970 - DNA, 103 bp, Artificial Sequence
  Synthetic Polynucleotide
taatacgactcactatagggtcctctcagtgcttcagccatctcagcagcaacagaggagagctgctatgatggctgaaaacctggcggcagcgcaaaagatg

SEQ ID NO: 78971 - DNA, 103 bp, Artificial Sequence
  Synthetic Polynucleotide
taatacgactcactatagggggcagtcctctcagtgcttcagccatctcaaacagaggagatgagatatgtgaagcactaacctggcggcagcgcaaaagatg

SEQ ID NO: 78972 - DNA, 103 bp, Artificial Sequence
  Synthetic Polynucleotide
taatacgactcactatagggggatgggcagtcctctcagtgcttcagccaaacagaggagatggctgatgcactgagagaacctggcggcagcgcaaaagatg

SEQ ID NO: 78973 - DNA, 103 bp, Artificial Sequence
  Synthetic Polynucleotide
taatacgactcactataggggtaccggatgggcagtcctctcagtgcttcaacagaggagagaagcaatgagaggactgaacctggcggcagcgcaaaagatg

SEQ ID NO: 78974 - DNA, 103 bp, Artificial Sequence
  Synthetic Polynucleotide
taatacgactcactataggggtctggtaccggatgggcagtcctctcagtaacagaggagaactgagatgactgcccataacctggcggcagcgcaaaagatg

SEQ ID NO: 78975 - DNA, 103 bp, Artificial Sequence
  Synthetic Polynucleotide
taatacgactcactatagggcggatgtctggtaccggatgggcagtcctcaacagaggagagaggacatgccatccggtaacctggcggcagcgcaaaagatg

SEQ ID NO: 78976 - DNA, 103 bp, Artificial Sequence
  Synthetic Polynucleotide
taatacgactcactatagggcactgcggatgtctggtaccggatgggcagaacagaggagactgcccatgcggtaccagaacctggcggcagcgcaaaagatg

SEQ ID NO: 78977 - DNA, 103 bp, Artificial Sequence
  Synthetic Polynucleotide
taatacgactcactatagggctgggcactgcggatgtctggtaccggatgaacagaggagacatccgatgccagacatcaacctggcggcagcgcaaaagatg

SEQ ID NO: 78978 - DNA, 103 bp, Artificial Sequence
  Synthetic Polynucleotide
taatacgactcactataggggttctctgggcactgcggatgtctggtaccaacagaggagaggtaccatgcatccgcagaacctggcggcagcgcaaaagatg

SEQ ID NO: 78979 - DNA, 103 bp, Artificial Sequence
  Synthetic Polynucleotide
taatacgactcactatagggattatgttctctgggcactgcggatgtctgaacagaggagacagacaatggcagtgcccaacctggcggcagcgcaaaagatg

SEQ ID NO: 78980 - DNA, 103 bp, Artificial Sequence
  Synthetic Polynucleotide
taatacgactcactatagggttctttccagcagctgttggaatcgtgatgaacagaggagacatcacatgtccaacagcaacctggcggcagcgcaaaagatg

SEQ ID NO: 78981 - DNA, 103 bp, Artificial Sequence
  Synthetic Polynucleotide
taatacgactcactatagggtttccattatgttctctgggcactgcggataacagaggagaatccgcatggcccagagaaacctggcggcagcgcaaaagatg

SEQ ID NO: 78982 - DNA, 103 bp, Artificial Sequence
  Synthetic Polynucleotide
taatacgactcactatagggtctcatttccattatgttctctgggcactgaacagaggagacagtgcatggagaacataaacctggcggcagcgcaaaagatg

SEQ ID NO: 78983 - DNA, 103 bp, Artificial Sequence
  Synthetic Polynucleotide
taatacgactcactatagggaacaatctcatttccattatgttctctgggaacagaggagacccagaatgcataatggaaacctggcggcagcgcaaaagatg

SEQ ID NO: 78984 - DNA, 103 bp, Artificial Sequence
  Synthetic Polynucleotide
taatacgactcactatagggacatcaacaatctcatttccattatgttctaacagaggagaagaacaatgtggaaatgaaacctggcggcagcgcaaaagatg

SEQ ID NO: 78985 - DNA, 103 bp, Artificial Sequence
  Synthetic Polynucleotide
taatacgactcactatagggacatgacatcaacaatctcatttccattataacagaggagaataatgatgatgagattgaacctggcggcagcgcaaaagatg

SEQ ID NO: 78986 - DNA, 103 bp, Artificial Sequence
  Synthetic Polynucleotide
taatacgactcactatagggatgacacatgacatcaacaatctcatttccaacagaggagaggaaatatgattgttgataacctggcggcagcgcaaaagatg

SEQ ID NO: 78987 - DNA, 103 bp, Artificial Sequence
  Synthetic Polynucleotide
taatacgactcactataggggtagcatgacacatgacatcaacaatctcaaacagaggagatgagatatgtgatgtcataacctggcggcagcgcaaaagatg

SEQ ID NO: 78988 - DNA, 103 bp, Artificial Sequence
  Synthetic Polynucleotide
taatacgactcactatagggtgagggtagcatgacacatgacatcaacaaaacagaggagattgttgatgtcatgtgtcaacctggcggcagcgcaaaagatg

SEQ ID NO: 78989 - DNA, 103 bp, Artificial Sequence
  Synthetic Polynucleotide
taatacgactcactataggggtgggtgagggtagcatgacacatgacatcaacagaggagagatgtcatgtgtcatgctaacctggcggcagcgcaaaagatg

SEQ ID NO: 78990 - DNA, 103 bp, Artificial Sequence
  Synthetic Polynucleotide
taatacgactcactatagggagcctgtgggtgagggtagcatgacacatgaacagaggagacatgtgatgtgctaccctaacctggcggcagcgcaaaagatg

SEQ ID NO: 78991 - DNA, 103 bp, Artificial Sequence
  Synthetic Polynucleotide
taatacgactcactatagggataggttctttccagcagctgttggaatcgaacagaggagacgattcatgcagctgctgaacctggcggcagcgcaaaagatg

SEQ ID NO: 78992 - DNA, 103 bp, Artificial Sequence
  Synthetic Polynucleotide
taatacgactcactatagggacatcagcctgtgggtgagggtagcatgacaacagaggagagtcatgatgccctcacccaacctggcggcagcgcaaaagatg

SEQ ID NO: 78993 - DNA, 103 bp, Artificial Sequence
  Synthetic Polynucleotide
taatacgactcactatagggaggagacatcagcctgtgggtgagggtagcaacagaggagagctaccatgacccacaggaacctggcggcagcgcaaaagatg

SEQ ID NO: 78994 - DNA, 103 bp, Artificial Sequence
  Synthetic Polynucleotide
taatacgactcactatagggctgtgaggagacatcagcctgtgggtgaggaacagaggagacctcacatgcaggctgataacctggcggcagcgcaaaagatg

SEQ ID NO: 78995 - DNA, 103 bp, Artificial Sequence
  Synthetic Polynucleotide
taatacgactcactataggggcaccctgtgaggagacatcagcctgtgggaacagaggagacccacaatgtgatgtctcaacctggcggcagcgcaaaagatg

SEQ ID NO: 78996 - DNA, 103 bp, Artificial Sequence
  Synthetic Polynucleotide
taatacgactcactataggggttcggcaccctgtgaggagacatcagcctaacagaggagaaggctgatgtctcctcacaacctggcggcagcgcaaaagatg

SEQ ID NO: 78997 - DNA, 103 bp, Artificial Sequence
  Synthetic Polynucleotide
taatacgactcactatagggttgtagttcggcaccctgtgaggagacatcaacagaggagagatgtcatgtcacagggtaacctggcggcagcgcaaaagatg

SEQ ID NO: 78998 - DNA, 103 bp, Artificial Sequence
  Synthetic Polynucleotide
taatacgactcactatagggacaggttgtagttcggcaccctgtgaggagaacagaggagactcctcatggggtgccgaaacctggcggcagcgcaaaagatg

SEQ ID NO: 78999 - DNA, 103 bp, Artificial Sequence
  Synthetic Polynucleotide
taatacgactcactatagggcacgaacaggttgtagttcggcaccctgtgaacagaggagacacaggatgccgaactacaacctggcggcagcgcaaaagatg

SEQ ID NO: 79000 - DNA, 103 bp, Artificial Sequence
  Synthetic Polynucleotide
taatacgactcactatagggtccatcacgaacaggttgtagttcggcaccaacagaggagaggtgccatgctacaacctaacctggcggcagcgcaaaagatg

SEQ ID NO: 79001 - DNA, 103 bp, Artificial Sequence
  Synthetic Polynucleotide
taatacgactcactatagggcctcatccatcacgaacaggttgtagttcgaacagaggagacgaactatgacctgttcgaacctggcggcagcgcaaaagatg

SEQ ID NO: 79002 - DNA, 103 bp, Artificial Sequence
  Synthetic Polynucleotide
taatacgactcactatagggaatgcataggttctttccagcagctgttggaacagaggagaccaacaatggctggaaagaacctggcggcagcgcaaaagatg

SEQ ID NO: 79003 - DNA, 103 bp, Artificial Sequence
  Synthetic Polynucleotide
taatacgactcactatagggatgagcctcatccatcacgaacaggttgtaaacagaggagatacaacatgttcgtgatgaacctggcggcagcgcaaaagatg

SEQ ID NO: 79004 - DNA, 103 bp, Artificial Sequence
  Synthetic Polynucleotide
taatacgactcactataggggtgaaatgagcctcatccatcacgaacaggaacagaggagacctgttatggatggatgaaacctggcggcagcgcaaaagatg

SEQ ID NO: 79005 - DNA, 103 bp, Artificial Sequence
  Synthetic Polynucleotide
taatacgactcactatagggggtcggtgaaatgagcctcatccatcacgaaacagaggagatcgtgaatgatgaggctcaacctggcggcagcgcaaaagatg

SEQ ID NO: 79006 - DNA, 103 bp, Artificial Sequence
  Synthetic Polynucleotide
taatacgactcactatagggagctgggtcggtgaaatgagcctcatccataacagaggagaatggatatggctcatttcaacctggcggcagcgcaaaagatg

SEQ ID NO: 79007 - DNA, 103 bp, Artificial Sequence
  Synthetic Polynucleotide
taatacgactcactatagggatgctagctgggtcggtgaaatgagcctcaaacagaggagatgaggcatgtttcaccgaaacctggcggcagcgcaaaagatg

SEQ ID NO: 79008 - DNA, 103 bp, Artificial Sequence
  Synthetic Polynucleotide
taatacgactcactatagggctgcaatgctagctgggtcggtgaaatgagaacagaggagactcattatgccgacccagaacctggcggcagcgcaaaagatg

SEQ ID NO: 79009 - DNA, 103 bp, Artificial Sequence
  Synthetic Polynucleotide
taatacgactcactatagggtcttgctgcaatgctagctgggtcggtgaaaacagaggagattcaccatgccagctagcaacctggcggcagcgcaaaagatg

SEQ ID NO: 79010 - DNA, 103 bp, Artificial Sequence
  Synthetic Polynucleotide
taatacgactcactatagggtaacctcttgctgcaatgctagctgggtcgaacagaggagacgacccatgtagcattgcaacctggcggcagcgcaaaagatg

SEQ ID NO: 79011 - DNA, 103 bp, Artificial Sequence
  Synthetic Polynucleotide
taatacgactcactatagggaaatgtaacctcttgctgcaatgctagctgaacagaggagacagctaatgttgcagcaaaacctggcggcagcgcaaaagatg

SEQ ID NO: 79012 - DNA, 103 bp, Artificial Sequence
  Synthetic Polynucleotide
taatacgactcactatagggtgtggaaatgtaacctcttgctgcaatgctaacagaggagaagcattatggcaagaggtaacctggcggcagcgcaaaagatg

SEQ ID NO: 79013 - DNA, 103 bp, Artificial Sequence
  Synthetic Polynucleotide
taatacgactcactatagggagaaacagctcgcactgtgttaattgttgtaacagaggagaacaacaatgaacacagtgaacctggcggcagcgcaaaagatg

SEQ ID NO: 79014 - DNA, 103 bp, Artificial Sequence
  Synthetic Polynucleotide
taatacgactcactatagggctgacaatgcataggttctttccagcagctaacagaggagaagctgcatgaaagaacctaacctggcggcagcgcaaaagatg

SEQ ID NO: 79015 - DNA, 103 bp, Artificial Sequence
  Synthetic Polynucleotide
taatacgactcactatagggacctttgtggaaatgtaacctcttgctgcaaacagaggagatgcagcatgaggttacataacctggcggcagcgcaaaagatg

SEQ ID NO: 79016 - DNA, 103 bp, Artificial Sequence
  Synthetic Polynucleotide
taatacgactcactataggggctcgacctttgtggaaatgtaacctcttgaacagaggagacaagagatgacatttccaaacctggcggcagcgcaaaagatg

SEQ ID NO: 79017 - DNA, 103 bp, Artificial Sequence
  Synthetic Polynucleotide
taatacgactcactatagggccctagctcgacctttgtggaaatgtaaccaacagaggagaggttacatgtccacaaagaacctggcggcagcgcaaaagatg

SEQ ID NO: 79018 - DNA, 103 bp, Artificial Sequence
  Synthetic Polynucleotide
taatacgactcactataggggcctcccctagctcgacctttgtggaaatgaacagaggagacatttcatgaaaggtcgaaacctggcggcagcgcaaaagatg

SEQ ID NO: 79019 - DNA, 103 bp, Artificial Sequence
  Synthetic Polynucleotide
taatacgactcactatagggccgccgcctcccctagctcgacctttgtggaacagaggagaccacaaatgtcgagctagaacctggcggcagcgcaaaagatg

SEQ ID NO: 79020 - DNA, 103 bp, Artificial Sequence
  Synthetic Polynucleotide
taatacgactcactatagggtattgccgccgcctcccctagctcgaccttaacagaggagaaaggtcatgctaggggagaacctggcggcagcgcaaaagatg

SEQ ID NO: 79021 - DNA, 103 bp, Artificial Sequence
  Synthetic Polynucleotide
taatacgactcactatagggatgaatattgccgccgcctcccctagctcgaacagaggagacgagctatgggaggcggcaacctggcggcagcgcaaaagatg

SEQ ID NO: 79022 - DNA, 103 bp, Artificial Sequence
  Synthetic Polynucleotide
taatacgactcactatagggctgtcatgaatattgccgccgcctcccctaaacagaggagataggggatgcggcggcaaaacctggcggcagcgcaaaagatg

SEQ ID NO: 79023 - DNA, 103 bp, Artificial Sequence
  Synthetic Polynucleotide
taatacgactcactatagggggtggctgtcatgaatattgccgccgcctcaacagaggagagaggcgatggcaatattcaacctggcggcagcgcaaaagatg

SEQ ID NO: 79024 - DNA, 103 bp, Artificial Sequence
  Synthetic Polynucleotide
taatacgactcactatagggggtggggtggctgtcatgaatattgccgccaacagaggagaggcggcatgattcatgacaacctggcggcagcgcaaaagatg

SEQ ID NO: 79025 - DNA, 103 bp, Artificial Sequence
  Synthetic Polynucleotide
taatacgactcactatagggttgctctgacaatgcataggttctttccagaacagaggagactggaaatgacctatgcaaacctggcggcagcgcaaaagatg

SEQ ID NO: 79026 - DNA, 103 bp, Artificial Sequence
  Synthetic Polynucleotide
taatacgactcactatagggtgcctggtggggtggctgtcatgaatattgaacagaggagacaatatatgtgacagccaaacctggcggcagcgcaaaagatg

SEQ ID NO: 79027 - DNA, 103 bp, Artificial Sequence
  Synthetic Polynucleotide
taatacgactcactatagggtgaagtgcctggtggggtggctgtcatgaaaacagaggagattcatgatggccaccccaaacctggcggcagcgcaaaagatg

SEQ ID NO: 79028 - DNA, 103 bp, Artificial Sequence
  Synthetic Polynucleotide
taatacgactcactatagggggatctgaagtgcctggtggggtggctgtcaacagaggagagacagcatgcccaccaggaacctggcggcagcgcaaaagatg

SEQ ID NO: 79029 - DNA, 103 bp, Artificial Sequence
  Synthetic Polynucleotide
taatacgactcactatagggggaatggatctgaagtgcctggtggggtggaacagaggagaccacccatgcaggcacttaacctggcggcagcgcaaaagatg

SEQ ID NO: 79030 - DNA, 103 bp, Artificial Sequence
  Synthetic Polynucleotide
taatacgactcactatagggctctgggaatggatctgaagtgcctggtggaacagaggagaccaccaatgacttcagataacctggcggcagcgcaaaagatg

SEQ ID NO: 79031 - DNA, 103 bp, Artificial Sequence
  Synthetic Polynucleotide
taatacgactcactatagggttggactctgggaatggatctgaagtgcctaacagaggagaaggcacatgagatccattaacctggcggcagcgcaaaagatg

SEQ ID NO: 79032 - DNA, 103 bp, Artificial Sequence
  Synthetic Polynucleotide
taatacgactcactataggggtgaattggactctgggaatggatctgaagaacagaggagacttcagatgcattcccagaacctggcggcagcgcaaaagatg

SEQ ID NO: 79033 - DNA, 103 bp, Artificial Sequence
  Synthetic Polynucleotide
taatacgactcactatagggaattggtgaattggactctgggaatggatcaacagaggagagatccaatgccagagtccaacctggcggcagcgcaaaagatg

SEQ ID NO: 79034 - DNA, 103 bp, Artificial Sequence
  Synthetic Polynucleotide
taatacgactcactatagggtcggaaattggtgaattggactctgggaataacagaggagaattcccatggtccaattcaacctggcggcagcgcaaaagatg

SEQ ID NO: 79035 - DNA, 103 bp, Artificial Sequence
  Synthetic Polynucleotide
taatacgactcactataggggtaagtcggaaattggtgaattggactctgaacagaggagacagagtatgattcaccaaaacctggcggcagcgcaaaagatg

SEQ ID NO: 79036 - DNA, 103 bp, Artificial Sequence
  Synthetic Polynucleotide
taatacgactcactatagggatccattgctctgacaatgcataggttcttaacagaggagaaagaacatgtgcattgtcaacctggcggcagcgcaaaagatg

SEQ ID NO: 79037 - DNA, 103 bp, Artificial Sequence
  Synthetic Polynucleotide
taatacgactcactatagggagtctgtaagtcggaaattggtgaattggaaacagaggagatccaatatgccaatttccaacctggcggcagcgcaaaagatg

SEQ ID NO: 79038 - DNA, 103 bp, Artificial Sequence
  Synthetic Polynucleotide
taatacgactcactatagggatctcagtctgtaagtcggaaattggtgaaaacagaggagattcaccatgttccgacttaacctggcggcagcgcaaaagatg

SEQ ID NO: 79039 - DNA, 103 bp, Artificial Sequence
  Synthetic Polynucleotide
taatacgactcactatagggccgggatctcagtctgtaagtcggaaattgaacagaggagacaatttatgacttacagaaacctggcggcagcgcaaaagatg

SEQ ID NO: 79040 - DNA, 103 bp, Artificial Sequence
  Synthetic Polynucleotide
taatacgactcactatagggtcgatccgggatctcagtctgtaagtcggaaacagaggagatccgacatgcagactgagaacctggcggcagcgcaaaagatg

SEQ ID NO: 79041 - DNA, 103 bp, Artificial Sequence
  Synthetic Polynucleotide
taatacgactcactatagggcaagctcgatccgggatctcagtctgtaagaacagaggagacttacaatgtgagatcccaacctggcggcagcgcaaaagatg

SEQ ID NO: 79042 - DNA, 103 bp, Artificial Sequence
  Synthetic Polynucleotide
taatacgactcactatagggagttccaagctcgatccgggatctcagtctaacagaggagaagactgatgtcccggatcaacctggcggcagcgcaaaagatg

SEQ ID NO: 79043 - DNA, 103 bp, Artificial Sequence
  Synthetic Polynucleotide
taatacgactcactatagggtccagagttccaagctcgatccgggatctcaacagaggagagagatcatggatcgagctaacctggcggcagcgcaaaagatg

SEQ ID NO: 79044 - DNA, 103 bp, Artificial Sequence
  Synthetic Polynucleotide
taatacgactcactatagggtcgtatccagagttccaagctcgatccgggaacagaggagacccggaatgagcttggaaaacctggcggcagcgcaaaagatg

SEQ ID NO: 79045 - DNA, 103 bp, Artificial Sequence
  Synthetic Polynucleotide
taatacgactcactatagggtccattcgtatccagagttccaagctcgataacagaggagaatcgagatgggaactctgaacctggcggcagcgcaaaagatg

SEQ ID NO: 79046 - DNA, 103 bp, Artificial Sequence
  Synthetic Polynucleotide
taatacgactcactatagggtgtgatccattcgtatccagagttccaagcaacagaggagagcttggatgtctggatacaacctggcggcagcgcaaaagatg

SEQ ID NO: 79047 - DNA, 103 bp, Artificial Sequence
  Synthetic Polynucleotide
taatacgactcactatagggcccacatccattgctctgacaatgcataggaacagaggagacctatgatgtgtcagagcaacctggcggcagcgcaaaagatg

SEQ ID NO: 79048 - DNA, 103 bp, Artificial Sequence
  Synthetic Polynucleotide
taatacgactcactatagggtattctgtgatccattcgtatccagagttcaacagaggagagaactcatgatacgaatgaacctggcggcagcgcaaaagatg

SEQ ID NO: 79049 - DNA, 103 bp, Artificial Sequence
  Synthetic Polynucleotide
taatacgactcactatagggcggtgtattctgtgatccattcgtatccagaacagaggagactggatatgaatggatcaaacctggcggcagcgcaaaagatg

SEQ ID NO: 79050 - DNA, 103 bp, Artificial Sequence
  Synthetic Polynucleotide
taatacgactcactatagggcttcccggtgtattctgtgatccattcgtaaacagaggagatacgaaatgatcacagaaaacctggcggcagcgcaaaagatg

SEQ ID NO: 79051 - DNA, 103 bp, Artificial Sequence
  Synthetic Polynucleotide
taatacgactcactatagggaccgtcttcccggtgtattctgtgatccataacagaggagaatggatatgagaatacacaacctggcggcagcgcaaaagatg

SEQ ID NO: 79052 - DNA, 103 bp, Artificial Sequence
  Synthetic Polynucleotide
taatacgactcactatagggaccaaaccgtcttcccggtgtattctgtgaaacagaggagatcacagatgacaccgggaaacctggcggcagcgcaaaagatg

SEQ ID NO: 79053 - DNA, 103 bp, Artificial Sequence
  Synthetic Polynucleotide
taatacgactcactatagggcacaaaccaaaccgtcttcccggtgtattcaacagaggagagaatacatggggaagacgaacctggcggcagcgcaaaagatg

SEQ ID NO: 79054 - DNA, 103 bp, Artificial Sequence
  Synthetic Polynucleotide
taatacgactcactatagggctaggcacaaaccaaaccgtcttcccggtgaacagaggagacaccggatggacggtttgaacctggcggcagcgcaaaagatg

SEQ ID NO: 79055 - DNA, 103 bp, Artificial Sequence
  Synthetic Polynucleotide
taatacgactcactatagggtgacactaggcacaaaccaaaccgtcttccaacagaggagaggaagaatgtttggtttgaacctggcggcagcgcaaaagatg

SEQ ID NO: 79056 - DNA, 103 bp, Artificial Sequence
  Synthetic Polynucleotide
taatacgactcactatagggcatcttgacactaggcacaaaccaaaccgtaacagaggagaacggttatgtttgtgcctaacctggcggcagcgcaaaagatg

SEQ ID NO: 79057 - DNA, 103 bp, Artificial Sequence
  Synthetic Polynucleotide
taatacgactcactatagggttccccatcttgacactaggcacaaaccaaaacagaggagattggttatggcctagtgtaacctggcggcagcgcaaaagatg

SEQ ID NO: 79058 - DNA, 103 bp, Artificial Sequence
  Synthetic Polynucleotide
taatacgactcactatagggtgtatcccacatccattgctctgacaatgcaacagaggagagcattgatggagcaatggaacctggcggcagcgcaaaagatg

SEQ ID NO: 79059 - DNA, 103 bp, Artificial Sequence
  Synthetic Polynucleotide
taatacgactcactatagggtctcattccccatcttgacactaggcacaaaacagaggagattgtgcatggtgtcaagaaacctggcggcagcgcaaaagatg

SEQ ID NO: 79060 - DNA, 103 bp, Artificial Sequence
  Synthetic Polynucleotide
taatacgactcactatagggggcaatctcattccccatcttgacactaggaacagaggagacctagtatgaagatggggaacctggcggcagcgcaaaagatg

SEQ ID NO: 79061 - DNA, 103 bp, Artificial Sequence
  Synthetic Polynucleotide
taatacgactcactatagggcaaagggcaatctcattccccatcttgacaaacagaggagatgtcaaatgggggaatgaaacctggcggcagcgcaaaagatg

SEQ ID NO: 79062 - DNA, 103 bp, Artificial Sequence
  Synthetic Polynucleotide
taatacgactcactataggggtaggcaaagggcaatctcattccccatctaacagaggagaagatggatgatgagattgaacctggcggcagcgcaaaagatg

SEQ ID NO: 79063 - DNA, 103 bp, Artificial Sequence
  Synthetic Polynucleotide
taatacgactcactatagggacgttgtaggcaaagggcaatctcattcccaacagaggagagggaatatgattgcccttaacctggcggcagcgcaaaagatg

SEQ ID NO: 79064 - DNA, 103 bp, Artificial Sequence
  Synthetic Polynucleotide
taatacgactcactatagggccagcacgttgtaggcaaagggcaatctcaaacagaggagatgagatatgcctttgcctaacctggcggcagcgcaaaagatg

SEQ ID NO: 79065 - DNA, 103 bp, Artificial Sequence
  Synthetic Polynucleotide
taatacgactcactatagggtctttccagcacgttgtaggcaaagggcaaaacagaggagattgcccatggcctacaacaacctggcggcagcgcaaaagatg

SEQ ID NO: 79066 - DNA, 103 bp, Artificial Sequence
  Synthetic Polynucleotide
taatacgactcactatagggtactttctttccagcacgttgtaggcaaagaacagaggagactttgcatgcaacgtgctaacctggcggcagcgcaaaagatg

SEQ ID NO: 79067 - DNA, 103 bp, Artificial Sequence
  Synthetic Polynucleotide
taatacgactcactatagggtggactactttctttccagcacgttgtaggaacagaggagacctacaatgtgctggaaaaacctggcggcagcgcaaaagatg

SEQ ID NO: 79068 - DNA, 103 bp, Artificial Sequence
  Synthetic Polynucleotide
taatacgactcactatagggtcaattggactactttctttccagcacgttaacagaggagaaacgtgatggaaagaaagaacctggcggcagcgcaaaagatg

SEQ ID NO: 79069 - DNA, 103 bp, Artificial Sequence
  Synthetic Polynucleotide
taatacgactcactataggggcacatgtatcccacatccattgctctgacaacagaggagagtcagaatgatggatgtgaacctggcggcagcgcaaaagatg

SEQ ID NO: 79070 - DNA, 103 bp, Artificial Sequence
  Synthetic Polynucleotide
taatacgactcactatagggtctgttcaattggactactttctttccagcaacagaggagagctggaatgaaagtagtcaacctggcggcagcgcaaaagatg

SEQ ID NO: 79071 - DNA, 103 bp, Artificial Sequence
  Synthetic Polynucleotide
taatacgactcactataggggactttctgttcaattggactactttctttaacagaggagaaaagaaatgagtccaattaacctggcggcagcgcaaaagatg

SEQ ID NO: 79072 - DNA, 103 bp, Artificial Sequence
  Synthetic Polynucleotide
taatacgactcactatagggcgtacgactttctgttcaattggactacttaacagaggagaaagtagatgaattgaacaaacctggcggcagcgcaaaagatg

SEQ ID NO: 79073 - DNA, 103 bp, Artificial Sequence
  Synthetic Polynucleotide
taatacgactcactatagggcgtctcgtacgactttctgttcaattggacaacagaggagagtccaaatgaacagaaagaacctggcggcagcgcaaaagatg

SEQ ID NO: 79074 - DNA, 103 bp, Artificial Sequence
  Synthetic Polynucleotide
taatacgactcactatagggtactccgtctcgtacgactttctgttcaataacagaggagaattgaaatgaaagtcgtaaacctggcggcagcgcaaaagatg

SEQ ID NO: 79075 - DNA, 103 bp, Artificial Sequence
  Synthetic Polynucleotide
taatacgactcactatagggttgggtactccgtctcgtacgactttctgtaacagaggagaacagaaatgcgtacgagaaacctggcggcagcgcaaaagatg

SEQ ID NO: 79076 - DNA, 103 bp, Artificial Sequence
  Synthetic Polynucleotide
taatacgactcactatagggacattttgggtactccgtctcgtacgacttaacagaggagaaagtcgatggagacggagaacctggcggcagcgcaaaagatg

SEQ ID NO: 79077 - DNA, 103 bp, Artificial Sequence
  Synthetic Polynucleotide
taatacgactcactatagggttcttacattttgggtactccgtctcgtacaacagaggagagtacgaatgggagtacccaacctggcggcagcgcaaaagatg

SEQ ID NO: 79078 - DNA, 103 bp, Artificial Sequence
  Synthetic Polynucleotide
taatacgactcactatagggcatcgttcttacattttgggtactccgtctaacagaggagaagacggatgacccaaaataacctggcggcagcgcaaaagatg

SEQ ID NO: 79079 - DNA, 103 bp, Artificial Sequence
  Synthetic Polynucleotide
taatacgactcactatagggccaatcatcgttcttacattttgggtactcaacagaggagagagtacatgaaatgtaagaacctggcggcagcgcaaaagatg

SEQ ID NO: 79080 - DNA, 103 bp, Artificial Sequence
  Synthetic Polynucleotide
taatacgactcactatagggtcatcgcacatgtatcccacatccattgctaacagaggagaagcaatatgtgtgggataaacctggcggcagcgcaaaagatg

SEQ ID NO: 79081 - DNA, 103 bp, Artificial Sequence
  Synthetic Polynucleotide
taatacgactcactatagggaagtcccaatcatcgttcttacattttgggaacagaggagacccaaaatgtaagaacgaaacctggcggcagcgcaaaagatg

SEQ ID NO: 79082 - DNA, 103 bp, Artificial Sequence
  Synthetic Polynucleotide
taatacgactcactatagggtaacaaagtcccaatcatcgttcttacattaacagaggagaaatgtaatgacgatgattaacctggcggcagcgcaaaagatg

SEQ ID NO: 79083 - DNA, 103 bp, Artificial Sequence
  Synthetic Polynucleotide
taatacgactcactatagggtgtgataacaaagtcccaatcatcgttcttaacagaggagaaagaacatggattgggacaacctggcggcagcgcaaaagatg

SEQ ID NO: 79084 - DNA, 103 bp, Artificial Sequence
  Synthetic Polynucleotide
taatacgactcactatagggtctgttgtgataacaaagtcccaatcatcgaacagaggagacgatgaatgggactttgtaacctggcggcagcgcaaaagatg

SEQ ID NO: 79085 - DNA, 103 bp, Artificial Sequence
  Synthetic Polynucleotide
taatacgactcactatagggatatgtctgttgtgataacaaagtcccaataacagaggagaattgggatgttgttatcaaacctggcggcagcgcaaaagatg

SEQ ID NO: 79086 - DNA, 103 bp, Artificial Sequence
  Synthetic Polynucleotide
taatacgactcactatagggttcagatatgtctgttgtgataacaaagtcaacagaggagagactttatgatcacaacaaacctggcggcagcgcaaaagatg

SEQ ID NO: 79087 - DNA, 103 bp, Artificial Sequence
  Synthetic Polynucleotide
taatacgactcactatagggcccatttcagatatgtctgttgtgataacaaacagaggagatgttatatgaacagacataacctggcggcagcgcaaaagatg

SEQ ID NO: 79088 - DNA, 103 bp, Artificial Sequence
  Synthetic Polynucleotide
taatacgactcactatagggtagcccccatttcagatatgtctgttgtgaaacagaggagatcacaaatgacatatctgaacctggcggcagcgcaaaagatg

SEQ ID NO: 79089 - DNA, 103 bp, Artificial Sequence
  Synthetic Polynucleotide
taatacgactcactataggggaagttagcccccatttcagatatgtctgtaacagaggagaacagacatgtctgaaatgaacctggcggcagcgcaaaagatg

SEQ ID NO: 79090 - DNA, 103 bp, Artificial Sequence
  Synthetic Polynucleotide
taatacgactcactataggggccttgaagttagcccccatttcagatatgaacagaggagacatatcatgaatgggggcaacctggcggcagcgcaaaagatg

SEQ ID NO: 79091 - DNA, 103 bp, Artificial Sequence
  Synthetic Polynucleotide
taatacgactcactatagggtagtatcatcgcacatgtatcccacatccaaacagaggagatggatgatggatacatgtaacctggcggcagcgcaaaagatg

SEQ ID NO: 79092 - DNA, 103 bp, Artificial Sequence
  Synthetic Polynucleotide
taatacgactcactatagggtgctcgccttgaagttagcccccatttcagaacagaggagactgaaaatggggctaactaacctggcggcagcgcaaaagatg

SEQ ID NO: 79093 - DNA, 103 bp, Artificial Sequence
  Synthetic Polynucleotide
taatacgactcactatagggcaccctgctcgccttgaagttagcccccataacagaggagaatggggatgaacttcaagaacctggcggcagcgcaaaagatg

SEQ ID NO: 79094 - DNA, 103 bp, Artificial Sequence
  Synthetic Polynucleotide
taatacgactcactatagggtcaatcaccctgctcgccttgaagttagccaacagaggagaggctaaatgcaaggcgagaacctggcggcagcgcaaaagatg

SEQ ID NO: 79095 - DNA, 103 bp, Artificial Sequence
  Synthetic Polynucleotide
taatacgactcactatagggggctgtcaatcaccctgctcgccttgaagtaacagaggagaacttcaatgcgagcagggaacctggcggcagcgcaaaagatg

SEQ ID NO: 79096 - DNA, 103 bp, Artificial Sequence
  Synthetic Polynucleotide
taatacgactcactatagggcttccggctgtcaatcaccctgctcgccttaacagaggagaaaggcgatgagggtgattaacctggcggcagcgcaaaagatg

SEQ ID NO: 79097 - DNA, 103 bp, Artificial Sequence
  Synthetic Polynucleotide
taatacgactcactatagggacactcttccggctgtcaatcaccctgctcaacagaggagagagcagatggattgacagaacctggcggcagcgcaaaagatg

SEQ ID NO: 79098 - DNA, 103 bp, Artificial Sequence
  Synthetic Polynucleotide
taatacgactcactataggggtttcacactcttccggctgtcaatcacccaacagaggagagggtgaatgacagccggaaacctggcggcagcgcaaaagatg

SEQ ID NO: 79099 - DNA, 103 bp, Artificial Sequence
  Synthetic Polynucleotide
taatacgactcactatagggggttggtttcacactcttccggctgtcaataacagaggagaattgacatgcggaagagtaacctggcggcagcgcaaaagatg

SEQ ID NO: 79100 - DNA, 103 bp, Artificial Sequence
  Synthetic Polynucleotide
taatacgactcactatagggatgatggttggtttcacactcttccggctgaacagaggagacagccgatggagtgtgaaaacctggcggcagcgcaaaagatg

SEQ ID NO: 79101 - DNA, 103 bp, Artificial Sequence
  Synthetic Polynucleotide
taatacgactcactatagggctgttatgatggttggtttcacactcttccaacagaggagaggaagaatgtgaaaccaaaacctggcggcagcgcaaaagatg

SEQ ID NO: 79102 - DNA, 103 bp, Artificial Sequence
  Synthetic Polynucleotide
taatacgactcactatagggagtgatagtatcatcgcacatgtatcccacaacagaggagagtgggaatgatgtgcgataacctggcggcagcgcaaaagatg

SEQ ID NO: 79103 - DNA, 103 bp, Artificial Sequence
  Synthetic Polynucleotide
taatacgactcactatagggtccttctgttatgatggttggtttcacactaacagaggagaagtgtgatgccaaccatcaacctggcggcagcgcaaaagatg

SEQ ID NO: 79104 - DNA, 103 bp, Artificial Sequence
  Synthetic Polynucleotide
taatacgactcactatagggccttctccttctgttatgatggttggtttcaacagaggagagaaaccatgcatcataacaacctggcggcagcgcaaaagatg

SEQ ID NO: 79105 - DNA, 103 bp, Artificial Sequence
  Synthetic Polynucleotide
taatacgactcactatagggctctcccttctccttctgttatgatggttgaacagaggagacaaccaatgtaacagaagaacctggcggcagcgcaaaagatg

SEQ ID NO: 79106 - DNA, 103 bp, Artificial Sequence
  Synthetic Polynucleotide
taatacgactcactataggggatcactctcccttctccttctgttatgataacagaggagaatcataatggaaggagaaaacctggcggcagcgcaaaagatg

SEQ ID NO: 79107 - DNA, 103 bp, Artificial Sequence
  Synthetic Polynucleotide
taatacgactcactatagggcccaggatcactctcccttctccttctgttaacagaggagaaacagaatgagaagggagaacctggcggcagcgcaaaagatg

SEQ ID NO: 79108 - DNA, 103 bp, Artificial Sequence
  Synthetic Polynucleotide
taatacgactcactataggggttctcccaggatcactctcccttctccttaacagaggagaaaggagatgggagagtgaaacctggcggcagcgcaaaagatg

SEQ ID NO: 79109 - DNA, 103 bp, Artificial Sequence
  Synthetic Polynucleotide
taatacgactcactatagggagatggttctcccaggatcactctcccttcaacagaggagagaagggatggtgatcctgaacctggcggcagcgcaaaagatg

SEQ ID NO: 79110 - DNA, 103 bp, Artificial Sequence
  Synthetic Polynucleotide
taatacgactcactatagggactgcagatggttctcccaggatcactctcaacagaggagagagagtatgcctgggagaaacctggcggcagcgcaaaagatg

SEQ ID NO: 79111 - DNA, 103 bp, Artificial Sequence
  Synthetic Polynucleotide
taatacgactcactatagggctgtcactgcagatggttctcccaggatcaaacagaggagatgatccatggagaaccataacctggcggcagcgcaaaagatg

SEQ ID NO: 79112 - DNA, 103 bp, Artificial Sequence
  Synthetic Polynucleotide
taatacgactcactatagggagctgctgtcactgcagatggttctcccagaacagaggagactgggaatgccatctgcaaacctggcggcagcgcaaaagatg

SEQ ID NO: 79113 - DNA, 103 bp, Artificial Sequence
  Synthetic Polynucleotide
taatacgactcactatagggtcataagtgatagtatcatcgcacatgtataacagaggagaatacatatgcgatgatacaacctggcggcagcgcaaaagatg

SEQ ID NO: 79114 - DNA, 103 bp, Artificial Sequence
  Synthetic Polynucleotide
taatacgactcactataggggcactagctgctgtcactgcagatggttctaacagaggagaagaaccatgtgcagtgacaacctggcggcagcgcaaaagatg

SEQ ID NO: 79115 - DNA, 103 bp, Artificial Sequence
  Synthetic Polynucleotide
taatacgactcactataggggggcggcactagctgctgtcactgcagatgaacagaggagacatctgatgtgacagcagaacctggcggcagcgcaaaagatg

SEQ ID NO: 79116 - DNA, 103 bp, Artificial Sequence
  Synthetic Polynucleotide
taatacgactcactatagggtctctgggcggcactagctgctgtcactgcaacagaggagagcagtgatggcagctagtaacctggcggcagcgcaaaagatg

SEQ ID NO: 79117 - DNA, 103 bp, Artificial Sequence
  Synthetic Polynucleotide
taatacgactcactatagggccacgtctctgggcggcactagctgctgtcaacagaggagagacagcatgtagtgccgcaacctggcggcagcgcaaaagatg

SEQ ID NO: 79118 - DNA, 103 bp, Artificial Sequence
  Synthetic Polynucleotide
taatacgactcactatagggtacgtccacgtctctgggcggcactagctgaacagaggagacagctaatgccgcccagaaacctggcggcagcgcaaaagatg

SEQ ID NO: 79119 - DNA, 103 bp, Artificial Sequence
  Synthetic Polynucleotide
taatacgactcactatagggaccgatacgtccacgtctctgggcggcactaacagaggagaagtgccatgcagagacgtaacctggcggcagcgcaaaagatg

SEQ ID NO: 79120 - DNA, 103 bp, Artificial Sequence
  Synthetic Polynucleotide
taatacgactcactatagggtttctaccgatacgtccacgtctctgggcgaacagaggagacgcccaatgacgtggacgaacctggcggcagcgcaaaagatg

SEQ ID NO: 79121 - DNA, 103 bp, Artificial Sequence
  Synthetic Polynucleotide
taatacgactcactatagggacggatttctaccgatacgtccacgtctctaacagaggagaagagacatggacgtatcgaacctggcggcagcgcaaaagatg

SEQ ID NO: 79122 - DNA, 103 bp, Artificial Sequence
  Synthetic Polynucleotide
taatacgactcactatagggttgcgacggatttctaccgatacgtccacgaacagaggagacgtggaatgatcggtagaaacctggcggcagcgcaaaagatg

SEQ ID NO: 79123 - DNA, 103 bp, Artificial Sequence
  Synthetic Polynucleotide
taatacgactcactatagggccaacttgcgacggatttctaccgatacgtaacagaggagaacgtatatgtagaaatccaacctggcggcagcgcaaaagatg

SEQ ID NO: 79124 - DNA, 103 bp, Artificial Sequence
  Synthetic Polynucleotide
taatacgactcactatagggtgctaagaaacagctcgcactgtgttaattaacagaggagaaattaaatgagtgcgagcaacctggcggcagcgcaaaagatg

SEQ ID NO: 79125 - DNA, 103 bp, Artificial Sequence
  Synthetic Polynucleotide
taatacgactcactatagggggcattcataagtgatagtatcatcgcacaaacagaggagatgtgcgatgatactatcaaacctggcggcagcgcaaaagatg

SEQ ID NO: 79126 - DNA, 103 bp, Artificial Sequence
  Synthetic Polynucleotide
taatacgactcactatagggcatcaccaacttgcgacggatttctaccgaaacagaggagatcggtaatgatccgtcgcaacctggcggcagcgcaaaagatg

SEQ ID NO: 79127 - DNA, 103 bp, Artificial Sequence
  Synthetic Polynucleotide
taatacgactcactataggggtactcatcaccaacttgcgacggatttctaacagaggagaagaaatatgtcgcaagttaacctggcggcagcgcaaaagatg

SEQ ID NO: 79128 - DNA, 103 bp, Artificial Sequence
  Synthetic Polynucleotide
taatacgactcactatagggtaacagtactcatcaccaacttgcgacggaaacagaggagatccgtcatgagttggtgaaacctggcggcagcgcaaaagatg

SEQ ID NO: 79129 - DNA, 103 bp, Artificial Sequence
  Synthetic Polynucleotide
taatacgactcactatagggccccataacagtactcatcaccaacttgcgaacagaggagacgcaagatggtgatgagtaacctggcggcagcgcaaaagatg

SEQ ID NO: 79130 - DNA, 103 bp, Artificial Sequence
  Synthetic Polynucleotide
taatacgactcactataggggtgccccccataacagtactcatcaccaacaacagaggagagttggtatggagtactgtaacctggcggcagcgcaaaagatg

SEQ ID NO: 79131 - DNA, 103 bp, Artificial Sequence
  Synthetic Polynucleotide
taatacgactcactatagggttcgtgtgccccccataacagtactcatcaaacagaggagatgatgaatgctgttatggaacctggcggcagcgcaaaagatg

SEQ ID NO: 79132 - DNA, 103 bp, Artificial Sequence
  Synthetic Polynucleotide
taatacgactcactatagggcttcattcgtgtgccccccataacagtactaacagaggagaagtactatgatggggggcaacctggcggcagcgcaaaagatg

SEQ ID NO: 79133 - DNA, 103 bp, Artificial Sequence
  Synthetic Polynucleotide
taatacgactcactataggggtcgtcttcattcgtgtgccccccataacaaacagaggagatgttatatggggcacacgaacctggcggcagcgcaaaagatg

SEQ ID NO: 79134 - DNA, 103 bp, Artificial Sequence
  Synthetic Polynucleotide
taatacgactcactatagggttcgagtcgtcttcattcgtgtgccccccaaacagaggagatgggggatgcacgaatgaaacctggcggcagcgcaaaagatg

SEQ ID NO: 79135 - DNA, 103 bp, Artificial Sequence
  Synthetic Polynucleotide
taatacgactcactatagggcgaagttcgagtcgtcttcattcgtgtgccaacagaggagaggcacaatgatgaagacgaacctggcggcagcgcaaaagatg

SEQ ID NO: 79136 - DNA, 103 bp, Artificial Sequence
  Synthetic Polynucleotide
taatacgactcactatagggtactgggcattcataagtgatagtatcatcaacagaggagagatgatatgatcacttataacctggcggcagcgcaaaagatg

SEQ ID NO: 79137 - DNA, 103 bp, Artificial Sequence
  Synthetic Polynucleotide
taatacgactcactatagggatgggcgaagttcgagtcgtcttcattcgtaacagaggagaacgaatatggacgactcgaacctggcggcagcgcaaaagatg

SEQ ID NO: 79138 - DNA, 103 bp, Artificial Sequence
  Synthetic Polynucleotide
taatacgactcactataggggtccaatgggcgaagttcgagtcgtcttcaaacagaggagatgaagaatgctcgaacttaacctggcggcagcgcaaaagatg

SEQ ID NO: 79139 - DNA, 103 bp, Artificial Sequence
  Synthetic Polynucleotide
taatacgactcactatagggcctcagtccaatgggcgaagttcgagtcgtaacagaggagaacgactatgacttcgcccaacctggcggcagcgcaaaagatg

SEQ ID NO: 79140 - DNA, 103 bp, Artificial Sequence
  Synthetic Polynucleotide
taatacgactcactatagggtcgtgcctcagtccaatgggcgaagttcgaaacagaggagatcgaacatggcccattggaacctggcggcagcgcaaaagatg

SEQ ID NO: 79141 - DNA, 103 bp, Artificial Sequence
  Synthetic Polynucleotide
taatacgactcactatagggatgattcgtgcctcagtccaatgggcgaagaacagaggagacttcgcatgttggactgaaacctggcggcagcgcaaaagatg

SEQ ID NO: 79142 - DNA, 103 bp, Artificial Sequence
  Synthetic Polynucleotide
taatacgactcactatagggccagcatgattcgtgcctcagtccaatgggaacagaggagacccattatgctgaggcacaacctggcggcagcgcaaaagatg

SEQ ID NO: 79143 - DNA, 103 bp, Artificial Sequence
  Synthetic Polynucleotide
taatacgactcactataggggttgtccagcatgattcgtgcctcagtccaaacagaggagatggactatggcacgaatcaacctggcggcagcgcaaaagatg

SEQ ID NO: 79144 - DNA, 103 bp, Artificial Sequence
  Synthetic Polynucleotide
taatacgactcactatagggttgatgttgtccagcatgattcgtgcctcaaacagaggagatgaggcatgaatcatgctaacctggcggcagcgcaaaagatg

SEQ ID NO: 79145 - DNA, 103 bp, Artificial Sequence
  Synthetic Polynucleotide
taatacgactcactataggggcatgttgatgttgtccagcatgattcgtgaacagaggagacacgaaatgtgctggacaaacctggcggcagcgcaaaagatg

SEQ ID NO: 79146 - DNA, 103 bp, Artificial Sequence
  Synthetic Polynucleotide
taatacgactcactataggggtttggcatgttgatgttgtccagcatgataacagaggagaatcatgatggacaacatcaacctggcggcagcgcaaaagatg

SEQ ID NO: 79147 - DNA, 103 bp, Artificial Sequence
  Synthetic Polynucleotide
taatacgactcactataggggacagtactgggcattcataagtgatagtaaacagaggagatactatatgttatgaatgaacctggcggcagcgcaaaagatg

SEQ ID NO: 79148 - DNA, 103 bp, Artificial Sequence
  Synthetic Polynucleotide
taatacgactcactatagggagtccgtttggcatgttgatgttgtccagcaacagaggagagctggaatgcatcaacataacctggcggcagcgcaaaagatg

SEQ ID NO: 79149 - DNA, 103 bp, Artificial Sequence
  Synthetic Polynucleotide
taatacgactcactatagggcgatcagtccgtttggcatgttgatgttgtaacagaggagaacaacaatgacatgccaaaacctggcggcagcgcaaaagatg

SEQ ID NO: 79150 - DNA, 103 bp, Artificial Sequence
  Synthetic Polynucleotide
taatacgactcactatagggttgagcgatcagtccgtttggcatgttgataacagaggagaatcaacatgccaaacggaaacctggcggcagcgcaaaagatg

SEQ ID NO: 79151 - DNA, 103 bp, Artificial Sequence
  Synthetic Polynucleotide
taatacgactcactatagggtagaattgagcgatcagtccgtttggcatgaacagaggagacatgccatgcggactgataacctggcggcagcgcaaaagatg

SEQ ID NO: 79152 - DNA, 103 bp, Artificial Sequence
  Synthetic Polynucleotide
taatacgactcactataggggttggtagaattgagcgatcagtccgtttgaacagaggagacaaacgatgtgatcgctcaacctggcggcagcgcaaaagatg

SEQ ID NO: 79153 - DNA, 103 bp, Artificial Sequence
  Synthetic Polynucleotide
taatacgactcactatagggctctggttggtagaattgagcgatcagtccaacagaggagaggactgatggctcaattcaacctggcggcagcgcaaaagatg

SEQ ID NO: 79154 - DNA, 103 bp, Artificial Sequence
  Synthetic Polynucleotide
taatacgactcactatagggtcacgctctggttggtagaattgagcgatcaacagaggagagatcgcatgattctaccaaacctggcggcagcgcaaaagatg

SEQ ID NO: 79155 - DNA, 103 bp, Artificial Sequence
  Synthetic Polynucleotide
taatacgactcactatagggccttctcacgctctggttggtagaattgagaacagaggagactcaatatgaccaaccagaacctggcggcagcgcaaaagatg

SEQ ID NO: 79156 - DNA, 103 bp, Artificial Sequence
  Synthetic Polynucleotide
taatacgactcactatagggatataccttctcacgctctggttggtagaaaacagaggagattctacatgccagagcgtaacctggcggcagcgcaaaagatg

SEQ ID NO: 79157 - DNA, 103 bp, Artificial Sequence
  Synthetic Polynucleotide
taatacgactcactatagggatggtatataccttctcacgctctggttggaacagaggagaccaaccatggcgtgagaaaacctggcggcagcgcaaaagatg

SEQ ID NO: 79158 - DNA, 103 bp, Artificial Sequence
  Synthetic Polynucleotide
taatacgactcactatagggcagccgacagtactgggcattcataagtgaaacagaggagatcacttatgaatgcccagaacctggcggcagcgcaaaagatg

SEQ ID NO: 79159 - DNA, 103 bp, Artificial Sequence
  Synthetic Polynucleotide
taatacgactcactatagggcatccatggtatataccttctcacgctctgaacagaggagacagagcatgagaaggtataacctggcggcagcgcaaaagatg

SEQ ID NO: 79160 - DNA, 103 bp, Artificial Sequence
  Synthetic Polynucleotide
taatacgactcactatagggttccccatccatggtatataccttctcacgaacagaggagacgtgagatggtatataccaacctggcggcagcgcaaaagatg

SEQ ID NO: 79161 - DNA, 103 bp, Artificial Sequence
  Synthetic Polynucleotide
taatacgactcactatagggcggtattccccatccatggtatataccttcaacagaggagagaaggtatgtaccatggaaacctggcggcagcgcaaaagatg

SEQ ID NO: 79162 - DNA, 103 bp, Artificial Sequence
  Synthetic Polynucleotide
taatacgactcactatagggtgagccggtattccccatccatggtatataaacagaggagatatataatgtggatggggaacctggcggcagcgcaaaagatg

SEQ ID NO: 79163 - DNA, 103 bp, Artificial Sequence
  Synthetic Polynucleotide
taatacgactcactatagggtcctctgagccggtattccccatccatggtaacagaggagaaccatgatgggggaatacaacctggcggcagcgcaaaagatg

SEQ ID NO: 79164 - DNA, 103 bp, Artificial Sequence
  Synthetic Polynucleotide
taatacgactcactatagggtcttctcctctgagccggtattccccatccaacagaggagaggatggatgataccggctaacctggcggcagcgcaaaagatg

SEQ ID NO: 79165 - DNA, 103 bp, Artificial Sequence
  Synthetic Polynucleotide
taatacgactcactatagggttctctcttctcctctgagccggtattcccaacagaggagagggaatatgggctcagagaacctggcggcagcgcaaaagatg

SEQ ID NO: 79166 - DNA, 103 bp, Artificial Sequence
  Synthetic Polynucleotide
taatacgactcactataggggttttttctctcttctcctctgagccggtaaacagaggagataccggatgagaggagaaaacctggcggcagcgcaaaagatg

SEQ ID NO: 79167 - DNA, 103 bp, Artificial Sequence
  Synthetic Polynucleotide
taatacgactcactatagggagaaagttttttctctcttctcctctgagcaacagaggagagctcagatgagaagagagaacctggcggcagcgcaaaagatg

SEQ ID NO: 79168 - DNA, 103 bp, Artificial Sequence
  Synthetic Polynucleotide
taatacgactcactataggggttccagaaagttttttctctcttctcctcaacagaggagagaggagatgagagaaaaaaacctggcggcagcgcaaaagatg

SEQ ID NO: 79169 - DNA, 103 bp, Artificial Sequence
  Synthetic Polynucleotide
taatacgactcactatagggattaccagccgacagtactgggcattcataaacagaggagatatgaaatgccagtactgaacctggcggcagcgcaaaagatg

SEQ ID NO: 79170 - DNA, 103 bp, Artificial Sequence
  Synthetic Polynucleotide
taatacgactcactatagggcaacagttccagaaagttttttctctcttcaacagaggagagaagagatgaaaaactttaacctggcggcagcgcaaaagatg

SEQ ID NO: 79171 - DNA, 103 bp, Artificial Sequence
  Synthetic Polynucleotide
taatacgactcactataggggtcctcaacagttccagaaagttttttctcaacagaggagagagaaaatgctttctggaaacctggcggcagcgcaaaagatg

SEQ ID NO: 79172 - DNA, 103 bp, Artificial Sequence
  Synthetic Polynucleotide
taatacgactcactatagggctgcagtcctcaacagttccagaaagttttaacagaggagaaaaactatgtggaactgtaacctggcggcagcgcaaaagatg

SEQ ID NO: 79173 - DNA, 103 bp, Artificial Sequence
  Synthetic Polynucleotide
taatacgactcactatagggcagatctgcagtcctcaacagttccagaaaaacagaggagatttctgatgctgttgaggaacctggcggcagcgcaaaagatg

SEQ ID NO: 79174 - DNA, 103 bp, Artificial Sequence
  Synthetic Polynucleotide
taatacgactcactatagggactggcagatctgcagtcctcaacagttccaacagaggagaggaactatggaggactgcaacctggcggcagcgcaaaagatg

SEQ ID NO: 79175 - DNA, 103 bp, Artificial Sequence
  Synthetic Polynucleotide
taatacgactcactataggggccaaactggcagatctgcagtcctcaacaaacagaggagatgttgaatgctgcagatcaacctggcggcagcgcaaaagatg

SEQ ID NO: 79176 - DNA, 103 bp, Artificial Sequence
  Synthetic Polynucleotide
taatacgactcactatagggagccagccaaactggcagatctgcagtcctaacagaggagaaggactatggatctgccaaacctggcggcagcgcaaaagatg

SEQ ID NO: 79177 - DNA, 103 bp, Artificial Sequence
  Synthetic Polynucleotide
taatacgactcactatagggttgtaagccagccaaactggcagatctgcaaacagaggagatgcagaatggccagtttgaacctggcggcagcgcaaaagatg

SEQ ID NO: 79178 - DNA, 103 bp, Artificial Sequence
  Synthetic Polynucleotide
taatacgactcactatagggcaaccttgtaagccagccaaactggcagataacagaggagaatctgcatgtttggctggaacctggcggcagcgcaaaagatg

SEQ ID NO: 79179 - DNA, 103 bp, Artificial Sequence
  Synthetic Polynucleotide
taatacgactcactatagggcgctgcaaccttgtaagccagccaaactggaacagaggagaccagttatgctggcttacaacctggcggcagcgcaaaagatg

SEQ ID NO: 79180 - DNA, 103 bp, Artificial Sequence
  Synthetic Polynucleotide
taatacgactcactatagggggatcattaccagccgacagtactgggcataacagaggagaatgcccatgactgtcggcaacctggcggcagcgcaaaagatg

SEQ ID NO: 79181 - DNA, 103 bp, Artificial Sequence
  Synthetic Polynucleotide
taatacgactcactatagggccagccgctgcaaccttgtaagccagccaaaacagaggagattggctatgttacaaggtaacctggcggcagcgcaaaagatg

SEQ ID NO: 79182 - DNA, 103 bp, Artificial Sequence
  Synthetic Polynucleotide
taatacgactcactatagggacactccagccgctgcaaccttgtaagccaaacagaggagatggcttatgaggttgcagaacctggcggcagcgcaaaagatg

SEQ ID NO: 79183 - DNA, 103 bp, Artificial Sequence
  Synthetic Polynucleotide
taatacgactcactataggggtatgacactccagccgctgcaaccttgtaaacagaggagatacaagatggcagcggctaacctggcggcagcgcaaaagatg

SEQ ID NO: 79184 - DNA, 103 bp, Artificial Sequence
  Synthetic Polynucleotide
taatacgactcactatagggtcgtggtatgacactccagccgctgcaaccaacagaggagaggttgcatgggctggagtaacctggcggcagcgcaaaagatg

SEQ ID NO: 79185 - DNA, 103 bp, Artificial Sequence
  Synthetic Polynucleotide
taatacgactcactatagggtccggtcgtggtatgacactccagccgctgaacagaggagacagcggatggagtgtcataacctggcggcagcgcaaaagatg

SEQ ID NO: 79186 - DNA, 103 bp, Artificial Sequence
  Synthetic Polynucleotide
taatacgactcactatagggccacctccggtcgtggtatgacactccagcaacagaggagagctggaatgtcataccacaacctggcggcagcgcaaaagatg

SEQ ID NO: 79187 - DNA, 103 bp, Artificial Sequence
  Synthetic Polynucleotide
taatacgactcactatagggaagcaccacctccggtcgtggtatgacactaacagaggagaagtgtcatgccacgaccgaacctggcggcagcgcaaaagatg

SEQ ID NO: 79188 - DNA, 103 bp, Artificial Sequence
  Synthetic Polynucleotide
taatacgactcactatagggcatcaaagcaccacctccggtcgtggtatgaacagaggagacataccatgaccggaggtaacctggcggcagcgcaaaagatg

SEQ ID NO: 79189 - DNA, 103 bp, Artificial Sequence
  Synthetic Polynucleotide
taatacgactcactatagggaggaccatcaaagcaccacctccggtcgtgaacagaggagacacgacatgaggtggtgcaacctggcggcagcgcaaaagatg

SEQ ID NO: 79190 - DNA, 103 bp, Artificial Sequence
  Synthetic Polynucleotide
taatacgactcactataggggtcctaggaccatcaaagcaccacctccggaacagaggagaccggagatggtgctttgaaacctggcggcagcgcaaaagatg

SEQ ID NO: 79191 - DNA, 103 bp, Artificial Sequence
  Synthetic Polynucleotide
taatacgactcactatagggcttctggatcattaccagccgacagtactgaacagaggagacagtacatgcggctggtaaacctggcggcagcgcaaaagatg

SEQ ID NO: 79192 - DNA, 103 bp, Artificial Sequence
  Synthetic Polynucleotide
taatacgactcactatagggtgtttgtcctaggaccatcaaagcaccaccaacagaggagaggtggtatgttgatggtcaacctggcggcagcgcaaaagatg

SEQ ID NO: 79193 - DNA, 103 bp, Artificial Sequence
  Synthetic Polynucleotide
taatacgactcactatagggaattgtgtttgtcctaggaccatcaaagcaaacagaggagatgctttatgggtcctaggaacctggcggcagcgcaaaagatg

SEQ ID NO: 79194 - DNA, 103 bp, Artificial Sequence
  Synthetic Polynucleotide
taatacgactcactatagggtctaaaattgtgtttgtcctaggaccatcaaacagaggagatgatggatgtaggacaaaaacctggcggcagcgcaaaagatg

SEQ ID NO: 79195 - DNA, 103 bp, Artificial Sequence
  Synthetic Polynucleotide
taatacgactcactatagggtgtcttctaaaattgtgtttgtcctaggacaacagaggagagtcctaatgcaaacacaaaacctggcggcagcgcaaaagatg

SEQ ID NO: 79196 - DNA, 103 bp, Artificial Sequence
  Synthetic Polynucleotide
taatacgactcactataggggttgttgtcttctaaaattgtgtttgtcctaacagaggagaaggacaatgacaattttaaacctggcggcagcgcaaaagatg

SEQ ID NO: 79197 - DNA, 103 bp, Artificial Sequence
  Synthetic Polynucleotide
taatacgactcactatagggacttcgttgttgtcttctaaaattgtgtttaacagaggagaaaacacatgtttagaagaaacctggcggcagcgcaaaagatg

SEQ ID NO: 79198 - DNA, 103 bp, Artificial Sequence
  Synthetic Polynucleotide
taatacgactcactatagggcttccacttcgttgttgtcttctaaaattgaacagaggagacaatttatgaagacaacaaacctggcggcagcgcaaaagatg

SEQ ID NO: 79199 - DNA, 103 bp, Artificial Sequence
  Synthetic Polynucleotide
taatacgactcactataggggatgacttccacttcgttgttgtcttctaaaacagaggagattagaaatgaacaacgaaaacctggcggcagcgcaaaagatg

SEQ ID NO: 79200 - DNA, 103 bp, Artificial Sequence
  Synthetic Polynucleotide
taatacgactcactatagggttcgtgatgacttccacttcgttgttgtctaacagaggagaagacaaatgcgaagtggaaacctggcggcagcgcaaaagatg

SEQ ID NO: 79201 - DNA, 103 bp, Artificial Sequence
  Synthetic Polynucleotide
taatacgactcactatagggcaagcttcgtgatgacttccacttcgttgtaacagaggagaacaacgatgtggaagtcaaacctggcggcagcgcaaaagatg

SEQ ID NO: 79202 - DNA, 103 bp, Artificial Sequence
  Synthetic Polynucleotide
taatacgactcactataggggatgtcttctggatcattaccagccgacagaacagaggagactgtcgatgggtaatgataacctggcggcagcgcaaaagatg

SEQ ID NO: 79203 - DNA, 103 bp, Artificial Sequence
  Synthetic Polynucleotide
taatacgactcactatagggttcaccaagcttcgtgatgacttccacttcaacagaggagagaagtgatggtcatcacgaacctggcggcagcgcaaaagatg

SEQ ID NO: 79204 - DNA, 103 bp, Artificial Sequence
  Synthetic Polynucleotide
taatacgactcactatagggttcctttcaccaagcttcgtgatgacttccaacagaggagaggaagtatgcacgaagctaacctggcggcagcgcaaaagatg

SEQ ID NO: 79205 - DNA, 103 bp, Artificial Sequence
  Synthetic Polynucleotide
taatacgactcactataggggaatcttcctttcaccaagcttcgtgatgaaacagaggagatcatcaatgagcttggtgaacctggcggcagcgcaaaagatg

SEQ ID NO: 79206 - DNA, 103 bp, Artificial Sequence
  Synthetic Polynucleotide
taatacgactcactatagggcctcagaatcttcctttcaccaagcttcgtaacagaggagaacgaagatgggtgaaaggaacctggcggcagcgcaaaagatg

SEQ ID NO: 79207 - DNA, 103 bp, Artificial Sequence
  Synthetic Polynucleotide
taatacgactcactatagggcgcggcctcagaatcttcctttcaccaagcaacagaggagagcttggatgaaggaagataacctggcggcagcgcaaaagatg

SEQ ID NO: 79208 - DNA, 103 bp, Artificial Sequence
  Synthetic Polynucleotide
taatacgactcactatagggtccagcgcggcctcagaatcttcctttcacaacagaggagagtgaaaatgagattctgaaacctggcggcagcgcaaaagatg

SEQ ID NO: 79209 - DNA, 103 bp, Artificial Sequence
  Synthetic Polynucleotide
taatacgactcactatagggatcaatccagcgcggcctcagaatcttcctaacagaggagaaggaagatgctgaggccgaacctggcggcagcgcaaaagatg

SEQ ID NO: 79210 - DNA, 103 bp, Artificial Sequence
  Synthetic Polynucleotide
taatacgactcactatagggctggcatcaatccagcgcggcctcagaatcaacagaggagagattctatggccgcgctgaacctggcggcagcgcaaaagatg

SEQ ID NO: 79211 - DNA, 103 bp, Artificial Sequence
  Synthetic Polynucleotide
taatacgactcactatagggacaccctggcatcaatccagcgcggcctcaaacagaggagatgaggcatggctggattgaacctggcggcagcgcaaaagatg

SEQ ID NO: 79212 - DNA, 103 bp, Artificial Sequence
  Synthetic Polynucleotide
taatacgactcactatagggcgagtacaccctggcatcaatccagcgcggaacagaggagaccgcgcatgattgatgccaacctggcggcagcgcaaaagatg

SEQ ID NO: 79213 - DNA, 103 bp, Artificial Sequence
  Synthetic Polynucleotide
taatacgactcactatagggcagtcgatgtcttctggatcattaccagccaacagaggagaggctggatgtgatccagaaacctggcggcagcgcaaaagatg

SEQ ID NO: 79214 - DNA, 103 bp, Artificial Sequence
  Synthetic Polynucleotide
taatacgactcactatagggtgatccgagtacaccctggcatcaatccagaacagaggagactggatatgtgccagggtaacctggcggcagcgcaaaagatg

SEQ ID NO: 79215 - DNA, 103 bp, Artificial Sequence
  Synthetic Polynucleotide
taatacgactcactatagggcctggtgatccgagtacaccctggcatcaaaacagaggagattgatgatggggtgtactaacctggcggcagcgcaaaagatg

SEQ ID NO: 79216 - DNA, 103 bp, Artificial Sequence
  Synthetic Polynucleotide
taatacgactcactatagggtagtgcctggtgatccgagtacaccctggcaacagaggagagccaggatgtactcggataacctggcggcagcgcaaaagatg

SEQ ID NO: 79217 - DNA, 103 bp, Artificial Sequence
  Synthetic Polynucleotide
taatacgactcactataggggcctttagtgcctggtgatccgagtacaccaacagaggagaggtgtaatgggatcaccaaacctggcggcagcgcaaaagatg

SEQ ID NO: 79218 - DNA, 103 bp, Artificial Sequence
  Synthetic Polynucleotide
taatacgactcactatagggtgaacgcctttagtgcctggtgatccgagtaacagaggagaactcggatgaccaggcacaacctggcggcagcgcaaaagatg

SEQ ID NO: 79219 - DNA, 103 bp, Artificial Sequence
  Synthetic Polynucleotide
taatacgactcactataggggtccttgaacgcctttagtgcctggtgatcaacagaggagagatcacatggcactaaagaacctggcggcagcgcaaaagatg

SEQ ID NO: 79220 - DNA, 103 bp, Artificial Sequence
  Synthetic Polynucleotide
taatacgactcactataggggcgaagtccttgaacgcctttagtgcctggaacagaggagaccaggcatgaaaggcgttaacctggcggcagcgcaaaagatg

SEQ ID NO: 79221 - DNA, 103 bp, Artificial Sequence
  Synthetic Polynucleotide
taatacgactcactatagggccgaggcgaagtccttgaacgcctttagtgaacagaggagacactaaatgcgttcaaggaacctggcggcagcgcaaaagatg

SEQ ID NO: 79222 - DNA, 103 bp, Artificial Sequence
  Synthetic Polynucleotide
taatacgactcactatagggttttcccgaggcgaagtccttgaacgccttaacagaggagaaaggcgatgaaggacttcaacctggcggcagcgcaaaagatg

SEQ ID NO: 79223 - DNA, 103 bp, Artificial Sequence
  Synthetic Polynucleotide
taatacgactcactataggggaacgttttcccgaggcgaagtccttgaacaacagaggagagttcaaatgcttcgcctcaacctggcggcagcgcaaaagatg

SEQ ID NO: 79224 - DNA, 103 bp, Artificial Sequence
  Synthetic Polynucleotide
taatacgactcactatagggaccaacagtcgatgtcttctggatcattacaacagaggagagtaatgatgcagaagacaaacctggcggcagcgcaaaagatg

SEQ ID NO: 79225 - DNA, 103 bp, Artificial Sequence
  Synthetic Polynucleotide
taatacgactcactatagggtctgagaacgttttcccgaggcgaagtcctaacagaggagaaggactatgcctcgggaaaacctggcggcagcgcaaaagatg

SEQ ID NO: 79226 - DNA, 103 bp, Artificial Sequence
  Synthetic Polynucleotide
taatacgactcactatagggccctatctgagaacgttttcccgaggcgaaaacagaggagattcgccatgggaaaacgtaacctggcggcagcgcaaaagatg

SEQ ID NO: 79227 - DNA, 103 bp, Artificial Sequence
  Synthetic Polynucleotide
taatacgactcactatagggatgagccctatctgagaacgttttcccgagaacagaggagactcgggatgacgttctcaaacctggcggcagcgcaaaagatg

SEQ ID NO: 79228 - DNA, 103 bp, Artificial Sequence
  Synthetic Polynucleotide
taatacgactcactatagggcctcaatgagccctatctgagaacgttttcaacagaggagagaaaacatgctcagatagaacctggcggcagcgcaaaagatg

SEQ ID NO: 79229 - DNA, 103 bp, Artificial Sequence
  Synthetic Polynucleotide
taatacgactcactatagggcagaacctcaatgagccctatctgagaacgaacagaggagacgttctatgatagggctcaacctggcggcagcgcaaaagatg

SEQ ID NO: 79230 - DNA, 103 bp, Artificial Sequence
  Synthetic Polynucleotide
taatacgactcactatagggtttcccagaacctcaatgagccctatctgaaacagaggagatcagatatggctcattgaaacctggcggcagcgcaaaagatg

SEQ ID NO: 79231 - DNA, 103 bp, Artificial Sequence
  Synthetic Polynucleotide
taatacgactcactataggggcatctttcccagaacctcaatgagccctaaacagaggagatagggcatgttgaggttcaacctggcggcagcgcaaaagatg

SEQ ID NO: 79232 - DNA, 103 bp, Artificial Sequence
  Synthetic Polynucleotide
taatacgactcactatagggctcaggcatctttcccagaacctcaatgagaacagaggagactcattatggttctgggaaacctggcggcagcgcaaaagatg

SEQ ID NO: 79233 - DNA, 103 bp, Artificial Sequence
  Synthetic Polynucleotide
taatacgactcactatagggaagtgctcaggcatctttcccagaacctcaaacagaggagatgaggtatggggaaagataacctggcggcagcgcaaaagatg

SEQ ID NO: 79234 - DNA, 103 bp, Artificial Sequence
  Synthetic Polynucleotide
taatacgactcactatagggccatgaagtgctcaggcatctttcccagaaaacagaggagattctggatgagatgcctgaacctggcggcagcgcaaaagatg

SEQ ID NO: 79235 - DNA, 103 bp, Artificial Sequence
  Synthetic Polynucleotide
taatacgactcactatagggcttcgtgctaagaaacagctcgcactgtgtaacagaggagaacacagatggagctgtttaacctggcggcagcgcaaaagatg

SEQ ID NO: 79236 - DNA, 103 bp, Artificial Sequence
  Synthetic Polynucleotide
taatacgactcactatagggtgtgcaccaacagtcgatgtcttctggatcaacagaggagagatccaatggacatcgacaacctggcggcagcgcaaaagatg

SEQ ID NO: 79237 - DNA, 103 bp, Artificial Sequence
  Synthetic Polynucleotide
taatacgactcactatagggcttccccatgaagtgctcaggcatctttccaacagaggagaggaaagatgcctgagcacaacctggcggcagcgcaaaagatg

SEQ ID NO: 79238 - DNA, 103 bp, Artificial Sequence
  Synthetic Polynucleotide
taatacgactcactatagggcatgtcttccccatgaagtgctcaggcatcaacagaggagagatgccatggcacttcataacctggcggcagcgcaaaagatg

SEQ ID NO: 79239 - DNA, 103 bp, Artificial Sequence
  Synthetic Polynucleotide
taatacgactcactatagggcttcccatgtcttccccatgaagtgctcagaacagaggagactgagcatgtcatggggaaacctggcggcagcgcaaaagatg

SEQ ID NO: 79240 - DNA, 103 bp, Artificial Sequence
  Synthetic Polynucleotide
taatacgactcactatagggaagtgcttcccatgtcttccccatgaagtgaacagaggagacacttcatggggaagacaaacctggcggcagcgcaaaagatg

SEQ ID NO: 79241 - DNA, 103 bp, Artificial Sequence
  Synthetic Polynucleotide
taatacgactcactataggggtgtcaagtgcttcccatgtcttccccatgaacagaggagacatgggatggacatgggaaacctggcggcagcgcaaaagatg

SEQ ID NO: 79242 - DNA, 103 bp, Artificial Sequence
  Synthetic Polynucleotide
taatacgactcactatagggacatggtgtcaagtgcttcccatgtcttccaacagaggagaggaagaatggggaagcacaacctggcggcagcgcaaaagatg

SEQ ID NO: 79243 - DNA, 103 bp, Artificial Sequence
  Synthetic Polynucleotide
taatacgactcactatagggaacgtacatggtgtcaagtgcttcccatgtaacagaggagaacatggatggcacttgacaacctggcggcagcgcaaaagatg

SEQ ID NO: 79244 - DNA, 103 bp, Artificial Sequence
  Synthetic Polynucleotide
taatacgactcactataggggccacaacgtacatggtgtcaagtgcttccaacagaggagaggaagcatgtgacaccataacctggcggcagcgcaaaagatg

SEQ ID NO: 79245 - DNA, 103 bp, Artificial Sequence
  Synthetic Polynucleotide
taatacgactcactatagggcagtggccacaacgtacatggtgtcaagtgaacagaggagacacttgatgccatgtacgaacctggcggcagcgcaaaagatg

SEQ ID NO: 79246 - DNA, 103 bp, Artificial Sequence
  Synthetic Polynucleotide
taatacgactcactatagggctctgcagtggccacaacgtacatggtgtcaacagaggagagacaccatgtacgttgtgaacctggcggcagcgcaaaagatg

SEQ ID NO: 79247 - DNA, 103 bp, Artificial Sequence
  Synthetic Polynucleotide
taatacgactcactataggggactttgtgcaccaacagtcgatgtcttctaacagaggagaagaagaatgcgactgttgaacctggcggcagcgcaaaagatg

SEQ ID NO: 79248 - DNA, 103 bp, Artificial Sequence
  Synthetic Polynucleotide
taatacgactcactatagggcctttctctgcagtggccacaacgtacatgaacagaggagacatgtaatgtgtggccacaacctggcggcagcgcaaaagatg

SEQ ID NO: 79249 - DNA, 103 bp, Artificial Sequence
  Synthetic Polynucleotide
taatacgactcactatagggttcctcctttctctgcagtggccacaacgtaacagaggagaacgttgatgccactgcagaacctggcggcagcgcaaaagatg

SEQ ID NO: 79250 - DNA, 103 bp, Artificial Sequence
  Synthetic Polynucleotide
taatacgactcactatagggagctcttcctcctttctctgcagtggccacaacagaggagagtggccatggcagagaaaaacctggcggcagcgcaaaagatg

SEQ ID NO: 79251 - DNA, 103 bp, Artificial Sequence
  Synthetic Polynucleotide
taatacgactcactatagggctgtgagctcttcctcctttctctgcagtgaacagaggagacactgcatggaaaggaggaacctggcggcagcgcaaaagatg

SEQ ID NO: 79252 - DNA, 103 bp, Artificial Sequence
  Synthetic Polynucleotide
taatacgactcactatagggccattctgtgagctcttcctcctttctctgaacagaggagacagagaatggaggaagagaacctggcggcagcgcaaaagatg

SEQ ID NO: 79253 - DNA, 103 bp, Artificial Sequence
  Synthetic Polynucleotide
taatacgactcactatagggcagggccattctgtgagctcttcctcctttaacagaggagaaaaggaatgagagctcacaacctggcggcagcgcaaaagatg

SEQ ID NO: 79254 - DNA, 103 bp, Artificial Sequence
  Synthetic Polynucleotide
taatacgactcactatagggtcctccagggccattctgtgagctcttcctaacagaggagaaggaagatgtcacagaataacctggcggcagcgcaaaagatg

SEQ ID NO: 79255 - DNA, 103 bp, Artificial Sequence
  Synthetic Polynucleotide
taatacgactcactataggggcagttcctccagggccattctgtgagctcaacagaggagagagctcatggaatggcccaacctggcggcagcgcaaaagatg

SEQ ID NO: 79256 - DNA, 103 bp, Artificial Sequence
  Synthetic Polynucleotide
taatacgactcactatagggatctggcagttcctccagggccattctgtgaacagaggagacacagaatggccctggagaacctggcggcagcgcaaaagatg

SEQ ID NO: 79257 - DNA, 103 bp, Artificial Sequence
  Synthetic Polynucleotide
taatacgactcactatagggagagcatctggcagttcctccagggccattaacagaggagaaatggcatgggaggaactaacctggcggcagcgcaaaagatg

SEQ ID NO: 79258 - DNA, 103 bp, Artificial Sequence
  Synthetic Polynucleotide
taatacgactcactatagggctgctgactttgtgcaccaacagtcgatgtaacagaggagaacatcgatggttggtgcaaacctggcggcagcgcaaaagatg

SEQ ID NO: 79259 - DNA, 103 bp, Artificial Sequence
  Synthetic Polynucleotide
taatacgactcactatagggtctgaagagcatctggcagttcctccagggaacagaggagaccctggatgaactgccagaacctggcggcagcgcaaaagatg

SEQ ID NO: 79260 - DNA, 103 bp, Artificial Sequence
  Synthetic Polynucleotide
taatacgactcactatagggaattgtctgaagagcatctggcagttcctcaacagaggagagaggaaatgccagatgctaacctggcggcagcgcaaaagatg

SEQ ID NO: 79261 - DNA, 103 bp, Artificial Sequence
  Synthetic Polynucleotide
taatacgactcactatagggaaggcaattgtctgaagagcatctggcagtaacagaggagaactgccatgtgctcttcaaacctggcggcagcgcaaaagatg

SEQ ID NO: 79262 - DNA, 103 bp, Artificial Sequence
  Synthetic Polynucleotide
taatacgactcactatagggcaatcaaggcaattgtctgaagagcatctgaacagaggagacagatgatgttcagacaaaacctggcggcagcgcaaaagatg

SEQ ID NO: 79263 - DNA, 103 bp, Artificial Sequence
  Synthetic Polynucleotide
taatacgactcactatagggtaaggcaatcaaggcaattgtctgaagagcaacagaggagagctcttatgacaattgccaacctggcggcagcgcaaaagatg

SEQ ID NO: 79264 - DNA, 103 bp, Artificial Sequence
  Synthetic Polynucleotide
taatacgactcactatagggctcaataaggcaatcaaggcaattgtctgaaacagaggagatcagacatgtgccttgataacctggcggcagcgcaaaagatg

SEQ ID NO: 79265 - DNA, 103 bp, Artificial Sequence
  Synthetic Polynucleotide
taatacgactcactatagggtcacactcaataaggcaatcaaggcaattgaacagaggagacaattgatgtgattgcctaacctggcggcagcgcaaaagatg

SEQ ID NO: 79266 - DNA, 103 bp, Artificial Sequence
  Synthetic Polynucleotide
taatacgactcactatagggggtcatcacactcaataaggcaatcaaggcaacagaggagagccttgatggccttattgaacctggcggcagcgcaaaagatg

SEQ ID NO: 79267 - DNA, 103 bp, Artificial Sequence
  Synthetic Polynucleotide
taatacgactcactatagggcccatggtcatcacactcaataaggcaatcaacagaggagagattgcatgattgagtgtaacctggcggcagcgcaaaagatg

SEQ ID NO: 79268 - DNA, 103 bp, Artificial Sequence
  Synthetic Polynucleotide
taatacgactcactatagggatactcccatggtcatcacactcaataaggaacagaggagaccttatatggtgtgatgaaacctggcggcagcgcaaaagatg

SEQ ID NO: 79269 - DNA, 103 bp, Artificial Sequence
  Synthetic Polynucleotide
taatacgactcactataggggtagactgctgactttgtgcaccaacagtcaacagaggagagactgtatgtgcacaaagaacctggcggcagcgcaaaagatg

SEQ ID NO: 79270 - DNA, 103 bp, Artificial Sequence
  Synthetic Polynucleotide
taatacgactcactataggggaagaatactcccatggtcatcacactcaaaacagaggagattgagtatgatgaccatgaacctggcggcagcgcaaaagatg

SEQ ID NO: 79271 - DNA, 103 bp, Artificial Sequence
  Synthetic Polynucleotide
taatacgactcactatagggaggaggaagaatactcccatggtcatcacaaacagaggagatgtgatatgcatgggagtaacctggcggcagcgcaaaagatg

SEQ ID NO: 79272 - DNA, 103 bp, Artificial Sequence
  Synthetic Polynucleotide
taatacgactcactataggggcatgaggaggaagaatactcccatggtcaaacagaggagatgaccaatggagtattctaacctggcggcagcgcaaaagatg

SEQ ID NO: 79273 - DNA, 103 bp, Artificial Sequence
  Synthetic Polynucleotide
taatacgactcactatagggccgctgcatgaggaggaagaatactcccataacagaggagaatgggaatgttcttcctcaacctggcggcagcgcaaaagatg

SEQ ID NO: 79274 - DNA, 103 bp, Artificial Sequence
  Synthetic Polynucleotide
taatacgactcactatagggcccttccgctgcatgaggaggaagaatactaacagaggagaagtattatgcctcctcataacctggcggcagcgcaaaagatg

SEQ ID NO: 79275 - DNA, 103 bp, Artificial Sequence
  Synthetic Polynucleotide
taatacgactcactatagggcaatgcccttccgctgcatgaggaggaagaaacagaggagatcttccatgtcatgcagcaacctggcggcagcgcaaaagatg

SEQ ID NO: 79276 - DNA, 103 bp, Artificial Sequence
  Synthetic Polynucleotide
taatacgactcactatagggctttccaatgcccttccgctgcatgaggagaacagaggagactcctcatgcagcggaagaacctggcggcagcgcaaaagatg

SEQ ID NO: 79277 - DNA, 103 bp, Artificial Sequence
  Synthetic Polynucleotide
taatacgactcactatagggcctatctttccaatgcccttccgctgcatgaacagaggagacatgcaatggaagggcataacctggcggcagcgcaaaagatg

SEQ ID NO: 79278 - DNA, 103 bp, Artificial Sequence
  Synthetic Polynucleotide
taatacgactcactatagggccaaacctatctttccaatgcccttccgctaacagaggagaagcggaatggcattggaaaacctggcggcagcgcaaaagatg

SEQ ID NO: 79279 - DNA, 103 bp, Artificial Sequence
  Synthetic Polynucleotide
taatacgactcactataggggcctcccaaacctatctttccaatgcccttaacagaggagaaagggcatgggaaagataaacctggcggcagcgcaaaagatg

SEQ ID NO: 79280 - DNA, 103 bp, Artificial Sequence
  Synthetic Polynucleotide
taatacgactcactatagggctgacgtagactgctgactttgtgcaccaaaacagaggagattggtgatgaaagtcagcaacctggcggcagcgcaaaagatg

SEQ ID NO: 79281 - DNA, 103 bp, Artificial Sequence
  Synthetic Polynucleotide
taatacgactcactatagggacagcgcctcccaaacctatctttccaatgaacagaggagacattggatggataggtttaacctggcggcagcgcaaaagatg

SEQ ID NO: 79282 - DNA, 103 bp, Artificial Sequence
  Synthetic Polynucleotide
taatacgactcactatagggccaagacagcgcctcccaaacctatctttcaacagaggagagaaagaatggtttgggagaacctggcggcagcgcaaaagatg

SEQ ID NO: 79283 - DNA, 103 bp, Artificial Sequence
  Synthetic Polynucleotide
taatacgactcactataggggactcccaagacagcgcctcccaaacctataacagaggagaataggtatgggaggcgctaacctggcggcagcgcaaaagatg

SEQ ID NO: 79284 - DNA, 103 bp, Artificial Sequence
  Synthetic Polynucleotide
taatacgactcactataggggtcgcgactcccaagacagcgcctcccaaaaacagaggagatttgggatgcgctgtcttaacctggcggcagcgcaaaagatg

SEQ ID NO: 79285 - DNA, 103 bp, Artificial Sequence
  Synthetic Polynucleotide
taatacgactcactatagggaaaaggtcgcgactcccaagacagcgcctcaacagaggagagaggcgatgtcttgggagaacctggcggcagcgcaaaagatg

SEQ ID NO: 79286 - DNA, 103 bp, Artificial Sequence
  Synthetic Polynucleotide
taatacgactcactatagggacagaaaaaggtcgcgactcccaagacagcaacagaggagagctgtcatgggagtcgcgaacctggcggcagcgcaaaagatg

SEQ ID NO: 79287 - DNA, 103 bp, Artificial Sequence
  Synthetic Polynucleotide
taatacgactcactatagggatccaacagaaaaaggtcgcgactcccaagaacagaggagacttgggatgcgcgaccttaacctggcggcagcgcaaaagatg

SEQ ID NO: 79288 - DNA, 103 bp, Artificial Sequence
  Synthetic Polynucleotide
taatacgactcactatagggcagccatccaacagaaaaaggtcgcgactcaacagaggagagagtcgatgcctttttctaacctggcggcagcgcaaaagatg

SEQ ID NO: 79289 - DNA, 103 bp, Artificial Sequence
  Synthetic Polynucleotide
taatacgactcactatagggaacttcagccatccaacagaaaaaggtcgcaacagaggagagcgaccatgttctgttggaacctggcggcagcgcaaaagatg

SEQ ID NO: 79290 - DNA, 103 bp, Artificial Sequence
  Synthetic Polynucleotide
taatacgactcactatagggcctggaacttcagccatccaacagaaaaagaacagaggagactttttatgttggatggcaacctggcggcagcgcaaaagatg

SEQ ID NO: 79291 - DNA, 103 bp, Artificial Sequence
  Synthetic Polynucleotide
taatacgactcactatagggcatacctgacgtagactgctgactttgtgcaacagaggagagcacaaatgcagcagtctaacctggcggcagcgcaaaagatg

SEQ ID NO: 79292 - DNA, 103 bp, Artificial Sequence
  Synthetic Polynucleotide
taatacgactcactatagggtcgttcctggaacttcagccatccaacagaaacagaggagatctgttatgtggctgaagaacctggcggcagcgcaaaagatg

SEQ ID NO: 79293 - DNA, 103 bp, Artificial Sequence
  Synthetic Polynucleotide
taatacgactcactataggggatcttcgttcctggaacttcagccatccaaacagaggagatggatgatggaagttccaaacctggcggcagcgcaaaagatg

SEQ ID NO: 79294 - DNA, 103 bp, Artificial Sequence
  Synthetic Polynucleotide
taatacgactcactatagggccggcgatcttcgttcctggaacttcagccaacagaggagaggctgaatgtccaggaacaacctggcggcagcgcaaaagatg

SEQ ID NO: 79295 - DNA, 103 bp, Artificial Sequence
  Synthetic Polynucleotide
taatacgactcactatagggacattccggcgatcttcgttcctggaacttaacagaggagaaagttcatggaacgaagaaacctggcggcagcgcaaaagatg

SEQ ID NO: 79296 - DNA, 103 bp, Artificial Sequence
  Synthetic Polynucleotide
taatacgactcactatagggcagcaacattccggcgatcttcgttcctggaacagaggagaccaggaatgaagatcgccaacctggcggcagcgcaaaagatg

SEQ ID NO: 79297 - DNA, 103 bp, Artificial Sequence
  Synthetic Polynucleotide
taatacgactcactataggggagagcagcaacattccggcgatcttcgttaacagaggagaaacgaaatgcgccggaataacctggcggcagcgcaaaagatg

SEQ ID NO: 79298 - DNA, 103 bp, Artificial Sequence
  Synthetic Polynucleotide
taatacgactcactataggggaagggagagcagcaacattccggcgatctaacagaggagaagatcgatggaatgttgcaacctggcggcagcgcaaaagatg

SEQ ID NO: 79299 - DNA, 103 bp, Artificial Sequence
  Synthetic Polynucleotide
taatacgactcactatagggcaagagaagggagagcagcaacattccggcaacagaggagagccggaatgttgctgctcaacctggcggcagcgcaaaagatg

SEQ ID NO: 79300 - DNA, 103 bp, Artificial Sequence
  Synthetic Polynucleotide
taatacgactcactatagggatcatcaagagaagggagagcagcaacattaacagaggagaaatgttatggctctccctaacctggcggcagcgcaaaagatg

SEQ ID NO: 79301 - DNA, 103 bp, Artificial Sequence
  Synthetic Polynucleotide
taatacgactcactataggggcacaatcatcaagagaagggagagcagcaaacagaggagatgctgcatgcccttctctaacctggcggcagcgcaaaagatg

SEQ ID NO: 79302 - DNA, 103 bp, Artificial Sequence
  Synthetic Polynucleotide
taatacgactcactatagggtcttccatacctgacgtagactgctgacttaacagaggagaaagtcaatggtctacgtcaacctggcggcagcgcaaaagatg

SEQ ID NO: 79303 - DNA, 103 bp, Artificial Sequence
  Synthetic Polynucleotide
taatacgactcactatagggaattagcacaatcatcaagagaagggagagaacagaggagactctccatgctcttgatgaacctggcggcagcgcaaaagatg

SEQ ID NO: 79304 - DNA, 103 bp, Artificial Sequence
  Synthetic Polynucleotide
taatacgactcactatagggtcaggaattagcacaatcatcaagagaaggaacagaggagaccttctatggatgattgtaacctggcggcagcgcaaaagatg

SEQ ID NO: 79305 - DNA, 103 bp, Artificial Sequence
  Synthetic Polynucleotide
taatacgactcactatagggctggctcaggaattagcacaatcatcaagaaacagaggagatcttgaatgttgtgctaaaacctggcggcagcgcaaaagatg

SEQ ID NO: 79306 - DNA, 103 bp, Artificial Sequence
  Synthetic Polynucleotide
taatacgactcactatagggcttctctggctcaggaattagcacaatcataacagaggagaatgattatgctaattcctaacctggcggcagcgcaaaagatg

SEQ ID NO: 79307 - DNA, 103 bp, Artificial Sequence
  Synthetic Polynucleotide
taatacgactcactatagggcgttgcttctctggctcaggaattagcacaaacagaggagatgtgctatgtcctgagccaacctggcggcagcgcaaaagatg

SEQ ID NO: 79308 - DNA, 103 bp, Artificial Sequence
  Synthetic Polynucleotide
taatacgactcactataggggcgaacgttgcttctctggctcaggaattaaacagaggagataattcatgagccagagaaacctggcggcagcgcaaaagatg

SEQ ID NO: 79309 - DNA, 103 bp, Artificial Sequence
  Synthetic Polynucleotide
taatacgactcactatagggtgtctgcgaacgttgcttctctggctcaggaacagaggagacctgagatggagaagcaaaacctggcggcagcgcaaaagatg

SEQ ID NO: 79310 - DNA, 103 bp, Artificial Sequence
  Synthetic Polynucleotide
taatacgactcactatagggttgtctgtctgcgaacgttgcttctctggcaacagaggagagccagaatggcaacgttcaacctggcggcagcgcaaaagatg

SEQ ID NO: 79311 - DNA, 103 bp, Artificial Sequence
  Synthetic Polynucleotide
taatacgactcactataggggctggttgtctgtctgcgaacgttgcttctaacagaggagaagaagcatggttcgcagaaacctggcggcagcgcaaaagatg

SEQ ID NO: 79312 - DNA, 103 bp, Artificial Sequence
  Synthetic Polynucleotide
taatacgactcactatagggggctagctggttgtctgtctgcgaacgttgaacagaggagacaacgtatgcagacagacaacctggcggcagcgcaaaagatg

SEQ ID NO: 79313 - DNA, 103 bp, Artificial Sequence
  Synthetic Polynucleotide
taatacgactcactataggggtgcatcttccatacctgacgtagactgctaacagaggagaagcagtatgcgtcaggtaaacctggcggcagcgcaaaagatg

SEQ ID NO: 79314 - DNA, 103 bp, Artificial Sequence
  Synthetic Polynucleotide
taatacgactcactatagggaacacggctagctggttgtctgtctgcgaaaacagaggagattcgcaatgagacaaccaaacctggcggcagcgcaaaagatg

SEQ ID NO: 79315 - DNA, 103 bp, Artificial Sequence
  Synthetic Polynucleotide
taatacgactcactatagggtcaggaacacggctagctggttgtctgtctaacagaggagaagacagatgaccagctagaacctggcggcagcgcaaaagatg

SEQ ID NO: 79316 - DNA, 103 bp, Artificial Sequence
  Synthetic Polynucleotide
taatacgactcactatagggacaaatcaggaacacggctagctggttgtcaacagaggagagacaacatgctagccgtgaacctggcggcagcgcaaaagatg

SEQ ID NO: 79317 - DNA, 103 bp, Artificial Sequence
  Synthetic Polynucleotide
taatacgactcactatagggatgacacaaatcaggaacacggctagctggaacagaggagaccagctatgcgtgttcctaacctggcggcagcgcaaaagatg

SEQ ID NO: 79318 - DNA, 103 bp, Artificial Sequence
  Synthetic Polynucleotide
taatacgactcactataggggggtcatgacacaaatcaggaacacggctaaacagaggagatagccgatgtcctgatttaacctggcggcagcgcaaaagatg

SEQ ID NO: 79319 - DNA, 103 bp, Artificial Sequence
  Synthetic Polynucleotide
taatacgactcactatagggcacaagggtcatgacacaaatcaggaacacaacagaggagagtgttcatgatttgtgtcaacctggcggcagcgcaaaagatg

SEQ ID NO: 79320 - DNA, 103 bp, Artificial Sequence
  Synthetic Polynucleotide
taatacgactcactataggggcgctcacaagggtcatgacacaaatcaggaacagaggagacctgatatgtgtcatgacaacctggcggcagcgcaaaagatg

SEQ ID NO: 79321 - DNA, 103 bp, Artificial Sequence
  Synthetic Polynucleotide
taatacgactcactatagggccactgcgctcacaagggtcatgacacaaaaacagaggagatttgtgatgtgacccttgaacctggcggcagcgcaaaagatg

SEQ ID NO: 79322 - DNA, 103 bp, Artificial Sequence
  Synthetic Polynucleotide
taatacgactcactatagggggctgccactgcgctcacaagggtcatgacaacagaggagagtcatgatgcttgtgagcaacctggcggcagcgcaaaagatg

SEQ ID NO: 79323 - DNA, 103 bp, Artificial Sequence
  Synthetic Polynucleotide
taatacgactcactatagggtcgttggctgccactgcgctcacaagggtcaacagaggagagaccctatggagcgcagtaacctggcggcagcgcaaaagatg

SEQ ID NO: 79324 - DNA, 103 bp, Artificial Sequence
  Synthetic Polynucleotide
taatacgactcactatagggtcttggtgcatcttccatacctgacgtagaaacagaggagatctacgatgggtatggaaaacctggcggcagcgcaaaagatg

SEQ ID NO: 79325 - DNA, 103 bp, Artificial Sequence
  Synthetic Polynucleotide
taatacgactcactatagggccatctcgttggctgccactgcgctcacaaaacagaggagattgtgaatgcagtggcagaacctggcggcagcgcaaaagatg

SEQ ID NO: 79326 - DNA, 103 bp, Artificial Sequence
  Synthetic Polynucleotide
taatacgactcactatagggccaacccatctcgttggctgccactgcgctaacagaggagaagcgcaatggcagccaacaacctggcggcagcgcaaaagatg

SEQ ID NO: 79327 - DNA, 103 bp, Artificial Sequence
  Synthetic Polynucleotide
taatacgactcactatagggtctagccaacccatctcgttggctgccactaacagaggagaagtggcatgcaacgagataacctggcggcagcgcaaaagatg

SEQ ID NO: 79328 - DNA, 103 bp, Artificial Sequence
  Synthetic Polynucleotide
taatacgactcactatagggtcttatctagccaacccatctcgttggctgaacagaggagacagccaatgagatgggttaacctggcggcagcgcaaaagatg

SEQ ID NO: 79329 - DNA, 103 bp, Artificial Sequence
  Synthetic Polynucleotide
taatacgactcactatagggcttggtcttatctagccaacccatctcgttaacagaggagaaacgagatgggttggctaaacctggcggcagcgcaaaagatg

SEQ ID NO: 79330 - DNA, 103 bp, Artificial Sequence
  Synthetic Polynucleotide
taatacgactcactatagggtcactcttggtcttatctagccaacccatcaacagaggagagatgggatggctagataaaacctggcggcagcgcaaaagatg

SEQ ID NO: 79331 - DNA, 103 bp, Artificial Sequence
  Synthetic Polynucleotide
taatacgactcactatagggttatgtcactcttggtcttatctagccaacaacagaggagagttggcatgataagaccaaacctggcggcagcgcaaaagatg

SEQ ID NO: 79332 - DNA, 103 bp, Artificial Sequence
  Synthetic Polynucleotide
taatacgactcactatagggactgcttatgtcactcttggtcttatctagaacagaggagactagatatgaccaagagtaacctggcggcagcgcaaaagatg

SEQ ID NO: 79333 - DNA, 103 bp, Artificial Sequence
  Synthetic Polynucleotide
taatacgactcactatagggaacaaactgcttatgtcactcttggtcttaaacagaggagataagacatggagtgacataacctggcggcagcgcaaaagatg

SEQ ID NO: 79334 - DNA, 103 bp, Artificial Sequence
  Synthetic Polynucleotide
taatacgactcactataggggcccaaacaaactgcttatgtcactcttggaacagaggagaccaagaatgacataagcaaacctggcggcagcgcaaaagatg

SEQ ID NO: 79335 - DNA, 103 bp, Artificial Sequence
  Synthetic Polynucleotide
taatacgactcactataggggcgtgtcttggtgcatcttccatacctgacaacagaggagagtcaggatgggaagatgcaacctggcggcagcgcaaaagatg

SEQ ID NO: 79336 - DNA, 103 bp, Artificial Sequence
  Synthetic Polynucleotide
taatacgactcactatagggtctttgcccaaacaaactgcttatgtcactaacagaggagaagtgacatgagcagtttgaacctggcggcagcgcaaaagatg

SEQ ID NO: 79337 - DNA, 103 bp, Artificial Sequence
  Synthetic Polynucleotide
taatacgactcactatagggtcaattctttgcccaaacaaactgcttatgaacagaggagacataagatgtttgtttggaacctggcggcagcgcaaaagatg

SEQ ID NO: 79338 - DNA, 103 bp, Artificial Sequence
  Synthetic Polynucleotide
taatacgactcactatagggtgacctcaattctttgcccaaacaaactgcaacagaggagagcagttatgttgggcaaaaacctggcggcagcgcaaaagatg

SEQ ID NO: 79339 - DNA, 103 bp, Artificial Sequence
  Synthetic Polynucleotide
taatacgactcactatagggctccttgacctcaattctttgcccaaacaaaacagaggagattgtttatgcaaagaattaacctggcggcagcgcaaaagatg

SEQ ID NO: 79340 - DNA, 103 bp, Artificial Sequence
  Synthetic Polynucleotide
taatacgactcactatagggaaattctccttgacctcaattctttgcccaaacagaggagatgggcaatgaattgaggtaacctggcggcagcgcaaaagatg

SEQ ID NO: 79341 - DNA, 103 bp, Artificial Sequence
  Synthetic Polynucleotide
taatacgactcactatagggtgctgaaattctccttgacctcaattctttaacagaggagaaaagaaatgaggtcaaggaacctggcggcagcgcaaaagatg

SEQ ID NO: 79342 - DNA, 103 bp, Artificial Sequence
  Synthetic Polynucleotide
taatacgactcactatagggtcccatgctgaaattctccttgacctcaataacagaggagaattgagatgaaggagaataacctggcggcagcgcaaaagatg

SEQ ID NO: 79343 - DNA, 103 bp, Artificial Sequence
  Synthetic Polynucleotide
taatacgactcactatagggaactctcccatgctgaaattctccttgaccaacagaggagaggtcaaatggaatttcagaacctggcggcagcgcaaaagatg

SEQ ID NO: 79344 - DNA, 103 bp, Artificial Sequence
  Synthetic Polynucleotide
taatacgactcactataggggaagaaactctcccatgctgaaattctcctaacagaggagaaggagaatgtcagcatggaacctggcggcagcgcaaaagatg

SEQ ID NO: 79345 - DNA, 103 bp, Artificial Sequence
  Synthetic Polynucleotide
taatacgactcactataggggtccagaagaaactctcccatgctgaaattaacagaggagaaatttcatgatgggagagaacctggcggcagcgcaaaagatg

SEQ ID NO: 79346 - DNA, 103 bp, Artificial Sequence
  Synthetic Polynucleotide
taatacgactcactataggggagatcttcgtgctaagaaacagctcgcacaacagaggagagtgcgaatggtttcttagaacctggcggcagcgcaaaagatg

SEQ ID NO: 79347 - DNA, 103 bp, Artificial Sequence
  Synthetic Polynucleotide
taatacgactcactataggggagtggcgtgtcttggtgcatcttccatacaacagaggagagtatggatgatgcaccaaaacctggcggcagcgcaaaagatg

SEQ ID NO: 79348 - DNA, 103 bp, Artificial Sequence
  Synthetic Polynucleotide
taatacgactcactatagggctcaagtccagaagaaactctcccatgctgaacagaggagacagcatatgagagtttctaacctggcggcagcgcaaaagatg

SEQ ID NO: 79349 - DNA, 103 bp, Artificial Sequence
  Synthetic Polynucleotide
taatacgactcactatagggccggcctcaagtccagaagaaactctcccaaacagaggagatgggagatgttcttctggaacctggcggcagcgcaaaagatg

SEQ ID NO: 79350 - DNA, 103 bp, Artificial Sequence
  Synthetic Polynucleotide
taatacgactcactatagggtgttgccggcctcaagtccagaagaaactcaacagaggagagagtttatgctggacttgaacctggcggcagcgcaaaagatg

SEQ ID NO: 79351 - DNA, 103 bp, Artificial Sequence
  Synthetic Polynucleotide
taatacgactcactatagggcaggctgttgccggcctcaagtccagaagaaacagaggagatcttctatgcttgaggccaacctggcggcagcgcaaaagatg

SEQ ID NO: 79352 - DNA, 103 bp, Artificial Sequence
  Synthetic Polynucleotide
taatacgactcactataggggtgaccaggctgttgccggcctcaagtccaaacagaggagatggactatgggccggcaaaacctggcggcagcgcaaaagatg

SEQ ID NO: 79353 - DNA, 103 bp, Artificial Sequence
  Synthetic Polynucleotide
taatacgactcactataggggtacagtgaccaggctgttgccggcctcaaaacagaggagattgaggatggcaacagccaacctggcggcagcgcaaaagatg

SEQ ID NO: 79354 - DNA, 103 bp, Artificial Sequence
  Synthetic Polynucleotide
taatacgactcactatagggacagcgtacagtgaccaggctgttgccggcaacagaggagagccggcatgagcctggtcaacctggcggcagcgcaaaagatg

SEQ ID NO: 79355 - DNA, 103 bp, Artificial Sequence
  Synthetic Polynucleotide
taatacgactcactatagggttgtcacagcgtacagtgaccaggctgttgaacagaggagacaacagatgggtcactgtaacctggcggcagcgcaaaagatg

SEQ ID NO: 79356 - DNA, 103 bp, Artificial Sequence
  Synthetic Polynucleotide
taatacgactcactatagggcgctgttgtcacagcgtacagtgaccaggcaacagaggagagcctggatgctgtacgctaacctggcggcagcgcaaaagatg

SEQ ID NO: 79357 - DNA, 103 bp, Artificial Sequence
  Synthetic Polynucleotide
taatacgactcactatagggaggaccgctgttgtcacagcgtacagtgacaacagaggagagtcactatgcgctgtgacaacctggcggcagcgcaaaagatg

SEQ ID NO: 79358 - DNA, 103 bp, Artificial Sequence
  Synthetic Polynucleotide
taatacgactcactataggggtcttgagtggcgtgtcttggtgcatcttcaacagaggagagaagatatgccaagacacaacctggcggcagcgcaaaagatg

SEQ ID NO: 79359 - DNA, 103 bp, Artificial Sequence
  Synthetic Polynucleotide
taatacgactcactataggggagtgaggaccgctgttgtcacagcgtacaaacagaggagatgtacgatgtgacaacagaacctggcggcagcgcaaaagatg

SEQ ID NO: 79360 - DNA, 103 bp, Artificial Sequence
  Synthetic Polynucleotide
taatacgactcactatagggcagtggagtgaggaccgctgttgtcacagcaacagaggagagctgtgatgacagcggtcaacctggcggcagcgcaaaagatg

SEQ ID NO: 79361 - DNA, 103 bp, Artificial Sequence
  Synthetic Polynucleotide
taatacgactcactatagggtttagcagtggagtgaggaccgctgttgtcaacagaggagagacaacatgggtcctcacaacctggcggcagcgcaaaagatg

SEQ ID NO: 79362 - DNA, 103 bp, Artificial Sequence
  Synthetic Polynucleotide
taatacgactcactatagggaatgctttagcagtggagtgaggaccgctgaacagaggagacagcggatgtcactccacaacctggcggcagcgcaaaagatg

SEQ ID NO: 79363 - DNA, 103 bp, Artificial Sequence
  Synthetic Polynucleotide
taatacgactcactataggggatcaaatgctttagcagtggagtgaggacaacagaggagagtcctcatgccactgctaaacctggcggcagcgcaaaagatg

SEQ ID NO: 79364 - DNA, 103 bp, Artificial Sequence
  Synthetic Polynucleotide
taatacgactcactataggggacgtgatcaaatgctttagcagtggagtgaacagaggagacactccatggctaaagcaaacctggcggcagcgcaaaagatg

SEQ ID NO: 79365 - DNA, 103 bp, Artificial Sequence
  Synthetic Polynucleotide
taatacgactcactatagggaatctgacgtgatcaaatgctttagcagtgaacagaggagacactgcatgagcatttgaaacctggcggcagcgcaaaagatg

SEQ ID NO: 79366 - DNA, 103 bp, Artificial Sequence
  Synthetic Polynucleotide
taatacgactcactataggggatgtaatctgacgtgatcaaatgctttagaacagaggagactaaagatgttgatcacgaacctggcggcagcgcaaaagatg

SEQ ID NO: 79367 - DNA, 103 bp, Artificial Sequence
  Synthetic Polynucleotide
taatacgactcactataggggtgttgatgtaatctgacgtgatcaaatgcaacagaggagagcatttatgcacgtcagaaacctggcggcagcgcaaaagatg

SEQ ID NO: 79368 - DNA, 103 bp, Artificial Sequence
  Synthetic Polynucleotide
taatacgactcactatagggatgaggtgttgatgtaatctgacgtgatcaaacagaggagatgatcaatgcagattacaaacctggcggcagcgcaaaagatg

SEQ ID NO: 79369 - DNA, 103 bp, Artificial Sequence
  Synthetic Polynucleotide
taatacgactcactatagggactgcgtcttgagtggcgtgtcttggtgcaaacagaggagatgcaccatgacacgccacaacctggcggcagcgcaaaagatg

SEQ ID NO: 79370 - DNA, 103 bp, Artificial Sequence
  Synthetic Polynucleotide
taatacgactcactatagggggtcaatgaggtgttgatgtaatctgacgtaacagaggagaacgtcaatgtacatcaacaacctggcggcagcgcaaaagatg

SEQ ID NO: 79371 - DNA, 103 bp, Artificial Sequence
  Synthetic Polynucleotide
taatacgactcactatagggattgaggtcaatgaggtgttgatgtaatctaacagaggagaagattaatgcaacacctcaacctggcggcagcgcaaaagatg

SEQ ID NO: 79372 - DNA, 103 bp, Artificial Sequence
  Synthetic Polynucleotide
taatacgactcactatagggcgtttattgaggtcaatgaggtgttgatgtaacagaggagaacatcaatgcctcattgaaacctggcggcagcgcaaaagatg

SEQ ID NO: 79373 - DNA, 103 bp, Artificial Sequence
  Synthetic Polynucleotide
taatacgactcactatagggctgaacgtttattgaggtcaatgaggtgttaacagaggagaaacaccatgttgacctcaaacctggcggcagcgcaaaagatg

SEQ ID NO: 79374 - DNA, 103 bp, Artificial Sequence
  Synthetic Polynucleotide
taatacgactcactatagggcttgcctgaacgtttattgaggtcaatgagaacagaggagactcattatgctcaataaaaacctggcggcagcgcaaaagatg

SEQ ID NO: 79375 - DNA, 103 bp, Artificial Sequence
  Synthetic Polynucleotide
taatacgactcactataggggtgcacttgcctgaacgtttattgaggtcaaacagaggagatgacctatgtaaacgttcaacctggcggcagcgcaaaagatg

SEQ ID NO: 79376 - DNA, 103 bp, Artificial Sequence
  Synthetic Polynucleotide
taatacgactcactataggggaatagtgcacttgcctgaacgtttattgaaacagaggagatcaataatggttcaggcaaacctggcggcagcgcaaaagatg

SEQ ID NO: 79377 - DNA, 103 bp, Artificial Sequence
  Synthetic Polynucleotide
taatacgactcactatagggagtgtgaatagtgcacttgcctgaacgtttaacagaggagaaaacgtatgggcaagtgcaacctggcggcagcgcaaaagatg

SEQ ID NO: 79378 - DNA, 103 bp, Artificial Sequence
  Synthetic Polynucleotide
taatacgactcactataggggcgcgagtgtgaatagtgcacttgcctgaaaacagaggagattcaggatggtgcactataacctggcggcagcgcaaaagatg

SEQ ID NO: 79379 - DNA, 103 bp, Artificial Sequence
  Synthetic Polynucleotide
taatacgactcactataggggcctcgcgcgagtgtgaatagtgcacttgcaacagaggagagcaagtatgctattcacaaacctggcggcagcgcaaaagatg

SEQ ID NO: 79380 - DNA, 103 bp, Artificial Sequence
  Synthetic Polynucleotide
taatacgactcactatagggctccgactgcgtcttgagtggcgtgtcttgaacagaggagacaagacatgccactcaagaacctggcggcagcgcaaaagatg

SEQ ID NO: 79381 - DNA, 103 bp, Artificial Sequence
  Synthetic Polynucleotide
taatacgactcactataggggggaagcctcgcgcgagtgtgaatagtgcaaacagaggagatgcactatgcacactcgcaacctggcggcagcgcaaaagatg

SEQ ID NO: 79382 - DNA, 103 bp, Artificial Sequence
  Synthetic Polynucleotide
taatacgactcactatagggcgaaggggaagcctcgcgcgagtgtgaataaacagaggagatattcaatgtcgcgcgagaacctggcggcagcgcaaaagatg

SEQ ID NO: 79383 - DNA, 103 bp, Artificial Sequence
  Synthetic Polynucleotide
taatacgactcactatagggatcgacgaaggggaagcctcgcgcgagtgtaacagaggagaacactcatgcgaggcttcaacctggcggcagcgcaaaagatg

SEQ ID NO: 79384 - DNA, 103 bp, Artificial Sequence
  Synthetic Polynucleotide
taatacgactcactatagggccaacatcgacgaaggggaagcctcgcgcgaacagaggagacgcgcgatgcttccccttaacctggcggcagcgcaaaagatg

SEQ ID NO: 79385 - DNA, 103 bp, Artificial Sequence
  Synthetic Polynucleotide
taatacgactcactatagggacactccaacatcgacgaaggggaagcctcaacagaggagagaggctatgccttcgtcgaacctggcggcagcgcaaaagatg

SEQ ID NO: 79386 - DNA, 103 bp, Artificial Sequence
  Synthetic Polynucleotide
taatacgactcactatagggagccgacactccaacatcgacgaaggggaaaacagaggagattccccatggtcgatgttaacctggcggcagcgcaaaagatg

SEQ ID NO: 79387 - DNA, 103 bp, Artificial Sequence
  Synthetic Polynucleotide
taatacgactcactatagggaggagagccgacactccaacatcgacgaagaacagaggagacttcgtatgtgttggagtaacctggcggcagcgcaaaagatg

SEQ ID NO: 79388 - DNA, 103 bp, Artificial Sequence
  Synthetic Polynucleotide
taatacgactcactatagggctagcaggagagccgacactccaacatcgaaacagaggagatcgatgatggagtgtcggaacctggcggcagcgcaaaagatg

SEQ ID NO: 79389 - DNA, 103 bp, Artificial Sequence
  Synthetic Polynucleotide
taatacgactcactatagggggctgctagcaggagagccgacactccaacaacagaggagagttggaatgtcggctctcaacctggcggcagcgcaaaagatg

SEQ ID NO: 79390 - DNA, 103 bp, Artificial Sequence
  Synthetic Polynucleotide
taatacgactcactatagggcatccggctgctagcaggagagccgacactaacagaggagaagtgtcatgtctcctgctaacctggcggcagcgcaaaagatg

SEQ ID NO: 79391 - DNA, 103 bp, Artificial Sequence
  Synthetic Polynucleotide
taatacgactcactataggggtgacctccgactgcgtcttgagtggcgtgaacagaggagacacgccatgcaagacgcaaacctggcggcagcgcaaaagatg

SEQ ID NO: 79392 - DNA, 103 bp, Artificial Sequence
  Synthetic Polynucleotide
taatacgactcactatagggcccagcatccggctgctagcaggagagccgaacagaggagacggctcatgtgctagcagaacctggcggcagcgcaaaagatg

SEQ ID NO: 79393 - DNA, 103 bp, Artificial Sequence
  Synthetic Polynucleotide
taatacgactcactatagggttgtccccagcatccggctgctagcaggagaacagaggagactcctgatggcagccggaaacctggcggcagcgcaaaagatg

SEQ ID NO: 79394 - DNA, 103 bp, Artificial Sequence
  Synthetic Polynucleotide
taatacgactcactataggggtgacttgtccccagcatccggctgctagcaacagaggagagctagcatgcggatgctgaacctggcggcagcgcaaaagatg

SEQ ID NO: 79395 - DNA, 103 bp, Artificial Sequence
  Synthetic Polynucleotide
taatacgactcactatagggtgagggtgacttgtccccagcatccggctgaacagaggagacagccgatggctggggacaacctggcggcagcgcaaaagatg

SEQ ID NO: 79396 - DNA, 103 bp, Artificial Sequence
  Synthetic Polynucleotide
taatacgactcactatagggaacggtgagggtgacttgtccccagcatccaacagaggagaggatgcatgggacaagtcaacctggcggcagcgcaaaagatg

SEQ ID NO: 79397 - DNA, 103 bp, Artificial Sequence
  Synthetic Polynucleotide
taatacgactcactatagggaccgtaacggtgagggtgacttgtccccagaacagaggagactggggatgagtcaccctaacctggcggcagcgcaaaagatg

SEQ ID NO: 79398 - DNA, 103 bp, Artificial Sequence
  Synthetic Polynucleotide
taatacgactcactatagggctgttaccgtaacggtgagggtgacttgtcaacagaggagagacaagatgccctcaccgaacctggcggcagcgcaaaagatg

SEQ ID NO: 79399 - DNA, 103 bp, Artificial Sequence
  Synthetic Polynucleotide
taatacgactcactatagggtgccgctgttaccgtaacggtgagggtgacaacagaggagagtcaccatgaccgttacgaacctggcggcagcgcaaaagatg

SEQ ID NO: 79400 - DNA, 103 bp, Artificial Sequence
  Synthetic Polynucleotide
taatacgactcactatagggagtgttgccgctgttaccgtaacggtgaggaacagaggagacctcacatgtacggtaacaacctggcggcagcgcaaaagatg

SEQ ID NO: 79401 - DNA, 103 bp, Artificial Sequence
  Synthetic Polynucleotide
taatacgactcactatagggaaaggagtgttgccgctgttaccgtaacggaacagaggagaccgttaatgtaacagcggaacctggcggcagcgcaaaagatg

SEQ ID NO: 79402 - DNA, 103 bp, Artificial Sequence
  Synthetic Polynucleotide
taatacgactcactatagggtgtcagtgacctccgactgcgtcttgagtgaacagaggagacactcaatgcgcagtcggaacctggcggcagcgcaaaagatg

SEQ ID NO: 79403 - DNA, 103 bp, Artificial Sequence
  Synthetic Polynucleotide
taatacgactcactataggggcaaaaaaggagtgttgccgctgttaccgtaacagaggagaacggtaatggcggcaacaaacctggcggcagcgcaaaagatg

SEQ ID NO: 79404 - DNA, 103 bp, Artificial Sequence
  Synthetic Polynucleotide
taatacgactcactatagggtagtggcaaaaaaggagtgttgccgctgttaacagaggagaaacagcatgaacactcctaacctggcggcagcgcaaaagatg

SEQ ID NO: 79405 - DNA, 103 bp, Artificial Sequence
  Synthetic Polynucleotide
taatacgactcactatagggaggcatagtggcaaaaaaggagtgttgccgaacagaggagacggcaaatgtccttttttaacctggcggcagcgcaaaagatg

SEQ ID NO: 79406 - DNA, 103 bp, Artificial Sequence
  Synthetic Polynucleotide
taatacgactcactatagggcatgtaggcatagtggcaaaaaaggagtgtaacagaggagaacactcatgttttgccacaacctggcggcagcgcaaaagatg

SEQ ID NO: 79407 - DNA, 103 bp, Artificial Sequence
  Synthetic Polynucleotide
taatacgactcactatagggggaaccatgtaggcatagtggcaaaaaaggaacagaggagaccttttatgccactatgcaacctggcggcagcgcaaaagatg

SEQ ID NO: 79408 - DNA, 103 bp, Artificial Sequence
  Synthetic Polynucleotide
taatacgactcactatagggaaccgggaaccatgtaggcatagtggcaaaaacagaggagatttgccatgatgcctacaaacctggcggcagcgcaaaagatg

SEQ ID NO: 79409 - DNA, 103 bp, Artificial Sequence
  Synthetic Polynucleotide
taatacgactcactatagggttgccaaccgggaaccatgtaggcatagtgaacagaggagacactatatgtacatggttaacctggcggcagcgcaaaagatg

SEQ ID NO: 79410 - DNA, 103 bp, Artificial Sequence
  Synthetic Polynucleotide
taatacgactcactatagggtcagcttgccaaccgggaaccatgtaggcaaacagaggagatgcctaatgggttcccggaacctggcggcagcgcaaaagatg

SEQ ID NO: 79411 - DNA, 103 bp, Artificial Sequence
  Synthetic Polynucleotide
taatacgactcactatagggttgcctcagcttgccaaccgggaaccatgtaacagaggagaacatggatgccggttggcaacctggcggcagcgcaaaagatg

SEQ ID NO: 79412 - DNA, 103 bp, Artificial Sequence
  Synthetic Polynucleotide
taatacgactcactataggggcgcattgcctcagcttgccaaccgggaacaacagaggagagttcccatgtggcaagctaacctggcggcagcgcaaaagatg

SEQ ID NO: 79413 - DNA, 103 bp, Artificial Sequence
  Synthetic Polynucleotide
taatacgactcactatagggtgcactgtcagtgacctccgactgcgtcttaacagaggagaaagacgatgtcggaggtcaacctggcggcagcgcaaaagatg

SEQ ID NO: 79414 - DNA, 103 bp, Artificial Sequence
  Synthetic Polynucleotide
taatacgactcactataggggctgagcgcattgcctcagcttgccaaccgaacagaggagacggttgatgagctgaggcaacctggcggcagcgcaaaagatg

SEQ ID NO: 79415 - DNA, 103 bp, Artificial Sequence
  Synthetic Polynucleotide
taatacgactcactataggggctgggctgagcgcattgcctcagcttgccaacagaggagaggcaagatgaggcaatgcaacctggcggcagcgcaaaagatg

SEQ ID NO: 79416 - DNA, 103 bp, Artificial Sequence
  Synthetic Polynucleotide
taatacgactcactatagggccgccgctgggctgagcgcattgcctcagcaacagaggagagctgagatgatgcgctcaaacctggcggcagcgcaaaagatg

SEQ ID NO: 79417 - DNA, 103 bp, Artificial Sequence
  Synthetic Polynucleotide
taatacgactcactataggggctgtccgccgctgggctgagcgcattgccaacagaggagaggcaatatgctcagcccaaacctggcggcagcgcaaaagatg

SEQ ID NO: 79418 - DNA, 103 bp, Artificial Sequence
  Synthetic Polynucleotide
taatacgactcactatagggcggccgctgtccgccgctgggctgagcgcaaacagaggagatgcgctatgcccagcggcaacctggcggcagcgcaaaagatg

SEQ ID NO: 79419 - DNA, 103 bp, Artificial Sequence
  Synthetic Polynucleotide
taatacgactcactataggggattccggccgctgtccgccgctgggctgaaacagaggagatcagccatgcggcggacaaacctggcggcagcgcaaaagatg

SEQ ID NO: 79420 - DNA, 103 bp, Artificial Sequence
  Synthetic Polynucleotide
taatacgactcactatagggttcatgattccggccgctgtccgccgctggaacagaggagaccagcgatggacagcggcaacctggcggcagcgcaaaagatg

SEQ ID NO: 79421 - DNA, 103 bp, Artificial Sequence
  Synthetic Polynucleotide
taatacgactcactatagggcgttcttcatgattccggccgctgtccgccaacagaggagaggcggaatgcggccggaaaacctggcggcagcgcaaaagatg

SEQ ID NO: 79422 - DNA, 103 bp, Artificial Sequence
  Synthetic Polynucleotide
taatacgactcactatagggtacagcgttcttcatgattccggccgctgtaacagaggagaacagcgatgggaatcatgaacctggcggcagcgcaaaagatg

SEQ ID NO: 79423 - DNA, 103 bp, Artificial Sequence
  Synthetic Polynucleotide
taatacgactcactatagggtccactacagcgttcttcatgattccggccaacagaggagaggccggatgcatgaagaaaacctggcggcagcgcaaaagatg

SEQ ID NO: 79424 - DNA, 103 bp, Artificial Sequence
  Synthetic Polynucleotide
taatacgactcactataggggtgtctgcactgtcagtgacctccgactgcaacagaggagagcagtcatgggtcactgaaacctggcggcagcgcaaaagatg

SEQ ID NO: 79425 - DNA, 103 bp, Artificial Sequence
  Synthetic Polynucleotide
taatacgactcactatagggtgccatccactacagcgttcttcatgattcaacagaggagagaatcaatgagaacgctgaacctggcggcagcgcaaaagatg

SEQ ID NO: 79426 - DNA, 103 bp, Artificial Sequence
  Synthetic Polynucleotide
taatacgactcactatagggcacgatgccatccactacagcgttcttcataacagaggagaatgaagatggctgtagtgaacctggcggcagcgcaaaagatg

SEQ ID NO: 79427 - DNA, 103 bp, Artificial Sequence
  Synthetic Polynucleotide
taatacgactcactataggggtggccacgatgccatccactacagcgttcaacagaggagagaacgcatgagtggatggaacctggcggcagcgcaaaagatg

SEQ ID NO: 79428 - DNA, 103 bp, Artificial Sequence
  Synthetic Polynucleotide
taatacgactcactatagggcgtccgtggccacgatgccatccactacagaacagaggagactgtagatgatggcatcgaacctggcggcagcgcaaaagatg

SEQ ID NO: 79429 - DNA, 103 bp, Artificial Sequence
  Synthetic Polynucleotide
taatacgactcactatagggtgggacgtccgtggccacgatgccatccacaacagaggagagtggatatgatcgtggccaacctggcggcagcgcaaaagatg

SEQ ID NO: 79430 - DNA, 103 bp, Artificial Sequence
  Synthetic Polynucleotide
taatacgactcactatagggaattctgggacgtccgtggccacgatgccaaacagaggagatggcatatgggccacggaaacctggcggcagcgcaaaagatg

SEQ ID NO: 79431 - DNA, 103 bp, Artificial Sequence
  Synthetic Polynucleotide
taatacgactcactataggggctctaattctgggacgtccgtggccacgaaacagaggagatcgtggatgcggacgtccaacctggcggcagcgcaaaagatg

SEQ ID NO: 79432 - DNA, 103 bp, Artificial Sequence
  Synthetic Polynucleotide
taatacgactcactatagggggtgcgctctaattctgggacgtccgtggcaacagaggagagccacgatggtcccagaaaacctggcggcagcgcaaaagatg

SEQ ID NO: 79433 - DNA, 103 bp, Artificial Sequence
  Synthetic Polynucleotide
taatacgactcactatagggggtgtggtgcgctctaattctgggacgtccaacagaggagaggacgtatgagaattagaaacctggcggcagcgcaaaagatg

SEQ ID NO: 79434 - DNA, 103 bp, Artificial Sequence
  Synthetic Polynucleotide
taatacgactcactatagggtgatgggtgtggtgcgctctaattctgggaaacagaggagatcccagatgtagagcgcaaacctggcggcagcgcaaaagatg

SEQ ID NO: 79435 - DNA, 103 bp, Artificial Sequence
  Synthetic Polynucleotide
taatacgactcactatagggtccgtgtgtctgcactgtcagtgacctccgaacagaggagacggaggatgctgacagtgaacctggcggcagcgcaaaagatg

SEQ ID NO: 79436 - DNA, 103 bp, Artificial Sequence
  Synthetic Polynucleotide
taatacgactcactatagggctgcatgatgggtgtggtgcgctctaattcaacagaggagagaattaatgcgcaccacaaacctggcggcagcgcaaaagatg

SEQ ID NO: 79437 - DNA, 103 bp, Artificial Sequence
  Synthetic Polynucleotide
taatacgactcactatagggttcttctgcatgatgggtgtggtgcgctctaacagaggagaagagcgatgcacacccataacctggcggcagcgcaaaagatg

SEQ ID NO: 79438 - DNA, 103 bp, Artificial Sequence
  Synthetic Polynucleotide
taatacgactcactatagggcaactttcttctgcatgatgggtgtggtgcaacagaggagagcaccaatgccatcatgcaacctggcggcagcgcaaaagatg

SEQ ID NO: 79439 - DNA, 103 bp, Artificial Sequence
  Synthetic Polynucleotide
taatacgactcactatagggctgtccaactttcttctgcatgatgggtgtaacagaggagaacacccatgatgcagaagaacctggcggcagcgcaaaagatg

SEQ ID NO: 79440 - DNA, 103 bp, Artificial Sequence
  Synthetic Polynucleotide
taatacgactcactatagggatgatctgtccaactttcttctgcatgatgaacagaggagacatcatatggaagaaagtaacctggcggcagcgcaaaagatg

SEQ ID NO: 79441 - DNA, 103 bp, Artificial Sequence
  Synthetic Polynucleotide
taatacgactcactatagggtcagcatgatctgtccaactttcttctgcaaacagaggagatgcagaatgaagttggacaacctggcggcagcgcaaaagatg

SEQ ID NO: 79442 - DNA, 103 bp, Artificial Sequence
  Synthetic Polynucleotide
taatacgactcactatagggcaagatcagcatgatctgtccaactttcttaacagaggagaaagaaaatgggacagatcaacctggcggcagcgcaaaagatg

SEQ ID NO: 79443 - DNA, 103 bp, Artificial Sequence
  Synthetic Polynucleotide
taatacgactcactataggggacaccaagatcagcatgatctgtccaactaacagaggagaagttggatggatcatgctaacctggcggcagcgcaaaagatg

SEQ ID NO: 79444 - DNA, 103 bp, Artificial Sequence
  Synthetic Polynucleotide
taatacgactcactatagggctagagacaccaagatcagcatgatctgtcaacagaggagagacagaatgtgctgatctaacctggcggcagcgcaaaagatg

SEQ ID NO: 79445 - DNA, 103 bp, Artificial Sequence
  Synthetic Polynucleotide
taatacgactcactatagggtgcagctagagacaccaagatcagcatgataacagaggagaatcatgatgatcttggtgaacctggcggcagcgcaaaagatg

SEQ ID NO: 79446 - DNA, 103 bp, Artificial Sequence
  Synthetic Polynucleotide
taatacgactcactatagggctttctccgtgtgtctgcactgtcagtgacaacagaggagagtcactatgagtgcagacaacctggcggcagcgcaaaagatg

SEQ ID NO: 79447 - DNA, 103 bp, Artificial Sequence
  Synthetic Polynucleotide
taatacgactcactatagggactactgcagctagagacaccaagatcagcaacagaggagagctgatatgggtgtctctaacctggcggcagcgcaaaagatg

SEQ ID NO: 79448 - DNA, 103 bp, Artificial Sequence
  Synthetic Polynucleotide
taatacgactcactatagggtcactactactgcagctagagacaccaagaaacagaggagatcttggatgctctagctgaacctggcggcagcgcaaaagatg

SEQ ID NO: 79449 - DNA, 103 bp, Artificial Sequence
  Synthetic Polynucleotide
taatacgactcactatagggcgggttcactactactgcagctagagacacaacagaggagagtgtctatggctgcagtaaacctggcggcagcgcaaaagatg

SEQ ID NO: 79450 - DNA, 103 bp, Artificial Sequence
  Synthetic Polynucleotide
taatacgactcactatagggacagacgggttcactactactgcagctagaaacagaggagatctagcatgagtagtagtaacctggcggcagcgcaaaagatg

SEQ ID NO: 79451 - DNA, 103 bp, Artificial Sequence
  Synthetic Polynucleotide
taatacgactcactatagggtcttcacagacgggttcactactactgcagaacagaggagactgcagatgtagtgaaccaacctggcggcagcgcaaaagatg

SEQ ID NO: 79452 - DNA, 103 bp, Artificial Sequence
  Synthetic Polynucleotide
taatacgactcactatagggtactgtcttcacagacgggttcactactacaacagaggagagtagtaatgaacccgtctaacctggcggcagcgcaaaagatg

SEQ ID NO: 79453 - DNA, 103 bp, Artificial Sequence
  Synthetic Polynucleotide
taatacgactcactatagggtctcgtactgtcttcacagacgggttcactaacagaggagaagtgaaatggtctgtgaaaacctggcggcagcgcaaaagatg

SEQ ID NO: 79454 - DNA, 103 bp, Artificial Sequence
  Synthetic Polynucleotide
taatacgactcactatagggcggcttctcgtactgtcttcacagacgggtaacagaggagaacccgtatgtgaagacagaacctggcggcagcgcaaaagatg

SEQ ID NO: 79455 - DNA, 103 bp, Artificial Sequence
  Synthetic Polynucleotide
taatacgactcactatagggaattccggcttctcgtactgtcttcacagaaacagaggagatctgtgatgacagtacgaaacctggcggcagcgcaaaagatg

SEQ ID NO: 79456 - DNA, 103 bp, Artificial Sequence
  Synthetic Polynucleotide
taatacgactcactatagggatcaaaattccggcttctcgtactgtcttcaacagaggagagaagacatgacgagaagcaacctggcggcagcgcaaaagatg

SEQ ID NO: 79457 - DNA, 103 bp, Artificial Sequence
  Synthetic Polynucleotide
taatacgactcactatagggacatcgagatcttcgtgctaagaaacagctaacagaggagaagctgtatgttagcacgaaacctggcggcagcgcaaaagatg

SEQ ID NO: 79458 - DNA, 103 bp, Artificial Sequence
  Synthetic Polynucleotide
taatacgactcactataggggagtgctttctccgtgtgtctgcactgtcaaacagaggagatgacagatgagacacacgaacctggcggcagcgcaaaagatg

SEQ ID NO: 79459 - DNA, 103 bp, Artificial Sequence
  Synthetic Polynucleotide
taatacgactcactatagggccgtgatcaaaattccggcttctcgtactgaacagaggagacagtacatgaagccggaaaacctggcggcagcgcaaaagatg

SEQ ID NO: 79460 - DNA, 103 bp, Artificial Sequence
  Synthetic Polynucleotide
taatacgactcactatagggtgcggccgtgatcaaaattccggcttctcgaacagaggagacgagaaatgggaattttgaacctggcggcagcgcaaaagatg

SEQ ID NO: 79461 - DNA, 103 bp, Artificial Sequence
  Synthetic Polynucleotide
taatacgactcactatagggaccgctgcggccgtgatcaaaattccggctaacagaggagaagccggatgtttgatcacaacctggcggcagcgcaaaagatg

SEQ ID NO: 79462 - DNA, 103 bp, Artificial Sequence
  Synthetic Polynucleotide
taatacgactcactataggggcgtcaccgctgcggccgtgatcaaaattcaacagaggagagaatttatgtcacggccgaacctggcggcagcgcaaaagatg

SEQ ID NO: 79463 - DNA, 103 bp, Artificial Sequence
  Synthetic Polynucleotide
taatacgactcactatagggccaaagcgtcaccgctgcggccgtgatcaaaacagaggagattgatcatggccgcagcgaacctggcggcagcgcaaaagatg

SEQ ID NO: 79464 - DNA, 103 bp, Artificial Sequence
  Synthetic Polynucleotide
taatacgactcactatagggttctcccaaagcgtcaccgctgcggccgtgaacagaggagacacggcatgagcggtgacaacctggcggcagcgcaaaagatg

SEQ ID NO: 79465 - DNA, 103 bp, Artificial Sequence
  Synthetic Polynucleotide
taatacgactcactatagggctccattctcccaaagcgtcaccgctgcggaacagaggagaccgcagatgtgacgctttaacctggcggcagcgcaaaagatg

SEQ ID NO: 79466 - DNA, 103 bp, Artificial Sequence
  Synthetic Polynucleotide
taatacgactcactataggggcttgctccattctcccaaagcgtcaccgcaacagaggagagcggtgatgctttgggagaacctggcggcagcgcaaaagatg

SEQ ID NO: 79467 - DNA, 103 bp, Artificial Sequence
  Synthetic Polynucleotide
taatacgactcactatagggacagagcttgctccattctcccaaagcgtcaacagaggagagacgctatgggagaatggaacctggcggcagcgcaaaagatg

SEQ ID NO: 79468 - DNA, 103 bp, Artificial Sequence
  Synthetic Polynucleotide
taatacgactcactatagggtccaaacagagcttgctccattctcccaaaaacagaggagatttgggatgatggagcaaaacctggcggcagcgcaaaagatg

SEQ ID NO: 79469 - DNA, 103 bp, Artificial Sequence
  Synthetic Polynucleotide
taatacgactcactatagggcgctagagtgctttctccgtgtgtctgcacaacagaggagagtgcagatgcacggagaaaacctggcggcagcgcaaaagatg

SEQ ID NO: 79470 - DNA, 103 bp, Artificial Sequence
  Synthetic Polynucleotide
taatacgactcactatagggtgcgttccaaacagagcttgctccattctcaacagaggagagagaatatggcaagctctaacctggcggcagcgcaaaagatg

SEQ ID NO: 79471 - DNA, 103 bp, Artificial Sequence
  Synthetic Polynucleotide
taatacgactcactataggggttgttgcgttccaaacagagcttgctccaaacagaggagatggagcatgctctgtttgaacctggcggcagcgcaaaagatg

SEQ ID NO: 79472 - DNA, 103 bp, Artificial Sequence
  Synthetic Polynucleotide
taatacgactcactatagggtggcagttgttgcgttccaaacagagcttgaacagaggagacaagctatgtttggaacgaacctggcggcagcgcaaaagatg

SEQ ID NO: 79473 - DNA, 103 bp, Artificial Sequence
  Synthetic Polynucleotide
taatacgactcactatagggtccgatggcagttgttgcgttccaaacagaaacagaggagatctgttatgaacgcaacaaacctggcggcagcgcaaaagatg

SEQ ID NO: 79474 - DNA, 103 bp, Artificial Sequence
  Synthetic Polynucleotide
taatacgactcactatagggcagagtccgatggcagttgttgcgttccaaaacagaggagattggaaatgaacaactgcaacctggcggcagcgcaaaagatg

SEQ ID NO: 79475 - DNA, 103 bp, Artificial Sequence
  Synthetic Polynucleotide
taatacgactcactatagggtgtggcagagtccgatggcagttgttgcgtaacagaggagaacgcaaatgctgccatcgaacctggcggcagcgcaaaagatg

SEQ ID NO: 79476 - DNA, 103 bp, Artificial Sequence
  Synthetic Polynucleotide
taatacgactcactatagggcatgatgtggcagagtccgatggcagttgtaacagaggagaacaactatgatcggactcaacctggcggcagcgcaaaagatg

SEQ ID NO: 79477 - DNA, 103 bp, Artificial Sequence
  Synthetic Polynucleotide
taatacgactcactatagggccacgcatgatgtggcagagtccgatggcaaacagaggagatgccatatgactctgccaaacctggcggcagcgcaaaagatg

SEQ ID NO: 79478 - DNA, 103 bp, Artificial Sequence
  Synthetic Polynucleotide
taatacgactcactatagggaacccccacgcatgatgtggcagagtccgaaacagaggagatcggacatggccacatcaaacctggcggcagcgcaaaagatg

SEQ ID NO: 79479 - DNA, 103 bp, Artificial Sequence
  Synthetic Polynucleotide
taatacgactcactatagggcaaccaacccccacgcatgatgtggcagagaacagaggagactctgcatgatcatgcgtaacctggcggcagcgcaaaagatg

SEQ ID NO: 79480 - DNA, 103 bp, Artificial Sequence
  Synthetic Polynucleotide
taatacgactcactatagggttgttcgctagagtgctttctccgtgtgtcaacagaggagagacacaatgagaaagcacaacctggcggcagcgcaaaagatg

SEQ ID NO: 79481 - DNA, 103 bp, Artificial Sequence
  Synthetic Polynucleotide
taatacgactcactatagggcatgacaaccaacccccacgcatgatgtggaacagaggagaccacatatggcgtgggggaacctggcggcagcgcaaaagatg

SEQ ID NO: 79482 - DNA, 103 bp, Artificial Sequence
  Synthetic Polynucleotide
taatacgactcactatagggatagacatgacaaccaacccccacgcatgaaacagaggagatcatgcatgggggttggtaacctggcggcagcgcaaaagatg

SEQ ID NO: 79483 - DNA, 103 bp, Artificial Sequence
  Synthetic Polynucleotide
taatacgactcactatagggtatggatagacatgacaaccaacccccacgaacagaggagacgtgggatgtggttgtcaaacctggcggcagcgcaaaagatg

SEQ ID NO: 79484 - DNA, 103 bp, Artificial Sequence
  Synthetic Polynucleotide
taatacgactcactatagggcatgttatggatagacatgacaaccaacccaacagaggagagggttgatggtcatgtctaacctggcggcagcgcaaaagatg

SEQ ID NO: 79485 - DNA, 103 bp, Artificial Sequence
  Synthetic Polynucleotide
taatacgactcactataggggtgtccatgttatggatagacatgacaaccaacagaggagaggttgtatggtctatccaaacctggcggcagcgcaaaagatg

SEQ ID NO: 79486 - DNA, 103 bp, Artificial Sequence
  Synthetic Polynucleotide
taatacgactcactatagggtatgagtgtccatgttatggatagacatgaaacagaggagatcatgtatgtccataacaaacctggcggcagcgcaaaagatg

SEQ ID NO: 79487 - DNA, 103 bp, Artificial Sequence
  Synthetic Polynucleotide
taatacgactcactatagggttctttatgagtgtccatgttatggatagaaacagaggagatctatcatgaacatggacaacctggcggcagcgcaaaagatg

SEQ ID NO: 79488 - DNA, 103 bp, Artificial Sequence
  Synthetic Polynucleotide
taatacgactcactatagggccatgttctttatgagtgtccatgttatggaacagaggagaccataaatgggacactcaaacctggcggcagcgcaaaagatg

SEQ ID NO: 79489 - DNA, 103 bp, Artificial Sequence
  Synthetic Polynucleotide
taatacgactcactatagggtttttccatgttctttatgagtgtccatgtaacagaggagaacatggatgctcataaagaacctggcggcagcgcaaaagatg

SEQ ID NO: 79490 - DNA, 103 bp, Artificial Sequence
  Synthetic Polynucleotide
taatacgactcactatagggcctggtttttccatgttctttatgagtgtcaacagaggagagacactatgaaagaacataacctggcggcagcgcaaaagatg

SEQ ID NO: 79491 - DNA, 103 bp, Artificial Sequence
  Synthetic Polynucleotide
taatacgactcactatagggccttcttgttcgctagagtgctttctccgtaacagaggagaacggagatggcactctagaacctggcggcagcgcaaaagatg

SEQ ID NO: 79492 - DNA, 103 bp, Artificial Sequence
  Synthetic Polynucleotide
taatacgactcactatagggttagtcctggtttttccatgttctttatgaaacagaggagatcataaatgacatggaaaaacctggcggcagcgcaaaagatg

SEQ ID NO: 79493 - DNA, 103 bp, Artificial Sequence
  Synthetic Polynucleotide
taatacgactcactatagggtctttttagtcctggtttttccatgttcttaacagaggagaaagaacatggaaaaaccaaacctggcggcagcgcaaaagatg

SEQ ID NO: 79494 - DNA, 103 bp, Artificial Sequence
  Synthetic Polynucleotide
taatacgactcactatagggccacctctttttagtcctggtttttccatgaacagaggagacatggaatgaccaggactaacctggcggcagcgcaaaagatg

SEQ ID NO: 79495 - DNA, 103 bp, Artificial Sequence
  Synthetic Polynucleotide
taatacgactcactatagggttgccccacctctttttagtcctggtttttaacagaggagaaaaaacatggactaaaaaaacctggcggcagcgcaaaagatg

SEQ ID NO: 79496 - DNA, 103 bp, Artificial Sequence
  Synthetic Polynucleotide
taatacgactcactatagggtccttttgccccacctctttttagtcctggaacagaggagaccaggaatgaaaagaggtaacctggcggcagcgcaaaagatg

SEQ ID NO: 79497 - DNA, 103 bp, Artificial Sequence
  Synthetic Polynucleotide
taatacgactcactataggggtgcgtccttttgccccacctctttttagtaacagaggagaactaaaatgaggtggggcaacctggcggcagcgcaaaagatg

SEQ ID NO: 79498 - DNA, 103 bp, Artificial Sequence
  Synthetic Polynucleotide
taatacgactcactatagggccaaggtgcgtccttttgccccacctctttaacagaggagaaaagagatggggcaaaagaacctggcggcagcgcaaaagatg

SEQ ID NO: 79499 - DNA, 103 bp, Artificial Sequence
  Synthetic Polynucleotide
taatacgactcactatagggctctcccaaggtgcgtccttttgccccaccaacagaggagaggtgggatgaaaggacgcaacctggcggcagcgcaaaagatg

SEQ ID NO: 79500 - DNA, 103 bp, Artificial Sequence
  Synthetic Polynucleotide
taatacgactcactatagggcaaacctctcccaaggtgcgtccttttgccaacagaggagaggcaaaatgacgcaccttaacctggcggcagcgcaaaagatg

SEQ ID NO: 79501 - DNA, 103 bp, Artificial Sequence
  Synthetic Polynucleotide
taatacgactcactatagggctttccaaacctctcccaaggtgcgtccttaacagaggagaaaggacatgccttgggagaacctggcggcagcgcaaaagatg

SEQ ID NO: 79502 - DNA, 103 bp, Artificial Sequence
  Synthetic Polynucleotide
taatacgactcactatagggagcccccttcttgttcgctagagtgctttcaacagaggagagaaagcatgctagcgaacaacctggcggcagcgcaaaagatg

SEQ ID NO: 79503 - DNA, 103 bp, Artificial Sequence
  Synthetic Polynucleotide
taatacgactcactatagggtctttctttccaaacctctcccaaggtgcgaacagaggagacgcaccatgggagaggttaacctggcggcagcgcaaaagatg

SEQ ID NO: 79504 - DNA, 103 bp, Artificial Sequence
  Synthetic Polynucleotide
taatacgactcactatagggttgagtctttctttccaaacctctcccaagaacagaggagacttgggatgggtttggaaaacctggcggcagcgcaaaagatg

SEQ ID NO: 79505 - DNA, 103 bp, Artificial Sequence
  Synthetic Polynucleotide
taatacgactcactatagggtctggttgagtctttctttccaaacctctcaacagaggagagagaggatgggaaagaaaaacctggcggcagcgcaaaagatg

SEQ ID NO: 79506 - DNA, 103 bp, Artificial Sequence
  Synthetic Polynucleotide
taatacgactcactatagggtgtcatctggttgagtctttctttccaaacaacagaggagagtttggatggaaagactcaacctggcggcagcgcaaaagatg

SEQ ID NO: 79507 - DNA, 103 bp, Artificial Sequence
  Synthetic Polynucleotide
taatacgactcactatagggtcttttgtcatctggttgagtctttctttcaacagaggagagaaagaatgactcaaccaaacctggcggcagcgcaaaagatg

SEQ ID NO: 79508 - DNA, 103 bp, Artificial Sequence
  Synthetic Polynucleotide
taatacgactcactatagggactcttcttttgtcatctggttgagtctttaacagaggagaaaagacatgaccagatgaaacctggcggcagcgcaaaagatg

SEQ ID NO: 79509 - DNA, 103 bp, Artificial Sequence
  Synthetic Polynucleotide
taatacgactcactatagggagtgaactcttcttttgtcatctggttgagaacagaggagactcaacatgatgacaaaaaacctggcggcagcgcaaaagatg

SEQ ID NO: 79510 - DNA, 103 bp, Artificial Sequence
  Synthetic Polynucleotide
taatacgactcactatagggtacctagtgaactcttcttttgtcatctggaacagaggagaccagatatgaaaagaagaaacctggcggcagcgcaaaagatg

SEQ ID NO: 79511 - DNA, 103 bp, Artificial Sequence
  Synthetic Polynucleotide
taatacgactcactatagggtgcggtacctagtgaactcttcttttgtcaaacagaggagatgacaaatgaagagttcaaacctggcggcagcgcaaaagatg

SEQ ID NO: 79512 - DNA, 103 bp, Artificial Sequence
  Synthetic Polynucleotide
taatacgactcactatagggctctttgcggtacctagtgaactcttctttaacagaggagaaaagaaatgttcactaggaacctggcggcagcgcaaaagatg

SEQ ID NO: 79513 - DNA, 103 bp, Artificial Sequence
  Synthetic Polynucleotide
taatacgactcactatagggatccaagcccccttcttgttcgctagagtgaacagaggagacactctatggaacaagaaaacctggcggcagcgcaaaagatg

SEQ ID NO: 79514 - DNA, 103 bp, Artificial Sequence
  Synthetic Polynucleotide
taatacgactcactatagggatggcctctttgcggtacctagtgaactctaacagaggagaagagttatgtaggtaccgaacctggcggcagcgcaaaagatg

SEQ ID NO: 79515 - DNA, 103 bp, Artificial Sequence
  Synthetic Polynucleotide
taatacgactcactatagggcgatgatggcctctttgcggtacctagtgaaacagaggagatcactaatgaccgcaaagaacctggcggcagcgcaaaagatg

SEQ ID NO: 79516 - DNA, 103 bp, Artificial Sequence
  Synthetic Polynucleotide
taatacgactcactataggggacttcgatgatggcctctttgcggtacctaacagaggagaaggtacatgaaagaggccaacctggcggcagcgcaaaagatg

SEQ ID NO: 79517 - DNA, 103 bp, Artificial Sequence
  Synthetic Polynucleotide
taatacgactcactatagggcgatcgacttcgatgatggcctctttgcggaacagaggagaccgcaaatgggccatcataacctggcggcagcgcaaaagatg

SEQ ID NO: 79518 - DNA, 103 bp, Artificial Sequence
  Synthetic Polynucleotide
taatacgactcactatagggctgagcgatcgacttcgatgatggcctcttaacagaggagaaagaggatgtcatcgaagaacctggcggcagcgcaaaagatg

SEQ ID NO: 79519 - DNA, 103 bp, Artificial Sequence
  Synthetic Polynucleotide
taatacgactcactatagggtgccgctgagcgatcgacttcgatgatggcaacagaggagagccatcatggaagtcgataacctggcggcagcgcaaaagatg

SEQ ID NO: 79520 - DNA, 103 bp, Artificial Sequence
  Synthetic Polynucleotide
taatacgactcactatagggtgttttgccgctgagcgatcgacttcgatgaacagaggagacatcgaatgcgatcgctcaacctggcggcagcgcaaaagatg

SEQ ID NO: 79521 - DNA, 103 bp, Artificial Sequence
  Synthetic Polynucleotide
taatacgactcactatagggtggcgtgttttgccgctgagcgatcgacttaacagaggagaaagtcgatggctcagcggaacctggcggcagcgcaaaagatg

SEQ ID NO: 79522 - DNA, 103 bp, Artificial Sequence
  Synthetic Polynucleotide
taatacgactcactatagggtttcctggcgtgttttgccgctgagcgatcaacagaggagagatcgcatggcggcaaaaaacctggcggcagcgcaaaagatg

SEQ ID NO: 79523 - DNA, 103 bp, Artificial Sequence
  Synthetic Polynucleotide
taatacgactcactatagggccttctttcctggcgtgttttgccgctgagaacagaggagactcagcatgaaaacacgcaacctggcggcagcgcaaaagatg

SEQ ID NO: 79524 - DNA, 103 bp, Artificial Sequence
  Synthetic Polynucleotide
taatacgactcactatagggtgtccatccaagcccccttcttgttcgctaaacagaggagatagcgaatgagaagggggaacctggcggcagcgcaaaagatg

SEQ ID NO: 79525 - DNA, 103 bp, Artificial Sequence
  Synthetic Polynucleotide
taatacgactcactatagggcattgccttctttcctggcgtgttttgccgaacagaggagacggcaaatgacgccaggaaacctggcggcagcgcaaaagatg

SEQ ID NO: 79526 - DNA, 103 bp, Artificial Sequence
  Synthetic Polynucleotide
taatacgactcactatagggagtgacattgccttctttcctggcgtgtttaacagaggagaaaacacatgaggaaagaaaacctggcggcagcgcaaaagatg

SEQ ID NO: 79527 - DNA, 103 bp, Artificial Sequence
  Synthetic Polynucleotide
taatacgactcactatagggcctccagtgacattgccttctttcctggcgaacagaggagacgccagatgagaaggcaaaacctggcggcagcgcaaaagatg

SEQ ID NO: 79528 - DNA, 103 bp, Artificial Sequence
  Synthetic Polynucleotide
taatacgactcactataggggatgccctccagtgacattgccttctttccaacagaggagaggaaagatggcaatgtcaaacctggcggcagcgcaaaagatg

SEQ ID NO: 79529 - DNA, 103 bp, Artificial Sequence
  Synthetic Polynucleotide
taatacgactcactataggggactggatgccctccagtgacattgccttcaacagaggagagaaggcatggtcactggaaacctggcggcagcgcaaaagatg

SEQ ID NO: 79530 - DNA, 103 bp, Artificial Sequence
  Synthetic Polynucleotide
taatacgactcactatagggctagagactggatgccctccagtgacattgaacagaggagacaatgtatgtggagggcaaacctggcggcagcgcaaaagatg

SEQ ID NO: 79531 - DNA, 103 bp, Artificial Sequence
  Synthetic Polynucleotide
taatacgactcactatagggtgcccctagagactggatgccctccagtgaaacagaggagatcactgatgggcatccagaacctggcggcagcgcaaaagatg

SEQ ID NO: 79532 - DNA, 103 bp, Artificial Sequence
  Synthetic Polynucleotide
taatacgactcactatagggtgctgtgcccctagagactggatgccctccaacagaggagaggagggatgccagtctctaacctggcggcagcgcaaaagatg

SEQ ID NO: 79533 - DNA, 103 bp, Artificial Sequence
  Synthetic Polynucleotide
taatacgactcactatagggagttttgctgtgcccctagagactggatgcaacagaggagagcatccatgctctaggggaacctggcggcagcgcaaaagatg

SEQ ID NO: 79534 - DNA, 103 bp, Artificial Sequence
  Synthetic Polynucleotide
taatacgactcactatagggatctcagttttgctgtgcccctagagactgaacagaggagacagtctatgggggcacagaacctggcggcagcgcaaaagatg

SEQ ID NO: 79535 - DNA, 103 bp, Artificial Sequence
  Synthetic Polynucleotide
taatacgactcactatagggggtgctgtccatccaagcccccttcttgttaacagaggagaaacaagatgggggcttggaacctggcggcagcgcaaaagatg

SEQ ID NO: 79536 - DNA, 103 bp, Artificial Sequence
  Synthetic Polynucleotide
taatacgactcactatagggcagccatctcagttttgctgtgcccctagaaacagaggagatctaggatgacagcaaaaaacctggcggcagcgcaaaagatg

SEQ ID NO: 79537 - DNA, 103 bp, Artificial Sequence
  Synthetic Polynucleotide
taatacgactcactatagggtcgaccagccatctcagttttgctgtgcccaacagaggagagggcacatgaaaactgagaacctggcggcagcgcaaaagatg

SEQ ID NO: 79538 - DNA, 103 bp, Artificial Sequence
  Synthetic Polynucleotide
taatacgactcactatagggtccgttcgaccagccatctcagttttgctgaacagaggagacagcaaatgtgagatggcaacctggcggcagcgcaaaagatg

SEQ ID NO: 79539 - DNA, 103 bp, Artificial Sequence
  Synthetic Polynucleotide
taatacgactcactatagggaaacctccgttcgaccagccatctcagtttaacagaggagaaaactgatgtggctggtcaacctggcggcagcgcaaaagatg

SEQ ID NO: 79540 - DNA, 103 bp, Artificial Sequence
  Synthetic Polynucleotide
taatacgactcactatagggtcgagaaacctccgttcgaccagccatctcaacagaggagagagatgatgggtcgaacgaacctggcggcagcgcaaaagatg

SEQ ID NO: 79541 - DNA, 103 bp, Artificial Sequence
  Synthetic Polynucleotide
taatacgactcactatagggccggttcgagaaacctccgttcgaccagccaacagaggagaggctggatgaacggaggtaacctggcggcagcgcaaaagatg

SEQ ID NO: 79542 - DNA, 103 bp, Artificial Sequence
  Synthetic Polynucleotide
taatacgactcactatagggtccgaccggttcgagaaacctccgttcgacaacagaggagagtcgaaatgaggtttctcaacctggcggcagcgcaaaagatg

SEQ ID NO: 79543 - DNA, 103 bp, Artificial Sequence
  Synthetic Polynucleotide
taatacgactcactatagggacttttccgaccggttcgagaaacctccgtaacagaggagaacggagatgtctcgaaccaacctggcggcagcgcaaaagatg

SEQ ID NO: 79544 - DNA, 103 bp, Artificial Sequence
  Synthetic Polynucleotide
taatacgactcactatagggcaatcacttttccgaccggttcgagaaaccaacagaggagaggtttcatgaaccggtcgaacctggcggcagcgcaaaagatg

SEQ ID NO: 79545 - DNA, 103 bp, Artificial Sequence
  Synthetic Polynucleotide
taatacgactcactatagggaaggtcaatcacttttccgaccggttcgagaacagaggagactcgaaatggtcggaaaaaacctggcggcagcgcaaaagatg

SEQ ID NO: 79546 - DNA, 103 bp, Artificial Sequence
  Synthetic Polynucleotide
taatacgactcactataggggccttggtgctgtccatccaagcccccttcaacagaggagagaagggatgttggatggaaacctggcggcagcgcaaaagatg

SEQ ID NO: 79547 - DNA, 103 bp, Artificial Sequence
  Synthetic Polynucleotide
taatacgactcactatagggcatccaaggtcaatcacttttccgaccggtaacagaggagaaccggtatgaaaagtgataacctggcggcagcgcaaaagatg

SEQ ID NO: 79548 - DNA, 103 bp, Artificial Sequence
  Synthetic Polynucleotide
taatacgactcactatagggttccacatccaaggtcaatcacttttccgaaacagaggagatcggaaatgtgattgaccaacctggcggcagcgcaaaagatg

SEQ ID NO: 79549 - DNA, 103 bp, Artificial Sequence
  Synthetic Polynucleotide
taatacgactcactataggggcctcttccacatccaaggtcaatcactttaacagaggagaaaagtgatggaccttggaaacctggcggcagcgcaaaagatg

SEQ ID NO: 79550 - DNA, 103 bp, Artificial Sequence
  Synthetic Polynucleotide
taatacgactcactatagggcaaccgcctcttccacatccaaggtcaatcaacagaggagagattgaatgtggatgtggaacctggcggcagcgcaaaagatg

SEQ ID NO: 79551 - DNA, 103 bp, Artificial Sequence
  Synthetic Polynucleotide
taatacgactcactatagggaacaccaaccgcctcttccacatccaaggtaacagaggagaaccttgatggtggaagagaacctggcggcagcgcaaaagatg

SEQ ID NO: 79552 - DNA, 103 bp, Artificial Sequence
  Synthetic Polynucleotide
taatacgactcactatagggatagtaacaccaaccgcctcttccacatccaacagaggagaggatgtatgagaggcggtaacctggcggcagcgcaaaagatg

SEQ ID NO: 79553 - DNA, 103 bp, Artificial Sequence
  Synthetic Polynucleotide
taatacgactcactataggggccatatagtaacaccaaccgcctcttccaaacagaggagatggaagatgcggttggtgaacctggcggcagcgcaaaagatg

SEQ ID NO: 79554 - DNA, 103 bp, Artificial Sequence
  Synthetic Polynucleotide
taatacgactcactataggggggttgccatatagtaacaccaaccgcctcaacagaggagagaggcgatgggtgttactaacctggcggcagcgcaaaagatg

SEQ ID NO: 79555 - DNA, 103 bp, Artificial Sequence
  Synthetic Polynucleotide
taatacgactcactatagggtttttgggttgccatatagtaacaccaaccaacagaggagaggttggatgtactatatgaacctggcggcagcgcaaaagatg

SEQ ID NO: 79556 - DNA, 103 bp, Artificial Sequence
  Synthetic Polynucleotide
taatacgactcactatagggactcttttttgggttgccatatagtaacacaacagaggagagtgttaatgtatggcaacaacctggcggcagcgcaaaagatg

SEQ ID NO: 79557 - DNA, 103 bp, Artificial Sequence
  Synthetic Polynucleotide
taatacgactcactatagggttgtggccttggtgctgtccatccaagcccaacagaggagagggcttatgtggacagcaaacctggcggcagcgcaaaagatg

SEQ ID NO: 79558 - DNA, 103 bp, Artificial Sequence
  Synthetic Polynucleotide
taatacgactcactatagggcttggactcttttttgggttgccatatagtaacagaggagaactataatgcaacccaaaaacctggcggcagcgcaaaagatg

SEQ ID NO: 79559 - DNA, 103 bp, Artificial Sequence
  Synthetic Polynucleotide
taatacgactcactataggggacttcttggactcttttttgggttgccataacagaggagaatggcaatgcaaaaaagaaacctggcggcagcgcaaaagatg

SEQ ID NO: 79560 - DNA, 103 bp, Artificial Sequence
  Synthetic Polynucleotide
taatacgactcactatagggcctctgacttcttggactcttttttgggttaacagaggagaaacccaatgaagagtccaaacctggcggcagcgcaaaagatg

SEQ ID NO: 79561 - DNA, 103 bp, Artificial Sequence
  Synthetic Polynucleotide
taatacgactcactatagggtgtaccctctgacttcttggactcttttttaacagaggagaaaaaaaatgtccaagaagaacctggcggcagcgcaaaagatg

SEQ ID NO: 79562 - DNA, 103 bp, Artificial Sequence
  Synthetic Polynucleotide
taatacgactcactatagggctttgtgtaccctctgacttcttggactctaacagaggagaagagtcatggaagtcagaaacctggcggcagcgcaaaagatg

SEQ ID NO: 79563 - DNA, 103 bp, Artificial Sequence
  Synthetic Polynucleotide
taatacgactcactatagggccgccctttgtgtaccctctgacttcttggaacagaggagaccaagaatgcagagggtaaacctggcggcagcgcaaaagatg

SEQ ID NO: 79564 - DNA, 103 bp, Artificial Sequence
  Synthetic Polynucleotide
taatacgactcactatagggcgggaccgccctttgtgtaccctctgacttaacagaggagaaagtcaatgggtacacaaaacctggcggcagcgcaaaagatg

SEQ ID NO: 79565 - DNA, 103 bp, Artificial Sequence
  Synthetic Polynucleotide
taatacgactcactatagggatgtccgggaccgccctttgtgtaccctctaacagaggagaagagggatgacaaagggcaacctggcggcagcgcaaaagatg

SEQ ID NO: 79566 - DNA, 103 bp, Artificial Sequence
  Synthetic Polynucleotide
taatacgactcactatagggtcttcatgtccgggaccgccctttgtgtacaacagaggagagtacacatggggcggtccaacctggcggcagcgcaaaagatg

SEQ ID NO: 79567 - DNA, 103 bp, Artificial Sequence
  Synthetic Polynucleotide
taatacgactcactatagggggggctcttcatgtccgggaccgccctttgaacagaggagacaaaggatggtcccggacaacctggcggcagcgcaaaagatg

SEQ ID NO: 79568 - DNA, 103 bp, Artificial Sequence
  Synthetic Polynucleotide
taatacgactcactatagggcttagacatcgagatcttcgtgctaagaaaaacagaggagatttcttatgacgaagatcaacctggcggcagcgcaaaagatg

SEQ ID NO: 79569 - DNA, 103 bp, Artificial Sequence
  Synthetic Polynucleotide
taatacgactcactatagggataccttgtggccttggtgctgtccatccaaacagaggagatggatgatgagcaccaagaacctggcggcagcgcaaaagatg

SEQ ID NO: 79570 - DNA, 103 bp, Artificial Sequence
  Synthetic Polynucleotide
taatacgactcactatagggtagttggggctcttcatgtccgggaccgccaacagaggagaggcggtatgggacatgaaaacctggcggcagcgcaaaagatg

SEQ ID NO: 79571 - DNA, 103 bp, Artificial Sequence
  Synthetic Polynucleotide
taatacgactcactatagggtgcactagttggggctcttcatgtccgggaaacagaggagatcccggatgtgaagagccaacctggcggcagcgcaaaagatg

SEQ ID NO: 79572 - DNA, 103 bp, Artificial Sequence
  Synthetic Polynucleotide
taatacgactcactatagggaactttgcactagttggggctcttcatgtcaacagaggagagacatgatgagccccaacaacctggcggcagcgcaaaagatg

SEQ ID NO: 79573 - DNA, 103 bp, Artificial Sequence
  Synthetic Polynucleotide
taatacgactcactatagggtccataactttgcactagttggggctcttcaacagaggagagaagagatgcaactagtgaacctggcggcagcgcaaaagatg

SEQ ID NO: 79574 - DNA, 103 bp, Artificial Sequence
  Synthetic Polynucleotide
taatacgactcactatagggttccatccataactttgcactagttggggcaacagaggagagccccaatgagtgcaaagaacctggcggcagcgcaaaagatg

SEQ ID NO: 79575 - DNA, 103 bp, Artificial Sequence
  Synthetic Polynucleotide
taatacgactcactatagggcaatgttccatccataactttgcactagttaacagaggagaaactagatgaaagttatgaacctggcggcagcgcaaaagatg

SEQ ID NO: 79576 - DNA, 103 bp, Artificial Sequence
  Synthetic Polynucleotide
taatacgactcactatagggggtgacaatgttccatccataactttgcacaacagaggagagtgcaaatgtatggatggaacctggcggcagcgcaaaagatg

SEQ ID NO: 79577 - DNA, 103 bp, Artificial Sequence
  Synthetic Polynucleotide
taatacgactcactatagggttcatggtgacaatgttccatccataacttaacagaggagaaagttaatgatggaacataacctggcggcagcgcaaaagatg

SEQ ID NO: 79578 - DNA, 103 bp, Artificial Sequence
  Synthetic Polynucleotide
taatacgactcactatagggcactcttcatggtgacaatgttccatccataacagaggagaatggatatgacattgtcaaacctggcggcagcgcaaaagatg

SEQ ID NO: 79579 - DNA, 103 bp, Artificial Sequence
  Synthetic Polynucleotide
taatacgactcactatagggcactccactcttcatggtgacaatgttccaaacagaggagatggaacatggtcaccatgaacctggcggcagcgcaaaagatg

SEQ ID NO: 79580 - DNA, 103 bp, Artificial Sequence
  Synthetic Polynucleotide
taatacgactcactatagggaccaaataccttgtggccttggtgctgtccaacagaggagaggacagatgcaaggccacaacctggcggcagcgcaaaagatg

SEQ ID NO: 79581 - DNA, 103 bp, Artificial Sequence
  Synthetic Polynucleotide
taatacgactcactatagggacatccactccactcttcatggtgacaatgaacagaggagacattgtatgcatgaagagaacctggcggcagcgcaaaagatg

SEQ ID NO: 79582 - DNA, 103 bp, Artificial Sequence
  Synthetic Polynucleotide
taatacgactcactatagggagaacacatccactccactcttcatggtgaaacagaggagatcaccaatgagagtggagaacctggcggcagcgcaaaagatg

SEQ ID NO: 79583 - DNA, 103 bp, Artificial Sequence
  Synthetic Polynucleotide
taatacgactcactatagggtctgtagaacacatccactccactcttcataacagaggagaatgaagatgggagtggataacctggcggcagcgcaaaagatg

SEQ ID NO: 79584 - DNA, 103 bp, Artificial Sequence
  Synthetic Polynucleotide
taatacgactcactataggggaaggtctgtagaacacatccactccactcaacagaggagagagtggatgggatgtgttaacctggcggcagcgcaaaagatg

SEQ ID NO: 79585 - DNA, 103 bp, Artificial Sequence
  Synthetic Polynucleotide
taatacgactcactatagggactcagaaggtctgtagaacacatccactcaacagaggagagagtggatgtgttctacaaacctggcggcagcgcaaaagatg

SEQ ID NO: 79586 - DNA, 103 bp, Artificial Sequence
  Synthetic Polynucleotide
taatacgactcactatagggacaacactcagaaggtctgtagaacacatcaacagaggagagatgtgatgtacagacctaacctggcggcagcgcaaaagatg

SEQ ID NO: 79587 - DNA, 103 bp, Artificial Sequence
  Synthetic Polynucleotide
taatacgactcactataggggtgtcacaacactcagaaggtctgtagaacaacagaggagagttctaatgaccttctgaaacctggcggcagcgcaaaagatg

SEQ ID NO: 79588 - DNA, 103 bp, Artificial Sequence
  Synthetic Polynucleotide
taatacgactcactatagggggagggtgtcacaacactcagaaggtctgtaacagaggagaacagacatgctgagtgttaacctggcggcagcgcaaaagatg

SEQ ID NO: 79589 - DNA, 103 bp, Artificial Sequence
  Synthetic Polynucleotide
taatacgactcactatagggacaaaggagggtgtcacaacactcagaaggaacagaggagaccttctatgtgttgtgacaacctggcggcagcgcaaaagatg

SEQ ID NO: 79590 - DNA, 103 bp, Artificial Sequence
  Synthetic Polynucleotide
taatacgactcactatagggatgtcacaaaggagggtgtcacaacactcaaacagaggagatgagtgatgtgacaccctaacctggcggcagcgcaaaagatg

SEQ ID NO: 79591 - DNA, 103 bp, Artificial Sequence
  Synthetic Polynucleotide
taatacgactcactatagggtttttaccaaataccttgtggccttggtgcaacagaggagagcaccaatgccacaaggtaacctggcggcagcgcaaaagatg

SEQ ID NO: 79592 - DNA, 103 bp, Artificial Sequence
  Synthetic Polynucleotide
taatacgactcactatagggctccgatgtcacaaaggagggtgtcacaacaacagaggagagttgtgatgccctcctttaacctggcggcagcgcaaaagatg

SEQ ID NO: 79593 - DNA, 103 bp, Artificial Sequence
  Synthetic Polynucleotide
taatacgactcactatagggggactctccgatgtcacaaaggagggtgtcaacagaggagagacaccatgctttgtgacaacctggcggcagcgcaaaagatg

SEQ ID NO: 79594 - DNA, 103 bp, Artificial Sequence
  Synthetic Polynucleotide
taatacgactcactataggggacgaggactctccgatgtcacaaaggaggaacagaggagacctcctatgtgacatcggaacctggcggcagcgcaaaagatg

SEQ ID NO: 79595 - DNA, 103 bp, Artificial Sequence
  Synthetic Polynucleotide
taatacgactcactatagggcacttgacgaggactctccgatgtcacaaaaacagaggagatttgtgatgtcggagagtaacctggcggcagcgcaaaagatg

SEQ ID NO: 79596 - DNA, 103 bp, Artificial Sequence
  Synthetic Polynucleotide
taatacgactcactatagggctcagcacttgacgaggactctccgatgtcaacagaggagagacatcatggagtcctcgaacctggcggcagcgcaaaagatg

SEQ ID NO: 79597 - DNA, 103 bp, Artificial Sequence
  Synthetic Polynucleotide
taatacgactcactatagggtcaacctcagcacttgacgaggactctccgaacagaggagacggagaatgctcgtcaagaacctggcggcagcgcaaaagatg

SEQ ID NO: 79598 - DNA, 103 bp, Artificial Sequence
  Synthetic Polynucleotide
taatacgactcactataggggctcttcaacctcagcacttgacgaggactaacagaggagaagtcctatgcaagtgctgaacctggcggcagcgcaaaagatg

SEQ ID NO: 79599 - DNA, 103 bp, Artificial Sequence
  Synthetic Polynucleotide
taatacgactcactatagggcctatgctcttcaacctcagcacttgacgaaacagaggagatcgtcaatggctgaggttaacctggcggcagcgcaaaagatg

SEQ ID NO: 79600 - DNA, 103 bp, Artificial Sequence
  Synthetic Polynucleotide
taatacgactcactatagggatcgtcctatgctcttcaacctcagcacttaacagaggagaaagtgcatgggttgaagaaacctggcggcagcgcaaaagatg

SEQ ID NO: 79601 - DNA, 103 bp, Artificial Sequence
  Synthetic Polynucleotide
taatacgactcactatagggcccgaatcgtcctatgctcttcaacctcagaacagaggagactgaggatgaagagcataaacctggcggcagcgcaaaagatg

SEQ ID NO: 79602 - DNA, 103 bp, Artificial Sequence
  Synthetic Polynucleotide
taatacgactcactatagggttctgtttttaccaaataccttgtggccttaacagaggagaaaggccatgaggtatttgaacctggcggcagcgcaaaagatg

SEQ ID NO: 79603 - DNA, 103 bp, Artificial Sequence
  Synthetic Polynucleotide
taatacgactcactatagggaaggacccgaatcgtcctatgctcttcaacaacagaggagagttgaaatgcataggacgaacctggcggcagcgcaaaagatg

SEQ ID NO: 79604 - DNA, 103 bp, Artificial Sequence
  Synthetic Polynucleotide
taatacgactcactatagggatttcaaggacccgaatcgtcctatgctctaacagaggagaagagcaatggacgattcgaacctggcggcagcgcaaaagatg

SEQ ID NO: 79605 - DNA, 103 bp, Artificial Sequence
  Synthetic Polynucleotide
taatacgactcactatagggcaaccatttcaaggacccgaatcgtcctataacagaggagaataggaatgttcgggtccaacctggcggcagcgcaaaagatg

SEQ ID NO: 79606 - DNA, 103 bp, Artificial Sequence
  Synthetic Polynucleotide
taatacgactcactataggggtcctcaaccatttcaaggacccgaatcgtaacagaggagaacgattatggtccttgaaaacctggcggcagcgcaaaagatg

SEQ ID NO: 79607 - DNA, 103 bp, Artificial Sequence
  Synthetic Polynucleotide
taatacgactcactatagggagccagtcctcaaccatttcaaggacccgaaacagaggagatcgggtatgtgaaatggtaacctggcggcagcgcaaaagatg

SEQ ID NO: 79608 - DNA, 103 bp, Artificial Sequence
  Synthetic Polynucleotide
taatacgactcactatagggggtgcagccagtcctcaaccatttcaaggaaacagaggagatccttgatgtggttgaggaacctggcggcagcgcaaaagatg

SEQ ID NO: 79609 - DNA, 103 bp, Artificial Sequence
  Synthetic Polynucleotide
taatacgactcactatagggccctcggtgcagccagtcctcaaccatttcaacagaggagagaaatgatggaggactggaacctggcggcagcgcaaaagatg

SEQ ID NO: 79610 - DNA, 103 bp, Artificial Sequence
  Synthetic Polynucleotide
taatacgactcactatagggcttggccctcggtgcagccagtcctcaaccaacagaggagaggttgaatgctggctgcaaacctggcggcagcgcaaaagatg

SEQ ID NO: 79611 - DNA, 103 bp, Artificial Sequence
  Synthetic Polynucleotide
taatacgactcactatagggattcccttggccctcggtgcagccagtcctaacagaggagaaggactatgtgcaccgagaacctggcggcagcgcaaaagatg

SEQ ID NO: 79612 - DNA, 103 bp, Artificial Sequence
  Synthetic Polynucleotide
taatacgactcactataggggcaaaattcccttggccctcggtgcagccaaacagaggagatggctgatgcgagggccaaacctggcggcagcgcaaaagatg

SEQ ID NO: 79613 - DNA, 103 bp, Artificial Sequence
  Synthetic Polynucleotide
taatacgactcactatagggcatgattctgtttttaccaaataccttgtgaacagaggagacacaagatgtttggtaaaaacctggcggcagcgcaaaagatg

SEQ ID NO: 79614 - DNA, 103 bp, Artificial Sequence
  Synthetic Polynucleotide
taatacgactcactatagggttcacgcaaaattcccttggccctcggtgcaacagaggagagcaccgatggccaagggaaacctggcggcagcgcaaaagatg

SEQ ID NO: 79615 - DNA, 103 bp, Artificial Sequence
  Synthetic Polynucleotide
taatacgactcactataggggcaccttcacgcaaaattcccttggccctcaacagaggagagagggcatggggaattttaacctggcggcagcgcaaaagatg

SEQ ID NO: 79616 - DNA, 103 bp, Artificial Sequence
  Synthetic Polynucleotide
taatacgactcactatagggacagagcaccttcacgcaaaattcccttggaacagaggagaccaaggatgttttgcgtgaacctggcggcagcgcaaaagatg

SEQ ID NO: 79617 - DNA, 103 bp, Artificial Sequence
  Synthetic Polynucleotide
taatacgactcactatagggtagggacagagcaccttcacgcaaaattccaacagaggagaggaattatgcgtgaaggtaacctggcggcagcgcaaaagatg

SEQ ID NO: 79618 - DNA, 103 bp, Artificial Sequence
  Synthetic Polynucleotide
taatacgactcactataggggcatgtagggacagagcaccttcacgcaaaaacagaggagatttgcgatgaggtgctctaacctggcggcagcgcaaaagatg

SEQ ID NO: 79619 - DNA, 103 bp, Artificial Sequence
  Synthetic Polynucleotide
taatacgactcactatagggtttcggcatgtagggacagagcaccttcacaacagaggagagtgaagatgctctgtcccaacctggcggcagcgcaaaagatg

SEQ ID NO: 79620 - DNA, 103 bp, Artificial Sequence
  Synthetic Polynucleotide
taatacgactcactatagggatgactttcggcatgtagggacagagcaccaacagaggagaggtgctatgtccctacataacctggcggcagcgcaaaagatg

SEQ ID NO: 79621 - DNA, 103 bp, Artificial Sequence
  Synthetic Polynucleotide
taatacgactcactatagggtctctatgactttcggcatgtagggacagaaacagaggagatctgtcatgacatgccgaaacctggcggcagcgcaaaagatg

SEQ ID NO: 79622 - DNA, 103 bp, Artificial Sequence
  Synthetic Polynucleotide
taatacgactcactatagggcatcttctctatgactttcggcatgtagggaacagaggagaccctacatgccgaaagtcaacctggcggcagcgcaaaagatg

SEQ ID NO: 79623 - DNA, 103 bp, Artificial Sequence
  Synthetic Polynucleotide
taatacgactcactatagggagctccatcttctctatgactttcggcatgaacagaggagacatgccatgagtcatagaaacctggcggcagcgcaaaagatg

SEQ ID NO: 79624 - DNA, 103 bp, Artificial Sequence
  Synthetic Polynucleotide
taatacgactcactatagggagatccatgattctgtttttaccaaataccaacagaggagaggtattatgtaaaaacagaacctggcggcagcgcaaaagatg

SEQ ID NO: 79625 - DNA, 103 bp, Artificial Sequence
  Synthetic Polynucleotide
taatacgactcactatagggggagcagctccatcttctctatgactttcgaacagaggagacgaaagatgtagagaagaaacctggcggcagcgcaaaagatg

SEQ ID NO: 79626 - DNA, 103 bp, Artificial Sequence
  Synthetic Polynucleotide
taatacgactcactataggggcgttggagcagctccatcttctctatgacaacagaggagagtcataatgaagatggagaacctggcggcagcgcaaaagatg

SEQ ID NO: 79627 - DNA, 103 bp, Artificial Sequence
  Synthetic Polynucleotide
taatacgactcactatagggtaccggcgttggagcagctccatcttctctaacagaggagaagagaaatgggagctgctaacctggcggcagcgcaaaagatg

SEQ ID NO: 79628 - DNA, 103 bp, Artificial Sequence
  Synthetic Polynucleotide
taatacgactcactatagggccccataccggcgttggagcagctccatctaacagaggagaagatggatgtgctccaacaacctggcggcagcgcaaaagatg

SEQ ID NO: 79629 - DNA, 103 bp, Artificial Sequence
  Synthetic Polynucleotide
taatacgactcactatagggtccccccccataccggcgttggagcagctcaacagaggagagagctgatgcaacgccggaacctggcggcagcgcaaaagatg

SEQ ID NO: 79630 - DNA, 103 bp, Artificial Sequence
  Synthetic Polynucleotide
taatacgactcactatagggaccagtccccccccataccggcgttggagcaacagaggagagctccaatgccggtatggaacctggcggcagcgcaaaagatg

SEQ ID NO: 79631 - DNA, 103 bp, Artificial Sequence
  Synthetic Polynucleotide
taatacgactcactatagggttctgaccagtccccccccataccggcgttaacagaggagaaacgccatgatgggggggaacctggcggcagcgcaaaagatg

SEQ ID NO: 79632 - DNA, 103 bp, Artificial Sequence
  Synthetic Polynucleotide
taatacgactcactatagggtgggtttctgaccagtccccccccataccgaacagaggagacggtatatggggggactgaacctggcggcagcgcaaaagatg

SEQ ID NO: 79633 - DNA, 103 bp, Artificial Sequence
  Synthetic Polynucleotide
taatacgactcactataggggagagtgggtttctgaccagtccccccccaaacagaggagatgggggatgactggtcagaacctggcggcagcgcaaaagatg

SEQ ID NO: 79634 - DNA, 103 bp, Artificial Sequence
  Synthetic Polynucleotide
taatacgactcactatagggtccgtgagagtgggtttctgaccagtccccaacagaggagaggggacatgtcagaaaccaacctggcggcagcgcaaaagatg

SEQ ID NO: 79635 - DNA, 103 bp, Artificial Sequence
  Synthetic Polynucleotide
taatacgactcactatagggcctcaagatccatgattctgtttttaccaaaacagaggagattggtaatgacagaatcaaacctggcggcagcgcaaaagatg

SEQ ID NO: 79636 - DNA, 103 bp, Artificial Sequence
  Synthetic Polynucleotide
taatacgactcactatagggggaattccgtgagagtgggtttctgaccagaacagaggagactggtcatgaacccactcaacctggcggcagcgcaaaagatg

SEQ ID NO: 79637 - DNA, 103 bp, Artificial Sequence
  Synthetic Polynucleotide
taatacgactcactatagggtgcgtggaattccgtgagagtgggtttctgaacagaggagacagaaaatgactctcacgaacctggcggcagcgcaaaagatg

SEQ ID NO: 79638 - DNA, 103 bp, Artificial Sequence
  Synthetic Polynucleotide
taatacgactcactatagggtctcgtgcgtggaattccgtgagagtgggtaacagaggagaacccacatgcacggaattaacctggcggcagcgcaaaagatg

SEQ ID NO: 79639 - DNA, 103 bp, Artificial Sequence
  Synthetic Polynucleotide
taatacgactcactatagggatacatctcgtgcgtggaattccgtgagagaacagaggagactctcaatgaattccacgaacctggcggcagcgcaaaagatg

SEQ ID NO: 79640 - DNA, 103 bp, Artificial Sequence
  Synthetic Polynucleotide
taatacgactcactatagggacccaatacatctcgtgcgtggaattccgtaacagaggagaacggaaatgcacgcacgaaacctggcggcagcgcaaaagatg

SEQ ID NO: 79641 - DNA, 103 bp, Artificial Sequence
  Synthetic Polynucleotide
taatacgactcactataggggactcacccaatacatctcgtgcgtggaataacagaggagaattccaatgacgagatgtaacctggcggcagcgcaaaagatg

SEQ ID NO: 79642 - DNA, 103 bp, Artificial Sequence
  Synthetic Polynucleotide
taatacgactcactatagggagctcgactcacccaatacatctcgtgcgtaacagaggagaacgcacatgatgtattggaacctggcggcagcgcaaaagatg

SEQ ID NO: 79643 - DNA, 103 bp, Artificial Sequence
  Synthetic Polynucleotide
taatacgactcactatagggcctgaagctcgactcacccaatacatctcgaacagaggagacgagatatgttgggtgagaacctggcggcagcgcaaaagatg

SEQ ID NO: 79644 - DNA, 103 bp, Artificial Sequence
  Synthetic Polynucleotide
taatacgactcactatagggcattgcctgaagctcgactcacccaatacaaacagaggagatgtattatgtgagtcgagaacctggcggcagcgcaaaagatg

SEQ ID NO: 79645 - DNA, 103 bp, Artificial Sequence
  Synthetic Polynucleotide
taatacgactcactatagggtaccacattgcctgaagctcgactcacccaaacagaggagatgggtgatgcgagcttcaaacctggcggcagcgcaaaagatg

SEQ ID NO: 79646 - DNA, 103 bp, Artificial Sequence
  Synthetic Polynucleotide
taatacgactcactataggggggttcctcaagatccatgattctgtttttaacagaggagaaaaaacatgatcatggataacctggcggcagcgcaaaagatg

SEQ ID NO: 79647 - DNA, 103 bp, Artificial Sequence
  Synthetic Polynucleotide
taatacgactcactataggggaatgtaccacattgcctgaagctcgactcaacagaggagagagtcgatgttcaggcaaaacctggcggcagcgcaaaagatg

SEQ ID NO: 79648 - DNA, 103 bp, Artificial Sequence
  Synthetic Polynucleotide
taatacgactcactatagggtcactgaatgtaccacattgcctgaagctcaacagaggagagagcttatggcaatgtggaacctggcggcagcgcaaaagatg

SEQ ID NO: 79649 - DNA, 103 bp, Artificial Sequence
  Synthetic Polynucleotide
taatacgactcactatagggcatattcactgaatgtaccacattgcctgaaacagaggagatcaggcatggtggtacataacctggcggcagcgcaaaagatg

SEQ ID NO: 79650 - DNA, 103 bp, Artificial Sequence
  Synthetic Polynucleotide
taatacgactcactatagggctggtcatattcactgaatgtaccacattgaacagaggagacaatgtatgacattcagtaacctggcggcagcgcaaaagatg

SEQ ID NO: 79651 - DNA, 103 bp, Artificial Sequence
  Synthetic Polynucleotide
taatacgactcactatagggcctggctggtcatattcactgaatgtaccaaacagaggagatggtacatgcagtgaataaacctggcggcagcgcaaaagatg

SEQ ID NO: 79652 - DNA, 103 bp, Artificial Sequence
  Synthetic Polynucleotide
taatacgactcactataggggagcacctggctggtcatattcactgaatgaacagaggagacattcaatgaatatgaccaacctggcggcagcgcaaaagatg

SEQ ID NO: 79653 - DNA, 103 bp, Artificial Sequence
  Synthetic Polynucleotide
taatacgactcactatagggcctaggagcacctggctggtcatattcactaacagaggagaagtgaaatggaccagccaaacctggcggcagcgcaaaagatg

SEQ ID NO: 79654 - DNA, 103 bp, Artificial Sequence
  Synthetic Polynucleotide
taatacgactcactatagggttcttcctaggagcacctggctggtcatataacagaggagaatatgaatggccaggtgcaacctggcggcagcgcaaaagatg

SEQ ID NO: 79655 - DNA, 103 bp, Artificial Sequence
  Synthetic Polynucleotide
taatacgactcactatagggttccattcttcctaggagcacctggctggtaacagaggagaaccagcatggtgctcctaaacctggcggcagcgcaaaagatg

SEQ ID NO: 79656 - DNA, 103 bp, Artificial Sequence
  Synthetic Polynucleotide
taatacgactcactatagggcttttttccattcttcctaggagcacctggaacagaggagaccaggtatgcctaggaagaacctggcggcagcgcaaaagatg

SEQ ID NO: 79657 - DNA, 103 bp, Artificial Sequence
  Synthetic Polynucleotide
taatacgactcactatagggatccagggttcctcaagatccatgattctgaacagaggagacagaatatgggatcttgaaacctggcggcagcgcaaaagatg

SEQ ID NO: 79658 - DNA, 103 bp, Artificial Sequence
  Synthetic Polynucleotide
taatacgactcactatagggaggtccttttttccattcttcctaggagcaaacagaggagatgctccatggaagaatggaacctggcggcagcgcaaaagatg

SEQ ID NO: 79659 - DNA, 103 bp, Artificial Sequence
  Synthetic Polynucleotide
taatacgactcactatagggcttccaggtccttttttccattcttcctagaacagaggagactaggaatgatggaaaaaaacctggcggcagcgcaaaagatg

SEQ ID NO: 79660 - DNA, 103 bp, Artificial Sequence
  Synthetic Polynucleotide
taatacgactcactatagggggtcccttccaggtccttttttccattcttaacagaggagaaagaatatgaaaaaggacaacctggcggcagcgcaaaagatg

SEQ ID NO: 79661 - DNA, 103 bp, Artificial Sequence
  Synthetic Polynucleotide
taatacgactcactatagggattggggtcccttccaggtccttttttccaaacagaggagatggaaaatgggacctggaaacctggcggcagcgcaaaagatg

SEQ ID NO: 79662 - DNA, 103 bp, Artificial Sequence
  Synthetic Polynucleotide
taatacgactcactatagggctcgtattggggtcccttccaggtccttttaacagaggagaaaaaggatgtggaagggaaacctggcggcagcgcaaaagatg

SEQ ID NO: 79663 - DNA, 103 bp, Artificial Sequence
  Synthetic Polynucleotide
taatacgactcactatagggtcttcctcgtattggggtcccttccaggtcaacagaggagagacctgatggggaccccaaacctggcggcagcgcaaaagatg

SEQ ID NO: 79664 - DNA, 103 bp, Artificial Sequence
  Synthetic Polynucleotide
taatacgactcactatagggttacatcttcctcgtattggggtcccttccaacagaggagaggaaggatgcccaatacgaacctggcggcagcgcaaaagatg

SEQ ID NO: 79665 - DNA, 103 bp, Artificial Sequence
  Synthetic Polynucleotide
taatacgactcactatagggcaagtttacatcttcctcgtattggggtccaacagaggagaggacccatgtacgaggaaaacctggcggcagcgcaaaagatg

SEQ ID NO: 79666 - DNA, 103 bp, Artificial Sequence
  Synthetic Polynucleotide
taatacgactcactatagggcttcccaagtttacatcttcctcgtattggaacagaggagaccaataatgggaagatgtaacctggcggcagcgcaaaagatg

SEQ ID NO: 79667 - DNA, 103 bp, Artificial Sequence
  Synthetic Polynucleotide
taatacgactcactatagggttccacttcccaagtttacatcttcctcgtaacagaggagaacgaggatgatgtaaactaacctggcggcagcgcaaaagatg

SEQ ID NO: 79668 - DNA, 103 bp, Artificial Sequence
  Synthetic Polynucleotide
taatacgactcactatagggggcatatccagggttcctcaagatccatgaaacagaggagatcatggatgttgaggaacaacctggcggcagcgcaaaagatg

SEQ ID NO: 79669 - DNA, 103 bp, Artificial Sequence
  Synthetic Polynucleotide
taatacgactcactatagggcctggttccacttcccaagtttacatcttcaacagaggagagaagatatgaacttgggaaacctggcggcagcgcaaaagatg

SEQ ID NO: 79670 - DNA, 103 bp, Artificial Sequence
  Synthetic Polynucleotide
taatacgactcactatagggaccgccctggttccacttcccaagtttacaaacagaggagatgtaaaatggggaagtggaacctggcggcagcgcaaaagatg

SEQ ID NO: 79671 - DNA, 103 bp, Artificial Sequence
  Synthetic Polynucleotide
taatacgactcactatagggttcccaccgccctggttccacttcccaagtaacagaggagaacttggatggtggaaccaaacctggcggcagcgcaaaagatg

SEQ ID NO: 79672 - DNA, 103 bp, Artificial Sequence
  Synthetic Polynucleotide
taatacgactcactataggggggttttcccaccgccctggttccacttccaacagaggagaggaagtatgaccagggcgaacctggcggcagcgcaaaagatg

SEQ ID NO: 79673 - DNA, 103 bp, Artificial Sequence
  Synthetic Polynucleotide
taatacgactcactatagggagcaggggttttcccaccgccctggttccaaacagaggagatggaacatgggcggtgggaacctggcggcagcgcaaaagatg

SEQ ID NO: 79674 - DNA, 103 bp, Artificial Sequence
  Synthetic Polynucleotide
taatacgactcactatagggagttgagcaggggttttcccaccgccctggaacagaggagaccagggatgtgggaaaacaacctggcggcagcgcaaaagatg

SEQ ID NO: 79675 - DNA, 103 bp, Artificial Sequence
  Synthetic Polynucleotide
taatacgactcactataggggtctgagttgagcaggggttttcccaccgcaacagaggagagcggtgatgaaacccctgaacctggcggcagcgcaaaagatg

SEQ ID NO: 79676 - DNA, 103 bp, Artificial Sequence
  Synthetic Polynucleotide
taatacgactcactatagggctggtgtctgagttgagcaggggttttcccaacagaggagagggaaaatgcctgctcaaaacctggcggcagcgcaaaagatg

SEQ ID NO: 79677 - DNA, 103 bp, Artificial Sequence
  Synthetic Polynucleotide
taatacgactcactatagggttttactggtgtctgagttgagcaggggttaacagaggagaaaccccatgtcaactcagaacctggcggcagcgcaaaagatg

SEQ ID NO: 79678 - DNA, 103 bp, Artificial Sequence
  Synthetic Polynucleotide
taatacgactcactatagggcttgattttactggtgtctgagttgagcagaacagaggagactgctcatgtcagacaccaacctggcggcagcgcaaaagatg

SEQ ID NO: 79679 - DNA, 103 bp, Artificial Sequence
  Synthetic Polynucleotide
taatacgactcactatagggggtttcttagacatcgagatcttcgtgctaaacagaggagatagcacatggatctcgataacctggcggcagcgcaaaagatg

SEQ ID NO: 79680 - DNA, 103 bp, Artificial Sequence
  Synthetic Polynucleotide
taatacgactcactatagggaccagggcatatccagggttcctcaagatcaacagaggagagatcttatggaaccctggaacctggcggcagcgcaaaagatg

SEQ ID NO: 79681 - DNA, 103 bp, Artificial Sequence
  Synthetic Polynucleotide
taatacgactcactatagggctgttcttgattttactggtgtctgagttgaacagaggagacaactcatgcaccagtaaaacctggcggcagcgcaaaagatg

SEQ ID NO: 79682 - DNA, 103 bp, Artificial Sequence
  Synthetic Polynucleotide
taatacgactcactatagggcaatcctgttcttgattttactggtgtctgaacagaggagacagacaatggtaaaatcaaacctggcggcagcgcaaaagatg

SEQ ID NO: 79683 - DNA, 103 bp, Artificial Sequence
  Synthetic Polynucleotide
taatacgactcactatagggtcgttcaatcctgttcttgattttactggtaacagaggagaaccagtatgatcaagaacaacctggcggcagcgcaaaagatg

SEQ ID NO: 79684 - DNA, 103 bp, Artificial Sequence
  Synthetic Polynucleotide
taatacgactcactatagggctgagtcgttcaatcctgttcttgattttaaacagaggagataaaatatggaacaggataacctggcggcagcgcaaaagatg

SEQ ID NO: 79685 - DNA, 103 bp, Artificial Sequence
  Synthetic Polynucleotide
taatacgactcactatagggcacgcctgagtcgttcaatcctgttcttgaaacagaggagatcaagaatgggattgaacaacctggcggcagcgcaaaagatg

SEQ ID NO: 79686 - DNA, 103 bp, Artificial Sequence
  Synthetic Polynucleotide
taatacgactcactataggggtactcacgcctgagtcgttcaatcctgttaacagaggagaaacaggatggaacgactcaacctggcggcagcgcaaaagatg

SEQ ID NO: 79687 - DNA, 103 bp, Artificial Sequence
  Synthetic Polynucleotide
taatacgactcactataggggaactgtactcacgcctgagtcgttcaatcaacagaggagagattgaatgactcaggcgaacctggcggcagcgcaaaagatg

SEQ ID NO: 79688 - DNA, 103 bp, Artificial Sequence
  Synthetic Polynucleotide
taatacgactcactatagggacgtcgaactgtactcacgcctgagtcgttaacagaggagaaacgacatgggcgtgagtaacctggcggcagcgcaaaagatg

SEQ ID NO: 79689 - DNA, 103 bp, Artificial Sequence
  Synthetic Polynucleotide
taatacgactcactataggggtgccacgtcgaactgtactcacgcctgagaacagaggagactcaggatggagtacagtaacctggcggcagcgcaaaagatg

SEQ ID NO: 79690 - DNA, 103 bp, Artificial Sequence
  Synthetic Polynucleotide
taatacgactcactatagggtcgtggtgccacgtcgaactgtactcacgcaacagaggagagcgtgaatgcagttcgacaacctggcggcagcgcaaaagatg

SEQ ID NO: 79691 - DNA, 103 bp, Artificial Sequence
  Synthetic Polynucleotide
taatacgactcactatagggctgccaccagggcatatccagggttcctcaaacagaggagatgaggaatgctggatatgaacctggcggcagcgcaaaagatg

SEQ ID NO: 79692 - DNA, 103 bp, Artificial Sequence
  Synthetic Polynucleotide
taatacgactcactatagggtctcatcgtggtgccacgtcgaactgtactaacagaggagaagtacaatgcgacgtggcaacctggcggcagcgcaaaagatg

SEQ ID NO: 79693 - DNA, 103 bp, Artificial Sequence
  Synthetic Polynucleotide
taatacgactcactataggggtggttctcatcgtggtgccacgtcgaactaacagaggagaagttcgatgtggcaccacaacctggcggcagcgcaaaagatg

SEQ ID NO: 79694 - DNA, 103 bp, Artificial Sequence
  Synthetic Polynucleotide
taatacgactcactatagggtatgggtggttctcatcgtggtgccacgtcaacagaggagagacgtgatgccacgatgaaacctggcggcagcgcaaaagatg

SEQ ID NO: 79695 - DNA, 103 bp, Artificial Sequence
  Synthetic Polynucleotide
taatacgactcactatagggttctatatgggtggttctcatcgtggtgccaacagaggagaggcaccatgatgagaaccaacctggcggcagcgcaaaagatg

SEQ ID NO: 79696 - DNA, 103 bp, Artificial Sequence
  Synthetic Polynucleotide
taatacgactcactatagggccaggttctatatgggtggttctcatcgtgaacagaggagacacgatatgaaccacccaaacctggcggcagcgcaaaagatg

SEQ ID NO: 79697 - DNA, 103 bp, Artificial Sequence
  Synthetic Polynucleotide
taatacgactcactatagggtagttccaggttctatatgggtggttctcaaacagaggagatgagaaatgcccatatagaacctggcggcagcgcaaaagatg

SEQ ID NO: 79698 - DNA, 103 bp, Artificial Sequence
  Synthetic Polynucleotide
taatacgactcactatagggcgtgatagttccaggttctatatgggtggtaacagaggagaaccaccatgatagaacctaacctggcggcagcgcaaaagatg

SEQ ID NO: 79699 - DNA, 103 bp, Artificial Sequence
  Synthetic Polynucleotide
taatacgactcactatagggactgccgtgatagttccaggttctatatggaacagaggagaccatatatgacctggaacaacctggcggcagcgcaaaagatg

SEQ ID NO: 79700 - DNA, 103 bp, Artificial Sequence
  Synthetic Polynucleotide
taatacgactcactatagggtcataactgccgtgatagttccaggttctaaacagaggagatagaacatggaactatcaaacctggcggcagcgcaaaagatg

SEQ ID NO: 79701 - DNA, 103 bp, Artificial Sequence
  Synthetic Polynucleotide
taatacgactcactatagggtcacatcataactgccgtgatagttccaggaacagaggagacctggaatgatcacggcaaacctggcggcagcgcaaaagatg

SEQ ID NO: 79702 - DNA, 103 bp, Artificial Sequence
  Synthetic Polynucleotide
taatacgactcactataggggacggctgccaccagggcatatccagggttaacagaggagaaaccctatgtatgccctgaacctggcggcagcgcaaaagatg

SEQ ID NO: 79703 - DNA, 103 bp, Artificial Sequence
  Synthetic Polynucleotide
taatacgactcactataggggggcttcacatcataactgccgtgatagttaacagaggagaaactatatgggcagttataacctggcggcagcgcaaaagatg

SEQ ID NO: 79704 - DNA, 103 bp, Artificial Sequence
  Synthetic Polynucleotide
taatacgactcactatagggcctgtgggcttcacatcataactgccgtgaaacagaggagatcacggatgttatgatgtaacctggcggcagcgcaaaagatg

SEQ ID NO: 79705 - DNA, 103 bp, Artificial Sequence
  Synthetic Polynucleotide
taatacgactcactatagggcggagcctgtgggcttcacatcataactgcaacagaggagagcagttatgatgtgaagcaacctggcggcagcgcaaaagatg

SEQ ID NO: 79706 - DNA, 103 bp, Artificial Sequence
  Synthetic Polynucleotide
taatacgactcactatagggactggcggagcctgtgggcttcacatcataaacagaggagatatgatatgaagcccacaaacctggcggcagcgcaaaagatg

SEQ ID NO: 79707 - DNA, 103 bp, Artificial Sequence
  Synthetic Polynucleotide
taatacgactcactatagggagcgaactggcggagcctgtgggcttcacaaacagaggagatgtgaaatgcacaggctcaacctggcggcagcgcaaaagatg

SEQ ID NO: 79708 - DNA, 103 bp, Artificial Sequence
  Synthetic Polynucleotide
taatacgactcactatagggtgaccagcgaactggcggagcctgtgggctaacagaggagaagcccaatggctccgccaaacctggcggcagcgcaaaagatg

SEQ ID NO: 79709 - DNA, 103 bp, Artificial Sequence
  Synthetic Polynucleotide
taatacgactcactatagggtccattgaccagcgaactggcggagcctgtaacagaggagaacaggcatggccagttcgaacctggcggcagcgcaaaagatg

SEQ ID NO: 79710 - DNA, 103 bp, Artificial Sequence
  Synthetic Polynucleotide
taatacgactcactatagggaccactccattgaccagcgaactggcggagaacagaggagactccgcatgttcgctggtaacctggcggcagcgcaaaagatg

SEQ ID NO: 79711 - DNA, 103 bp, Artificial Sequence
  Synthetic Polynucleotide
taatacgactcactataggggcctgaccactccattgaccagcgaactggaacagaggagaccagttatgtggtcaatgaacctggcggcagcgcaaaagatg

SEQ ID NO: 79712 - DNA, 103 bp, Artificial Sequence
  Synthetic Polynucleotide
taatacgactcactataggggaggagcctgaccactccattgaccagcgaaacagaggagatcgctgatgaatggagtgaacctggcggcagcgcaaaagatg

SEQ ID NO: 79713 - DNA, 103 bp, Artificial Sequence
  Synthetic Polynucleotide
taatacgactcactatagggccaatgacggctgccaccagggcatatccaaacagaggagatggataatgcctggtggcaacctggcggcagcgcaaaagatg

SEQ ID NO: 79714 - DNA, 103 bp, Artificial Sequence
  Synthetic Polynucleotide
taatacgactcactatagggtttgagaggagcctgaccactccattgaccaacagaggagaggtcaaatgagtggtcagaacctggcggcagcgcaaaagatg

SEQ ID NO: 79715 - DNA, 103 bp, Artificial Sequence
  Synthetic Polynucleotide
taatacgactcactatagggatggttttgagaggagcctgaccactccataacagaggagaatggagatgtcaggctccaacctggcggcagcgcaaaagatg

SEQ ID NO: 79716 - DNA, 103 bp, Artificial Sequence
  Synthetic Polynucleotide
taatacgactcactataggggtcccatggttttgagaggagcctgaccacaacagaggagagtggtcatgctcctctcaaacctggcggcagcgcaaaagatg

SEQ ID NO: 79717 - DNA, 103 bp, Artificial Sequence
  Synthetic Polynucleotide
taatacgactcactatagggatggtgtcccatggttttgagaggagcctgaacagaggagacaggctatgctcaaaaccaacctggcggcagcgcaaaagatg

SEQ ID NO: 79718 - DNA, 103 bp, Artificial Sequence
  Synthetic Polynucleotide
taatacgactcactatagggtcgtgatggtgtcccatggttttgagaggaaacagaggagatcctctatgaaccatgggaacctggcggcagcgcaaaagatg

SEQ ID NO: 79719 - DNA, 103 bp, Artificial Sequence
  Synthetic Polynucleotide
taatacgactcactatagggaacattcgtgatggtgtcccatggttttgaaacagaggagatcaaaaatgtgggacaccaacctggcggcagcgcaaaagatg

SEQ ID NO: 79720 - DNA, 103 bp, Artificial Sequence
  Synthetic Polynucleotide
taatacgactcactataggggtggtaacattcgtgatggtgtcccatggtaacagaggagaaccatgatgcaccatcacaacctggcggcagcgcaaaagatg

SEQ ID NO: 79721 - DNA, 103 bp, Artificial Sequence
  Synthetic Polynucleotide
taatacgactcactatagggccatggtggtaacattcgtgatggtgtcccaacagaggagagggacaatgtcacgaatgaacctggcggcagcgcaaaagatg

SEQ ID NO: 79722 - DNA, 103 bp, Artificial Sequence
  Synthetic Polynucleotide
taatacgactcactatagggcatggccatggtggtaacattcgtgatggtaacagaggagaaccatcatgaatgttaccaacctggcggcagcgcaaaagatg

SEQ ID NO: 79723 - DNA, 103 bp, Artificial Sequence
  Synthetic Polynucleotide
taatacgactcactatagggtcagtcatggccatggtggtaacattcgtgaacagaggagacacgaaatgtaccaccataacctggcggcagcgcaaaagatg

SEQ ID NO: 79724 - DNA, 103 bp, Artificial Sequence
  Synthetic Polynucleotide
taatacgactcactatagggtccaaccaatgacggctgccaccagggcataacagaggagaatgcccatgtggcagccgaacctggcggcagcgcaaaagatg

SEQ ID NO: 79725 - DNA, 103 bp, Artificial Sequence
  Synthetic Polynucleotide
taatacgactcactatagggtagtgtcagtcatggccatggtggtaacataacagaggagaatgttaatgccatggccaaacctggcggcagcgcaaaagatg

SEQ ID NO: 79726 - DNA, 103 bp, Artificial Sequence
  Synthetic Polynucleotide
taatacgactcactataggggggagtagtgtcagtcatggccatggtggtaacagaggagaaccaccatggccatgactaacctggcggcagcgcaaaagatg

SEQ ID NO: 79727 - DNA, 103 bp, Artificial Sequence
  Synthetic Polynucleotide
taatacgactcactatagggccgaagggagtagtgtcagtcatggccatgaacagaggagacatggcatggactgacacaacctggcggcagcgcaaaagatg

SEQ ID NO: 79728 - DNA, 103 bp, Artificial Sequence
  Synthetic Polynucleotide
taatacgactcactataggggctgcccgaagggagtagtgtcagtcatggaacagaggagaccatgaatgacactactcaacctggcggcagcgcaaaagatg

SEQ ID NO: 79729 - DNA, 103 bp, Artificial Sequence
  Synthetic Polynucleotide
taatacgactcactatagggtcgctgctgcccgaagggagtagtgtcagtaacagaggagaactgacatgactcccttcaacctggcggcagcgcaaaagatg

SEQ ID NO: 79730 - DNA, 103 bp, Artificial Sequence
  Synthetic Polynucleotide
taatacgactcactatagggaacactcgctgctgcccgaagggagtagtgaacagaggagacactacatgcttcgggcaaacctggcggcagcgcaaaagatg

SEQ ID NO: 79731 - DNA, 103 bp, Artificial Sequence
  Synthetic Polynucleotide
taatacgactcactatagggctttgaacactcgctgctgcccgaagggagaacagaggagactccctatgggcagcagcaacctggcggcagcgcaaaagatg

SEQ ID NO: 79732 - DNA, 103 bp, Artificial Sequence
  Synthetic Polynucleotide
taatacgactcactatagggcttctctttgaacactcgctgctgcccgaaaacagaggagattcgggatgcagcgagtgaacctggcggcagcgcaaaagatg

SEQ ID NO: 79733 - DNA, 103 bp, Artificial Sequence
  Synthetic Polynucleotide
taatacgactcactatagggtccaccttctctttgaacactcgctgctgcaacagaggagagcagcaatgagtgttcaaaacctggcggcagcgcaaaagatg

SEQ ID NO: 79734 - DNA, 103 bp, Artificial Sequence
  Synthetic Polynucleotide
taatacgactcactatagggtcgtgtccaccttctctttgaacactcgctaacagaggagaagcgagatgtcaaagagaaacctggcggcagcgcaaaagatg

SEQ ID NO: 79735 - DNA, 103 bp, Artificial Sequence
  Synthetic Polynucleotide
taatacgactcactatagggaagcatccaaccaatgacggctgccaccagaacagaggagactggtgatggccgtcattaacctggcggcagcgcaaaagatg

SEQ ID NO: 79736 - DNA, 103 bp, Artificial Sequence
  Synthetic Polynucleotide
taatacgactcactatagggagctttcgtgtccaccttctctttgaacacaacagaggagagtgttcatggagaaggtgaacctggcggcagcgcaaaagatg

SEQ ID NO: 79737 - DNA, 103 bp, Artificial Sequence
  Synthetic Polynucleotide
taatacgactcactatagggtcaggagctttcgtgtccaccttctctttgaacagaggagacaaagaatgggtggacacaacctggcggcagcgcaaaagatg

SEQ ID NO: 79738 - DNA, 103 bp, Artificial Sequence
  Synthetic Polynucleotide
taatacgactcactataggggcggttcaggagctttcgtgtccaccttctaacagaggagaagaaggatgacacgaaagaacctggcggcagcgcaaaagatg

SEQ ID NO: 79739 - DNA, 103 bp, Artificial Sequence
  Synthetic Polynucleotide
taatacgactcactatagggttctggcggttcaggagctttcgtgtccacaacagaggagagtggacatgaaagctcctaacctggcggcagcgcaaaagatg

SEQ ID NO: 79740 - DNA, 103 bp, Artificial Sequence
  Synthetic Polynucleotide
taatacgactcactatagggactccttctggcggttcaggagctttcgtgaacagaggagacacgaaatgtcctgaaccaacctggcggcagcgcaaaagatg

SEQ ID NO: 79741 - DNA, 103 bp, Artificial Sequence
  Synthetic Polynucleotide
taatacgactcactatagggacttcactccttctggcggttcaggagcttaacagaggagaaagctcatgaaccgccagaacctggcggcagcgcaaaagatg

SEQ ID NO: 79742 - DNA, 103 bp, Artificial Sequence
  Synthetic Polynucleotide
taatacgactcactatagggcacgtacttcactccttctggcggttcaggaacagaggagacctgaaatgccagaaggaaacctggcggcagcgcaaaagatg

SEQ ID NO: 79743 - DNA, 103 bp, Artificial Sequence
  Synthetic Polynucleotide
taatacgactcactatagggttgagcacgtacttcactccttctggcggtaacagaggagaaccgccatgaggagtgaaaacctggcggcagcgcaaaagatg

SEQ ID NO: 79744 - DNA, 103 bp, Artificial Sequence
  Synthetic Polynucleotide
taatacgactcactatagggtctcgttgagcacgtacttcactccttctgaacagaggagacagaagatgtgaagtacgaacctggcggcagcgcaaaagatg

SEQ ID NO: 79745 - DNA, 103 bp, Artificial Sequence
  Synthetic Polynucleotide
taatacgactcactatagggggtggtctcgttgagcacgtacttcactccaacagaggagaggagtgatgtacgtgctcaacctggcggcagcgcaaaagatg

SEQ ID NO: 79746 - DNA, 103 bp, Artificial Sequence
  Synthetic Polynucleotide
taatacgactcactatagggctcccaagcatccaaccaatgacggctgccaacagaggagaggcagcatgcattggttgaacctggcggcagcgcaaaagatg

SEQ ID NO: 79747 - DNA, 103 bp, Artificial Sequence
  Synthetic Polynucleotide
taatacgactcactatagggcagttggtggtctcgttgagcacgtacttcaacagaggagagaagtaatggctcaacgaaacctggcggcagcgcaaaagatg

SEQ ID NO: 79748 - DNA, 103 bp, Artificial Sequence
  Synthetic Polynucleotide
taatacgactcactatagggacaaccagttggtggtctcgttgagcacgtaacagaggagaacgtgcatgacgagaccaaacctggcggcagcgcaaaagatg

SEQ ID NO: 79749 - DNA, 103 bp, Artificial Sequence
  Synthetic Polynucleotide
taatacgactcactatagggcgcccacaaccagttggtggtctcgttgagaacagaggagactcaacatgaccaccaacaacctggcggcagcgcaaaagatg

SEQ ID NO: 79750 - DNA, 103 bp, Artificial Sequence
  Synthetic Polynucleotide
taatacgactcactatagggaaaaacgcccacaaccagttggtggtctcgaacagaggagacgagacatgcaactggttaacctggcggcagcgcaaaagatg

SEQ ID NO: 79751 - DNA, 103 bp, Artificial Sequence
  Synthetic Polynucleotide
taatacgactcactatagggtggccaaaaacgcccacaaccagttggtggaacagaggagaccaccaatgggttgtgggaacctggcggcagcgcaaaagatg

SEQ ID NO: 79752 - DNA, 103 bp, Artificial Sequence
  Synthetic Polynucleotide
taatacgactcactatagggttctctggccaaaaacgcccacaaccagttaacagaggagaaactggatgtgggcgtttaacctggcggcagcgcaaaagatg

SEQ ID NO: 79753 - DNA, 103 bp, Artificial Sequence
  Synthetic Polynucleotide
taatacgactcactatagggcgtttttctctggccaaaaacgcccacaacaacagaggagagttgtgatggtttttggcaacctggcggcagcgcaaaagatg

SEQ ID NO: 79754 - DNA, 103 bp, Artificial Sequence
  Synthetic Polynucleotide
taatacgactcactatagggtgggacgtttttctctggccaaaaacgcccaacagaggagagggcgtatgtggccagagaacctggcggcagcgcaaaagatg

SEQ ID NO: 79755 - DNA, 103 bp, Artificial Sequence
  Synthetic Polynucleotide
taatacgactcactatagggcattctgggacgtttttctctggccaaaaaaacagaggagatttttgatgagagaaaaaaacctggcggcagcgcaaaagatg

SEQ ID NO: 79756 - DNA, 103 bp, Artificial Sequence
  Synthetic Polynucleotide
taatacgactcactataggggagcacattctgggacgtttttctctggccaacagaggagaggccagatgaaaacgtccaacctggcggcagcgcaaaagatg

SEQ ID NO: 79757 - DNA, 103 bp, Artificial Sequence
  Synthetic Polynucleotide
taatacgactcactatagggtgttgctcccaagcatccaaccaatgacggaacagaggagaccgtcaatggttggatgcaacctggcggcagcgcaaaagatg

SEQ ID NO: 79758 - DNA, 103 bp, Artificial Sequence
  Synthetic Polynucleotide
taatacgactcactatagggctcgagagcacattctgggacgtttttctcaacagaggagagagaaaatggtcccagaaaacctggcggcagcgcaaaagatg

SEQ ID NO: 79759 - DNA, 103 bp, Artificial Sequence
  Synthetic Polynucleotide
taatacgactcactatagggttcctctcgagagcacattctgggacgtttaacagaggagaaaacgtatgagaatgtgcaacctggcggcagcgcaaaagatg

SEQ ID NO: 79760 - DNA, 103 bp, Artificial Sequence
  Synthetic Polynucleotide
taatacgactcactatagggatgaattcctctcgagagcacattctgggaaacagaggagatcccagatggtgctctcgaacctggcggcagcgcaaaagatg

SEQ ID NO: 79761 - DNA, 103 bp, Artificial Sequence
  Synthetic Polynucleotide
taatacgactcactatagggttcttatgaattcctctcgagagcacattcaacagaggagagaatgtatgctcgagaggaacctggcggcagcgcaaaagatg

SEQ ID NO: 79762 - DNA, 103 bp, Artificial Sequence
  Synthetic Polynucleotide
taatacgactcactataggggacctttcttatgaattcctctcgagagcaaacagaggagatgctctatggaggaattcaacctggcggcagcgcaaaagatg

SEQ ID NO: 79763 - DNA, 103 bp, Artificial Sequence
  Synthetic Polynucleotide
taatacgactcactatagggctgttgacctttcttatgaattcctctcgaaacagaggagatcgagaatgattcataagaacctggcggcagcgcaaaagatg

SEQ ID NO: 79764 - DNA, 103 bp, Artificial Sequence
  Synthetic Polynucleotide
taatacgactcactatagggcattgctgttgacctttcttatgaattcctaacagaggagaaggaatatgtaagaaaggaacctggcggcagcgcaaaagatg

SEQ ID NO: 79765 - DNA, 103 bp, Artificial Sequence
  Synthetic Polynucleotide
taatacgactcactatagggagctgcattgctgttgacctttcttatgaaaacagaggagattcataatgaaggtcaacaacctggcggcagcgcaaaagatg

SEQ ID NO: 79766 - DNA, 103 bp, Artificial Sequence
  Synthetic Polynucleotide
taatacgactcactatagggcccaaagctgcattgctgttgacctttcttaacagaggagaaagaaaatgcaacagcaaaacctggcggcagcgcaaaagatg

SEQ ID NO: 79767 - DNA, 103 bp, Artificial Sequence
  Synthetic Polynucleotide
taatacgactcactatagggtggcacccaaagctgcattgctgttgacctaacagaggagaaggtcaatggcaatgcagaacctggcggcagcgcaaaagatg

SEQ ID NO: 79768 - DNA, 103 bp, Artificial Sequence
  Synthetic Polynucleotide
taatacgactcactatagggcatggtgttgctcccaagcatccaaccaataacagaggagaattggtatgatgcttgggaacctggcggcagcgcaaaagatg

SEQ ID NO: 79769 - DNA, 103 bp, Artificial Sequence
  Synthetic Polynucleotide
taatacgactcactatagggaaacatggcacccaaagctgcattgctgttaacagaggagaaacagcatggcagctttgaacctggcggcagcgcaaaagatg

SEQ ID NO: 79770 - DNA, 103 bp, Artificial Sequence
  Synthetic Polynucleotide
taatacgactcactatagggtcttcaaacatggcacccaaagctgcattgaacagaggagacaatgcatgtttgggtgcaacctggcggcagcgcaaaagatg

SEQ ID NO: 79771 - DNA, 103 bp, Artificial Sequence
  Synthetic Polynucleotide
taatacgactcactatagggtctgctcttcaaacatggcacccaaagctgaacagaggagacagcttatggtgccatgtaacctggcggcagcgcaaaagatg

SEQ ID NO: 79772 - DNA, 103 bp, Artificial Sequence
  Synthetic Polynucleotide
taatacgactcactatagggttgattctgctcttcaaacatggcacccaaaacagaggagattgggtatgatgtttgaaaacctggcggcagcgcaaaagatg

SEQ ID NO: 79773 - DNA, 103 bp, Artificial Sequence
  Synthetic Polynucleotide
taatacgactcactatagggctccattgattctgctcttcaaacatggcaaacagaggagatgccatatgtgaagagcaaacctggcggcagcgcaaaagatg

SEQ ID NO: 79774 - DNA, 103 bp, Artificial Sequence
  Synthetic Polynucleotide
taatacgactcactatagggcgctcctccattgattctgctcttcaaacaaacagaggagatgtttgatgagcagaatcaacctggcggcagcgcaaaagatg

SEQ ID NO: 79775 - DNA, 103 bp, Artificial Sequence
  Synthetic Polynucleotide
taatacgactcactatagggtctggcgctcctccattgattctgctcttcaacagaggagagaagagatgaatcaatggaacctggcggcagcgcaaaagatg

SEQ ID NO: 79776 - DNA, 103 bp, Artificial Sequence
  Synthetic Polynucleotide
taatacgactcactataggggcttctctggcgctcctccattgattctgcaacagaggagagcagaaatgatggaggagaacctggcggcagcgcaaaagatg

SEQ ID NO: 79777 - DNA, 103 bp, Artificial Sequence
  Synthetic Polynucleotide
taatacgactcactatagggcaactgcttctctggcgctcctccattgataacagaggagaatcaatatgggagcgccaaacctggcggcagcgcaaaagatg

SEQ ID NO: 79778 - DNA, 103 bp, Artificial Sequence
  Synthetic Polynucleotide
taatacgactcactatagggatcttcaactgcttctctggcgctcctccaaacagaggagatggaggatggccagagaaaacctggcggcagcgcaaaagatg

SEQ ID NO: 79779 - DNA, 103 bp, Artificial Sequence
  Synthetic Polynucleotide
taatacgactcactatagggctctgcatggtgttgctcccaagcatccaaaacagaggagattggatatgtgggagcaaaacctggcggcagcgcaaaagatg

SEQ ID NO: 79780 - DNA, 103 bp, Artificial Sequence
  Synthetic Polynucleotide
taatacgactcactatagggtttggatcttcaactgcttctctggcgctcaacagaggagagagcgcatgagaagcagtaacctggcggcagcgcaaaagatg

SEQ ID NO: 79781 - DNA, 103 bp, Artificial Sequence
  Synthetic Polynucleotide
taatacgactcactatagggaaaattttggatcttcaactgcttctctggaacagaggagaccagagatgcagttgaagaacctggcggcagcgcaaaagatg

SEQ ID NO: 79782 - DNA, 103 bp, Artificial Sequence
  Synthetic Polynucleotide
taatacgactcactatagggctcccaaaattttggatcttcaactgcttcaacagaggagagaagcaatggaagatccaaacctggcggcagcgcaaaagatg

SEQ ID NO: 79783 - DNA, 103 bp, Artificial Sequence
  Synthetic Polynucleotide
taatacgactcactatagggaccatctcccaaaattttggatcttcaactaacagaggagaagttgaatgtccaaaattaacctggcggcagcgcaaaagatg

SEQ ID NO: 79784 - DNA, 103 bp, Artificial Sequence
  Synthetic Polynucleotide
taatacgactcactatagggcatccaccatctcccaaaattttggatcttaacagaggagaaagatcatgaattttgggaacctggcggcagcgcaaaagatg

SEQ ID NO: 79785 - DNA, 103 bp, Artificial Sequence
  Synthetic Polynucleotide
taatacgactcactatagggctcctcatccaccatctcccaaaattttggaacagaggagaccaaaaatgtgggagatgaacctggcggcagcgcaaaagatg

SEQ ID NO: 79786 - DNA, 103 bp, Artificial Sequence
  Synthetic Polynucleotide
taatacgactcactatagggtcgcgctcctcatccaccatctcccaaaataacagaggagaattttgatggatggtggaaacctggcggcagcgcaaaagatg

SEQ ID NO: 79787 - DNA, 103 bp, Artificial Sequence
  Synthetic Polynucleotide
taatacgactcactataggggtgcctcgcgctcctcatccaccatctcccaacagaggagagggagaatgtggatgaggaacctggcggcagcgcaaaagatg

SEQ ID NO: 79788 - DNA, 103 bp, Artificial Sequence
  Synthetic Polynucleotide
taatacgactcactatagggcagatgtgcctcgcgctcctcatccaccataacagaggagaatggtgatggaggagcgcaacctggcggcagcgcaaaagatg

SEQ ID NO: 79789 - DNA, 103 bp, Artificial Sequence
  Synthetic Polynucleotide
taatacgactcactatagggccccgcagatgtgcctcgcgctcctcatccaacagaggagaggatgaatggcgcgaggcaacctggcggcagcgcaaaagatg

SEQ ID NO: 79790 - DNA, 103 bp, Artificial Sequence
  Synthetic Polynucleotide
taatacgactcactatagggctcctggtttcttagacatcgagatcttcgaacagaggagacgaagaatgcgatgtctaaacctggcggcagcgcaaaagatg

SEQ ID NO: 79791 - DNA, 103 bp, Artificial Sequence
  Synthetic Polynucleotide
taatacgactcactatagggcaactctctgcatggtgttgctcccaagcaaacagaggagatgcttgatggcaacaccaaacctggcggcagcgcaaaagatg

SEQ ID NO: 79792 - DNA, 103 bp, Artificial Sequence
  Synthetic Polynucleotide
taatacgactcactatagggattccccccgcagatgtgcctcgcgctcctaacagaggagaaggagcatgaggcacatcaacctggcggcagcgcaaaagatg

SEQ ID NO: 79793 - DNA, 103 bp, Artificial Sequence
  Synthetic Polynucleotide
taatacgactcactataggggtgacattccccccgcagatgtgcctcgcgaacagaggagacgcgagatgcatctgcggaacctggcggcagcgcaaaagatg

SEQ ID NO: 79794 - DNA, 103 bp, Artificial Sequence
  Synthetic Polynucleotide
taatacgactcactatagggcaagtgtgacattccccccgcagatgtgccaacagaggagaggcacaatggcggggggaaacctggcggcagcgcaaaagatg

SEQ ID NO: 79795 - DNA, 103 bp, Artificial Sequence
  Synthetic Polynucleotide
taatacgactcactatagggaaatgcaagtgtgacattccccccgcagataacagaggagaatctgcatggggaatgtcaacctggcggcagcgcaaaagatg

SEQ ID NO: 79796 - DNA, 103 bp, Artificial Sequence
  Synthetic Polynucleotide
taatacgactcactataggggttgtaaatgcaagtgtgacattccccccgaacagaggagacgggggatgtgtcacactaacctggcggcagcgcaaaagatg

SEQ ID NO: 79797 - DNA, 103 bp, Artificial Sequence
  Synthetic Polynucleotide
taatacgactcactatagggatcatgttgtaaatgcaagtgtgacattccaacagaggagaggaatgatgcacttgcataacctggcggcagcgcaaaagatg

SEQ ID NO: 79798 - DNA, 103 bp, Artificial Sequence
  Synthetic Polynucleotide
taatacgactcactatagggttcccatcatgttgtaaatgcaagtgtgacaacagaggagagtcacaatggcatttacaaacctggcggcagcgcaaaagatg

SEQ ID NO: 79799 - DNA, 103 bp, Artificial Sequence
  Synthetic Polynucleotide
taatacgactcactatagggtctctttcccatcatgttgtaaatgcaagtaacagaggagaacttgcatgtacaacatgaacctggcggcagcgcaaaagatg

SEQ ID NO: 79800 - DNA, 103 bp, Artificial Sequence
  Synthetic Polynucleotide
taatacgactcactatagggttctctctctttcccatcatgttgtaaatgaacagaggagacatttaatgcatgatgggaacctggcggcagcgcaaaagatg

SEQ ID NO: 79801 - DNA, 103 bp, Artificial Sequence
  Synthetic Polynucleotide
taatacgactcactataggggttttttctctctctttcccatcatgttgtaacagaggagaacaacaatgtgggaaagaaacctggcggcagcgcaaaagatg

SEQ ID NO: 79802 - DNA, 103 bp, Artificial Sequence
  Synthetic Polynucleotide
taatacgactcactatagggaaacacaactctctgcatggtgttgctcccaacagaggagagggagcatgaccatgcagaacctggcggcagcgcaaaagatg

SEQ ID NO: 79803 - DNA, 103 bp, Artificial Sequence
  Synthetic Polynucleotide
taatacgactcactatagggtccgggttttttctctctctttcccatcataacagaggagaatgatgatgaagagagagaacctggcggcagcgcaaaagatg

SEQ ID NO: 79804 - DNA, 103 bp, Artificial Sequence
  Synthetic Polynucleotide
taatacgactcactatagggaactctccgggttttttctctctctttcccaacagaggagagggaaaatgagagaaaaaaacctggcggcagcgcaaaagatg

SEQ ID NO: 79805 - DNA, 103 bp, Artificial Sequence
  Synthetic Polynucleotide
taatacgactcactatagggttccgaactctccgggttttttctctctctaacagaggagaagagagatgaaaaacccgaacctggcggcagcgcaaaagatg

SEQ ID NO: 79806 - DNA, 103 bp, Artificial Sequence
  Synthetic Polynucleotide
taatacgactcactatagggggcctttccgaactctccgggttttttctcaacagaggagagagaaaatgcccggagagaacctggcggcagcgcaaaagatg

SEQ ID NO: 79807 - DNA, 103 bp, Artificial Sequence
  Synthetic Polynucleotide
taatacgactcactatagggcccttggcctttccgaactctccgggttttaacagaggagaaaaaccatgagagttcggaacctggcggcagcgcaaaagatg

SEQ ID NO: 79808 - DNA, 103 bp, Artificial Sequence
  Synthetic Polynucleotide
taatacgactcactatagggtgcttcccttggcctttccgaactctccggaacagaggagaccggagatgtcggaaaggaacctggcggcagcgcaaaagatg

SEQ ID NO: 79809 - DNA, 103 bp, Artificial Sequence
  Synthetic Polynucleotide
taatacgactcactatagggggctctgcttcccttggcctttccgaactcaacagaggagagagttcatgaaggccaagaacctggcggcagcgcaaaagatg

SEQ ID NO: 79810 - DNA, 103 bp, Artificial Sequence
  Synthetic Polynucleotide
taatacgactcactatagggcaaatggctctgcttcccttggcctttccgaacagaggagacggaaaatgcaagggaagaacctggcggcagcgcaaaagatg

SEQ ID NO: 79811 - DNA, 103 bp, Artificial Sequence
  Synthetic Polynucleotide
taatacgactcactatagggtgaaccaaatggctctgcttcccttggcctaacagaggagaaggccaatggaagcagagaacctggcggcagcgcaaaagatg

SEQ ID NO: 79812 - DNA, 103 bp, Artificial Sequence
  Synthetic Polynucleotide
taatacgactcactatagggccacatgaaccaaatggctctgcttcccttaacagaggagaaagggaatgagagccattaacctggcggcagcgcaaaagatg

SEQ ID NO: 79813 - DNA, 103 bp, Artificial Sequence
  Synthetic Polynucleotide
taatacgactcactatagggacgacaaacacaactctctgcatggtgttgaacagaggagacaacacatggcagagagtaacctggcggcagcgcaaaagatg

SEQ ID NO: 79814 - DNA, 103 bp, Artificial Sequence
  Synthetic Polynucleotide
taatacgactcactatagggccgagccacatgaaccaaatggctctgcttaacagaggagaaagcagatgcatttggttaacctggcggcagcgcaaaagatg

SEQ ID NO: 79815 - DNA, 103 bp, Artificial Sequence
  Synthetic Polynucleotide
taatacgactcactataggggagctccgagccacatgaaccaaatggctcaacagaggagagagccaatgggttcatgtaacctggcggcagcgcaaaagatg

SEQ ID NO: 79816 - DNA, 103 bp, Artificial Sequence
  Synthetic Polynucleotide
taatacgactcactatagggaaagcgagctccgagccacatgaaccaaataacagaggagaatttggatgatgtggctcaacctggcggcagcgcaaaagatg

SEQ ID NO: 79817 - DNA, 103 bp, Artificial Sequence
  Synthetic Polynucleotide
taatacgactcactatagggtccagaaagcgagctccgagccacatgaacaacagaggagagttcatatggctcggagcaacctggcggcagcgcaaaagatg

SEQ ID NO: 79818 - DNA, 103 bp, Artificial Sequence
  Synthetic Polynucleotide
taatacgactcactatagggcgaactccagaaagcgagctccgagccacaaacagaggagatgtggcatggagctcgctaacctggcggcagcgcaaaagatg

SEQ ID NO: 79819 - DNA, 103 bp, Artificial Sequence
  Synthetic Polynucleotide
taatacgactcactatagggagcctcgaactccagaaagcgagctccgagaacagaggagactcggaatgcgctttctgaacctggcggcagcgcaaaagatg

SEQ ID NO: 79820 - DNA, 103 bp, Artificial Sequence
  Synthetic Polynucleotide
taatacgactcactatagggcccagagcctcgaactccagaaagcgagctaacagaggagaagctcgatgtctggagttaacctggcggcagcgcaaaagatg

SEQ ID NO: 79821 - DNA, 103 bp, Artificial Sequence
  Synthetic Polynucleotide
taatacgactcactataggggaaaacccagagcctcgaactccagaaagcaacagaggagagctttcatgagttcgaggaacctggcggcagcgcaaaagatg

SEQ ID NO: 79822 - DNA, 103 bp, Artificial Sequence
  Synthetic Polynucleotide
taatacgactcactatagggattgagaaaacccagagcctcgaactccagaacagaggagactggagatggaggctctgaacctggcggcagcgcaaaagatg

SEQ ID NO: 79823 - DNA, 103 bp, Artificial Sequence
  Synthetic Polynucleotide
taatacgactcactatagggtcttcattgagaaaacccagagcctcgaacaacagaggagagttcgaatgtctgggtttaacctggcggcagcgcaaaagatg

SEQ ID NO: 79824 - DNA, 103 bp, Artificial Sequence
  Synthetic Polynucleotide
taatacgactcactatagggatagcacgacaaacacaactctctgcatggaacagaggagaccatgcatggagttgtgtaacctggcggcagcgcaaaagatg

SEQ ID NO: 79825 - DNA, 103 bp, Artificial Sequence
  Synthetic Polynucleotide
taatacgactcactatagggagtggtcttcattgagaaaacccagagcctaacagaggagaaggctcatggttttctcaaacctggcggcagcgcaaaagatg

SEQ ID NO: 79826 - DNA, 103 bp, Artificial Sequence
  Synthetic Polynucleotide
taatacgactcactatagggaagccagtggtcttcattgagaaaacccagaacagaggagactgggtatgctcaatgaaaacctggcggcagcgcaaaagatg

SEQ ID NO: 79827 - DNA, 103 bp, Artificial Sequence
  Synthetic Polynucleotide
taatacgactcactatagggcttccaagccagtggtcttcattgagaaaaaacagaggagattttctatgtgaagaccaaacctggcggcagcgcaaaagatg

SEQ ID NO: 79828 - DNA, 103 bp, Artificial Sequence
  Synthetic Polynucleotide
taatacgactcactatagggtctttcttccaagccagtggtcttcattgaaacagaggagatcaatgatgaccactggcaacctggcggcagcgcaaaagatg

SEQ ID NO: 79829 - DNA, 103 bp, Artificial Sequence
  Synthetic Polynucleotide
taatacgactcactatagggtgagttctttcttccaagccagtggtcttcaacagaggagagaagacatgtggcttggaaacctggcggcagcgcaaaagatg

SEQ ID NO: 79830 - DNA, 103 bp, Artificial Sequence
  Synthetic Polynucleotide
taatacgactcactatagggcctcctgagttctttcttccaagccagtggaacagaggagaccactgatgtggaagaaaaacctggcggcagcgcaaaagatg

SEQ ID NO: 79831 - DNA, 103 bp, Artificial Sequence
  Synthetic Polynucleotide
taatacgactcactatagggcacctcctcctgagttctttcttccaagccaacagaggagaggcttgatggaaagaactaacctggcggcagcgcaaaagatg

SEQ ID NO: 79832 - DNA, 103 bp, Artificial Sequence
  Synthetic Polynucleotide
taatacgactcactatagggctcgacacctcctcctgagttctttcttccaacagaggagaggaagaatgaactcaggaaacctggcggcagcgcaaaagatg

SEQ ID NO: 79833 - DNA, 103 bp, Artificial Sequence
  Synthetic Polynucleotide
taatacgactcactatagggaagccctcgacacctcctcctgagttctttaacagaggagaaaagaaatgaggaggaggaacctggcggcagcgcaaaagatg

SEQ ID NO: 79834 - DNA, 103 bp, Artificial Sequence
  Synthetic Polynucleotide
taatacgactcactatagggggcccaagccctcgacacctcctcctgagtaacagaggagaactcagatggaggtgtcgaacctggcggcagcgcaaaagatg

SEQ ID NO: 79835 - DNA, 103 bp, Artificial Sequence
  Synthetic Polynucleotide
taatacgactcactatagggaagcaatagcacgacaaacacaactctctgaacagaggagacagagaatggtgtttgtcaacctggcggcagcgcaaaagatg

SEQ ID NO: 79836 - DNA, 103 bp, Artificial Sequence
  Synthetic Polynucleotide
taatacgactcactatagggttggaggcccaagccctcgacacctcctccaacagaggagaggaggaatggtcgagggcaacctggcggcagcgcaaaagatg

SEQ ID NO: 79837 - DNA, 103 bp, Artificial Sequence
  Synthetic Polynucleotide
taatacgactcactatagggagtttttggaggcccaagccctcgacacctaacagaggagaaggtgtatggggcttgggaacctggcggcagcgcaaaagatg

SEQ ID NO: 79838 - DNA, 103 bp, Artificial Sequence
  Synthetic Polynucleotide
taatacgactcactatagggaacccagtttttggaggcccaagccctcgaaacagaggagatcgaggatgtgggcctccaacctggcggcagcgcaaaagatg

SEQ ID NO: 79839 - DNA, 103 bp, Artificial Sequence
  Synthetic Polynucleotide
taatacgactcactataggggatgtaacccagtttttggaggcccaagccaacagaggagaggcttgatgctccaaaaaaacctggcggcagcgcaaaagatg

SEQ ID NO: 79840 - DNA, 103 bp, Artificial Sequence
  Synthetic Polynucleotide
taatacgactcactatagggcgcaggatgtaacccagtttttggaggcccaacagaggagagggcctatgaaaactgggaacctggcggcagcgcaaaagatg

SEQ ID NO: 79841 - DNA, 103 bp, Artificial Sequence
  Synthetic Polynucleotide
taatacgactcactatagggcttcacgcaggatgtaacccagtttttggaaacagaggagatccaaaatgtgggttacaaacctggcggcagcgcaaaagatg

SEQ ID NO: 79842 - DNA, 103 bp, Artificial Sequence
  Synthetic Polynucleotide
taatacgactcactataggggccaacttcacgcaggatgtaacccagtttaacagaggagaaaactgatgtacatcctgaacctggcggcagcgcaaaagatg

SEQ ID NO: 79843 - DNA, 103 bp, Artificial Sequence
  Synthetic Polynucleotide
taatacgactcactatagggcgggtgccaacttcacgcaggatgtaacccaacagaggagagggttaatgcctgcgtgaaacctggcggcagcgcaaaagatg

SEQ ID NO: 79844 - DNA, 103 bp, Artificial Sequence
  Synthetic Polynucleotide
taatacgactcactatagggcaggccgggtgccaacttcacgcaggatgtaacagaggagaacatccatggtgaagttgaacctggcggcagcgcaaaagatg

SEQ ID NO: 79845 - DNA, 103 bp, Artificial Sequence
  Synthetic Polynucleotide
taatacgactcactataggggcccccaggccgggtgccaacttcacgcagaacagaggagactgcgtatggttggcaccaacctggcggcagcgcaaaagatg

SEQ ID NO: 79846 - DNA, 103 bp, Artificial Sequence
  Synthetic Polynucleotide
taatacgactcactatagggaccaaaagcaatagcacgacaaacacaactaacagaggagaagttgtatgtgtcgtgctaacctggcggcagcgcaaaagatg

SEQ ID NO: 79847 - DNA, 103 bp, Artificial Sequence
  Synthetic Polynucleotide
taatacgactcactatagggatcttgcccccaggccgggtgccaacttcaaacagaggagatgaagtatgcacccggccaacctggcggcagcgcaaaagatg

SEQ ID NO: 79848 - DNA, 103 bp, Artificial Sequence
  Synthetic Polynucleotide
taatacgactcactatagggcatagatcttgcccccaggccgggtgccaaaacagaggagattggcaatgggcctggggaacctggcggcagcgcaaaagatg

SEQ ID NO: 79849 - DNA, 103 bp, Artificial Sequence
  Synthetic Polynucleotide
taatacgactcactatagggatcagcatagatcttgcccccaggccgggtaacagaggagaacccggatggggggcaagaacctggcggcagcgcaaaagatg

SEQ ID NO: 79850 - DNA, 103 bp, Artificial Sequence
  Synthetic Polynucleotide
taatacgactcactataggggtgtcatcagcatagatcttgcccccaggcaacagaggagagcctggatgcaagatctaaacctggcggcagcgcaaaagatg

SEQ ID NO: 79851 - DNA, 103 bp, Artificial Sequence
  Synthetic Polynucleotide
taatacgactcactatagggcagctgtgtcatcagcatagatcttgccccaacagaggagaggggcaatgtctatgctgaacctggcggcagcgcaaaagatg

SEQ ID NO: 79852 - DNA, 103 bp, Artificial Sequence
  Synthetic Polynucleotide
taatacgactcactatagggccagccagctgtgtcatcagcatagatcttaacagaggagaaagatcatggctgatgacaacctggcggcagcgcaaaagatg

SEQ ID NO: 79853 - DNA, 103 bp, Artificial Sequence
  Synthetic Polynucleotide
taatacgactcactataggggtgtcccagccagctgtgtcatcagcatagaacagaggagactatgcatgtgacacagcaacctggcggcagcgcaaaagatg

SEQ ID NO: 79854 - DNA, 103 bp, Artificial Sequence
  Synthetic Polynucleotide
taatacgactcactatagggtgcgggtgtcccagccagctgtgtcatcagaacagaggagactgatgatgcagctggctaacctggcggcagcgcaaaagatg

SEQ ID NO: 79855 - DNA, 103 bp, Artificial Sequence
  Synthetic Polynucleotide
taatacgactcactatagggcgtgatgcgggtgtcccagccagctgtgtcaacagaggagagacacaatgggctgggacaacctggcggcagcgcaaaagatg

SEQ ID NO: 79856 - DNA, 103 bp, Artificial Sequence
  Synthetic Polynucleotide
taatacgactcactataggggctctcgtgatgcgggtgtcccagccagctaacagaggagaagctggatgggacacccgaacctggcggcagcgcaaaagatg

SEQ ID NO: 79857 - DNA, 103 bp, Artificial Sequence
  Synthetic Polynucleotide
taatacgactcactataggggggccaccaaaagcaatagcacgacaaacaaacagaggagatgtttgatgtgctattgcaacctggcggcagcgcaaaagatg

SEQ ID NO: 79858 - DNA, 103 bp, Artificial Sequence
  Synthetic Polynucleotide
taatacgactcactatagggagtcagctctcgtgatgcgggtgtcccagcaacagaggagagctgggatgcccgcatcaaacctggcggcagcgcaaaagatg

SEQ ID NO: 79859 - DNA, 103 bp, Artificial Sequence
  Synthetic Polynucleotide
taatacgactcactatagggttccaagtcagctctcgtgatgcgggtgtcaacagaggagagacaccatgatcacgagaaacctggcggcagcgcaaaagatg

SEQ ID NO: 79860 - DNA, 103 bp, Artificial Sequence
  Synthetic Polynucleotide
taatacgactcactatagggtcattttccaagtcagctctcgtgatgcggaacagaggagaccgcatatggagagctgaaacctggcggcagcgcaaaagatg

SEQ ID NO: 79861 - DNA, 103 bp, Artificial Sequence
  Synthetic Polynucleotide
taatacgactcactatagggtagcttcattttccaagtcagctctcgtgaaacagaggagatcacgaatgctgacttggaacctggcggcagcgcaaaagatg

SEQ ID NO: 79862 - DNA, 103 bp, Artificial Sequence
  Synthetic Polynucleotide
taatacgactcactatagggcaccttagcttcattttccaagtcagctctaacagaggagaagagctatgttggaaaataacctggcggcagcgcaaaagatg

SEQ ID NO: 79863 - DNA, 103 bp, Artificial Sequence
  Synthetic Polynucleotide
taatacgactcactatagggtcaagcaccttagcttcattttccaagtcaaacagaggagatgacttatgaaatgaagcaacctggcggcagcgcaaaagatg

SEQ ID NO: 79864 - DNA, 103 bp, Artificial Sequence
  Synthetic Polynucleotide
taatacgactcactataggggcagctcaagcaccttagcttcattttccaaacagaggagatggaaaatgaagctaaggaacctggcggcagcgcaaaagatg

SEQ ID NO: 79865 - DNA, 103 bp, Artificial Sequence
  Synthetic Polynucleotide
taatacgactcactatagggatcaagcagctcaagcaccttagcttcattaacagaggagaaatgaaatgaaggtgcttaacctggcggcagcgcaaaagatg

SEQ ID NO: 79866 - DNA, 103 bp, Artificial Sequence
  Synthetic Polynucleotide
taatacgactcactatagggtccccatcaagcagctcaagcaccttagctaacagaggagaagctaaatggcttgagctaacctggcggcagcgcaaaagatg

SEQ ID NO: 79867 - DNA, 103 bp, Artificial Sequence
  Synthetic Polynucleotide
taatacgactcactataggggatgttccccatcaagcagctcaagcacctaacagaggagaaggtgcatgagctgcttgaacctggcggcagcgcaaaagatg

SEQ ID NO: 79868 - DNA, 103 bp, Artificial Sequence
  Synthetic Polynucleotide
taatacgactcactatagggagctggggccaccaaaagcaatagcacgacaacagaggagagtcgtgatgttgcttttgaacctggcggcagcgcaaaagatg

SEQ ID NO: 79869 - DNA, 103 bp, Artificial Sequence
  Synthetic Polynucleotide
taatacgactcactatagggacgccgatgttccccatcaagcagctcaagaacagaggagacttgagatgcttgatgggaacctggcggcagcgcaaaagatg

SEQ ID NO: 79870 - DNA, 103 bp, Artificial Sequence
  Synthetic Polynucleotide
taatacgactcactataggggcaagacgccgatgttccccatcaagcagcaacagaggagagctgctatgtggggaacaaacctggcggcagcgcaaaagatg

SEQ ID NO: 79871 - DNA, 103 bp, Artificial Sequence
  Synthetic Polynucleotide
taatacgactcactatagggccctggcaagacgccgatgttccccatcaaaacagaggagattgatgatgaacatcggcaacctggcggcagcgcaaaagatg

SEQ ID NO: 79872 - DNA, 103 bp, Artificial Sequence
  Synthetic Polynucleotide
taatacgactcactataggggatggccctggcaagacgccgatgttccccaacagaggagaggggaaatgcggcgtcttaacctggcggcagcgcaaaagatg

SEQ ID NO: 79873 - DNA, 103 bp, Artificial Sequence
  Synthetic Polynucleotide
taatacgactcactatagggtcaatgatggccctggcaagacgccgatgtaacagaggagaacatcgatgtcttgccagaacctggcggcagcgcaaaagatg

SEQ ID NO: 79874 - DNA, 103 bp, Artificial Sequence
  Synthetic Polynucleotide
taatacgactcactatagggtgagctcaatgatggccctggcaagacgccaacagaggagaggcgtcatgccagggccaaacctggcggcagcgcaaaagatg

SEQ ID NO: 79875 - DNA, 103 bp, Artificial Sequence
  Synthetic Polynucleotide
taatacgactcactatagggataggtgagctcaatgatggccctggcaagaacagaggagacttgccatggccatcattaacctggcggcagcgcaaaagatg

SEQ ID NO: 79876 - DNA, 103 bp, Artificial Sequence
  Synthetic Polynucleotide
taatacgactcactatagggtgacgataggtgagctcaatgatggccctgaacagaggagacagggcatgcattgagctaacctggcggcagcgcaaaagatg

SEQ ID NO: 79877 - DNA, 103 bp, Artificial Sequence
  Synthetic Polynucleotide
taatacgactcactatagggctttgtgacgataggtgagctcaatgatggaacagaggagaccatcaatgagctcacctaacctggcggcagcgcaaaagatg

SEQ ID NO: 79878 - DNA, 103 bp, Artificial Sequence
  Synthetic Polynucleotide
taatacgactcactatagggcacaactttgtgacgataggtgagctcaataacagaggagaattgagatgacctatcgtaacctggcggcagcgcaaaagatg

SEQ ID NO: 79879 - DNA, 103 bp, Artificial Sequence
  Synthetic Polynucleotide
taatacgactcactatagggctgtaagctggggccaccaaaagcaatagcaacagaggagagctattatgtttggtggcaacctggcggcagcgcaaaagatg

SEQ ID NO: 79880 - DNA, 103 bp, Artificial Sequence
  Synthetic Polynucleotide
taatacgactcactatagggactttcacaactttgtgacgataggtgagcaacagaggagagctcacatgtcgtcacaaaacctggcggcagcgcaaaagatg

SEQ ID NO: 79881 - DNA, 103 bp, Artificial Sequence
  Synthetic Polynucleotide
taatacgactcactataggggcatcactttcacaactttgtgacgataggaacagaggagacctatcatgacaaagttgaacctggcggcagcgcaaaagatg

SEQ ID NO: 79882 - DNA, 103 bp, Artificial Sequence
  Synthetic Polynucleotide
taatacgactcactatagggcgggcgcatcactttcacaactttgtgacgaacagaggagacgtcacatggttgtgaaaaacctggcggcagcgcaaaagatg

SEQ ID NO: 79883 - DNA, 103 bp, Artificial Sequence
  Synthetic Polynucleotide
taatacgactcactataggggcagccgggcgcatcactttcacaactttgaacagaggagacaaagtatggaaagtgataacctggcggcagcgcaaaagatg

SEQ ID NO: 79884 - DNA, 103 bp, Artificial Sequence
  Synthetic Polynucleotide
taatacgactcactatagggcatcagcagccgggcgcatcactttcacaaaacagaggagattgtgaatgtgatgcgccaacctggcggcagcgcaaaagatg

SEQ ID NO: 79885 - DNA, 103 bp, Artificial Sequence
  Synthetic Polynucleotide
taatacgactcactatagggtcttccatcagcagccgggcgcatcactttaacagaggagaaaagtgatgcgcccggctaacctggcggcagcgcaaaagatg

SEQ ID NO: 79886 - DNA, 103 bp, Artificial Sequence
  Synthetic Polynucleotide
taatacgactcactatagggacggttcttccatcagcagccgggcgcatcaacagaggagagatgcgatgggctgctgaaacctggcggcagcgcaaaagatg

SEQ ID NO: 79887 - DNA, 103 bp, Artificial Sequence
  Synthetic Polynucleotide
taatacgactcactatagggccatgacggttcttccatcagcagccgggcaacagaggagagcccggatgctgatggaaaacctggcggcagcgcaaaagatg

SEQ ID NO: 79888 - DNA, 103 bp, Artificial Sequence
  Synthetic Polynucleotide
taatacgactcactatagggaacatccatgacggttcttccatcagcagcaacagaggagagctgctatgggaagaaccaacctggcggcagcgcaaaagatg

SEQ ID NO: 79889 - DNA, 103 bp, Artificial Sequence
  Synthetic Polynucleotide
taatacgactcactataggggagataacatccatgacggttcttccatcaaacagaggagatgatggatgaaccgtcataacctggcggcagcgcaaaagatg

SEQ ID NO: 79890 - DNA, 103 bp, Artificial Sequence
  Synthetic Polynucleotide
taatacgactcactatagggtgaagctgtaagctggggccaccaaaagcaaacagaggagatgctttatgtggccccagaacctggcggcagcgcaaaagatg

SEQ ID NO: 79891 - DNA, 103 bp, Artificial Sequence
  Synthetic Polynucleotide
taatacgactcactatagggctctggagataacatccatgacggttcttcaacagaggagagaagaaatgtcatggatgaacctggcggcagcgcaaaagatg

SEQ ID NO: 79892 - DNA, 103 bp, Artificial Sequence
  Synthetic Polynucleotide
taatacgactcactatagggatcttctctggagataacatccatgacggtaacagaggagaaccgtcatggatgttatcaacctggcggcagcgcaaaagatg

SEQ ID NO: 79893 - DNA, 103 bp, Artificial Sequence
  Synthetic Polynucleotide
taatacgactcactatagggctctgatcttctctggagataacatccatgaacagaggagacatggaatgtatctccagaacctggcggcagcgcaaaagatg

SEQ ID NO: 79894 - DNA, 103 bp, Artificial Sequence
  Synthetic Polynucleotide
taatacgactcactatagggtccccctctgatcttctctggagataacataacagaggagaatgttaatgccagagaagaacctggcggcagcgcaaaagatg

SEQ ID NO: 79895 - DNA, 103 bp, Artificial Sequence
  Synthetic Polynucleotide
taatacgactcactatagggtccactccccctctgatcttctctggagataacagaggagaatctccatggaagatcagaacctggcggcagcgcaaaagatg

SEQ ID NO: 79896 - DNA, 103 bp, Artificial Sequence
  Synthetic Polynucleotide
taatacgactcactatagggacttgtccactccccctctgatcttctctgaacagaggagacagagaatgtcagaggggaacctggcggcagcgcaaaagatg

SEQ ID NO: 79897 - DNA, 103 bp, Artificial Sequence
  Synthetic Polynucleotide
taatacgactcactatagggtgacaacttgtccactccccctctgatcttaacagaggagaaagatcatggggggagtgaacctggcggcagcgcaaaagatg

SEQ ID NO: 79898 - DNA, 103 bp, Artificial Sequence
  Synthetic Polynucleotide
taatacgactcactataggggtaggtgacaacttgtccactccccctctgaacagaggagacagaggatgagtggacaaaacctggcggcagcgcaaaagatg

SEQ ID NO: 79899 - DNA, 103 bp, Artificial Sequence
  Synthetic Polynucleotide
taatacgactcactatagggagggcgtaggtgacaacttgtccactccccaacagaggagaggggagatgacaagttgtaacctggcggcagcgcaaaagatg

SEQ ID NO: 79900 - DNA, 103 bp, Artificial Sequence
  Synthetic Polynucleotide
taatacgactcactatagggtgtttagggcgtaggtgacaacttgtccacaacagaggagagtggacatgttgtcacctaacctggcggcagcgcaaaagatg

SEQ ID NO: 79901 - DNA, 103 bp, Artificial Sequence
  Synthetic Polynucleotide
taatacgactcactataggggggccctcctggtttcttagacatcgagataacagaggagaatctcgatgtctaagaaaaacctggcggcagcgcaaaagatg

SEQ ID NO: 79902 - DNA, 103 bp, Artificial Sequence
  Synthetic Polynucleotide
taatacgactcactataggggcagttgaagctgtaagctggggccaccaaaacagaggagattggtgatgccagcttacaacctggcggcagcgcaaaagatg

SEQ ID NO: 79903 - DNA, 103 bp, Artificial Sequence
  Synthetic Polynucleotide
taatacgactcactataggggaaagtgtttagggcgtaggtgacaacttgaacagaggagacaagttatgacctacgccaacctggcggcagcgcaaaagatg

SEQ ID NO: 79904 - DNA, 103 bp, Artificial Sequence
  Synthetic Polynucleotide
taatacgactcactatagggttggtgaaagtgtttagggcgtaggtgacaaacagaggagatgtcacatgcgccctaaaaacctggcggcagcgcaaaagatg

SEQ ID NO: 79905 - DNA, 103 bp, Artificial Sequence
  Synthetic Polynucleotide
taatacgactcactatagggccaggttggtgaaagtgtttagggcgtaggaacagaggagacctacgatgtaaacacttaacctggcggcagcgcaaaagatg

SEQ ID NO: 79906 - DNA, 103 bp, Artificial Sequence
  Synthetic Polynucleotide
taatacgactcactataggggacggccaggttggtgaaagtgtttagggcaacagaggagagccctaatgactttcaccaacctggcggcagcgcaaaagatg

SEQ ID NO: 79907 - DNA, 103 bp, Artificial Sequence
  Synthetic Polynucleotide
taatacgactcactatagggagctggacggccaggttggtgaaagtgtttaacagaggagaaaacacatgcaccaacctaacctggcggcagcgcaaaagatg

SEQ ID NO: 79908 - DNA, 103 bp, Artificial Sequence
  Synthetic Polynucleotide
taatacgactcactatagggtcaccagctggacggccaggttggtgaaagaacagaggagactttcaatgacctggccgaacctggcggcagcgcaaaagatg

SEQ ID NO: 79909 - DNA, 103 bp, Artificial Sequence
  Synthetic Polynucleotide
taatacgactcactatagggcatcctcaccagctggacggccaggttggtaacagaggagaaccaacatggccgtccagaacctggcggcagcgcaaaagatg

SEQ ID NO: 79910 - DNA, 103 bp, Artificial Sequence
  Synthetic Polynucleotide
taatacgactcactatagggtccatcatcctcaccagctggacggccaggaacagaggagacctggcatgccagctggtaacctggcggcagcgcaaaagatg

SEQ ID NO: 79911 - DNA, 103 bp, Artificial Sequence
  Synthetic Polynucleotide
taatacgactcactatagggccccttccatcatcctcaccagctggacggaacagaggagaccgtccatgtggtgaggaaacctggcggcagcgcaaaagatg

SEQ ID NO: 79912 - DNA, 103 bp, Artificial Sequence
  Synthetic Polynucleotide
taatacgactcactatagggtccttccccttccatcatcctcaccagctgaacagaggagacagctgatgaggatgatgaacctggcggcagcgcaaaagatg

SEQ ID NO: 79913 - DNA, 103 bp, Artificial Sequence
  Synthetic Polynucleotide
taatacgactcactatagggccaaggcagttgaagctgtaagctggggccaacagaggagaggccccatgttacagcttaacctggcggcagcgcaaaagatg

SEQ ID NO: 79914 - DNA, 103 bp, Artificial Sequence
  Synthetic Polynucleotide
taatacgactcactatagggatcactccttccccttccatcatcctcaccaacagaggagaggtgagatggatggaaggaacctggcggcagcgcaaaagatg

SEQ ID NO: 79915 - DNA, 103 bp, Artificial Sequence
  Synthetic Polynucleotide
taatacgactcactatagggggccaatcactccttccccttccatcatccaacagaggagaggatgaatgaaggggaagaacctggcggcagcgcaaaagatg

SEQ ID NO: 79916 - DNA, 103 bp, Artificial Sequence
  Synthetic Polynucleotide
taatacgactcactatagggatctgggccaatcactccttccccttccataacagaggagaatggaaatggaaggagtgaacctggcggcagcgcaaaagatg

SEQ ID NO: 79917 - DNA, 103 bp, Artificial Sequence
  Synthetic Polynucleotide
taatacgactcactatagggacatcatctgggccaatcactccttcccctaacagaggagaaggggaatgagtgattggaacctggcggcagcgcaaaagatg

SEQ ID NO: 79918 - DNA, 103 bp, Artificial Sequence
  Synthetic Polynucleotide
taatacgactcactatagggtctccacatcatctgggccaatcactccttaacagaggagaaaggagatgttggcccagaacctggcggcagcgcaaaagatg

SEQ ID NO: 79919 - DNA, 103 bp, Artificial Sequence
  Synthetic Polynucleotide
taatacgactcactataggggagtttctccacatcatctgggccaatcacaacagaggagagtgattatgccagatgataacctggcggcagcgcaaaagatg

SEQ ID NO: 79920 - DNA, 103 bp, Artificial Sequence
  Synthetic Polynucleotide
taatacgactcactatagggtttgtgagtttctccacatcatctgggccaaacagaggagatggcccatgtgatgtggaaacctggcggcagcgcaaaagatg

SEQ ID NO: 79921 - DNA, 103 bp, Artificial Sequence
  Synthetic Polynucleotide
taatacgactcactatagggtcccttttgtgagtttctccacatcatctgaacagaggagacagatgatgtggagaaacaacctggcggcagcgcaaaagatg

SEQ ID NO: 79922 - DNA, 103 bp, Artificial Sequence
  Synthetic Polynucleotide
taatacgactcactatagggtcctttcccttttgtgagtttctccacatcaacagaggagagatgtgatgaaactcacaaacctggcggcagcgcaaaagatg

SEQ ID NO: 79923 - DNA, 103 bp, Artificial Sequence
  Synthetic Polynucleotide
taatacgactcactatagggttgggtcctttcccttttgtgagtttctccaacagaggagaggagaaatgcacaaaaggaacctggcggcagcgcaaaagatg

SEQ ID NO: 79924 - DNA, 103 bp, Artificial Sequence
  Synthetic Polynucleotide
taatacgactcactatagggtcattccaaggcagttgaagctgtaagctgaacagaggagacagcttatggcttcaactaacctggcggcagcgcaaaagatg

SEQ ID NO: 79925 - DNA, 103 bp, Artificial Sequence
  Synthetic Polynucleotide
taatacgactcactatagggtgactttgggtcctttcccttttgtgagttaacagaggagaaactcaatgaagggaaagaacctggcggcagcgcaaaagatg

SEQ ID NO: 79926 - DNA, 103 bp, Artificial Sequence
  Synthetic Polynucleotide
taatacgactcactatagggggtcctgactttgggtcctttcccttttgtaacagaggagaacaaaaatgaaaggacccaacctggcggcagcgcaaaagatg

SEQ ID NO: 79927 - DNA, 103 bp, Artificial Sequence
  Synthetic Polynucleotide
taatacgactcactatagggagccaggtcctgactttgggtcctttccctaacagaggagaagggaaatgacccaaagtaacctggcggcagcgcaaaagatg

SEQ ID NO: 79928 - DNA, 103 bp, Artificial Sequence
  Synthetic Polynucleotide
taatacgactcactatagggcaaacagccaggtcctgactttgggtccttaacagaggagaaaggacatgaagtcaggaaacctggcggcagcgcaaaagatg

SEQ ID NO: 79929 - DNA, 103 bp, Artificial Sequence
  Synthetic Polynucleotide
taatacgactcactatagggattctcaaacagccaggtcctgactttgggaacagaggagacccaaaatgaggacctggaacctggcggcagcgcaaaagatg

SEQ ID NO: 79930 - DNA, 103 bp, Artificial Sequence
  Synthetic Polynucleotide
taatacgactcactatagggtccccattctcaaacagccaggtcctgactaacagaggagaagtcagatgctggctgttaacctggcggcagcgcaaaagatg

SEQ ID NO: 79931 - DNA, 103 bp, Artificial Sequence
  Synthetic Polynucleotide
taatacgactcactatagggtttcttccccattctcaaacagccaggtccaacagaggagaggacctatgtgtttgagaaacctggcggcagcgcaaaagatg

SEQ ID NO: 79932 - DNA, 103 bp, Artificial Sequence
  Synthetic Polynucleotide
taatacgactcactataggggagtctttcttccccattctcaaacagccaaacagaggagatggctgatggagaatgggaacctggcggcagcgcaaaagatg

SEQ ID NO: 79933 - DNA, 103 bp, Artificial Sequence
  Synthetic Polynucleotide
taatacgactcactatagggcggctgagtctttcttccccattctcaaacaacagaggagagtttgaatgtggggaagaaacctggcggcagcgcaaaagatg

SEQ ID NO: 79934 - DNA, 103 bp, Artificial Sequence
  Synthetic Polynucleotide
taatacgactcactatagggccatgcggctgagtctttcttccccattctaacagaggagaagaatgatgaagaaagacaacctggcggcagcgcaaaagatg

SEQ ID NO: 79935 - DNA, 103 bp, Artificial Sequence
  Synthetic Polynucleotide
taatacgactcactataggggttgctcattccaaggcagttgaagctgtaaacagaggagatacagcatgaactgccttaacctggcggcagcgcaaaagatg

SEQ ID NO: 79936 - DNA, 103 bp, Artificial Sequence
  Synthetic Polynucleotide
taatacgactcactataggggacagccatgcggctgagtctttcttccccaacagaggagaggggaaatgagactcagcaacctggcggcagcgcaaaagatg

SEQ ID NO: 79937 - DNA, 103 bp, Artificial Sequence
  Synthetic Polynucleotide
taatacgactcactatagggccactgacagccatgcggctgagtctttctaacagaggagaagaaagatgcagccgcataacctggcggcagcgcaaaagatg

SEQ ID NO: 79938 - DNA, 103 bp, Artificial Sequence
  Synthetic Polynucleotide
taatacgactcactatagggcatctccactgacagccatgcggctgagtcaacagaggagagactcaatggcatggctgaacctggcggcagcgcaaaagatg

SEQ ID NO: 79939 - DNA, 103 bp, Artificial Sequence
  Synthetic Polynucleotide
taatacgactcactatagggacagtcatctccactgacagccatgcggctaacagaggagaagccgcatggctgtcagtaacctggcggcagcgcaaaagatg

SEQ ID NO: 79940 - DNA, 103 bp, Artificial Sequence
  Synthetic Polynucleotide
taatacgactcactatagggaccacacagtcatctccactgacagccatgaacagaggagacatggcatgcagtggagaaacctggcggcagcgcaaaagatg

SEQ ID NO: 79941 - DNA, 103 bp, Artificial Sequence
  Synthetic Polynucleotide
taatacgactcactataggggctttaccacacagtcatctccactgacagaacagaggagactgtcaatggagatgactaacctggcggcagcgcaaaagatg

SEQ ID NO: 79942 - DNA, 103 bp, Artificial Sequence
  Synthetic Polynucleotide
taatacgactcactatagggcaggggctttaccacacagtcatctccactaacagaggagaagtggaatggactgtgtgaacctggcggcagcgcaaaagatg

SEQ ID NO: 79943 - DNA, 103 bp, Artificial Sequence
  Synthetic Polynucleotide
taatacgactcactatagggtcgtccaggggctttaccacacagtcatctaacagaggagaagatgaatgtgtggtaaaaacctggcggcagcgcaaaagatg

SEQ ID NO: 79944 - DNA, 103 bp, Artificial Sequence
  Synthetic Polynucleotide
taatacgactcactatagggagcgatcgtccaggggctttaccacacagtaacagaggagaactgtgatgtaaagccccaacctggcggcagcgcaaaagatg

SEQ ID NO: 79945 - DNA, 103 bp, Artificial Sequence
  Synthetic Polynucleotide
taatacgactcactatagggggcaaagcgatcgtccaggggctttaccacaacagaggagagtggtaatgcccctggacaacctggcggcagcgcaaaagatg

SEQ ID NO: 79946 - DNA, 103 bp, Artificial Sequence
  Synthetic Polynucleotide
taatacgactcactatagggtctctgttgctcattccaaggcagttgaagaacagaggagacttcaaatgccttggaataacctggcggcagcgcaaaagatg

SEQ ID NO: 79947 - DNA, 103 bp, Artificial Sequence
  Synthetic Polynucleotide
taatacgactcactataggggaggtggcaaagcgatcgtccaggggctttaacagaggagaaaagccatgggacgatcgaacctggcggcagcgcaaaagatg

SEQ ID NO: 79948 - DNA, 103 bp, Artificial Sequence
  Synthetic Polynucleotide
taatacgactcactatagggggagcgaggtggcaaagcgatcgtccagggaacagaggagaccctggatgatcgctttgaacctggcggcagcgcaaaagatg

SEQ ID NO: 79949 - DNA, 103 bp, Artificial Sequence
  Synthetic Polynucleotide
taatacgactcactataggggaagtggagcgaggtggcaaagcgatcgtcaacagaggagagacgatatgtttgccaccaacctggcggcagcgcaaaagatg

SEQ ID NO: 79950 - DNA, 103 bp, Artificial Sequence
  Synthetic Polynucleotide
taatacgactcactatagggttgaggaagtggagcgaggtggcaaagcgaaacagaggagatcgcttatgcacctcgctaacctggcggcagcgcaaaagatg

SEQ ID NO: 79951 - DNA, 103 bp, Artificial Sequence
  Synthetic Polynucleotide
taatacgactcactatagggtagcattgaggaagtggagcgaggtggcaaaacagaggagattgccaatgcgctccactaacctggcggcagcgcaaaagatg

SEQ ID NO: 79952 - DNA, 103 bp, Artificial Sequence
  Synthetic Polynucleotide
taatacgactcactatagggtgacatagcattgaggaagtggagcgaggtaacagaggagaacctcgatgcacttcctcaacctggcggcagcgcaaaagatg

SEQ ID NO: 79953 - DNA, 103 bp, Artificial Sequence
  Synthetic Polynucleotide
taatacgactcactatagggacctttgacatagcattgaggaagtggagcaacagaggagagctccaatgcctcaatgcaacctggcggcagcgcaaaagatg

SEQ ID NO: 79954 - DNA, 103 bp, Artificial Sequence
  Synthetic Polynucleotide
taatacgactcactatagggtgcgaacctttgacatagcattgaggaagtaacagaggagaacttccatgatgctatgtaacctggcggcagcgcaaaagatg

SEQ ID NO: 79955 - DNA, 103 bp, Artificial Sequence
  Synthetic Polynucleotide
taatacgactcactataggggtctttgcgaacctttgacatagcattgagaacagaggagactcaatatgatgtcaaagaacctggcggcagcgcaaaagatg

SEQ ID NO: 79956 - DNA, 103 bp, Artificial Sequence
  Synthetic Polynucleotide
taatacgactcactatagggtggatgtctttgcgaacctttgacatagcaaacagaggagatgctatatgaaaggttcgaacctggcggcagcgcaaaagatg

SEQ ID NO: 79957 - DNA, 103 bp, Artificial Sequence
  Synthetic Polynucleotide
taatacgactcactatagggagaagtctctgttgctcattccaaggcagtaacagaggagaactgccatggaatgagcaaacctggcggcagcgcaaaagatg

SEQ ID NO: 79958 - DNA, 103 bp, Artificial Sequence
  Synthetic Polynucleotide
taatacgactcactatagggactcttggatgtctttgcgaacctttgacaaacagaggagatgtcaaatgttcgcaaagaacctggcggcagcgcaaaagatg

SEQ ID NO: 79959 - DNA, 103 bp, Artificial Sequence
  Synthetic Polynucleotide
taatacgactcactatagggtttccactcttggatgtctttgcgaaccttaacagaggagaaaggttatgaaagacatcaacctggcggcagcgcaaaagatg

SEQ ID NO: 79960 - DNA, 103 bp, Artificial Sequence
  Synthetic Polynucleotide
taatacgactcactataggggacggtttccactcttggatgtctttgcgaaacagaggagatcgcaaatgcatccaagaaacctggcggcagcgcaaaagatg

SEQ ID NO: 79961 - DNA, 103 bp, Artificial Sequence
  Synthetic Polynucleotide
taatacgactcactatagggcagttgacggtttccactcttggatgtcttaacagaggagaaagacaatgaagagtggaaacctggcggcagcgcaaaagatg

SEQ ID NO: 79962 - DNA, 103 bp, Artificial Sequence
  Synthetic Polynucleotide
taatacgactcactatagggccatccagttgacggtttccactcttggataacagaggagaatccaaatgtggaaaccgaacctggcggcagcgcaaaagatg

SEQ ID NO: 79963 - DNA, 103 bp, Artificial Sequence
  Synthetic Polynucleotide
taatacgactcactatagggtcataccatccagttgacggtttccactctaacagaggagaagagtgatgaccgtcaacaacctggcggcagcgcaaaagatg

SEQ ID NO: 79964 - DNA, 103 bp, Artificial Sequence
  Synthetic Polynucleotide
taatacgactcactataggggccaatcataccatccagttgacggtttccaacagaggagaggaaacatgcaactggataacctggcggcagcgcaaaagatg

SEQ ID NO: 79965 - DNA, 103 bp, Artificial Sequence
  Synthetic Polynucleotide
taatacgactcactatagggctgctgccaatcataccatccagttgacggaacagaggagaccgtcaatgggatggtataacctggcggcagcgcaaaagatg

SEQ ID NO: 79966 - DNA, 103 bp, Artificial Sequence
  Synthetic Polynucleotide
taatacgactcactatagggggaacctgctgccaatcataccatccagttaacagaggagaaactggatggtatgattgaacctggcggcagcgcaaaagatg

SEQ ID NO: 79967 - DNA, 103 bp, Artificial Sequence
  Synthetic Polynucleotide
taatacgactcactatagggaaaatggaacctgctgccaatcataccatcaacagaggagagatggtatgattggcagcaacctggcggcagcgcaaaagatg

SEQ ID NO: 79968 - DNA, 103 bp, Artificial Sequence
  Synthetic Polynucleotide
taatacgactcactatagggttccaagaagtctctgttgctcattccaagaacagaggagacttggaatgagcaacagaaacctggcggcagcgcaaaagatg

SEQ ID NO: 79969 - DNA, 103 bp, Artificial Sequence
  Synthetic Polynucleotide
taatacgactcactatagggtgagcaaaatggaacctgctgccaatcataaacagaggagatatgatatgcagcaggttaacctggcggcagcgcaaaagatg

SEQ ID NO: 79970 - DNA, 103 bp, Artificial Sequence
  Synthetic Polynucleotide
taatacgactcactatagggtggtttgagcaaaatggaacctgctgccaaaacagaggagattggcaatgggttccattaacctggcggcagcgcaaaagatg

SEQ ID NO: 79971 - DNA, 103 bp, Artificial Sequence
  Synthetic Polynucleotide
taatacgactcactatagggtgaaatggtttgagcaaaatggaacctgctaacagaggagaagcaggatgcattttgctaacctggcggcagcgcaaaagatg

SEQ ID NO: 79972 - DNA, 103 bp, Artificial Sequence
  Synthetic Polynucleotide
taatacgactcactatagggttcagtgaaatggtttgagcaaaatggaacaacagaggagagttccaatgtgctcaaacaacctggcggcagcgcaaaagatg

SEQ ID NO: 79973 - DNA, 103 bp, Artificial Sequence
  Synthetic Polynucleotide
taatacgactcactatagggatcaattcagtgaaatggtttgagcaaaataacagaggagaattttgatgaaaccatttaacctggcggcagcgcaaaagatg

SEQ ID NO: 79974 - DNA, 103 bp, Artificial Sequence
  Synthetic Polynucleotide
taatacgactcactatagggtcatgatcaattcagtgaaatggtttgagcaacagaggagagctcaaatgatttcactgaacctggcggcagcgcaaaagatg

SEQ ID NO: 79975 - DNA, 103 bp, Artificial Sequence
  Synthetic Polynucleotide
taatacgactcactatagggatctttcatgatcaattcagtgaaatggttaacagaggagaaaccatatgactgaattgaacctggcggcagcgcaaaagatg

SEQ ID NO: 79976 - DNA, 103 bp, Artificial Sequence
  Synthetic Polynucleotide
taatacgactcactatagggcttccatctttcatgatcaattcagtgaaaaacagaggagatttcacatgattgatcataacctggcggcagcgcaaaagatg

SEQ ID NO: 79977 - DNA, 103 bp, Artificial Sequence
  Synthetic Polynucleotide
taatacgactcactataggggtgttcttccatctttcatgatcaattcagaacagaggagactgaatatgtcatgaaagaacctggcggcagcgcaaaagatg

SEQ ID NO: 79978 - DNA, 103 bp, Artificial Sequence
  Synthetic Polynucleotide
taatacgactcactatagggcaccagtgttcttccatctttcatgatcaaaacagaggagattgatcatgaaagatggaaacctggcggcagcgcaaaagatg

SEQ ID NO: 79979 - DNA, 103 bp, Artificial Sequence
  Synthetic Polynucleotide
taatacgactcactatagggactccttccaagaagtctctgttgctcattaacagaggagaaatgagatgcagagacttaacctggcggcagcgcaaaagatg

SEQ ID NO: 79980 - DNA, 103 bp, Artificial Sequence
  Synthetic Polynucleotide
taatacgactcactatagggggaaccaccagtgttcttccatctttcatgaacagaggagacatgaaatgtggaagaacaacctggcggcagcgcaaaagatg

SEQ ID NO: 79981 - DNA, 103 bp, Artificial Sequence
  Synthetic Polynucleotide
taatacgactcactatagggggcatggaaccaccagtgttcttccatcttaacagaggagaaagatgatggaacactggaacctggcggcagcgcaaaagatg

SEQ ID NO: 79982 - DNA, 103 bp, Artificial Sequence
  Synthetic Polynucleotide
taatacgactcactatagggtcctcggcatggaaccaccagtgttcttccaacagaggagaggaagaatgctggtggttaacctggcggcagcgcaaaagatg

SEQ ID NO: 79983 - DNA, 103 bp, Artificial Sequence
  Synthetic Polynucleotide
taatacgactcactatagggtcctgtcctcggcatggaaccaccagtgttaacagaggagaaacactatgggttccatgaacctggcggcagcgcaaaagatg

SEQ ID NO: 79984 - DNA, 103 bp, Artificial Sequence
  Synthetic Polynucleotide
taatacgactcactatagggattcatcctgtcctcggcatggaaccaccaaacagaggagatggtggatgcatgccgagaacctggcggcagcgcaaaagatg

SEQ ID NO: 79985 - DNA, 103 bp, Artificial Sequence
  Synthetic Polynucleotide
taatacgactcactatagggtaccaattcatcctgtcctcggcatggaacaacagaggagagttccaatgcgaggacagaacctggcggcagcgcaaaagatg

SEQ ID NO: 79986 - DNA, 103 bp, Artificial Sequence
  Synthetic Polynucleotide
taatacgactcactatagggctgcctaccaattcatcctgtcctcggcataacagaggagaatgccgatgacaggatgaaacctggcggcagcgcaaaagatg

SEQ ID NO: 79987 - DNA, 103 bp, Artificial Sequence
  Synthetic Polynucleotide
taatacgactcactataggggagctctgcctaccaattcatcctgtcctcaacagaggagagaggacatgatgaattggaacctggcggcagcgcaaaagatg

SEQ ID NO: 79988 - DNA, 103 bp, Artificial Sequence
  Synthetic Polynucleotide
taatacgactcactatagggtatgcgagctctgcctaccaattcatcctgaacagaggagacaggatatgttggtaggcaacctggcggcagcgcaaaagatg

SEQ ID NO: 79989 - DNA, 103 bp, Artificial Sequence
  Synthetic Polynucleotide
taatacgactcactatagggggagatatgcgagctctgcctaccaattcaaacagaggagatgaattatgaggcagagcaacctggcggcagcgcaaaagatg

SEQ ID NO: 79990 - DNA, 103 bp, Artificial Sequence
  Synthetic Polynucleotide
taatacgactcactatagggcagacactccttccaagaagtctctgttgcaacagaggagagcaacaatgacttcttggaacctggcggcagcgcaaaagatg

SEQ ID NO: 79991 - DNA, 103 bp, Artificial Sequence
  Synthetic Polynucleotide
taatacgactcactatagggcccctggagatatgcgagctctgcctaccaaacagaggagatggtagatggagctcgcaaacctggcggcagcgcaaaagatg

SEQ ID NO: 79992 - DNA, 103 bp, Artificial Sequence
  Synthetic Polynucleotide
taatacgactcactatagggtccggcccctggagatatgcgagctctgccaacagaggagaggcagaatgcgcatatctaacctggcggcagcgcaaaagatg

SEQ ID NO: 79993 - DNA, 103 bp, Artificial Sequence
  Synthetic Polynucleotide
taatacgactcactatagggttccatccggcccctggagatatgcgagctaacagaggagaagctcgatgatctccaggaacctggcggcagcgcaaaagatg

SEQ ID NO: 79994 - DNA, 103 bp, Artificial Sequence
  Synthetic Polynucleotide
taatacgactcactatagggggacgttccatccggcccctggagatatgcaacagaggagagcatatatgcaggggccgaacctggcggcagcgcaaaagatg

SEQ ID NO: 79995 - DNA, 103 bp, Artificial Sequence
  Synthetic Polynucleotide
taatacgactcactataggggtcgcggacgttccatccggcccctggagaaacagaggagatctccaatggccggatggaacctggcggcagcgcaaaagatg

SEQ ID NO: 79996 - DNA, 103 bp, Artificial Sequence
  Synthetic Polynucleotide
taatacgactcactataggggcagtgtcgcggacgttccatccggcccctaacagaggagaaggggcatgatggaacgtaacctggcggcagcgcaaaagatg

SEQ ID NO: 79997 - DNA, 103 bp, Artificial Sequence
  Synthetic Polynucleotide
taatacgactcactataggggacaagcagtgtcgcggacgttccatccggaacagaggagaccggatatgacgtccgcgaacctggcggcagcgcaaaagatg

SEQ ID NO: 79998 - DNA, 103 bp, Artificial Sequence
  Synthetic Polynucleotide
taatacgactcactatagggagccagacaagcagtgtcgcggacgttccaaacagaggagatggaacatgcgcgacactaacctggcggcagcgcaaaagatg

SEQ ID NO: 79999 - DNA, 103 bp, Artificial Sequence
  Synthetic Polynucleotide
taatacgactcactataggggacttagccagacaagcagtgtcgcggacgaacagaggagacgtccgatgcactgcttgaacctggcggcagcgcaaaagatg

SEQ ID NO: 80000 - DNA, 103 bp, Artificial Sequence
  Synthetic Polynucleotide
taatacgactcactatagggcataagacttagccagacaagcagtgtcgcaacagaggagagcgacaatgcttgtctggaacctggcggcagcgcaaaagatg

SEQ ID NO: 80001 - DNA, 103 bp, Artificial Sequence
  Synthetic Polynucleotide
taatacgactcactatagggtgctccagacactccttccaagaagtctctaacagaggagaagagacatgttggaaggaaacctggcggcagcgcaaaagatg

SEQ ID NO: 80002 - DNA, 103 bp, Artificial Sequence
  Synthetic Polynucleotide
taatacgactcactatagggctgggcataagacttagccagacaagcagtaacagaggagaactgctatgctggctaagaacctggcggcagcgcaaaagatg

SEQ ID NO: 80003 - DNA, 103 bp, Artificial Sequence
  Synthetic Polynucleotide
taatacgactcactatagggcacatctgggcataagacttagccagacaaaacagaggagattgtctatgtaagtcttaaacctggcggcagcgcaaaagatg

SEQ ID NO: 80004 - DNA, 103 bp, Artificial Sequence
  Synthetic Polynucleotide
taatacgactcactataggggcagccacatctgggcataagacttagccaaacagaggagatggctaatgcttatgcccaacctggcggcagcgcaaaagatg

SEQ ID NO: 80005 - DNA, 103 bp, Artificial Sequence
  Synthetic Polynucleotide
taatacgactcactatagggcagaagcagccacatctgggcataagacttaacagaggagaaagtctatggcccagatgaacctggcggcagcgcaaaagatg

SEQ ID NO: 80006 - DNA, 103 bp, Artificial Sequence
  Synthetic Polynucleotide
taatacgactcactatagggaagtacagaagcagccacatctgggcataaaacagaggagattatgcatggatgtggctaacctggcggcagcgcaaaagatg

SEQ ID NO: 80007 - DNA, 103 bp, Artificial Sequence
  Synthetic Polynucleotide
taatacgactcactatagggtgtggaagtacagaagcagccacatctgggaacagaggagacccagaatgggctgcttcaacctggcggcagcgcaaaagatg

SEQ ID NO: 80008 - DNA, 103 bp, Artificial Sequence
  Synthetic Polynucleotide
taatacgactcactatagggtcttctgtggaagtacagaagcagccacataacagaggagaatgtggatgcttctgtacaacctggcggcagcgcaaaagatg

SEQ ID NO: 80009 - DNA, 103 bp, Artificial Sequence
  Synthetic Polynucleotide
taatacgactcactatagggaggtctcttctgtggaagtacagaagcagcaacagaggagagctgctatggtacttccaaacctggcggcagcgcaaaagatg

SEQ ID NO: 80010 - DNA, 103 bp, Artificial Sequence
  Synthetic Polynucleotide
taatacgactcactataggggccgcaggtctcttctgtggaagtacagaaaacagaggagattctgtatgtccacagaaaacctggcggcagcgcaaaagatg

SEQ ID NO: 80011 - DNA, 103 bp, Artificial Sequence
  Synthetic Polynucleotide
taatacgactcactatagggcatgagccgcaggtctcttctgtggaagtaaacagaggagatacttcatgagaagagacaacctggcggcagcgcaaaagatg

SEQ ID NO: 80012 - DNA, 103 bp, Artificial Sequence
  Synthetic Polynucleotide
taatacgactcactatagggctactaagtttgtcagctcacacaggcgaaaacagaggagattcgccatggtgagctgaaacctggcggcagcgcaaaagatg

SEQ ID NO: 80013 - DNA, 103 bp, Artificial Sequence
  Synthetic Polynucleotide
taatacgactcactatagggttgccgggccctcctggtttcttagacatcaacagaggagagatgtcatggaaaccaggaacctggcggcagcgcaaaagatg

SEQ ID NO: 80014 - DNA, 103 bp, Artificial Sequence
  Synthetic Polynucleotide
taatacgactcactatagggcatgttgctccagacactccttccaagaagaacagaggagacttcttatgaggagtgtcaacctggcggcagcgcaaaagatg

SEQ ID NO: 80015 - DNA, 103 bp, Artificial Sequence
  Synthetic Polynucleotide
taatacgactcactatagggttggccatgagccgcaggtctcttctgtggaacagaggagaccacagatgagacctgcgaacctggcggcagcgcaaaagatg

SEQ ID NO: 80016 - DNA, 103 bp, Artificial Sequence
  Synthetic Polynucleotide
taatacgactcactatagggtggcgttggccatgagccgcaggtctcttcaacagaggagagaagagatgtgcggctcaaacctggcggcagcgcaaaagatg

SEQ ID NO: 80017 - DNA, 103 bp, Artificial Sequence
  Synthetic Polynucleotide
taatacgactcactataggggcaaatggcgttggccatgagccgcaggtcaacagaggagagacctgatgctcatggccaacctggcggcagcgcaaaagatg

SEQ ID NO: 80018 - DNA, 103 bp, Artificial Sequence
  Synthetic Polynucleotide
taatacgactcactataggggcggagcaaatggcgttggccatgagccgcaacagaggagagcggctatgggccaacgcaacctggcggcagcgcaaaagatg

SEQ ID NO: 80019 - DNA, 103 bp, Artificial Sequence
  Synthetic Polynucleotide
taatacgactcactatagggggacagcggagcaaatggcgttggccatgaaacagaggagatcatggatgacgccatttaacctggcggcagcgcaaaagatg

SEQ ID NO: 80020 - DNA, 103 bp, Artificial Sequence
  Synthetic Polynucleotide
taatacgactcactatagggcacagggacagcggagcaaatggcgttggcaacagaggagagccaacatgatttgctccaacctggcggcagcgcaaaagatg

SEQ ID NO: 80021 - DNA, 103 bp, Artificial Sequence
  Synthetic Polynucleotide
taatacgactcactatagggcaattcacagggacagcggagcaaatggcgaacagaggagacgccatatgctccgctgtaacctggcggcagcgcaaaagatg

SEQ ID NO: 80022 - DNA, 103 bp, Artificial Sequence
  Synthetic Polynucleotide
taatacgactcactatagggggacccaattcacagggacagcggagcaaaaacagaggagatttgctatgctgtccctgaacctggcggcagcgcaaaagatg

SEQ ID NO: 80023 - DNA, 103 bp, Artificial Sequence
  Synthetic Polynucleotide
taatacgactcactatagggggtagggacccaattcacagggacagcggaaacagaggagatccgctatgcctgtgaataacctggcggcagcgcaaaagatg

SEQ ID NO: 80024 - DNA, 103 bp, Artificial Sequence
  Synthetic Polynucleotide
taatacgactcactatagggcttccggtagggacccaattcacagggacaaacagaggagatgtcccatggaattgggtaacctggcggcagcgcaaaagatg

SEQ ID NO: 80025 - DNA, 103 bp, Artificial Sequence
  Synthetic Polynucleotide
taatacgactcactatagggccacccatgttgctccagacactccttccaaacagaggagatggaagatgtgtctggagaacctggcggcagcgcaaaagatg

SEQ ID NO: 80026 - DNA, 103 bp, Artificial Sequence
  Synthetic Polynucleotide
taatacgactcactatagggtggttcttccggtagggacccaattcacagaacagaggagactgtgaatggggtccctaaacctggcggcagcgcaaaagatg

SEQ ID NO: 80027 - DNA, 103 bp, Artificial Sequence
  Synthetic Polynucleotide
taatacgactcactatagggccacgtggttcttccggtagggacccaattaacagaggagaaattggatgcctaccggaaacctggcggcagcgcaaaagatg

SEQ ID NO: 80028 - DNA, 103 bp, Artificial Sequence
  Synthetic Polynucleotide
taatacgactcactatagggatggaccacgtggttcttccggtagggaccaacagaggagaggtcccatgcggaagaacaacctggcggcagcgcaaaagatg

SEQ ID NO: 80029 - DNA, 103 bp, Artificial Sequence
  Synthetic Polynucleotide
taatacgactcactatagggcatggatggaccacgtggttcttccggtagaacagaggagactaccgatggaaccacgtaacctggcggcagcgcaaaagatg

SEQ ID NO: 80030 - DNA, 103 bp, Artificial Sequence
  Synthetic Polynucleotide
taatacgactcactatagggtcctgcatggatggaccacgtggttcttccaacagaggagaggaagaatgacgtggtccaacctggcggcagcgcaaaagatg

SEQ ID NO: 80031 - DNA, 103 bp, Artificial Sequence
  Synthetic Polynucleotide
taatacgactcactatagggtctcctcctgcatggatggaccacgtggttaacagaggagaaaccacatggtccatccaaacctggcggcagcgcaaaagatg

SEQ ID NO: 80032 - DNA, 103 bp, Artificial Sequence
  Synthetic Polynucleotide
taatacgactcactatagggtccactctcctcctgcatggatggaccacgaacagaggagacgtggtatgtccatgcagaacctggcggcagcgcaaaagatg

SEQ ID NO: 80033 - DNA, 103 bp, Artificial Sequence
  Synthetic Polynucleotide
taatacgactcactatagggtgtcatccactctcctcctgcatggatggaaacagaggagatccatcatggcaggaggaaacctggcggcagcgcaaaagatg

SEQ ID NO: 80034 - DNA, 103 bp, Artificial Sequence
  Synthetic Polynucleotide
taatacgactcactatagggtctgttgtcatccactctcctcctgcatggaacagaggagaccatgcatgaggagagtgaacctggcggcagcgcaaaagatg

SEQ ID NO: 80035 - DNA, 103 bp, Artificial Sequence
  Synthetic Polynucleotide
taatacgactcactatagggtgtcctctgttgtcatccactctcctcctgaacagaggagacaggagatgagtggatgaaacctggcggcagcgcaaaagatg

SEQ ID NO: 80036 - DNA, 103 bp, Artificial Sequence
  Synthetic Polynucleotide
taatacgactcactatagggcaaatccacccatgttgctccagacactccaacagaggagaggagtgatgggagcaacaaacctggcggcagcgcaaaagatg

SEQ ID NO: 80037 - DNA, 103 bp, Artificial Sequence
  Synthetic Polynucleotide
taatacgactcactatagggcaacatgtcctctgttgtcatccactctccaacagaggagaggagagatgatgacaacaaacctggcggcagcgcaaaagatg

SEQ ID NO: 80038 - DNA, 103 bp, Artificial Sequence
  Synthetic Polynucleotide
taatacgactcactatagggacctccaacatgtcctctgttgtcatccacaacagaggagagtggatatgaacagaggaaacctggcggcagcgcaaaagatg

SEQ ID NO: 80039 - DNA, 103 bp, Artificial Sequence
  Synthetic Polynucleotide
taatacgactcactatagggtccagacctccaacatgtcctctgttgtcaaacagaggagatgacaaatgaggacatgtaacctggcggcagcgcaaaagatg

SEQ ID NO: 80040 - DNA, 103 bp, Artificial Sequence
  Synthetic Polynucleotide
taatacgactcactatagggacggttccagacctccaacatgtcctctgtaacagaggagaacagagatgatgttggagaacctggcggcagcgcaaaagatg

SEQ ID NO: 80041 - DNA, 103 bp, Artificial Sequence
  Synthetic Polynucleotide
taatacgactcactatagggcaaacacggttccagacctccaacatgtccaacagaggagaggacatatgggaggtctgaacctggcggcagcgcaaaagatg

SEQ ID NO: 80042 - DNA, 103 bp, Artificial Sequence
  Synthetic Polynucleotide
taatacgactcactatagggctatccaaacacggttccagacctccaacaaacagaggagatgttggatgtctggaaccaacctggcggcagcgcaaaagatg

SEQ ID NO: 80043 - DNA, 103 bp, Artificial Sequence
  Synthetic Polynucleotide
taatacgactcactatagggctcctctatccaaacacggttccagacctcaacagaggagagaggtcatgaaccgtgttaacctggcggcagcgcaaaagatg

SEQ ID NO: 80044 - DNA, 103 bp, Artificial Sequence
  Synthetic Polynucleotide
taatacgactcactatagggtcattctcctctatccaaacacggttccagaacagaggagactggaaatgtgtttggataacctggcggcagcgcaaaagatg

SEQ ID NO: 80045 - DNA, 103 bp, Artificial Sequence
  Synthetic Polynucleotide
taatacgactcactatagggtccattcattctcctctatccaaacacggtaacagaggagaaccgtgatgggatagaggaacctggcggcagcgcaaaagatg

SEQ ID NO: 80046 - DNA, 103 bp, Artificial Sequence
  Synthetic Polynucleotide
taatacgactcactatagggttccatccattcattctcctctatccaaacaacagaggagagtttggatggaggagaataacctggcggcagcgcaaaagatg

SEQ ID NO: 80047 - DNA, 103 bp, Artificial Sequence
  Synthetic Polynucleotide
taatacgactcactatagggagaaccaaatccacccatgttgctccagacaacagaggagagtctggatgaacatgggtaacctggcggcagcgcaaaagatg

SEQ ID NO: 80048 - DNA, 103 bp, Artificial Sequence
  Synthetic Polynucleotide
taatacgactcactatagggttgtcttccatccattcattctcctctatcaacagaggagagatagaatggaatgaatgaacctggcggcagcgcaaaagatg

SEQ ID NO: 80049 - DNA, 103 bp, Artificial Sequence
  Synthetic Polynucleotide
taatacgactcactataggggggttttgtcttccatccattcattctcctaacagaggagaaggagaatgaatggatggaacctggcggcagcgcaaaagatg

SEQ ID NO: 80050 - DNA, 103 bp, Artificial Sequence
  Synthetic Polynucleotide
taatacgactcactatagggcactggggttttgtcttccatccattcattaacagaggagaaatgaaatgatggaagacaacctggcggcagcgcaaaagatg

SEQ ID NO: 80051 - DNA, 103 bp, Artificial Sequence
  Synthetic Polynucleotide
taatacgactcactatagggttctccactggggttttgtcttccatccataacagaggagaatggatatgagacaaaacaacctggcggcagcgcaaaagatg

SEQ ID NO: 80052 - DNA, 103 bp, Artificial Sequence
  Synthetic Polynucleotide
taatacgactcactatagggtccatttctccactggggttttgtcttccaaacagaggagatggaagatgaaaccccagaacctggcggcagcgcaaaagatg

SEQ ID NO: 80053 - DNA, 103 bp, Artificial Sequence
  Synthetic Polynucleotide
taatacgactcactataggggtcactccatttctccactggggttttgtcaacagaggagagacaaaatgccagtggagaacctggcggcagcgcaaaagatg

SEQ ID NO: 80054 - DNA, 103 bp, Artificial Sequence
  Synthetic Polynucleotide
taatacgactcactataggggggacgtcactccatttctccactggggttaacagaggagaaaccccatgggagaaatgaacctggcggcagcgcaaaagatg

SEQ ID NO: 80055 - DNA, 103 bp, Artificial Sequence
  Synthetic Polynucleotide
taatacgactcactatagggaatatgggacgtcactccatttctccactgaacagaggagacagtggatgaatggagtgaacctggcggcagcgcaaaagatg

SEQ ID NO: 80056 - DNA, 103 bp, Artificial Sequence
  Synthetic Polynucleotide
taatacgactcactatagggtcctgaatatgggacgtcactccatttctcaacagaggagagagaaaatgagtgacgtcaacctggcggcagcgcaaaagatg

SEQ ID NO: 80057 - DNA, 103 bp, Artificial Sequence
  Synthetic Polynucleotide
taatacgactcactatagggcgttttcctgaatatgggacgtcactccataacagaggagaatggagatgcgtcccataaacctggcggcagcgcaaaagatg

SEQ ID NO: 80058 - DNA, 103 bp, Artificial Sequence
  Synthetic Polynucleotide
taatacgactcactatagggcttcgagaaccaaatccacccatgttgctcaacagaggagagagcaaatggggtggattaacctggcggcagcgcaaaagatg

SEQ ID NO: 80059 - DNA, 103 bp, Artificial Sequence
  Synthetic Polynucleotide
taatacgactcactatagggcctctcgttttcctgaatatgggacgtcacaacagaggagagtgacgatgcatattcagaacctggcggcagcgcaaaagatg

SEQ ID NO: 80060 - DNA, 103 bp, Artificial Sequence
  Synthetic Polynucleotide
taatacgactcactataggggatgtcctctcgttttcctgaatatgggacaacagaggagagtcccaatgtcaggaaaaaacctggcggcagcgcaaaagatg

SEQ ID NO: 80061 - DNA, 103 bp, Artificial Sequence
  Synthetic Polynucleotide
taatacgactcactatagggcaccagatgtcctctcgttttcctgaatataacagaggagaatattcatgaaaacgagaaacctggcggcagcgcaaaagatg

SEQ ID NO: 80062 - DNA, 103 bp, Artificial Sequence
  Synthetic Polynucleotide
taatacgactcactatagggtgccacaccagatgtcctctcgttttcctgaacagaggagacaggaaatggagaggacaaacctggcggcagcgcaaaagatg

SEQ ID NO: 80063 - DNA, 103 bp, Artificial Sequence
  Synthetic Polynucleotide
taatacgactcactatagggcaggctgccacaccagatgtcctctcgtttaacagaggagaaaacgaatggacatctggaacctggcggcagcgcaaaagatg

SEQ ID NO: 80064 - DNA, 103 bp, Artificial Sequence
  Synthetic Polynucleotide
taatacgactcactatagggccaatcaggctgccacaccagatgtcctctaacagaggagaagaggaatgctggtgtggaacctggcggcagcgcaaaagatg

SEQ ID NO: 80065 - DNA, 103 bp, Artificial Sequence
  Synthetic Polynucleotide
taatacgactcactatagggttgtgccaatcaggctgccacaccagatgtaacagaggagaacatctatggtggcagccaacctggcggcagcgcaaaagatg

SEQ ID NO: 80066 - DNA, 103 bp, Artificial Sequence
  Synthetic Polynucleotide
taatacgactcactatagggggctcttgtgccaatcaggctgccacaccaaacagaggagatggtgtatgagcctgattaacctggcggcagcgcaaaagatg

SEQ ID NO: 80067 - DNA, 103 bp, Artificial Sequence
  Synthetic Polynucleotide
taatacgactcactataggggctcgggctcttgtgccaatcaggctgccaaacagaggagatggcagatggattggcacaacctggcggcagcgcaaaagatg

SEQ ID NO: 80068 - DNA, 103 bp, Artificial Sequence
  Synthetic Polynucleotide
taatacgactcactatagggacgtggctcgggctcttgtgccaatcaggcaacagaggagagcctgaatggcacaagagaacctggcggcagcgcaaaagatg

SEQ ID NO: 80069 - DNA, 103 bp, Artificial Sequence
  Synthetic Polynucleotide
taatacgactcactataggggtcgccttcgagaaccaaatccacccatgtaacagaggagaacatggatggatttggttaacctggcggcagcgcaaaagatg

SEQ ID NO: 80070 - DNA, 103 bp, Artificial Sequence
  Synthetic Polynucleotide
taatacgactcactatagggtgcccacgtggctcgggctcttgtgccaataacagaggagaattggcatgagagcccgaaacctggcggcagcgcaaaagatg

SEQ ID NO: 80071 - DNA, 103 bp, Artificial Sequence
  Synthetic Polynucleotide
taatacgactcactatagggttttctgcccacgtggctcgggctcttgtgaacagaggagacacaagatgccgagccacaacctggcggcagcgcaaaagatg

SEQ ID NO: 80072 - DNA, 103 bp, Artificial Sequence
  Synthetic Polynucleotide
taatacgactcactatagggggatgttttctgcccacgtggctcgggctcaacagaggagagagcccatgccacgtgggaacctggcggcagcgcaaaagatg

SEQ ID NO: 80073 - DNA, 103 bp, Artificial Sequence
  Synthetic Polynucleotide
taatacgactcactatagggcacctggatgttttctgcccacgtggctcgaacagaggagacgagccatgtgggcagaaaacctggcggcagcgcaaaagatg

SEQ ID NO: 80074 - DNA, 103 bp, Artificial Sequence
  Synthetic Polynucleotide
taatacgactcactatagggatagccacctggatgttttctgcccacgtgaacagaggagacacgtgatgagaaaacataacctggcggcagcgcaaaagatg

SEQ ID NO: 80075 - DNA, 103 bp, Artificial Sequence
  Synthetic Polynucleotide
taatacgactcactatagggggttgatagccacctggatgttttctgcccaacagaggagagggcagatgacatccaggaacctggcggcagcgcaaaagatg

SEQ ID NO: 80076 - DNA, 103 bp, Artificial Sequence
  Synthetic Polynucleotide
taatacgactcactataggggacttggttgatagccacctggatgttttcaacagaggagagaaaacatgcaggtggctaacctggcggcagcgcaaaagatg

SEQ ID NO: 80077 - DNA, 103 bp, Artificial Sequence
  Synthetic Polynucleotide
taatacgactcactataggggctctgacttggttgatagccacctggatgaacagaggagacatccaatgggctatcaaaacctggcggcagcgcaaaagatg

SEQ ID NO: 80078 - DNA, 103 bp, Artificial Sequence
  Synthetic Polynucleotide
taatacgactcactatagggtgattgctctgacttggttgatagccacctaacagaggagaaggtggatgtcaaccaagaacctggcggcagcgcaaaagatg

SEQ ID NO: 80079 - DNA, 103 bp, Artificial Sequence
  Synthetic Polynucleotide
taatacgactcactatagggtccgatgattgctctgacttggttgatagcaacagaggagagctatcatgcaagtcagaaacctggcggcagcgcaaaagatg

SEQ ID NO: 80080 - DNA, 103 bp, Artificial Sequence
  Synthetic Polynucleotide
taatacgactcactatagggcagctgtcgccttcgagaaccaaatccaccaacagaggagaggtggaatgggttctcgaaacctggcggcagcgcaaaagatg

SEQ ID NO: 80081 - DNA, 103 bp, Artificial Sequence
  Synthetic Polynucleotide
taatacgactcactatagggtcatctccgatgattgctctgacttggttgaacagaggagacaaccaatgcagagcaataacctggcggcagcgcaaaagatg

SEQ ID NO: 80082 - DNA, 103 bp, Artificial Sequence
  Synthetic Polynucleotide
taatacgactcactatagggacttctcatctccgatgattgctctgacttaacagaggagaaagtcaatgcaatcatcgaacctggcggcagcgcaaaagatg

SEQ ID NO: 80083 - DNA, 103 bp, Artificial Sequence
  Synthetic Polynucleotide
taatacgactcactatagggcacatacttctcatctccgatgattgctctaacagaggagaagagcaatgatcggagataacctggcggcagcgcaaaagatg

SEQ ID NO: 80084 - DNA, 103 bp, Artificial Sequence
  Synthetic Polynucleotide
taatacgactcactatagggtagtccacatacttctcatctccgatgattaacagaggagaaatcatatgagatgagaaaacctggcggcagcgcaaaagatg

SEQ ID NO: 80085 - DNA, 103 bp, Artificial Sequence
  Synthetic Polynucleotide
taatacgactcactatagggtcatgtagtccacatacttctcatctccgaaacagaggagatcggagatgagaagtatgaacctggcggcagcgcaaaagatg

SEQ ID NO: 80086 - DNA, 103 bp, Artificial Sequence
  Synthetic Polynucleotide
taatacgactcactatagggtgaactcatgtagtccacatacttctcatcaacagaggagagatgagatgtatgtggacaacctggcggcagcgcaaaagatg

SEQ ID NO: 80087 - DNA, 103 bp, Artificial Sequence
  Synthetic Polynucleotide
taatacgactcactatagggtttagtgaactcatgtagtccacatacttcaacagaggagagaagtaatgggactacataacctggcggcagcgcaaaagatg

SEQ ID NO: 80088 - DNA, 103 bp, Artificial Sequence
  Synthetic Polynucleotide
taatacgactcactatagggatctctttagtgaactcatgtagtccacataacagaggagaatgtggatgacatgagttaacctggcggcagcgcaaaagatg

SEQ ID NO: 80089 - DNA, 103 bp, Artificial Sequence
  Synthetic Polynucleotide
taatacgactcactatagggttcatatctctttagtgaactcatgtagtcaacagaggagagactacatgagttcactaaacctggcggcagcgcaaaagatg

SEQ ID NO: 80090 - DNA, 103 bp, Artificial Sequence
  Synthetic Polynucleotide
taatacgactcactataggggtgtcttcatatctctttagtgaactcatgaacagaggagacatgagatgactaaagagaacctggcggcagcgcaaaagatg

SEQ ID NO: 80091 - DNA, 103 bp, Artificial Sequence
  Synthetic Polynucleotide
taatacgactcactatagggtcacgcagctgtcgccttcgagaaccaaataacagaggagaatttggatgtcgaaggcgaacctggcggcagcgcaaaagatg

SEQ ID NO: 80092 - DNA, 103 bp, Artificial Sequence
  Synthetic Polynucleotide
taatacgactcactatagggaagttgtgtcttcatatctctttagtgaacaacagaggagagttcacatgagagatatgaacctggcggcagcgcaaaagatg

SEQ ID NO: 80093 - DNA, 103 bp, Artificial Sequence
  Synthetic Polynucleotide
taatacgactcactatagggaaccaaagttgtgtcttcatatctctttagaacagaggagactaaagatgtatgaagacaacctggcggcagcgcaaaagatg

SEQ ID NO: 80094 - DNA, 103 bp, Artificial Sequence
  Synthetic Polynucleotide
taatacgactcactatagggtcctcaaccaaagttgtgtcttcatatctcaacagaggagagagataatgagacacaacaacctggcggcagcgcaaaagatg

SEQ ID NO: 80095 - DNA, 103 bp, Artificial Sequence
  Synthetic Polynucleotide
taatacgactcactatagggctgtgtcctcaaccaaagttgtgtcttcataacagaggagaatgaagatgcaactttggaacctggcggcagcgcaaaagatg

SEQ ID NO: 80096 - DNA, 103 bp, Artificial Sequence
  Synthetic Polynucleotide
taatacgactcactatagggcagtactgtgtcctcaaccaaagttgtgtcaacagaggagagacacaatgttggttgagaacctggcggcagcgcaaaagatg

SEQ ID NO: 80097 - DNA, 103 bp, Artificial Sequence
  Synthetic Polynucleotide
taatacgactcactatagggatctacagtactgtgtcctcaaccaaagttaacagaggagaaactttatgtgaggacacaacctggcggcagcgcaaaagatg

SEQ ID NO: 80098 - DNA, 103 bp, Artificial Sequence
  Synthetic Polynucleotide
taatacgactcactatagggtaaatatctacagtactgtgtcctcaaccaaacagaggagatggttgatgacacagtacaacctggcggcagcgcaaaagatg

SEQ ID NO: 80099 - DNA, 103 bp, Artificial Sequence
  Synthetic Polynucleotide
taatacgactcactatagggttgattaaatatctacagtactgtgtcctcaacagaggagagaggacatggtactgtagaacctggcggcagcgcaaaagatg

SEQ ID NO: 80100 - DNA, 103 bp, Artificial Sequence
  Synthetic Polynucleotide
taatacgactcactatagggtacaattgattaaatatctacagtactgtgaacagaggagacacagtatggtagatattaacctggcggcagcgcaaaagatg

SEQ ID NO: 80101 - DNA, 103 bp, Artificial Sequence
  Synthetic Polynucleotide
taatacgactcactatagggctatttacaattgattaaatatctacagtaaacagaggagatactgtatgtatttaatcaacctggcggcagcgcaaaagatg

SEQ ID NO: 80102 - DNA, 103 bp, Artificial Sequence
  Synthetic Polynucleotide
taatacgactcactataggggatagtcacgcagctgtcgccttcgagaacaacagaggagagttctcatgggcgacagcaacctggcggcagcgcaaaagatg

SEQ ID NO: 80103 - DNA, 103 bp, Artificial Sequence
  Synthetic Polynucleotide
taatacgactcactatagggattgtctatttacaattgattaaatatctaaacagaggagatagataatgaatcaattgaacctggcggcagcgcaaaagatg

SEQ ID NO: 80104 - DNA, 103 bp, Artificial Sequence
  Synthetic Polynucleotide
taatacgactcactatagggcttatattgtctatttacaattgattaaataacagaggagaatttaaatgattgtaaataacctggcggcagcgcaaaagatg

SEQ ID NO: 80105 - DNA, 103 bp, Artificial Sequence
  Synthetic Polynucleotide
taatacgactcactataggggcatacttatattgtctatttacaattgataacagaggagaatcaatatgaaatagacaaacctggcggcagcgcaaaagatg

SEQ ID NO: 80106 - DNA, 103 bp, Artificial Sequence
  Synthetic Polynucleotide
taatacgactcactatagggtttatgcatacttatattgtctatttacaaaacagaggagattgtaaatggacaatataaacctggcggcagcgcaaaagatg

SEQ ID NO: 80107 - DNA, 103 bp, Artificial Sequence
  Synthetic Polynucleotide
taatacgactcactatagggacacttttatgcatacttatattgtctattaacagaggagaaatagaatgtataagtataacctggcggcagcgcaaaagatg

SEQ ID NO: 80108 - DNA, 103 bp, Artificial Sequence
  Synthetic Polynucleotide
taatacgactcactatagggaaactacacttttatgcatacttatattgtaacagaggagaacaataatggtatgcataaacctggcggcagcgcaaaagatg

SEQ ID NO: 80109 - DNA, 103 bp, Artificial Sequence
  Synthetic Polynucleotide
taatacgactcactatagggctataaaactacacttttatgcatacttataacagaggagaataagtatgcataaaagtaacctggcggcagcgcaaaagatg

SEQ ID NO: 80110 - DNA, 103 bp, Artificial Sequence
  Synthetic Polynucleotide
taatacgactcactatagggtactactataaaactacacttttatgcataaacagaggagatatgcaatgaagtgtagtaacctggcggcagcgcaaaagatg

SEQ ID NO: 80111 - DNA, 103 bp, Artificial Sequence
  Synthetic Polynucleotide
taatacgactcactatagggctaaatactactataaaactacacttttataacagaggagaataaaaatgtagttttataacctggcggcagcgcaaaagatg

SEQ ID NO: 80112 - DNA, 103 bp, Artificial Sequence
  Synthetic Polynucleotide
taatacgactcactatagggcaccactaaatactactataaaactacactaacagaggagaagtgtaatgttatagtagaacctggcggcagcgcaaaagatg

SEQ ID NO: 80113 - DNA, 103 bp, Artificial Sequence
  Synthetic Polynucleotide
taatacgactcactataggggacatgatagtcacgcagctgtcgccttcgaacagaggagacgaaggatgcagctgcgtaacctggcggcagcgcaaaagatg

SEQ ID NO: 80114 - DNA, 103 bp, Artificial Sequence
  Synthetic Polynucleotide
taatacgactcactatagggactaacaccactaaatactactataaaactaacagaggagaagttttatggtagtatttaacctggcggcagcgcaaaagatg

SEQ ID NO: 80115 - DNA, 103 bp, Artificial Sequence
  Synthetic Polynucleotide
taatacgactcactatagggtttacactaacaccactaaatactactataaacagaggagatatagtatgatttagtggaacctggcggcagcgcaaaagatg

SEQ ID NO: 80116 - DNA, 103 bp, Artificial Sequence
  Synthetic Polynucleotide
taatacgactcactatagggaactatttacactaacaccactaaatactaaacagaggagatagtatatggtggtgttaaacctggcggcagcgcaaaagatg

SEQ ID NO: 80117 - DNA, 103 bp, Artificial Sequence
  Synthetic Polynucleotide
taatacgactcactatagggttcttaactatttacactaacaccactaaaaacagaggagatttagtatggttagtgtaaacctggcggcagcgcaaaagatg

SEQ ID NO: 80118 - DNA, 103 bp, Artificial Sequence
  Synthetic Polynucleotide
taatacgactcactatagggaaattttcttaactatttacactaacaccaaacagaggagatggtgtatgtgtaaatagaacctggcggcagcgcaaaagatg

SEQ ID NO: 80119 - DNA, 103 bp, Artificial Sequence
  Synthetic Polynucleotide
taatacgactcactatagggcctcaaaattttcttaactatttacactaaaacagaggagattagtgatgatagttaagaacctggcggcagcgcaaaagatg

SEQ ID NO: 80120 - DNA, 103 bp, Artificial Sequence
  Synthetic Polynucleotide
taatacgactcactatagggtttctcctcaaaattttcttaactatttacaacagaggagagtaaatatgtaagaaaataacctggcggcagcgcaaaagatg

SEQ ID NO: 80121 - DNA, 103 bp, Artificial Sequence
  Synthetic Polynucleotide
taatacgactcactatagggctgactttctcctcaaaattttcttaactaaacagaggagatagttaatgaaattttgaaacctggcggcagcgcaaaagatg

SEQ ID NO: 80122 - DNA, 103 bp, Artificial Sequence
  Synthetic Polynucleotide
taatacgactcactatagggccggcctgactttctcctcaaaattttcttaacagaggagaaagaaaatgttgaggagaaacctggcggcagcgcaaaagatg

SEQ ID NO: 80123 - DNA, 103 bp, Artificial Sequence
  Synthetic Polynucleotide
taatacgactcactatagggacttcccggcctgactttctcctcaaaattaacagaggagaaattttatggagaaagtcaacctggcggcagcgcaaaagatg

SEQ ID NO: 80124 - DNA, 103 bp, Artificial Sequence
  Synthetic Polynucleotide
taatacgactcactatagggggctcttgccgggccctcctggtttcttagaacagaggagactaagaatgcaggagggcaacctggcggcagcgcaaaagatg

SEQ ID NO: 80125 - DNA, 103 bp, Artificial Sequence
  Synthetic Polynucleotide
taatacgactcactatagggccttagacatgatagtcacgcagctgtcgcaacagaggagagcgacaatggcgtgactaaacctggcggcagcgcaaaagatg

SEQ ID NO: 80126 - DNA, 103 bp, Artificial Sequence
  Synthetic Polynucleotide
taatacgactcactatagggcgggaacttcccggcctgactttctcctcaaacagaggagatgaggaatgagtcaggccaacctggcggcagcgcaaaagatg

SEQ ID NO: 80127 - DNA, 103 bp, Artificial Sequence
  Synthetic Polynucleotide
taatacgactcactatagggggtggcgggaacttcccggcctgactttctaacagaggagaagaaagatgggccgggaaaacctggcggcagcgcaaaagatg

SEQ ID NO: 80128 - DNA, 103 bp, Artificial Sequence
  Synthetic Polynucleotide
taatacgactcactatagggcttccggtggcgggaacttcccggcctgacaacagaggagagtcaggatgggaagttccaacctggcggcagcgcaaaagatg

SEQ ID NO: 80129 - DNA, 103 bp, Artificial Sequence
  Synthetic Polynucleotide
taatacgactcactatagggctcaacttccggtggcgggaacttcccggcaacagaggagagccgggatgttcccgccaaacctggcggcagcgcaaaagatg

SEQ ID NO: 80130 - DNA, 103 bp, Artificial Sequence
  Synthetic Polynucleotide
taatacgactcactataggggtctactcaacttccggtggcgggaacttcaacagaggagagaagttatggccaccggaaacctggcggcagcgcaaaagatg

SEQ ID NO: 80131 - DNA, 103 bp, Artificial Sequence
  Synthetic Polynucleotide
taatacgactcactataggggcaccgtctactcaacttccggtggcgggaaacagaggagatcccgcatgcggaagttgaacctggcggcagcgcaaaagatg

SEQ ID NO: 80132 - DNA, 103 bp, Artificial Sequence
  Synthetic Polynucleotide
taatacgactcactatagggaggcagcaccgtctactcaacttccggtggaacagaggagaccaccgatggttgagtagaacctggcggcagcgcaaaagatg

SEQ ID NO: 80133 - DNA, 103 bp, Artificial Sequence
  Synthetic Polynucleotide
taatacgactcactataggggtcgcaggcagcaccgtctactcaacttccaacagaggagaggaagtatggtagacggtaacctggcggcagcgcaaaagatg

SEQ ID NO: 80134 - DNA, 103 bp, Artificial Sequence
  Synthetic Polynucleotide
taatacgactcactataggggttgagtcgcaggcagcaccgtctactcaaaacagaggagattgagtatgcggtgctgcaacctggcggcagcgcaaaagatg

SEQ ID NO: 80135 - DNA, 103 bp, Artificial Sequence
  Synthetic Polynucleotide
taatacgactcactatagggctggggttgagtcgcaggcagcaccgtctaaacagaggagatagacgatgctgcctgcgaacctggcggcagcgcaaaagatg

SEQ ID NO: 80136 - DNA, 103 bp, Artificial Sequence
  Synthetic Polynucleotide
taatacgactcactatagggcttgtccttagacatgatagtcacgcagctaacagaggagaagctgcatgactatcatgaacctggcggcagcgcaaaagatg

SEQ ID NO: 80137 - DNA, 103 bp, Artificial Sequence
  Synthetic Polynucleotide
taatacgactcactatagggtcctcctggggttgagtcgcaggcagcaccaacagaggagaggtgctatgtgcgactcaaacctggcggcagcgcaaaagatg

SEQ ID NO: 80138 - DNA, 103 bp, Artificial Sequence
  Synthetic Polynucleotide
taatacgactcactatagggcccagtcctcctggggttgagtcgcaggcaaacagaggagatgcctgatgctcaaccccaacctggcggcagcgcaaaagatg

SEQ ID NO: 80139 - DNA, 103 bp, Artificial Sequence
  Synthetic Polynucleotide
taatacgactcactataggggttcacccagtcctcctggggttgagtcgcaacagaggagagcgactatgccccaggagaacctggcggcagcgcaaaagatg

SEQ ID NO: 80140 - DNA, 103 bp, Artificial Sequence
  Synthetic Polynucleotide
taatacgactcactataggggctttgttcacccagtcctcctggggttgaaacagaggagatcaaccatgggaggactgaacctggcggcagcgcaaaagatg

SEQ ID NO: 80141 - DNA, 103 bp, Artificial Sequence
  Synthetic Polynucleotide
taatacgactcactatagggtcgcggctttgttcacccagtcctcctgggaacagaggagacccaggatgactgggtgaaacctggcggcagcgcaaaagatg

SEQ ID NO: 80142 - DNA, 103 bp, Artificial Sequence
  Synthetic Polynucleotide
taatacgactcactatagggtcacttcgcggctttgttcacccagtcctcaacagaggagagaggacatggtgaacaaaaacctggcggcagcgcaaaagatg

SEQ ID NO: 80143 - DNA, 103 bp, Artificial Sequence
  Synthetic Polynucleotide
taatacgactcactatagggatggatcacttcgcggctttgttcacccagaacagaggagactgggtatgcaaagccgcaacctggcggcagcgcaaaagatg

SEQ ID NO: 80144 - DNA, 103 bp, Artificial Sequence
  Synthetic Polynucleotide
taatacgactcactatagggcttacatggatcacttcgcggctttgttcaaacagaggagatgaacaatgccgcgaagtaacctggcggcagcgcaaaagatg

SEQ ID NO: 80145 - DNA, 103 bp, Artificial Sequence
  Synthetic Polynucleotide
taatacgactcactataggggagggcttacatggatcacttcgcggctttaacagaggagaaaagccatgaagtgatccaacctggcggcagcgcaaaagatg

SEQ ID NO: 80146 - DNA, 103 bp, Artificial Sequence
  Synthetic Polynucleotide
taatacgactcactataggggttctgagggcttacatggatcacttcgcgaacagaggagacgcgaaatgatccatgtaaacctggcggcagcgcaaaagatg

SEQ ID NO: 80147 - DNA, 103 bp, Artificial Sequence
  Synthetic Polynucleotide
taatacgactcactataggggtaggcttgtccttagacatgatagtcacgaacagaggagacgtgacatgcatgtctaaaacctggcggcagcgcaaaagatg

SEQ ID NO: 80148 - DNA, 103 bp, Artificial Sequence
  Synthetic Polynucleotide
taatacgactcactatagggagacggttctgagggcttacatggatcactaacagaggagaagtgatatgtgtaagcccaacctggcggcagcgcaaaagatg

SEQ ID NO: 80149 - DNA, 103 bp, Artificial Sequence
  Synthetic Polynucleotide
taatacgactcactatagggttccgagacggttctgagggcttacatggaaacagaggagatccatgatggccctcagaaacctggcggcagcgcaaaagatg

SEQ ID NO: 80150 - DNA, 103 bp, Artificial Sequence
  Synthetic Polynucleotide
taatacgactcactatagggcctccttccgagacggttctgagggcttacaacagaggagagtaagcatgcagaaccgtaacctggcggcagcgcaaaagatg

SEQ ID NO: 80151 - DNA, 103 bp, Artificial Sequence
  Synthetic Polynucleotide
taatacgactcactatagggggggtcctccttccgagacggttctgagggaacagaggagaccctcaatgccgtctcggaacctggcggcagcgcaaaagatg

SEQ ID NO: 80152 - DNA, 103 bp, Artificial Sequence
  Synthetic Polynucleotide
taatacgactcactatagggcatgtggggtcctccttccgagacggttctaacagaggagaagaaccatgtcggaaggaaacctggcggcagcgcaaaagatg

SEQ ID NO: 80153 - DNA, 103 bp, Artificial Sequence
  Synthetic Polynucleotide
taatacgactcactatagggtacaacatgtggggtcctccttccgagacgaacagaggagacgtctcatgaggaggaccaacctggcggcagcgcaaaagatg

SEQ ID NO: 80154 - DNA, 103 bp, Artificial Sequence
  Synthetic Polynucleotide
taatacgactcactataggggaagttacaacatgtggggtcctccttccgaacagaggagacggaagatggaccccacaaacctggcggcagcgcaaaagatg

SEQ ID NO: 80155 - DNA, 103 bp, Artificial Sequence
  Synthetic Polynucleotide
taatacgactcactataggggctttgaagttacaacatgtggggtcctccaacagaggagaggaggaatgcacatgttgaacctggcggcagcgcaaaagatg

SEQ ID NO: 80156 - DNA, 103 bp, Artificial Sequence
  Synthetic Polynucleotide
taatacgactcactatagggattgggctttgaagttacaacatgtggggtaacagaggagaaccccaatggttgtaactaacctggcggcagcgcaaaagatg

SEQ ID NO: 80157 - DNA, 103 bp, Artificial Sequence
  Synthetic Polynucleotide
taatacgactcactatagggctgacattgggctttgaagttacaacatgtaacagaggagaacatgtatgaacttcaaaaacctggcggcagcgcaaaagatg

SEQ ID NO: 80158 - DNA, 103 bp, Artificial Sequence
  Synthetic Polynucleotide
taatacgactcactatagggcgatggtaggcttgtccttagacatgatagaacagaggagactatcaatgctaaggacaaacctggcggcagcgcaaaagatg

SEQ ID NO: 80159 - DNA, 103 bp, Artificial Sequence
  Synthetic Polynucleotide
taatacgactcactataggggtggtctgacattgggctttgaagttacaaaacagaggagattgtaaatgcaaagcccaaacctggcggcagcgcaaaagatg

SEQ ID NO: 80160 - DNA, 103 bp, Artificial Sequence
  Synthetic Polynucleotide
taatacgactcactataggggtagcgtggtctgacattgggctttgaagtaacagaggagaacttcaatgcccaatgtcaacctggcggcagcgcaaaagatg

SEQ ID NO: 80161 - DNA, 103 bp, Artificial Sequence
  Synthetic Polynucleotide
taatacgactcactatagggacgccgtagcgtggtctgacattgggctttaacagaggagaaaagccatgtgtcagaccaacctggcggcagcgcaaaagatg

SEQ ID NO: 80162 - DNA, 103 bp, Artificial Sequence
  Synthetic Polynucleotide
taatacgactcactataggggtagcacgccgtagcgtggtctgacattggaacagaggagaccaatgatggaccacgctaacctggcggcagcgcaaaagatg

SEQ ID NO: 80163 - DNA, 103 bp, Artificial Sequence
  Synthetic Polynucleotide
taatacgactcactataggggcagagtagcacgccgtagcgtggtctgacaacagaggagagtcagaatgcgctacggcaacctggcggcagcgcaaaagatg

SEQ ID NO: 80164 - DNA, 103 bp, Artificial Sequence
  Synthetic Polynucleotide
taatacgactcactatagggtctccgcagagtagcacgccgtagcgtggtaacagaggagaaccacgatgcggcgtgctaacctggcggcagcgcaaaagatg

SEQ ID NO: 80165 - DNA, 103 bp, Artificial Sequence
  Synthetic Polynucleotide
taatacgactcactatagggtgcactctccgcagagtagcacgccgtagcaacagaggagagctacgatgtgctactctaacctggcggcagcgcaaaagatg

SEQ ID NO: 80166 - DNA, 103 bp, Artificial Sequence
  Synthetic Polynucleotide
taatacgactcactatagggcagactgcactctccgcagagtagcacgccaacagaggagaggcgtgatgctctgcggaaacctggcggcagcgcaaaagatg

SEQ ID NO: 80167 - DNA, 103 bp, Artificial Sequence
  Synthetic Polynucleotide
taatacgactcactatagggtatcgcagactgcactctccgcagagtagcaacagaggagagctactatgcggagagtgaacctggcggcagcgcaaaagatg

SEQ ID NO: 80168 - DNA, 103 bp, Artificial Sequence
  Synthetic Polynucleotide
taatacgactcactatagggggcactatcgcagactgcactctccgcagaaacagaggagatctgcgatgagtgcagtcaacctggcggcagcgcaaaagatg

SEQ ID NO: 80169 - DNA, 103 bp, Artificial Sequence
  Synthetic Polynucleotide
taatacgactcactatagggcacatcgatggtaggcttgtccttagacataacagaggagaatgtctatggacaagcctaacctggcggcagcgcaaaagatg

SEQ ID NO: 80170 - DNA, 103 bp, Artificial Sequence
  Synthetic Polynucleotide
taatacgactcactatagggcctggggcactatcgcagactgcactctccaacagaggagaggagagatgagtctgcgaaacctggcggcagcgcaaaagatg

SEQ ID NO: 80171 - DNA, 103 bp, Artificial Sequence
  Synthetic Polynucleotide
taatacgactcactataggggtcctcctggggcactatcgcagactgcacaacagaggagagtgcagatggcgatagtgaacctggcggcagcgcaaaagatg

SEQ ID NO: 80172 - DNA, 103 bp, Artificial Sequence
  Synthetic Polynucleotide
taatacgactcactatagggacccagtcctcctggggcactatcgcagacaacagaggagagtctgcatgagtgccccaaacctggcggcagcgcaaaagatg

SEQ ID NO: 80173 - DNA, 103 bp, Artificial Sequence
  Synthetic Polynucleotide
taatacgactcactatagggtgttaacccagtcctcctggggcactatcgaacagaggagacgatagatgcccaggaggaacctggcggcagcgcaaaagatg

SEQ ID NO: 80174 - DNA, 103 bp, Artificial Sequence
  Synthetic Polynucleotide
taatacgactcactataggggcctttgttaacccagtcctcctggggcacaacagaggagagtgcccatggaggactggaacctggcggcagcgcaaaagatg

SEQ ID NO: 80175 - DNA, 103 bp, Artificial Sequence
  Synthetic Polynucleotide
taatacgactcactatagggggtttgcctttgttaacccagtcctcctggaacagaggagaccaggaatgctgggttaaaacctggcggcagcgcaaaagatg

SEQ ID NO: 80176 - DNA, 103 bp, Artificial Sequence
  Synthetic Polynucleotide
taatacgactcactataggggcgttggtttgcctttgttaacccagtcctaacagaggagaaggactatgttaacaaagaacctggcggcagcgcaaaagatg

SEQ ID NO: 80177 - DNA, 103 bp, Artificial Sequence
  Synthetic Polynucleotide
taatacgactcactataggggtggggcgttggtttgcctttgttaacccaaacagaggagatgggttatgaaaggcaaaaacctggcggcagcgcaaaagatg

SEQ ID NO: 80178 - DNA, 103 bp, Artificial Sequence
  Synthetic Polynucleotide
taatacgactcactataggggccgcgtggggcgttggtttgcctttgttaaacagaggagataacaaatgcaaaccaacaacctggcggcagcgcaaaagatg

SEQ ID NO: 80179 - DNA, 103 bp, Artificial Sequence
  Synthetic Polynucleotide
taatacgactcactatagggctagggccgcgtggggcgttggtttgccttaacagaggagaaaggcaatgcaacgccccaacctggcggcagcgcaaaagatg

SEQ ID NO: 80180 - DNA, 103 bp, Artificial Sequence
  Synthetic Polynucleotide
taatacgactcactatagggatcttcacatcgatggtaggcttgtccttaaacagaggagataaggaatggcctaccataacctggcggcagcgcaaaagatg

SEQ ID NO: 80181 - DNA, 103 bp, Artificial Sequence
  Synthetic Polynucleotide
taatacgactcactatagggcggggctagggccgcgtggggcgttggtttaacagaggagaaaaccaatgccccacgcgaacctggcggcagcgcaaaagatg

SEQ ID NO: 80182 - DNA, 103 bp, Artificial Sequence
  Synthetic Polynucleotide
taatacgactcactatagggattaccggggctagggccgcgtggggcgttaacagaggagaaacgccatgcgcggccctaacctggcggcagcgcaaaagatg

SEQ ID NO: 80183 - DNA, 103 bp, Artificial Sequence
  Synthetic Polynucleotide
taatacgactcactatagggacaccattaccggggctagggccgcgtgggaacagaggagacccacgatgccctagcccaacctggcggcagcgcaaaagatg

SEQ ID NO: 80184 - DNA, 103 bp, Artificial Sequence
  Synthetic Polynucleotide
taatacgactcactatagggggttaacaccattaccggggctagggccgcaacagaggagagcggccatggccccggtaaacctggcggcagcgcaaaagatg

SEQ ID NO: 80185 - DNA, 103 bp, Artificial Sequence
  Synthetic Polynucleotide
taatacgactcactataggggccctggttaacaccattaccggggctaggaacagaggagacctagcatgggtaatggtaacctggcggcagcgcaaaagatg

SEQ ID NO: 80186 - DNA, 103 bp, Artificial Sequence
  Synthetic Polynucleotide
taatacgactcactatagggctttcgccctggttaacaccattaccggggaacagaggagaccccggatgtggtgttaaaacctggcggcagcgcaaaagatg

SEQ ID NO: 80187 - DNA, 103 bp, Artificial Sequence
  Synthetic Polynucleotide
taatacgactcactatagggtagtcctttcgccctggttaacaccattacaacagaggagagtaatgatgttaaccaggaacctggcggcagcgcaaaagatg

SEQ ID NO: 80188 - DNA, 103 bp, Artificial Sequence
  Synthetic Polynucleotide
taatacgactcactatagggacctctagtcctttcgccctggttaacaccaacagaggagaggtgttatgcagggcgaaaacctggcggcagcgcaaaagatg

SEQ ID NO: 80189 - DNA, 103 bp, Artificial Sequence
  Synthetic Polynucleotide
taatacgactcactatagggctctaacctctagtcctttcgccctggttaaacagaggagataaccaatgcgaaaggacaacctggcggcagcgcaaaagatg

SEQ ID NO: 80190 - DNA, 103 bp, Artificial Sequence
  Synthetic Polynucleotide
taatacgactcactataggggtctcctctaacctctagtcctttcgccctaacagaggagaagggcgatgggactagagaacctggcggcagcgcaaaagatg

SEQ ID NO: 80191 - DNA, 103 bp, Artificial Sequence
  Synthetic Polynucleotide
taatacgactcactatagggtcatcatcttcacatcgatggtaggcttgtaacagaggagaacaagcatgccatcgatgaacctggcggcagcgcaaaagatg

SEQ ID NO: 80192 - DNA, 103 bp, Artificial Sequence
  Synthetic Polynucleotide
taatacgactcactataggggcggggtctcctctaacctctagtcctttcaacagaggagagaaaggatgagaggttagaacctggcggcagcgcaaaagatg

SEQ ID NO: 80193 - DNA, 103 bp, Artificial Sequence
  Synthetic Polynucleotide
taatacgactcactatagggaaaccgcggggtctcctctaacctctagtcaacagaggagagactagatgttagaggagaacctggcggcagcgcaaaagatg

SEQ ID NO: 80194 - DNA, 103 bp, Artificial Sequence
  Synthetic Polynucleotide
taatacgactcactatagggactttaaaccgcggggtctcctctaacctcaacagaggagagaggttatgggagaccccaacctggcggcagcgcaaaagatg

SEQ ID NO: 80195 - DNA, 103 bp, Artificial Sequence
  Synthetic Polynucleotide
taatacgactcactatagggcgtgcactttaaaccgcggggtctcctctaaacagaggagatagaggatgccccgcggtaacctggcggcagcgcaaaagatg

SEQ ID NO: 80196 - DNA, 103 bp, Artificial Sequence
  Synthetic Polynucleotide
taatacgactcactatagggtgggccgtgcactttaaaccgcggggtctcaacagaggagagagaccatgcggtttaaaaacctggcggcagcgcaaaagatg

SEQ ID NO: 80197 - DNA, 103 bp, Artificial Sequence
  Synthetic Polynucleotide
taatacgactcactatagggcaggctgggccgtgcactttaaaccgcgggaacagaggagacccgcgatgtaaagtgcaaacctggcggcagcgcaaaagatg

SEQ ID NO: 80198 - DNA, 103 bp, Artificial Sequence
  Synthetic Polynucleotide
taatacgactcactatagggtcagccaggctgggccgtgcactttaaaccaacagaggagaggtttaatgtgcacggccaacctggcggcagcgcaaaagatg

SEQ ID NO: 80199 - DNA, 103 bp, Artificial Sequence
  Synthetic Polynucleotide
taatacgactcactatagggcagcttcagccaggctgggccgtgcactttaacagaggagaaaagtgatgggcccagccaacctggcggcagcgcaaaagatg

SEQ ID NO: 80200 - DNA, 103 bp, Artificial Sequence
  Synthetic Polynucleotide
taatacgactcactatagggacctacagcttcagccaggctgggccgtgcaacagaggagagcacggatgagcctggctaacctggcggcagcgcaaaagatg

SEQ ID NO: 80201 - DNA, 103 bp, Artificial Sequence
  Synthetic Polynucleotide
taatacgactcactatagggccctgacctacagcttcagccaggctgggcaacagaggagagcccagatgggctgaagcaacctggcggcagcgcaaaagatg

SEQ ID NO: 80202 - DNA, 103 bp, Artificial Sequence
  Synthetic Polynucleotide
taatacgactcactatagggcatattcatcatcttcacatcgatggtaggaacagaggagacctaccatggatgtgaagaacctggcggcagcgcaaaagatg

SEQ ID NO: 80203 - DNA, 103 bp, Artificial Sequence
  Synthetic Polynucleotide
taatacgactcactatagggccttcccctgacctacagcttcagccaggcaacagaggagagcctggatgaagctgtagaacctggcggcagcgcaaaagatg

SEQ ID NO: 80204 - DNA, 103 bp, Artificial Sequence
  Synthetic Polynucleotide
taatacgactcactatagggctagtccttcccctgacctacagcttcagcaacagaggagagctgaaatggtaggtcagaacctggcggcagcgcaaaagatg

SEQ ID NO: 80205 - DNA, 103 bp, Artificial Sequence
  Synthetic Polynucleotide
taatacgactcactatagggaacctctagtccttcccctgacctacagctaacagaggagaagctgtatgtcaggggaaaacctggcggcagcgcaaaagatg

SEQ ID NO: 80206 - DNA, 103 bp, Artificial Sequence
  Synthetic Polynucleotide
taatacgactcactatagggccactaacctctagtccttcccctgacctaaacagaggagataggtcatgggaaggactaacctggcggcagcgcaaaagatg

SEQ ID NO: 80207 - DNA, 103 bp, Artificial Sequence
  Synthetic Polynucleotide
taatacgactcactatagggggtctccactaacctctagtccttcccctgaacagaggagacaggggatggactagaggaacctggcggcagcgcaaaagatg

SEQ ID NO: 80208 - DNA, 103 bp, Artificial Sequence
  Synthetic Polynucleotide
taatacgactcactatagggcacggggtctccactaacctctagtccttcaacagaggagagaaggaatggaggttagtaacctggcggcagcgcaaaagatg

SEQ ID NO: 80209 - DNA, 103 bp, Artificial Sequence
  Synthetic Polynucleotide
taatacgactcactatagggtgtggcacggggtctccactaacctctagtaacagaggagaactagaatgtagtggagaaacctggcggcagcgcaaaagatg

SEQ ID NO: 80210 - DNA, 103 bp, Artificial Sequence
  Synthetic Polynucleotide
taatacgactcactatagggtgttttgtggcacggggtctccactaacctaacagaggagaaggttaatggagaccccgaacctggcggcagcgcaaaagatg

SEQ ID NO: 80211 - DNA, 103 bp, Artificial Sequence
  Synthetic Polynucleotide
taatacgactcactatagggtgtggtgttttgtggcacggggtctccactaacagaggagaagtggaatgcccgtgccaaacctggcggcagcgcaaaagatg

SEQ ID NO: 80212 - DNA, 103 bp, Artificial Sequence
  Synthetic Polynucleotide
taatacgactcactatagggtttgttgtggtgttttgtggcacggggtctaacagaggagaagacccatggccacaaaaaacctggcggcagcgcaaaagatg

SEQ ID NO: 80213 - DNA, 103 bp, Artificial Sequence
  Synthetic Polynucleotide
taatacgactcactataggggcctccatattcatcatcttcacatcgatgaacagaggagacatcgaatggaagatgataacctggcggcagcgcaaaagatg

SEQ ID NO: 80214 - DNA, 103 bp, Artificial Sequence
  Synthetic Polynucleotide
taatacgactcactataggggctgttttgttgtggtgttttgtggcacggaacagaggagaccgtgcatgaaaacaccaaacctggcggcagcgcaaaagatg

SEQ ID NO: 80215 - DNA, 103 bp, Artificial Sequence
  Synthetic Polynucleotide
taatacgactcactatagggaatatgctgttttgttgtggtgttttgtggaacagaggagaccacaaatgaccacaacaaacctggcggcagcgcaaaagatg

SEQ ID NO: 80216 - DNA, 103 bp, Artificial Sequence
  Synthetic Polynucleotide
taatacgactcactataggggtgtcaatatgctgttttgttgtggtgtttaacagaggagaaaacacatgaacaaaacaaacctggcggcagcgcaaaagatg

SEQ ID NO: 80217 - DNA, 103 bp, Artificial Sequence
  Synthetic Polynucleotide
taatacgactcactatagggcccaggtgtcaatatgctgttttgttgtggaacagaggagaccacaaatgaacagcataaacctggcggcagcgcaaaagatg

SEQ ID NO: 80218 - DNA, 103 bp, Artificial Sequence
  Synthetic Polynucleotide
taatacgactcactatagggtctatcccaggtgtcaatatgctgttttgtaacagaggagaacaaaaatgcatattgacaacctggcggcagcgcaaaagatg

SEQ ID NO: 80219 - DNA, 103 bp, Artificial Sequence
  Synthetic Polynucleotide
taatacgactcactatagggcctagtctatcccaggtgtcaatatgctgtaacagaggagaacagcaatgtgacacctgaacctggcggcagcgcaaaagatg

SEQ ID NO: 80220 - DNA, 103 bp, Artificial Sequence
  Synthetic Polynucleotide
taatacgactcactataggggatctcctagtctatcccaggtgtcaatataacagaggagaatattgatgcctgggataaacctggcggcagcgcaaaagatg

SEQ ID NO: 80221 - DNA, 103 bp, Artificial Sequence
  Synthetic Polynucleotide
taatacgactcactatagggcagaagatctcctagtctatcccaggtgtcaacagaggagagacaccatggatagactaaacctggcggcagcgcaaaagatg

SEQ ID NO: 80222 - DNA, 103 bp, Artificial Sequence
  Synthetic Polynucleotide
taatacgactcactatagggcagagcagaagatctcctagtctatcccagaacagaggagactgggaatgactaggagaaacctggcggcagcgcaaaagatg

SEQ ID NO: 80223 - DNA, 103 bp, Artificial Sequence
  Synthetic Polynucleotide
taatacgactcactatagggttgtgcagagcagaagatctcctagtctataacagaggagaatagacatggagatcttcaacctggcggcagcgcaaaagatg

SEQ ID NO: 80224 - DNA, 103 bp, Artificial Sequence
  Synthetic Polynucleotide
taatacgactcactatagggtggccgcctccatattcatcatcttcacataacagaggagaatgtgaatgtgatgaataaacctggcggcagcgcaaaagatg

SEQ ID NO: 80225 - DNA, 103 bp, Artificial Sequence
  Synthetic Polynucleotide
taatacgactcactataggggctggttgtgcagagcagaagatctcctagaacagaggagactaggaatgcttctgctcaacctggcggcagcgcaaaagatg

SEQ ID NO: 80226 - DNA, 103 bp, Artificial Sequence
  Synthetic Polynucleotide
taatacgactcactataggggtgtggctggttgtgcagagcagaagatctaacagaggagaagatctatggctctgcacaacctggcggcagcgcaaaagatg

SEQ ID NO: 80227 - DNA, 103 bp, Artificial Sequence
  Synthetic Polynucleotide
taatacgactcactataggggtgccgtgtggctggttgtgcagagcagaaaacagaggagattctgcatggcacaaccaaacctggcggcagcgcaaaagatg

SEQ ID NO: 80228 - DNA, 103 bp, Artificial Sequence
  Synthetic Polynucleotide
taatacgactcactataggggcactgtgccgtgtggctggttgtgcagagaacagaggagactctgcatgaccagccacaacctggcggcagcgcaaaagatg

SEQ ID NO: 80229 - DNA, 103 bp, Artificial Sequence
  Synthetic Polynucleotide
taatacgactcactatagggtcggcgcactgtgccgtgtggctggttgtgaacagaggagacacaacatgccacacggcaacctggcggcagcgcaaaagatg

SEQ ID NO: 80230 - DNA, 103 bp, Artificial Sequence
  Synthetic Polynucleotide
taatacgactcactatagggcattgtcggcgcactgtgccgtgtggctggaacagaggagaccagccatgcggcacagtaacctggcggcagcgcaaaagatg

SEQ ID NO: 80231 - DNA, 103 bp, Artificial Sequence
  Synthetic Polynucleotide
taatacgactcactataggggccaccattgtcggcgcactgtgccgtgtgaacagaggagacacacgatgcagtgcgccaacctggcggcagcgcaaaagatg

SEQ ID NO: 80232 - DNA, 103 bp, Artificial Sequence
  Synthetic Polynucleotide
taatacgactcactatagggcaccagccaccattgtcggcgcactgtgccaacagaggagaggcacaatgcgccgacaaaacctggcggcagcgcaaaagatg

SEQ ID NO: 80233 - DNA, 103 bp, Artificial Sequence
  Synthetic Polynucleotide
taatacgactcactatagggcgcaccaccagccaccattgtcggcgcactaacagaggagaagtgcgatgacaatggtgaacctggcggcagcgcaaaagatg

SEQ ID NO: 80234 - DNA, 103 bp, Artificial Sequence
  Synthetic Polynucleotide
taatacgactcactataggggttctcgcaccaccagccaccattgtcggcaacagaggagagccgacatgggtggctggaacctggcggcagcgcaaaagatg

SEQ ID NO: 80235 - DNA, 103 bp, Artificial Sequence
  Synthetic Polynucleotide
taatacgactcactatagggagcccggctcttgccgggccctcctggtttaacagaggagaaaaccaatggggcccggcaacctggcggcagcgcaaaagatg

SEQ ID NO: 80236 - DNA, 103 bp, Artificial Sequence
  Synthetic Polynucleotide
taatacgactcactatagggcaggttggccgcctccatattcatcatcttaacagaggagaaagatgatgaatatggagaacctggcggcagcgcaaaagatg

SEQ ID NO: 80237 - DNA, 103 bp, Artificial Sequence
  Synthetic Polynucleotide
taatacgactcactatagggcctgtgttctcgcaccaccagccaccattgaacagaggagacaatggatgctggtggtgaacctggcggcagcgcaaaagatg

SEQ ID NO: 80238 - DNA, 103 bp, Artificial Sequence
  Synthetic Polynucleotide
taatacgactcactatagggtctgccaggttggccgcctccatattcatcaacagaggagagatgaaatgggaggcggcaacctggcggcagcgcaaaagatg

SEQ ID NO: 80239 - DNA, 103 bp, Artificial Sequence
  Synthetic Polynucleotide
taatacgactcactatagggggacctctgccaggttggccgcctccatataacagaggagaatatggatgcggccaaccaacctggcggcagcgcaaaagatg

SEQ ID NO: 80240 - DNA, 103 bp, Artificial Sequence
  Synthetic Polynucleotide
taatacgactcactatagggactgcggacctctgccaggttggccgcctcaacagaggagagaggcgatgaacctggcaaacctggcggcagcgcaaaagatg

SEQ ID NO: 80241 - DNA, 103 bp, Artificial Sequence
  Synthetic Polynucleotide
taatacgactcactatagggcaataactgcggacctctgccaggttggccaacagaggagaggccaaatgggcagaggtaacctggcggcagcgcaaaagatg

SEQ ID NO: 80242 - DNA, 103 bp, Artificial Sequence
  Synthetic Polynucleotide
taatacgactcactatagggaatagcaataactgcggacctctgccaggtaacagaggagaacctggatgaggtccgcaaacctggcggcagcgcaaaagatg

SEQ ID NO: 80243 - DNA, 103 bp, Artificial Sequence
  Synthetic Polynucleotide
taatacgactcactatagggagccaaatagcaataactgcggacctctgcaacagaggagagcagagatgcgcagttataacctggcggcagcgcaaaagatg

SEQ ID NO: 80244 - DNA, 103 bp, Artificial Sequence
  Synthetic Polynucleotide
taatacgactcactatagggacggtagccaaatagcaataactgcggaccaacagaggagaggtccgatgttattgctaaacctggcggcagcgcaaaagatg

SEQ ID NO: 80245 - DNA, 103 bp, Artificial Sequence
  Synthetic Polynucleotide
taatacgactcactatagggcgctgacggtagccaaatagcaataactgcaacagaggagagcagttatggctatttggaacctggcggcagcgcaaaagatg

SEQ ID NO: 80246 - DNA, 103 bp, Artificial Sequence
  Synthetic Polynucleotide
taatacgactcactataggggagatcgctgacggtagccaaatagcaataaacagaggagatattgcatgttggctaccaacctggcggcagcgcaaaagatg

SEQ ID NO: 80247 - DNA, 103 bp, Artificial Sequence
  Synthetic Polynucleotide
taatacgactcactatagggttgacagcccggctcttgccgggccctcctaacagaggagaaggaggatgcggcaagagaacctggcggcagcgcaaaagatg

SEQ ID NO: 80248 - DNA, 103 bp, Artificial Sequence
  Synthetic Polynucleotide
taatacgactcactataggggtggagagatcgctgacggtagccaaatagaacagaggagactatttatgtaccgtcagaacctggcggcagcgcaaaagatg

SEQ ID NO: 80249 - DNA, 103 bp, Artificial Sequence
  Synthetic Polynucleotide
taatacgactcactatagggctttggtggagagatcgctgacggtagccaaacagaggagatggctaatgtcagcgatcaacctggcggcagcgcaaaagatg

SEQ ID NO: 80250 - DNA, 103 bp, Artificial Sequence
  Synthetic Polynucleotide
taatacgactcactatagggcgcagctttggtggagagatcgctgacggtaacagaggagaaccgtcatggatctctccaacctggcggcagcgcaaaagatg

SEQ ID NO: 80251 - DNA, 103 bp, Artificial Sequence
  Synthetic Polynucleotide
taatacgactcactataggggggcacgcagctttggtggagagatcgctgaacagaggagacagcgaatgctccaccaaaacctggcggcagcgcaaaagatg

SEQ ID NO: 80252 - DNA, 103 bp, Artificial Sequence
  Synthetic Polynucleotide
taatacgactcactatagggtggtcgggcacgcagctttggtggagagataacagaggagaatctctatgccaaagctgaacctggcggcagcgcaaaagatg

SEQ ID NO: 80253 - DNA, 103 bp, Artificial Sequence
  Synthetic Polynucleotide
taatacgactcactatagggtcccatggtcgggcacgcagctttggtggaaacagaggagatccaccatggctgcgtgcaacctggcggcagcgcaaaagatg

SEQ ID NO: 80254 - DNA, 103 bp, Artificial Sequence
  Synthetic Polynucleotide
taatacgactcactataggggcttctcccatggtcgggcacgcagctttgaacagaggagacaaagcatggtgcccgacaacctggcggcagcgcaaaagatg

SEQ ID NO: 80255 - DNA, 103 bp, Artificial Sequence
  Synthetic Polynucleotide
taatacgactcactatagggtgtgagcttctcccatggtcgggcacgcagaacagaggagactgcgtatgcgaccatggaacctggcggcagcgcaaaagatg

SEQ ID NO: 80256 - DNA, 103 bp, Artificial Sequence
  Synthetic Polynucleotide
taatacgactcactataggggtcattgtgagcttctcccatggtcgggcaaacagaggagatgcccgatgatgggagaaaacctggcggcagcgcaaaagatg

SEQ ID NO: 80257 - DNA, 103 bp, Artificial Sequence
  Synthetic Polynucleotide
taatacgactcactatagggcgtttgtcattgtgagcttctcccatggtcaacagaggagagaccatatgagaagctcaaacctggcggcagcgcaaaagatg

SEQ ID NO: 80258 - DNA, 103 bp, Artificial Sequence
  Synthetic Polynucleotide
taatacgactcactataggggcatattgacagcccggctcttgccgggccaacagaggagaggcccgatgagagccgggaacctggcggcagcgcaaaagatg

SEQ ID NO: 80259 - DNA, 103 bp, Artificial Sequence
  Synthetic Polynucleotide
taatacgactcactatagggcagcacgtttgtcattgtgagcttctcccaaacagaggagatgggagatgctcacaatgaacctggcggcagcgcaaaagatg

SEQ ID NO: 80260 - DNA, 103 bp, Artificial Sequence
  Synthetic Polynucleotide
taatacgactcactatagggtgggtcagcacgtttgtcattgtgagcttcaacagaggagagaagctatgaatgacaaaaacctggcggcagcgcaaaagatg

SEQ ID NO: 80261 - DNA, 103 bp, Artificial Sequence
  Synthetic Polynucleotide
taatacgactcactatagggaaagctgggtcagcacgtttgtcattgtgaaacagaggagatcacaaatgcaaacgtgcaacctggcggcagcgcaaaagatg

SEQ ID NO: 80262 - DNA, 103 bp, Artificial Sequence
  Synthetic Polynucleotide
taatacgactcactatagggacacaaaagctgggtcagcacgtttgtcataacagaggagaatgacaatggtgctgaccaacctggcggcagcgcaaaagatg

SEQ ID NO: 80263 - DNA, 103 bp, Artificial Sequence
  Synthetic Polynucleotide
taatacgactcactatagggtctgcacacaaaagctgggtcagcacgtttaacagaggagaaaacgtatggacccagctaacctggcggcagcgcaaaagatg

SEQ ID NO: 80264 - DNA, 103 bp, Artificial Sequence
  Synthetic Polynucleotide
taatacgactcactatagggccttgtctgcacacaaaagctgggtcagcaaacagaggagatgctgaatgagcttttgtaacctggcggcagcgcaaaagatg

SEQ ID NO: 80265 - DNA, 103 bp, Artificial Sequence
  Synthetic Polynucleotide
taatacgactcactatagggccactccttgtctgcacacaaaagctgggtaacagaggagaacccagatgttgtgtgcaaacctggcggcagcgcaaaagatg

SEQ ID NO: 80266 - DNA, 103 bp, Artificial Sequence
  Synthetic Polynucleotide
taatacgactcactataggggtccaccactccttgtctgcacacaaaagcaacagaggagagcttttatgtgcagacaaaacctggcggcagcgcaaaagatg

SEQ ID NO: 80267 - DNA, 103 bp, Artificial Sequence
  Synthetic Polynucleotide
taatacgactcactatagggcccctgtccaccactccttgtctgcacacaaacagaggagatgtgtgatgacaaggagtaacctggcggcagcgcaaaagatg

SEQ ID NO: 80268 - DNA, 103 bp, Artificial Sequence
  Synthetic Polynucleotide
taatacgactcactatagggcccagcccctgtccaccactccttgtctgcaacagaggagagcagacatggagtggtggaacctggcggcagcgcaaaagatg

SEQ ID NO: 80269 - DNA, 103 bp, Artificial Sequence
  Synthetic Polynucleotide
taatacgactcactatagggttttagcatattgacagcccggctcttgccaacagaggagaggcaagatgcgggctgtcaacctggcggcagcgcaaaagatg

SEQ ID NO: 80270 - DNA, 103 bp, Artificial Sequence
  Synthetic Polynucleotide
taatacgactcactataggggttgccccagcccctgtccaccactccttgaacagaggagacaaggaatggtggacaggaacctggcggcagcgcaaaagatg

SEQ ID NO: 80271 - DNA, 103 bp, Artificial Sequence
  Synthetic Polynucleotide
taatacgactcactatagggcagccgttgccccagcccctgtccaccactaacagaggagaagtggtatgcaggggctgaacctggcggcagcgcaaaagatg

SEQ ID NO: 80272 - DNA, 103 bp, Artificial Sequence
  Synthetic Polynucleotide
taatacgactcactataggggtccgcagccgttgccccagcccctgtccaaacagaggagatggacaatggctggggcaaacctggcggcagcgcaaaagatg

SEQ ID NO: 80273 - DNA, 103 bp, Artificial Sequence
  Synthetic Polynucleotide
taatacgactcactatagggaaatagtccgcagccgttgccccagcccctaacagaggagaaggggcatgggcaacggcaacctggcggcagcgcaaaagatg

SEQ ID NO: 80274 - DNA, 103 bp, Artificial Sequence
  Synthetic Polynucleotide
taatacgactcactatagggttgccaaatagtccgcagccgttgccccagaacagaggagactggggatgcggctgcggaacctggcggcagcgcaaaagatg

SEQ ID NO: 80275 - DNA, 103 bp, Artificial Sequence
  Synthetic Polynucleotide
taatacgactcactatagggttcctttgccaaatagtccgcagccgttgcaacagaggagagcaacgatggcggactataacctggcggcagcgcaaaagatg

SEQ ID NO: 80276 - DNA, 103 bp, Artificial Sequence
  Synthetic Polynucleotide
taatacgactcactatagggaatgcttcctttgccaaatagtccgcagccaacagaggagaggctgcatgctatttggcaacctggcggcagcgcaaaagatg

SEQ ID NO: 80277 - DNA, 103 bp, Artificial Sequence
  Synthetic Polynucleotide
taatacgactcactataggggtgtcaatgcttcctttgccaaatagtccgaacagaggagacggactatgtggcaaaggaacctggcggcagcgcaaaagatg

SEQ ID NO: 80278 - DNA, 103 bp, Artificial Sequence
  Synthetic Polynucleotide
taatacgactcactatagggcgcatgtgtcaatgcttcctttgccaaataaacagaggagatatttgatgaaggaagcaaacctggcggcagcgcaaaagatg

SEQ ID NO: 80279 - DNA, 103 bp, Artificial Sequence
  Synthetic Polynucleotide
taatacgactcactatagggtttggcgcatgtgtcaatgcttcctttgccaacagaggagaggcaaaatgagcattgacaacctggcggcagcgcaaaagatg

SEQ ID NO: 80280 - DNA, 103 bp, Artificial Sequence
  Synthetic Polynucleotide
taatacgactcactatagggccgcgttttagcatattgacagcccggctcaacagaggagagagccgatgtgtcaatataacctggcggcagcgcaaaagatg

SEQ ID NO: 80281 - DNA, 103 bp, Artificial Sequence
  Synthetic Polynucleotide
taatacgactcactataggggcaaatttggcgcatgtgtcaatgcttcctaacagaggagaaggaagatgtgacacatgaacctggcggcagcgcaaaagatg

SEQ ID NO: 80282 - DNA, 103 bp, Artificial Sequence
  Synthetic Polynucleotide
taatacgactcactatagggagcaggcaaatttggcgcatgtgtcaatgcaacagaggagagcattgatgcatgcgccaaacctggcggcagcgcaaaagatg

SEQ ID NO: 80283 - DNA, 103 bp, Artificial Sequence
  Synthetic Polynucleotide
taatacgactcactatagggggtagagcaggcaaatttggcgcatgtgtcaacagaggagagacacaatggccaaatttaacctggcggcagcgcaaaagatg

SEQ ID NO: 80284 - DNA, 103 bp, Artificial Sequence
  Synthetic Polynucleotide
taatacgactcactataggggccttggtagagcaggcaaatttggcgcataacagaggagaatgcgcatgatttgcctgaacctggcggcagcgcaaaagatg

SEQ ID NO: 80285 - DNA, 103 bp, Artificial Sequence
  Synthetic Polynucleotide
taatacgactcactatagggctattgccttggtagagcaggcaaatttggaacagaggagaccaaatatgcctgctctaaacctggcggcagcgcaaaagatg

SEQ ID NO: 80286 - DNA, 103 bp, Artificial Sequence
  Synthetic Polynucleotide
taatacgactcactatagggtcttcctattgccttggtagagcaggcaaaaacagaggagatttgccatgtctaccaagaacctggcggcagcgcaaaagatg

SEQ ID NO: 80287 - DNA, 103 bp, Artificial Sequence
  Synthetic Polynucleotide
taatacgactcactatagggatggttcttcctattgccttggtagagcagaacagaggagactgctcatgcaaggcaataacctggcggcagcgcaaaagatg

SEQ ID NO: 80288 - DNA, 103 bp, Artificial Sequence
  Synthetic Polynucleotide
taatacgactcactatagggtcaagatggttcttcctattgccttggtagaacagaggagactaccaatgcaataggaaaacctggcggcagcgcaaaagatg

SEQ ID NO: 80289 - DNA, 103 bp, Artificial Sequence
  Synthetic Polynucleotide
taatacgactcactatagggctctttcaagatggttcttcctattgccttaacagaggagaaaggcaatgggaagaaccaacctggcggcagcgcaaaagatg

SEQ ID NO: 80290 - DNA, 103 bp, Artificial Sequence
  Synthetic Polynucleotide
taatacgactcactatagggatattctctttcaagatggttcttcctattaacagaggagaaataggatgaaccatcttaacctggcggcagcgcaaaagatg

SEQ ID NO: 80291 - DNA, 103 bp, Artificial Sequence
  Synthetic Polynucleotide
taatacgactcactataggggcattccgcgttttagcatattgacagcccaacagaggagagggctgatgatatgctaaaacctggcggcagcgcaaaagatg

SEQ ID NO: 80292 - DNA, 103 bp, Artificial Sequence
  Synthetic Polynucleotide
taatacgactcactatagggacttgatattctctttcaagatggttcttcaacagaggagagaagaaatgtcttgaaagaacctggcggcagcgcaaaagatg

SEQ ID NO: 80293 - DNA, 103 bp, Artificial Sequence
  Synthetic Polynucleotide
taatacgactcactatagggttcgtacttgatattctctttcaagatggtaacagaggagaaccatcatgaaagagaataacctggcggcagcgcaaaagatg

SEQ ID NO: 80294 - DNA, 103 bp, Artificial Sequence
  Synthetic Polynucleotide
taatacgactcactataggggccacttcgtacttgatattctctttcaagaacagaggagacttgaaatggaatatcaaaacctggcggcagcgcaaaagatg

SEQ ID NO: 80295 - DNA, 103 bp, Artificial Sequence
  Synthetic Polynucleotide
taatacgactcactatagggaaatggccacttcgtacttgatattctcttaacagaggagaaagagaatgtcaagtacgaacctggcggcagcgcaaaagatg

SEQ ID NO: 80296 - DNA, 103 bp, Artificial Sequence
  Synthetic Polynucleotide
taatacgactcactataggggacaaaaatggccacttcgtacttgatattaacagaggagaaatatcatgtacgaagtgaacctggcggcagcgcaaaagatg

SEQ ID NO: 80297 - DNA, 103 bp, Artificial Sequence
  Synthetic Polynucleotide
taatacgactcactatagggccatggacaaaaatggccacttcgtacttgaacagaggagacaagtaatgagtggccataacctggcggcagcgcaaaagatg

SEQ ID NO: 80298 - DNA, 103 bp, Artificial Sequence
  Synthetic Polynucleotide
taatacgactcactatagggttggtccatggacaaaaatggccacttcgtaacagaggagaacgaagatgccatttttgaacctggcggcagcgcaaaagatg

SEQ ID NO: 80299 - DNA, 103 bp, Artificial Sequence
  Synthetic Polynucleotide
taatacgactcactatagggagtagttggtccatggacaaaaatggccacaacagaggagagtggccatgtttgtccataacctggcggcagcgcaaaagatg

SEQ ID NO: 80300 - DNA, 103 bp, Artificial Sequence
  Synthetic Polynucleotide
taatacgactcactatagggtccacagtagttggtccatggacaaaaatgaacagaggagacattttatgccatggaccaacctggcggcagcgcaaaagatg

SEQ ID NO: 80301 - DNA, 103 bp, Artificial Sequence
  Synthetic Polynucleotide
taatacgactcactataggggcgactccacagtagttggtccatggacaaaacagaggagattgtccatggaccaactaaacctggcggcagcgcaaaagatg

SEQ ID NO: 80302 - DNA, 103 bp, Artificial Sequence
  Synthetic Polynucleotide
taatacgactcactataggggcggggcattccgcgttttagcatattgacaacagaggagagtcaatatgctaaaacgcaacctggcggcagcgcaaaagatg

SEQ ID NO: 80303 - DNA, 103 bp, Artificial Sequence
  Synthetic Polynucleotide
taatacgactcactatagggtccgtgcgactccacagtagttggtccatgaacagaggagacatggaatgactactgtgaacctggcggcagcgcaaaagatg

SEQ ID NO: 80304 - DNA, 103 bp, Artificial Sequence
  Synthetic Polynucleotide
taatacgactcactatagggtagtttccgtgcgactccacagtagttggtaacagaggagaaccaacatgtgtggagtcaacctggcggcagcgcaaaagatg

SEQ ID NO: 80305 - DNA, 103 bp, Artificial Sequence
  Synthetic Polynucleotide
taatacgactcactatagggtggagtagtttccgtgcgactccacagtagaacagaggagactactgatgagtcgcacgaacctggcggcagcgcaaaagatg

SEQ ID NO: 80306 - DNA, 103 bp, Artificial Sequence
  Synthetic Polynucleotide
taatacgactcactatagggctgtgtggagtagtttccgtgcgactccacaacagaggagagtggagatgcacggaaacaacctggcggcagcgcaaaagatg

SEQ ID NO: 80307 - DNA, 103 bp, Artificial Sequence
  Synthetic Polynucleotide
taatacgactcactatagggccaacctgtgtggagtagtttccgtgcgacaacagaggagagtcgcaatgaaactactcaacctggcggcagcgcaaaagatg

SEQ ID NO: 80308 - DNA, 103 bp, Artificial Sequence
  Synthetic Polynucleotide
taatacgactcactatagggtggctccaacctgtgtggagtagtttccgtaacagaggagaacggaaatgactccacacaacctggcggcagcgcaaaagatg

SEQ ID NO: 80309 - DNA, 103 bp, Artificial Sequence
  Synthetic Polynucleotide
taatacgactcactatagggctgagtggctccaacctgtgtggagtagttaacagaggagaaactacatgacacaggttaacctggcggcagcgcaaaagatg

SEQ ID NO: 80310 - DNA, 103 bp, Artificial Sequence
  Synthetic Polynucleotide
taatacgactcactatagggcctgcctgagtggctccaacctgtgtggagaacagaggagactccacatgggttggagcaacctggcggcagcgcaaaagatg

SEQ ID NO: 80311 - DNA, 103 bp, Artificial Sequence
  Synthetic Polynucleotide
taatacgactcactataggggtctccctgcctgagtggctccaacctgtgaacagaggagacacaggatggagccactcaacctggcggcagcgcaaaagatg

SEQ ID NO: 80312 - DNA, 103 bp, Artificial Sequence
  Synthetic Polynucleotide
taatacgactcactataggggctgagtctccctgcctgagtggctccaacaacagaggagagttggaatgactcaggcaaacctggcggcagcgcaaaagatg

SEQ ID NO: 80313 - DNA, 103 bp, Artificial Sequence
  Synthetic Polynucleotide
taatacgactcactatagggaacacgcggggcattccgcgttttagcataaacagaggagatatgctatgacgcggaataacctggcggcagcgcaaaagatg

SEQ ID NO: 80314 - DNA, 103 bp, Artificial Sequence
  Synthetic Polynucleotide
taatacgactcactataggggtgatgctgagtctccctgcctgagtggctaacagaggagaagccacatgggcagggagaacctggcggcagcgcaaaagatg

SEQ ID NO: 80315 - DNA, 103 bp, Artificial Sequence
  Synthetic Polynucleotide
taatacgactcactatagggcaggagtgatgctgagtctccctgcctgagaacagaggagactcaggatgggagactcaaacctggcggcagcgcaaaagatg

SEQ ID NO: 80316 - DNA, 103 bp, Artificial Sequence
  Synthetic Polynucleotide
taatacgactcactatagggcgccgcaggagtgatgctgagtctccctgcaacagaggagagcagggatgctcagcatcaacctggcggcagcgcaaaagatg

SEQ ID NO: 80317 - DNA, 103 bp, Artificial Sequence
  Synthetic Polynucleotide
taatacgactcactataggggaaggcgccgcaggagtgatgctgagtctcaacagaggagagagactatgcatcactccaacctggcggcagcgcaaaagatg

SEQ ID NO: 80318 - DNA, 103 bp, Artificial Sequence
  Synthetic Polynucleotide
taatacgactcactatagggtgtatgaaggcgccgcaggagtgatgctgaaacagaggagatcagcaatgctcctgcggaacctggcggcagcgcaaaagatg

SEQ ID NO: 80319 - DNA, 103 bp, Artificial Sequence
  Synthetic Polynucleotide
taatacgactcactatagggtagtgtgtatgaaggcgccgcaggagtgataacagaggagaatcactatggcggcgcctaacctggcggcagcgcaaaagatg

SEQ ID NO: 80320 - DNA, 103 bp, Artificial Sequence
  Synthetic Polynucleotide
taatacgactcactatagggagctttagtgtgtatgaaggcgccgcaggaaacagaggagatcctgcatggccttcataaacctggcggcagcgcaaaagatg

SEQ ID NO: 80321 - DNA, 103 bp, Artificial Sequence
  Synthetic Polynucleotide
taatacgactcactatagggctccaagctttagtgtgtatgaaggcgccgaacagaggagacggcgcatgcatacacacaacctggcggcagcgcaaaagatg

SEQ ID NO: 80322 - DNA, 103 bp, Artificial Sequence
  Synthetic Polynucleotide
taatacgactcactatagggatattctccaagctttagtgtgtatgaaggaacagaggagaccttcaatgacactaaagaacctggcggcagcgcaaaagatg

SEQ ID NO: 80323 - DNA, 103 bp, Artificial Sequence
  Synthetic Polynucleotide
taatacgactcactatagggtctccatattctccaagctttagtgtgtataacagaggagaatacacatgaaagcttggaacctggcggcagcgcaaaagatg

SEQ ID NO: 80324 - DNA, 103 bp, Artificial Sequence
  Synthetic Polynucleotide
taatacgactcactatagggaaacactactaagtttgtcagctcacacagaacagaggagactgtgtatgctgacaaacaacctggcggcagcgcaaaagatg

SEQ ID NO: 80325 - DNA, 103 bp, Artificial Sequence
  Synthetic Polynucleotide
taatacgactcactatagggaggacaacacgcggggcattccgcgttttaaacagaggagataaaacatggaatgccccaacctggcggcagcgcaaaagatg

SEQ ID NO: 80326 - DNA, 103 bp, Artificial Sequence
  Synthetic Polynucleotide
taatacgactcactatagggtcacctctccatattctccaagctttagtgaacagaggagacactaaatgttggagaataacctggcggcagcgcaaaagatg

SEQ ID NO: 80327 - DNA, 103 bp, Artificial Sequence
  Synthetic Polynucleotide
taatacgactcactatagggcactgtcacctctccatattctccaagcttaacagaggagaaagcttatggaatatggaaacctggcggcagcgcaaaagatg

SEQ ID NO: 80328 - DNA, 103 bp, Artificial Sequence
  Synthetic Polynucleotide
taatacgactcactatagggcagtccactgtcacctctccatattctccaaacagaggagatggagaatgtggagaggtaacctggcggcagcgcaaaagatg

SEQ ID NO: 80329 - DNA, 103 bp, Artificial Sequence
  Synthetic Polynucleotide
taatacgactcactataggggttcacagtccactgtcacctctccatattaacagaggagaaatatgatgaggtgacagaacctggcggcagcgcaaaagatg

SEQ ID NO: 80330 - DNA, 103 bp, Artificial Sequence
  Synthetic Polynucleotide
taatacgactcactatagggccgtggttcacagtccactgtcacctctccaacagaggagaggagagatgacagtggacaacctggcggcagcgcaaaagatg

SEQ ID NO: 80331 - DNA, 103 bp, Artificial Sequence
  Synthetic Polynucleotide
taatacgactcactatagggcctgaccgtggttcacagtccactgtcaccaacagaggagaggtgacatgggactgtgaaacctggcggcagcgcaaaagatg

SEQ ID NO: 80332 - DNA, 103 bp, Artificial Sequence
  Synthetic Polynucleotide
taatacgactcactatagggcaatccctgaccgtggttcacagtccactgaacagaggagacagtggatggtgaaccacaacctggcggcagcgcaaaagatg

SEQ ID NO: 80333 - DNA, 103 bp, Artificial Sequence
  Synthetic Polynucleotide
taatacgactcactatagggggtgtcaatccctgaccgtggttcacagtcaacagaggagagactgtatgccacggtcaaacctggcggcagcgcaaaagatg

SEQ ID NO: 80334 - DNA, 103 bp, Artificial Sequence
  Synthetic Polynucleotide
taatacgactcactataggggcattggtgtcaatccctgaccgtggttcaaacagaggagatgaaccatggtcagggataacctggcggcagcgcaaaagatg

SEQ ID NO: 80335 - DNA, 103 bp, Artificial Sequence
  Synthetic Polynucleotide
taatacgactcactatagggagtatgcattggtgtcaatccctgaccgtgaacagaggagacacggtatgggattgacaaacctggcggcagcgcaaaagatg

SEQ ID NO: 80336 - DNA, 103 bp, Artificial Sequence
  Synthetic Polynucleotide
taatacgactcactatagggaatcaaggacaacacgcggggcattccgcgaacagaggagacgcggaatgccccgcgtgaacctggcggcagcgcaaaagatg

SEQ ID NO: 80337 - DNA, 103 bp, Artificial Sequence
  Synthetic Polynucleotide
taatacgactcactatagggcacgtagtatgcattggtgtcaatccctgaaacagaggagatcagggatggacaccaataacctggcggcagcgcaaaagatg

SEQ ID NO: 80338 - DNA, 103 bp, Artificial Sequence
  Synthetic Polynucleotide
taatacgactcactataggggtcatcacgtagtatgcattggtgtcaatcaacagaggagagattgaatgcaatgcataaacctggcggcagcgcaaaagatg

SEQ ID NO: 80339 - DNA, 103 bp, Artificial Sequence
  Synthetic Polynucleotide
taatacgactcactatagggcaacagtcatcacgtagtatgcattggtgtaacagaggagaacaccaatgcatactacgaacctggcggcagcgcaaaagatg

SEQ ID NO: 80340 - DNA, 103 bp, Artificial Sequence
  Synthetic Polynucleotide
taatacgactcactatagggtgttccaacagtcatcacgtagtatgcattaacagaggagaaatgcaatgtacgtgatgaacctggcggcagcgcaaaagatg

SEQ ID NO: 80341 - DNA, 103 bp, Artificial Sequence
  Synthetic Polynucleotide
taatacgactcactataggggtctttgttccaacagtcatcacgtagtataacagaggagaatactaatggatgactgtaacctggcggcagcgcaaaagatg

SEQ ID NO: 80342 - DNA, 103 bp, Artificial Sequence
  Synthetic Polynucleotide
taatacgactcactatagggagaacgtctttgttccaacagtcatcacgtaacagaggagaacgtgaatgctgttggaaaacctggcggcagcgcaaaagatg

SEQ ID NO: 80343 - DNA, 103 bp, Artificial Sequence
  Synthetic Polynucleotide
taatacgactcactataggggaccaagaacgtctttgttccaacagtcataacagaggagaatgactatgggaacaaagaacctggcggcagcgcaaaagatg

SEQ ID NO: 80344 - DNA, 103 bp, Artificial Sequence
  Synthetic Polynucleotide
taatacgactcactatagggcgatggaccaagaacgtctttgttccaacaaacagaggagatgttggatgaaagacgttaacctggcggcagcgcaaaagatg

SEQ ID NO: 80345 - DNA, 103 bp, Artificial Sequence
  Synthetic Polynucleotide
taatacgactcactatagggactcacgatggaccaagaacgtctttgttcaacagaggagagaacaaatgcgttcttggaacctggcggcagcgcaaaagatg

SEQ ID NO: 80346 - DNA, 103 bp, Artificial Sequence
  Synthetic Polynucleotide
taatacgactcactataggggaaccactcacgatggaccaagaacgtcttaacagaggagaaagacgatgttggtccataacctggcggcagcgcaaaagatg

SEQ ID NO: 80347 - DNA, 103 bp, Artificial Sequence
  Synthetic Polynucleotide
taatacgactcactatagggagtccaatcaaggacaacacgcggggcattaacagaggagaaatgccatgcgtgttgtcaacctggcggcagcgcaaaagatg

SEQ ID NO: 80348 - DNA, 103 bp, Artificial Sequence
  Synthetic Polynucleotide
taatacgactcactatagggtccatgaaccactcacgatggaccaagaacaacagaggagagttcttatgccatcgtgaaacctggcggcagcgcaaaagatg

SEQ ID NO: 80349 - DNA, 103 bp, Artificial Sequence
  Synthetic Polynucleotide
taatacgactcactatagggtgaggtccatgaaccactcacgatggaccaaacagaggagatggtccatggtgagtggtaacctggcggcagcgcaaaagatg

SEQ ID NO: 80350 - DNA, 103 bp, Artificial Sequence
  Synthetic Polynucleotide
taatacgactcactataggggaggttgaggtccatgaaccactcacgatgaacagaggagacatcgtatgtggttcatgaacctggcggcagcgcaaaagatg

SEQ ID NO: 80351 - DNA, 103 bp, Artificial Sequence
  Synthetic Polynucleotide
taatacgactcactatagggcaagggaggttgaggtccatgaaccactcaaacagaggagatgagtgatgcatggacctaacctggcggcagcgcaaaagatg

SEQ ID NO: 80352 - DNA, 103 bp, Artificial Sequence
  Synthetic Polynucleotide
taatacgactcactatagggtgctccaagggaggttgaggtccatgaaccaacagaggagaggttcaatgacctcaaccaacctggcggcagcgcaaaagatg

SEQ ID NO: 80353 - DNA, 103 bp, Artificial Sequence
  Synthetic Polynucleotide
taatacgactcactatagggagcactgctccaagggaggttgaggtccataacagaggagaatggacatgaacctccctaacctggcggcagcgcaaaagatg

SEQ ID NO: 80354 - DNA, 103 bp, Artificial Sequence
  Synthetic Polynucleotide
taatacgactcactatagggcttccagcactgctccaagggaggttgaggaacagaggagacctcaaatgcccttggagaacctggcggcagcgcaaaagatg

SEQ ID NO: 80355 - DNA, 103 bp, Artificial Sequence
  Synthetic Polynucleotide
taatacgactcactatagggcagtacttccagcactgctccaagggaggtaacagaggagaacctccatgggagcagtgaacctggcggcagcgcaaaagatg

SEQ ID NO: 80356 - DNA, 103 bp, Artificial Sequence
  Synthetic Polynucleotide
taatacgactcactatagggccacacagtacttccagcactgctccaaggaacagaggagaccttggatgagtgctggaaacctggcggcagcgcaaaagatg

SEQ ID NO: 80357 - DNA, 103 bp, Artificial Sequence
  Synthetic Polynucleotide
taatacgactcactatagggttcctccacacagtacttccagcactgctcaacagaggagagagcagatgtggaagtacaacctggcggcagcgcaaaagatg

SEQ ID NO: 80358 - DNA, 103 bp, Artificial Sequence
  Synthetic Polynucleotide
taatacgactcactatagggtcttcagtccaatcaaggacaacacgcgggaacagaggagacccgcgatgtgtccttgaaacctggcggcagcgcaaaagatg

SEQ ID NO: 80359 - DNA, 103 bp, Artificial Sequence
  Synthetic Polynucleotide
taatacgactcactatagggctctgttcctccacacagtacttccagcacaacagaggagagtgctgatggtactgtgtaacctggcggcagcgcaaaagatg

SEQ ID NO: 80360 - DNA, 103 bp, Artificial Sequence
  Synthetic Polynucleotide
taatacgactcactatagggcgtctctctgttcctccacacagtacttccaacagaggagaggaagtatggtgtggaggaacctggcggcagcgcaaaagatg

SEQ ID NO: 80361 - DNA, 103 bp, Artificial Sequence
  Synthetic Polynucleotide
taatacgactcactatagggattaacgtctctctgttcctccacacagtaaacagaggagatactgtatggaggaacagaacctggcggcagcgcaaaagatg

SEQ ID NO: 80362 - DNA, 103 bp, Artificial Sequence
  Synthetic Polynucleotide
taatacgactcactatagggactccattaacgtctctctgttcctccacaaacagaggagatgtggaatgacagagagaaacctggcggcagcgcaaaagatg

SEQ ID NO: 80363 - DNA, 103 bp, Artificial Sequence
  Synthetic Polynucleotide
taatacgactcactatagggctcaaactccattaacgtctctctgttcctaacagaggagaaggaacatggagacgttaaacctggcggcagcgcaaaagatg

SEQ ID NO: 80364 - DNA, 103 bp, Artificial Sequence
  Synthetic Polynucleotide
taatacgactcactatagggggttcctcaaactccattaacgtctctctgaacagaggagacagagaatggttaatggaaacctggcggcagcgcaaaagatg

SEQ ID NO: 80365 - DNA, 103 bp, Artificial Sequence
  Synthetic Polynucleotide
taatacgactcactatagggcgtgtggttcctcaaactccattaacgtctaacagaggagaagacgtatgtggagtttgaacctggcggcagcgcaaaagatg

SEQ ID NO: 80366 - DNA, 103 bp, Artificial Sequence
  Synthetic Polynucleotide
taatacgactcactatagggcgtggcgtgtggttcctcaaactccattaaaacagaggagattaatgatgtttgaggaaaacctggcggcagcgcaaaagatg

SEQ ID NO: 80367 - DNA, 103 bp, Artificial Sequence
  Synthetic Polynucleotide
taatacgactcactatagggtgcttcgtggcgtgtggttcctcaaactccaacagaggagaggagttatgggaaccacaaacctggcggcagcgcaaaagatg

SEQ ID NO: 80368 - DNA, 103 bp, Artificial Sequence
  Synthetic Polynucleotide
taatacgactcactatagggcagactgcttcgtggcgtgtggttcctcaaaacagaggagattgaggatgcacacgccaaacctggcggcagcgcaaaagatg

SEQ ID NO: 80369 - DNA, 103 bp, Artificial Sequence
  Synthetic Polynucleotide
taatacgactcactatagggagccctcttcagtccaatcaaggacaacacaacagaggagagtgttgatgttgattggaaacctggcggcagcgcaaaagatg

SEQ ID NO: 80370 - DNA, 103 bp, Artificial Sequence
  Synthetic Polynucleotide
taatacgactcactatagggtatcacagactgcttcgtggcgtgtggttcaacagaggagagaaccaatggccacgaagaacctggcggcagcgcaaaagatg

SEQ ID NO: 80371 - DNA, 103 bp, Artificial Sequence
  Synthetic Polynucleotide
taatacgactcactatagggaatgctatcacagactgcttcgtggcgtgtaacagaggagaacacgcatggaagcagtcaacctggcggcagcgcaaaagatg

SEQ ID NO: 80372 - DNA, 103 bp, Artificial Sequence
  Synthetic Polynucleotide
taatacgactcactatagggagcccaatgctatcacagactgcttcgtggaacagaggagaccacgaatgagtctgtgaaacctggcggcagcgcaaaagatg

SEQ ID NO: 80373 - DNA, 103 bp, Artificial Sequence
  Synthetic Polynucleotide
taatacgactcactatagggttgtgagcccaatgctatcacagactgcttaacagaggagaaagcagatggtgatagcaaacctggcggcagcgcaaaagatg

SEQ ID NO: 80374 - DNA, 103 bp, Artificial Sequence
  Synthetic Polynucleotide
taatacgactcactatagggccctcttgtgagcccaatgctatcacagacaacagaggagagtctgtatgagcattgggaacctggcggcagcgcaaaagatg

SEQ ID NO: 80375 - DNA, 103 bp, Artificial Sequence
  Synthetic Polynucleotide
taatacgactcactataggggagctccctcttgtgagcccaatgctatcaaacagaggagatgatagatgtgggctcacaacctggcggcagcgcaaaagatg

SEQ ID NO: 80376 - DNA, 103 bp, Artificial Sequence
  Synthetic Polynucleotide
taatacgactcactatagggatgcagagctccctcttgtgagcccaatgcaacagaggagagcattgatgtcacaagagaacctggcggcagcgcaaaagatg

SEQ ID NO: 80377 - DNA, 103 bp, Artificial Sequence
  Synthetic Polynucleotide
taatacgactcactataggggcttgatgcagagctccctcttgtgagcccaacagaggagagggctcatgagagggagcaacctggcggcagcgcaaaagatg

SEQ ID NO: 80378 - DNA, 103 bp, Artificial Sequence
  Synthetic Polynucleotide
taatacgactcactatagggccaaagcttgatgcagagctccctcttgtgaacagaggagacacaagatggagctctgcaacctggcggcagcgcaaaagatg

SEQ ID NO: 80379 - DNA, 103 bp, Artificial Sequence
  Synthetic Polynucleotide
taatacgactcactatagggtccagccaaagcttgatgcagagctccctcaacagaggagagagggaatgctgcatcaaaacctggcggcagcgcaaaagatg

SEQ ID NO: 80380 - DNA, 103 bp, Artificial Sequence
  Synthetic Polynucleotide
taatacgactcactatagggaacatagccctcttcagtccaatcaaggacaacagaggagagtccttatgtggactgaaaacctggcggcagcgcaaaagatg

SEQ ID NO: 80381 - DNA, 103 bp, Artificial Sequence
  Synthetic Polynucleotide
taatacgactcactatagggatggctccagccaaagcttgatgcagagctaacagaggagaagctctatgtcaagctttaacctggcggcagcgcaaaagatg

SEQ ID NO: 80382 - DNA, 103 bp, Artificial Sequence
  Synthetic Polynucleotide
taatacgactcactatagggcaggaatggctccagccaaagcttgatgcaaacagaggagatgcatcatgctttggctgaacctggcggcagcgcaaaagatg

SEQ ID NO: 80383 - DNA, 103 bp, Artificial Sequence
  Synthetic Polynucleotide
taatacgactcactatagggttccacaggaatggctccagccaaagcttgaacagaggagacaagctatggctggagccaacctggcggcagcgcaaaagatg

SEQ ID NO: 80384 - DNA, 103 bp, Artificial Sequence
  Synthetic Polynucleotide
taatacgactcactataggggaaaattccacaggaatggctccagccaaaaacagaggagatttggcatgagccattccaacctggcggcagcgcaaaagatg

SEQ ID NO: 80385 - DNA, 103 bp, Artificial Sequence
  Synthetic Polynucleotide
taatacgactcactatagggtgcttgaaaattccacaggaatggctccagaacagaggagactggagatgttcctgtggaacctggcggcagcgcaaaagatg

SEQ ID NO: 80386 - DNA, 103 bp, Artificial Sequence
  Synthetic Polynucleotide
taatacgactcactatagggagtgttgcttgaaaattccacaggaatggcaacagaggagagccattatggtggaatttaacctggcggcagcgcaaaagatg

SEQ ID NO: 80387 - DNA, 103 bp, Artificial Sequence
  Synthetic Polynucleotide
taatacgactcactatagggttgacagtgttgcttgaaaattccacaggaaacagaggagatcctgtatgattttcaagaacctggcggcagcgcaaaagatg

SEQ ID NO: 80388 - DNA, 103 bp, Artificial Sequence
  Synthetic Polynucleotide
taatacgactcactatagggtcaacttgacagtgttgcttgaaaattccaaacagaggagatggaatatgcaagcaacaaacctggcggcagcgcaaaagatg

SEQ ID NO: 80389 - DNA, 103 bp, Artificial Sequence
  Synthetic Polynucleotide
taatacgactcactatagggcgacgtcaacttgacagtgttgcttgaaaaaacagaggagattttcaatgaacactgtcaacctggcggcagcgcaaaagatg

SEQ ID NO: 80390 - DNA, 103 bp, Artificial Sequence
  Synthetic Polynucleotide
taatacgactcactatagggtgacccgacgtcaacttgacagtgttgcttaacagaggagaaagcaaatgtgtcaagttaacctggcggcagcgcaaaagatg

SEQ ID NO: 80391 - DNA, 103 bp, Artificial Sequence
  Synthetic Polynucleotide
taatacgactcactatagggggctcaacatagccctcttcagtccaatcaaacagaggagatgattgatgtgaagagggaacctggcggcagcgcaaaagatg

SEQ ID NO: 80392 - DNA, 103 bp, Artificial Sequence
  Synthetic Polynucleotide
taatacgactcactatagggtcaaatgacccgacgtcaacttgacagtgtaacagaggagaacactgatgagttgacgtaacctggcggcagcgcaaaagatg

SEQ ID NO: 80393 - DNA, 103 bp, Artificial Sequence
  Synthetic Polynucleotide
taatacgactcactatagggacacttcaaatgacccgacgtcaacttgacaacagaggagagtcaagatgacgtcgggtaacctggcggcagcgcaaaagatg

SEQ ID NO: 80394 - DNA, 103 bp, Artificial Sequence
  Synthetic Polynucleotide
taatacgactcactatagggactctacacttcaaatgacccgacgtcaacaacagaggagagttgacatggggtcatttaacctggcggcagcgcaaaagatg

SEQ ID NO: 80395 - DNA, 103 bp, Artificial Sequence
  Synthetic Polynucleotide
taatacgactcactatagggtcttcactctacacttcaaatgacccgacgaacagaggagacgtcggatgatttgaagtaacctggcggcagcgcaaaagatg

SEQ ID NO: 80396 - DNA, 103 bp, Artificial Sequence
  Synthetic Polynucleotide
taatacgactcactatagggttccatcttcactctacacttcaaatgaccaacagaggagaggtcatatgaagtgtagaaacctggcggcagcgcaaaagatg

SEQ ID NO: 80397 - DNA, 103 bp, Artificial Sequence
  Synthetic Polynucleotide
taatacgactcactatagggaatttttccatcttcactctacacttcaaaaacagaggagatttgaaatgtagagtgaaaacctggcggcagcgcaaaagatg

SEQ ID NO: 80398 - DNA, 103 bp, Artificial Sequence
  Synthetic Polynucleotide
taatacgactcactatagggactgcaatttttccatcttcactctacactaacagaggagaagtgtaatgtgaagatggaacctggcggcagcgcaaaagatg

SEQ ID NO: 80399 - DNA, 103 bp, Artificial Sequence
  Synthetic Polynucleotide
taatacgactcactatagggcttcaactgcaatttttccatcttcactctaacagaggagaagagtgatgatggaaaaaaacctggcggcagcgcaaaagatg

SEQ ID NO: 80400 - DNA, 103 bp, Artificial Sequence
  Synthetic Polynucleotide
taatacgactcactataggggttcccttcaactgcaatttttccatcttcaacagaggagagaagatatgaaaattgcaaacctggcggcagcgcaaaagatg

SEQ ID NO: 80401 - DNA, 103 bp, Artificial Sequence
  Synthetic Polynucleotide
taatacgactcactatagggaggttgttcccttcaactgcaatttttccaaacagaggagatggaaaatgtgcagttgaaacctggcggcagcgcaaaagatg

SEQ ID NO: 80402 - DNA, 103 bp, Artificial Sequence
  Synthetic Polynucleotide
taatacgactcactataggggatcaggctcaacatagccctcttcagtccaacagaggagaggactgatgagggctatgaacctggcggcagcgcaaaagatg

SEQ ID NO: 80403 - DNA, 103 bp, Artificial Sequence
  Synthetic Polynucleotide
taatacgactcactataggggccataggttgttcccttcaactgcaatttaacagaggagaaaattgatgttgaagggaaacctggcggcagcgcaaaagatg

SEQ ID NO: 80404 - DNA, 103 bp, Artificial Sequence
  Synthetic Polynucleotide
taatacgactcactatagggcagacgccataggttgttcccttcaactgcaacagaggagagcagttatggggaacaacaacctggcggcagcgcaaaagatg

SEQ ID NO: 80405 - DNA, 103 bp, Artificial Sequence
  Synthetic Polynucleotide
taatacgactcactatagggttgaacagacgccataggttgttcccttcaaacagaggagatgaaggatgcaacctatgaacctggcggcagcgcaaaagatg

SEQ ID NO: 80406 - DNA, 103 bp, Artificial Sequence
  Synthetic Polynucleotide
taatacgactcactatagggagcctttgaacagacgccataggttgttccaacagaggagaggaacaatgtatggcgtcaacctggcggcagcgcaaaagatg

SEQ ID NO: 80407 - DNA, 103 bp, Artificial Sequence
  Synthetic Polynucleotide
taatacgactcactatagggttgaaagcctttgaacagacgccataggttaacagaggagaaacctaatgcgtctgttcaacctggcggcagcgcaaaagatg

SEQ ID NO: 80408 - DNA, 103 bp, Artificial Sequence
  Synthetic Polynucleotide
taatacgactcactataggggaaacttgaaagcctttgaacagacgccataacagaggagaatggcgatggttcaaaggaacctggcggcagcgcaaaagatg

SEQ ID NO: 80409 - DNA, 103 bp, Artificial Sequence
  Synthetic Polynucleotide
taatacgactcactatagggcccaagaaacttgaaagcctttgaacagacaacagaggagagtctgtatgaaggctttcaacctggcggcagcgcaaaagatg

SEQ ID NO: 80410 - DNA, 103 bp, Artificial Sequence
  Synthetic Polynucleotide
taatacgactcactatagggggagtcccaagaaacttgaaagcctttgaaaacagaggagattcaaaatgtttcaagttaacctggcggcagcgcaaaagatg

SEQ ID NO: 80411 - DNA, 103 bp, Artificial Sequence
  Synthetic Polynucleotide
taatacgactcactatagggctgcgggagtcccaagaaacttgaaagcctaacagaggagaaggcttatgagtttcttgaacctggcggcagcgcaaaagatg

SEQ ID NO: 80412 - DNA, 103 bp, Artificial Sequence
  Synthetic Polynucleotide
taatacgactcactatagggtgtgtctgcgggagtcccaagaaacttgaaaacagaggagattcaagatgcttgggactaacctggcggcagcgcaaaagatg

SEQ ID NO: 80413 - DNA, 103 bp, Artificial Sequence
  Synthetic Polynucleotide
taatacgactcactatagggccgtcgatcaggctcaacatagccctcttcaacagaggagagaagagatgtatgttgagaacctggcggcagcgcaaaagatg

SEQ ID NO: 80414 - DNA, 103 bp, Artificial Sequence
  Synthetic Polynucleotide
taatacgactcactatagggtgacctgtgtctgcgggagtcccaagaaacaacagaggagagtttctatggactcccgcaacctggcggcagcgcaaaagatg

SEQ ID NO: 80415 - DNA, 103 bp, Artificial Sequence
  Synthetic Polynucleotide
taatacgactcactatagggtgccgtgacctgtgtctgcgggagtcccaaaacagaggagattgggaatgccgcagacaaacctggcggcagcgcaaaagatg

SEQ ID NO: 80416 - DNA, 103 bp, Artificial Sequence
  Synthetic Polynucleotide
taatacgactcactatagggcacagtgccgtgacctgtgtctgcgggagtaacagaggagaactcccatggacacaggtaacctggcggcagcgcaaaagatg

SEQ ID NO: 80417 - DNA, 103 bp, Artificial Sequence
  Synthetic Polynucleotide
taatacgactcactatagggaacaccacagtgccgtgacctgtgtctgcgaacagaggagacgcagaatgaggtcacggaacctggcggcagcgcaaaagatg

SEQ ID NO: 80418 - DNA, 103 bp, Artificial Sequence
  Synthetic Polynucleotide
taatacgactcactatagggattccaacaccacagtgccgtgacctgtgtaacagaggagaacacagatgacggcactgaacctggcggcagcgcaaaagatg

SEQ ID NO: 80419 - DNA, 103 bp, Artificial Sequence
  Synthetic Polynucleotide
taatacgactcactatagggctgcaattccaacaccacagtgccgtgaccaacagaggagaggtcacatgactgtggtgaacctggcggcagcgcaaaagatg

SEQ ID NO: 80420 - DNA, 103 bp, Artificial Sequence
  Synthetic Polynucleotide
taatacgactcactataggggtgtactgcaattccaacaccacagtgccgaacagaggagacggcacatgggtgttggaaacctggcggcagcgcaaaagatg

SEQ ID NO: 80421 - DNA, 103 bp, Artificial Sequence
  Synthetic Polynucleotide
taatacgactcactatagggtgccagtgtactgcaattccaacaccacagaacagaggagactgtggatgtggaattgcaacctggcggcagcgcaaaagatg

SEQ ID NO: 80422 - DNA, 103 bp, Artificial Sequence
  Synthetic Polynucleotide
taatacgactcactatagggatccgtgccagtgtactgcaattccaacacaacagaggagagtgttgatgttgcagtacaacctggcggcagcgcaaaagatg

SEQ ID NO: 80423 - DNA, 103 bp, Artificial Sequence
  Synthetic Polynucleotide
taatacgactcactatagggggtccatccgtgccagtgtactgcaattccaacagaggagaggaattatggtacactggaacctggcggcagcgcaaaagatg

SEQ ID NO: 80424 - DNA, 103 bp, Artificial Sequence
  Synthetic Polynucleotide
taatacgactcactatagggccttgccgtcgatcaggctcaacatagcccaacagaggagagggctaatgtgagcctgaaacctggcggcagcgcaaaagatg

SEQ ID NO: 80425 - DNA, 103 bp, Artificial Sequence
  Synthetic Polynucleotide
taatacgactcactatagggtgcaaggtccatccgtgccagtgtactgcaaacagaggagatgcagtatgctggcacggaacctggcggcagcgcaaaagatg

SEQ ID NO: 80426 - DNA, 103 bp, Artificial Sequence
  Synthetic Polynucleotide
taatacgactcactatagggaactttgcaaggtccatccgtgccagtgtaaacagaggagatacactatgacggatggaaacctggcggcagcgcaaaagatg

SEQ ID NO: 80427 - DNA, 103 bp, Artificial Sequence
  Synthetic Polynucleotide
taatacgactcactatagggataggaactttgcaaggtccatccgtgccaaacagaggagatggcacatgtggaccttgaacctggcggcagcgcaaaagatg

SEQ ID NO: 80428 - DNA, 103 bp, Artificial Sequence
  Synthetic Polynucleotide
taatacgactcactatagggacgagataggaactttgcaaggtccatccgaacagaggagacggatgatgcttgcaaagaacctggcggcagcgcaaaagatg

SEQ ID NO: 80429 - DNA, 103 bp, Artificial Sequence
  Synthetic Polynucleotide
taatacgactcactatagggcactgacgagataggaactttgcaaggtccaacagaggagaggacctatgaaagttcctaacctggcggcagcgcaaaagatg

SEQ ID NO: 80430 - DNA, 103 bp, Artificial Sequence
  Synthetic Polynucleotide
taatacgactcactataggggaagccactgacgagataggaactttgcaaaacagaggagattgcaaatgtcctatctcaacctggcggcagcgcaaaagatg

SEQ ID NO: 80431 - DNA, 103 bp, Artificial Sequence
  Synthetic Polynucleotide
taatacgactcactatagggtcaatgaagccactgacgagataggaacttaacagaggagaaagttcatgtctcgtcagaacctggcggcagcgcaaaagatg

SEQ ID NO: 80432 - DNA, 103 bp, Artificial Sequence
  Synthetic Polynucleotide
taatacgactcactataggggtcgttcaatgaagccactgacgagataggaacagaggagacctatcatgtcagtggctaacctggcggcagcgcaaaagatg

SEQ ID NO: 80433 - DNA, 103 bp, Artificial Sequence
  Synthetic Polynucleotide
taatacgactcactataggggttaggtcgttcaatgaagccactgacgagaacagaggagactcgtcatgggcttcattaacctggcggcagcgcaaaagatg

SEQ ID NO: 80434 - DNA, 103 bp, Artificial Sequence
  Synthetic Polynucleotide
taatacgactcactatagggctggcgttaggtcgttcaatgaagccactgaacagaggagacagtggatgcattgaacgaacctggcggcagcgcaaaagatg

SEQ ID NO: 80435 - DNA, 103 bp, Artificial Sequence
  Synthetic Polynucleotide
taatacgactcactatagggctcacaaacactactaagtttgtcagctcaaacagaggagatgagctatgaaacttagtaacctggcggcagcgcaaaagatg

SEQ ID NO: 80436 - DNA, 103 bp, Artificial Sequence
  Synthetic Polynucleotide
taatacgactcactatagggtggccccttgccgtcgatcaggctcaacataacagaggagaatgttgatgctgatcgacaacctggcggcagcgcaaaagatg

SEQ ID NO: 80437 - DNA, 103 bp, Artificial Sequence
  Synthetic Polynucleotide
taatacgactcactataggggcccactggcgttaggtcgttcaatgaagcaacagaggagagcttcaatgaacgacctaaacctggcggcagcgcaaaagatg

SEQ ID NO: 80438 - DNA, 103 bp, Artificial Sequence
  Synthetic Polynucleotide
taatacgactcactatagggaatctgcccactggcgttaggtcgttcaataacagaggagaattgaaatgcctaacgccaacctggcggcagcgcaaaagatg

SEQ ID NO: 80439 - DNA, 103 bp, Artificial Sequence
  Synthetic Polynucleotide
taatacgactcactatagggtgaccaatctgcccactggcgttaggtcgtaacagaggagaacgaccatgcgccagtggaacctggcggcagcgcaaaagatg

SEQ ID NO: 80440 - DNA, 103 bp, Artificial Sequence
  Synthetic Polynucleotide
taatacgactcactataggggacagtgaccaatctgcccactggcgttagaacagaggagactaacgatggtgggcagaaacctggcggcagcgcaaaagatg

SEQ ID NO: 80441 - DNA, 103 bp, Artificial Sequence
  Synthetic Polynucleotide
taatacgactcactataggggggttgacagtgaccaatctgcccactggcaacagaggagagccagtatgcagattggtaacctggcggcagcgcaaaagatg

SEQ ID NO: 80442 - DNA, 103 bp, Artificial Sequence
  Synthetic Polynucleotide
taatacgactcactatagggcaaaagggttgacagtgaccaatctgcccaaacagaggagatgggcaatgtggtcactgaacctggcggcagcgcaaaagatg

SEQ ID NO: 80443 - DNA, 103 bp, Artificial Sequence
  Synthetic Polynucleotide
taatacgactcactatagggtgaaacaaaagggttgacagtgaccaatctaacagaggagaagattgatgactgtcaacaacctggcggcagcgcaaaagatg

SEQ ID NO: 80444 - DNA, 103 bp, Artificial Sequence
  Synthetic Polynucleotide
taatacgactcactataggggccactgaaacaaaagggttgacagtgaccaacagaggagaggtcacatgcaaccctttaacctggcggcagcgcaaaagatg

SEQ ID NO: 80445 - DNA, 103 bp, Artificial Sequence
  Synthetic Polynucleotide
taatacgactcactatagggccgtggccactgaaacaaaagggttgacagaacagaggagactgtcaatgcttttgtttaacctggcggcagcgcaaaagatg

SEQ ID NO: 80446 - DNA, 103 bp, Artificial Sequence
  Synthetic Polynucleotide
taatacgactcactataggggttggccgtggccactgaaacaaaagggttaacagaggagaaaccctatggtttcagtgaacctggcggcagcgcaaaagatg

SEQ ID NO: 80447 - DNA, 103 bp, Artificial Sequence
  Synthetic Polynucleotide
taatacgactcactatagggcgtattggccccttgccgtcgatcaggctcaacagaggagagagcctatgcgacggcaaaacctggcggcagcgcaaaagatg

SEQ ID NO: 80448 - DNA, 103 bp, Artificial Sequence
  Synthetic Polynucleotide
taatacgactcactatagggttagcgttggccgtggccactgaaacaaaaaacagaggagattttgtatgagtggccacaacctggcggcagcgcaaaagatg

SEQ ID NO: 80449 - DNA, 103 bp, Artificial Sequence
  Synthetic Polynucleotide
taatacgactcactatagggggaccttagcgttggccgtggccactgaaaaacagaggagatttcagatgccacggccaaacctggcggcagcgcaaaagatg

SEQ ID NO: 80450 - DNA, 103 bp, Artificial Sequence
  Synthetic Polynucleotide
taatacgactcactatagggaatcaggaccttagcgttggccgtggccacaacagaggagagtggccatggccaacgctaacctggcggcagcgcaaaagatg

SEQ ID NO: 80451 - DNA, 103 bp, Artificial Sequence
  Synthetic Polynucleotide
taatacgactcactatagggaattcaatcaggaccttagcgttggccgtgaacagaggagacacggcatgcgctaaggtaacctggcggcagcgcaaaagatg

SEQ ID NO: 80452 - DNA, 103 bp, Artificial Sequence
  Synthetic Polynucleotide
taatacgactcactataggggttccaattcaatcaggaccttagcgttggaacagaggagaccaacgatgaggtcctgaaacctggcggcagcgcaaaagatg

SEQ ID NO: 80453 - DNA, 103 bp, Artificial Sequence
  Synthetic Polynucleotide
taatacgactcactataggggggtggttccaattcaatcaggaccttagcaacagaggagagctaagatgctgattgaaaacctggcggcagcgcaaaagatg

SEQ ID NO: 80454 - DNA, 103 bp, Artificial Sequence
  Synthetic Polynucleotide
taatacgactcactatagggccaaagggtggttccaattcaatcaggaccaacagaggagaggtcctatgtgaattggaaacctggcggcagcgcaaaagatg

SEQ ID NO: 80455 - DNA, 103 bp, Artificial Sequence
  Synthetic Polynucleotide
taatacgactcactatagggagtctccaaagggtggttccaattcaatcaaacagaggagatgattgatgtggaaccacaacctggcggcagcgcaaaagatg

SEQ ID NO: 80456 - DNA, 103 bp, Artificial Sequence
  Synthetic Polynucleotide
taatacgactcactataggggtatgagtctccaaagggtggttccaattcaacagaggagagaattgatgccaccctttaacctggcggcagcgcaaaagatg

SEQ ID NO: 80457 - DNA, 103 bp, Artificial Sequence
  Synthetic Polynucleotide
taatacgactcactatagggactatgtatgagtctccaaagggtggttccaacagaggagaggaaccatgctttggagaaacctggcggcagcgcaaaagatg

SEQ ID NO: 80458 - DNA, 103 bp, Artificial Sequence
  Synthetic Polynucleotide
taatacgactcactatagggcaaatcgtattggccccttgccgtcgatcaaacagaggagatgatcgatggcaaggggcaacctggcggcagcgcaaaagatg

SEQ ID NO: 80459 - DNA, 103 bp, Artificial Sequence
  Synthetic Polynucleotide
taatacgactcactatagggccaccactatgtatgagtctccaaagggtgaacagaggagacaccctatggagactcataacctggcggcagcgcaaaagatg

SEQ ID NO: 80460 - DNA, 103 bp, Artificial Sequence
  Synthetic Polynucleotide
taatacgactcactatagggtctgcccaccactatgtatgagtctccaaaaacagaggagatttggaatgtcatacataaacctggcggcagcgcaaaagatg

SEQ ID NO: 80461 - DNA, 103 bp, Artificial Sequence
  Synthetic Polynucleotide
taatacgactcactatagggtctcctctgcccaccactatgtatgagtctaacagaggagaagactcatgcatagtggtaacctggcggcagcgcaaaagatg

SEQ ID NO: 80462 - DNA, 103 bp, Artificial Sequence
  Synthetic Polynucleotide
taatacgactcactataggggttgttctcctctgcccaccactatgtatgaacagaggagacatacaatgtggtgggcaaacctggcggcagcgcaaaagatg

SEQ ID NO: 80463 - DNA, 103 bp, Artificial Sequence
  Synthetic Polynucleotide
taatacgactcactataggggatctgttgttctcctctgcccaccactataacagaggagaatagtgatgggcagaggaaacctggcggcagcgcaaaagatg

SEQ ID NO: 80464 - DNA, 103 bp, Artificial Sequence
  Synthetic Polynucleotide
taatacgactcactatagggtgattgatctgttgttctcctctgcccaccaacagaggagaggtgggatgaggagaacaaacctggcggcagcgcaaaagatg

SEQ ID NO: 80465 - DNA, 103 bp, Artificial Sequence
  Synthetic Polynucleotide
taatacgactcactatagggaatggtgattgatctgttgttctcctctgcaacagaggagagcagagatgaacaacagaaacctggcggcagcgcaaaagatg

SEQ ID NO: 80466 - DNA, 103 bp, Artificial Sequence
  Synthetic Polynucleotide
taatacgactcactataggggtgccaatggtgattgatctgttgttctccaacagaggagaggagaaatgcagatcaataacctggcggcagcgcaaaagatg

SEQ ID NO: 80467 - DNA, 103 bp, Artificial Sequence
  Synthetic Polynucleotide
taatacgactcactataggggacttgtgccaatggtgattgatctgttgtaacagaggagaacaacaatgcaatcaccaaacctggcggcagcgcaaaagatg

SEQ ID NO: 80468 - DNA, 103 bp, Artificial Sequence
  Synthetic Polynucleotide
taatacgactcactatagggttccagacttgtgccaatggtgattgatctaacagaggagaagatcaatgaccattggcaacctggcggcagcgcaaaagatg

SEQ ID NO: 80469 - DNA, 103 bp, Artificial Sequence
  Synthetic Polynucleotide
taatacgactcactatagggcaacacaaatcgtattggccccttgccgtcaacagaggagagacggcatggggccaataaacctggcggcagcgcaaaagatg

SEQ ID NO: 80470 - DNA, 103 bp, Artificial Sequence
  Synthetic Polynucleotide
taatacgactcactataggggctgcttccagacttgtgccaatggtgattaacagaggagaaatcacatgtggcacaagaacctggcggcagcgcaaaagatg

SEQ ID NO: 80471 - DNA, 103 bp, Artificial Sequence
  Synthetic Polynucleotide
taatacgactcactatagggccaatgctgcttccagacttgtgccaatggaacagaggagaccattgatgcaagtctggaacctggcggcagcgcaaaagatg

SEQ ID NO: 80472 - DNA, 103 bp, Artificial Sequence
  Synthetic Polynucleotide
taatacgactcactatagggctttgccaatgctgcttccagacttgtgccaacagaggagaggcacaatgctggaagcaaacctggcggcagcgcaaaagatg

SEQ ID NO: 80473 - DNA, 103 bp, Artificial Sequence
  Synthetic Polynucleotide
taatacgactcactatagggaaaggctttgccaatgctgcttccagacttaacagaggagaaagtctatgagcagcattaacctggcggcagcgcaaaagatg

SEQ ID NO: 80474 - DNA, 103 bp, Artificial Sequence
  Synthetic Polynucleotide
taatacgactcactataggggttgtaaaggctttgccaatgctgcttccaaacagaggagatggaagatgcattggcaaaacctggcggcagcgcaaaagatg

SEQ ID NO: 80475 - DNA, 103 bp, Artificial Sequence
  Synthetic Polynucleotide
taatacgactcactataggggggtggttgtaaaggctttgccaatgctgcaacagaggagagcagcaatggcaaagcctaacctggcggcagcgcaaaagatg

SEQ ID NO: 80476 - DNA, 103 bp, Artificial Sequence
  Synthetic Polynucleotide
taatacgactcactatagggtttgagggtggttgtaaaggctttgccaataacagaggagaattggcatggcctttacaaacctggcggcagcgcaaaagatg

SEQ ID NO: 80477 - DNA, 103 bp, Artificial Sequence
  Synthetic Polynucleotide
taatacgactcactataggggctcctttgagggtggttgtaaaggctttgaacagaggagacaaagcatgtacaaccacaacctggcggcagcgcaaaagatg

SEQ ID NO: 80478 - DNA, 103 bp, Artificial Sequence
  Synthetic Polynucleotide
taatacgactcactatagggtctgcgctcctttgagggtggttgtaaaggaacagaggagacctttaatgccaccctcaaacctggcggcagcgcaaaagatg

SEQ ID NO: 80479 - DNA, 103 bp, Artificial Sequence
  Synthetic Polynucleotide
taatacgactcactatagggtagtctctgcgctcctttgagggtggttgtaacagaggagaacaaccatgctcaaaggaaacctggcggcagcgcaaaagatg

SEQ ID NO: 80480 - DNA, 103 bp, Artificial Sequence
  Synthetic Polynucleotide
taatacgactcactatagggagagccaacacaaatcgtattggccccttgaacagaggagacaagggatgaatacgattaacctggcggcagcgcaaaagatg

SEQ ID NO: 80481 - DNA, 103 bp, Artificial Sequence
  Synthetic Polynucleotide
taatacgactcactataggggcggctagtctctgcgctcctttgagggtgaacagaggagacaccctatgaggagcgcaaacctggcggcagcgcaaaagatg

SEQ ID NO: 80482 - DNA, 103 bp, Artificial Sequence
  Synthetic Polynucleotide
taatacgactcactatagggctagagcggctagtctctgcgctcctttgaaacagaggagatcaaagatgcgcagagacaacctggcggcagcgcaaaagatg

SEQ ID NO: 80483 - DNA, 103 bp, Artificial Sequence
  Synthetic Polynucleotide
taatacgactcactataggggtctcctagagcggctagtctctgcgctccaacagaggagaggagcgatgagactagccaacctggcggcagcgcaaaagatg

SEQ ID NO: 80484 - DNA, 103 bp, Artificial Sequence
  Synthetic Polynucleotide
taatacgactcactataggggctgtgtctcctagagcggctagtctctgcaacagaggagagcagagatgagccgctctaacctggcggcagcgcaaaagatg

SEQ ID NO: 80485 - DNA, 103 bp, Artificial Sequence
  Synthetic Polynucleotide
taatacgactcactatagggcccaagctgtgtctcctagagcggctagtcaacagaggagagactagatgctctaggagaacctggcggcagcgcaaaagatg

SEQ ID NO: 80486 - DNA, 103 bp, Artificial Sequence
  Synthetic Polynucleotide
taatacgactcactatagggaaagtcccaagctgtgtctcctagagcggcaacagaggagagccgctatgggagacacaaacctggcggcagcgcaaaagatg

SEQ ID NO: 80487 - DNA, 103 bp, Artificial Sequence
  Synthetic Polynucleotide
taatacgactcactataggggatccaaagtcccaagctgtgtctcctagaaacagaggagatctaggatgcacagcttgaacctggcggcagcgcaaaagatg

SEQ ID NO: 80488 - DNA, 103 bp, Artificial Sequence
  Synthetic Polynucleotide
taatacgactcactatagggcaactgatccaaagtcccaagctgtgtctcaacagaggagagagacaatgcttgggactaacctggcggcagcgcaaaagatg

SEQ ID NO: 80489 - DNA, 103 bp, Artificial Sequence
  Synthetic Polynucleotide
taatacgactcactatagggccctccaactgatccaaagtcccaagctgtaacagaggagaacagctatggactttggaaacctggcggcagcgcaaaagatg

SEQ ID NO: 80490 - DNA, 103 bp, Artificial Sequence
  Synthetic Polynucleotide
taatacgactcactatagggaacacccctccaactgatccaaagtcccaaaacagaggagattgggaatgtggatcagtaacctggcggcagcgcaaaagatg

SEQ ID NO: 80491 - DNA, 103 bp, Artificial Sequence
  Synthetic Polynucleotide
taatacgactcactatagggccaagagagccaacacaaatcgtattggccaacagaggagaggccaaatggatttgtgtaacctggcggcagcgcaaaagatg

SEQ ID NO: 80492 - DNA, 103 bp, Artificial Sequence
  Synthetic Polynucleotide
taatacgactcactatagggaggtgaacacccctccaactgatccaaagtaacagaggagaactttgatgcagttggagaacctggcggcagcgcaaaagatg

SEQ ID NO: 80493 - DNA, 103 bp, Artificial Sequence
  Synthetic Polynucleotide
taatacgactcactatagggaactgaggtgaacacccctccaactgatccaacagaggagaggatcaatgggaggggtgaacctggcggcagcgcaaaagatg

SEQ ID NO: 80494 - DNA, 103 bp, Artificial Sequence
  Synthetic Polynucleotide
taatacgactcactatagggttcccaactgaggtgaacacccctccaactaacagaggagaagttggatgggtgttcacaacctggcggcagcgcaaaagatg

SEQ ID NO: 80495 - DNA, 103 bp, Artificial Sequence
  Synthetic Polynucleotide
taatacgactcactatagggcagccttcccaactgaggtgaacacccctcaacagaggagagaggggatgtcacctcagaacctggcggcagcgcaaaagatg

SEQ ID NO: 80496 - DNA, 103 bp, Artificial Sequence
  Synthetic Polynucleotide
taatacgactcactatagggatggacagccttcccaactgaggtgaacacaacagaggagagtgttcatgtcagttgggaacctggcggcagcgcaaaagatg

SEQ ID NO: 80497 - DNA, 103 bp, Artificial Sequence
  Synthetic Polynucleotide
taatacgactcactatagggacttgatggacagccttcccaactgaggtgaacagaggagacacctcatgtgggaaggcaacctggcggcagcgcaaaagatg

SEQ ID NO: 80498 - DNA, 103 bp, Artificial Sequence
  Synthetic Polynucleotide
taatacgactcactatagggcgaacacttgatggacagccttcccaactgaacagaggagacagttgatgaggctgtccaacctggcggcagcgcaaaagatg

SEQ ID NO: 80499 - DNA, 103 bp, Artificial Sequence
  Synthetic Polynucleotide
taatacgactcactatagggtcctccgaacacttgatggacagccttcccaacagaggagagggaagatggtccatcaaaacctggcggcagcgcaaaagatg

SEQ ID NO: 80500 - DNA, 103 bp, Artificial Sequence
  Synthetic Polynucleotide
taatacgactcactatagggaatgctcctccgaacacttgatggacagccaacagaggagaggctgtatgtcaagtgttaacctggcggcagcgcaaaagatg

SEQ ID NO: 80501 - DNA, 103 bp, Artificial Sequence
  Synthetic Polynucleotide
taatacgactcactatagggagcggaatgctcctccgaacacttgatggaaacagaggagatccatcatgtgttcggagaacctggcggcagcgcaaaagatg

SEQ ID NO: 80502 - DNA, 103 bp, Artificial Sequence
  Synthetic Polynucleotide
taatacgactcactataggggaacgccaagagagccaacacaaatcgtataacagaggagaatacgaatggtgttggctaacctggcggcagcgcaaaagatg

SEQ ID NO: 80503 - DNA, 103 bp, Artificial Sequence
  Synthetic Polynucleotide
taatacgactcactatagggcagtgagcggaatgctcctccgaacacttgaacagaggagacaagtgatgggaggagcaaacctggcggcagcgcaaaagatg

SEQ ID NO: 80504 - DNA, 103 bp, Artificial Sequence
  Synthetic Polynucleotide
taatacgactcactatagggccgaacagtgagcggaatgctcctccgaacaacagaggagagttcggatgagcattccgaacctggcggcagcgcaaaagatg

SEQ ID NO: 80505 - DNA, 103 bp, Artificial Sequence
  Synthetic Polynucleotide
taatacgactcactatagggtgcctccgaacagtgagcggaatgctcctcaacagaggagagaggagatgtccgctcacaacctggcggcagcgcaaaagatg

SEQ ID NO: 80506 - DNA, 103 bp, Artificial Sequence
  Synthetic Polynucleotide
taatacgactcactatagggggacatgcctccgaacagtgagcggaatgcaacagaggagagcattcatgtcactgttcaacctggcggcagcgcaaaagatg

SEQ ID NO: 80507 - DNA, 103 bp, Artificial Sequence
  Synthetic Polynucleotide
taatacgactcactatagggatccaggacatgcctccgaacagtgagcggaacagaggagaccgctcatggttcggaggaacctggcggcagcgcaaaagatg

SEQ ID NO: 80508 - DNA, 103 bp, Artificial Sequence
  Synthetic Polynucleotide
taatacgactcactataggggcgttatccaggacatgcctccgaacagtgaacagaggagacactgtatggaggcatgtaacctggcggcagcgcaaaagatg

SEQ ID NO: 80509 - DNA, 103 bp, Artificial Sequence
  Synthetic Polynucleotide
taatacgactcactatagggtccttgcgttatccaggacatgcctccgaaaacagaggagattcggaatgatgtcctggaacctggcggcagcgcaaaagatg

SEQ ID NO: 80510 - DNA, 103 bp, Artificial Sequence
  Synthetic Polynucleotide
taatacgactcactatagggagcaatccttgcgttatccaggacatgcctaacagaggagaaggcatatgctggataacaacctggcggcagcgcaaaagatg

SEQ ID NO: 80511 - DNA, 103 bp, Artificial Sequence
  Synthetic Polynucleotide
taatacgactcactatagggcccccagcaatccttgcgttatccaggacaaacagaggagatgtcctatgtaacgcaagaacctggcggcagcgcaaaagatg

SEQ ID NO: 80512 - DNA, 103 bp, Artificial Sequence
  Synthetic Polynucleotide
taatacgactcactataggggagagcccccagcaatccttgcgttatccaaacagaggagatggataatgcaaggattgaacctggcggcagcgcaaaagatg

SEQ ID NO: 80513 - DNA, 103 bp, Artificial Sequence
  Synthetic Polynucleotide
taatacgactcactatagggctgaagaacgccaagagagccaacacaaataacagaggagaatttgtatgggctctcttaacctggcggcagcgcaaaagatg

SEQ ID NO: 80514 - DNA, 103 bp, Artificial Sequence
  Synthetic Polynucleotide
taatacgactcactatagggaacaggagagcccccagcaatccttgcgttaacagaggagaaacgcaatgattgctgggaacctggcggcagcgcaaaagatg

SEQ ID NO: 80515 - DNA, 103 bp, Artificial Sequence
  Synthetic Polynucleotide
taatacgactcactatagggtccacaacaggagagcccccagcaatccttaacagaggagaaaggatatgtgggggctcaacctggcggcagcgcaaaagatg

SEQ ID NO: 80516 - DNA, 103 bp, Artificial Sequence
  Synthetic Polynucleotide
taatacgactcactataggggcccatccacaacaggagagcccccagcaaaacagaggagattgctgatggctctcctgaacctggcggcagcgcaaaagatg

SEQ ID NO: 80517 - DNA, 103 bp, Artificial Sequence
  Synthetic Polynucleotide
taatacgactcactatagggttgatgcccatccacaacaggagagcccccaacagaggagagggggcatgcctgttgtgaacctggcggcagcgcaaaagatg

SEQ ID NO: 80518 - DNA, 103 bp, Artificial Sequence
  Synthetic Polynucleotide
taatacgactcactataggggagcattgatgcccatccacaacaggagagaacagaggagactctccatgtgtggatggaacctggcggcagcgcaaaagatg

SEQ ID NO: 80519 - DNA, 103 bp, Artificial Sequence
  Synthetic Polynucleotide
taatacgactcactatagggatcacgagcattgatgcccatccacaacagaacagaggagactgttgatgatgggcatcaacctggcggcagcgcaaaagatg

SEQ ID NO: 80520 - DNA, 103 bp, Artificial Sequence
  Synthetic Polynucleotide
taatacgactcactataggggacctatcacgagcattgatgcccatccacaacagaggagagtggatatgcatcaatgcaacctggcggcagcgcaaaagatg

SEQ ID NO: 80521 - DNA, 103 bp, Artificial Sequence
  Synthetic Polynucleotide
taatacgactcactatagggctatggacctatcacgagcattgatgcccaaacagaggagatgggcaatgatgctcgtgaacctggcggcagcgcaaaagatg

SEQ ID NO: 80522 - DNA, 103 bp, Artificial Sequence
  Synthetic Polynucleotide
taatacgactcactataggggagagctatggacctatcacgagcattgataacagaggagaatcaatatgcgtgataggaacctggcggcagcgcaaaagatg

SEQ ID NO: 80523 - DNA, 103 bp, Artificial Sequence
  Synthetic Polynucleotide
taatacgactcactatagggaacgtgagagctatggacctatcacgagcaaacagaggagatgctcgatgtaggtccataacctggcggcagcgcaaaagatg

SEQ ID NO: 80524 - DNA, 103 bp, Artificial Sequence
  Synthetic Polynucleotide
taatacgactcactatagggtgaacctgaagaacgccaagagagccaacaaacagaggagatgttggatgtcttggcgtaacctggcggcagcgcaaaagatg

SEQ ID NO: 80525 - DNA, 103 bp, Artificial Sequence
  Synthetic Polynucleotide
taatacgactcactatagggcgagaaacgtgagagctatggacctatcacaacagaggagagtgataatgccatagctcaacctggcggcagcgcaaaagatg

SEQ ID NO: 80526 - DNA, 103 bp, Artificial Sequence
  Synthetic Polynucleotide
taatacgactcactatagggaactgcgagaaacgtgagagctatggacctaacagaggagaaggtccatggctctcacgaacctggcggcagcgcaaaagatg

SEQ ID NO: 80527 - DNA, 103 bp, Artificial Sequence
  Synthetic Polynucleotide
taatacgactcactatagggcctccaactgcgagaaacgtgagagctatgaacagaggagacatagcatgcacgtttctaacctggcggcagcgcaaaagatg

SEQ ID NO: 80528 - DNA, 103 bp, Artificial Sequence
  Synthetic Polynucleotide
taatacgactcactataggggaactcctccaactgcgagaaacgtgagagaacagaggagactctcaatgttctcgcagaacctggcggcagcgcaaaagatg

SEQ ID NO: 80529 - DNA, 103 bp, Artificial Sequence
  Synthetic Polynucleotide
taatacgactcactataggggagcagaactcctccaactgcgagaaacgtaacagaggagaacgtttatggcagttggaaacctggcggcagcgcaaaagatg

SEQ ID NO: 80530 - DNA, 103 bp, Artificial Sequence
  Synthetic Polynucleotide
taatacgactcactatagggaggaagagcagaactcctccaactgcgagaaacagaggagatctcgcatgtggaggagtaacctggcggcagcgcaaaagatg

SEQ ID NO: 80531 - DNA, 103 bp, Artificial Sequence
  Synthetic Polynucleotide
taatacgactcactatagggcggagaggaagagcagaactcctccaactgaacagaggagacagttgatggagttctgcaacctggcggcagcgcaaaagatg

SEQ ID NO: 80532 - DNA, 103 bp, Artificial Sequence
  Synthetic Polynucleotide
taatacgactcactataggggttcacggagaggaagagcagaactcctccaacagaggagaggaggaatgctgctcttcaacctggcggcagcgcaaaagatg

SEQ ID NO: 80533 - DNA, 103 bp, Artificial Sequence
  Synthetic Polynucleotide
taatacgactcactatagggtgcacgttcacggagaggaagagcagaactaacagaggagaagttctatgcttcctctcaacctggcggcagcgcaaaagatg

SEQ ID NO: 80534 - DNA, 103 bp, Artificial Sequence
  Synthetic Polynucleotide
taatacgactcactatagggcagcgtgcacgttcacggagaggaagagcaaacagaggagatgctctatgtctccgtgaaacctggcggcagcgcaaaagatg

SEQ ID NO: 80535 - DNA, 103 bp, Artificial Sequence
  Synthetic Polynucleotide
taatacgactcactatagggtgctgtgaacctgaagaacgccaagagagcaacagaggagagctctcatggcgttcttcaacctggcggcagcgcaaaagatg

SEQ ID NO: 80536 - DNA, 103 bp, Artificial Sequence
  Synthetic Polynucleotide
taatacgactcactatagggagtgtcagcgtgcacgttcacggagaggaaaacagaggagattcctcatggtgaacgtgaacctggcggcagcgcaaaagatg

SEQ ID NO: 80537 - DNA, 103 bp, Artificial Sequence
  Synthetic Polynucleotide
taatacgactcactatagggcacccagtgtcagcgtgcacgttcacggagaacagaggagactccgtatgcgtgcacgcaacctggcggcagcgcaaaagatg

SEQ ID NO: 80538 - DNA, 103 bp, Artificial Sequence
  Synthetic Polynucleotide
taatacgactcactatagggtggcacacccagtgtcagcgtgcacgttcaaacagaggagatgaacgatgacgctgacaaacctggcggcagcgcaaaagatg

SEQ ID NO: 80539 - DNA, 103 bp, Artificial Sequence
  Synthetic Polynucleotide
taatacgactcactataggggtctatggcacacccagtgtcagcgtgcacaacagaggagagtgcacatggacactgggaacctggcggcagcgcaaaagatg

SEQ ID NO: 80540 - DNA, 103 bp, Artificial Sequence
  Synthetic Polynucleotide
taatacgactcactatagggctgatgtctatggcacacccagtgtcagcgaacagaggagacgctgaatgtgggtgtgcaacctggcggcagcgcaaaagatg

SEQ ID NO: 80541 - DNA, 103 bp, Artificial Sequence
  Synthetic Polynucleotide
taatacgactcactataggggccggctgatgtctatggcacacccagtgtaacagaggagaacactgatggtgccatagaacctggcggcagcgcaaaagatg

SEQ ID NO: 80542 - DNA, 103 bp, Artificial Sequence
  Synthetic Polynucleotide
taatacgactcactatagggctcttgccggctgatgtctatggcacacccaacagaggagagggtgtatgatagacatcaacctggcggcagcgcaaaagatg

SEQ ID NO: 80543 - DNA, 103 bp, Artificial Sequence
  Synthetic Polynucleotide
taatacgactcactatagggctcagctcttgccggctgatgtctatggcaaacagaggagatgccatatgcatcagccgaacctggcggcagcgcaaaagatg

SEQ ID NO: 80544 - DNA, 103 bp, Artificial Sequence
  Synthetic Polynucleotide
taatacgactcactatagggcacatctcagctcttgccggctgatgtctaaacagaggagatagacaatggccggcaagaacctggcggcagcgcaaaagatg

SEQ ID NO: 80545 - DNA, 103 bp, Artificial Sequence
  Synthetic Polynucleotide
taatacgactcactatagggacttccacatctcagctcttgccggctgataacagaggagaatcagcatgcaagagctgaacctggcggcagcgcaaaagatg

SEQ ID NO: 80546 - DNA, 103 bp, Artificial Sequence
  Synthetic Polynucleotide
taatacgactcactatagggtaatcctcacaaacactactaagtttgtcaaacagaggagatgacaaatgtagtagtgtaacctggcggcagcgcaaaagatg

SEQ ID NO: 80547 - DNA, 103 bp, Artificial Sequence
  Synthetic Polynucleotide
taatacgactcactataggggcaattgctgtgaacctgaagaacgccaagaacagaggagacttggcatgcttcaggttaacctggcggcagcgcaaaagatg

SEQ ID NO: 80548 - DNA, 103 bp, Artificial Sequence
  Synthetic Polynucleotide
taatacgactcactatagggactccacttccacatctcagctcttgccggaacagaggagaccggcaatggctgagatgaacctggcggcagcgcaaaagatg

SEQ ID NO: 80549 - DNA, 103 bp, Artificial Sequence
  Synthetic Polynucleotide
taatacgactcactatagggtgaacactccacttccacatctcagctcttaacagaggagaaagagcatggatgtggaaaacctggcggcagcgcaaaagatg

SEQ ID NO: 80550 - DNA, 103 bp, Artificial Sequence
  Synthetic Polynucleotide
taatacgactcactataggggtgtatgaacactccacttccacatctcagaacagaggagactgagaatgggaagtggaaacctggcggcagcgcaaaagatg

SEQ ID NO: 80551 - DNA, 103 bp, Artificial Sequence
  Synthetic Polynucleotide
taatacgactcactatagggtcattgtgtatgaacactccacttccacataacagaggagaatgtggatgtggagtgttaacctggcggcagcgcaaaagatg

SEQ ID NO: 80552 - DNA, 103 bp, Artificial Sequence
  Synthetic Polynucleotide
taatacgactcactatagggccacatcattgtgtatgaacactccacttcaacagaggagagaagtgatgtgttcatacaacctggcggcagcgcaaaagatg

SEQ ID NO: 80553 - DNA, 103 bp, Artificial Sequence
  Synthetic Polynucleotide
taatacgactcactatagggagcctccacatcattgtgtatgaacactccaacagaggagaggagtgatgatacacaataacctggcggcagcgcaaaagatg

SEQ ID NO: 80554 - DNA, 103 bp, Artificial Sequence
  Synthetic Polynucleotide
taatacgactcactatagggatccaagcctccacatcattgtgtatgaacaacagaggagagttcatatgcaatgatgtaacctggcggcagcgcaaaagatg

SEQ ID NO: 80555 - DNA, 103 bp, Artificial Sequence
  Synthetic Polynucleotide
taatacgactcactatagggggtccatccaagcctccacatcattgtgtaaacagaggagatacacaatgatgtggaggaacctggcggcagcgcaaaagatg

SEQ ID NO: 80556 - DNA, 103 bp, Artificial Sequence
  Synthetic Polynucleotide
taatacgactcactataggggtaccggtccatccaagcctccacatcattaacagaggagaaatgatatggaggcttggaacctggcggcagcgcaaaagatg

SEQ ID NO: 80557 - DNA, 103 bp, Artificial Sequence
  Synthetic Polynucleotide
taatacgactcactatagggtacttgtaccggtccatccaagcctccacaaacagaggagatgtggaatgttggatggaaacctggcggcagcgcaaaagatg

SEQ ID NO: 80558 - DNA, 103 bp, Artificial Sequence
  Synthetic Polynucleotide
taatacgactcactatagggtcggagcaattgctgtgaacctgaagaacgaacagaggagacgttctatgggttcacagaacctggcggcagcgcaaaagatg

SEQ ID NO: 80559 - DNA, 103 bp, Artificial Sequence
  Synthetic Polynucleotide
taatacgactcactatagggggtaatacttgtaccggtccatccaagcctaacagaggagaaggcttatgtggaccggtaacctggcggcagcgcaaaagatg

SEQ ID NO: 80560 - DNA, 103 bp, Artificial Sequence
  Synthetic Polynucleotide
taatacgactcactatagggttcagggtaatacttgtaccggtccatccaaacagaggagatggatgatgcggtacaagaacctggcggcagcgcaaaagatg

SEQ ID NO: 80561 - DNA, 103 bp, Artificial Sequence
  Synthetic Polynucleotide
taatacgactcactatagggggcgtttcagggtaatacttgtaccggtccaacagaggagaggaccgatgcaagtattaaacctggcggcagcgcaaaagatg

SEQ ID NO: 80562 - DNA, 103 bp, Artificial Sequence
  Synthetic Polynucleotide
taatacgactcactatagggcttgtggcgtttcagggtaatacttgtaccaacagaggagaggtacaatgattaccctgaacctggcggcagcgcaaaagatg

SEQ ID NO: 80563 - DNA, 103 bp, Artificial Sequence
  Synthetic Polynucleotide
taatacgactcactatagggtaggccttgtggcgtttcagggtaatacttaacagaggagaaagtatatgcctgaaacgaacctggcggcagcgcaaaagatg

SEQ ID NO: 80564 - DNA, 103 bp, Artificial Sequence
  Synthetic Polynucleotide
taatacgactcactatagggttggctaggccttgtggcgtttcagggtaaaacagaggagattacccatgaacgccacaaacctggcggcagcgcaaaagatg

SEQ ID NO: 80565 - DNA, 103 bp, Artificial Sequence
  Synthetic Polynucleotide
taatacgactcactatagggtgatcttggctaggccttgtggcgtttcagaacagaggagactgaaaatgcacaaggccaacctggcggcagcgcaaaagatg

SEQ ID NO: 80566 - DNA, 103 bp, Artificial Sequence
  Synthetic Polynucleotide
taatacgactcactatagggctgaatgatcttggctaggccttgtggcgtaacagaggagaacgccaatgggcctagccaacctggcggcagcgcaaaagatg

SEQ ID NO: 80567 - DNA, 103 bp, Artificial Sequence
  Synthetic Polynucleotide
taatacgactcactataggggctttctgaatgatcttggctaggccttgtaacagaggagaacaaggatgagccaagataacctggcggcagcgcaaaagatg

SEQ ID NO: 80568 - DNA, 103 bp, Artificial Sequence
  Synthetic Polynucleotide
taatacgactcactatagggtatgagctttctgaatgatcttggctaggcaacagaggagagcctagatgagatcattcaacctggcggcagcgcaaaagatg

SEQ ID NO: 80569 - DNA, 103 bp, Artificial Sequence
  Synthetic Polynucleotide
taatacgactcactatagggtcgggtcggagcaattgctgtgaacctgaaaacagaggagattcaggatgacagcaattaacctggcggcagcgcaaaagatg

SEQ ID NO: 80570 - DNA, 103 bp, Artificial Sequence
  Synthetic Polynucleotide
taatacgactcactatagggttccttatgagctttctgaatgatcttggcaacagaggagagccaagatgattcagaaaaacctggcggcagcgcaaaagatg

SEQ ID NO: 80571 - DNA, 103 bp, Artificial Sequence
  Synthetic Polynucleotide
taatacgactcactatagggactccttccttatgagctttctgaatgatcaacagaggagagatcatatggaaagctcaaacctggcggcagcgcaaaagatg

SEQ ID NO: 80572 - DNA, 103 bp, Artificial Sequence
  Synthetic Polynucleotide
taatacgactcactatagggcgcacactccttccttatgagctttctgaaaacagaggagattcagaatgctcataaggaacctggcggcagcgcaaaagatg

SEQ ID NO: 80573 - DNA, 103 bp, Artificial Sequence
  Synthetic Polynucleotide
taatacgactcactatagggtagaccgcacactccttccttatgagctttaacagaggagaaaagctatgaaggaaggaaacctggcggcagcgcaaaagatg

SEQ ID NO: 80574 - DNA, 103 bp, Artificial Sequence
  Synthetic Polynucleotide
taatacgactcactataggggatcgtagaccgcacactccttccttatgaaacagaggagatcataaatgaggagtgtgaacctggcggcagcgcaaaagatg

SEQ ID NO: 80575 - DNA, 103 bp, Artificial Sequence
  Synthetic Polynucleotide
taatacgactcactatagggaaactgatcgtagaccgcacactccttcctaacagaggagaaggaagatgtgtgcggtcaacctggcggcagcgcaaaagatg

SEQ ID NO: 80576 - DNA, 103 bp, Artificial Sequence
  Synthetic Polynucleotide
taatacgactcactatagggtctggaaactgatcgtagaccgcacactccaacagaggagaggagtgatgggtctacgaaacctggcggcagcgcaaaagatg

SEQ ID NO: 80577 - DNA, 103 bp, Artificial Sequence
  Synthetic Polynucleotide
taatacgactcactatagggtccagtctggaaactgatcgtagaccgcacaacagaggagagtgcggatgacgatcagtaacctggcggcagcgcaaaagatg

SEQ ID NO: 80578 - DNA, 103 bp, Artificial Sequence
  Synthetic Polynucleotide
taatacgactcactataggggatgctccagtctggaaactgatcgtagacaacagaggagagtctacatgcagtttccaaacctggcggcagcgcaaaagatg

SEQ ID NO: 80579 - DNA, 103 bp, Artificial Sequence
  Synthetic Polynucleotide
taatacgactcactatagggcatttgatgctccagtctggaaactgatcgaacagaggagacgatcaatgtccagactgaacctggcggcagcgcaaaagatg

SEQ ID NO: 80580 - DNA, 103 bp, Artificial Sequence
  Synthetic Polynucleotide
taatacgactcactatagggactgctcgggtcggagcaattgctgtgaacaacagaggagagttcacatgaattgctccaacctggcggcagcgcaaaagatg

SEQ ID NO: 80581 - DNA, 103 bp, Artificial Sequence
  Synthetic Polynucleotide
taatacgactcactatagggtcccacatttgatgctccagtctggaaactaacagaggagaagtttcatgactggagcaaacctggcggcagcgcaaaagatg

SEQ ID NO: 80582 - DNA, 103 bp, Artificial Sequence
  Synthetic Polynucleotide
taatacgactcactatagggctgcttcccacatttgatgctccagtctggaacagaggagaccagacatgagcatcaaaaacctggcggcagcgcaaaagatg

SEQ ID NO: 80583 - DNA, 103 bp, Artificial Sequence
  Synthetic Polynucleotide
taatacgactcactatagggcttcactgcttcccacatttgatgctccagaacagaggagactggagatgcaaatgtggaacctggcggcagcgcaaaagatg

SEQ ID NO: 80584 - DNA, 103 bp, Artificial Sequence
  Synthetic Polynucleotide
taatacgactcactatagggtcgtccttcactgcttcccacatttgatgcaacagaggagagcatcaatggtgggaagcaacctggcggcagcgcaaaagatg

SEQ ID NO: 80585 - DNA, 103 bp, Artificial Sequence
  Synthetic Polynucleotide
taatacgactcactatagggtcagctcgtccttcactgcttcccacatttaacagaggagaaaatgtatgaagcagtgaaacctggcggcagcgcaaaagatg

SEQ ID NO: 80586 - DNA, 103 bp, Artificial Sequence
  Synthetic Polynucleotide
taatacgactcactatagggagtgttcagctcgtccttcactgcttcccaaacagaggagatgggaaatggtgaaggacaacctggcggcagcgcaaaagatg

SEQ ID NO: 80587 - DNA, 103 bp, Artificial Sequence
  Synthetic Polynucleotide
taatacgactcactatagggaaaagagtgttcagctcgtccttcactgctaacagaggagaagcagtatgggacgagctaacctggcggcagcgcaaaagatg

SEQ ID NO: 80588 - DNA, 103 bp, Artificial Sequence
  Synthetic Polynucleotide
taatacgactcactatagggccttcaaaagagtgttcagctcgtccttcaaacagaggagatgaaggatgagctgaacaaacctggcggcagcgcaaaagatg

SEQ ID NO: 80589 - DNA, 103 bp, Artificial Sequence
  Synthetic Polynucleotide
taatacgactcactatagggattctccttcaaaagagtgttcagctcgtcaacagaggagagacgagatgaacactcttaacctggcggcagcgcaaaagatg

SEQ ID NO: 80590 - DNA, 103 bp, Artificial Sequence
  Synthetic Polynucleotide
taatacgactcactatagggacaccattctccttcaaaagagtgttcagcaacagaggagagctgaaatgtcttttgaaaacctggcggcagcgcaaaagatg

SEQ ID NO: 80591 - DNA, 103 bp, Artificial Sequence
  Synthetic Polynucleotide
taatacgactcactatagggccagcactgctcgggtcggagcaattgctgaacagaggagacagcaaatgctccgacccaacctggcggcagcgcaaaagatg

SEQ ID NO: 80592 - DNA, 103 bp, Artificial Sequence
  Synthetic Polynucleotide
taatacgactcactatagggggtccacaccattctccttcaaaagagtgtaacagaggagaacactcatgtgaaggagaaacctggcggcagcgcaaaagatg

SEQ ID NO: 80593 - DNA, 103 bp, Artificial Sequence
  Synthetic Polynucleotide
taatacgactcactatagggactaaggtccacaccattctccttcaaaagaacagaggagacttttgatggagaatggtaacctggcggcagcgcaaaagatg

SEQ ID NO: 80594 - DNA, 103 bp, Artificial Sequence
  Synthetic Polynucleotide
taatacgactcactatagggacgacactaaggtccacaccattctccttcaacagaggagagaaggaatgtggtgtggaaacctggcggcagcgcaaaagatg

SEQ ID NO: 80595 - DNA, 103 bp, Artificial Sequence
  Synthetic Polynucleotide
taatacgactcactatagggcaaccacgacactaaggtccacaccattctaacagaggagaagaatgatgtggaccttaaacctggcggcagcgcaaaagatg

SEQ ID NO: 80596 - DNA, 103 bp, Artificial Sequence
  Synthetic Polynucleotide
taatacgactcactatagggtttctcaaccacgacactaaggtccacaccaacagaggagaggtgtgatgcttagtgtcaacctggcggcagcgcaaaagatg

SEQ ID NO: 80597 - DNA, 103 bp, Artificial Sequence
  Synthetic Polynucleotide
taatacgactcactatagggtcctgtttctcaaccacgacactaaggtccaacagaggagaggacctatgtgtcgtggtaacctggcggcagcgcaaaagatg

SEQ ID NO: 80598 - DNA, 103 bp, Artificial Sequence
  Synthetic Polynucleotide
taatacgactcactatagggttccctcctgtttctcaaccacgacactaaaacagaggagattagtgatgtggttgagaaacctggcggcagcgcaaaagatg

SEQ ID NO: 80599 - DNA, 103 bp, Artificial Sequence
  Synthetic Polynucleotide
taatacgactcactataggggtacattccctcctgtttctcaaccacgacaacagaggagagtcgtgatggagaaacagaacctggcggcagcgcaaaagatg

SEQ ID NO: 80600 - DNA, 103 bp, Artificial Sequence
  Synthetic Polynucleotide
taatacgactcactataggggacttgtacattccctcctgtttctcaaccaacagaggagaggttgaatgacaggagggaacctggcggcagcgcaaaagatg

SEQ ID NO: 80601 - DNA, 103 bp, Artificial Sequence
  Synthetic Polynucleotide
taatacgactcactataggggtgctgacttgtacattccctcctgtttctaacagaggagaagaaacatgagggaatgtaacctggcggcagcgcaaaagatg

SEQ ID NO: 80602 - DNA, 103 bp, Artificial Sequence
  Synthetic Polynucleotide
taatacgactcactatagggtcgatccagcactgctcgggtcggagcaataacagaggagaattgctatgacccgagcaaacctggcggcagcgcaaaagatg

SEQ ID NO: 80603 - DNA, 103 bp, Artificial Sequence
  Synthetic Polynucleotide
taatacgactcactatagggtttaggtgctgacttgtacattccctcctgaacagaggagacaggagatgatgtacaagaacctggcggcagcgcaaaagatg

SEQ ID NO: 80604 - DNA, 103 bp, Artificial Sequence
  Synthetic Polynucleotide
taatacgactcactatagggaggcgtttaggtgctgacttgtacattcccaacagaggagagggaatatgcaagtcagcaacctggcggcagcgcaaaagatg

SEQ ID NO: 80605 - DNA, 103 bp, Artificial Sequence
  Synthetic Polynucleotide
taatacgactcactatagggcggtgaggcgtttaggtgctgacttgtacaaacagaggagatgtacaatgcagcacctaaacctggcggcagcgcaaaagatg

SEQ ID NO: 80606 - DNA, 103 bp, Artificial Sequence
  Synthetic Polynucleotide
taatacgactcactatagggggtggcggtgaggcgtttaggtgctgacttaacagaggagaaagtcaatgcctaaacgcaacctggcggcagcgcaaaagatg

SEQ ID NO: 80607 - DNA, 103 bp, Artificial Sequence
  Synthetic Polynucleotide
taatacgactcactatagggtccgtggtggcggtgaggcgtttaggtgctaacagaggagaagcaccatgacgcctcacaacctggcggcagcgcaaaagatg

SEQ ID NO: 80608 - DNA, 103 bp, Artificial Sequence
  Synthetic Polynucleotide
taatacgactcactatagggatttttccgtggtggcggtgaggcgtttagaacagaggagactaaacatgtcaccgccaaacctggcggcagcgcaaaagatg

SEQ ID NO: 80609 - DNA, 103 bp, Artificial Sequence
  Synthetic Polynucleotide
taatacgactcactatagggttccaatttttccgtggtggcggtgaggcgaacagaggagacgcctcatggccaccacgaacctggcggcagcgcaaaagatg

SEQ ID NO: 80610 - DNA, 103 bp, Artificial Sequence
  Synthetic Polynucleotide
taatacgactcactatagggccaatttccaatttttccgtggtggcggtgaacagaggagacaccgcatgcacggaaaaaacctggcggcagcgcaaaagatg

SEQ ID NO: 80611 - DNA, 103 bp, Artificial Sequence
  Synthetic Polynucleotide
taatacgactcactatagggtccagccaatttccaatttttccgtggtggaacagaggagaccaccaatgaaaaattggaacctggcggcagcgcaaaagatg

SEQ ID NO: 80612 - DNA, 103 bp, Artificial Sequence
  Synthetic Polynucleotide
taatacgactcactatagggggccttccagccaatttccaatttttccgtaacagaggagaacggaaatgttggaaattaacctggcggcagcgcaaaagatg

SEQ ID NO: 80613 - DNA, 103 bp, Artificial Sequence
  Synthetic Polynucleotide
taatacgactcactatagggctccatcgatccagcactgctcgggtcggaaacagaggagatccgacatgagcagtgctaacctggcggcagcgcaaaagatg

SEQ ID NO: 80614 - DNA, 103 bp, Artificial Sequence
  Synthetic Polynucleotide
taatacgactcactatagggccccaggccttccagccaatttccaattttaacagaggagaaaaattatgaattggctgaacctggcggcagcgcaaaagatg

SEQ ID NO: 80615 - DNA, 103 bp, Artificial Sequence
  Synthetic Polynucleotide
taatacgactcactatagggtctttccccaggccttccagccaatttccaaacagaggagatggaaaatggctggaaggaacctggcggcagcgcaaaagatg

SEQ ID NO: 80616 - DNA, 103 bp, Artificial Sequence
  Synthetic Polynucleotide
taatacgactcactatagggaatactctttccccaggccttccagccaataacagaggagaattggcatgaaggcctggaacctggcggcagcgcaaaagatg

SEQ ID NO: 80617 - DNA, 103 bp, Artificial Sequence
  Synthetic Polynucleotide
taatacgactcactatagggaataaaatactctttccccaggccttccagaacagaggagactggaaatgctggggaaaaacctggcggcagcgcaaaagatg

SEQ ID NO: 80618 - DNA, 103 bp, Artificial Sequence
  Synthetic Polynucleotide
taatacgactcactataggggtgcaaataaaatactctttccccaggcctaacagaggagaaggcctatggaaagagtaaacctggcggcagcgcaaaagatg

SEQ ID NO: 80619 - DNA, 103 bp, Artificial Sequence
  Synthetic Polynucleotide
taatacgactcactatagggttctggtgcaaataaaatactctttccccaaacagaggagatggggaatgagtattttaaacctggcggcagcgcaaaagatg

SEQ ID NO: 80620 - DNA, 103 bp, Artificial Sequence
  Synthetic Polynucleotide
taatacgactcactataggggcgagttctggtgcaaataaaatactctttaacagaggagaaaagagatgtttatttgcaacctggcggcagcgcaaaagatg

SEQ ID NO: 80621 - DNA, 103 bp, Artificial Sequence
  Synthetic Polynucleotide
taatacgactcactatagggtgttggcgagttctggtgcaaataaaatacaacagaggagagtatttatgttgcaccagaacctggcggcagcgcaaaagatg

SEQ ID NO: 80622 - DNA, 103 bp, Artificial Sequence
  Synthetic Polynucleotide
taatacgactcactatagggggtgttgttggcgagttctggtgcaaataaaacagaggagattatttatgccagaactcaacctggcggcagcgcaaaagatg

SEQ ID NO: 80623 - DNA, 103 bp, Artificial Sequence
  Synthetic Polynucleotide
taatacgactcactatagggacaaaggtgttgttggcgagttctggtgcaaacagaggagatgcaccatgactcgccaaaacctggcggcagcgcaaaagatg

SEQ ID NO: 80624 - DNA, 103 bp, Artificial Sequence
  Synthetic Polynucleotide
taatacgactcactatagggcacctctccatcgatccagcactgctcgggaacagaggagacccgagatgtgctggatcaacctggcggcagcgcaaaagatg

SEQ ID NO: 80625 - DNA, 103 bp, Artificial Sequence
  Synthetic Polynucleotide
taatacgactcactatagggcaaccacaaaggtgttgttggcgagttctgaacagaggagacagaacatgccaacaacaaacctggcggcagcgcaaaagatg

SEQ ID NO: 80626 - DNA, 103 bp, Artificial Sequence
  Synthetic Polynucleotide
taatacgactcactatagggaccatcaaccacaaaggtgttgttggcgagaacagaggagactcgccatgaacacctttaacctggcggcagcgcaaaagatg

SEQ ID NO: 80627 - DNA, 103 bp, Artificial Sequence
  Synthetic Polynucleotide
taatacgactcactatagggtccggaccatcaaccacaaaggtgttgttgaacagaggagacaacaaatgctttgtggtaacctggcggcagcgcaaaagatg

SEQ ID NO: 80628 - DNA, 103 bp, Artificial Sequence
  Synthetic Polynucleotide
taatacgactcactatagggtggtctccggaccatcaaccacaaaggtgtaacagaggagaacacctatgtggttgatgaacctggcggcagcgcaaaagatg

SEQ ID NO: 80629 - DNA, 103 bp, Artificial Sequence
  Synthetic Polynucleotide
taatacgactcactatagggttccttggtctccggaccatcaaccacaaaaacagaggagatttgtgatggatggtccgaacctggcggcagcgcaaaagatg

SEQ ID NO: 80630 - DNA, 103 bp, Artificial Sequence
  Synthetic Polynucleotide
taatacgactcactatagggggacattccttggtctccggaccatcaaccaacagaggagaggttgaatgtccggagacaacctggcggcagcgcaaaagatg

SEQ ID NO: 80631 - DNA, 103 bp, Artificial Sequence
  Synthetic Polynucleotide
taatacgactcactataggggagtcggacattccttggtctccggaccataacagaggagaatggtcatgagaccaaggaacctggcggcagcgcaaaagatg

SEQ ID NO: 80632 - DNA, 103 bp, Artificial Sequence
  Synthetic Polynucleotide
taatacgactcactatagggattctgagtcggacattccttggtctccggaacagaggagaccggagatgaaggaatgtaacctggcggcagcgcaaaagatg

SEQ ID NO: 80633 - DNA, 103 bp, Artificial Sequence
  Synthetic Polynucleotide
taatacgactcactataggggcgcgattctgagtcggacattccttggtcaacagaggagagaccaaatgatgtccgacaacctggcggcagcgcaaaagatg

SEQ ID NO: 80634 - DNA, 103 bp, Artificial Sequence
  Synthetic Polynucleotide
taatacgactcactatagggtccaagcgcgattctgagtcggacattcctaacagaggagaaggaatatgcgactcagaaacctggcggcagcgcaaaagatg

SEQ ID NO: 80635 - DNA, 103 bp, Artificial Sequence
  Synthetic Polynucleotide
taatacgactcactataggggttcacacctctccatcgatccagcactgcaacagaggagagcagtgatggatcgatggaacctggcggcagcgcaaaagatg

SEQ ID NO: 80636 - DNA, 103 bp, Artificial Sequence
  Synthetic Polynucleotide
taatacgactcactataggggctattccaagcgcgattctgagtcggacaaacagaggagatgtccgatgcagaatcgcaacctggcggcagcgcaaaagatg

SEQ ID NO: 80637 - DNA, 103 bp, Artificial Sequence
  Synthetic Polynucleotide
taatacgactcactatagggtctaagctattccaagcgcgattctgagtcaacagaggagagactcaatgtcgcgcttgaacctggcggcagcgcaaaagatg

SEQ ID NO: 80638 - DNA, 103 bp, Artificial Sequence
  Synthetic Polynucleotide
taatacgactcactatagggccacttctaagctattccaagcgcgattctaacagaggagaagaatcatgcttggaataaacctggcggcagcgcaaaagatg

SEQ ID NO: 80639 - DNA, 103 bp, Artificial Sequence
  Synthetic Polynucleotide
taatacgactcactatagggatcctccacttctaagctattccaagcgcgaacagaggagacgcgctatgaatagcttaaacctggcggcagcgcaaaagatg

SEQ ID NO: 80640 - DNA, 103 bp, Artificial Sequence
  Synthetic Polynucleotide
taatacgactcactatagggccaaaatcctccacttctaagctattccaaaacagaggagattggaaatgcttagaagtaacctggcggcagcgcaaaagatg

SEQ ID NO: 80641 - DNA, 103 bp, Artificial Sequence
  Synthetic Polynucleotide
taatacgactcactatagggcaaatccaaaatcctccacttctaagctataacagaggagaatagctatgaagtggaggaacctggcggcagcgcaaaagatg

SEQ ID NO: 80642 - DNA, 103 bp, Artificial Sequence
  Synthetic Polynucleotide
taatacgactcactataggggagaccaaatccaaaatcctccacttctaaaacagaggagattagaaatggaggattttaacctggcggcagcgcaaaagatg

SEQ ID NO: 80643 - DNA, 103 bp, Artificial Sequence
  Synthetic Polynucleotide
taatacgactcactatagggctggtgagaccaaatccaaaatcctccactaacagaggagaagtggaatgttttggattaacctggcggcagcgcaaaagatg

SEQ ID NO: 80644 - DNA, 103 bp, Artificial Sequence
  Synthetic Polynucleotide
taatacgactcactataggggagtgctggtgagaccaaatccaaaatcctaacagaggagaaggattatggatttggtcaacctggcggcagcgcaaaagatg

SEQ ID NO: 80645 - DNA, 103 bp, Artificial Sequence
  Synthetic Polynucleotide
taatacgactcactatagggcatccgagtgctggtgagaccaaatccaaaaacagaggagatttggaatgggtctcaccaacctggcggcagcgcaaaagatg

SEQ ID NO: 80646 - DNA, 103 bp, Artificial Sequence
  Synthetic Polynucleotide
taatacgactcactatagggtgtttgttcacacctctccatcgatccagcaacagaggagagctggaatgatggagaggaacctggcggcagcgcaaaagatg

SEQ ID NO: 80647 - DNA, 103 bp, Artificial Sequence
  Synthetic Polynucleotide
taatacgactcactatagggaggaacatccgagtgctggtgagaccaaataacagaggagaatttggatgcaccagcacaacctggcggcagcgcaaaagatg

SEQ ID NO: 80648 - DNA, 103 bp, Artificial Sequence
  Synthetic Polynucleotide
taatacgactcactatagggccttcaggaacatccgagtgctggtgagacaacagaggagagtctcaatggcactcggaaacctggcggcagcgcaaaagatg

SEQ ID NO: 80649 - DNA, 103 bp, Artificial Sequence
  Synthetic Polynucleotide
taatacgactcactatagggtctgaccttcaggaacatccgagtgctggtaacagaggagaaccagcatgcggatgttcaacctggcggcagcgcaaaagatg

SEQ ID NO: 80650 - DNA, 103 bp, Artificial Sequence
  Synthetic Polynucleotide
taatacgactcactatagggctctctctgaccttcaggaacatccgagtgaacagaggagacactcgatggttcctgaaaacctggcggcagcgcaaaagatg

SEQ ID NO: 80651 - DNA, 103 bp, Artificial Sequence
  Synthetic Polynucleotide
taatacgactcactatagggtgttgctctctctgaccttcaggaacatccaacagaggagaggatgtatgtgaaggtcaaacctggcggcagcgcaaaagatg

SEQ ID NO: 80652 - DNA, 103 bp, Artificial Sequence
  Synthetic Polynucleotide
taatacgactcactatagggagttgtgttgctctctctgaccttcaggaaaacagaggagattcctgatggtcagagagaacctggcggcagcgcaaaagatg

SEQ ID NO: 80653 - DNA, 103 bp, Artificial Sequence
  Synthetic Polynucleotide
taatacgactcactatagggcattcagttgtgttgctctctctgaccttcaacagaggagagaaggtatgagagagcaaaacctggcggcagcgcaaaagatg

SEQ ID NO: 80654 - DNA, 103 bp, Artificial Sequence
  Synthetic Polynucleotide
taatacgactcactatagggagtcacattcagttgtgttgctctctctgaaacagaggagatcagagatggcaacacaaaacctggcggcagcgcaaaagatg

SEQ ID NO: 80655 - DNA, 103 bp, Artificial Sequence
  Synthetic Polynucleotide
taatacgactcactatagggcttcgagtcacattcagttgtgttgctctcaacagaggagagagagcatgacaactgaaaacctggcggcagcgcaaaagatg

SEQ ID NO: 80656 - DNA, 103 bp, Artificial Sequence
  Synthetic Polynucleotide
taatacgactcactatagggatgatcttcgagtcacattcagttgtgttgaacagaggagacaacacatgtgaatgtgaaacctggcggcagcgcaaaagatg

SEQ ID NO: 80657 - DNA, 103 bp, Artificial Sequence
  Synthetic Polynucleotide
taatacgactcactataggggttgttaatcctcacaaacactactaagttaacagaggagaaacttaatggtgtttgtgaacctggcggcagcgcaaaagatg

SEQ ID NO: 80658 - DNA, 103 bp, Artificial Sequence
  Synthetic Polynucleotide
taatacgactcactatagggctgtttgtttgttcacacctctccatcgataacagaggagaatcgatatggaggtgtgaaacctggcggcagcgcaaaagatg

SEQ ID NO: 80659 - DNA, 103 bp, Artificial Sequence
  Synthetic Polynucleotide
taatacgactcactatagggttccaatgatcttcgagtcacattcagttgaacagaggagacaactgatggtgactcgaaacctggcggcagcgcaaaagatg

SEQ ID NO: 80660 - DNA, 103 bp, Artificial Sequence
  Synthetic Polynucleotide
taatacgactcactatagggagccgttccaatgatcttcgagtcacattcaacagaggagagaatgtatgtcgaagatcaacctggcggcagcgcaaaagatg

SEQ ID NO: 80661 - DNA, 103 bp, Artificial Sequence
  Synthetic Polynucleotide
taatacgactcactatagggttgacagccgttccaatgatcttcgagtcaaacagaggagatgactcatggatcattggaacctggcggcagcgcaaaagatg

SEQ ID NO: 80662 - DNA, 103 bp, Artificial Sequence
  Synthetic Polynucleotide
taatacgactcactatagggtgttcttgacagccgttccaatgatcttcgaacagaggagacgaagaatgttggaacggaacctggcggcagcgcaaaagatg

SEQ ID NO: 80663 - DNA, 103 bp, Artificial Sequence
  Synthetic Polynucleotide
taatacgactcactatagggcaagttgttcttgacagccgttccaatgataacagaggagaatcattatgacggctgtcaacctggcggcagcgcaaaagatg

SEQ ID NO: 80664 - DNA, 103 bp, Artificial Sequence
  Synthetic Polynucleotide
taatacgactcactatagggatcgccaagttgttcttgacagccgttccaaacagaggagatggaacatgtgtcaagaaaacctggcggcagcgcaaaagatg

SEQ ID NO: 80665 - DNA, 103 bp, Artificial Sequence
  Synthetic Polynucleotide
taatacgactcactatagggtgtggatcgccaagttgttcttgacagccgaacagaggagacggctgatgagaacaactaacctggcggcagcgcaaaagatg

SEQ ID NO: 80666 - DNA, 103 bp, Artificial Sequence
  Synthetic Polynucleotide
taatacgactcactataggggtcactgtggatcgccaagttgttcttgacaacagaggagagtcaagatgaacttggcgaacctggcggcagcgcaaaagatg

SEQ ID NO: 80667 - DNA, 103 bp, Artificial Sequence
  Synthetic Polynucleotide
taatacgactcactataggggacaggtcactgtggatcgccaagttgttcaacagaggagagaacaaatgggcgatccaaacctggcggcagcgcaaaagatg

SEQ ID NO: 80668 - DNA, 103 bp, Artificial Sequence
  Synthetic Polynucleotide
taatacgactcactatagggaataggacaggtcactgtggatcgccaagtaacagaggagaacttggatgtccacagtgaacctggcggcagcgcaaaagatg

SEQ ID NO: 80669 - DNA, 103 bp, Artificial Sequence
  Synthetic Polynucleotide
taatacgactcactatagggcatcgctgtttgtttgttcacacctctccaaacagaggagatggagaatggtgaacaaaaacctggcggcagcgcaaaagatg

SEQ ID NO: 80670 - DNA, 103 bp, Artificial Sequence
  Synthetic Polynucleotide
taatacgactcactatagggaatccaataggacaggtcactgtggatcgcaacagaggagagcgatcatgagtgacctgaacctggcggcagcgcaaaagatg

SEQ ID NO: 80671 - DNA, 103 bp, Artificial Sequence
  Synthetic Polynucleotide
taatacgactcactatagggctttcaatccaataggacaggtcactgtggaacagaggagaccacagatgcctgtcctaaacctggcggcagcgcaaaagatg

SEQ ID NO: 80672 - DNA, 103 bp, Artificial Sequence
  Synthetic Polynucleotide
taatacgactcactataggggcctgctttcaatccaataggacaggtcacaacagaggagagtgaccatgcctattggaaacctggcggcagcgcaaaagatg

SEQ ID NO: 80673 - DNA, 103 bp, Artificial Sequence
  Synthetic Polynucleotide
taatacgactcactatagggattgagcctgctttcaatccaataggacagaacagaggagactgtccatgtggattgaaaacctggcggcagcgcaaaagatg

SEQ ID NO: 80674 - DNA, 103 bp, Artificial Sequence
  Synthetic Polynucleotide
taatacgactcactataggggtatcattgagcctgctttcaatccaatagaacagaggagactattgatgtgaaagcagaacctggcggcagcgcaaaagatg

SEQ ID NO: 80675 - DNA, 103 bp, Artificial Sequence
  Synthetic Polynucleotide
taatacgactcactatagggtccacgtatcattgagcctgctttcaatccaacagaggagaggattgatggcaggctcaaacctggcggcagcgcaaaagatg

SEQ ID NO: 80676 - DNA, 103 bp, Artificial Sequence
  Synthetic Polynucleotide
taatacgactcactatagggaagcttccacgtatcattgagcctgctttcaacagaggagagaaagcatgctcaatgataacctggcggcagcgcaaaagatg

SEQ ID NO: 80677 - DNA, 103 bp, Artificial Sequence
  Synthetic Polynucleotide
taatacgactcactatagggctttcaagcttccacgtatcattgagcctgaacagaggagacaggctatgtgatacgtgaacctggcggcagcgcaaaagatg

SEQ ID NO: 80678 - DNA, 103 bp, Artificial Sequence
  Synthetic Polynucleotide
taatacgactcactatagggctgccctttcaagcttccacgtatcattgaaacagaggagatcaatgatgcgtggaagcaacctggcggcagcgcaaaagatg

SEQ ID NO: 80679 - DNA, 103 bp, Artificial Sequence
  Synthetic Polynucleotide
taatacgactcactatagggcagaactgccctttcaagcttccacgtatcaacagaggagagatacgatgaagcttgaaaacctggcggcagcgcaaaagatg

SEQ ID NO: 80680 - DNA, 103 bp, Artificial Sequence
  Synthetic Polynucleotide
taatacgactcactatagggtgtttcatcgctgtttgtttgttcacacctaacagaggagaaggtgtatgcaaacaaacaacctggcggcagcgcaaaagatg

SEQ ID NO: 80681 - DNA, 103 bp, Artificial Sequence
  Synthetic Polynucleotide
taatacgactcactatagggtcacccagaactgccctttcaagcttccacaacagaggagagtggaaatgtgaaagggcaacctggcggcagcgcaaaagatg

SEQ ID NO: 80682 - DNA, 103 bp, Artificial Sequence
  Synthetic Polynucleotide
taatacgactcactatagggtgacttcacccagaactgccctttcaagctaacagaggagaagcttgatggggcagttcaacctggcggcagcgcaaaagatg

SEQ ID NO: 80683 - DNA, 103 bp, Artificial Sequence
  Synthetic Polynucleotide
taatacgactcactatagggtgatttgacttcacccagaactgccctttcaacagaggagagaaaggatggttctgggtaacctggcggcagcgcaaaagatg

SEQ ID NO: 80684 - DNA, 103 bp, Artificial Sequence
  Synthetic Polynucleotide
taatacgactcactataggggtacatgatttgacttcacccagaactgccaacagaggagaggcagtatggggtgaagtaacctggcggcagcgcaaaagatg

SEQ ID NO: 80685 - DNA, 103 bp, Artificial Sequence
  Synthetic Polynucleotide
taatacgactcactataggggccacgtacatgatttgacttcacccagaaaacagaggagattctggatgaagtcaaataacctggcggcagcgcaaaagatg

SEQ ID NO: 80686 - DNA, 103 bp, Artificial Sequence
  Synthetic Polynucleotide
taatacgactcactatagggctcaggccacgtacatgatttgacttcaccaacagaggagaggtgaaatgaaatcatgtaacctggcggcagcgcaaaagatg

SEQ ID NO: 80687 - DNA, 103 bp, Artificial Sequence
  Synthetic Polynucleotide
taatacgactcactatagggtgcgtctcaggccacgtacatgatttgactaacagaggagaagtcaaatgatgtacgtgaacctggcggcagcgcaaaagatg

SEQ ID NO: 80688 - DNA, 103 bp, Artificial Sequence
  Synthetic Polynucleotide
taatacgactcactatagggaggtatgcgtctcaggccacgtacatgattaacagaggagaaatcatatgcgtggcctgaacctggcggcagcgcaaaagatg

SEQ ID NO: 80689 - DNA, 103 bp, Artificial Sequence
  Synthetic Polynucleotide
taatacgactcactatagggccacaaggtatgcgtctcaggccacgtacaaacagaggagatgtacgatgcctgagacgaacctggcggcagcgcaaaagatg

SEQ ID NO: 80690 - DNA, 103 bp, Artificial Sequence
  Synthetic Polynucleotide
taatacgactcactatagggtcgccccacaaggtatgcgtctcaggccacaacagaggagagtggccatggacgcatacaacctggcggcagcgcaaaagatg

SEQ ID NO: 80691 - DNA, 103 bp, Artificial Sequence
  Synthetic Polynucleotide
taatacgactcactataggggaaggtgtttcatcgctgtttgtttgttcaaacagaggagatgaacaatgaaacagcgaaacctggcggcagcgcaaaagatg

SEQ ID NO: 80692 - DNA, 103 bp, Artificial Sequence
  Synthetic Polynucleotide
taatacgactcactatagggttccatcgccccacaaggtatgcgtctcagaacagaggagactgagaatgataccttgtaacctggcggcagcgcaaaagatg

SEQ ID NO: 80693 - DNA, 103 bp, Artificial Sequence
  Synthetic Polynucleotide
taatacgactcactatagggaaggattccatcgccccacaaggtatgcgtaacagaggagaacgcatatgttgtggggcaacctggcggcagcgcaaaagatg

SEQ ID NO: 80694 - DNA, 103 bp, Artificial Sequence
  Synthetic Polynucleotide
taatacgactcactatagggctctcaaggattccatcgccccacaaggtaaacagaggagataccttatggggcgatggaacctggcggcagcgcaaaagatg

SEQ ID NO: 80695 - DNA, 103 bp, Artificial Sequence
  Synthetic Polynucleotide
taatacgactcactatagggagtcactctcaaggattccatcgccccacaaacagaggagatgtgggatgatggaatccaacctggcggcagcgcaaaagatg

SEQ ID NO: 80696 - DNA, 103 bp, Artificial Sequence
  Synthetic Polynucleotide
taatacgactcactatagggtatcaagtcactctcaaggattccatcgccaacagaggagaggcgatatgatccttgagaacctggcggcagcgcaaaagatg

SEQ ID NO: 80697 - DNA, 103 bp, Artificial Sequence
  Synthetic Polynucleotide
taatacgactcactatagggggtattatcaagtcactctcaaggattccaaacagaggagatggaatatgtgagagtgaaacctggcggcagcgcaaaagatg

SEQ ID NO: 80698 - DNA, 103 bp, Artificial Sequence
  Synthetic Polynucleotide
taatacgactcactatagggtgactggtattatcaagtcactctcaaggaaacagaggagatccttgatggtgacttgaaacctggcggcagcgcaaaagatg

SEQ ID NO: 80699 - DNA, 103 bp, Artificial Sequence
  Synthetic Polynucleotide
taatacgactcactatagggcagtgtgactggtattatcaagtcactctcaacagaggagagagagtatgttgataataaacctggcggcagcgcaaaagatg

SEQ ID NO: 80700 - DNA, 103 bp, Artificial Sequence
  Synthetic Polynucleotide
taatacgactcactatagggcccgccagtgtgactggtattatcaagtcaaacagaggagatgacttatgaataccagtaacctggcggcagcgcaaaagatg

SEQ ID NO: 80701 - DNA, 103 bp, Artificial Sequence
  Synthetic Polynucleotide
taatacgactcactataggggtggtcccgccagtgtgactggtattatcaaacagaggagatgataaatgcagtcacacaacctggcggcagcgcaaaagatg

SEQ ID NO: 80702 - DNA, 103 bp, Artificial Sequence
  Synthetic Polynucleotide
taatacgactcactatagggactcagaaggtgtttcatcgctgtttgtttaacagaggagaaaacaaatggcgatgaaaaacctggcggcagcgcaaaagatg

SEQ ID NO: 80703 - DNA, 103 bp, Artificial Sequence
  Synthetic Polynucleotide
taatacgactcactataggggcttcgtggtcccgccagtgtgactggtataacagaggagaataccaatgacactggcgaacctggcggcagcgcaaaagatg

SEQ ID NO: 80704 - DNA, 103 bp, Artificial Sequence
  Synthetic Polynucleotide
taatacgactcactatagggtgattgcttcgtggtcccgccagtgtgactaacagaggagaagtcacatgggcgggaccaacctggcggcagcgcaaaagatg

SEQ ID NO: 80705 - DNA, 103 bp, Artificial Sequence
  Synthetic Polynucleotide
taatacgactcactataggggattgtgattgcttcgtggtcccgccagtgaacagaggagacactggatggaccacgaaaacctggcggcagcgcaaaagatg

SEQ ID NO: 80706 - DNA, 103 bp, Artificial Sequence
  Synthetic Polynucleotide
taatacgactcactatagggtctccgattgtgattgcttcgtggtcccgcaacagaggagagcgggaatgcgaagcaataacctggcggcagcgcaaaagatg

SEQ ID NO: 80707 - DNA, 103 bp, Artificial Sequence
  Synthetic Polynucleotide
taatacgactcactatagggccaggtctccgattgtgattgcttcgtggtaacagaggagaaccacgatgcaatcacaaaacctggcggcagcgcaaaagatg

SEQ ID NO: 80708 - DNA, 103 bp, Artificial Sequence
  Synthetic Polynucleotide
taatacgactcactatagggtgtacccaggtctccgattgtgattgcttcaacagaggagagaagcaatgacaatcggaaacctggcggcagcgcaaaagatg

SEQ ID NO: 80709 - DNA, 103 bp, Artificial Sequence
  Synthetic Polynucleotide
taatacgactcactatagggtgtcttgtacccaggtctccgattgtgattaacagaggagaaatcacatgcggagacctaacctggcggcagcgcaaaagatg

SEQ ID NO: 80710 - DNA, 103 bp, Artificial Sequence
  Synthetic Polynucleotide
taatacgactcactatagggttttgtgtcttgtacccaggtctccgattgaacagaggagacaatcgatgacctgggtaaacctggcggcagcgcaaaagatg

SEQ ID NO: 80711 - DNA, 103 bp, Artificial Sequence
  Synthetic Polynucleotide
taatacgactcactatagggcctggttttgtgtcttgtacccaggtctccaacagaggagaggagacatgggtacaagaaacctggcggcagcgcaaaagatg

SEQ ID NO: 80712 - DNA, 103 bp, Artificial Sequence
  Synthetic Polynucleotide
taatacgactcactatagggtgggccctggttttgtgtcttgtacccaggaacagaggagacctgggatgaagacacaaaacctggcggcagcgcaaaagatg

SEQ ID NO: 80713 - DNA, 103 bp, Artificial Sequence
  Synthetic Polynucleotide
taatacgactcactatagggttaaaactcagaaggtgtttcatcgctgttaacagaggagaaacagcatggaaacacctaacctggcggcagcgcaaaagatg

SEQ ID NO: 80714 - DNA, 103 bp, Artificial Sequence
  Synthetic Polynucleotide
taatacgactcactatagggtcccatgggccctggttttgtgtcttgtacaacagaggagagtacaaatgacaaaaccaaacctggcggcagcgcaaaagatg

SEQ ID NO: 80715 - DNA, 103 bp, Artificial Sequence
  Synthetic Polynucleotide
taatacgactcactatagggcttcgtcccatgggccctggttttgtgtctaacagaggagaagacacatgaccagggccaacctggcggcagcgcaaaagatg

SEQ ID NO: 80716 - DNA, 103 bp, Artificial Sequence
  Synthetic Polynucleotide
taatacgactcactatagggccggccttcgtcccatgggccctggttttgaacagaggagacaaaacatgggcccatggaacctggcggcagcgcaaaagatg

SEQ ID NO: 80717 - DNA, 103 bp, Artificial Sequence
  Synthetic Polynucleotide
taatacgactcactatagggtctacccggccttcgtcccatgggccctggaacagaggagaccagggatgatgggacgaaacctggcggcagcgcaaaagatg

SEQ ID NO: 80718 - DNA, 103 bp, Artificial Sequence
  Synthetic Polynucleotide
taatacgactcactatagggcaatctctacccggccttcgtcccatgggcaacagaggagagcccatatgacgaaggccaacctggcggcagcgcaaaagatg

SEQ ID NO: 80719 - DNA, 103 bp, Artificial Sequence
  Synthetic Polynucleotide
taatacgactcactataggggaagtcaatctctacccggccttcgtcccaaacagaggagatgggacatgggccgggtaaacctggcggcagcgcaaaagatg

SEQ ID NO: 80720 - DNA, 103 bp, Artificial Sequence
  Synthetic Polynucleotide
taatacgactcactatagggtaatcgaagtcaatctctacccggccttcgaacagaggagacgaaggatgggtagagataacctggcggcagcgcaaaagatg

SEQ ID NO: 80721 - DNA, 103 bp, Artificial Sequence
  Synthetic Polynucleotide
taatacgactcactatagggggcagtaatcgaagtcaatctctacccggcaacagaggagagccgggatgagattgactaacctggcggcagcgcaaaagatg

SEQ ID NO: 80722 - DNA, 103 bp, Artificial Sequence
  Synthetic Polynucleotide
taatacgactcactatagggtcctgggcagtaatcgaagtcaatctctacaacagaggagagtagagatggacttcgataacctggcggcagcgcaaaagatg

SEQ ID NO: 80723 - DNA, 103 bp, Artificial Sequence
  Synthetic Polynucleotide
taatacgactcactataggggtagttcctgggcagtaatcgaagtcaatcaacagaggagagattgaatgcgattactgaacctggcggcagcgcaaaagatg

SEQ ID NO: 80724 - DNA, 103 bp, Artificial Sequence
  Synthetic Polynucleotide
taatacgactcactatagggccttcttaaaactcagaaggtgtttcatcgaacagaggagacgatgaatgaccttctgaaacctggcggcagcgcaaaagatg

SEQ ID NO: 80725 - DNA, 103 bp, Artificial Sequence
  Synthetic Polynucleotide
taatacgactcactatagggtgaccgtagttcctgggcagtaatcgaagtaacagaggagaacttcgatgactgcccagaacctggcggcagcgcaaaagatg

SEQ ID NO: 80726 - DNA, 103 bp, Artificial Sequence
  Synthetic Polynucleotide
taatacgactcactatagggcagggtgaccgtagttcctgggcagtaatcaacagaggagagattacatgccaggaactaacctggcggcagcgcaaaagatg

SEQ ID NO: 80727 - DNA, 103 bp, Artificial Sequence
  Synthetic Polynucleotide
taatacgactcactatagggtcactcagggtgaccgtagttcctgggcagaacagaggagactgcccatgaactacggtaacctggcggcagcgcaaaagatg

SEQ ID NO: 80728 - DNA, 103 bp, Artificial Sequence
  Synthetic Polynucleotide
taatacgactcactatagggagctctcactcagggtgaccgtagttcctgaacagaggagacaggaaatgcggtcacccaacctggcggcagcgcaaaagatg

SEQ ID NO: 80729 - DNA, 103 bp, Artificial Sequence
  Synthetic Polynucleotide
taatacgactcactatagggtccgcagctctcactcagggtgaccgtagtaacagaggagaactacgatgaccctgagtaacctggcggcagcgcaaaagatg

SEQ ID NO: 80730 - DNA, 103 bp, Artificial Sequence
  Synthetic Polynucleotide
taatacgactcactatagggcggtgtccgcagctctcactcagggtgaccaacagaggagaggtcacatggagtgagagaacctggcggcagcgcaaaagatg

SEQ ID NO: 80731 - DNA, 103 bp, Artificial Sequence
  Synthetic Polynucleotide
taatacgactcactataggggtccacggtgtccgcagctctcactcagggaacagaggagaccctgaatgagagctgcgaacctggcggcagcgcaaaagatg

SEQ ID NO: 80732 - DNA, 103 bp, Artificial Sequence
  Synthetic Polynucleotide
taatacgactcactatagggggcaggtccacggtgtccgcagctctcactaacagaggagaagtgagatgtgcggacacaacctggcggcagcgcaaaagatg

SEQ ID NO: 80733 - DNA, 103 bp, Artificial Sequence
  Synthetic Polynucleotide
taatacgactcactatagggcgagtggcaggtccacggtgtccgcagctcaacagaggagagagctgatgacaccgtggaacctggcggcagcgcaaaagatg

SEQ ID NO: 80734 - DNA, 103 bp, Artificial Sequence
  Synthetic Polynucleotide
taatacgactcactatagggtggtgcgagtggcaggtccacggtgtccgcaacagaggagagcggacatggtggacctgaacctggcggcagcgcaaaagatg

SEQ ID NO: 80735 - DNA, 103 bp, Artificial Sequence
  Synthetic Polynucleotide
taatacgactcactatagggtagttccttcttaaaactcagaaggtgtttaacagaggagaaaacacatgctgagttttaacctggcggcagcgcaaaagatg

SEQ ID NO: 80736 - DNA, 103 bp, Artificial Sequence
  Synthetic Polynucleotide
taatacgactcactatagggtgtggtggtgcgagtggcaggtccacggtgaacagaggagacaccgtatgcctgccactaacctggcggcagcgcaaaagatg

SEQ ID NO: 80737 - DNA, 103 bp, Artificial Sequence
  Synthetic Polynucleotide
taatacgactcactatagggctctctgtggtggtgcgagtggcaggtccaaacagaggagatggaccatgcactcgcacaacctggcggcagcgcaaaagatg

SEQ ID NO: 80738 - DNA, 103 bp, Artificial Sequence
  Synthetic Polynucleotide
taatacgactcactatagggttccgctctctgtggtggtgcgagtggcagaacagaggagactgccaatggcaccaccaaacctggcggcagcgcaaaagatg

SEQ ID NO: 80739 - DNA, 103 bp, Artificial Sequence
  Synthetic Polynucleotide
taatacgactcactatagggcaactttccgctctctgtggtggtgcgagtaacagaggagaactcgcatgaccacagagaacctggcggcagcgcaaaagatg

SEQ ID NO: 80740 - DNA, 103 bp, Artificial Sequence
  Synthetic Polynucleotide
taatacgactcactataggggttatcaactttccgctctctgtggtggtgaacagaggagacaccacatgagagagcggaacctggcggcagcgcaaaagatg

SEQ ID NO: 80741 - DNA, 103 bp, Artificial Sequence
  Synthetic Polynucleotide
taatacgactcactatagggaatctgttatcaactttccgctctctgtggaacagaggagaccacagatggcggaaagtaacctggcggcagcgcaaaagatg

SEQ ID NO: 80742 - DNA, 103 bp, Artificial Sequence
  Synthetic Polynucleotide
taatacgactcactataggggcaccaatctgttatcaactttccgctctcaacagaggagagagagcatgaagttgataaacctggcggcagcgcaaaagatg

SEQ ID NO: 80743 - DNA, 103 bp, Artificial Sequence
  Synthetic Polynucleotide
taatacgactcactatagggctgcagcaccaatctgttatcaactttccgaacagaggagacggaaaatggataacagaaacctggcggcagcgcaaaagatg

SEQ ID NO: 80744 - DNA, 103 bp, Artificial Sequence
  Synthetic Polynucleotide
taatacgactcactatagggagctcctgcagcaccaatctgttatcaactaacagaggagaagttgaatgcagattggtaacctggcggcagcgcaaaagatg

SEQ ID NO: 80745 - DNA, 103 bp, Artificial Sequence
  Synthetic Polynucleotide
taatacgactcactatagggggtgcagctcctgcagcaccaatctgttataacagaggagaataacaatgtggtgctgcaacctggcggcagcgcaaaagatg

SEQ ID NO: 80746 - DNA, 103 bp, Artificial Sequence
  Synthetic Polynucleotide
taatacgactcactataggggtccctagttccttcttaaaactcagaaggaacagaggagaccttctatgttttaagaaaacctggcggcagcgcaaaagatg

SEQ ID NO: 80747 - DNA, 103 bp, Artificial Sequence
  Synthetic Polynucleotide
taatacgactcactatagggggtaaggtgcagctcctgcagcaccaatctaacagaggagaagattgatgctgcaggagaacctggcggcagcgcaaaagatg

SEQ ID NO: 80748 - DNA, 103 bp, Artificial Sequence
  Synthetic Polynucleotide
taatacgactcactataggggtggtggtaaggtgcagctcctgcagcaccaacagaggagaggtgctatgggagctgcaaacctggcggcagcgcaaaagatg

SEQ ID NO: 80749 - DNA, 103 bp, Artificial Sequence
  Synthetic Polynucleotide
taatacgactcactataggggcgcagtggtggtaaggtgcagctcctgcaaacagaggagatgcaggatgtgcaccttaaacctggcggcagcgcaaaagatg

SEQ ID NO: 80750 - DNA, 103 bp, Artificial Sequence
  Synthetic Polynucleotide
taatacgactcactatagggtggtagcgcagtggtggtaaggtgcagctcaacagaggagagagctgatgcttaccaccaacctggcggcagcgcaaaagatg

SEQ ID NO: 80751 - DNA, 103 bp, Artificial Sequence
  Synthetic Polynucleotide
taatacgactcactatagggcagtttggtagcgcagtggtggtaaggtgcaacagaggagagcacctatgcaccactgcaacctggcggcagcgcaaaagatg

SEQ ID NO: 80752 - DNA, 103 bp, Artificial Sequence
  Synthetic Polynucleotide
taatacgactcactataggggctgtcagtttggtagcgcagtggtggtaaaacagaggagattaccaatgctgcgctacaacctggcggcagcgcaaaagatg

SEQ ID NO: 80753 - DNA, 103 bp, Artificial Sequence
  Synthetic Polynucleotide
taatacgactcactatagggcagccgctgtcagtttggtagcgcagtggtaacagaggagaaccactatgctaccaaacaacctggcggcagcgcaaaagatg

SEQ ID NO: 80754 - DNA, 103 bp, Artificial Sequence
  Synthetic Polynucleotide
taatacgactcactatagggaccaacagccgctgtcagtttggtagcgcaaacagaggagatgcgctatgaaactgacaaacctggcggcagcgcaaaagatg

SEQ ID NO: 80755 - DNA, 103 bp, Artificial Sequence
  Synthetic Polynucleotide
taatacgactcactatagggaccataccaacagccgctgtcagtttggtaaacagaggagataccaaatggacagcggcaacctggcggcagcgcaaaagatg

SEQ ID NO: 80756 - DNA, 103 bp, Artificial Sequence
  Synthetic Polynucleotide
taatacgactcactatagggtccataccataccaacagccgctgtcagttaacagaggagaaactgaatgcggctgttgaacctggcggcagcgcaaaagatg

SEQ ID NO: 80757 - DNA, 103 bp, Artificial Sequence
  Synthetic Polynucleotide
taatacgactcactatagggtcaaggtccctagttccttcttaaaactcaaacagaggagatgagttatgagaaggaacaacctggcggcagcgcaaaagatg

SEQ ID NO: 80758 - DNA, 103 bp, Artificial Sequence
  Synthetic Polynucleotide
taatacgactcactatagggtgatctccataccataccaacagccgctgtaacagaggagaacagcgatggttggtatgaacctggcggcagcgcaaaagatg

SEQ ID NO: 80759 - DNA, 103 bp, Artificial Sequence
  Synthetic Polynucleotide
taatacgactcactatagggtggtctgatctccataccataccaacagccaacagaggagaggctgtatgtatggtatgaacctggcggcagcgcaaaagatg

SEQ ID NO: 80760 - DNA, 103 bp, Artificial Sequence
  Synthetic Polynucleotide
taatacgactcactatagggctctgtggtctgatctccataccataccaaaacagaggagattggtaatgtatggagataacctggcggcagcgcaaaagatg

SEQ ID NO: 80761 - DNA, 103 bp, Artificial Sequence
  Synthetic Polynucleotide
taatacgactcactatagggcatgtctctgtggtctgatctccataccataacagaggagaatggtaatgagatcagacaacctggcggcagcgcaaaagatg

SEQ ID NO: 80762 - DNA, 103 bp, Artificial Sequence
  Synthetic Polynucleotide
taatacgactcactatagggttcatcatgtctctgtggtctgatctccataacagaggagaatggagatgagaccacagaacctggcggcagcgcaaaagatg

SEQ ID NO: 80763 - DNA, 103 bp, Artificial Sequence
  Synthetic Polynucleotide
taatacgactcactataggggtcttttcatcatgtctctgtggtctgatcaacagaggagagatcagatgacagagacaaacctggcggcagcgcaaaagatg

SEQ ID NO: 80764 - DNA, 103 bp, Artificial Sequence
  Synthetic Polynucleotide
taatacgactcactatagggcgagggtcttttcatcatgtctctgtggtcaacagaggagagaccacatggacatgatgaacctggcggcagcgcaaaagatg

SEQ ID NO: 80765 - DNA, 103 bp, Artificial Sequence
  Synthetic Polynucleotide
taatacgactcactatagggctgcacgagggtcttttcatcatgtctctgaacagaggagacagagaatggatgaaaagaacctggcggcagcgcaaaagatg

SEQ ID NO: 80766 - DNA, 103 bp, Artificial Sequence
  Synthetic Polynucleotide
taatacgactcactatagggtgtgactgcacgagggtcttttcatcatgtaacagaggagaacatgaatgaaagaccctaacctggcggcagcgcaaaagatg

SEQ ID NO: 80767 - DNA, 103 bp, Artificial Sequence
  Synthetic Polynucleotide
taatacgactcactatagggtcacttgtgactgcacgagggtcttttcataacagaggagaatgaaaatgccctcgtgcaacctggcggcagcgcaaaagatg

SEQ ID NO: 80768 - DNA, 103 bp, Artificial Sequence
  Synthetic Polynucleotide
taatacgactcactatagggtaattgttgttaatcctcacaaacactactaacagaggagaagtagtatgtgtgaggataacctggcggcagcgcaaaagatg

SEQ ID NO: 80769 - DNA, 103 bp, Artificial Sequence
  Synthetic Polynucleotide
taatacgactcactatagggactggtcaaggtccctagttccttcttaaaaacagaggagatttaagatggaactagggaacctggcggcagcgcaaaagatg

SEQ ID NO: 80770 - DNA, 103 bp, Artificial Sequence
  Synthetic Polynucleotide
taatacgactcactatagggagcattcacttgtgactgcacgagggtcttaacagaggagaaagaccatggtgcagtcaaacctggcggcagcgcaaaagatg

SEQ ID NO: 80771 - DNA, 103 bp, Artificial Sequence
  Synthetic Polynucleotide
taatacgactcactatagggttataagcattcacttgtgactgcacgaggaacagaggagacctcgtatggtcacaagtaacctggcggcagcgcaaaagatg

SEQ ID NO: 80772 - DNA, 103 bp, Artificial Sequence
  Synthetic Polynucleotide
taatacgactcactatagggcagcattataagcattcacttgtgactgcaaacagaggagatgcagtatgaagtgaatgaacctggcggcagcgcaaaagatg

SEQ ID NO: 80773 - DNA, 103 bp, Artificial Sequence
  Synthetic Polynucleotide
taatacgactcactatagggcatatcagcattataagcattcacttgtgaaacagaggagatcacaaatgaatgcttataacctggcggcagcgcaaaagatg

SEQ ID NO: 80774 - DNA, 103 bp, Artificial Sequence
  Synthetic Polynucleotide
taatacgactcactatagggtcaatcatatcagcattataagcattcactaacagaggagaagtgaaatgttataatgcaacctggcggcagcgcaaaagatg

SEQ ID NO: 80775 - DNA, 103 bp, Artificial Sequence
  Synthetic Polynucleotide
taatacgactcactatagggaagggtcaatcatatcagcattataagcataacagaggagaatgcttatgatgctgataaacctggcggcagcgcaaaagatg

SEQ ID NO: 80776 - DNA, 103 bp, Artificial Sequence
  Synthetic Polynucleotide
taatacgactcactatagggctgaaaagggtcaatcatatcagcattataaacagaggagatataatatggatatgattaacctggcggcagcgcaaaagatg

SEQ ID NO: 80777 - DNA, 103 bp, Artificial Sequence
  Synthetic Polynucleotide
taatacgactcactatagggcccaactgaaaagggtcaatcatatcagcaaacagaggagatgctgaatggattgacccaacctggcggcagcgcaaaagatg

SEQ ID NO: 80778 - DNA, 103 bp, Artificial Sequence
  Synthetic Polynucleotide
taatacgactcactataggggaaggcccaactgaaaagggtcaatcatataacagaggagaatatgaatgacccttttcaacctggcggcagcgcaaaagatg

SEQ ID NO: 80779 - DNA, 103 bp, Artificial Sequence
  Synthetic Polynucleotide
taatacgactcactataggggaccagaaggcccaactgaaaagggtcaataacagaggagaattgacatgtttcagttgaacctggcggcagcgcaaaagatg

SEQ ID NO: 80780 - DNA, 103 bp, Artificial Sequence
  Synthetic Polynucleotide
taatacgactcactatagggatagcactggtcaaggtccctagttccttcaacagaggagagaaggaatgagggaccttaacctggcggcagcgcaaaagatg

SEQ ID NO: 80781 - DNA, 103 bp, Artificial Sequence
  Synthetic Polynucleotide
taatacgactcactatagggaacacgaccagaaggcccaactgaaaagggaacagaggagaccctttatggttgggcctaacctggcggcagcgcaaaagatg

SEQ ID NO: 80782 - DNA, 103 bp, Artificial Sequence
  Synthetic Polynucleotide
taatacgactcactatagggccaagaacacgaccagaaggcccaactgaaaacagaggagattcagtatggccttctggaacctggcggcagcgcaaaagatg

SEQ ID NO: 80783 - DNA, 103 bp, Artificial Sequence
  Synthetic Polynucleotide
taatacgactcactatagggggtggccaagaacacgaccagaaggcccaaaacagaggagattgggcatgctggtcgtgaacctggcggcagcgcaaaagatg

SEQ ID NO: 80784 - DNA, 103 bp, Artificial Sequence
  Synthetic Polynucleotide
taatacgactcactatagggtcctgggtggccaagaacacgaccagaaggaacagaggagaccttctatgcgtgttcttaacctggcggcagcgcaaaagatg

SEQ ID NO: 80785 - DNA, 103 bp, Artificial Sequence
  Synthetic Polynucleotide
taatacgactcactatagggggacctcctgggtggccaagaacacgaccaaacagaggagatggtcgatgtcttggccaaacctggcggcagcgcaaaagatg

SEQ ID NO: 80786 - DNA, 103 bp, Artificial Sequence
  Synthetic Polynucleotide
taatacgactcactataggggcgaaggacctcctgggtggccaagaacacaacagaggagagtgttcatggccacccagaacctggcggcagcgcaaaagatg

SEQ ID NO: 80787 - DNA, 103 bp, Artificial Sequence
  Synthetic Polynucleotide
taatacgactcactatagggctcttgcgaaggacctcctgggtggccaagaacagaggagacttggcatgccaggaggtaacctggcggcagcgcaaaagatg

SEQ ID NO: 80788 - DNA, 103 bp, Artificial Sequence
  Synthetic Polynucleotide
taatacgactcactatagggtccacctcttgcgaaggacctcctgggtggaacagaggagaccacccatgaggtccttcaacctggcggcagcgcaaaagatg

SEQ ID NO: 80789 - DNA, 103 bp, Artificial Sequence
  Synthetic Polynucleotide
taatacgactcactatagggggctgtccacctcttgcgaaggacctcctgaacagaggagacaggagatgcttcgcaagaacctggcggcagcgcaaaagatg

SEQ ID NO: 80790 - DNA, 103 bp, Artificial Sequence
  Synthetic Polynucleotide
taatacgactcactatagggatcttggctgtccacctcttgcgaaggaccaacagaggagaggtcctatgcaagaggtgaacctggcggcagcgcaaaagatg

SEQ ID NO: 80791 - DNA, 103 bp, Artificial Sequence
  Synthetic Polynucleotide
taatacgactcactataggggattgatagcactggtcaaggtccctagttaacagaggagaaactagatgccttgaccaaacctggcggcagcgcaaaagatg

SEQ ID NO: 80792 - DNA, 103 bp, Artificial Sequence
  Synthetic Polynucleotide
taatacgactcactatagggtgctgatcttggctgtccacctcttgcgaaaacagaggagattcgcaatgggtggacagaacctggcggcagcgcaaaagatg

SEQ ID NO: 80793 - DNA, 103 bp, Artificial Sequence
  Synthetic Polynucleotide
taatacgactcactatagggtggcatgctgatcttggctgtccacctcttaacagaggagaaagaggatgacagccaagaacctggcggcagcgcaaaagatg

SEQ ID NO: 80794 - DNA, 103 bp, Artificial Sequence
  Synthetic Polynucleotide
taatacgactcactatagggatagctggcatgctgatcttggctgtccacaacagaggagagtggacatgcaagatcagaacctggcggcagcgcaaaagatg

SEQ ID NO: 80795 - DNA, 103 bp, Artificial Sequence
  Synthetic Polynucleotide
taatacgactcactatagggtcagtatagctggcatgctgatcttggctgaacagaggagacagccaatgtcagcatgcaacctggcggcagcgcaaaagatg

SEQ ID NO: 80796 - DNA, 103 bp, Artificial Sequence
  Synthetic Polynucleotide
taatacgactcactatagggagcaatcagtatagctggcatgctgatcttaacagaggagaaagatcatgatgccagctaacctggcggcagcgcaaaagatg

SEQ ID NO: 80797 - DNA, 103 bp, Artificial Sequence
  Synthetic Polynucleotide
taatacgactcactatagggagcagagcaatcagtatagctggcatgctgaacagaggagacagcatatgagctatactaacctggcggcagcgcaaaagatg

SEQ ID NO: 80798 - DNA, 103 bp, Artificial Sequence
  Synthetic Polynucleotide
taatacgactcactatagggggactagcagagcaatcagtatagctggcaaacagaggagatgccagatgtactgattgaacctggcggcagcgcaaaagatg

SEQ ID NO: 80799 - DNA, 103 bp, Artificial Sequence
  Synthetic Polynucleotide
taatacgactcactatagggcaccaggactagcagagcaatcagtatagcaacagaggagagctataatgattgctctgaacctggcggcagcgcaaaagatg

SEQ ID NO: 80800 - DNA, 103 bp, Artificial Sequence
  Synthetic Polynucleotide
taatacgactcactatagggccaaacaccaggactagcagagcaatcagtaacagaggagaactgatatgtctgctagtaacctggcggcagcgcaaaagatg

SEQ ID NO: 80801 - DNA, 103 bp, Artificial Sequence
  Synthetic Polynucleotide
taatacgactcactatagggtgcccccaaacaccaggactagcagagcaaaacagaggagattgctcatgtagtcctggaacctggcggcagcgcaaaagatg

SEQ ID NO: 80802 - DNA, 103 bp, Artificial Sequence
  Synthetic Polynucleotide
taatacgactcactatagggccgccgattgatagcactggtcaaggtcccaacagaggagagggaccatgaccagtgctaacctggcggcagcgcaaaagatg

SEQ ID NO: 80803 - DNA, 103 bp, Artificial Sequence
  Synthetic Polynucleotide
taatacgactcactatagggagtaatgcccccaaacaccaggactagcagaacagaggagactgctaatgctggtgtttaacctggcggcagcgcaaaagatg

SEQ ID NO: 80804 - DNA, 103 bp, Artificial Sequence
  Synthetic Polynucleotide
taatacgactcactataggggtgtaagtaatgcccccaaacaccaggactaacagaggagaagtcctatggtttgggggaacctggcggcagcgcaaaagatg

SEQ ID NO: 80805 - DNA, 103 bp, Artificial Sequence
  Synthetic Polynucleotide
taatacgactcactatagggcatcagtgtaagtaatgcccccaaacaccaaacagaggagatggtgtatgggggcattaaacctggcggcagcgcaaaagatg

SEQ ID NO: 80806 - DNA, 103 bp, Artificial Sequence
  Synthetic Polynucleotide
taatacgactcactatagggtaacacatcagtgtaagtaatgcccccaaaaacagaggagatttgggatgattacttacaacctggcggcagcgcaaaagatg

SEQ ID NO: 80807 - DNA, 103 bp, Artificial Sequence
  Synthetic Polynucleotide
taatacgactcactatagggtagcgtaacacatcagtgtaagtaatgcccaacagaggagagggcatatgttacactgaaacctggcggcagcgcaaaagatg

SEQ ID NO: 80808 - DNA, 103 bp, Artificial Sequence
  Synthetic Polynucleotide
taatacgactcactatagggtgacatagcgtaacacatcagtgtaagtaaaacagaggagattacttatgctgatgtgtaacctggcggcagcgcaaaagatg

SEQ ID NO: 80809 - DNA, 103 bp, Artificial Sequence
  Synthetic Polynucleotide
taatacgactcactatagggcaagatgacatagcgtaacacatcagtgtaaacagaggagatacactatggtgttacgcaacctggcggcagcgcaaaagatg

SEQ ID NO: 80810 - DNA, 103 bp, Artificial Sequence
  Synthetic Polynucleotide
taatacgactcactatagggcccaccaagatgacatagcgtaacacatcaaacagaggagatgatgtatgacgctatgtaacctggcggcagcgcaaaagatg

SEQ ID NO: 80811 - DNA, 103 bp, Artificial Sequence
  Synthetic Polynucleotide
taatacgactcactatagggctgcccccaccaagatgacatagcgtaacaaacagaggagatgttacatgatgtcatctaacctggcggcagcgcaaaagatg

SEQ ID NO: 80812 - DNA, 103 bp, Artificial Sequence
  Synthetic Polynucleotide
taatacgactcactataggggaaagctgcccccaccaagatgacatagcgaacagaggagacgctatatgatcttggtgaacctggcggcagcgcaaaagatg

SEQ ID NO: 80813 - DNA, 103 bp, Artificial Sequence
  Synthetic Polynucleotide
taatacgactcactataggggagctccgccgattgatagcactggtcaagaacagaggagacttgacatgtgctatcaaaacctggcggcagcgcaaaagatg

SEQ ID NO: 80814 - DNA, 103 bp, Artificial Sequence
  Synthetic Polynucleotide
taatacgactcactatagggtctgcgaaagctgcccccaccaagatgacaaacagaggagatgtcatatgggtgggggcaacctggcggcagcgcaaaagatg

SEQ ID NO: 80815 - DNA, 103 bp, Artificial Sequence
  Synthetic Polynucleotide
taatacgactcactatagggtagattctgcgaaagctgcccccaccaagaaacagaggagatcttggatggggcagcttaacctggcggcagcgcaaaagatg

SEQ ID NO: 80816 - DNA, 103 bp, Artificial Sequence
  Synthetic Polynucleotide
taatacgactcactatagggcgaattagattctgcgaaagctgcccccacaacagaggagagtggggatggctttcgcaaacctggcggcagcgcaaaagatg

SEQ ID NO: 80817 - DNA, 103 bp, Artificial Sequence
  Synthetic Polynucleotide
taatacgactcactatagggcctcccgaattagattctgcgaaagctgccaacagaggagaggcagcatgcgcagaatcaacctggcggcagcgcaaaagatg

SEQ ID NO: 80818 - DNA, 103 bp, Artificial Sequence
  Synthetic Polynucleotide
taatacgactcactatagggcgtctcctcccgaattagattctgcgaaagaacagaggagactttcgatgaatctaattaacctggcggcagcgcaaaagatg

SEQ ID NO: 80819 - DNA, 103 bp, Artificial Sequence
  Synthetic Polynucleotide
taatacgactcactatagggtaccacgtctcctcccgaattagattctgcaacagaggagagcagaaatgaattcgggaaacctggcggcagcgcaaaagatg

SEQ ID NO: 80820 - DNA, 103 bp, Artificial Sequence
  Synthetic Polynucleotide
taatacgactcactatagggaagtgtaccacgtctcctcccgaattagataacagaggagaatctaaatggggaggagaaacctggcggcagcgcaaaagatg

SEQ ID NO: 80821 - DNA, 103 bp, Artificial Sequence
  Synthetic Polynucleotide
taatacgactcactataggggcgccaagtgtaccacgtctcctcccgaataacagaggagaattcggatggagacgtggaacctggcggcagcgcaaaagatg

SEQ ID NO: 80822 - DNA, 103 bp, Artificial Sequence
  Synthetic Polynucleotide
taatacgactcactatagggcatgagcgccaagtgtaccacgtctcctccaacagaggagaggaggaatggtggtacacaacctggcggcagcgcaaaagatg

SEQ ID NO: 80823 - DNA, 103 bp, Artificial Sequence
  Synthetic Polynucleotide
taatacgactcactataggggtcgccatgagcgccaagtgtaccacgtctaacagaggagaagacgtatgacacttggcaacctggcggcagcgcaaaagatg

SEQ ID NO: 80824 - DNA, 103 bp, Artificial Sequence
  Synthetic Polynucleotide
taatacgactcactataggggttttgagctccgccgattgatagcactggaacagaggagaccagtgatgtcaatcggcaacctggcggcagcgcaaaagatg

SEQ ID NO: 80825 - DNA, 103 bp, Artificial Sequence
  Synthetic Polynucleotide
taatacgactcactatagggtgaaggtcgccatgagcgccaagtgtaccaaacagaggagatggtacatgtggcgctcaaacctggcggcagcgcaaaagatg

SEQ ID NO: 80826 - DNA, 103 bp, Artificial Sequence
  Synthetic Polynucleotide
taatacgactcactatagggtatcttgaaggtcgccatgagcgccaagtgaacagaggagacacttgatgctcatggcgaacctggcggcagcgcaaaagatg

SEQ ID NO: 80827 - DNA, 103 bp, Artificial Sequence
  Synthetic Polynucleotide
taatacgactcactatagggggttgtatcttgaaggtcgccatgagcgccaacagaggagaggcgctatgggcgaccttaacctggcggcagcgcaaaagatg

SEQ ID NO: 80828 - DNA, 103 bp, Artificial Sequence
  Synthetic Polynucleotide
taatacgactcactatagggacactggttgtatcttgaaggtcgccatgaaacagaggagatcatggatgccttcaagaaacctggcggcagcgcaaaagatg

SEQ ID NO: 80829 - DNA, 103 bp, Artificial Sequence
  Synthetic Polynucleotide
taatacgactcactatagggcataaacactggttgtatcttgaaggtcgcaacagaggagagcgaccatgaagatacaaaacctggcggcagcgcaaaagatg

SEQ ID NO: 80830 - DNA, 103 bp, Artificial Sequence
  Synthetic Polynucleotide
taatacgactcactataggggccaccataaacactggttgtatcttgaagaacagaggagacttcaaatgacaaccagtaacctggcggcagcgcaaaagatg

SEQ ID NO: 80831 - DNA, 103 bp, Artificial Sequence
  Synthetic Polynucleotide
taatacgactcactatagggacgatgccaccataaacactggttgtatctaacagaggagaagatacatgcagtgtttaaacctggcggcagcgcaaaagatg

SEQ ID NO: 80832 - DNA, 103 bp, Artificial Sequence
  Synthetic Polynucleotide
taatacgactcactataggggagaaacgatgccaccataaacactggttgaacagaggagacaaccaatgtttatggtgaacctggcggcagcgcaaaagatg

SEQ ID NO: 80833 - DNA, 103 bp, Artificial Sequence
  Synthetic Polynucleotide
taatacgactcactataggggctttgagaaacgatgccaccataaacactaacagaggagaagtgttatgggtggcatcaacctggcggcagcgcaaaagatg

SEQ ID NO: 80834 - DNA, 103 bp, Artificial Sequence
  Synthetic Polynucleotide
taatacgactcactatagggatctcgctttgagaaacgatgccaccataaaacagaggagattatggatgcatcgtttcaacctggcggcagcgcaaaagatg

SEQ ID NO: 80835 - DNA, 103 bp, Artificial Sequence
  Synthetic Polynucleotide
taatacgactcactatagggcttttgttttgagctccgccgattgatagcaacagaggagagctatcatgcggcggagcaacctggcggcagcgcaaaagatg

SEQ ID NO: 80836 - DNA, 103 bp, Artificial Sequence
  Synthetic Polynucleotide
taatacgactcactatagggggtccatctcgctttgagaaacgatgccacaacagaggagagtggcaatgtttctcaaaaacctggcggcagcgcaaaagatg

SEQ ID NO: 80837 - DNA, 103 bp, Artificial Sequence
  Synthetic Polynucleotide
taatacgactcactatagggtggttggtccatctcgctttgagaaacgataacagaggagaatcgttatgcaaagcgagaacctggcggcagcgcaaaagatg

SEQ ID NO: 80838 - DNA, 103 bp, Artificial Sequence
  Synthetic Polynucleotide
taatacgactcactatagggtctcctggttggtccatctcgctttgagaaaacagaggagattctcaatgcgagatggaaacctggcggcagcgcaaaagatg

SEQ ID NO: 80839 - DNA, 103 bp, Artificial Sequence
  Synthetic Polynucleotide
taatacgactcactatagggaatgttctcctggttggtccatctcgctttaacagaggagaaaagcgatgtggaccaacaacctggcggcagcgcaaaagatg

SEQ ID NO: 80840 - DNA, 103 bp, Artificial Sequence
  Synthetic Polynucleotide
taatacgactcactatagggaacaaaatgttctcctggttggtccatctcaacagaggagagagatgatgcaaccaggaaacctggcggcagcgcaaaagatg

SEQ ID NO: 80841 - DNA, 103 bp, Artificial Sequence
  Synthetic Polynucleotide
taatacgactcactatagggacatcaacaaaatgttctcctggttggtccaacagaggagaggaccaatgaggagaacaaacctggcggcagcgcaaaagatg

SEQ ID NO: 80842 - DNA, 103 bp, Artificial Sequence
  Synthetic Polynucleotide
taatacgactcactatagggcgccaacatcaacaaaatgttctcctggttaacagaggagaaaccagatgaacattttgaacctggcggcagcgcaaaagatg

SEQ ID NO: 80843 - DNA, 103 bp, Artificial Sequence
  Synthetic Polynucleotide
taatacgactcactatagggacagccgccaacatcaacaaaatgttctccaacagaggagaggagaaatgtttgttgataacctggcggcagcgcaaaagatg

SEQ ID NO: 80844 - DNA, 103 bp, Artificial Sequence
  Synthetic Polynucleotide
taatacgactcactatagggagaaaacagccgccaacatcaacaaaatgtaacagaggagaacatttatgtgatgttggaacctggcggcagcgcaaaagatg

SEQ ID NO: 80845 - DNA, 103 bp, Artificial Sequence
  Synthetic Polynucleotide
taatacgactcactatagggttgaaagaaaacagccgccaacatcaacaaaacagaggagattgttgatgttggcggctaacctggcggcagcgcaaaagatg

SEQ ID NO: 80846 - DNA, 103 bp, Artificial Sequence
  Synthetic Polynucleotide
taatacgactcactatagggcttttcttttgttttgagctccgccgattgaacagaggagacaatcgatggagctcaaaaacctggcggcagcgcaaaagatg

SEQ ID NO: 80847 - DNA, 103 bp, Artificial Sequence
  Synthetic Polynucleotide
taatacgactcactataggggccatttgaaagaaaacagccgccaacatcaacagaggagagatgttatgggctgttttaacctggcggcagcgcaaaagatg

SEQ ID NO: 80848 - DNA, 103 bp, Artificial Sequence
  Synthetic Polynucleotide
taatacgactcactataggggataagccatttgaaagaaaacagccgccaaacagaggagatggcggatgttttctttcaacctggcggcagcgcaaaagatg

SEQ ID NO: 80849 - DNA, 103 bp, Artificial Sequence
  Synthetic Polynucleotide
taatacgactcactatagggatcgtgataagccatttgaaagaaaacagcaacagaggagagctgttatgtttcaaatgaacctggcggcagcgcaaaagatg

SEQ ID NO: 80850 - DNA, 103 bp, Artificial Sequence
  Synthetic Polynucleotide
taatacgactcactatagggcgggcatcgtgataagccatttgaaagaaaaacagaggagatttcttatgaatggcttaaacctggcggcagcgcaaaagatg

SEQ ID NO: 80851 - DNA, 103 bp, Artificial Sequence
  Synthetic Polynucleotide
taatacgactcactatagggtttggcgggcatcgtgataagccatttgaaaacagaggagattcaaaatgcttatcacgaacctggcggcagcgcaaaagatg

SEQ ID NO: 80852 - DNA, 103 bp, Artificial Sequence
  Synthetic Polynucleotide
taatacgactcactatagggcagaatttggcgggcatcgtgataagccataacagaggagaatggctatgcacgatgccaacctggcggcagcgcaaaagatg

SEQ ID NO: 80853 - DNA, 103 bp, Artificial Sequence
  Synthetic Polynucleotide
taatacgactcactatagggcagagcagaatttggcgggcatcgtgataaaacagaggagattatcaatgtgcccgccaaacctggcggcagcgcaaaagatg

SEQ ID NO: 80854 - DNA, 103 bp, Artificial Sequence
  Synthetic Polynucleotide
taatacgactcactatagggtctcccagagcagaatttggcgggcatcgtaacagaggagaacgatgatggccaaattcaacctggcggcagcgcaaaagatg

SEQ ID NO: 80855 - DNA, 103 bp, Artificial Sequence
  Synthetic Polynucleotide
taatacgactcactatagggagggatctcccagagcagaatttggcgggcaacagaggagagcccgcatgattctgctcaacctggcggcagcgcaaaagatg

SEQ ID NO: 80856 - DNA, 103 bp, Artificial Sequence
  Synthetic Polynucleotide
taatacgactcactatagggacatcagggatctcccagagcagaatttggaacagaggagaccaaatatggctctgggaaacctggcggcagcgcaaaagatg

SEQ ID NO: 80857 - DNA, 103 bp, Artificial Sequence
  Synthetic Polynucleotide
taatacgactcactatagggctcctcttttcttttgttttgagctccgccaacagaggagaggcggaatgcaaaacaaaaacctggcggcagcgcaaaagatg

SEQ ID NO: 80858 - DNA, 103 bp, Artificial Sequence
  Synthetic Polynucleotide
taatacgactcactatagggtcaacacatcagggatctcccagagcagaaaacagaggagattctgcatggggagatccaacctggcggcagcgcaaaagatg

SEQ ID NO: 80859 - DNA, 103 bp, Artificial Sequence
  Synthetic Polynucleotide
taatacgactcactatagggtgaattcaacacatcagggatctcccagagaacagaggagactctggatgatccctgataacctggcggcagcgcaaaagatg

SEQ ID NO: 80860 - DNA, 103 bp, Artificial Sequence
  Synthetic Polynucleotide
taatacgactcactataggggccagtgaattcaacacatcagggatctccaacagaggagaggagatatgtgatgtgttaacctggcggcagcgcaaaagatg

SEQ ID NO: 80861 - DNA, 103 bp, Artificial Sequence
  Synthetic Polynucleotide
taatacgactcactatagggctaccgccagtgaattcaacacatcagggaaacagaggagatccctgatgtgttgaattaacctggcggcagcgcaaaagatg

SEQ ID NO: 80862 - DNA, 103 bp, Artificial Sequence
  Synthetic Polynucleotide
taatacgactcactatagggccaagctaccgccagtgaattcaacacatcaacagaggagagatgtgatgaattcactgaacctggcggcagcgcaaaagatg

SEQ ID NO: 80863 - DNA, 103 bp, Artificial Sequence
  Synthetic Polynucleotide
taatacgactcactatagggatcatccaagctaccgccagtgaattcaacaacagaggagagttgaaatgactggcggtaacctggcggcagcgcaaaagatg

SEQ ID NO: 80864 - DNA, 103 bp, Artificial Sequence
  Synthetic Polynucleotide
taatacgactcactatagggtcagtatcatccaagctaccgccagtgaataacagaggagaattcacatgcggtagcttaacctggcggcagcgcaaaagatg

SEQ ID NO: 80865 - DNA, 103 bp, Artificial Sequence
  Synthetic Polynucleotide
taatacgactcactatagggggctctcagtatcatccaagctaccgccagaacagaggagactggcgatggcttggatgaacctggcggcagcgcaaaagatg

SEQ ID NO: 80866 - DNA, 103 bp, Artificial Sequence
  Synthetic Polynucleotide
taatacgactcactataggggttatggctctcagtatcatccaagctaccaacagaggagaggtagcatggatgatactaacctggcggcagcgcaaaagatg

SEQ ID NO: 80867 - DNA, 103 bp, Artificial Sequence
  Synthetic Polynucleotide
taatacgactcactatagggtgaatgttatggctctcagtatcatccaagaacagaggagacttggaatgtactgagagaacctggcggcagcgcaaaagatg

SEQ ID NO: 80868 - DNA, 103 bp, Artificial Sequence
  Synthetic Polynucleotide
taatacgactcactatagggctttcctcctcttttcttttgttttgagctaacagaggagaagctcaatgcaaaagaaaaacctggcggcagcgcaaaagatg

SEQ ID NO: 80869 - DNA, 103 bp, Artificial Sequence
  Synthetic Polynucleotide
taatacgactcactatagggcgttgtgaatgttatggctctcagtatcataacagaggagaatgataatgagagccataaacctggcggcagcgcaaaagatg

SEQ ID NO: 80870 - DNA, 103 bp, Artificial Sequence
  Synthetic Polynucleotide
taatacgactcactataggggatgtcgttgtgaatgttatggctctcagtaacagaggagaactgagatgcataacattaacctggcggcagcgcaaaagatg

SEQ ID NO: 80871 - DNA, 103 bp, Artificial Sequence
  Synthetic Polynucleotide
taatacgactcactatagggcgtttgatgtcgttgtgaatgttatggctcaacagaggagagagccaatgcattcacaaaacctggcggcagcgcaaaagatg

SEQ ID NO: 80872 - DNA, 103 bp, Artificial Sequence
  Synthetic Polynucleotide
taatacgactcactatagggaaccacgtttgatgtcgttgtgaatgttataacagaggagaataacaatgacaacgacaaacctggcggcagcgcaaaagatg

SEQ ID NO: 80873 - DNA, 103 bp, Artificial Sequence
  Synthetic Polynucleotide
taatacgactcactatagggggaacaaccacgtttgatgtcgttgtgaataacagaggagaattcacatggacatcaaaaacctggcggcagcgcaaaagatg

SEQ ID NO: 80874 - DNA, 103 bp, Artificial Sequence
  Synthetic Polynucleotide
taatacgactcactataggggcagcggaacaaccacgtttgatgtcgttgaacagaggagacaacgaatgcaaacgtggaacctggcggcagcgcaaaagatg

SEQ ID NO: 80875 - DNA, 103 bp, Artificial Sequence
  Synthetic Polynucleotide
taatacgactcactatagggggctagcagcggaacaaccacgtttgatgtaacagaggagaacatcaatggtggttgttaacctggcggcagcgcaaaagatg

SEQ ID NO: 80876 - DNA, 103 bp, Artificial Sequence
  Synthetic Polynucleotide
taatacgactcactatagggagcagggctagcagcggaacaaccacgtttaacagaggagaaaacgtatgtgttccgctaacctggcggcagcgcaaaagatg

SEQ ID NO: 80877 - DNA, 103 bp, Artificial Sequence
  Synthetic Polynucleotide
taatacgactcactataggggtgttagcagggctagcagcggaacaaccaaacagaggagatggttgatgcgctgctagaacctggcggcagcgcaaaagatg

SEQ ID NO: 80878 - DNA, 103 bp, Artificial Sequence
  Synthetic Polynucleotide
taatacgactcactatagggcccgggtgttagcagggctagcagcggaacaacagaggagagttccgatgctagccctgaacctggcggcagcgcaaaagatg

SEQ ID NO: 80879 - DNA, 103 bp, Artificial Sequence
  Synthetic Polynucleotide
taatacgactcactatagggtgtgttaattgttgttaatcctcacaaacaaacagaggagatgtttgatgggattaacaaacctggcggcagcgcaaaagatg

SEQ ID NO: 80880 - DNA, 103 bp, Artificial Sequence
  Synthetic Polynucleotide
taatacgactcactatagggccggtctttcctcctcttttcttttgttttaacagaggagaaaaacaatggaaaagaggaacctggcggcagcgcaaaagatg

SEQ ID NO: 80881 - DNA, 103 bp, Artificial Sequence
  Synthetic Polynucleotide
taatacgactcactatagggctcagcccgggtgttagcagggctagcagcaacagaggagagctgctatgcctgctaacaacctggcggcagcgcaaaagatg

SEQ ID NO: 80882 - DNA, 103 bp, Artificial Sequence
  Synthetic Polynucleotide
taatacgactcactatagggagcatctcagcccgggtgttagcagggctaaacagaggagatagcccatgtaacacccgaacctggcggcagcgcaaaagatg

SEQ ID NO: 80883 - DNA, 103 bp, Artificial Sequence
  Synthetic Polynucleotide
taatacgactcactatagggattcaagcatctcagcccgggtgttagcagaacagaggagactgctaatgcccgggctgaacctggcggcagcgcaaaagatg

SEQ ID NO: 80884 - DNA, 103 bp, Artificial Sequence
  Synthetic Polynucleotide
taatacgactcactatagggtccagattcaagcatctcagcccgggtgttaacagaggagaaacaccatggctgagatgaacctggcggcagcgcaaaagatg

SEQ ID NO: 80885 - DNA, 103 bp, Artificial Sequence
  Synthetic Polynucleotide
taatacgactcactatagggacacatccagattcaagcatctcagcccggaacagaggagaccgggcatggatgcttgaaacctggcggcagcgcaaaagatg

SEQ ID NO: 80886 - DNA, 103 bp, Artificial Sequence
  Synthetic Polynucleotide
taatacgactcactatagggcctgtacacatccagattcaagcatctcagaacagaggagactgagaatgttgaatctgaacctggcggcagcgcaaaagatg

SEQ ID NO: 80887 - DNA, 103 bp, Artificial Sequence
  Synthetic Polynucleotide
taatacgactcactatagggagtatcctgtacacatccagattcaagcataacagaggagaatgcttatgtctggatgtaacctggcggcagcgcaaaagatg

SEQ ID NO: 80888 - DNA, 103 bp, Artificial Sequence
  Synthetic Polynucleotide
taatacgactcactatagggacagcagtatcctgtacacatccagattcaaacagaggagatgaatcatgatgtgtacaaacctggcggcagcgcaaaagatg

SEQ ID NO: 80889 - DNA, 103 bp, Artificial Sequence
  Synthetic Polynucleotide
taatacgactcactatagggcatcaacagcagtatcctgtacacatccagaacagaggagactggatatgtacaggataaacctggcggcagcgcaaaagatg

SEQ ID NO: 80890 - DNA, 103 bp, Artificial Sequence
  Synthetic Polynucleotide
taatacgactcactatagggccgaccatcaacagcagtatcctgtacacaaacagaggagatgtgtaatggatactgctaacctggcggcagcgcaaaagatg

SEQ ID NO: 80891 - DNA, 103 bp, Artificial Sequence
  Synthetic Polynucleotide
taatacgactcactatagggcaattccggtctttcctcctcttttcttttaacagaggagaaaaagaatggaggaggaaaacctggcggcagcgcaaaagatg

SEQ ID NO: 80892 - DNA, 103 bp, Artificial Sequence
  Synthetic Polynucleotide
taatacgactcactatagggctattccgaccatcaacagcagtatcctgtaacagaggagaacaggaatgtgctgttgaaacctggcggcagcgcaaaagatg

SEQ ID NO: 80893 - DNA, 103 bp, Artificial Sequence
  Synthetic Polynucleotide
taatacgactcactataggggctgcctattccgaccatcaacagcagtataacagaggagaatactgatgttgatggtcaacctggcggcagcgcaaaagatg

SEQ ID NO: 80894 - DNA, 103 bp, Artificial Sequence
  Synthetic Polynucleotide
taatacgactcactatagggatcaagctgcctattccgaccatcaacagcaacagaggagagctgttatgggtcggaataacctggcggcagcgcaaaagatg

SEQ ID NO: 80895 - DNA, 103 bp, Artificial Sequence
  Synthetic Polynucleotide
taatacgactcactatagggccctgatcaagctgcctattccgaccatcaaacagaggagatgatggatggaataggcaaacctggcggcagcgcaaaagatg

SEQ ID NO: 80896 - DNA, 103 bp, Artificial Sequence
  Synthetic Polynucleotide
taatacgactcactatagggcttctccctgatcaagctgcctattccgacaacagaggagagtcggaatgggcagcttgaacctggcggcagcgcaaaagatg

SEQ ID NO: 80897 - DNA, 103 bp, Artificial Sequence
  Synthetic Polynucleotide
taatacgactcactatagggctcctcttctccctgatcaagctgcctattaacagaggagaaataggatgcttgatcagaacctggcggcagcgcaaaagatg

SEQ ID NO: 80898 - DNA, 103 bp, Artificial Sequence
  Synthetic Polynucleotide
taatacgactcactatagggctgcactcctcttctccctgatcaagctgcaacagaggagagcagctatgtcagggagaaacctggcggcagcgcaaaagatg

SEQ ID NO: 80899 - DNA, 103 bp, Artificial Sequence
  Synthetic Polynucleotide
taatacgactcactatagggtgcggctgcactcctcttctccctgatcaaaacagaggagattgatcatggagaagaggaacctggcggcagcgcaaaagatg

SEQ ID NO: 80900 - DNA, 103 bp, Artificial Sequence
  Synthetic Polynucleotide
taatacgactcactatagggttttttgcggctgcactcctcttctccctgaacagaggagacagggaatggaggagtgcaacctggcggcagcgcaaaagatg

SEQ ID NO: 80901 - DNA, 103 bp, Artificial Sequence
  Synthetic Polynucleotide
taatacgactcactatagggctttcttttttgcggctgcactcctcttctaacagaggagaagaagaatggtgcagccgaacctggcggcagcgcaaaagatg

SEQ ID NO: 80902 - DNA, 103 bp, Artificial Sequence
  Synthetic Polynucleotide
taatacgactcactataggggactgcaattccggtctttcctcctcttttaacagaggagaaaaagaatgggaaagaccaacctggcggcagcgcaaaagatg

SEQ ID NO: 80903 - DNA, 103 bp, Artificial Sequence
  Synthetic Polynucleotide
taatacgactcactatagggtgctcctttcttttttgcggctgcactcctaacagaggagaaggagtatggccgcaaaaaacctggcggcagcgcaaaagatg

SEQ ID NO: 80904 - DNA, 103 bp, Artificial Sequence
  Synthetic Polynucleotide
taatacgactcactatagggagacttgctcctttcttttttgcggctgcaaacagaggagatgcagcatgaaaaaagaaaacctggcggcagcgcaaaagatg

SEQ ID NO: 80905 - DNA, 103 bp, Artificial Sequence
  Synthetic Polynucleotide
taatacgactcactatagggatagcagacttgctcctttcttttttgcggaacagaggagaccgcaaatgagaaaggagaacctggcggcagcgcaaaagatg

SEQ ID NO: 80906 - DNA, 103 bp, Artificial Sequence
  Synthetic Polynucleotide
taatacgactcactatagggcaagcatagcagacttgctcctttctttttaacagaggagaaaaaagatgggagcaagtaacctggcggcagcgcaaaagatg

SEQ ID NO: 80907 - DNA, 103 bp, Artificial Sequence
  Synthetic Polynucleotide
taatacgactcactatagggagagccaagcatagcagacttgctcctttcaacagaggagagaaaggatgaagtctgctaacctggcggcagcgcaaaagatg

SEQ ID NO: 80908 - DNA, 103 bp, Artificial Sequence
  Synthetic Polynucleotide
taatacgactcactatagggaggctagagccaagcatagcagacttgctcaacagaggagagagcaaatgtgctatgctaacctggcggcagcgcaaaagatg

SEQ ID NO: 80909 - DNA, 103 bp, Artificial Sequence
  Synthetic Polynucleotide
taatacgactcactatagggtgttgaggctagagccaagcatagcagactaacagaggagaagtctgatgtgcttggctaacctggcggcagcgcaaaagatg

SEQ ID NO: 80910 - DNA, 103 bp, Artificial Sequence
  Synthetic Polynucleotide
taatacgactcactatagggagtcctgttgaggctagagccaagcatagcaacagaggagagctatgatgggctctagcaacctggcggcagcgcaaaagatg

SEQ ID NO: 80911 - DNA, 103 bp, Artificial Sequence
  Synthetic Polynucleotide
taatacgactcactatagggtgaaaagtcctgttgaggctagagccaagcaacagaggagagcttggatgtagcctcaaaacctggcggcagcgcaaaagatg

SEQ ID NO: 80912 - DNA, 103 bp, Artificial Sequence
  Synthetic Polynucleotide
taatacgactcactatagggggggttgaaaagtcctgttgaggctagagcaacagaggagagctctaatgtcaacaggaaacctggcggcagcgcaaaagatg

SEQ ID NO: 80913 - DNA, 103 bp, Artificial Sequence
  Synthetic Polynucleotide
taatacgactcactatagggatcatgactgcaattccggtctttcctcctaacagaggagaaggaggatggaccggaataacctggcggcagcgcaaaagatg

SEQ ID NO: 80914 - DNA, 103 bp, Artificial Sequence
  Synthetic Polynucleotide
taatacgactcactatagggatcatggggttgaaaagtcctgttgaggctaacagaggagaagcctcatgaggacttttaacctggcggcagcgcaaaagatg

SEQ ID NO: 80915 - DNA, 103 bp, Artificial Sequence
  Synthetic Polynucleotide
taatacgactcactatagggcaaggatcatggggttgaaaagtcctgttgaacagaggagacaacagatgttttcaaccaacctggcggcagcgcaaaagatg

SEQ ID NO: 80916 - DNA, 103 bp, Artificial Sequence
  Synthetic Polynucleotide
taatacgactcactatagggagcagcaaggatcatggggttgaaaagtccaacagaggagaggacttatgaaccccatgaacctggcggcagcgcaaaagatg

SEQ ID NO: 80917 - DNA, 103 bp, Artificial Sequence
  Synthetic Polynucleotide
taatacgactcactatagggagtccagcagcaaggatcatggggttgaaaaacagaggagatttcaaatgcatgatcctaacctggcggcagcgcaaaagatg

SEQ ID NO: 80918 - DNA, 103 bp, Artificial Sequence
  Synthetic Polynucleotide
taatacgactcactatagggcaatcagtccagcagcaaggatcatggggtaacagaggagaaccccaatgtccttgctgaacctggcggcagcgcaaaagatg

SEQ ID NO: 80919 - DNA, 103 bp, Artificial Sequence
  Synthetic Polynucleotide
taatacgactcactatagggacatgcaatcagtccagcagcaaggatcataacagaggagaatgatcatggctgctggaaacctggcggcagcgcaaaagatg

SEQ ID NO: 80920 - DNA, 103 bp, Artificial Sequence
  Synthetic Polynucleotide
taatacgactcactatagggggatcacatgcaatcagtccagcagcaaggaacagaggagaccttgcatgtggactgataacctggcggcagcgcaaaagatg

SEQ ID NO: 80921 - DNA, 103 bp, Artificial Sequence
  Synthetic Polynucleotide
taatacgactcactatagggggttgggatcacatgcaatcagtccagcagaacagaggagactgctgatgtgattgcataacctggcggcagcgcaaaagatg

SEQ ID NO: 80922 - DNA, 103 bp, Artificial Sequence
  Synthetic Polynucleotide
taatacgactcactatagggtttacggttgggatcacatgcaatcagtccaacagaggagaggactgatggcatgtgataacctggcggcagcgcaaaagatg

SEQ ID NO: 80923 - DNA, 103 bp, Artificial Sequence
  Synthetic Polynucleotide
taatacgactcactatagggccgcgtttacggttgggatcacatgcaatcaacagaggagagattgcatgtgatcccaaaacctggcggcagcgcaaaagatg

SEQ ID NO: 80924 - DNA, 103 bp, Artificial Sequence
  Synthetic Polynucleotide
taatacgactcactatagggggccaatcatgactgcaattccggtctttcaacagaggagagaaagaatggaattgcagaacctggcggcagcgcaaaagatg

SEQ ID NO: 80925 - DNA, 103 bp, Artificial Sequence
  Synthetic Polynucleotide
taatacgactcactataggggccatccgcgtttacggttgggatcacatgaacagaggagacatgtgatgccaaccgtaaacctggcggcagcgcaaaagatg

SEQ ID NO: 80926 - DNA, 103 bp, Artificial Sequence
  Synthetic Polynucleotide
taatacgactcactatagggtgcgggccatccgcgtttacggttgggatcaacagaggagagatcccatgcgtaaacgcaacctggcggcagcgcaaaagatg

SEQ ID NO: 80927 - DNA, 103 bp, Artificial Sequence
  Synthetic Polynucleotide
taatacgactcactatagggtcagttgcgggccatccgcgtttacggttgaacagaggagacaaccgatgacgcggatgaacctggcggcagcgcaaaagatg

SEQ ID NO: 80928 - DNA, 103 bp, Artificial Sequence
  Synthetic Polynucleotide
taatacgactcactatagggtcacttcagttgcgggccatccgcgtttacaacagaggagagtaaacatggatggcccgaacctggcggcagcgcaaaagatg

SEQ ID NO: 80929 - DNA, 103 bp, Artificial Sequence
  Synthetic Polynucleotide
taatacgactcactatagggtgtcatcacttcagttgcgggccatccgcgaacagaggagacgcggaatgcccgcaactaacctggcggcagcgcaaaagatg

SEQ ID NO: 80930 - DNA, 103 bp, Artificial Sequence
  Synthetic Polynucleotide
taatacgactcactatagggacagctgtcatcacttcagttgcgggccataacagaggagaatggccatgaactgaagtaacctggcggcagcgcaaaagatg

SEQ ID NO: 80931 - DNA, 103 bp, Artificial Sequence
  Synthetic Polynucleotide
taatacgactcactatagggggccgacagctgtcatcacttcagttgcggaacagaggagaccgcaaatgaagtgatgaaacctggcggcagcgcaaaagatg

SEQ ID NO: 80932 - DNA, 103 bp, Artificial Sequence
  Synthetic Polynucleotide
taatacgactcactatagggcattaggccgacagctgtcatcacttcagtaacagaggagaactgaaatgatgacagctaacctggcggcagcgcaaaagatg

SEQ ID NO: 80933 - DNA, 103 bp, Artificial Sequence
  Synthetic Polynucleotide
taatacgactcactataggggcaaacattaggccgacagctgtcatcactaacagaggagaagtgatatgagctgtcggaacctggcggcagcgcaaaagatg

SEQ ID NO: 80934 - DNA, 103 bp, Artificial Sequence
  Synthetic Polynucleotide
taatacgactcactatagggcgatggcaaacattaggccgacagctgtcaaacagaggagatgacagatgtcggcctaaaacctggcggcagcgcaaaagatg

SEQ ID NO: 80935 - DNA, 103 bp, Artificial Sequence
  Synthetic Polynucleotide
taatacgactcactataggggatcaggccaatcatgactgcaattccggtaacagaggagaaccggaatggcagtcatgaacctggcggcagcgcaaaagatg

SEQ ID NO: 80936 - DNA, 103 bp, Artificial Sequence
  Synthetic Polynucleotide
taatacgactcactatagggtccgacgatggcaaacattaggccgacagcaacagaggagagctgtcatgctaatgtttaacctggcggcagcgcaaaagatg

SEQ ID NO: 80937 - DNA, 103 bp, Artificial Sequence
  Synthetic Polynucleotide
taatacgactcactatagggagccctccgacgatggcaaacattaggccgaacagaggagacggcctatggtttgccataacctggcggcagcgcaaaagatg

SEQ ID NO: 80938 - DNA, 103 bp, Artificial Sequence
  Synthetic Polynucleotide
taatacgactcactatagggctgccagccctccgacgatggcaaacattaaacagaggagataatgtatgccatcgtcgaacctggcggcagcgcaaaagatg

SEQ ID NO: 80939 - DNA, 103 bp, Artificial Sequence
  Synthetic Polynucleotide
taatacgactcactatagggaagctctgccagccctccgacgatggcaaaaacagaggagatttgccatggtcggagggaacctggcggcagcgcaaaagatg

SEQ ID NO: 80940 - DNA, 103 bp, Artificial Sequence
  Synthetic Polynucleotide
taatacgactcactatagggatgtcaagctctgccagccctccgacgatgaacagaggagacatcgtatgagggctggcaacctggcggcagcgcaaaagatg

SEQ ID NO: 80941 - DNA, 103 bp, Artificial Sequence
  Synthetic Polynucleotide
taatacgactcactatagggagtcaatgtcaagctctgccagccctccgaaacagaggagatcggagatgtggcagagcaacctggcggcagcgcaaaagatg

SEQ ID NO: 80942 - DNA, 103 bp, Artificial Sequence
  Synthetic Polynucleotide
taatacgactcactatagggcatggagtcaatgtcaagctctgccagcccaacagaggagagggctgatggagcttgacaacctggcggcagcgcaaaagatg

SEQ ID NO: 80943 - DNA, 103 bp, Artificial Sequence
  Synthetic Polynucleotide
taatacgactcactatagggatggccatggagtcaatgtcaagctctgccaacagaggagaggcagaatgtgacattgaaacctggcggcagcgcaaaagatg

SEQ ID NO: 80944 - DNA, 103 bp, Artificial Sequence
  Synthetic Polynucleotide
taatacgactcactatagggttggaatggccatggagtcaatgtcaagctaacagaggagaagcttgatgttgactccaaacctggcggcagcgcaaaagatg

SEQ ID NO: 80945 - DNA, 103 bp, Artificial Sequence
  Synthetic Polynucleotide
taatacgactcactatagggagtcattggaatggccatggagtcaatgtcaacagaggagagacattatgtccatggccaacctggcggcagcgcaaaagatg

SEQ ID NO: 80946 - DNA, 103 bp, Artificial Sequence
  Synthetic Polynucleotide
taatacgactcactatagggctggcgatcaggccaatcatgactgcaattaacagaggagaaattgcatgcatgattggaacctggcggcagcgcaaaagatg

SEQ ID NO: 80947 - DNA, 103 bp, Artificial Sequence
  Synthetic Polynucleotide
taatacgactcactataggggcgatagtcattggaatggccatggagtcaaacagaggagatgactcatgggccattccaacctggcggcagcgcaaaagatg

SEQ ID NO: 80948 - DNA, 103 bp, Artificial Sequence
  Synthetic Polynucleotide
taatacgactcactataggggccccgcgatagtcattggaatggccatggaacagaggagaccatggatgttccaatgaaacctggcggcagcgcaaaagatg

SEQ ID NO: 80949 - DNA, 103 bp, Artificial Sequence
  Synthetic Polynucleotide
taatacgactcactatagggcatgagccccgcgatagtcattggaatggcaacagaggagagccattatgatgactatcaacctggcggcagcgcaaaagatg

SEQ ID NO: 80950 - DNA, 103 bp, Artificial Sequence
  Synthetic Polynucleotide
taatacgactcactataggggcaaacatgagccccgcgatagtcattggaaacagaggagatccaatatgtatcgcgggaacctggcggcagcgcaaaagatg

SEQ ID NO: 80951 - DNA, 103 bp, Artificial Sequence
  Synthetic Polynucleotide
taatacgactcactatagggaagcagcaaacatgagccccgcgatagtcaaacagaggagatgactaatgcggggctcaaacctggcggcagcgcaaaagatg

SEQ ID NO: 80952 - DNA, 103 bp, Artificial Sequence
  Synthetic Polynucleotide
taatacgactcactatagggcacgaaagcagcaaacatgagccccgcgataacagaggagaatcgcgatgctcatgtttaacctggcggcagcgcaaaagatg

SEQ ID NO: 80953 - DNA, 103 bp, Artificial Sequence
  Synthetic Polynucleotide
taatacgactcactataggggaaatcacgaaagcagcaaacatgagccccaacagaggagaggggctatggtttgctgcaacctggcggcagcgcaaaagatg

SEQ ID NO: 80954 - DNA, 103 bp, Artificial Sequence
  Synthetic Polynucleotide
taatacgactcactatagggtcccagaaatcacgaaagcagcaaacatgaaacagaggagatcatgtatgctgctttcgaacctggcggcagcgcaaaagatg

SEQ ID NO: 80955 - DNA, 103 bp, Artificial Sequence
  Synthetic Polynucleotide
taatacgactcactatagggtgatttcccagaaatcacgaaagcagcaaaaacagaggagatttgctatgttcgtgattaacctggcggcagcgcaaaagatg

SEQ ID NO: 80956 - DNA, 103 bp, Artificial Sequence
  Synthetic Polynucleotide
taatacgactcactatagggtctgttgatttcccagaaatcacgaaagcaaacagaggagatgctttatggatttctggaacctggcggcagcgcaaaagatg

SEQ ID NO: 80957 - DNA, 103 bp, Artificial Sequence
  Synthetic Polynucleotide
taatacgactcactatagggctacgctggcgatcaggccaatcatgactgaacagaggagacagtcaatgttggcctgaaacctggcggcagcgcaaaagatg

SEQ ID NO: 80958 - DNA, 103 bp, Artificial Sequence
  Synthetic Polynucleotide
taatacgactcactatagggacatatctgttgatttcccagaaatcacgaaacagaggagatcgtgaatgctgggaaataacctggcggcagcgcaaaagatg

SEQ ID NO: 80959 - DNA, 103 bp, Artificial Sequence
  Synthetic Polynucleotide
taatacgactcactatagggaatccacatatctgttgatttcccagaaataacagaggagaatttctatgaaatcaacaaacctggcggcagcgcaaaagatg

SEQ ID NO: 80960 - DNA, 103 bp, Artificial Sequence
  Synthetic Polynucleotide
taatacgactcactatagggctctcaatccacatatctgttgatttcccaaacagaggagatgggaaatgaacagatataacctggcggcagcgcaaaagatg

SEQ ID NO: 80961 - DNA, 103 bp, Artificial Sequence
  Synthetic Polynucleotide
taatacgactcactatagggccgttctctcaatccacatatctgttgattaacagaggagaaatcaaatgatatgtggaaacctggcggcagcgcaaaagatg

SEQ ID NO: 80962 - DNA, 103 bp, Artificial Sequence
  Synthetic Polynucleotide
taatacgactcactataggggtccgccgttctctcaatccacatatctgtaacagaggagaacagatatgtggattgagaacctggcggcagcgcaaaagatg

SEQ ID NO: 80963 - DNA, 103 bp, Artificial Sequence
  Synthetic Polynucleotide
taatacgactcactataggggaaatgtccgccgttctctcaatccacataaacagaggagatatgtgatgtgagagaacaacctggcggcagcgcaaaagatg

SEQ ID NO: 80964 - DNA, 103 bp, Artificial Sequence
  Synthetic Polynucleotide
taatacgactcactatagggcccaggaaatgtccgccgttctctcaatccaacagaggagaggattgatggaacggcggaacctggcggcagcgcaaaagatg

SEQ ID NO: 80965 - DNA, 103 bp, Artificial Sequence
  Synthetic Polynucleotide
taatacgactcactatagggactttcccaggaaatgtccgccgttctctcaacagaggagagagagaatggcggacattaacctggcggcagcgcaaaagatg

SEQ ID NO: 80966 - DNA, 103 bp, Artificial Sequence
  Synthetic Polynucleotide
taatacgactcactataggggcatcactttcccaggaaatgtccgccgttaacagaggagaaacggcatgcatttcctgaacctggcggcagcgcaaaagatg

SEQ ID NO: 80967 - DNA, 103 bp, Artificial Sequence
  Synthetic Polynucleotide
taatacgactcactatagggtttctgcatcactttcccaggaaatgtccgaacagaggagacggacaatgcctgggaaaaacctggcggcagcgcaaaagatg

SEQ ID NO: 80968 - DNA, 103 bp, Artificial Sequence
  Synthetic Polynucleotide
taatacgactcactatagggtgctcctacgctggcgatcaggccaatcataacagaggagaatgattatgctgatcgccaacctggcggcagcgcaaaagatg

SEQ ID NO: 80969 - DNA, 103 bp, Artificial Sequence
  Synthetic Polynucleotide
taatacgactcactatagggtgtaatttctgcatcactttcccaggaaataacagaggagaatttccatggaaagtgataacctggcggcagcgcaaaagatg

SEQ ID NO: 80970 - DNA, 103 bp, Artificial Sequence
  Synthetic Polynucleotide
taatacgactcactataggggagcctgtaatttctgcatcactttcccagaacagaggagactgggaatgtgatgcagaaacctggcggcagcgcaaaagatg

SEQ ID NO: 80971 - DNA, 103 bp, Artificial Sequence
  Synthetic Polynucleotide
taatacgactcactatagggcgctcgagcctgtaatttctgcatcactttaacagaggagaaaagtgatgcagaaattaaacctggcggcagcgcaaaagatg

SEQ ID NO: 80972 - DNA, 103 bp, Artificial Sequence
  Synthetic Polynucleotide
taatacgactcactatagggtctttcgctcgagcctgtaatttctgcatcaacagaggagagatgcaatgattacaggcaacctggcggcagcgcaaaagatg

SEQ ID NO: 80973 - DNA, 103 bp, Artificial Sequence
  Synthetic Polynucleotide
taatacgactcactatagggtcaactctttcgctcgagcctgtaatttctaacagaggagaagaaatatgaggctcgagaacctggcggcagcgcaaaagatg

SEQ ID NO: 80974 - DNA, 103 bp, Artificial Sequence
  Synthetic Polynucleotide
taatacgactcactataggggcacatcaactctttcgctcgagcctgtaaaacagaggagattacagatgcgagcgaaaaacctggcggcagcgcaaaagatg

SEQ ID NO: 80975 - DNA, 103 bp, Artificial Sequence
  Synthetic Polynucleotide
taatacgactcactatagggaagccgcacatcaactctttcgctcgagccaacagaggagaggctcgatggaaagagttaacctggcggcagcgcaaaagatg

SEQ ID NO: 80976 - DNA, 103 bp, Artificial Sequence
  Synthetic Polynucleotide
taatacgactcactatagggtcatcaagccgcacatcaactctttcgctcaacagaggagagagcgaatgagttgatgtaacctggcggcagcgcaaaagatg

SEQ ID NO: 80977 - DNA, 103 bp, Artificial Sequence
  Synthetic Polynucleotide
taatacgactcactatagggcatcatcatcaagccgcacatcaactctttaacagaggagaaaagagatgatgtgcggcaacctggcggcagcgcaaaagatg

SEQ ID NO: 80978 - DNA, 103 bp, Artificial Sequence
  Synthetic Polynucleotide
taatacgactcactataggggtttccatcatcatcaagccgcacatcaacaacagaggagagttgatatgcggcttgataacctggcggcagcgcaaaagatg

SEQ ID NO: 80979 - DNA, 103 bp, Artificial Sequence
  Synthetic Polynucleotide
taatacgactcactataggggtaactgctcctacgctggcgatcaggccaaacagaggagatggcctatgcgccagcgtaacctggcggcagcgcaaaagatg

SEQ ID NO: 80980 - DNA, 103 bp, Artificial Sequence
  Synthetic Polynucleotide
taatacgactcactatagggtggaagtttccatcatcatcaagccgcacaaacagaggagatgtgcgatgtgatgatgaaacctggcggcagcgcaaaagatg

SEQ ID NO: 80981 - DNA, 103 bp, Artificial Sequence
  Synthetic Polynucleotide
taatacgactcactatagggtgagctggaagtttccatcatcatcaagccaacagaggagaggcttgatgatgatggaaaacctggcggcagcgcaaaagatg

SEQ ID NO: 80982 - DNA, 103 bp, Artificial Sequence
  Synthetic Polynucleotide
taatacgactcactatagggattcatgagctggaagtttccatcatcatcaacagaggagagatgatatgggaaacttcaacctggcggcagcgcaaaagatg

SEQ ID NO: 80983 - DNA, 103 bp, Artificial Sequence
  Synthetic Polynucleotide
taatacgactcactatagggggatcattcatgagctggaagtttccatcaaacagaggagatgatggatgcttccagctaacctggcggcagcgcaaaagatg

SEQ ID NO: 80984 - DNA, 103 bp, Artificial Sequence
  Synthetic Polynucleotide
taatacgactcactatagggctcctggatcattcatgagctggaagtttcaacagaggagagaaactatgagctcatgaaacctggcggcagcgcaaaagatg

SEQ ID NO: 80985 - DNA, 103 bp, Artificial Sequence
  Synthetic Polynucleotide
taatacgactcactatagggaggtgctcctggatcattcatgagctggaaaacagaggagattccagatgatgaatgataacctggcggcagcgcaaaagatg

SEQ ID NO: 80986 - DNA, 103 bp, Artificial Sequence
  Synthetic Polynucleotide
taatacgactcactatagggttccaaggtgctcctggatcattcatgagcaacagaggagagctcatatgtgatccaggaacctggcggcagcgcaaaagatg

SEQ ID NO: 80987 - DNA, 103 bp, Artificial Sequence
  Synthetic Polynucleotide
taatacgactcactatagggatatcttccaaggtgctcctggatcattcaaacagaggagatgaatgatgcaggagcacaacctggcggcagcgcaaaagatg

SEQ ID NO: 80988 - DNA, 103 bp, Artificial Sequence
  Synthetic Polynucleotide
taatacgactcactatagggcatccatatcttccaaggtgctcctggatcaacagaggagagatccaatggcaccttggaacctggcggcagcgcaaaagatg

SEQ ID NO: 80989 - DNA, 103 bp, Artificial Sequence
  Synthetic Polynucleotide
taatacgactcactatagggctgagcatccatatcttccaaggtgctcctaacagaggagaaggagcatgttggaagataacctggcggcagcgcaaaagatg

SEQ ID NO: 80990 - DNA, 103 bp, Artificial Sequence
  Synthetic Polynucleotide
taatacgactcactatagggcgcactgtgttaattgttgttaatcctcacaacagaggagagtgaggatgaacaacaataacctggcggcagcgcaaaagatg

SEQ ID NO: 80991 - DNA, 103 bp, Artificial Sequence
  Synthetic Polynucleotide
taatacgactcactatagggagagggtaactgctcctacgctggcgatcaaacagaggagatgatcgatggcgtaggagaacctggcggcagcgcaaaagatg

SEQ ID NO: 80992 - DNA, 103 bp, Artificial Sequence
  Synthetic Polynucleotide
taatacgactcactatagggccattctgagcatccatatcttccaaggtgaacagaggagacaccttatgagatatggaaacctggcggcagcgcaaaagatg

SEQ ID NO: 80993 - DNA, 103 bp, Artificial Sequence
  Synthetic Polynucleotide
taatacgactcactatagggacagaccattctgagcatccatatcttccaaacagaggagatggaagatgtggatgctcaacctggcggcagcgcaaaagatg

SEQ ID NO: 80994 - DNA, 103 bp, Artificial Sequence
  Synthetic Polynucleotide
taatacgactcactataggggcgagacagaccattctgagcatccatatcaacagaggagagatatgatggctcagaataacctggcggcagcgcaaaagatg

SEQ ID NO: 80995 - DNA, 103 bp, Artificial Sequence
  Synthetic Polynucleotide
taatacgactcactatagggtaatcgcgagacagaccattctgagcatccaacagaggagaggatgcatggaatggtctaacctggcggcagcgcaaaagatg

SEQ ID NO: 80996 - DNA, 103 bp, Artificial Sequence
  Synthetic Polynucleotide
taatacgactcactatagggcgcactaatcgcgagacagaccattctgagaacagaggagactcagaatggtctgtctcaacctggcggcagcgcaaaagatg

SEQ ID NO: 80997 - DNA, 103 bp, Artificial Sequence
  Synthetic Polynucleotide
taatacgactcactataggggtgtacgcactaatcgcgagacagaccattaacagaggagaaatggtatgtctcgcgataacctggcggcagcgcaaaagatg

SEQ ID NO: 80998 - DNA, 103 bp, Artificial Sequence
  Synthetic Polynucleotide
taatacgactcactatagggagggggtgtacgcactaatcgcgagacagaaacagaggagatctgtcatgcgattagtgaacctggcggcagcgcaaaagatg

SEQ ID NO: 80999 - DNA, 103 bp, Artificial Sequence
  Synthetic Polynucleotide
taatacgactcactatagggtgcccagggggtgtacgcactaatcgcgagaacagaggagactcgcgatgagtgcgtacaacctggcggcagcgcaaaagatg

SEQ ID NO: 81000 - DNA, 103 bp, Artificial Sequence
  Synthetic Polynucleotide
taatacgactcactatagggaagattgcccagggggtgtacgcactaatcaacagaggagagattagatggtacaccccaacctggcggcagcgcaaaagatg

SEQ ID NO: 81001 - DNA, 103 bp, Artificial Sequence
  Synthetic Polynucleotide
taatacgactcactatagggagggcaagattgcccagggggtgtacgcacaacagaggagagtgcgtatgccccctgggaacctggcggcagcgcaaaagatg

SEQ ID NO: 81002 - DNA, 103 bp, Artificial Sequence
  Synthetic Polynucleotide
taatacgactcactataggggttagagagggtaactgctcctacgctggcaacagaggagagccagcatgggagcagttaacctggcggcagcgcaaaagatg

SEQ ID NO: 81003 - DNA, 103 bp, Artificial Sequence
  Synthetic Polynucleotide
taatacgactcactatagggtactgagggcaagattgcccagggggtgtaaacagaggagatacaccatgtgggcaatcaacctggcggcagcgcaaaagatg

SEQ ID NO: 81004 - DNA, 103 bp, Artificial Sequence
  Synthetic Polynucleotide
taatacgactcactatagggccaactactgagggcaagattgcccaggggaacagaggagacccctgatgaatcttgccaacctggcggcagcgcaaaagatg

SEQ ID NO: 81005 - DNA, 103 bp, Artificial Sequence
  Synthetic Polynucleotide
taatacgactcactatagggaaaatccaactactgagggcaagattgcccaacagaggagagggcaaatgtgccctcagaacctggcggcagcgcaaaagatg

SEQ ID NO: 81006 - DNA, 103 bp, Artificial Sequence
  Synthetic Polynucleotide
taatacgactcactatagggtatccaaaatccaactactgagggcaagataacagaggagaatcttgatgtcagtagttaacctggcggcagcgcaaaagatg

SEQ ID NO: 81007 - DNA, 103 bp, Artificial Sequence
  Synthetic Polynucleotide
taatacgactcactatagggagagttatccaaaatccaactactgagggcaacagaggagagccctcatgagttggattaacctggcggcagcgcaaaagatg

SEQ ID NO: 81008 - DNA, 103 bp, Artificial Sequence
  Synthetic Polynucleotide
taatacgactcactatagggattggagagttatccaaaatccaactactgaacagaggagacagtagatggattttggaaacctggcggcagcgcaaaagatg

SEQ ID NO: 81009 - DNA, 103 bp, Artificial Sequence
  Synthetic Polynucleotide
taatacgactcactatagggtgtgtattggagagttatccaaaatccaacaacagaggagagttggaatgtggataactaacctggcggcagcgcaaaagatg

SEQ ID NO: 81010 - DNA, 103 bp, Artificial Sequence
  Synthetic Polynucleotide
taatacgactcactatagggctctttgtgtattggagagttatccaaaataacagaggagaattttgatgaactctccaaacctggcggcagcgcaaaagatg

SEQ ID NO: 81011 - DNA, 103 bp, Artificial Sequence
  Synthetic Polynucleotide
taatacgactcactatagggctcctctctttgtgtattggagagttatccaacagaggagaggataaatgtccaatacaaacctggcggcagcgcaaaagatg

SEQ ID NO: 81012 - DNA, 103 bp, Artificial Sequence
  Synthetic Polynucleotide
taatacgactcactatagggcacgcctcctctctttgtgtattggagagtaacagaggagaactctcatgtacacaaagaacctggcggcagcgcaaaagatg

SEQ ID NO: 81013 - DNA, 103 bp, Artificial Sequence
  Synthetic Polynucleotide
taatacgactcactatagggtggaagttagagagggtaactgctcctacgaacagaggagacgtaggatgagttaccctaacctggcggcagcgcaaaagatg

SEQ ID NO: 81014 - DNA, 103 bp, Artificial Sequence
  Synthetic Polynucleotide
taatacgactcactatagggcacaacacgcctcctctctttgtgtattggaacagaggagaccaataatgaaagagaggaacctggcggcagcgcaaaagatg

SEQ ID NO: 81015 - DNA, 103 bp, Artificial Sequence
  Synthetic Polynucleotide
taatacgactcactatagggtgtcccacaacacgcctcctctctttgtgtaacagaggagaacacaaatggaggaggcgaacctggcggcagcgcaaaagatg

SEQ ID NO: 81016 - DNA, 103 bp, Artificial Sequence
  Synthetic Polynucleotide
taatacgactcactataggggggagtgtcccacaacacgcctcctctcttaacagaggagaaagagaatgggcgtgttgaacctggcggcagcgcaaaagatg

SEQ ID NO: 81017 - DNA, 103 bp, Artificial Sequence
  Synthetic Polynucleotide
taatacgactcactatagggggtgagggagtgtcccacaacacgcctcctaacagaggagaaggaggatggttgtgggaaacctggcggcagcgcaaaagatg

SEQ ID NO: 81018 - DNA, 103 bp, Artificial Sequence
  Synthetic Polynucleotide
taatacgactcactatagggcctttggtgagggagtgtcccacaacacgcaacagaggagagcgtgtatggggacactcaacctggcggcagcgcaaaagatg

SEQ ID NO: 81019 - DNA, 103 bp, Artificial Sequence
  Synthetic Polynucleotide
taatacgactcactataggggtactcctttggtgagggagtgtcccacaaaacagaggagattgtggatgactccctcaaacctggcggcagcgcaaaagatg

SEQ ID NO: 81020 - DNA, 103 bp, Artificial Sequence
  Synthetic Polynucleotide
taatacgactcactatagggtttttgtactcctttggtgagggagtgtccaacagaggagaggacacatgctcaccaaaaacctggcggcagcgcaaaagatg

SEQ ID NO: 81021 - DNA, 103 bp, Artificial Sequence
  Synthetic Polynucleotide
taatacgactcactatagggccccctttttgtactcctttggtgagggagaacagaggagactccctatgcaaaggagtaacctggcggcagcgcaaaagatg

SEQ ID NO: 81022 - DNA, 103 bp, Artificial Sequence
  Synthetic Polynucleotide
taatacgactcactatagggcgtgtccccctttttgtactcctttggtgaaacagaggagatcaccaatggagtacaaaaacctggcggcagcgcaaaagatg

SEQ ID NO: 81023 - DNA, 103 bp, Artificial Sequence
  Synthetic Polynucleotide
taatacgactcactataggggtggtcgtgtccccctttttgtactcctttaacagaggagaaaaggaatgcaaaaagggaacctggcggcagcgcaaaagatg

SEQ ID NO: 81024 - DNA, 103 bp, Artificial Sequence
  Synthetic Polynucleotide
taatacgactcactatagggtcccttggaagttagagagggtaactgctcaacagaggagagagcagatgccctctctaaacctggcggcagcgcaaaagatg

SEQ ID NO: 81025 - DNA, 103 bp, Artificial Sequence
  Synthetic Polynucleotide
taatacgactcactatagggcgccggtggtcgtgtccccctttttgtactaacagaggagaagtacaatgagggggacaaacctggcggcagcgcaaaagatg

SEQ ID NO: 81026 - DNA, 103 bp, Artificial Sequence
  Synthetic Polynucleotide
taatacgactcactataggggtagacgccggtggtcgtgtccccctttttaacagaggagaaaaaagatggacacgaccaacctggcggcagcgcaaaagatg

SEQ ID NO: 81027 - DNA, 103 bp, Artificial Sequence
  Synthetic Polynucleotide
taatacgactcactatagggatcctgtagacgccggtggtcgtgtcccccaacagaggagagggggaatggaccaccggaacctggcggcagcgcaaaagatg

SEQ ID NO: 81028 - DNA, 103 bp, Artificial Sequence
  Synthetic Polynucleotide
taatacgactcactatagggtcatgatcctgtagacgccggtggtcgtgtaacagaggagaacacgaatgccggcgtctaacctggcggcagcgcaaaagatg

SEQ ID NO: 81029 - DNA, 103 bp, Artificial Sequence
  Synthetic Polynucleotide
taatacgactcactatagggacgagtcatgatcctgtagacgccggtggtaacagaggagaaccaccatggtctacaggaacctggcggcagcgcaaaagatg

SEQ ID NO: 81030 - DNA, 103 bp, Artificial Sequence
  Synthetic Polynucleotide
taatacgactcactatagggagcccacgagtcatgatcctgtagacgccgaacagaggagacggcgtatgcaggatcataacctggcggcagcgcaaaagatg

SEQ ID NO: 81031 - DNA, 103 bp, Artificial Sequence
  Synthetic Polynucleotide
taatacgactcactatagggcgagcagcccacgagtcatgatcctgtagaaacagaggagatctacaatgtcatgactcaacctggcggcagcgcaaaagatg

SEQ ID NO: 81032 - DNA, 103 bp, Artificial Sequence
  Synthetic Polynucleotide
taatacgactcactatagggactgccgagcagcccacgagtcatgatcctaacagaggagaaggatcatgactcgtgggaacctggcggcagcgcaaaagatg

SEQ ID NO: 81033 - DNA, 103 bp, Artificial Sequence
  Synthetic Polynucleotide
taatacgactcactatagggtgataactgccgagcagcccacgagtcatgaacagaggagacatgacatgtgggctgctaacctggcggcagcgcaaaagatg

SEQ ID NO: 81034 - DNA, 103 bp, Artificial Sequence
  Synthetic Polynucleotide
taatacgactcactatagggctgcttgataactgccgagcagcccacgagaacagaggagactcgtgatgtgctcggcaaacctggcggcagcgcaaaagatg

SEQ ID NO: 81035 - DNA, 103 bp, Artificial Sequence
  Synthetic Polynucleotide
taatacgactcactatagggcaccttcccttggaagttagagagggtaacaacagaggagagttaccatgtctaacttcaacctggcggcagcgcaaaagatg

SEQ ID NO: 81036 - DNA, 103 bp, Artificial Sequence
  Synthetic Polynucleotide
taatacgactcactatagggcgctcctgcttgataactgccgagcagcccaacagaggagagggctgatgggcagttataacctggcggcagcgcaaaagatg

SEQ ID NO: 81037 - DNA, 103 bp, Artificial Sequence
  Synthetic Polynucleotide
taatacgactcactatagggacgcccgctcctgcttgataactgccgagcaacagaggagagctcggatgttatcaagcaacctggcggcagcgcaaaagatg

SEQ ID NO: 81038 - DNA, 103 bp, Artificial Sequence
  Synthetic Polynucleotide
taatacgactcactatagggccatcacgcccgctcctgcttgataactgcaacagaggagagcagttatgaagcaggagaacctggcggcagcgcaaaagatg

SEQ ID NO: 81039 - DNA, 103 bp, Artificial Sequence
  Synthetic Polynucleotide
taatacgactcactatagggttcaaccatcacgcccgctcctgcttgataaacagaggagatatcaaatgggagcgggcaacctggcggcagcgcaaaagatg

SEQ ID NO: 81040 - DNA, 103 bp, Artificial Sequence
  Synthetic Polynucleotide
taatacgactcactatagggacaccttcaaccatcacgcccgctcctgctaacagaggagaagcaggatggggcgtgataacctggcggcagcgcaaaagatg

SEQ ID NO: 81041 - DNA, 103 bp, Artificial Sequence
  Synthetic Polynucleotide
taatacgactcactatagggggaaaacaccttcaaccatcacgcccgctcaacagaggagagagcggatgtgatggttgaacctggcggcagcgcaaaagatg

SEQ ID NO: 81042 - DNA, 103 bp, Artificial Sequence
  Synthetic Polynucleotide
taatacgactcactatagggggtgtggaaaacaccttcaaccatcacgccaacagaggagaggcgtgatggttgaaggtaacctggcggcagcgcaaaagatg

SEQ ID NO: 81043 - DNA, 103 bp, Artificial Sequence
  Synthetic Polynucleotide
taatacgactcactatagggcaaagggtgtggaaaacaccttcaaccatcaacagaggagagatggtatgaggtgttttaacctggcggcagcgcaaaagatg

SEQ ID NO: 81044 - DNA, 103 bp, Artificial Sequence
  Synthetic Polynucleotide
taatacgactcactatagggtatgccaaagggtgtggaaaacaccttcaaaacagaggagattgaagatgttttccacaaacctggcggcagcgcaaaagatg

SEQ ID NO: 81045 - DNA, 103 bp, Artificial Sequence
  Synthetic Polynucleotide
taatacgactcactatagggtgttgtatgccaaagggtgtggaaaacaccaacagaggagaggtgttatgcacacccttaacctggcggcagcgcaaaagatg

SEQ ID NO: 81046 - DNA, 103 bp, Artificial Sequence
  Synthetic Polynucleotide
taatacgactcactatagggatcatcaccttcccttggaagttagagaggaacagaggagacctctcatgcttccaaggaacctggcggcagcgcaaaagatg

SEQ ID NO: 81047 - DNA, 103 bp, Artificial Sequence
  Synthetic Polynucleotide
taatacgactcactatagggccttttgttgtatgccaaagggtgtggaaaaacagaggagatttccaatgcctttggcaaacctggcggcagcgcaaaagatg

SEQ ID NO: 81048 - DNA, 103 bp, Artificial Sequence
  Synthetic Polynucleotide
taatacgactcactatagggcggctccttttgttgtatgccaaagggtgtaacagaggagaacacccatgggcatacaaaacctggcggcagcgcaaaagatg

SEQ ID NO: 81049 - DNA, 103 bp, Artificial Sequence
  Synthetic Polynucleotide
taatacgactcactatagggcaaagcggctccttttgttgtatgccaaagaacagaggagactttggatgacaacaaaaaacctggcggcagcgcaaaagatg

SEQ ID NO: 81050 - DNA, 103 bp, Artificial Sequence
  Synthetic Polynucleotide
taatacgactcactatagggctcatcaaagcggctccttttgttgtatgcaacagaggagagcatacatgaaaaggagcaacctggcggcagcgcaaaagatg

SEQ ID NO: 81051 - DNA, 103 bp, Artificial Sequence
  Synthetic Polynucleotide
taatacgactcactatagggctccgctcatcaaagcggctccttttgttgaacagaggagacaacaaatggagccgcttaacctggcggcagcgcaaaagatg

SEQ ID NO: 81052 - DNA, 103 bp, Artificial Sequence
  Synthetic Polynucleotide
taatacgactcactataggggccctctccgctcatcaaagcggctcctttaacagaggagaaaaggaatggctttgatgaacctggcggcagcgcaaaagatg

SEQ ID NO: 81053 - DNA, 103 bp, Artificial Sequence
  Synthetic Polynucleotide
taatacgactcactatagggaggcggccctctccgctcatcaaagcggctaacagaggagaagccgcatggatgagcggaacctggcggcagcgcaaaagatg

SEQ ID NO: 81054 - DNA, 103 bp, Artificial Sequence
  Synthetic Polynucleotide
taatacgactcactatagggggtccaggcggccctctccgctcatcaaagaacagaggagactttgaatggcggagaggaacctggcggcagcgcaaaagatg

SEQ ID NO: 81055 - DNA, 103 bp, Artificial Sequence
  Synthetic Polynucleotide
taatacgactcactataggggtatgggtccaggcggccctctccgctcataacagaggagaatgagcatggagggccgcaacctggcggcagcgcaaaagatg

SEQ ID NO: 81056 - DNA, 103 bp, Artificial Sequence
  Synthetic Polynucleotide
taatacgactcactatagggccccagtatgggtccaggcggccctctccgaacagaggagacggagaatgccgcctggaaacctggcggcagcgcaaaagatg

SEQ ID NO: 81057 - DNA, 103 bp, Artificial Sequence
  Synthetic Polynucleotide
taatacgactcactatagggccgtcatcatcaccttcccttggaagttagaacagaggagactaactatgaagggaaggaacctggcggcagcgcaaaagatg

SEQ ID NO: 81058 - DNA, 103 bp, Artificial Sequence
  Synthetic Polynucleotide
taatacgactcactatagggcactgccccagtatgggtccaggcggccctaacagaggagaagggccatgtggacccataacctggcggcagcgcaaaagatg

SEQ ID NO: 81059 - DNA, 103 bp, Artificial Sequence
  Synthetic Polynucleotide
taatacgactcactatagggcttgacactgccccagtatgggtccaggcgaacagaggagacgcctgatgccatactggaacctggcggcagcgcaaaagatg

SEQ ID NO: 81060 - DNA, 103 bp, Artificial Sequence
  Synthetic Polynucleotide
taatacgactcactatagggtcctccttgacactgccccagtatgggtccaacagaggagaggacccatgctggggcagaacctggcggcagcgcaaaagatg

SEQ ID NO: 81061 - DNA, 103 bp, Artificial Sequence
  Synthetic Polynucleotide
taatacgactcactataggggtcgatcctccttgacactgccccagtatgaacagaggagacatactatggcagtgtcaaacctggcggcagcgcaaaagatg

SEQ ID NO: 81062 - DNA, 103 bp, Artificial Sequence
  Synthetic Polynucleotide
taatacgactcactatagggacaaagtcgatcctccttgacactgccccaaacagaggagatggggcatggtcaaggagaacctggcggcagcgcaaaagatg

SEQ ID NO: 81063 - DNA, 103 bp, Artificial Sequence
  Synthetic Polynucleotide
taatacgactcactatagggccgtaacaaagtcgatcctccttgacactgaacagaggagacagtgtatgggaggatcgaacctggcggcagcgcaaaagatg

SEQ ID NO: 81064 - DNA, 103 bp, Artificial Sequence
  Synthetic Polynucleotide
taatacgactcactataggggtcctccgtaacaaagtcgatcctccttgaaacagaggagatcaaggatgatcgactttaacctggcggcagcgcaaaagatg

SEQ ID NO: 81065 - DNA, 103 bp, Artificial Sequence
  Synthetic Polynucleotide
taatacgactcactatagggccagggtcctccgtaacaaagtcgatcctcaacagaggagagaggatatgctttgttacaacctggcggcagcgcaaaagatg

SEQ ID NO: 81066 - DNA, 103 bp, Artificial Sequence
  Synthetic Polynucleotide
taatacgactcactatagggaatttccagggtcctccgtaacaaagtcgaaacagaggagatcgactatgttacggaggaacctggcggcagcgcaaaagatg

SEQ ID NO: 81067 - DNA, 103 bp, Artificial Sequence
  Synthetic Polynucleotide
taatacgactcactataggggctgcaatttccagggtcctccgtaacaaaaacagaggagatttgttatggaggaccctaacctggcggcagcgcaaaagatg

SEQ ID NO: 81068 - DNA, 103 bp, Artificial Sequence
  Synthetic Polynucleotide
taatacgactcactatagggatttaccgtcatcatcaccttcccttggaaaacagaggagattccaaatgaaggtgatgaacctggcggcagcgcaaaagatg

SEQ ID NO: 81069 - DNA, 103 bp, Artificial Sequence
  Synthetic Polynucleotide
taatacgactcactatagggcttgtgctgcaatttccagggtcctccgtaaacagaggagatacggaatgccctggaaaaacctggcggcagcgcaaaagatg

SEQ ID NO: 81070 - DNA, 103 bp, Artificial Sequence
  Synthetic Polynucleotide
taatacgactcactatagggttccacttgtgctgcaatttccagggtcctaacagaggagaaggaccatggaaattgcaaacctggcggcagcgcaaaagatg

SEQ ID NO: 81071 - DNA, 103 bp, Artificial Sequence
  Synthetic Polynucleotide
taatacgactcactataggggcccgttccacttgtgctgcaatttccaggaacagaggagacctggaatgtgcagcacaaacctggcggcagcgcaaaagatg

SEQ ID NO: 81072 - DNA, 103 bp, Artificial Sequence
  Synthetic Polynucleotide
taatacgactcactatagggatcctgcccgttccacttgtgctgcaatttaacagaggagaaaattgatgcacaagtggaacctggcggcagcgcaaaagatg

SEQ ID NO: 81073 - DNA, 103 bp, Artificial Sequence
  Synthetic Polynucleotide
taatacgactcactatagggacctcatcctgcccgttccacttgtgctgcaacagaggagagcagcaatggtggaacggaacctggcggcagcgcaaaagatg

SEQ ID NO: 81074 - DNA, 103 bp, Artificial Sequence
  Synthetic Polynucleotide
taatacgactcactatagggtctgcacctcatcctgcccgttccacttgtaacagaggagaacaagtatgacgggcaggaacctggcggcagcgcaaaagatg

SEQ ID NO: 81075 - DNA, 103 bp, Artificial Sequence
  Synthetic Polynucleotide
taatacgactcactatagggaatcatctgcacctcatcctgcccgttccaaacagaggagatggaacatgcaggatgagaacctggcggcagcgcaaaagatg

SEQ ID NO: 81076 - DNA, 103 bp, Artificial Sequence
  Synthetic Polynucleotide
taatacgactcactatagggaccacaatcatctgcacctcatcctgcccgaacagaggagacgggcaatgtgaggtgcaaacctggcggcagcgcaaaagatg

SEQ ID NO: 81077 - DNA, 103 bp, Artificial Sequence
  Synthetic Polynucleotide
taatacgactcactataggggttccaccacaatcatctgcacctcatcctaacagaggagaaggatgatgtgcagatgaaacctggcggcagcgcaaaagatg

SEQ ID NO: 81078 - DNA, 103 bp, Artificial Sequence
  Synthetic Polynucleotide
taatacgactcactataggggccaggttccaccacaatcatctgcacctcaacagaggagagaggtgatgatgattgtgaacctggcggcagcgcaaaagatg

SEQ ID NO: 81079 - DNA, 103 bp, Artificial Sequence
  Synthetic Polynucleotide
taatacgactcactataggggtagcatttaccgtcatcatcaccttccctaacagaggagaagggaaatggatgatgacaacctggcggcagcgcaaaagatg

SEQ ID NO: 81080 - DNA, 103 bp, Artificial Sequence
  Synthetic Polynucleotide
taatacgactcactatagggttcttgccaggttccaccacaatcatctgcaacagaggagagcagatatgtgtggtggaaacctggcggcagcgcaaaagatg

SEQ ID NO: 81081 - DNA, 103 bp, Artificial Sequence
  Synthetic Polynucleotide
taatacgactcactatagggtaacgttcttgccaggttccaccacaatcaaacagaggagatgattgatgtggaacctgaacctggcggcagcgcaaaagatg

SEQ ID NO: 81082 - DNA, 103 bp, Artificial Sequence
  Synthetic Polynucleotide
taatacgactcactataggggttcttaacgttcttgccaggttccaccacaacagaggagagtggtgatgcctggcaagaacctggcggcagcgcaaaagatg

SEQ ID NO: 81083 - DNA, 103 bp, Artificial Sequence
  Synthetic Polynucleotide
taatacgactcactatagggtggacgttcttaacgttcttgccaggttccaacagaggagaggaaccatgcaagaacgtaacctggcggcagcgcaaaagatg

SEQ ID NO: 81084 - DNA, 103 bp, Artificial Sequence
  Synthetic Polynucleotide
taatacgactcactatagggtcgtctggacgttcttaacgttcttgccagaacagaggagactggcaatgacgttaagaaacctggcggcagcgcaaaagatg

SEQ ID NO: 81085 - DNA, 103 bp, Artificial Sequence
  Synthetic Polynucleotide
taatacgactcactatagggtggtttcgtctggacgttcttaacgttcttaacagaggagaaagaacatgaagaacgtcaacctggcggcagcgcaaaagatg

SEQ ID NO: 81086 - DNA, 103 bp, Artificial Sequence
  Synthetic Polynucleotide
taatacgactcactatagggacccctggtttcgtctggacgttcttaacgaacagaggagacgttaaatgcgtccagacaacctggcggcagcgcaaaagatg

SEQ ID NO: 81087 - DNA, 103 bp, Artificial Sequence
  Synthetic Polynucleotide
taatacgactcactatagggtgaacacccctggtttcgtctggacgttctaacagaggagaagaacgatgagacgaaacaacctggcggcagcgcaaaagatg

SEQ ID NO: 81088 - DNA, 103 bp, Artificial Sequence
  Synthetic Polynucleotide
taatacgactcactatagggtgttttgaacacccctggtttcgtctggacaacagaggagagtccagatgaaaccagggaacctggcggcagcgcaaaagatg

SEQ ID NO: 81089 - DNA, 103 bp, Artificial Sequence
  Synthetic Polynucleotide
taatacgactcactatagggtcaggtgttttgaacacccctggtttcgtcaacagaggagagacgaaatgaggggtgttaacctggcggcagcgcaaaagatg

SEQ ID NO: 81090 - DNA, 103 bp, Artificial Sequence
  Synthetic Polynucleotide
taatacgactcactatagggcgtcagtagcatttaccgtcatcatcacctaacagaggagaaggtgaatgtgacggtaaaacctggcggcagcgcaaaagatg

SEQ ID NO: 81091 - DNA, 103 bp, Artificial Sequence
  Synthetic Polynucleotide
taatacgactcactatagggctccttcaggtgttttgaacacccctggttaacagaggagaaaccagatgtgttcaaaaaacctggcggcagcgcaaaagatg

SEQ ID NO: 81092 - DNA, 103 bp, Artificial Sequence
  Synthetic Polynucleotide
taatacgactcactataggggatttctccttcaggtgttttgaacaccccaacagaggagaggggtgatgaaaacacctaacctggcggcagcgcaaaagatg

SEQ ID NO: 81093 - DNA, 103 bp, Artificial Sequence
  Synthetic Polynucleotide
taatacgactcactataggggccccgatttctccttcaggtgttttgaacaacagaggagagttcaaatgacctgaaggaacctggcggcagcgcaaaagatg

SEQ ID NO: 81094 - DNA, 103 bp, Artificial Sequence
  Synthetic Polynucleotide
taatacgactcactatagggtcacggccccgatttctccttcaggtgtttaacagaggagaaaacacatgaaggagaaaaacctggcggcagcgcaaaagatg

SEQ ID NO: 81095 - DNA, 103 bp, Artificial Sequence
  Synthetic Polynucleotide
taatacgactcactatagggcaaagtcacggccccgatttctccttcaggaacagaggagacctgaaatggaaatcgggaacctggcggcagcgcaaaagatg

SEQ ID NO: 81096 - DNA, 103 bp, Artificial Sequence
  Synthetic Polynucleotide
taatacgactcactatagggaagtccaaagtcacggccccgatttctcctaacagaggagaaggagaatgcggggccgtaacctggcggcagcgcaaaagatg

SEQ ID NO: 81097 - DNA, 103 bp, Artificial Sequence
  Synthetic Polynucleotide
taatacgactcactatagggtggggaagtccaaagtcacggccccgatttaacagaggagaaaatcgatgccgtgacttaacctggcggcagcgcaaaagatg

SEQ ID NO: 81098 - DNA, 103 bp, Artificial Sequence
  Synthetic Polynucleotide
taatacgactcactatagggtccagtggggaagtccaaagtcacggccccaacagaggagaggggccatgactttggacaacctggcggcagcgcaaaagatg

SEQ ID NO: 81099 - DNA, 103 bp, Artificial Sequence
  Synthetic Polynucleotide
taatacgactcactataggggatgttccagtggggaagtccaaagtcacgaacagaggagacgtgacatgggacttcccaacctggcggcagcgcaaaagatg

SEQ ID NO: 81100 - DNA, 103 bp, Artificial Sequence
  Synthetic Polynucleotide
taatacgactcactatagggagcctgatgttccagtggggaagtccaaagaacagaggagactttggatgtccccactgaacctggcggcagcgcaaaagatg

SEQ ID NO: 81101 - DNA, 103 bp, Artificial Sequence
  Synthetic Polynucleotide
taatacgactcactatagggatgcacctcaattagcacacaggatttactaacagaggagaagtaaaatgtgtgtgctaaacctggcggcagcgcaaaagatg

SEQ ID NO: 81102 - DNA, 103 bp, Artificial Sequence
  Synthetic Polynucleotide
taatacgactcactatagggttaatccaaatgtgtttattgcctagcaacaacagaggagagttgctatgcaataaacaaacctggcggcagcgcaaaagatg

SEQ ID NO: 81103 - DNA, 103 bp, Artificial Sequence
  Synthetic Polynucleotide
taatacgactcactataggggtcacatttaggagcaaccatctgtttttcaacagaggagagaaaaaatgatggttgctaacctggcggcagcgcaaaagatg

SEQ ID NO: 81104 - DNA, 103 bp, Artificial Sequence
  Synthetic Polynucleotide
taatacgactcactatagggagcccaatcacctctccgttcctgttaacaaacagaggagatgttaaatggaacggagaaacctggcggcagcgcaaaagatg

SEQ ID NO: 81105 - DNA, 103 bp, Artificial Sequence
  Synthetic Polynucleotide
taatacgactcactatagggcgtacagcccaatcacctctccgttcctgtaacagaggagaacaggaatggagaggtgaaacctggcggcagcgcaaaagatg

SEQ ID NO: 81106 - DNA, 103 bp, Artificial Sequence
  Synthetic Polynucleotide
taatacgactcactatagggattgccgtacagcccaatcacctctccgttaacagaggagaaacggaatggtgattgggaacctggcggcagcgcaaaagatg

SEQ ID NO: 81107 - DNA, 103 bp, Artificial Sequence
  Synthetic Polynucleotide
taatacgactcactatagggatgccattgccgtacagcccaatcacctctaacagaggagaagaggtatgtgggctgtaaacctggcggcagcgcaaaagatg

SEQ ID NO: 81108 - DNA, 103 bp, Artificial Sequence
  Synthetic Polynucleotide
taatacgactcactatagggcaaggatgccattgccgtacagcccaatcaaacagaggagatgattgatgtgtacggcaaacctggcggcagcgcaaaagatg

SEQ ID NO: 81109 - DNA, 103 bp, Artificial Sequence
  Synthetic Polynucleotide
taatacgactcactatagggaccgacaaggatgccattgccgtacagcccaacagaggagagggctgatgggcaatggcaacctggcggcagcgcaaaagatg

SEQ ID NO: 81110 - DNA, 103 bp, Artificial Sequence
  Synthetic Polynucleotide
taatacgactcactatagggttgtcaccgacaaggatgccattgccgtacaacagaggagagtacggatgtggcatcctaacctggcggcagcgcaaaagatg

SEQ ID NO: 81111 - DNA, 103 bp, Artificial Sequence
  Synthetic Polynucleotide
taatacgactcactatagggaggagttgtcaccgacaaggatgccattgcaacagaggagagcaatgatgtccttgtcgaacctggcggcagcgcaaaagatg

SEQ ID NO: 81112 - DNA, 103 bp, Artificial Sequence
  Synthetic Polynucleotide
taatacgactcactatagggcacgaaggagttgtcaccgacaaggatgccaacagaggagaggcatcatggtcggtgacaacctggcggcagcgcaaaagatg

SEQ ID NO: 81113 - DNA, 103 bp, Artificial Sequence
  Synthetic Polynucleotide
taatacgactcactataggggcggacacgaaggagttgtcaccgacaaggaacagaggagaccttgtatgtgacaactcaacctggcggcagcgcaaaagatg

SEQ ID NO: 81114 - DNA, 103 bp, Artificial Sequence
  Synthetic Polynucleotide
taatacgactcactatagggcagatgtcacatttaggagcaaccatctgtaacagaggagaacagatatgtgctcctaaaacctggcggcagcgcaaaagatg

SEQ ID NO: 81115 - DNA, 103 bp, Artificial Sequence
  Synthetic Polynucleotide
taatacgactcactatagggatatggcggacacgaaggagttgtcaccgaaacagaggagatcggtgatgactccttcgaacctggcggcagcgcaaaagatg

SEQ ID NO: 81116 - DNA, 103 bp, Artificial Sequence
  Synthetic Polynucleotide
taatacgactcactatagggctgggatatggcggacacgaaggagttgtcaacagaggagagacaacatgttcgtgtccaacctggcggcagcgcaaaagatg

SEQ ID NO: 81117 - DNA, 103 bp, Artificial Sequence
  Synthetic Polynucleotide
taatacgactcactatagggtcagtctgggatatggcggacacgaaggagaacagaggagactccttatggtccgccataacctggcggcagcgcaaaagatg

SEQ ID NO: 81118 - DNA, 103 bp, Artificial Sequence
  Synthetic Polynucleotide
taatacgactcactatagggtcacctcagtctgggatatggcggacacgaaacagaggagatcgtgtatgccatatcccaacctggcggcagcgcaaaagatg

SEQ ID NO: 81119 - DNA, 103 bp, Artificial Sequence
  Synthetic Polynucleotide
taatacgactcactatagggttccttcacctcagtctgggatatggcggaaacagaggagatccgccatgtcccagactaacctggcggcagcgcaaaagatg

SEQ ID NO: 81120 - DNA, 103 bp, Artificial Sequence
  Synthetic Polynucleotide
taatacgactcactatagggccttcttccttcacctcagtctgggatatgaacagaggagacatatcatggactgaggtaacctggcggcagcgcaaaagatg

SEQ ID NO: 81121 - DNA, 103 bp, Artificial Sequence
  Synthetic Polynucleotide
taatacgactcactatagggcctttccttcttccttcacctcagtctgggaacagaggagacccagaatgaggtgaaggaacctggcggcagcgcaaaagatg

SEQ ID NO: 81122 - DNA, 103 bp, Artificial Sequence
  Synthetic Polynucleotide
taatacgactcactatagggctcctcctttccttcttccttcacctcagtaacagaggagaactgagatgaaggaagaaaacctggcggcagcgcaaaagatg

SEQ ID NO: 81123 - DNA, 103 bp, Artificial Sequence
  Synthetic Polynucleotide
taatacgactcactatagggtggagctcctcctttccttcttccttcaccaacagaggagaggtgaaatgagaaggaaaaacctggcggcagcgcaaaagatg

SEQ ID NO: 81124 - DNA, 103 bp, Artificial Sequence
  Synthetic Polynucleotide
taatacgactcactatagggtctcttggagctcctcctttccttcttcctaacagaggagaaggaagatggaaaggaggaacctggcggcagcgcaaaagatg

SEQ ID NO: 81125 - DNA, 103 bp, Artificial Sequence
  Synthetic Polynucleotide
taatacgactcactataggggtcctcagatgtcacatttaggagcaaccaaacagaggagatggttgatgctaaatgtgaacctggcggcagcgcaaaagatg

SEQ ID NO: 81126 - DNA, 103 bp, Artificial Sequence
  Synthetic Polynucleotide
taatacgactcactatagggcgggatctcttggagctcctcctttccttcaacagaggagagaaggaatggaggagctcaacctggcggcagcgcaaaagatg

SEQ ID NO: 81127 - DNA, 103 bp, Artificial Sequence
  Synthetic Polynucleotide
taatacgactcactatagggattgtcgggatctcttggagctcctcctttaacagaggagaaaaggaatggctccaagaaacctggcggcagcgcaaaagatg

SEQ ID NO: 81128 - DNA, 103 bp, Artificial Sequence
  Synthetic Polynucleotide
taatacgactcactatagggttagcattgtcgggatctcttggagctcctaacagaggagaaggagcatgaagagatccaacctggcggcagcgcaaaagatg

SEQ ID NO: 81129 - DNA, 103 bp, Artificial Sequence
  Synthetic Polynucleotide
taatacgactcactatagggtttctttagcattgtcgggatctcttggagaacagaggagactccaaatgatcccgacaaacctggcggcagcgcaaaagatg

SEQ ID NO: 81130 - DNA, 103 bp, Artificial Sequence
  Synthetic Polynucleotide
taatacgactcactatagggattcctttctttagcattgtcgggatctctaacagaggagaagagatatggacaatgctaacctggcggcagcgcaaaagatg

SEQ ID NO: 81131 - DNA, 103 bp, Artificial Sequence
  Synthetic Polynucleotide
taatacgactcactatagggttgtcattcctttctttagcattgtcgggaaacagaggagatcccgaatgtgctaaagaaacctggcggcagcgcaaaagatg

SEQ ID NO: 81132 - DNA, 103 bp, Artificial Sequence
  Synthetic Polynucleotide
taatacgactcactataggggacagttgtcattcctttctttagcattgtaacagaggagaacaatgatgaagaaaggaaacctggcggcagcgcaaaagatg

SEQ ID NO: 81133 - DNA, 103 bp, Artificial Sequence
  Synthetic Polynucleotide
taatacgactcactatagggtcaaggacagttgtcattcctttctttagcaacagaggagagctaaaatgaggaatgacaacctggcggcagcgcaaaagatg

SEQ ID NO: 81134 - DNA, 103 bp, Artificial Sequence
  Synthetic Polynucleotide
taatacgactcactataggggaaaatcaaggacagttgtcattcctttctaacagaggagaagaaagatgtgacaactgaacctggcggcagcgcaaaagatg

SEQ ID NO: 81135 - DNA, 103 bp, Artificial Sequence
  Synthetic Polynucleotide
taatacgactcactatagggaggatgaaaatcaaggacagttgtcattccaacagaggagaggaatgatgactgtccttaacctggcggcagcgcaaaagatg

SEQ ID NO: 81136 - DNA, 103 bp, Artificial Sequence
  Synthetic Polynucleotide
taatacgactcactatagggccgaggtcctcagatgtcacatttaggagcaacagaggagagctcctatgtgtgacatcaacctggcggcagcgcaaaagatg

SEQ ID NO: 81137 - DNA, 103 bp, Artificial Sequence
  Synthetic Polynucleotide
taatacgactcactataggggctccaggatgaaaatcaaggacagttgtcaacagaggagagacaacatgccttgatttaacctggcggcagcgcaaaagatg

SEQ ID NO: 81138 - DNA, 103 bp, Artificial Sequence
  Synthetic Polynucleotide
taatacgactcactatagggtcccagctccaggatgaaaatcaaggacagaacagaggagactgtccatgattttcatcaacctggcggcagcgcaaaagatg

SEQ ID NO: 81139 - DNA, 103 bp, Artificial Sequence
  Synthetic Polynucleotide
taatacgactcactatagggtgtcttcccagctccaggatgaaaatcaagaacagaggagacttgatatgcatcctggaaacctggcggcagcgcaaaagatg

SEQ ID NO: 81140 - DNA, 103 bp, Artificial Sequence
  Synthetic Polynucleotide
taatacgactcactatagggcgtcttgtcttcccagctccaggatgaaaaaacagaggagattttcaatgtggagctggaacctggcggcagcgcaaaagatg

SEQ ID NO: 81141 - DNA, 103 bp, Artificial Sequence
  Synthetic Polynucleotide
taatacgactcactatagggggaaacgtcttgtcttcccagctccaggataacagaggagaatcctgatgctgggaagaaacctggcggcagcgcaaaagatg

SEQ ID NO: 81142 - DNA, 103 bp, Artificial Sequence
  Synthetic Polynucleotide
taatacgactcactatagggtgggaggaaacgtcttgtcttcccagctccaacagaggagaggagctatgaagacaagaaacctggcggcagcgcaaaagatg

SEQ ID NO: 81143 - DNA, 103 bp, Artificial Sequence
  Synthetic Polynucleotide
taatacgactcactatagggatctgtgggaggaaacgtcttgtcttcccaaacagaggagatgggaaatgaagacgtttaacctggcggcagcgcaaaagatg

SEQ ID NO: 81144 - DNA, 103 bp, Artificial Sequence
  Synthetic Polynucleotide
taatacgactcactatagggccaagatctgtgggaggaaacgtcttgtctaacagaggagaagacaaatggtttcctccaacctggcggcagcgcaaaagatg

SEQ ID NO: 81145 - DNA, 103 bp, Artificial Sequence
  Synthetic Polynucleotide
taatacgactcactatagggctcggccaagatctgtgggaggaaacgtctaacagaggagaagacgtatgctcccacagaacctggcggcagcgcaaaagatg

SEQ ID NO: 81146 - DNA, 103 bp, Artificial Sequence
  Synthetic Polynucleotide
taatacgactcactataggggcgcactcggccaagatctgtgggaggaaaaacagaggagatttcctatgacagatcttaacctggcggcagcgcaaaagatg

SEQ ID NO: 81147 - DNA, 103 bp, Artificial Sequence
  Synthetic Polynucleotide
taatacgactcactatagggttttcccgaggtcctcagatgtcacatttaaacagaggagataaatgatgcatctgaggaacctggcggcagcgcaaaagatg

SEQ ID NO: 81148 - DNA, 103 bp, Artificial Sequence
  Synthetic Polynucleotide
taatacgactcactatagggtccgtgcgcactcggccaagatctgtgggaaacagaggagatcccacatgtcttggccgaacctggcggcagcgcaaaagatg

SEQ ID NO: 81149 - DNA, 103 bp, Artificial Sequence
  Synthetic Polynucleotide
taatacgactcactataggggcgtctccgtgcgcactcggccaagatctgaacagaggagacagatcatggccgagtgcaacctggcggcagcgcaaaagatg

SEQ ID NO: 81150 - DNA, 103 bp, Artificial Sequence
  Synthetic Polynucleotide
taatacgactcactatagggcgcaagcgtctccgtgcgcactcggccaagaacagaggagacttggcatggtgcgcacgaacctggcggcagcgcaaaagatg

SEQ ID NO: 81151 - DNA, 103 bp, Artificial Sequence
  Synthetic Polynucleotide
taatacgactcactataggggagtgcgcaagcgtctccgtgcgcactcggaacagaggagaccgagtatgcacggagacaacctggcggcagcgcaaaagatg

SEQ ID NO: 81152 - DNA, 103 bp, Artificial Sequence
  Synthetic Polynucleotide
taatacgactcactatagggcacaagagtgcgcaagcgtctccgtgcgcaaacagaggagatgcgcaatgagacgcttgaacctggcggcagcgcaaaagatg

SEQ ID NO: 81153 - DNA, 103 bp, Artificial Sequence
  Synthetic Polynucleotide
taatacgactcactataggggccaacacaagagtgcgcaagcgtctccgtaacagaggagaacggagatgcttgcgcacaacctggcggcagcgcaaaagatg

SEQ ID NO: 81154 - DNA, 103 bp, Artificial Sequence
  Synthetic Polynucleotide
taatacgactcactatagggtgggggccaacacaagagtgcgcaagcgtcaacagaggagagacgctatggcactcttgaacctggcggcagcgcaaaagatg

SEQ ID NO: 81155 - DNA, 103 bp, Artificial Sequence
  Synthetic Polynucleotide
taatacgactcactatagggcctggtgggggccaacacaagagtgcgcaaaacagaggagattgcgcatgcttgtgttgaacctggcggcagcgcaaaagatg

SEQ ID NO: 81156 - DNA, 103 bp, Artificial Sequence
  Synthetic Polynucleotide
taatacgactcactatagggacaaccctggtgggggccaacacaagagtgaacagaggagacactctatggttggccccaacctggcggcagcgcaaaagatg

SEQ ID NO: 81157 - DNA, 103 bp, Artificial Sequence
  Synthetic Polynucleotide
taatacgactcactatagggaaagaacaaccctggtgggggccaacacaaaacagaggagattgtgtatgcccccaccaaacctggcggcagcgcaaaagatg

SEQ ID NO: 81158 - DNA, 103 bp, Artificial Sequence
  Synthetic Polynucleotide
taatacgactcactataggggaatgttttcccgaggtcctcagatgtcacaacagaggagagtgacaatggaggacctcaacctggcggcagcgcaaaagatg

SEQ ID NO: 81159 - DNA, 103 bp, Artificial Sequence
  Synthetic Polynucleotide
taatacgactcactatagggttcagaaagaacaaccctggtgggggccaaaacagaggagattggccatgaccagggttaacctggcggcagcgcaaaagatg

SEQ ID NO: 81160 - DNA, 103 bp, Artificial Sequence
  Synthetic Polynucleotide
taatacgactcactatagggttcatttcagaaagaacaaccctggtggggaacagaggagaccccacatgggttgttctaacctggcggcagcgcaaaagatg

SEQ ID NO: 81161 - DNA, 103 bp, Artificial Sequence
  Synthetic Polynucleotide
taatacgactcactatagggcctccttcatttcagaaagaacaaccctggaacagaggagaccagggatgttctttctgaacctggcggcagcgcaaaagatg

SEQ ID NO: 81162 - DNA, 103 bp, Artificial Sequence
  Synthetic Polynucleotide
taatacgactcactatagggaaaagcctccttcatttcagaaagaacaacaacagaggagagttgttatgtctgaaatgaacctggcggcagcgcaaaagatg

SEQ ID NO: 81163 - DNA, 103 bp, Artificial Sequence
  Synthetic Polynucleotide
taatacgactcactatagggccgtgaaaagcctccttcatttcagaaagaaacagaggagatctttcatgaatgaaggaaacctggcggcagcgcaaaagatg

SEQ ID NO: 81164 - DNA, 103 bp, Artificial Sequence
  Synthetic Polynucleotide
taatacgactcactatagggccaggccgtgaaaagcctccttcatttcagaacagaggagactgaaaatgaggaggcttaacctggcggcagcgcaaaagatg

SEQ ID NO: 81165 - DNA, 103 bp, Artificial Sequence
  Synthetic Polynucleotide
taatacgactcactatagggcacgtccaggccgtgaaaagcctccttcataacagaggagaatgaagatggcttttcacaacctggcggcagcgcaaaagatg

SEQ ID NO: 81166 - DNA, 103 bp, Artificial Sequence
  Synthetic Polynucleotide
taatacgactcactatagggaatttcacgtccaggccgtgaaaagcctccaacagaggagaggaggcatgtcacggcctaacctggcggcagcgcaaaagatg

SEQ ID NO: 81167 - DNA, 103 bp, Artificial Sequence
  Synthetic Polynucleotide
taatacgactcactatagggtgtggaatttcacgtccaggccgtgaaaagaacagaggagacttttcatggcctggacgaacctggcggcagcgcaaaagatg

SEQ ID NO: 81168 - DNA, 103 bp, Artificial Sequence
  Synthetic Polynucleotide
taatacgactcactatagggctgtgtgtggaatttcacgtccaggccgtgaacagaggagacacggcatggacgtgaaaaacctggcggcagcgcaaaagatg

SEQ ID NO: 81169 - DNA, 103 bp, Artificial Sequence
  Synthetic Polynucleotide
taatacgactcactatagggacagagaatgttttcccgaggtcctcagataacagaggagaatctgaatgcctcgggaaaacctggcggcagcgcaaaagatg

SEQ ID NO: 81170 - DNA, 103 bp, Artificial Sequence
  Synthetic Polynucleotide
taatacgactcactatagggaaagcctgtgtgtggaatttcacgtccaggaacagaggagacctggaatggaaattccaaacctggcggcagcgcaaaagatg

SEQ ID NO: 81171 - DNA, 103 bp, Artificial Sequence
  Synthetic Polynucleotide
taatacgactcactatagggcggaaaaagcctgtgtgtggaatttcacgtaacagaggagaacgtgaatgtccacacacaacctggcggcagcgcaaaagatg

SEQ ID NO: 81172 - DNA, 103 bp, Artificial Sequence
  Synthetic Polynucleotide
taatacgactcactataggggtgagcggaaaaagcctgtgtgtggaatttaacagaggagaaaattcatgacacaggctaacctggcggcagcgcaaaagatg

SEQ ID NO: 81173 - DNA, 103 bp, Artificial Sequence
  Synthetic Polynucleotide
taatacgactcactatagggctgccgtgagcggaaaaagcctgtgtgtggaacagaggagaccacacatgggctttttcaacctggcggcagcgcaaaagatg

SEQ ID NO: 81174 - DNA, 103 bp, Artificial Sequence
  Synthetic Polynucleotide
taatacgactcactatagggtcccgctgccgtgagcggaaaaagcctgtgaacagaggagacacaggatgtttccgctcaacctggcggcagcgcaaaagatg

SEQ ID NO: 81175 - DNA, 103 bp, Artificial Sequence
  Synthetic Polynucleotide
taatacgactcactatagggttctctcccgctgccgtgagcggaaaaagcaacagaggagagcttttatggctcacggcaacctggcggcagcgcaaaagatg

SEQ ID NO: 81176 - DNA, 103 bp, Artificial Sequence
  Synthetic Polynucleotide
taatacgactcactatagggatgacttctctcccgctgccgtgagcggaaaacagaggagattccgcatgcggcagcggaacctggcggcagcgcaaaagatg

SEQ ID NO: 81177 - DNA, 103 bp, Artificial Sequence
  Synthetic Polynucleotide
taatacgactcactatagggcatcaatgacttctctcccgctgccgtgagaacagaggagactcacgatggcgggagagaacctggcggcagcgcaaaagatg

SEQ ID NO: 81178 - DNA, 103 bp, Artificial Sequence
  Synthetic Polynucleotide
taatacgactcactatagggcatggcatcaatgacttctctcccgctgccaacagaggagaggcagcatgagagaagtcaacctggcggcagcgcaaaagatg

SEQ ID NO: 81179 - DNA, 103 bp, Artificial Sequence
  Synthetic Polynucleotide
taatacgactcactatagggtggcacatggcatcaatgacttctctcccgaacagaggagacgggagatgagtcattgaaacctggcggcagcgcaaaagatg

SEQ ID NO: 81180 - DNA, 103 bp, Artificial Sequence
  Synthetic Polynucleotide
taatacgactcactatagggtgcccacagagaatgttttcccgaggtcctaacagaggagaaggaccatgggaaaacataacctggcggcagcgcaaaagatg

SEQ ID NO: 81181 - DNA, 103 bp, Artificial Sequence
  Synthetic Polynucleotide
taatacgactcactatagggtggcatggcacatggcatcaatgacttctcaacagaggagagagaagatgttgatgccaaacctggcggcagcgcaaaagatg

SEQ ID NO: 81182 - DNA, 103 bp, Artificial Sequence
  Synthetic Polynucleotide
taatacgactcactatagggtagggtggcatggcacatggcatcaatgacaacagaggagagtcattatggccatgtgcaacctggcggcagcgcaaaagatg

SEQ ID NO: 81183 - DNA, 103 bp, Artificial Sequence
  Synthetic Polynucleotide
taatacgactcactatagggtaagttagggtggcatggcacatggcatcaaacagaggagatgatgcatggtgccatgcaacctggcggcagcgcaaaagatg

SEQ ID NO: 81184 - DNA, 103 bp, Artificial Sequence
  Synthetic Polynucleotide
taatacgactcactatagggtcctgtaagttagggtggcatggcacatggaacagaggagaccatgtatgatgccacccaacctggcggcagcgcaaaagatg

SEQ ID NO: 81185 - DNA, 103 bp, Artificial Sequence
  Synthetic Polynucleotide
taatacgactcactatagggcaacatcctgtaagttagggtggcatggcaaacagaggagatgccatatgaccctaactaacctggcggcagcgcaaaagatg

SEQ ID NO: 81186 - DNA, 103 bp, Artificial Sequence
  Synthetic Polynucleotide
taatacgactcactatagggggttccaacatcctgtaagttagggtggcaaacagaggagatgccacatgaacttacagaacctggcggcagcgcaaaagatg

SEQ ID NO: 81187 - DNA, 103 bp, Artificial Sequence
  Synthetic Polynucleotide
taatacgactcactatagggtagttggttccaacatcctgtaagttagggaacagaggagaccctaaatgacaggatgtaacctggcggcagcgcaaaagatg

SEQ ID NO: 81188 - DNA, 103 bp, Artificial Sequence
  Synthetic Polynucleotide
taatacgactcactatagggaaccctagttggttccaacatcctgtaagtaacagaggagaacttacatgatgttggaaaacctggcggcagcgcaaaagatg

SEQ ID NO: 81189 - DNA, 103 bp, Artificial Sequence
  Synthetic Polynucleotide
taatacgactcactatagggttaacaaccctagttggttccaacatcctgaacagaggagacaggatatgggaaccaacaacctggcggcagcgcaaaagatg

SEQ ID NO: 81190 - DNA, 103 bp, Artificial Sequence
  Synthetic Polynucleotide
taatacgactcactatagggcccagttaacaaccctagttggttccaacaaacagaggagatgttggatgcaactagggaacctggcggcagcgcaaaagatg

SEQ ID NO: 81191 - DNA, 103 bp, Artificial Sequence
  Synthetic Polynucleotide
taatacgactcactataggggcctgtgcccacagagaatgttttcccgagaacagaggagactcgggatgacattctctaacctggcggcagcgcaaaagatg

SEQ ID NO: 81192 - DNA, 103 bp, Artificial Sequence
  Synthetic Polynucleotide
taatacgactcactatagggcacttcccagttaacaaccctagttggttcaacagaggagagaaccaatgagggttgttaacctggcggcagcgcaaaagatg

SEQ ID NO: 81193 - DNA, 103 bp, Artificial Sequence
  Synthetic Polynucleotide
taatacgactcactatagggatgatcacttcccagttaacaaccctagttaacagaggagaaactagatgtgttaactgaacctggcggcagcgcaaaagatg

SEQ ID NO: 81194 - DNA, 103 bp, Artificial Sequence
  Synthetic Polynucleotide
taatacgactcactatagggccataatgatcacttcccagttaacaacccaacagaggagagggttgatgactgggaagaacctggcggcagcgcaaaagatg

SEQ ID NO: 81195 - DNA, 103 bp, Artificial Sequence
  Synthetic Polynucleotide
taatacgactcactatagggttcatccataatgatcacttcccagttaacaacagaggagagttaacatggaagtgatcaacctggcggcagcgcaaaagatg

SEQ ID NO: 81196 - DNA, 103 bp, Artificial Sequence
  Synthetic Polynucleotide
taatacgactcactatagggtgggcttcatccataatgatcacttcccagaacagaggagactgggaatggatcattataacctggcggcagcgcaaaagatg

SEQ ID NO: 81197 - DNA, 103 bp, Artificial Sequence
  Synthetic Polynucleotide
taatacgactcactatagggaaaaatgggcttcatccataatgatcacttaacagaggagaaagtgaatgttatggatgaacctggcggcagcgcaaaagatg

SEQ ID NO: 81198 - DNA, 103 bp, Artificial Sequence
  Synthetic Polynucleotide
taatacgactcactatagggatccaaaaaatgggcttcatccataatgataacagaggagaatcattatggatgaagccaacctggcggcagcgcaaaagatg

SEQ ID NO: 81199 - DNA, 103 bp, Artificial Sequence
  Synthetic Polynucleotide
taatacgactcactataggggctggatccaaaaaatgggcttcatccataaacagaggagatatggaatgagcccatttaacctggcggcagcgcaaaagatg

SEQ ID NO: 81200 - DNA, 103 bp, Artificial Sequence
  Synthetic Polynucleotide
taatacgactcactatagggtgctagctggatccaaaaaatgggcttcataacagaggagaatgaagatgattttttggaacctggcggcagcgcaaaagatg

SEQ ID NO: 81201 - DNA, 103 bp, Artificial Sequence
  Synthetic Polynucleotide
taatacgactcactatagggggctatgctagctggatccaaaaaatgggcaacagaggagagcccatatgttggatccaaacctggcggcagcgcaaaagatg

SEQ ID NO: 81202 - DNA, 103 bp, Artificial Sequence
  Synthetic Polynucleotide
taatacgactcactatagggcagttgcctgtgcccacagagaatgttttcaacagaggagagaaaacatgctctgtgggaacctggcggcagcgcaaaagatg

SEQ ID NO: 81203 - DNA, 103 bp, Artificial Sequence
  Synthetic Polynucleotide
taatacgactcactatagggctagcggctatgctagctggatccaaaaaaaacagaggagattttttatgtccagctagaacctggcggcagcgcaaaagatg

SEQ ID NO: 81204 - DNA, 103 bp, Artificial Sequence
  Synthetic Polynucleotide
taatacgactcactatagggaacctctagcggctatgctagctggatccaaacagaggagatggatcatgctagcatagaacctggcggcagcgcaaaagatg

SEQ ID NO: 81205 - DNA, 103 bp, Artificial Sequence
  Synthetic Polynucleotide
taatacgactcactatagggtgcccaacctctagcggctatgctagctggaacagaggagaccagctatgatagccgctaacctggcggcagcgcaaaagatg

SEQ ID NO: 81206 - DNA, 103 bp, Artificial Sequence
  Synthetic Polynucleotide
taatacgactcactatagggtgcgctgcccaacctctagcggctatgctaaacagaggagatagcatatgcgctagaggaacctggcggcagcgcaaaagatg

SEQ ID NO: 81207 - DNA, 103 bp, Artificial Sequence
  Synthetic Polynucleotide
taatacgactcactatagggctctgtgcgctgcccaacctctagcggctaaacagaggagatagccgatggaggttgggaacctggcggcagcgcaaaagatg

SEQ ID NO: 81208 - DNA, 103 bp, Artificial Sequence
  Synthetic Polynucleotide
taatacgactcactatagggcctagctctgtgcgctgcccaacctctagcaacagaggagagctagaatgtgggcagcgaacctggcggcagcgcaaaagatg

SEQ ID NO: 81209 - DNA, 103 bp, Artificial Sequence
  Synthetic Polynucleotide
taatacgactcactatagggtttgccctagctctgtgcgctgcccaacctaacagaggagaaggttgatgagcgcacagaacctggcggcagcgcaaaagatg

SEQ ID NO: 81210 - DNA, 103 bp, Artificial Sequence
  Synthetic Polynucleotide
taatacgactcactatagggtttcatttgccctagctctgtgcgctgcccaacagaggagagggcagatgacagagctaaacctggcggcagcgcaaaagatg

SEQ ID NO: 81211 - DNA, 103 bp, Artificial Sequence
  Synthetic Polynucleotide
taatacgactcactatagggtgcactttcatttgccctagctctgtgcgcaacagaggagagcgcacatggctagggcaaacctggcggcagcgcaaaagatg

SEQ ID NO: 81212 - DNA, 103 bp, Artificial Sequence
  Synthetic Polynucleotide
taatacgactcactatagggattgttgcactttcatttgccctagctctgaacagaggagacagagcatgggcaaatgaaacctggcggcagcgcaaaagatg

SEQ ID NO: 81213 - DNA, 103 bp, Artificial Sequence
  Synthetic Polynucleotide
taatacgactcactatagggtaaaattaatccaaatgtgtttattgcctaaacagaggagataggcaatgaacacatttaacctggcggcagcgcaaaagatg

SEQ ID NO: 81214 - DNA, 103 bp, Artificial Sequence
  Synthetic Polynucleotide
taatacgactcactatagggttgtgcagttgcctgtgcccacagagaatgaacagaggagacattctatgtgggcacagaacctggcggcagcgcaaaagatg

SEQ ID NO: 81215 - DNA, 103 bp, Artificial Sequence
  Synthetic Polynucleotide
taatacgactcactatagggtcaagattgttgcactttcatttgccctagaacagaggagactagggatgatgaaagtgaacctggcggcagcgcaaaagatg

SEQ ID NO: 81216 - DNA, 103 bp, Artificial Sequence
  Synthetic Polynucleotide
taatacgactcactatagggtgtcatcaagattgttgcactttcatttgcaacagaggagagcaaatatgagtgcaacaaacctggcggcagcgcaaaagatg

SEQ ID NO: 81217 - DNA, 103 bp, Artificial Sequence
  Synthetic Polynucleotide
taatacgactcactataggggtggctgtcatcaagattgttgcactttcaaacagaggagatgaaagatgaacaatcttaacctggcggcagcgcaaaagatg

SEQ ID NO: 81218 - DNA, 103 bp, Artificial Sequence
  Synthetic Polynucleotide
taatacgactcactataggggcggtgtggctgtcatcaagattgttgcacaacagaggagagtgcaaatgtcttgatgaaacctggcggcagcgcaaaagatg

SEQ ID NO: 81219 - DNA, 103 bp, Artificial Sequence
  Synthetic Polynucleotide
taatacgactcactatagggcccaggcggtgtggctgtcatcaagattgtaacagaggagaacaatcatgatgacagccaacctggcggcagcgcaaaagatg

SEQ ID NO: 81220 - DNA, 103 bp, Artificial Sequence
  Synthetic Polynucleotide
taatacgactcactatagggctagtcccaggcggtgtggctgtcatcaagaacagaggagacttgatatgagccacaccaacctggcggcagcgcaaaagatg

SEQ ID NO: 81221 - DNA, 103 bp, Artificial Sequence
  Synthetic Polynucleotide
taatacgactcactatagggcatcactagtcccaggcggtgtggctgtcaaacagaggagatgacagatgcaccgcctgaacctggcggcagcgcaaaagatg

SEQ ID NO: 81222 - DNA, 103 bp, Artificial Sequence
  Synthetic Polynucleotide
taatacgactcactatagggaaattcatcactagtcccaggcggtgtggcaacagaggagagccacaatgcctgggactaacctggcggcagcgcaaaagatg

SEQ ID NO: 81223 - DNA, 103 bp, Artificial Sequence
  Synthetic Polynucleotide
taatacgactcactatagggtgtggaaattcatcactagtcccaggcggtaacagaggagaaccgccatggactagtgaaacctggcggcagcgcaaaagatg

SEQ ID NO: 81224 - DNA, 103 bp, Artificial Sequence
  Synthetic Polynucleotide
taatacgactcactatagggttgaatgtggaaattcatcactagtcccagaacagaggagactgggaatggtgatgaataacctggcggcagcgcaaaagatg

SEQ ID NO: 81225 - DNA, 103 bp, Artificial Sequence
  Synthetic Polynucleotide
taatacgactcactataggggtttgttgtgcagttgcctgtgcccacagaaacagaggagatctgtgatgacaggcaacaacctggcggcagcgcaaaagatg

SEQ ID NO: 81226 - DNA, 103 bp, Artificial Sequence
  Synthetic Polynucleotide
taatacgactcactatagggaccatttgaatgtggaaattcatcactagtaacagaggagaactagtatggaatttccaaacctggcggcagcgcaaaagatg

SEQ ID NO: 81227 - DNA, 103 bp, Artificial Sequence
  Synthetic Polynucleotide
taatacgactcactatagggatttcaccatttgaatgtggaaattcatcaaacagaggagatgatgaatgtccacattcaacctggcggcagcgcaaaagatg

SEQ ID NO: 81228 - DNA, 103 bp, Artificial Sequence
  Synthetic Polynucleotide
taatacgactcactatagggcttctatttcaccatttgaatgtggaaattaacagaggagaaatttcatgattcaaatgaacctggcggcagcgcaaaagatg

SEQ ID NO: 81229 - DNA, 103 bp, Artificial Sequence
  Synthetic Polynucleotide
taatacgactcactatagggaacatcttctatttcaccatttgaatgtggaacagaggagaccacatatgaatggtgaaaacctggcggcagcgcaaaagatg

SEQ ID NO: 81230 - DNA, 103 bp, Artificial Sequence
  Synthetic Polynucleotide
taatacgactcactataggggtttgaacatcttctatttcaccatttgaaaacagaggagattcaaaatgtgaaatagaaacctggcggcagcgcaaaagatg

SEQ ID NO: 81231 - DNA, 103 bp, Artificial Sequence
  Synthetic Polynucleotide
taatacgactcactatagggtgtccgtttgaacatcttctatttcaccataacagaggagaatggtgatgtagaagatgaacctggcggcagcgcaaaagatg

SEQ ID NO: 81232 - DNA, 103 bp, Artificial Sequence
  Synthetic Polynucleotide
taatacgactcactataggggggtatgtccgtttgaacatcttctatttcaacagaggagagaaataatggatgttcaaaacctggcggcagcgcaaaagatg

SEQ ID NO: 81233 - DNA, 103 bp, Artificial Sequence
  Synthetic Polynucleotide
taatacgactcactatagggtcactgggtatgtccgtttgaacatcttctaacagaggagaagaagaatgtcaaacggaaacctggcggcagcgcaaaagatg

SEQ ID NO: 81234 - DNA, 103 bp, Artificial Sequence
  Synthetic Polynucleotide
taatacgactcactatagggagggctcactgggtatgtccgtttgaacataacagaggagaatgttcatgcggacatacaacctggcggcagcgcaaaagatg

SEQ ID NO: 81235 - DNA, 103 bp, Artificial Sequence
  Synthetic Polynucleotide
taatacgactcactataggggttccagggctcactgggtatgtccgtttgaacagaggagacaaacgatgatacccagtaacctggcggcagcgcaaaagatg

SEQ ID NO: 81236 - DNA, 103 bp, Artificial Sequence
  Synthetic Polynucleotide
taatacgactcactatagggaaaatgtttgttgtgcagttgcctgtgcccaacagaggagagggcacatgcaactgcacaacctggcggcagcgcaaaagatg

SEQ ID NO: 81237 - DNA, 103 bp, Artificial Sequence
  Synthetic Polynucleotide
taatacgactcactatagggcctgtgttccagggctcactgggtatgtccaacagaggagaggacatatgcagtgagccaacctggcggcagcgcaaaagatg

SEQ ID NO: 81238 - DNA, 103 bp, Artificial Sequence
  Synthetic Polynucleotide
taatacgactcactatagggcatgccctgtgttccagggctcactgggtaaacagaggagatacccaatgagccctggaaacctggcggcagcgcaaaagatg

SEQ ID NO: 81239 - DNA, 103 bp, Artificial Sequence
  Synthetic Polynucleotide
taatacgactcactatagggccagtcatgccctgtgttccagggctcactaacagaggagaagtgagatgtggaacacaaacctggcggcagcgcaaaagatg

SEQ ID NO: 81240 - DNA, 103 bp, Artificial Sequence
  Synthetic Polynucleotide
taatacgactcactatagggaggatccagtcatgccctgtgttccagggcaacagaggagagccctgatgcacagggcaaacctggcggcagcgcaaaagatg

SEQ ID NO: 81241 - DNA, 103 bp, Artificial Sequence
  Synthetic Polynucleotide
taatacgactcactatagggcagctaggatccagtcatgccctgtgttccaacagaggagaggaacaatgggcatgactaacctggcggcagcgcaaaagatg

SEQ ID NO: 81242 - DNA, 103 bp, Artificial Sequence
  Synthetic Polynucleotide
taatacgactcactatagggtttgtcagctaggatccagtcatgccctgtaacagaggagaacagggatggactggatcaacctggcggcagcgcaaaagatg

SEQ ID NO: 81243 - DNA, 103 bp, Artificial Sequence
  Synthetic Polynucleotide
taatacgactcactatagggggccttttgtcagctaggatccagtcatgcaacagaggagagcatgaatggatcctagcaacctggcggcagcgcaaaagatg

SEQ ID NO: 81244 - DNA, 103 bp, Artificial Sequence
  Synthetic Polynucleotide
taatacgactcactatagggccgtgggccttttgtcagctaggatccagtaacagaggagaactggaatgtagctgacaaacctggcggcagcgcaaaagatg

SEQ ID NO: 81245 - DNA, 103 bp, Artificial Sequence
  Synthetic Polynucleotide
taatacgactcactatagggccatgccgtgggccttttgtcagctaggataacagaggagaatcctaatggacaaaaggaacctggcggcagcgcaaaagatg

SEQ ID NO: 81246 - DNA, 103 bp, Artificial Sequence
  Synthetic Polynucleotide
taatacgactcactatagggaggaaccatgccgtgggccttttgtcagctaacagaggagaagctgaatgaaggcccacaacctggcggcagcgcaaaagatg

SEQ ID NO: 81247 - DNA, 103 bp, Artificial Sequence
  Synthetic Polynucleotide
taatacgactcactatagggcttccaaaatgtttgttgtgcagttgcctgaacagaggagacaggcaatggcacaacaaaacctggcggcagcgcaaaagatg

SEQ ID NO: 81248 - DNA, 103 bp, Artificial Sequence
  Synthetic Polynucleotide
taatacgactcactatagggatggaaggaaccatgccgtgggccttttgtaacagaggagaacaaaaatgccacggcataacctggcggcagcgcaaaagatg

SEQ ID NO: 81249 - DNA, 103 bp, Artificial Sequence
  Synthetic Polynucleotide
taatacgactcactataggggatggatggaaggaaccatgccgtgggcctaacagaggagaaggcccatggcatggttcaacctggcggcagcgcaaaagatg

SEQ ID NO: 81250 - DNA, 103 bp, Artificial Sequence
  Synthetic Polynucleotide
taatacgactcactataggggctctgatggatggaaggaaccatgccgtgaacagaggagacacggcatggttccttccaacctggcggcagcgcaaaagatg

SEQ ID NO: 81251 - DNA, 103 bp, Artificial Sequence
  Synthetic Polynucleotide
taatacgactcactatagggttgcagctctgatggatggaaggaaccatgaacagaggagacatggtatgttccatccaaacctggcggcagcgcaaaagatg

SEQ ID NO: 81252 - DNA, 103 bp, Artificial Sequence
  Synthetic Polynucleotide
taatacgactcactataggggacatttgcagctctgatggatggaaggaaaacagaggagattccttatgtccatcagaaacctggcggcagcgcaaaagatg

SEQ ID NO: 81253 - DNA, 103 bp, Artificial Sequence
  Synthetic Polynucleotide
taatacgactcactataggggccatgacatttgcagctctgatggatggaaacagaggagatccatcatgcagagctgcaacctggcggcagcgcaaaagatg

SEQ ID NO: 81254 - DNA, 103 bp, Artificial Sequence
  Synthetic Polynucleotide
taatacgactcactatagggaggcagccatgacatttgcagctctgatggaacagaggagaccatcaatgctgcaaatgaacctggcggcagcgcaaaagatg

SEQ ID NO: 81255 - DNA, 103 bp, Artificial Sequence
  Synthetic Polynucleotide
taatacgactcactatagggcaaagaggcagccatgacatttgcagctctaacagaggagaagagctatgaatgtcatgaacctggcggcagcgcaaaagatg

SEQ ID NO: 81256 - DNA, 103 bp, Artificial Sequence
  Synthetic Polynucleotide
taatacgactcactatagggttacgcaaagaggcagccatgacatttgcaaacagaggagatgcaaaatgcatggctgcaacctggcggcagcgcaaaagatg

SEQ ID NO: 81257 - DNA, 103 bp, Artificial Sequence
  Synthetic Polynucleotide
taatacgactcactatagggcagccttacgcaaagaggcagccatgacataacagaggagaatgtcaatgctgcctcttaacctggcggcagcgcaaaagatg

SEQ ID NO: 81258 - DNA, 103 bp, Artificial Sequence
  Synthetic Polynucleotide
taatacgactcactatagggcttggcttccaaaatgtttgttgtgcagttaacagaggagaaactgcatgacaaacattaacctggcggcagcgcaaaagatg

SEQ ID NO: 81259 - DNA, 103 bp, Artificial Sequence
  Synthetic Polynucleotide
taatacgactcactatagggctttccagccttacgcaaagaggcagccataacagaggagaatggctatgtctttgcgtaacctggcggcagcgcaaaagatg

SEQ ID NO: 81260 - DNA, 103 bp, Artificial Sequence
  Synthetic Polynucleotide
taatacgactcactatagggacactctttccagccttacgcaaagaggcaaacagaggagatgcctcatggcgtaaggcaacctggcggcagcgcaaaagatg

SEQ ID NO: 81261 - DNA, 103 bp, Artificial Sequence
  Synthetic Polynucleotide
taatacgactcactatagggccaccacactctttccagccttacgcaaagaacagaggagactttgcatgaggctggaaaacctggcggcagcgcaaaagatg

SEQ ID NO: 81262 - DNA, 103 bp, Artificial Sequence
  Synthetic Polynucleotide
taatacgactcactatagggcaggaccaccacactctttccagccttacgaacagaggagacgtaagatgggaaagagtaacctggcggcagcgcaaaagatg

SEQ ID NO: 81263 - DNA, 103 bp, Artificial Sequence
  Synthetic Polynucleotide
taatacgactcactatagggctgttcaggaccaccacactctttccagccaacagaggagaggctggatggagtgtggtaacctggcggcagcgcaaaagatg

SEQ ID NO: 81264 - DNA, 103 bp, Artificial Sequence
  Synthetic Polynucleotide
taatacgactcactatagggttttcctgttcaggaccaccacactctttcaacagaggagagaaagaatgtggtggtccaacctggcggcagcgcaaaagatg

SEQ ID NO: 81265 - DNA, 103 bp, Artificial Sequence
  Synthetic Polynucleotide
taatacgactcactatagggaaaggttttcctgttcaggaccaccacactaacagaggagaagtgtgatggtcctgaacaacctggcggcagcgcaaaagatg

SEQ ID NO: 81266 - DNA, 103 bp, Artificial Sequence
  Synthetic Polynucleotide
taatacgactcactatagggctctcaaaggttttcctgttcaggaccaccaacagaggagaggtggtatggaacaggaaaacctggcggcagcgcaaaagatg

SEQ ID NO: 81267 - DNA, 103 bp, Artificial Sequence
  Synthetic Polynucleotide
taatacgactcactatagggattctctctcaaaggttttcctgttcaggaaacagaggagatcctgaatgggaaaacctaacctggcggcagcgcaaaagatg

SEQ ID NO: 81268 - DNA, 103 bp, Artificial Sequence
  Synthetic Polynucleotide
taatacgactcactatagggggggtattctctctcaaaggttttcctgttaacagaggagaaacaggatgacctttgagaacctggcggcagcgcaaaagatg

SEQ ID NO: 81269 - DNA, 103 bp, Artificial Sequence
  Synthetic Polynucleotide
taatacgactcactatagggcagtacttggcttccaaaatgtttgttgtgaacagaggagacacaacatgcattttggaaacctggcggcagcgcaaaagatg

SEQ ID NO: 81270 - DNA, 103 bp, Artificial Sequence
  Synthetic Polynucleotide
taatacgactcactatagggatcgtggggtattctctctcaaaggttttcaacagaggagagaaaacatgtgagagagaaacctggcggcagcgcaaaagatg

SEQ ID NO: 81271 - DNA, 103 bp, Artificial Sequence
  Synthetic Polynucleotide
taatacgactcactataggggctttatcgtggggtattctctctcaaaggaacagaggagacctttgatggagaataccaacctggcggcagcgcaaaagatg

SEQ ID NO: 81272 - DNA, 103 bp, Artificial Sequence
  Synthetic Polynucleotide
taatacgactcactatagggcttctgctttatcgtggggtattctctctcaacagaggagagagagaatgtaccccacgaacctggcggcagcgcaaaagatg

SEQ ID NO: 81273 - DNA, 103 bp, Artificial Sequence
  Synthetic Polynucleotide
taatacgactcactatagggggtttcttctgctttatcgtggggtattctaacagaggagaagaataatgcacgataaaaacctggcggcagcgcaaaagatg

SEQ ID NO: 81274 - DNA, 103 bp, Artificial Sequence
  Synthetic Polynucleotide
taatacgactcactatagggagtcaggtttcttctgctttatcgtggggtaacagaggagaaccccaatgtaaagcagaaacctggcggcagcgcaaaagatg

SEQ ID NO: 81275 - DNA, 103 bp, Artificial Sequence
  Synthetic Polynucleotide
taatacgactcactatagggtataaagtcaggtttcttctgctttatcgtaacagaggagaacgataatgcagaagaaaaacctggcggcagcgcaaaagatg

SEQ ID NO: 81276 - DNA, 103 bp, Artificial Sequence
  Synthetic Polynucleotide
taatacgactcactataggggccaatataaagtcaggtttcttctgctttaacagaggagaaaagcaatggaaacctgaaacctggcggcagcgcaaaagatg

SEQ ID NO: 81277 - DNA, 103 bp, Artificial Sequence
  Synthetic Polynucleotide
taatacgactcactatagggcagtggccaatataaagtcaggtttcttctaacagaggagaagaagaatgctgactttaaacctggcggcagcgcaaaagatg

SEQ ID NO: 81278 - DNA, 103 bp, Artificial Sequence
  Synthetic Polynucleotide
taatacgactcactatagggtatgtcagtggccaatataaagtcaggtttaacagaggagaaaacctatgtttatattgaacctggcggcagcgcaaaagatg

SEQ ID NO: 81279 - DNA, 103 bp, Artificial Sequence
  Synthetic Polynucleotide
taatacgactcactatagggtcagctatgtcagtggccaatataaagtcaaacagaggagatgacttatgattggccacaacctggcggcagcgcaaaagatg

SEQ ID NO: 81280 - DNA, 103 bp, Artificial Sequence
  Synthetic Polynucleotide
taatacgactcactatagggggcaccagtacttggcttccaaaatgtttgaacagaggagacaaacaatgtggaagccaaacctggcggcagcgcaaaagatg

SEQ ID NO: 81281 - DNA, 103 bp, Artificial Sequence
  Synthetic Polynucleotide
taatacgactcactatagggccatttcagctatgtcagtggccaatataaaacagaggagattatatatgccactgacaaacctggcggcagcgcaaaagatg

SEQ ID NO: 81282 - DNA, 103 bp, Artificial Sequence
  Synthetic Polynucleotide
taatacgactcactatagggggctcccatttcagctatgtcagtggccaaaacagaggagattggccatggacatagctaacctggcggcagcgcaaaagatg

SEQ ID NO: 81283 - DNA, 103 bp, Artificial Sequence
  Synthetic Polynucleotide
taatacgactcactatagggaggttggctcccatttcagctatgtcagtgaacagaggagacactgaatgagctgaaataacctggcggcagcgcaaaagatg

SEQ ID NO: 81284 - DNA, 103 bp, Artificial Sequence
  Synthetic Polynucleotide
taatacgactcactatagggcgcaaaggttggctcccatttcagctatgtaacagaggagaacatagatgaaatgggagaacctggcggcagcgcaaaagatg

SEQ ID NO: 81285 - DNA, 103 bp, Artificial Sequence
  Synthetic Polynucleotide
taatacgactcactatagggctccacgcaaaggttggctcccatttcagcaacagaggagagctgaaatgggagccaacaacctggcggcagcgcaaaagatg

SEQ ID NO: 81286 - DNA, 103 bp, Artificial Sequence
  Synthetic Polynucleotide
taatacgactcactatagggactcgctccacgcaaaggttggctcccattaacagaggagaaatgggatgcaacctttgaacctggcggcagcgcaaaagatg

SEQ ID NO: 81287 - DNA, 103 bp, Artificial Sequence
  Synthetic Polynucleotide
taatacgactcactatagggccagcactcgctccacgcaaaggttggctcaacagaggagagagccaatgtttgcgtggaacctggcggcagcgcaaaagatg

SEQ ID NO: 81288 - DNA, 103 bp, Artificial Sequence
  Synthetic Polynucleotide
taatacgactcactataggggcaatccagcactcgctccacgcaaaggttaacagaggagaaaccttatggtggagcgaaacctggcggcagcgcaaaagatg

SEQ ID NO: 81289 - DNA, 103 bp, Artificial Sequence
  Synthetic Polynucleotide
taatacgactcactataggggtcctgcaatccagcactcgctccacgcaaaacagaggagattgcgtatggcgagtgctaacctggcggcagcgcaaaagatg

SEQ ID NO: 81290 - DNA, 103 bp, Artificial Sequence
  Synthetic Polynucleotide
taatacgactcactatagggaagccgtcctgcaatccagcactcgctccaaacagaggagatggagcatgtgctggattaacctggcggcagcgcaaaagatg

SEQ ID NO: 81291 - DNA, 103 bp, Artificial Sequence
  Synthetic Polynucleotide
taatacgactcactataggggtctgggcaccagtacttggcttccaaaataacagaggagaattttgatggccaagtacaacctggcggcagcgcaaaagatg

SEQ ID NO: 81292 - DNA, 103 bp, Artificial Sequence
  Synthetic Polynucleotide
taatacgactcactatagggcttaaaagccgtcctgcaatccagcactcgaacagaggagacgagtgatggattgcaggaacctggcggcagcgcaaaagatg

SEQ ID NO: 81293 - DNA, 103 bp, Artificial Sequence
  Synthetic Polynucleotide
taatacgactcactatagggacaggcttaaaagccgtcctgcaatccagcaacagaggagagctggaatgcaggacggcaacctggcggcagcgcaaaagatg

SEQ ID NO: 81294 - DNA, 103 bp, Artificial Sequence
  Synthetic Polynucleotide
taatacgactcactatagggcaagcacaggcttaaaagccgtcctgcaataacagaggagaattgcaatgcggcttttaaacctggcggcagcgcaaaagatg

SEQ ID NO: 81295 - DNA, 103 bp, Artificial Sequence
  Synthetic Polynucleotide
taatacgactcactatagggatccacaagcacaggcttaaaagccgtcctaacagaggagaaggacgatgtttaagcctaacctggcggcagcgcaaaagatg

SEQ ID NO: 81296 - DNA, 103 bp, Artificial Sequence
  Synthetic Polynucleotide
taatacgactcactatagggccttcatccacaagcacaggcttaaaagccaacagaggagaggctttatggcctgtgctaacctggcggcagcgcaaaagatg

SEQ ID NO: 81297 - DNA, 103 bp, Artificial Sequence
  Synthetic Polynucleotide
taatacgactcactatagggtcctcccttcatccacaagcacaggcttaaaacagaggagattaagcatgtgcttgtggaacctggcggcagcgcaaaagatg

SEQ ID NO: 81298 - DNA, 103 bp, Artificial Sequence
  Synthetic Polynucleotide
taatacgactcactatagggcaccttcctcccttcatccacaagcacaggaacagaggagacctgtgatggtggatgaaaacctggcggcagcgcaaaagatg

SEQ ID NO: 81299 - DNA, 103 bp, Artificial Sequence
  Synthetic Polynucleotide
taatacgactcactatagggattgccaccttcctcccttcatccacaagcaacagaggagagcttgtatgtgaagggagaacctggcggcagcgcaaaagatg

SEQ ID NO: 81300 - DNA, 103 bp, Artificial Sequence
  Synthetic Polynucleotide
taatacgactcactatagggcttttattgccaccttcctcccttcatccaaacagaggagatggatgatgggaggaaggaacctggcggcagcgcaaaagatg

SEQ ID NO: 81301 - DNA, 103 bp, Artificial Sequence
  Synthetic Polynucleotide
taatacgactcactatagggtggcccttttattgccaccttcctcccttcaacagaggagagaagggatgaaggtggcaaacctggcggcagcgcaaaagatg

SEQ ID NO: 81302 - DNA, 103 bp, Artificial Sequence
  Synthetic Polynucleotide
taatacgactcactatagggattgagtctgggcaccagtacttggcttccaacagaggagaggaagcatggtactggtgaacctggcggcagcgcaaaagatg

SEQ ID NO: 81303 - DNA, 103 bp, Artificial Sequence
  Synthetic Polynucleotide
taatacgactcactatagggcgaagtggcccttttattgccaccttcctcaacagaggagagaggaaatgggcaataaaaacctggcggcagcgcaaaagatg

SEQ ID NO: 81304 - DNA, 103 bp, Artificial Sequence
  Synthetic Polynucleotide
taatacgactcactatagggagatacgaagtggcccttttattgccacctaacagaggagaaggtggatgtaaaagggcaacctggcggcagcgcaaaagatg

SEQ ID NO: 81305 - DNA, 103 bp, Artificial Sequence
  Synthetic Polynucleotide
taatacgactcactatagggtgcggagatacgaagtggcccttttattgcaacagaggagagcaataatggggccacttaacctggcggcagcgcaaaagatg

SEQ ID NO: 81306 - DNA, 103 bp, Artificial Sequence
  Synthetic Polynucleotide
taatacgactcactataggggaggatgcggagatacgaagtggcccttttaacagaggagaaaaaggatgacttcgtataacctggcggcagcgcaaaagatg

SEQ ID NO: 81307 - DNA, 103 bp, Artificial Sequence
  Synthetic Polynucleotide
taatacgactcactatagggcagcagaggatgcggagatacgaagtggccaacagaggagaggccacatggtatctccgaacctggcggcagcgcaaaagatg

SEQ ID NO: 81308 - DNA, 103 bp, Artificial Sequence
  Synthetic Polynucleotide
taatacgactcactatagggttgagcagcagaggatgcggagatacgaagaacagaggagacttcgtatgtccgcatccaacctggcggcagcgcaaaagatg

SEQ ID NO: 81309 - DNA, 103 bp, Artificial Sequence
  Synthetic Polynucleotide
taatacgactcactatagggctcctttgagcagcagaggatgcggagataaacagaggagatatctcatgatcctctgcaacctggcggcagcgcaaaagatg

SEQ ID NO: 81310 - DNA, 103 bp, Artificial Sequence
  Synthetic Polynucleotide
taatacgactcactataggggccccctcctttgagcagcagaggatgcggaacagaggagaccgcatatgctgctgctcaacctggcggcagcgcaaaagatg

SEQ ID NO: 81311 - DNA, 103 bp, Artificial Sequence
  Synthetic Polynucleotide
taatacgactcactatagggaatgcgccccctcctttgagcagcagaggaaacagaggagatcctctatggctcaaaggaacctggcggcagcgcaaaagatg

SEQ ID NO: 81312 - DNA, 103 bp, Artificial Sequence
  Synthetic Polynucleotide
taatacgactcactatagggctcccaatgcgccccctcctttgagcagcaaacagaggagatgctgcatgaaggaggggaacctggcggcagcgcaaaagatg

SEQ ID NO: 81313 - DNA, 103 bp, Artificial Sequence
  Synthetic Polynucleotide
taatacgactcactatagggattccattgagtctgggcaccagtacttggaacagaggagaccaagtatgggtgcccagaacctggcggcagcgcaaaagatg

SEQ ID NO: 81314 - DNA, 103 bp, Artificial Sequence
  Synthetic Polynucleotide
taatacgactcactataggggatttctcccaatgcgccccctcctttgagaacagaggagactcaaaatggggggcgcaaacctggcggcagcgcaaaagatg

SEQ ID NO: 81315 - DNA, 103 bp, Artificial Sequence
  Synthetic Polynucleotide
taatacgactcactataggggttgggatttctcccaatgcgccccctcctaacagaggagaaggaggatgcgcattgggaacctggcggcagcgcaaaagatg

SEQ ID NO: 81316 - DNA, 103 bp, Artificial Sequence
  Synthetic Polynucleotide
taatacgactcactatagggtctctgttgggatttctcccaatgcgccccaacagaggagaggggcgatgtgggagaaaaacctggcggcagcgcaaaagatg

SEQ ID NO: 81317 - DNA, 103 bp, Artificial Sequence
  Synthetic Polynucleotide
taatacgactcactatagggctccatctctgttgggatttctcccaatgcaacagaggagagcattgatggaaatcccaaacctggcggcagcgcaaaagatg

SEQ ID NO: 81318 - DNA, 103 bp, Artificial Sequence
  Synthetic Polynucleotide
taatacgactcactatagggtgagtctccatctctgttgggatttctcccaacagaggagagggagaatgcccaacagaaacctggcggcagcgcaaaagatg

SEQ ID NO: 81319 - DNA, 103 bp, Artificial Sequence
  Synthetic Polynucleotide
taatacgactcactatagggtagtatgagtctccatctctgttgggatttaacagaggagaaaatccatgcagagatggaacctggcggcagcgcaaaagatg

SEQ ID NO: 81320 - DNA, 103 bp, Artificial Sequence
  Synthetic Polynucleotide
taatacgactcactatagggaatagtagtatgagtctccatctctgttggaacagaggagaccaacaatgatggagactaacctggcggcagcgcaaaagatg

SEQ ID NO: 81321 - DNA, 103 bp, Artificial Sequence
  Synthetic Polynucleotide
taatacgactcactatagggctcagaatagtagtatgagtctccatctctaacagaggagaagagatatggactcatacaacctggcggcagcgcaaaagatg

SEQ ID NO: 81322 - DNA, 103 bp, Artificial Sequence
  Synthetic Polynucleotide
taatacgactcactataggggtaggctcagaatagtagtatgagtctccaaacagaggagatggagaatgatactactaaacctggcggcagcgcaaaagatg

SEQ ID NO: 81323 - DNA, 103 bp, Artificial Sequence
  Synthetic Polynucleotide
taatacgactcactatagggcacttgtaggctcagaatagtagtatgagtaacagaggagaactcatatgactattctgaacctggcggcagcgcaaaagatg

SEQ ID NO: 81324 - DNA, 103 bp, Artificial Sequence
  Synthetic Polynucleotide
taatacgactcactatagggacgattaaaattaatccaaatgtgtttattaacagaggagaaataaaatgatttggattaacctggcggcagcgcaaaagatg

SEQ ID NO: 81325 - DNA, 103 bp, Artificial Sequence
  Synthetic Polynucleotide
taatacgactcactataggggttgtattccattgagtctgggcaccagtaaacagaggagatactggatgccagactcaaacctggcggcagcgcaaaagatg

SEQ ID NO: 81326 - DNA, 103 bp, Artificial Sequence
  Synthetic Polynucleotide
taatacgactcactatagggattttcacttgtaggctcagaatagtagtaaacagaggagatactacatgtctgagcctaacctggcggcagcgcaaaagatg

SEQ ID NO: 81327 - DNA, 103 bp, Artificial Sequence
  Synthetic Polynucleotide
taatacgactcactataggggcattattttcacttgtaggctcagaatagaacagaggagactattcatggcctacaagaacctggcggcagcgcaaaagatg

SEQ ID NO: 81328 - DNA, 103 bp, Artificial Sequence
  Synthetic Polynucleotide
taatacgactcactatagggggtgggcattattttcacttgtaggctcagaacagaggagactgagcatgcaagtgaaaaacctggcggcagcgcaaaagatg

SEQ ID NO: 81329 - DNA, 103 bp, Artificial Sequence
  Synthetic Polynucleotide
taatacgactcactataggggacgtggtgggcattattttcacttgtaggaacagaggagacctacaatggaaaataataacctggcggcagcgcaaaagatg

SEQ ID NO: 81330 - DNA, 103 bp, Artificial Sequence
  Synthetic Polynucleotide
taatacgactcactatagggcagcagacgtggtgggcattattttcacttaacagaggagaaagtgaatgtaatgcccaaacctggcggcagcgcaaaagatg

SEQ ID NO: 81331 - DNA, 103 bp, Artificial Sequence
  Synthetic Polynucleotide
taatacgactcactatagggccaaccagcagacgtggtgggcattattttaacagaggagaaaaataatgcccaccacgaacctggcggcagcgcaaaagatg

SEQ ID NO: 81332 - DNA, 103 bp, Artificial Sequence
  Synthetic Polynucleotide
taatacgactcactatagggggcctccaaccagcagacgtggtgggcattaacagaggagaaatgccatgcacgtctgcaacctggcggcagcgcaaaagatg

SEQ ID NO: 81333 - DNA, 103 bp, Artificial Sequence
  Synthetic Polynucleotide
taatacgactcactatagggattgaggcctccaaccagcagacgtggtggaacagaggagaccaccaatgctgctggttaacctggcggcagcgcaaaagatg

SEQ ID NO: 81334 - DNA, 103 bp, Artificial Sequence
  Synthetic Polynucleotide
taatacgactcactatagggagagcattgaggcctccaaccagcagacgtaacagaggagaacgtctatgggttggaggaacctggcggcagcgcaaaagatg

SEQ ID NO: 81335 - DNA, 103 bp, Artificial Sequence
  Synthetic Polynucleotide
taatacgactcactataggggtccaagagcattgaggcctccaaccagcaaacagaggagatgctggatggaggcctcaaacctggcggcagcgcaaaagatg

SEQ ID NO: 81336 - DNA, 103 bp, Artificial Sequence
  Synthetic Polynucleotide
taatacgactcactatagggggacagttgtattccattgagtctgggcacaacagaggagagtgcccatgctcaatggaaacctggcggcagcgcaaaagatg

SEQ ID NO: 81337 - DNA, 103 bp, Artificial Sequence
  Synthetic Polynucleotide
taatacgactcactatagggatgttgtccaagagcattgaggcctccaacaacagaggagagttggaatgctcaatgctaacctggcggcagcgcaaaagatg

SEQ ID NO: 81338 - DNA, 103 bp, Artificial Sequence
  Synthetic Polynucleotide
taatacgactcactatagggcctccatgttgtccaagagcattgaggcctaacagaggagaaggcctatgtgctcttggaacctggcggcagcgcaaaagatg

SEQ ID NO: 81339 - DNA, 103 bp, Artificial Sequence
  Synthetic Polynucleotide
taatacgactcactatagggcctcacctccatgttgtccaagagcattgaaacagaggagatcaatgatgttggacaacaacctggcggcagcgcaaaagatg

SEQ ID NO: 81340 - DNA, 103 bp, Artificial Sequence
  Synthetic Polynucleotide
taatacgactcactatagggccacccctcacctccatgttgtccaagagcaacagaggagagctcttatgcaacatggaaacctggcggcagcgcaaaagatg

SEQ ID NO: 81341 - DNA, 103 bp, Artificial Sequence
  Synthetic Polynucleotide
taatacgactcactatagggccattccacccctcacctccatgttgtccaaacagaggagatggacaatgtggaggtgaaacctggcggcagcgcaaaagatg

SEQ ID NO: 81342 - DNA, 103 bp, Artificial Sequence
  Synthetic Polynucleotide
taatacgactcactatagggggcgaccattccacccctcacctccatgttaacagaggagaaacatgatggtgaggggtaacctggcggcagcgcaaaagatg

SEQ ID NO: 81343 - DNA, 103 bp, Artificial Sequence
  Synthetic Polynucleotide
taatacgactcactatagggagtggggcgaccattccacccctcacctccaacagaggagaggaggtatggggtggaataacctggcggcagcgcaaaagatg

SEQ ID NO: 81344 - DNA, 103 bp, Artificial Sequence
  Synthetic Polynucleotide
taatacgactcactatagggcatagagtggggcgaccattccacccctcaaacagaggagatgagggatggaatggtcgaacctggcggcagcgcaaaagatg

SEQ ID NO: 81345 - DNA, 103 bp, Artificial Sequence
  Synthetic Polynucleotide
taatacgactcactatagggaacgccatagagtggggcgaccattccaccaacagaggagaggtggaatggtcgccccaaacctggcggcagcgcaaaagatg

SEQ ID NO: 81346 - DNA, 103 bp, Artificial Sequence
  Synthetic Polynucleotide
taatacgactcactatagggccttcaacgccatagagtggggcgaccattaacagaggagaaatggtatgcccactctaaacctggcggcagcgcaaaagatg

SEQ ID NO: 81347 - DNA, 103 bp, Artificial Sequence
  Synthetic Polynucleotide
taatacgactcactataggggattgggacagttgtattccattgagtctgaacagaggagacagactatgtggaatacaaacctggcggcagcgcaaaagatg

SEQ ID NO: 81348 - DNA, 103 bp, Artificial Sequence
  Synthetic Polynucleotide
taatacgactcactatagggtagttccttcaacgccatagagtggggcgaaacagaggagatcgcccatgtctatggcgaacctggcggcagcgcaaaagatg

SEQ ID NO: 81349 - DNA, 103 bp, Artificial Sequence
  Synthetic Polynucleotide
taatacgactcactatagggtgttttagttccttcaacgccatagagtggaacagaggagaccactcatgggcgttgaaaacctggcggcagcgcaaaagatg

SEQ ID NO: 81350 - DNA, 103 bp, Artificial Sequence
  Synthetic Polynucleotide
taatacgactcactatagggactggtgttttagttccttcaacgccatagaacagaggagactatggatgtgaaggaacaacctggcggcagcgcaaaagatg

SEQ ID NO: 81351 - DNA, 103 bp, Artificial Sequence
  Synthetic Polynucleotide
taatacgactcactataggggggaaactggtgttttagttccttcaacgcaacagaggagagcgttgatggaactaaaaaacctggcggcagcgcaaaagatg

SEQ ID NO: 81352 - DNA, 103 bp, Artificial Sequence
  Synthetic Polynucleotide
taatacgactcactatagggaccaggggaaactggtgttttagttccttcaacagaggagagaaggaatgaaaacaccaaacctggcggcagcgcaaaagatg

SEQ ID NO: 81353 - DNA, 103 bp, Artificial Sequence
  Synthetic Polynucleotide
taatacgactcactatagggatttcaccaggggaaactggtgttttagttaacagaggagaaactaaatgaccagtttcaacctggcggcagcgcaaaagatg

SEQ ID NO: 81354 - DNA, 103 bp, Artificial Sequence
  Synthetic Polynucleotide
taatacgactcactataggggtctcatttcaccaggggaaactggtgtttaacagaggagaaaacacatgtttcccctgaacctggcggcagcgcaaaagatg

SEQ ID NO: 81355 - DNA, 103 bp, Artificial Sequence
  Synthetic Polynucleotide
taatacgactcactatagggcctcagtctcatttcaccaggggaaactggaacagaggagaccagttatgcctggtgaaaacctggcggcagcgcaaaagatg

SEQ ID NO: 81356 - DNA, 103 bp, Artificial Sequence
  Synthetic Polynucleotide
taatacgactcactatagggtcatccctcagtctcatttcaccaggggaaaacagaggagattccccatgtgaaatgagaacctggcggcagcgcaaaagatg

SEQ ID NO: 81357 - DNA, 103 bp, Artificial Sequence
  Synthetic Polynucleotide
taatacgactcactatagggtctggtcatccctcagtctcatttcaccagaacagaggagactggtgatgtgagactgaaacctggcggcagcgcaaaagatg

SEQ ID NO: 81358 - DNA, 103 bp, Artificial Sequence
  Synthetic Polynucleotide
taatacgactcactatagggactgagattgggacagttgtattccattgaaacagaggagatcaatgatgtacaactgtaacctggcggcagcgcaaaagatg

SEQ ID NO: 81359 - DNA, 103 bp, Artificial Sequence
  Synthetic Polynucleotide
taatacgactcactatagggtttcctctggtcatccctcagtctcatttcaacagaggagagaaatgatgctgagggataacctggcggcagcgcaaaagatg

SEQ ID NO: 81360 - DNA, 103 bp, Artificial Sequence
  Synthetic Polynucleotide
taatacgactcactatagggaagactttcctctggtcatccctcagtctcaacagaggagagagactatgggatgaccaaacctggcggcagcgcaaaagatg

SEQ ID NO: 81361 - DNA, 103 bp, Artificial Sequence
  Synthetic Polynucleotide
taatacgactcactatagggctctgaagactttcctctggtcatccctcaaacagaggagatgagggatgaccagaggaaacctggcggcagcgcaaaagatg

SEQ ID NO: 81362 - DNA, 103 bp, Artificial Sequence
  Synthetic Polynucleotide
taatacgactcactatagggtagttctctgaagactttcctctggtcatcaacagaggagagatgacatgaggaaagtcaacctggcggcagcgcaaaagatg

SEQ ID NO: 81363 - DNA, 103 bp, Artificial Sequence
  Synthetic Polynucleotide
taatacgactcactatagggctcactagttctctgaagactttcctctggaacagaggagaccagagatgagtcttcagaacctggcggcagcgcaaaagatg

SEQ ID NO: 81364 - DNA, 103 bp, Artificial Sequence
  Synthetic Polynucleotide
taatacgactcactatagggaattcctcactagttctctgaagactttccaacagaggagaggaaagatgtcagagaacaacctggcggcagcgcaaaagatg

SEQ ID NO: 81365 - DNA, 103 bp, Artificial Sequence
  Synthetic Polynucleotide
taatacgactcactataggggtcacaattcctcactagttctctgaagacaacagaggagagtcttcatggaactagtgaacctggcggcagcgcaaaagatg

SEQ ID NO: 81366 - DNA, 103 bp, Artificial Sequence
  Synthetic Polynucleotide
taatacgactcactatagggggcaggtcacaattcctcactagttctctgaacagaggagacagagaatgagtgaggaaaacctggcggcagcgcaaaagatg

SEQ ID NO: 81367 - DNA, 103 bp, Artificial Sequence
  Synthetic Polynucleotide
taatacgactcactatagggaaacgggcaggtcacaattcctcactagttaacagaggagaaactagatgggaattgtgaacctggcggcagcgcaaaagatg

SEQ ID NO: 81368 - DNA, 103 bp, Artificial Sequence
  Synthetic Polynucleotide
taatacgactcactatagggaagccaaacgggcaggtcacaattcctcacaacagaggagagtgaggatgtgtgacctgaacctggcggcagcgcaaaagatg

SEQ ID NO: 81369 - DNA, 103 bp, Artificial Sequence
  Synthetic Polynucleotide
taatacgactcactatagggcttggactgagattgggacagttgtattccaacagaggagaggaataatgctgtcccaaaacctggcggcagcgcaaaagatg

SEQ ID NO: 81370 - DNA, 103 bp, Artificial Sequence
  Synthetic Polynucleotide
taatacgactcactatagggcacgaaagccaaacgggcaggtcacaattcaacagaggagagaattgatgcctgcccgtaacctggcggcagcgcaaaagatg

SEQ ID NO: 81371 - DNA, 103 bp, Artificial Sequence
  Synthetic Polynucleotide
taatacgactcactatagggcttgccacgaaagccaaacgggcaggtcacaacagaggagagtgaccatgccgtttggcaacctggcggcagcgcaaaagatg

SEQ ID NO: 81372 - DNA, 103 bp, Artificial Sequence
  Synthetic Polynucleotide
taatacgactcactatagggggccacttgccacgaaagccaaacgggcagaacagaggagactgcccatgtggctttcgaacctggcggcagcgcaaaagatg

SEQ ID NO: 81373 - DNA, 103 bp, Artificial Sequence
  Synthetic Polynucleotide
taatacgactcactataggggccttggccacttgccacgaaagccaaacgaacagaggagacgtttgatgttcgtggcaaacctggcggcagcgcaaaagatg

SEQ ID NO: 81374 - DNA, 103 bp, Artificial Sequence
  Synthetic Polynucleotide
taatacgactcactatagggaaccagccttggccacttgccacgaaagccaacagaggagaggctttatgggcaagtggaacctggcggcagcgcaaaagatg

SEQ ID NO: 81375 - DNA, 103 bp, Artificial Sequence
  Synthetic Polynucleotide
taatacgactcactatagggcttcaaaccagccttggccacttgccacgaaacagaggagatcgtggatggtggccaagaacctggcggcagcgcaaaagatg

SEQ ID NO: 81376 - DNA, 103 bp, Artificial Sequence
  Synthetic Polynucleotide
taatacgactcactatagggttcgtcttcaaaccagccttggccacttgcaacagaggagagcaagtatgcaaggctggaacctggcggcagcgcaaaagatg

SEQ ID NO: 81377 - DNA, 103 bp, Artificial Sequence
  Synthetic Polynucleotide
taatacgactcactataggggatcattcgtcttcaaaccagccttggccaaacagaggagatggccaatgctggtttgaaacctggcggcagcgcaaaagatg

SEQ ID NO: 81378 - DNA, 103 bp, Artificial Sequence
  Synthetic Polynucleotide
taatacgactcactatagggcttacgatcattcgtcttcaaaccagccttaacagaggagaaaggctatgttgaagacgaacctggcggcagcgcaaaagatg

SEQ ID NO: 81379 - DNA, 103 bp, Artificial Sequence
  Synthetic Polynucleotide
taatacgactcactatagggcaccacttacgatcattcgtcttcaaaccaaacagaggagatggtttatggacgaatgaaacctggcggcagcgcaaaagatg

SEQ ID NO: 81380 - DNA, 103 bp, Artificial Sequence
  Synthetic Polynucleotide
taatacgactcactatagggcctctcttggactgagattgggacagttgtaacagaggagaacaactatgccaatctcaaacctggcggcagcgcaaaagatg

SEQ ID NO: 81381 - DNA, 103 bp, Artificial Sequence
  Synthetic Polynucleotide
taatacgactcactatagggcaaaacaccacttacgatcattcgtcttcaaacagaggagatgaagaatgatgatcgtaaacctggcggcagcgcaaaagatg

SEQ ID NO: 81382 - DNA, 103 bp, Artificial Sequence
  Synthetic Polynucleotide
taatacgactcactataggggccttcaaaacaccacttacgatcattcgtaacagaggagaacgaatatgcgtaagtggaacctggcggcagcgcaaaagatg

SEQ ID NO: 81383 - DNA, 103 bp, Artificial Sequence
  Synthetic Polynucleotide
taatacgactcactatagggtcagggccttcaaaacaccacttacgatcaaacagaggagatgatcgatggtggtgtttaacctggcggcagcgcaaaagatg

SEQ ID NO: 81384 - DNA, 103 bp, Artificial Sequence
  Synthetic Polynucleotide
taatacgactcactataggggttcctcagggccttcaaaacaccacttacaacagaggagagtaagtatggttttgaagaacctggcggcagcgcaaaagatg

SEQ ID NO: 81385 - DNA, 103 bp, Artificial Sequence
  Synthetic Polynucleotide
taatacgactcactatagggctcatgttcctcagggccttcaaaacaccaaacagaggagatggtgtatggaaggccctaacctggcggcagcgcaaaagatg

SEQ ID NO: 81386 - DNA, 103 bp, Artificial Sequence
  Synthetic Polynucleotide
taatacgactcactatagggaagatctcatgttcctcagggccttcaaaaaacagaggagattttgaatgccctgaggaaacctggcggcagcgcaaaagatg

SEQ ID NO: 81387 - DNA, 103 bp, Artificial Sequence
  Synthetic Polynucleotide
taatacgactcactatagggcattcaagatctcatgttcctcagggccttaacagaggagaaaggccatgaggaacatgaacctggcggcagcgcaaaagatg

SEQ ID NO: 81388 - DNA, 103 bp, Artificial Sequence
  Synthetic Polynucleotide
taatacgactcactataggggctgtcattcaagatctcatgttcctcaggaacagaggagacctgagatgcatgagatcaacctggcggcagcgcaaaagatg

SEQ ID NO: 81389 - DNA, 103 bp, Artificial Sequence
  Synthetic Polynucleotide
taatacgactcactatagggtcaccgctgtcattcaagatctcatgttccaacagaggagaggaacaatggatcttgaaaacctggcggcagcgcaaaagatg

SEQ ID NO: 81390 - DNA, 103 bp, Artificial Sequence
  Synthetic Polynucleotide
taatacgactcactatagggctgtttcaccgctgtcattcaagatctcataacagaggagaatgagaatgtgaatgacaaacctggcggcagcgcaaaagatg

SEQ ID NO: 81391 - DNA, 103 bp, Artificial Sequence
  Synthetic Polynucleotide
taatacgactcactatagggtggctcctctcttggactgagattgggacaaacagaggagatgtcccatgctcagtccaaacctggcggcagcgcaaaagatg

SEQ ID NO: 81392 - DNA, 103 bp, Artificial Sequence
  Synthetic Polynucleotide
taatacgactcactatagggcttcactgtttcaccgctgtcattcaagataacagaggagaatcttgatggacagcggtaacctggcggcagcgcaaaagatg

SEQ ID NO: 81393 - DNA, 103 bp, Artificial Sequence
  Synthetic Polynucleotide
taatacgactcactatagggctgcacttcactgtttcaccgctgtcattcaacagaggagagaatgaatgcggtgaaacaacctggcggcagcgcaaaagatg

SEQ ID NO: 81394 - DNA, 103 bp, Artificial Sequence
  Synthetic Polynucleotide
taatacgactcactataggggagccctgcacttcactgtttcaccgctgtaacagaggagaacagcgatgaaacagtgaaacctggcggcagcgcaaaagatg

SEQ ID NO: 81395 - DNA, 103 bp, Artificial Sequence
  Synthetic Polynucleotide
taatacgactcactatagggtccaggagccctgcacttcactgtttcaccaacagaggagaggtgaaatggtgaagtgcaacctggcggcagcgcaaaagatg

SEQ ID NO: 81396 - DNA, 103 bp, Artificial Sequence
  Synthetic Polynucleotide
taatacgactcactataggggctcctccaggagccctgcacttcactgttaacagaggagaaacagtatggtgcagggcaacctggcggcagcgcaaaagatg

SEQ ID NO: 81397 - DNA, 103 bp, Artificial Sequence
  Synthetic Polynucleotide
taatacgactcactatagggtctttgctcctccaggagccctgcacttcaaacagaggagatgaagtatggggctcctgaacctggcggcagcgcaaaagatg

SEQ ID NO: 81398 - DNA, 103 bp, Artificial Sequence
  Synthetic Polynucleotide
taatacgactcactatagggaggcttctttgctcctccaggagccctgcaaacagaggagatgcaggatgcctggaggaaacctggcggcagcgcaaaagatg

SEQ ID NO: 81399 - DNA, 103 bp, Artificial Sequence
  Synthetic Polynucleotide
taatacgactcactatagggcgcagaggcttctttgctcctccaggagccaacagaggagaggctccatgaggagcaaaaacctggcggcagcgcaaaagatg

SEQ ID NO: 81400 - DNA, 103 bp, Artificial Sequence
  Synthetic Polynucleotide
taatacgactcactatagggttgggcgcagaggcttctttgctcctccagaacagaggagactggagatgcaaagaagcaacctggcggcagcgcaaaagatg

SEQ ID NO: 81401 - DNA, 103 bp, Artificial Sequence
  Synthetic Polynucleotide
taatacgactcactatagggccaccttgggcgcagaggcttctttgctccaacagaggagaggagcaatgaagcctctgaacctggcggcagcgcaaaagatg

SEQ ID NO: 81402 - DNA, 103 bp, Artificial Sequence
  Synthetic Polynucleotide
taatacgactcactatagggtcatctggctcctctcttggactgagattgaacagaggagacaatctatgtccaagagaaacctggcggcagcgcaaaagatg

SEQ ID NO: 81403 - DNA, 103 bp, Artificial Sequence
  Synthetic Polynucleotide
taatacgactcactatagggtcacaccaccttgggcgcagaggcttctttaacagaggagaaaagaaatgtctgcgcccaacctggcggcagcgcaaaagatg

SEQ ID NO: 81404 - DNA, 103 bp, Artificial Sequence
  Synthetic Polynucleotide
taatacgactcactatagggtttcatcacaccaccttgggcgcagaggctaacagaggagaagcctcatggcccaaggtaacctggcggcagcgcaaaagatg

SEQ ID NO: 81405 - DNA, 103 bp, Artificial Sequence
  Synthetic Polynucleotide
taatacgactcactatagggcaccctttcatcacaccaccttgggcgcagaacagaggagactgcgcatgaggtggtgtaacctggcggcagcgcaaaagatg

SEQ ID NO: 81406 - DNA, 103 bp, Artificial Sequence
  Synthetic Polynucleotide
taatacgactcactataggggatgacaccctttcatcacaccaccttgggaacagaggagacccaagatggtgtgatgaaacctggcggcagcgcaaaagatg

SEQ ID NO: 81407 - DNA, 103 bp, Artificial Sequence
  Synthetic Polynucleotide
taatacgactcactatagggggtcagatgacaccctttcatcacaccaccaacagaggagaggtggtatgatgaaagggaacctggcggcagcgcaaaagatg

SEQ ID NO: 81408 - DNA, 103 bp, Artificial Sequence
  Synthetic Polynucleotide
taatacgactcactatagggactctggtcagatgacaccctttcatcacaaacagaggagatgtgatatgagggtgtcaaacctggcggcagcgcaaaagatg

SEQ ID NO: 81409 - DNA, 103 bp, Artificial Sequence
  Synthetic Polynucleotide
taatacgactcactatagggagcgcactctggtcagatgacaccctttcaaacagaggagatgaaagatggtcatctgaaacctggcggcagcgcaaaagatg

SEQ ID NO: 81410 - DNA, 103 bp, Artificial Sequence
  Synthetic Polynucleotide
taatacgactcactatagggcagacagcgcactctggtcagatgacacccaacagaggagagggtgtatgctgaccagaaacctggcggcagcgcaaaagatg

SEQ ID NO: 81411 - DNA, 103 bp, Artificial Sequence
  Synthetic Polynucleotide
taatacgactcactatagggaaattcagacagcgcactctggtcagatgaaacagaggagatcatctatgcagagtgcgaacctggcggcagcgcaaaagatg

SEQ ID NO: 81412 - DNA, 103 bp, Artificial Sequence
  Synthetic Polynucleotide
taatacgactcactatagggttaataaattcagacagcgcactctggtcaaacagaggagatgaccaatgtgcgctgtcaacctggcggcagcgcaaaagatg

SEQ ID NO: 81413 - DNA, 103 bp, Artificial Sequence
  Synthetic Polynucleotide
taatacgactcactatagggcaatgtcatctggctcctctcttggactgaaacagaggagatcagtcatggagaggagcaacctggcggcagcgcaaaagatg

SEQ ID NO: 81414 - DNA, 103 bp, Artificial Sequence
  Synthetic Polynucleotide
taatacgactcactatagggcaaacttaataaattcagacagcgcactctaacagaggagaagagtgatgtgtctgaataacctggcggcagcgcaaaagatg

SEQ ID NO: 81415 - DNA, 103 bp, Artificial Sequence
  Synthetic Polynucleotide
taatacgactcactatagggttcagcaaacttaataaattcagacagcgcaacagaggagagcgctgatggaatttattaacctggcggcagcgcaaaagatg

SEQ ID NO: 81416 - DNA, 103 bp, Artificial Sequence
  Synthetic Polynucleotide
taatacgactcactatagggctaccttcagcaaacttaataaattcagacaacagaggagagtctgaatgtattaagttaacctggcggcagcgcaaaagatg

SEQ ID NO: 81417 - DNA, 103 bp, Artificial Sequence
  Synthetic Polynucleotide
taatacgactcactatagggccctcctaccttcagcaaacttaataaattaacagaggagaaatttaatgagtttgctgaacctggcggcagcgcaaaagatg

SEQ ID NO: 81418 - DNA, 103 bp, Artificial Sequence
  Synthetic Polynucleotide
taatacgactcactatagggagctcccctcctaccttcagcaaacttaataacagaggagaattaagatggctgaaggtaacctggcggcagcgcaaaagatg

SEQ ID NO: 81419 - DNA, 103 bp, Artificial Sequence
  Synthetic Polynucleotide
taatacgactcactatagggtcagcagctcccctcctaccttcagcaaacaacagaggagagtttgcatgaggtaggagaacctggcggcagcgcaaaagatg

SEQ ID NO: 81420 - DNA, 103 bp, Artificial Sequence
  Synthetic Polynucleotide
taatacgactcactataggggcacttcagcagctcccctcctaccttcagaacagaggagactgaagatgggaggggagaacctggcggcagcgcaaaagatg

SEQ ID NO: 81421 - DNA, 103 bp, Artificial Sequence
  Synthetic Polynucleotide
taatacgactcactatagggaactagcacttcagcagctcccctcctaccaacagaggagaggtaggatgggagctgctaacctggcggcagcgcaaaagatg

SEQ ID NO: 81422 - DNA, 103 bp, Artificial Sequence
  Synthetic Polynucleotide
taatacgactcactatagggagcacaactagcacttcagcagctcccctcaacagaggagagaggggatgtgctgaagtaacctggcggcagcgcaaaagatg

SEQ ID NO: 81423 - DNA, 103 bp, Artificial Sequence
  Synthetic Polynucleotide
taatacgactcactatagggcactcagcacaactagcacttcagcagctcaacagaggagagagctgatgaagtgctagaacctggcggcagcgcaaaagatg

SEQ ID NO: 81424 - DNA, 103 bp, Artificial Sequence
  Synthetic Polynucleotide
taatacgactcactataggggcaatcaatgtcatctggctcctctcttggaacagaggagaccaagaatggagccagataacctggcggcagcgcaaaagatg

SEQ ID NO: 81425 - DNA, 103 bp, Artificial Sequence
  Synthetic Polynucleotide
taatacgactcactataggggagttcactcagcacaactagcacttcagcaacagaggagagctgaaatgctagttgtgaacctggcggcagcgcaaaagatg

SEQ ID NO: 81426 - DNA, 103 bp, Artificial Sequence
  Synthetic Polynucleotide
taatacgactcactatagggtcagggagttcactcagcacaactagcactaacagaggagaagtgctatgtgtgctgagaacctggcggcagcgcaaaagatg

SEQ ID NO: 81427 - DNA, 103 bp, Artificial Sequence
  Synthetic Polynucleotide
taatacgactcactatagggggaaatcagggagttcactcagcacaactaaacagaggagatagttgatgtgagtgaacaacctggcggcagcgcaaaagatg

SEQ ID NO: 81428 - DNA, 103 bp, Artificial Sequence
  Synthetic Polynucleotide
taatacgactcactatagggagccaggaaatcagggagttcactcagcacaacagaggagagtgctgatggaactccctaacctggcggcagcgcaaaagatg

SEQ ID NO: 81429 - DNA, 103 bp, Artificial Sequence
  Synthetic Polynucleotide
taatacgactcactatagggtttttagccaggaaatcagggagttcactcaacagaggagagagtgaatgccctgatttaacctggcggcagcgcaaaagatg

SEQ ID NO: 81430 - DNA, 103 bp, Artificial Sequence
  Synthetic Polynucleotide
taatacgactcactatagggcaccttttttagccaggaaatcagggagttaacagaggagaaactccatgatttcctggaacctggcggcagcgcaaaagatg

SEQ ID NO: 81431 - DNA, 103 bp, Artificial Sequence
  Synthetic Polynucleotide
taatacgactcactatagggctctccaccttttttagccaggaaatcaggaacagaggagacctgatatgctggctaaaaacctggcggcagcgcaaaagatg

SEQ ID NO: 81432 - DNA, 103 bp, Artificial Sequence
  Synthetic Polynucleotide
taatacgactcactatagggattgcctctccaccttttttagccaggaaaaacagaggagatttcctatgtaaaaaaggaacctggcggcagcgcaaaagatg

SEQ ID NO: 81433 - DNA, 103 bp, Artificial Sequence
  Synthetic Polynucleotide
taatacgactcactatagggtatccattgcctctccaccttttttagccaaacagaggagatggctaatgaaggtggagaacctggcggcagcgcaaaagatg

SEQ ID NO: 81434 - DNA, 103 bp, Artificial Sequence
  Synthetic Polynucleotide
taatacgactcactataggggatggtatccattgcctctccaccttttttaacagaggagaaaaaaaatgggagaggcaaacctggcggcagcgcaaaagatg

SEQ ID NO: 81435 - DNA, 103 bp, Artificial Sequence
  Synthetic Polynucleotide
taatacgactcactatagggaacgaacgattaaaattaatccaaatgtgtaacagaggagaacacatatggattaatttaacctggcggcagcgcaaaagatg

SEQ ID NO: 81436 - DNA, 103 bp, Artificial Sequence
  Synthetic Polynucleotide
taatacgactcactatagggcaccagcaatcaatgtcatctggctcctctaacagaggagaagaggaatgagatgacataacctggcggcagcgcaaaagatg

SEQ ID NO: 81437 - DNA, 103 bp, Artificial Sequence
  Synthetic Polynucleotide
taatacgactcactatagggacactgatggtatccattgcctctccacctaacagaggagaaggtggatgggcaatggaaacctggcggcagcgcaaaagatg

SEQ ID NO: 81438 - DNA, 103 bp, Artificial Sequence
  Synthetic Polynucleotide
taatacgactcactatagggggaacacactgatggtatccattgcctctcaacagaggagagagaggatgtggataccaaacctggcggcagcgcaaaagatg

SEQ ID NO: 81439 - DNA, 103 bp, Artificial Sequence
  Synthetic Polynucleotide
taatacgactcactataggggtggaggaacacactgatggtatccattgcaacagaggagagcaatgatgaccatcagtaacctggcggcagcgcaaaagatg

SEQ ID NO: 81440 - DNA, 103 bp, Artificial Sequence
  Synthetic Polynucleotide
taatacgactcactatagggtcagagtggaggaacacactgatggtatccaacagaggagaggatacatgcagtgtgttaacctggcggcagcgcaaaagatg

SEQ ID NO: 81441 - DNA, 103 bp, Artificial Sequence
  Synthetic Polynucleotide
taatacgactcactatagggcttcctcagagtggaggaacacactgatggaacagaggagaccatcaatgtgttcctccaacctggcggcagcgcaaaagatg

SEQ ID NO: 81442 - DNA, 103 bp, Artificial Sequence
  Synthetic Polynucleotide
taatacgactcactatagggagagccttcctcagagtggaggaacacactaacagaggagaagtgtgatgctccactctaacctggcggcagcgcaaaagatg

SEQ ID NO: 81443 - DNA, 103 bp, Artificial Sequence
  Synthetic Polynucleotide
taatacgactcactataggggccctagagccttcctcagagtggaggaacaacagaggagagttcctatgctctgaggaaacctggcggcagcgcaaaagatg

SEQ ID NO: 81444 - DNA, 103 bp, Artificial Sequence
  Synthetic Polynucleotide
taatacgactcactatagggggtaagccctagagccttcctcagagtggaaacagaggagatccactatgaggaaggctaacctggcggcagcgcaaaagatg

SEQ ID NO: 81445 - DNA, 103 bp, Artificial Sequence
  Synthetic Polynucleotide
taatacgactcactatagggattgcggtaagccctagagccttcctcagaaacagaggagatctgagatgggctctaggaacctggcggcagcgcaaaagatg

SEQ ID NO: 81446 - DNA, 103 bp, Artificial Sequence
  Synthetic Polynucleotide
taatacgactcactatagggagtgcattgcggtaagccctagagccttccaacagaggagaggaaggatgtagggcttaaacctggcggcagcgcaaaagatg

SEQ ID NO: 81447 - DNA, 103 bp, Artificial Sequence
  Synthetic Polynucleotide
taatacgactcactatagggcatagcaccagcaatcaatgtcatctggctaacagaggagaagccagatgacattgattaacctggcggcagcgcaaaagatg

SEQ ID NO: 81448 - DNA, 103 bp, Artificial Sequence
  Synthetic Polynucleotide
taatacgactcactatagggttgatagtgcattgcggtaagccctagagcaacagaggagagctctaatgcttaccgcaaacctggcggcagcgcaaaagatg

SEQ ID NO: 81449 - DNA, 103 bp, Artificial Sequence
  Synthetic Polynucleotide
taatacgactcactatagggcatcattgatagtgcattgcggtaagccctaacagaggagaagggctatgcgcaatgcaaacctggcggcagcgcaaaagatg

SEQ ID NO: 81450 - DNA, 103 bp, Artificial Sequence
  Synthetic Polynucleotide
taatacgactcactatagggtcaggcatcattgatagtgcattgcggtaaaacagaggagattaccgatgtgcactatcaacctggcggcagcgcaaaagatg

SEQ ID NO: 81451 - DNA, 103 bp, Artificial Sequence
  Synthetic Polynucleotide
taatacgactcactatagggttgcctcaggcatcattgatagtgcattgcaacagaggagagcaatgatgtatcaatgaaacctggcggcagcgcaaaagatg

SEQ ID NO: 81452 - DNA, 103 bp, Artificial Sequence
  Synthetic Polynucleotide
taatacgactcactatagggtgtcattgcctcaggcatcattgatagtgcaacagaggagagcactaatgatgatgcctaacctggcggcagcgcaaaagatg

SEQ ID NO: 81453 - DNA, 103 bp, Artificial Sequence
  Synthetic Polynucleotide
taatacgactcactatagggactattgtcattgcctcaggcatcattgataacagaggagaatcaatatggcctgaggcaacctggcggcagcgcaaaagatg

SEQ ID NO: 81454 - DNA, 103 bp, Artificial Sequence
  Synthetic Polynucleotide
taatacgactcactataggggcatgactattgtcattgcctcaggcatcaaacagaggagatgatgcatgaggcaatgaaacctggcggcagcgcaaaagatg

SEQ ID NO: 81455 - DNA, 103 bp, Artificial Sequence
  Synthetic Polynucleotide
taatacgactcactatagggaaacagcatgactattgtcattgcctcaggaacagaggagacctgagatgatgacaataaacctggcggcagcgcaaaagatg

SEQ ID NO: 81456 - DNA, 103 bp, Artificial Sequence
  Synthetic Polynucleotide
taatacgactcactatagggagtataaacagcatgactattgtcattgccaacagaggagaggcaatatgaatagtcataacctggcggcagcgcaaaagatg

SEQ ID NO: 81457 - DNA, 103 bp, Artificial Sequence
  Synthetic Polynucleotide
taatacgactcactatagggcagccagtataaacagcatgactattgtcaaacagaggagatgacaaatgtcatgctgtaacctggcggcagcgcaaaagatg

SEQ ID NO: 81458 - DNA, 103 bp, Artificial Sequence
  Synthetic Polynucleotide
taatacgactcactatagggcaccccatagcaccagcaatcaatgtcatcaacagaggagagatgacatggattgctggaacctggcggcagcgcaaaagatg

SEQ ID NO: 81459 - DNA, 103 bp, Artificial Sequence
  Synthetic Polynucleotide
taatacgactcactatagggtagtccagccagtataaacagcatgactataacagaggagaatagtcatgctgtttataaacctggcggcagcgcaaaagatg

SEQ ID NO: 81460 - DNA, 103 bp, Artificial Sequence
  Synthetic Polynucleotide
taatacgactcactataggggtcagtagtccagccagtataaacagcatgaacagaggagacatgctatgtatactggcaacctggcggcagcgcaaaagatg

SEQ ID NO: 81461 - DNA, 103 bp, Artificial Sequence
  Synthetic Polynucleotide
taatacgactcactatagggccgatgtcagtagtccagccagtataaacaaacagaggagatgtttaatgtggctggacaacctggcggcagcgcaaaagatg

SEQ ID NO: 81462 - DNA, 103 bp, Artificial Sequence
  Synthetic Polynucleotide
taatacgactcactatagggcattcccgatgtcagtagtccagccagtataacagaggagaatactgatgggactactgaacctggcggcagcgcaaaagatg

SEQ ID NO: 81463 - DNA, 103 bp, Artificial Sequence
  Synthetic Polynucleotide
taatacgactcactatagggatgaccattcccgatgtcagtagtccagccaacagaggagaggctggatgactgacatcaacctggcggcagcgcaaaagatg

SEQ ID NO: 81464 - DNA, 103 bp, Artificial Sequence
  Synthetic Polynucleotide
taatacgactcactatagggaaaagatgaccattcccgatgtcagtagtcaacagaggagagactacatgcatcgggaaaacctggcggcagcgcaaaagatg

SEQ ID NO: 81465 - DNA, 103 bp, Artificial Sequence
  Synthetic Polynucleotide
taatacgactcactatagggcatgaaaaagatgaccattcccgatgtcagaacagaggagactgacaatgggaatggtcaacctggcggcagcgcaaaagatg

SEQ ID NO: 81466 - DNA, 103 bp, Artificial Sequence
  Synthetic Polynucleotide
taatacgactcactatagggggagacatgaaaaagatgaccattcccgataacagaggagaatcgggatgggtcatcttaacctggcggcagcgcaaaagatg

SEQ ID NO: 81467 - DNA, 103 bp, Artificial Sequence
  Synthetic Polynucleotide
taatacgactcactatagggctttgggagacatgaaaaagatgaccattcaacagaggagagaatggatgtctttttcaaacctggcggcagcgcaaaagatg

SEQ ID NO: 81468 - DNA, 103 bp, Artificial Sequence
  Synthetic Polynucleotide
taatacgactcactataggggatgcctttgggagacatgaaaaagatgacaacagaggagagtcatcatgttcatgtctaacctggcggcagcgcaaaagatg

SEQ ID NO: 81469 - DNA, 103 bp, Artificial Sequence
  Synthetic Polynucleotide
taatacgactcactatagggttttccaccccatagcaccagcaatcaatgaacagaggagacattgaatgctggtgctaaacctggcggcagcgcaaaagatg

SEQ ID NO: 81470 - DNA, 103 bp, Artificial Sequence
  Synthetic Polynucleotide
taatacgactcactatagggctactgatgcctttgggagacatgaaaaagaacagaggagactttttatggtctcccaaaacctggcggcagcgcaaaagatg

SEQ ID NO: 81471 - DNA, 103 bp, Artificial Sequence
  Synthetic Polynucleotide
taatacgactcactatagggacattctactgatgcctttgggagacatgaaacagaggagatcatgtatgccaaaggcaaacctggcggcagcgcaaaagatg

SEQ ID NO: 81472 - DNA, 103 bp, Artificial Sequence
  Synthetic Polynucleotide
taatacgactcactatagggcatagacattctactgatgcctttgggagaaacagaggagatctcccatgggcatcagtaacctggcggcagcgcaaaagatg

SEQ ID NO: 81473 - DNA, 103 bp, Artificial Sequence
  Synthetic Polynucleotide
taatacgactcactatagggatcgccatagacattctactgatgcctttgaacagaggagacaaaggatgcagtagaataacctggcggcagcgcaaaagatg

SEQ ID NO: 81474 - DNA, 103 bp, Artificial Sequence
  Synthetic Polynucleotide
taatacgactcactatagggtgcccatcgccatagacattctactgatgcaacagaggagagcatcaatggaatgtctaaacctggcggcagcgcaaaagatg

SEQ ID NO: 81475 - DNA, 103 bp, Artificial Sequence
  Synthetic Polynucleotide
taatacgactcactatagggcattgtgcccatcgccatagacattctactaacagaggagaagtagaatgtctatggcgaacctggcggcagcgcaaaagatg

SEQ ID NO: 81476 - DNA, 103 bp, Artificial Sequence
  Synthetic Polynucleotide
taatacgactcactatagggccggccattgtgcccatcgccatagacattaacagaggagaaatgtcatgggcgatgggaacctggcggcagcgcaaaagatg

SEQ ID NO: 81477 - DNA, 103 bp, Artificial Sequence
  Synthetic Polynucleotide
taatacgactcactatagggcacagccggccattgtgcccatcgccatagaacagaggagactatggatgtgggcacaaaacctggcggcagcgcaaaagatg

SEQ ID NO: 81478 - DNA, 103 bp, Artificial Sequence
  Synthetic Polynucleotide
taatacgactcactatagggatatccacagccggccattgtgcccatcgcaacagaggagagcgatgatgacaatggccaacctggcggcagcgcaaaagatg

SEQ ID NO: 81479 - DNA, 103 bp, Artificial Sequence
  Synthetic Polynucleotide
taatacgactcactatagggatgagatatccacagccggccattgtgcccaacagaggagagggcacatgggccggctgaacctggcggcagcgcaaaagatg

SEQ ID NO: 81480 - DNA, 103 bp, Artificial Sequence
  Synthetic Polynucleotide
taatacgactcactatagggtaacgttttccaccccatagcaccagcaataacagaggagaattgctatggctatggggaacctggcggcagcgcaaaagatg

SEQ ID NO: 81481 - DNA, 103 bp, Artificial Sequence
  Synthetic Polynucleotide
taatacgactcactatagggggaacatgagatatccacagccggccattgaacagaggagacaatggatggctgtggataacctggcggcagcgcaaaagatg

SEQ ID NO: 81482 - DNA, 103 bp, Artificial Sequence
  Synthetic Polynucleotide
taatacgactcactatagggtccaaggaacatgagatatccacagccggcaacagaggagagccggcatgggatatctcaacctggcggcagcgcaaaagatg

SEQ ID NO: 81483 - DNA, 103 bp, Artificial Sequence
  Synthetic Polynucleotide
taatacgactcactatagggacgcctccaaggaacatgagatatccacagaacagaggagactgtggatgtctcatgttaacctggcggcagcgcaaaagatg

SEQ ID NO: 81484 - DNA, 103 bp, Artificial Sequence
  Synthetic Polynucleotide
taatacgactcactataggggtttgacgcctccaaggaacatgagatatcaacagaggagagatatcatgtgttccttgaacctggcggcagcgcaaaagatg

SEQ ID NO: 81485 - DNA, 103 bp, Artificial Sequence
  Synthetic Polynucleotide
taatacgactcactatagggagtgggtttgacgcctccaaggaacatgagaacagaggagactcatgatgcttggaggcaacctggcggcagcgcaaaagatg

SEQ ID NO: 81486 - DNA, 103 bp, Artificial Sequence
  Synthetic Polynucleotide
taatacgactcactatagggatgtgagtgggtttgacgcctccaaggaacaacagaggagagttcctatgaggcgtcaaaacctggcggcagcgcaaaagatg

SEQ ID NO: 81487 - DNA, 103 bp, Artificial Sequence
  Synthetic Polynucleotide
taatacgactcactatagggaggagatgtgagtgggtttgacgcctccaaaacagaggagattggagatgtcaaacccaaacctggcggcagcgcaaaagatg

SEQ ID NO: 81488 - DNA, 103 bp, Artificial Sequence
  Synthetic Polynucleotide
taatacgactcactataggggacataggagatgtgagtgggtttgacgccaacagaggagaggcgtcatgcccactcacaacctggcggcagcgcaaaagatg

SEQ ID NO: 81489 - DNA, 103 bp, Artificial Sequence
  Synthetic Polynucleotide
taatacgactcactatagggagcatgacataggagatgtgagtgggtttgaacagaggagacaaaccatgtcacatctcaacctggcggcagcgcaaaagatg

SEQ ID NO: 81490 - DNA, 103 bp, Artificial Sequence
  Synthetic Polynucleotide
taatacgactcactatagggatatgagcatgacataggagatgtgagtggaacagaggagaccactcatgtctcctatgaacctggcggcagcgcaaaagatg

SEQ ID NO: 81491 - DNA, 103 bp, Artificial Sequence
  Synthetic Polynucleotide
taatacgactcactataggggactctaacgttttccaccccatagcaccaaacagaggagatggtgcatgggggtggaaaacctggcggcagcgcaaaagatg

SEQ ID NO: 81492 - DNA, 103 bp, Artificial Sequence
  Synthetic Polynucleotide
taatacgactcactatagggaaagaatatgagcatgacataggagatgtgaacagaggagacacatcatgtatgtcatgaacctggcggcagcgcaaaagatg

SEQ ID NO: 81493 - DNA, 103 bp, Artificial Sequence
  Synthetic Polynucleotide
taatacgactcactatagggaggacaaagaatatgagcatgacataggagaacagaggagactcctaatgcatgctcataacctggcggcagcgcaaaagatg

SEQ ID NO: 81494 - DNA, 103 bp, Artificial Sequence
  Synthetic Polynucleotide
taatacgactcactatagggccatcaggacaaagaatatgagcatgacataacagaggagaatgtcaatgtcatattctaacctggcggcagcgcaaaagatg

SEQ ID NO: 81495 - DNA, 103 bp, Artificial Sequence
  Synthetic Polynucleotide
taatacgactcactatagggaaccaccatcaggacaaagaatatgagcataacagaggagaatgctcatgttctttgtcaacctggcggcagcgcaaaagatg

SEQ ID NO: 81496 - DNA, 103 bp, Artificial Sequence
  Synthetic Polynucleotide
taatacgactcactatagggatcacaaccaccatcaggacaaagaatatgaacagaggagacatattatgtgtcctgataacctggcggcagcgcaaaagatg

SEQ ID NO: 81497 - DNA, 103 bp, Artificial Sequence
  Synthetic Polynucleotide
taatacgactcactatagggcggggatcacaaccaccatcaggacaaagaaacagaggagatctttgatgtgatggtggaacctggcggcagcgcaaaagatg

SEQ ID NO: 81498 - DNA, 103 bp, Artificial Sequence
  Synthetic Polynucleotide
taatacgactcactatagggtggctcggggatcacaaccaccatcaggacaacagaggagagtcctgatggtggttgtgaacctggcggcagcgcaaaagatg

SEQ ID NO: 81499 - DNA, 103 bp, Artificial Sequence
  Synthetic Polynucleotide
taatacgactcactatagggtgccctggctcggggatcacaaccaccatcaacagaggagagatggtatgtgtgatcccaacctggcggcagcgcaaaagatg

SEQ ID NO: 81500 - DNA, 103 bp, Artificial Sequence
  Synthetic Polynucleotide
taatacgactcactatagggtttgttgccctggctcggggatcacaaccaaacagaggagatggttgatgtccccgagcaacctggcggcagcgcaaaagatg

SEQ ID NO: 81501 - DNA, 103 bp, Artificial Sequence
  Synthetic Polynucleotide
taatacgactcactatagggggacctttgttgccctggctcggggatcacaacagaggagagtgatcatggagccagggaacctggcggcagcgcaaaagatg

SEQ ID NO: 81502 - DNA, 103 bp, Artificial Sequence
  Synthetic Polynucleotide
taatacgactcactatagggtatgcgactctaacgttttccaccccatagaacagaggagactatggatgggaaaacgtaacctggcggcagcgcaaaagatg

SEQ ID NO: 81503 - DNA, 103 bp, Artificial Sequence
  Synthetic Polynucleotide
taatacgactcactatagggtggatggacctttgttgccctggctcggggaacagaggagaccccgaatgagggcaacaaacctggcggcagcgcaaaagatg

SEQ ID NO: 81504 - DNA, 103 bp, Artificial Sequence
  Synthetic Polynucleotide
taatacgactcactatagggtgtcttggatggacctttgttgccctggctaacagaggagaagccagatgaacaaaggtaacctggcggcagcgcaaaagatg

SEQ ID NO: 81505 - DNA, 103 bp, Artificial Sequence
  Synthetic Polynucleotide
taatacgactcactatagggttggttgtcttggatggacctttgttgcccaacagaggagagggcaaatgaggtccatcaacctggcggcagcgcaaaagatg

SEQ ID NO: 81506 - DNA, 103 bp, Artificial Sequence
  Synthetic Polynucleotide
taatacgactcactataggggccacttggttgtcttggatggacctttgtaacagaggagaacaaagatgcatccaagaaacctggcggcagcgcaaaagatg

SEQ ID NO: 81507 - DNA, 103 bp, Artificial Sequence
  Synthetic Polynucleotide
taatacgactcactatagggggtatgccacttggttgtcttggatggaccaacagaggagaggtccaatgaagacaaccaacctggcggcagcgcaaaagatg

SEQ ID NO: 81508 - DNA, 103 bp, Artificial Sequence
  Synthetic Polynucleotide
taatacgactcactatagggaatgaggtatgccacttggttgtcttggataacagaggagaatccaaatgaaccaagtgaacctggcggcagcgcaaaagatg

SEQ ID NO: 81509 - DNA, 103 bp, Artificial Sequence
  Synthetic Polynucleotide
taatacgactcactatagggccaataatgaggtatgccacttggttgtctaacagaggagaagacaaatgagtggcataaacctggcggcagcgcaaaagatg

SEQ ID NO: 81510 - DNA, 103 bp, Artificial Sequence
  Synthetic Polynucleotide
taatacgactcactatagggggatgccaataatgaggtatgccacttggtaacagaggagaaccaagatgcatacctcaaacctggcggcagcgcaaaagatg

SEQ ID NO: 81511 - DNA, 103 bp, Artificial Sequence
  Synthetic Polynucleotide
taatacgactcactatagggcgtcaggatgccaataatgaggtatgccacaacagaggagagtggcaatgctcattattaacctggcggcagcgcaaaagatg

SEQ ID NO: 81512 - DNA, 103 bp, Artificial Sequence
  Synthetic Polynucleotide
taatacgactcactatagggaccagcgtcaggatgccaataatgaggtataacagaggagaatacctatgtattggcataacctggcggcagcgcaaaagatg

SEQ ID NO: 81513 - DNA, 103 bp, Artificial Sequence
  Synthetic Polynucleotide
taatacgactcactatagggtaccatatgcgactctaacgttttccacccaacagaggagagggtggatgacgttagagaacctggcggcagcgcaaaagatg

SEQ ID NO: 81514 - DNA, 103 bp, Artificial Sequence
  Synthetic Polynucleotide
taatacgactcactatagggctgaaaccagcgtcaggatgccaataatgaaacagaggagatcattaatggcatcctgaaacctggcggcagcgcaaaagatg

SEQ ID NO: 81515 - DNA, 103 bp, Artificial Sequence
  Synthetic Polynucleotide
taatacgactcactatagggcaccgctgaaaccagcgtcaggatgccaataacagaggagaattggcatgctgacgctgaacctggcggcagcgcaaaagatg

SEQ ID NO: 81516 - DNA, 103 bp, Artificial Sequence
  Synthetic Polynucleotide
taatacgactcactataggggctgccaccgctgaaaccagcgtcaggatgaacagaggagacatcctatggctggtttcaacctggcggcagcgcaaaagatg

SEQ ID NO: 81517 - DNA, 103 bp, Artificial Sequence
  Synthetic Polynucleotide
taatacgactcactatagggcgttggctgccaccgctgaaaccagcgtcaaacagaggagatgacgcatgtttcagcggaacctggcggcagcgcaaaagatg

SEQ ID NO: 81518 - DNA, 103 bp, Artificial Sequence
  Synthetic Polynucleotide
taatacgactcactatagggtagctcgttggctgccaccgctgaaaccagaacagaggagactggttatggcggtggcaaacctggcggcagcgcaaaagatg

SEQ ID NO: 81519 - DNA, 103 bp, Artificial Sequence
  Synthetic Polynucleotide
taatacgactcactatagggatgcctagctcgttggctgccaccgctgaaaacagaggagattcagcatgggcagccaaaacctggcggcagcgcaaaagatg

SEQ ID NO: 81520 - DNA, 103 bp, Artificial Sequence
  Synthetic Polynucleotide
taatacgactcactatagggccagcatgcctagctcgttggctgccaccgaacagaggagacggtggatgccaacgagcaacctggcggcagcgcaaaagatg

SEQ ID NO: 81521 - DNA, 103 bp, Artificial Sequence
  Synthetic Polynucleotide
taatacgactcactatagggtttctccagcatgcctagctcgttggctgcaacagaggagagcagccatggagctaggcaacctggcggcagcgcaaaagatg

SEQ ID NO: 81522 - DNA, 103 bp, Artificial Sequence
  Synthetic Polynucleotide
taatacgactcactatagggttggttttctccagcatgcctagctcgttgaacagaggagacaacgaatgaggcatgctaacctggcggcagcgcaaaagatg

SEQ ID NO: 81523 - DNA, 103 bp, Artificial Sequence
  Synthetic Polynucleotide
taatacgactcactatagggcctctttggttttctccagcatgcctagctaacagaggagaagctagatgtgctggagaaacctggcggcagcgcaaaagatg

SEQ ID NO: 81524 - DNA, 103 bp, Artificial Sequence
  Synthetic Polynucleotide
taatacgactcactatagggacacttaccatatgcgactctaacgttttcaacagaggagagaaaacatgagagtcgcaaacctggcggcagcgcaaaagatg

SEQ ID NO: 81525 - DNA, 103 bp, Artificial Sequence
  Synthetic Polynucleotide
taatacgactcactataggggaggtcctctttggttttctccagcatgccaacagaggagaggcatgatggagaaaaccaacctggcggcagcgcaaaagatg

SEQ ID NO: 81526 - DNA, 103 bp, Artificial Sequence
  Synthetic Polynucleotide
taatacgactcactatagggccaaagaggtcctctttggttttctccagcaacagaggagagctggaatgaaccaaagaaacctggcggcagcgcaaaagatg

SEQ ID NO: 81527 - DNA, 103 bp, Artificial Sequence
  Synthetic Polynucleotide
taatacgactcactatagggtcttcccaaagaggtcctctttggttttctaacagaggagaagaaaaatgaagaggaccaacctggcggcagcgcaaaagatg

SEQ ID NO: 81528 - DNA, 103 bp, Artificial Sequence
  Synthetic Polynucleotide
taatacgactcactataggggttcttcttcccaaagaggtcctctttggtaacagaggagaaccaaaatggacctctttaacctggcggcagcgcaaaagatg

SEQ ID NO: 81529 - DNA, 103 bp, Artificial Sequence
  Synthetic Polynucleotide
taatacgactcactatagggattaagttcttcttcccaaagaggtcctctaacagaggagaagaggaatgctttgggaaaacctggcggcagcgcaaaagatg

SEQ ID NO: 81530 - DNA, 103 bp, Artificial Sequence
  Synthetic Polynucleotide
taatacgactcactatagggatggaattaagttcttcttcccaaagaggtaacagaggagaacctctatgggaagaagaaacctggcggcagcgcaaaagatg

SEQ ID NO: 81531 - DNA, 103 bp, Artificial Sequence
  Synthetic Polynucleotide
taatacgactcactatagggactagatggaattaagttcttcttcccaaaaacagaggagatttgggatgaagaacttaaacctggcggcagcgcaaaagatg

SEQ ID NO: 81532 - DNA, 103 bp, Artificial Sequence
  Synthetic Polynucleotide
taatacgactcactataggggaagcactagatggaattaagttcttcttcaacagaggagagaagaaatgcttaattccaacctggcggcagcgcaaaagatg

SEQ ID NO: 81533 - DNA, 103 bp, Artificial Sequence
  Synthetic Polynucleotide
taatacgactcactatagggagggtgaagcactagatggaattaagttctaacagaggagaagaactatgttccatctaaacctggcggcagcgcaaaagatg

SEQ ID NO: 81534 - DNA, 103 bp, Artificial Sequence
  Synthetic Polynucleotide
taatacgactcactatagggactccagggtgaagcactagatggaattaaaacagaggagattaattatgtctagtgctaacctggcggcagcgcaaaagatg

SEQ ID NO: 81535 - DNA, 103 bp, Artificial Sequence
  Synthetic Polynucleotide
taatacgactcactataggggagtcacacttaccatatgcgactctaacgaacagaggagacgttagatgcgcatatggaacctggcggcagcgcaaaagatg

SEQ ID NO: 81536 - DNA, 103 bp, Artificial Sequence
  Synthetic Polynucleotide
taatacgactcactatagggggccaactccagggtgaagcactagatggaaacagaggagatccatcatgtgcttcaccaacctggcggcagcgcaaaagatg

SEQ ID NO: 81537 - DNA, 103 bp, Artificial Sequence
  Synthetic Polynucleotide
taatacgactcactataggggatccggccaactccagggtgaagcactagaacagaggagactagtgatgcaccctggaaacctggcggcagcgcaaaagatg

SEQ ID NO: 81538 - DNA, 103 bp, Artificial Sequence
  Synthetic Polynucleotide
taatacgactcactataggggtcaagatccggccaactccagggtgaagcaacagaggagagcttcaatgtggagttggaacctggcggcagcgcaaaagatg

SEQ ID NO: 81539 - DNA, 103 bp, Artificial Sequence
  Synthetic Polynucleotide
taatacgactcactatagggttcaggtcaagatccggccaactccagggtaacagaggagaaccctgatgttggccggaaacctggcggcagcgcaaaagatg

SEQ ID NO: 81540 - DNA, 103 bp, Artificial Sequence
  Synthetic Polynucleotide
taatacgactcactatagggctggcttcaggtcaagatccggccaactccaacagaggagaggagttatgcggatcttgaacctggcggcagcgcaaaagatg

SEQ ID NO: 81541 - DNA, 103 bp, Artificial Sequence
  Synthetic Polynucleotide
taatacgactcactatagggagctcctggcttcaggtcaagatccggccaaacagaggagatggccgatgcttgacctgaacctggcggcagcgcaaaagatg

SEQ ID NO: 81542 - DNA, 103 bp, Artificial Sequence
  Synthetic Polynucleotide
taatacgactcactatagggcaggcagctcctggcttcaggtcaagatccaacagaggagaggatctatgcctgaagccaacctggcggcagcgcaaaagatg

SEQ ID NO: 81543 - DNA, 103 bp, Artificial Sequence
  Synthetic Polynucleotide
taatacgactcactatagggctgtccaggcagctcctggcttcaggtcaaaacagaggagattgaccatgagccaggagaacctggcggcagcgcaaaagatg

SEQ ID NO: 81544 - DNA, 103 bp, Artificial Sequence
  Synthetic Polynucleotide
taatacgactcactataggggtacactgtccaggcagctcctggcttcagaacagaggagactgaagatgggagctgccaacctggcggcagcgcaaaagatg

SEQ ID NO: 81545 - DNA, 103 bp, Artificial Sequence
  Synthetic Polynucleotide
taatacgactcactatagggccaacgtacactgtccaggcagctcctggcaacagaggagagccaggatgtgcctggacaacctggcggcagcgcaaaagatg

SEQ ID NO: 81546 - DNA, 103 bp, Artificial Sequence
  Synthetic Polynucleotide
taatacgactcactatagggcgctcaacgaacgattaaaattaatccaaaaacagaggagatttggaatgattttaatcaacctggcggcagcgcaaaagatg

SEQ ID NO: 81547 - DNA, 103 bp, Artificial Sequence
  Synthetic Polynucleotide
taatacgactcactatagggctgctgagtcacacttaccatatgcgactcaacagaggagagagtcgatgatggtaagtaacctggcggcagcgcaaaagatg

SEQ ID NO: 81548 - DNA, 103 bp, Artificial Sequence
  Synthetic Polynucleotide
taatacgactcactatagggcaatgccaacgtacactgtccaggcagctcaacagaggagagagctgatgggacagtgtaacctggcggcagcgcaaaagatg

SEQ ID NO: 81549 - DNA, 103 bp, Artificial Sequence
  Synthetic Polynucleotide
taatacgactcactatagggtgtaacaatgccaacgtacactgtccaggcaacagaggagagcctggatggtgtacgttaacctggcggcagcgcaaaagatg

SEQ ID NO: 81550 - DNA, 103 bp, Artificial Sequence
  Synthetic Polynucleotide
taatacgactcactatagggagcattgtaacaatgccaacgtacactgtcaacagaggagagacagtatgcgttggcataacctggcggcagcgcaaaagatg

SEQ ID NO: 81551 - DNA, 103 bp, Artificial Sequence
  Synthetic Polynucleotide
taatacgactcactataggggagagagcattgtaacaatgccaacgtacaaacagaggagatgtacgatggcattgttaaacctggcggcagcgcaaaagatg

SEQ ID NO: 81552 - DNA, 103 bp, Artificial Sequence
  Synthetic Polynucleotide
taatacgactcactatagggcattggagagagcattgtaacaatgccaacaacagaggagagttggcatggttacaatgaacctggcggcagcgcaaaagatg

SEQ ID NO: 81553 - DNA, 103 bp, Artificial Sequence
  Synthetic Polynucleotide
taatacgactcactatagggtgcaacattggagagagcattgtaacaatgaacagaggagacattgtatgaatgctctcaacctggcggcagcgcaaaagatg

SEQ ID NO: 81554 - DNA, 103 bp, Artificial Sequence
  Synthetic Polynucleotide
taatacgactcactatagggagtggtgcaacattggagagagcattgtaaaacagaggagattacaaatgtctctccaaaacctggcggcagcgcaaaagatg

SEQ ID NO: 81555 - DNA, 103 bp, Artificial Sequence
  Synthetic Polynucleotide
taatacgactcactataggggatccagtggtgcaacattggagagagcataacagaggagaatgctcatgccaatgttgaacctggcggcagcgcaaaagatg

SEQ ID NO: 81556 - DNA, 103 bp, Artificial Sequence
  Synthetic Polynucleotide
taatacgactcactatagggactttgatccagtggtgcaacattggagagaacagaggagactctccatggttgcaccaaacctggcggcagcgcaaaagatg

SEQ ID NO: 81557 - DNA, 103 bp, Artificial Sequence
  Synthetic Polynucleotide
taatacgactcactatagggattcgactttgatccagtggtgcaacattgaacagaggagacaatgtatgaccactggaaacctggcggcagcgcaaaagatg

SEQ ID NO: 81558 - DNA, 103 bp, Artificial Sequence
  Synthetic Polynucleotide
taatacgactcactatagggcctgcctgctgagtcacacttaccatatgcaacagaggagagcatatatgaagtgtgacaacctggcggcagcgcaaaagatg

SEQ ID NO: 81559 - DNA, 103 bp, Artificial Sequence
  Synthetic Polynucleotide
taatacgactcactataggggccatattcgactttgatccagtggtgcaaaacagaggagattgcacatgtggatcaaaaacctggcggcagcgcaaaagatg

SEQ ID NO: 81560 - DNA, 103 bp, Artificial Sequence
  Synthetic Polynucleotide
taatacgactcactatagggaggttgccatattcgactttgatccagtggaacagaggagaccactgatgcaaagtcgaaacctggcggcagcgcaaaagatg

SEQ ID NO: 81561 - DNA, 103 bp, Artificial Sequence
  Synthetic Polynucleotide
taatacgactcactataggggagacaggttgccatattcgactttgatccaacagaggagaggatcaatgtcgaatatgaacctggcggcagcgcaaaagatg

SEQ ID NO: 81562 - DNA, 103 bp, Artificial Sequence
  Synthetic Polynucleotide
taatacgactcactatagggagacagagacaggttgccatattcgactttaacagaggagaaaagtcatgtatggcaacaacctggcggcagcgcaaaagatg

SEQ ID NO: 81563 - DNA, 103 bp, Artificial Sequence
  Synthetic Polynucleotide
taatacgactcactatagggattccagacagagacaggttgccatattcgaacagaggagacgaataatgcaacctgtcaacctggcggcagcgcaaaagatg

SEQ ID NO: 81564 - DNA, 103 bp, Artificial Sequence
  Synthetic Polynucleotide
taatacgactcactataggggggctattccagacagagacaggttgccataacagaggagaatggcaatgtgtctctgtaacctggcggcagcgcaaaagatg

SEQ ID NO: 81565 - DNA, 103 bp, Artificial Sequence
  Synthetic Polynucleotide
taatacgactcactatagggtgactgggctattccagacagagacaggttaacagaggagaaacctgatgctgtctggaaacctggcggcagcgcaaaagatg

SEQ ID NO: 81566 - DNA, 103 bp, Artificial Sequence
  Synthetic Polynucleotide
taatacgactcactataggggaggctgactgggctattccagacagagacaacagaggagagtctctatgtggaatagcaacctggcggcagcgcaaaagatg

SEQ ID NO: 81567 - DNA, 103 bp, Artificial Sequence
  Synthetic Polynucleotide
taatacgactcactatagggggactgaggctgactgggctattccagacaaacagaggagatgtctgatgtagcccagtaacctggcggcagcgcaaaagatg

SEQ ID NO: 81568 - DNA, 103 bp, Artificial Sequence
  Synthetic Polynucleotide
taatacgactcactatagggagaaaggactgaggctgactgggctattccaacagaggagaggaataatgcagtcagccaacctggcggcagcgcaaaagatg

SEQ ID NO: 81569 - DNA, 103 bp, Artificial Sequence
  Synthetic Polynucleotide
taatacgactcactatagggctagacctgcctgctgagtcacacttaccaaacagaggagatggtaaatgtgactcagcaacctggcggcagcgcaaaagatg

SEQ ID NO: 81570 - DNA, 103 bp, Artificial Sequence
  Synthetic Polynucleotide
taatacgactcactatagggatgaaagaaaggactgaggctgactgggctaacagaggagaagcccaatgagcctcagtaacctggcggcagcgcaaaagatg

SEQ ID NO: 81571 - DNA, 103 bp, Artificial Sequence
  Synthetic Polynucleotide
taatacgactcactatagggtgtccatgaaagaaaggactgaggctgactaacagaggagaagtcagatgcagtcctttaacctggcggcagcgcaaaagatg

SEQ ID NO: 81572 - DNA, 103 bp, Artificial Sequence
  Synthetic Polynucleotide
taatacgactcactatagggccccttgtccatgaaagaaaggactgaggcaacagaggagagcctcaatgctttctttcaacctggcggcagcgcaaaagatg

SEQ ID NO: 81573 - DNA, 103 bp, Artificial Sequence
  Synthetic Polynucleotide
taatacgactcactatagggggtatccccttgtccatgaaagaaaggactaacagaggagaagtcctatgtttcatggaaacctggcggcagcgcaaaagatg

SEQ ID NO: 81574 - DNA, 103 bp, Artificial Sequence
  Synthetic Polynucleotide
taatacgactcactatagggtgaatggtatccccttgtccatgaaagaaaaacagaggagatttcttatgtggacaaggaacctggcggcagcgcaaaagatg

SEQ ID NO: 81575 - DNA, 103 bp, Artificial Sequence
  Synthetic Polynucleotide
taatacgactcactatagggcttcatgaatggtatccccttgtccatgaaaacagaggagattcatgatgaaggggataaacctggcggcagcgcaaaagatg

SEQ ID NO: 81576 - DNA, 103 bp, Artificial Sequence
  Synthetic Polynucleotide
taatacgactcactatagggttcatcttcatgaatggtatccccttgtccaacagaggagaggacaaatggataccattaacctggcggcagcgcaaaagatg

SEQ ID NO: 81577 - DNA, 103 bp, Artificial Sequence
  Synthetic Polynucleotide
taatacgactcactatagggagatattcatcttcatgaatggtatcccctaacagaggagaaggggaatgcattcatgaaacctggcggcagcgcaaaagatg

SEQ ID NO: 81578 - DNA, 103 bp, Artificial Sequence
  Synthetic Polynucleotide
taatacgactcactataggggaccgagatattcatcttcatgaatggtataacagaggagaataccaatgatgaagatgaacctggcggcagcgcaaaagatg

SEQ ID NO: 81579 - DNA, 103 bp, Artificial Sequence
  Synthetic Polynucleotide
taatacgactcactatagggattatgaccgagatattcatcttcatgaataacagaggagaattcatatggatgaatataacctggcggcagcgcaaaagatg

SEQ ID NO: 81580 - DNA, 103 bp, Artificial Sequence
  Synthetic Polynucleotide
taatacgactcactatagggacctcctagacctgcctgctgagtcacactaacagaggagaagtgtgatgcagcaggcaaacctggcggcagcgcaaaagatg

SEQ ID NO: 81581 - DNA, 103 bp, Artificial Sequence
  Synthetic Polynucleotide
taatacgactcactataggggcagcattatgaccgagatattcatcttcaaacagaggagatgaagaatgatatctcggaacctggcggcagcgcaaaagatg

SEQ ID NO: 81582 - DNA, 103 bp, Artificial Sequence
  Synthetic Polynucleotide
taatacgactcactataggggaccagcagcattatgaccgagatattcataacagaggagaatgaatatgtcggtcataaacctggcggcagcgcaaaagatg

SEQ ID NO: 81583 - DNA, 103 bp, Artificial Sequence
  Synthetic Polynucleotide
taatacgactcactatagggccactgaccagcagcattatgaccgagataaacagaggagatatctcatgcataatgctaacctggcggcagcgcaaaagatg

SEQ ID NO: 81584 - DNA, 103 bp, Artificial Sequence
  Synthetic Polynucleotide
taatacgactcactatagggtccagccactgaccagcagcattatgaccgaacagaggagacggtcaatgtgctgctggaacctggcggcagcgcaaaagatg

SEQ ID NO: 81585 - DNA, 103 bp, Artificial Sequence
  Synthetic Polynucleotide
taatacgactcactatagggtgaattccagccactgaccagcagcattataacagaggagaataatgatgctggtcagtaacctggcggcagcgcaaaagatg

SEQ ID NO: 81586 - DNA, 103 bp, Artificial Sequence
  Synthetic Polynucleotide
taatacgactcactataggggttattgaattccagccactgaccagcagcaacagaggagagctgctatgcagtggctgaacctggcggcagcgcaaaagatg

SEQ ID NO: 81587 - DNA, 103 bp, Artificial Sequence
  Synthetic Polynucleotide
taatacgactcactatagggtcactgttattgaattccagccactgaccaaacagaggagatggtcaatggctggaattaacctggcggcagcgcaaaagatg

SEQ ID NO: 81588 - DNA, 103 bp, Artificial Sequence
  Synthetic Polynucleotide
taatacgactcactatagggaggcatcactgttattgaattccagccactaacagaggagaagtggcatgaattcaataaacctggcggcagcgcaaaagatg

SEQ ID NO: 81589 - DNA, 103 bp, Artificial Sequence
  Synthetic Polynucleotide
taatacgactcactatagggagcagaggcatcactgttattgaattccagaacagaggagactggaaatgaataacagtaacctggcggcagcgcaaaagatg

SEQ ID NO: 81590 - DNA, 103 bp, Artificial Sequence
  Synthetic Polynucleotide
taatacgactcactatagggcacagagcagaggcatcactgttattgaataacagaggagaattcaaatgcagtgatgcaacctggcggcagcgcaaaagatg

SEQ ID NO: 81591 - DNA, 103 bp, Artificial Sequence
  Synthetic Polynucleotide
taatacgactcactatagggtcttgacctcctagacctgcctgctgagtcaacagaggagagactcaatgggcaggtctaacctggcggcagcgcaaaagatg

SEQ ID NO: 81592 - DNA, 103 bp, Artificial Sequence
  Synthetic Polynucleotide
taatacgactcactatagggtatgccacagagcagaggcatcactgttataacagaggagaataacaatgatgcctctgaacctggcggcagcgcaaaagatg

SEQ ID NO: 81593 - DNA, 103 bp, Artificial Sequence
  Synthetic Polynucleotide
taatacgactcactatagggcaccctatgccacagagcagaggcatcactaacagaggagaagtgatatgtctgctctgaacctggcggcagcgcaaaagatg

SEQ ID NO: 81594 - DNA, 103 bp, Artificial Sequence
  Synthetic Polynucleotide
taatacgactcactatagggtggcgcaccctatgccacagagcagaggcaaacagaggagatgcctcatgtctgtggcaaacctggcggcagcgcaaaagatg

SEQ ID NO: 81595 - DNA, 103 bp, Artificial Sequence
  Synthetic Polynucleotide
taatacgactcactataggggagcatggcgcaccctatgccacagagcagaacagaggagactgctcatgggcatagggaacctggcggcagcgcaaaagatg

SEQ ID NO: 81596 - DNA, 103 bp, Artificial Sequence
  Synthetic Polynucleotide
taatacgactcactatagggcagtggagcatggcgcaccctatgccacagaacagaggagactgtggatgagggtgcgcaacctggcggcagcgcaaaagatg

SEQ ID NO: 81597 - DNA, 103 bp, Artificial Sequence
  Synthetic Polynucleotide
taatacgactcactataggggagaccagtggagcatggcgcaccctatgcaacagaggagagcatagatggcgccatgcaacctggcggcagcgcaaaagatg

SEQ ID NO: 81598 - DNA, 103 bp, Artificial Sequence
  Synthetic Polynucleotide
taatacgactcactatagggaatgagagaccagtggagcatggcgcacccaacagaggagagggtgcatgatgctccacaacctggcggcagcgcaaaagatg

SEQ ID NO: 81599 - DNA, 103 bp, Artificial Sequence
  Synthetic Polynucleotide
taatacgactcactatagggggtaaaatgagagaccagtggagcatggcgaacagaggagacgccatatgccactggtcaacctggcggcagcgcaaaagatg

SEQ ID NO: 81600 - DNA, 103 bp, Artificial Sequence
  Synthetic Polynucleotide
taatacgactcactatagggttccaggtaaaatgagagaccagtggagcaaacagaggagatgctccatgggtctctcaaacctggcggcagcgcaaaagatg

SEQ ID NO: 81601 - DNA, 103 bp, Artificial Sequence
  Synthetic Polynucleotide
taatacgactcactatagggtttgattccaggtaaaatgagagaccagtgaacagaggagacactggatgctcattttaaacctggcggcagcgcaaaagatg

SEQ ID NO: 81602 - DNA, 103 bp, Artificial Sequence
  Synthetic Polynucleotide
taatacgactcactataggggcccttcttgacctcctagacctgcctgctaacagaggagaagcaggatggtctaggagaacctggcggcagcgcaaaagatg

SEQ ID NO: 81603 - DNA, 103 bp, Artificial Sequence
  Synthetic Polynucleotide
taatacgactcactatagggtgcgctttgattccaggtaaaatgagagacaacagaggagagtctctatgtttacctggaacctggcggcagcgcaaaagatg

SEQ ID NO: 81604 - DNA, 103 bp, Artificial Sequence
  Synthetic Polynucleotide
taatacgactcactatagggactgctgcgctttgattccaggtaaaatgaaacagaggagatcatttatgctggaatcaaacctggcggcagcgcaaaagatg

SEQ ID NO: 81605 - DNA, 103 bp, Artificial Sequence
  Synthetic Polynucleotide
taatacgactcactatagggctttgactgctgcgctttgattccaggtaaaacagaggagattacctatgatcaaagcgaacctggcggcagcgcaaaagatg

SEQ ID NO: 81606 - DNA, 103 bp, Artificial Sequence
  Synthetic Polynucleotide
taatacgactcactataggggcaagctttgactgctgcgctttgattccaaacagaggagatggaatatgagcgcagcaaacctggcggcagcgcaaaagatg

SEQ ID NO: 81607 - DNA, 103 bp, Artificial Sequence
  Synthetic Polynucleotide
taatacgactcactatagggtctgtgcaagctttgactgctgcgctttgaaacagaggagatcaaagatgagcagtcaaaacctggcggcagcgcaaaagatg

SEQ ID NO: 81608 - DNA, 103 bp, Artificial Sequence
  Synthetic Polynucleotide
taatacgactcactatagggccttctctgtgcaagctttgactgctgcgcaacagaggagagcgcagatgtcaaagcttaacctggcggcagcgcaaaagatg

SEQ ID NO: 81609 - DNA, 103 bp, Artificial Sequence
  Synthetic Polynucleotide
taatacgactcactatagggaacacccttctctgtgcaagctttgactgcaacagaggagagcagtcatggcttgcacaaacctggcggcagcgcaaaagatg

SEQ ID NO: 81610 - DNA, 103 bp, Artificial Sequence
  Synthetic Polynucleotide
taatacgactcactatagggcatggaacacccttctctgtgcaagctttgaacagaggagacaaagcatgcacagagaaaacctggcggcagcgcaaaagatg

SEQ ID NO: 81611 - DNA, 103 bp, Artificial Sequence
  Synthetic Polynucleotide
taatacgactcactatagggaacgccatggaacacccttctctgtgcaagaacagaggagacttgcaatgagaagggtgaacctggcggcagcgcaaaagatg

SEQ ID NO: 81612 - DNA, 103 bp, Artificial Sequence
  Synthetic Polynucleotide
taatacgactcactatagggtcggcaacgccatggaacacccttctctgtaacagaggagaacagagatgggtgttccaaacctggcggcagcgcaaaagatg

SEQ ID NO: 81613 - DNA, 103 bp, Artificial Sequence
  Synthetic Polynucleotide
taatacgactcactatagggcaatggcccttcttgacctcctagacctgcaacagaggagagcaggtatgggaggtcaaaacctggcggcagcgcaaaagatg

SEQ ID NO: 81614 - DNA, 103 bp, Artificial Sequence
  Synthetic Polynucleotide
taatacgactcactatagggggttctcggcaacgccatggaacacccttcaacagaggagagaagggatgtccatggcgaacctggcggcagcgcaaaagatg

SEQ ID NO: 81615 - DNA, 103 bp, Artificial Sequence
  Synthetic Polynucleotide
taatacgactcactatagggcacagggttctcggcaacgccatggaacacaacagaggagagtgttcatgggcgttgccaacctggcggcagcgcaaaagatg

SEQ ID NO: 81616 - DNA, 103 bp, Artificial Sequence
  Synthetic Polynucleotide
taatacgactcactatagggtcaaccacagggttctcggcaacgccatggaacagaggagaccatggatgtgccgagaaaacctggcggcagcgcaaaagatg

SEQ ID NO: 81617 - DNA, 103 bp, Artificial Sequence
  Synthetic Polynucleotide
taatacgactcactatagggtcccatcaaccacagggttctcggcaacgcaacagaggagagcgttgatgagaaccctgaacctggcggcagcgcaaaagatg

SEQ ID NO: 81618 - DNA, 103 bp, Artificial Sequence
  Synthetic Polynucleotide
taatacgactcactatagggtggattcccatcaaccacagggttctcggcaacagaggagagccgagatgcctgtggttaacctggcggcagcgcaaaagatg

SEQ ID NO: 81619 - DNA, 103 bp, Artificial Sequence
  Synthetic Polynucleotide
taatacgactcactatagggactgttggattcccatcaaccacagggttcaacagaggagagaacccatgggttgatggaacctggcggcagcgcaaaagatg

SEQ ID NO: 81620 - DNA, 103 bp, Artificial Sequence
  Synthetic Polynucleotide
taatacgactcactatagggtgtcaactgttggattcccatcaaccacagaacagaggagactgtggatgatgggaatcaacctggcggcagcgcaaaagatg

SEQ ID NO: 81621 - DNA, 103 bp, Artificial Sequence
  Synthetic Polynucleotide
taatacgactcactatagggctcaatgtcaactgttggattcccatcaacaacagaggagagttgatatgaatccaacaaacctggcggcagcgcaaaagatg

SEQ ID NO: 81622 - DNA, 103 bp, Artificial Sequence
  Synthetic Polynucleotide
taatacgactcactataggggcttcctcaatgtcaactgttggattcccaaacagaggagatgggaaatgaacagttgaaacctggcggcagcgcaaaagatg

SEQ ID NO: 81623 - DNA, 103 bp, Artificial Sequence
  Synthetic Polynucleotide
taatacgactcactatagggcaggagcttcctcaatgtcaactgttggataacagaggagaatccaaatgttgacattgaacctggcggcagcgcaaaagatg

SEQ ID NO: 81624 - DNA, 103 bp, Artificial Sequence
  Synthetic Polynucleotide
taatacgactcactatagggcaagtcaatggcccttcttgacctcctagaaacagaggagatctaggatgtcaagaaggaacctggcggcagcgcaaaagatg

SEQ ID NO: 81625 - DNA, 103 bp, Artificial Sequence
  Synthetic Polynucleotide
taatacgactcactatagggcatttcaggagcttcctcaatgtcaactgtaacagaggagaacagttatgattgaggaaaacctggcggcagcgcaaaagatg

SEQ ID NO: 81626 - DNA, 103 bp, Artificial Sequence
  Synthetic Polynucleotide
taatacgactcactataggggcaggcatttcaggagcttcctcaatgtcaaacagaggagatgacatatgggaagctccaacctggcggcagcgcaaaagatg

SEQ ID NO: 81627 - DNA, 103 bp, Artificial Sequence
  Synthetic Polynucleotide
taatacgactcactatagggaaagggcaggcatttcaggagcttcctcaaaacagaggagattgaggatgctcctgaaaaacctggcggcagcgcaaaagatg

SEQ ID NO: 81628 - DNA, 103 bp, Artificial Sequence
  Synthetic Polynucleotide
taatacgactcactatagggctcataaagggcaggcatttcaggagcttcaacagaggagagaagctatggaaatgcctaacctggcggcagcgcaaaagatg

SEQ ID NO: 81629 - DNA, 103 bp, Artificial Sequence
  Synthetic Polynucleotide
taatacgactcactatagggttcttctcataaagggcaggcatttcaggaaacagaggagatcctgaatggcctgccctaacctggcggcagcgcaaaagatg

SEQ ID NO: 81630 - DNA, 103 bp, Artificial Sequence
  Synthetic Polynucleotide
taatacgactcactatagggccagtttcttctcataaagggcaggcatttaacagaggagaaaatgcatgccctttatgaacctggcggcagcgcaaaagatg

SEQ ID NO: 81631 - DNA, 103 bp, Artificial Sequence
  Synthetic Polynucleotide
taatacgactcactatagggtagagccagtttcttctcataaagggcaggaacagaggagacctgccatgtatgagaagaacctggcggcagcgcaaaagatg

SEQ ID NO: 81632 - DNA, 103 bp, Artificial Sequence
  Synthetic Polynucleotide
taatacgactcactatagggagatatagagccagtttcttctcataaaggaacagaggagacctttaatggaagaaactaacctggcggcagcgcaaaagatg

SEQ ID NO: 81633 - DNA, 103 bp, Artificial Sequence
  Synthetic Polynucleotide
taatacgactcactataggggaaggagatatagagccagtttcttctcataacagaggagaatgagaatgaactggctcaacctggcggcagcgcaaaagatg

SEQ ID NO: 81634 - DNA, 103 bp, Artificial Sequence
  Synthetic Polynucleotide
taatacgactcactatagggagcaagaaggagatatagagccagtttcttaacagaggagaaagaaaatggctctatataacctggcggcagcgcaaaagatg

SEQ ID NO: 81635 - DNA, 103 bp, Artificial Sequence
  Synthetic Polynucleotide
taatacgactcactataggggtaggcaagtcaatggcccttcttgacctcaacagaggagagaggtcatgaagggccataacctggcggcagcgcaaaagatg

SEQ ID NO: 81636 - DNA, 103 bp, Artificial Sequence
  Synthetic Polynucleotide
taatacgactcactatagggctgagagcaagaaggagatatagagccagtaacagaggagaactggcatgatatctcctaacctggcggcagcgcaaaagatg

SEQ ID NO: 81637 - DNA, 103 bp, Artificial Sequence
  Synthetic Polynucleotide
taatacgactcactatagggctaggctgagagcaagaaggagatatagagaacagaggagactctatatgtccttcttgaacctggcggcagcgcaaaagatg

SEQ ID NO: 81638 - DNA, 103 bp, Artificial Sequence
  Synthetic Polynucleotide
taatacgactcactatagggagaagctaggctgagagcaagaaggagataaacagaggagatatctcatgcttgctctcaacctggcggcagcgcaaaagatg

SEQ ID NO: 81639 - DNA, 103 bp, Artificial Sequence
  Synthetic Polynucleotide
taatacgactcactataggggcaacagaagctaggctgagagcaagaaggaacagaggagaccttctatgtctcagcctaacctggcggcagcgcaaaagatg

SEQ ID NO: 81640 - DNA, 103 bp, Artificial Sequence
  Synthetic Polynucleotide
taatacgactcactatagggacatggcaacagaagctaggctgagagcaaaacagaggagattgctcatggcctagcttaacctggcggcagcgcaaaagatg

SEQ ID NO: 81641 - DNA, 103 bp, Artificial Sequence
  Synthetic Polynucleotide
taatacgactcactatagggtctgcacatggcaacagaagctaggctgagaacagaggagactcagcatggcttctgttaacctggcggcagcgcaaaagatg

SEQ ID NO: 81642 - DNA, 103 bp, Artificial Sequence
  Synthetic Polynucleotide
taatacgactcactatagggggcgttctgcacatggcaacagaagctaggaacagaggagacctagcatgtgttgccataacctggcggcagcgcaaaagatg

SEQ ID NO: 81643 - DNA, 103 bp, Artificial Sequence
  Synthetic Polynucleotide
taatacgactcactatagggaaaagggcgttctgcacatggcaacagaagaacagaggagacttctgatgccatgtgcaaacctggcggcagcgcaaaagatg

SEQ ID NO: 81644 - DNA, 103 bp, Artificial Sequence
  Synthetic Polynucleotide
taatacgactcactatagggcaatgaaaagggcgttctgcacatggcaacaacagaggagagttgccatgtgcagaacgaacctggcggcagcgcaaaagatg

SEQ ID NO: 81645 - DNA, 103 bp, Artificial Sequence
  Synthetic Polynucleotide
taatacgactcactatagggtcagccaatgaaaagggcgttctgcacatgaacagaggagacatgtgatgaacgcccttaacctggcggcagcgcaaaagatg

SEQ ID NO: 81646 - DNA, 103 bp, Artificial Sequence
  Synthetic Polynucleotide
taatacgactcactatagggcatgcgtaggcaagtcaatggcccttcttgaacagaggagacaagaaatgccattgactaacctggcggcagcgcaaaagatg

SEQ ID NO: 81647 - DNA, 103 bp, Artificial Sequence
  Synthetic Polynucleotide
taatacgactcactatagggtgccttcagccaatgaaaagggcgttctgcaacagaggagagcagaaatgccttttcataacctggcggcagcgcaaaagatg

SEQ ID NO: 81648 - DNA, 103 bp, Artificial Sequence
  Synthetic Polynucleotide
taatacgactcactataggggacaatgccttcagccaatgaaaagggcgtaacagaggagaacgcccatgtcattggctaacctggcggcagcgcaaaagatg

SEQ ID NO: 81649 - DNA, 103 bp, Artificial Sequence
  Synthetic Polynucleotide
taatacgactcactataggggctaggacaatgccttcagccaatgaaaagaacagaggagacttttcatgggctgaaggaacctggcggcagcgcaaaagatg

SEQ ID NO: 81650 - DNA, 103 bp, Artificial Sequence
  Synthetic Polynucleotide
taatacgactcactatagggctgatgctaggacaatgccttcagccaatgaacagaggagacattggatgaaggcattgaacctggcggcagcgcaaaagatg

SEQ ID NO: 81651 - DNA, 103 bp, Artificial Sequence
  Synthetic Polynucleotide
taatacgactcactatagggggcagctgatgctaggacaatgccttcagcaacagaggagagctgaaatgattgtcctaaacctggcggcagcgcaaaagatg

SEQ ID NO: 81652 - DNA, 103 bp, Artificial Sequence
  Synthetic Polynucleotide
taatacgactcactatagggcctaaggcagctgatgctaggacaatgcctaacagaggagaaggcatatgcctagcatcaacctggcggcagcgcaaaagatg

SEQ ID NO: 81653 - DNA, 103 bp, Artificial Sequence
  Synthetic Polynucleotide
taatacgactcactataggggcggccctaaggcagctgatgctaggacaaaacagaggagattgtccatgcatcagctgaacctggcggcagcgcaaaagatg

SEQ ID NO: 81654 - DNA, 103 bp, Artificial Sequence
  Synthetic Polynucleotide
taatacgactcactatagggtatgagcggccctaaggcagctgatgctagaacagaggagactagcaatggctgccttaaacctggcggcagcgcaaaagatg

SEQ ID NO: 81655 - DNA, 103 bp, Artificial Sequence
  Synthetic Polynucleotide
taatacgactcactatagggccctctatgagcggccctaaggcagctgataacagaggagaatcagcatgcttagggccaacctggcggcagcgcaaaagatg

SEQ ID NO: 81656 - DNA, 103 bp, Artificial Sequence
  Synthetic Polynucleotide
taatacgactcactatagggtgtttccctctatgagcggccctaaggcagaacagaggagactgcctatgggccgctcaaacctggcggcagcgcaaaagatg

SEQ ID NO: 81657 - DNA, 103 bp, Artificial Sequence
  Synthetic Polynucleotide
taatacgactcactatagggctaatcgctcaacgaacgattaaaattaataacagaggagaattaatatgaatcgttcgaacctggcggcagcgcaaaagatg

SEQ ID NO: 81658 - DNA, 103 bp, Artificial Sequence
  Synthetic Polynucleotide
taatacgactcactataggggttttcatgcgtaggcaagtcaatggccctaacagaggagaagggccatggacttgcctaacctggcggcagcgcaaaagatg

SEQ ID NO: 81659 - DNA, 103 bp, Artificial Sequence
  Synthetic Polynucleotide
taatacgactcactataggggctggtgtttccctctatgagcggccctaaaacagaggagattagggatgctcatagagaacctggcggcagcgcaaaagatg

SEQ ID NO: 81660 - DNA, 103 bp, Artificial Sequence
  Synthetic Polynucleotide
taatacgactcactatagggagaaggctggtgtttccctctatgagcggcaacagaggagagccgctatgagagggaaaaacctggcggcagcgcaaaagatg

SEQ ID NO: 81661 - DNA, 103 bp, Artificial Sequence
  Synthetic Polynucleotide
taatacgactcactatagggtccaaagaaggctggtgtttccctctatgaaacagaggagatcatagatggaaacaccaaacctggcggcagcgcaaaagatg

SEQ ID NO: 81662 - DNA, 103 bp, Artificial Sequence
  Synthetic Polynucleotide
taatacgactcactatagggtccattccaaagaaggctggtgtttccctcaacagaggagagagggaatgaccagccttaacctggcggcagcgcaaaagatg

SEQ ID NO: 81663 - DNA, 103 bp, Artificial Sequence
  Synthetic Polynucleotide
taatacgactcactatagggatgggtccattccaaagaaggctggtgtttaacagaggagaaaacacatgccttctttgaacctggcggcagcgcaaaagatg

SEQ ID NO: 81664 - DNA, 103 bp, Artificial Sequence
  Synthetic Polynucleotide
taatacgactcactatagggcagccatgggtccattccaaagaaggctggaacagaggagaccagccatgtttggaatgaacctggcggcagcgcaaaagatg

SEQ ID NO: 81665 - DNA, 103 bp, Artificial Sequence
  Synthetic Polynucleotide
taatacgactcactatagggggagacagccatgggtccattccaaagaagaacagaggagacttcttatgaatggacccaacctggcggcagcgcaaaagatg

SEQ ID NO: 81666 - DNA, 103 bp, Artificial Sequence
  Synthetic Polynucleotide
taatacgactcactataggggtcatggagacagccatgggtccattccaaaacagaggagattggaaatgacccatggcaacctggcggcagcgcaaaagatg

SEQ ID NO: 81667 - DNA, 103 bp, Artificial Sequence
  Synthetic Polynucleotide
taatacgactcactatagggctcctgtcatggagacagccatgggtccataacagaggagaatggacatgtggctgtctaacctggcggcagcgcaaaagatg

SEQ ID NO: 81668 - DNA, 103 bp, Artificial Sequence
  Synthetic Polynucleotide
taatacgactcactatagggcatgactcctgtcatggagacagccatgggaacagaggagacccatgatggtctccatgaacctggcggcagcgcaaaagatg

SEQ ID NO: 81669 - DNA, 103 bp, Artificial Sequence
  Synthetic Polynucleotide
taatacgactcactatagggccatggttttcatgcgtaggcaagtcaatgaacagaggagacattgaatggcctacgcaaacctggcggcagcgcaaaagatg

SEQ ID NO: 81670 - DNA, 103 bp, Artificial Sequence
  Synthetic Polynucleotide
taatacgactcactatagggcccctcatgactcctgtcatggagacagccaacagaggagaggctgtatgcatgacaggaacctggcggcagcgcaaaagatg

SEQ ID NO: 81671 - DNA, 103 bp, Artificial Sequence
  Synthetic Polynucleotide
taatacgactcactataggggattccccctcatgactcctgtcatggagaaacagaggagatctccaatgcaggagtcaaacctggcggcagcgcaaaagatg

SEQ ID NO: 81672 - DNA, 103 bp, Artificial Sequence
  Synthetic Polynucleotide
taatacgactcactatagggatagtgattccccctcatgactcctgtcataacagaggagaatgacaatggtcatgaggaacctggcggcagcgcaaaagatg

SEQ ID NO: 81673 - DNA, 103 bp, Artificial Sequence
  Synthetic Polynucleotide
taatacgactcactatagggaaagcatagtgattccccctcatgactcctaacagaggagaaggagtatggagggggaaaacctggcggcagcgcaaaagatg

SEQ ID NO: 81674 - DNA, 103 bp, Artificial Sequence
  Synthetic Polynucleotide
taatacgactcactatagggccacaaaagcatagtgattccccctcatgaaacagaggagatcatgaatgggaatcactaacctggcggcagcgcaaaagatg

SEQ ID NO: 81675 - DNA, 103 bp, Artificial Sequence
  Synthetic Polynucleotide
taatacgactcactataggggactcccacaaaagcatagtgattccccctaacagaggagaagggggatgcactatgctaacctggcggcagcgcaaaagatg

SEQ ID NO: 81676 - DNA, 103 bp, Artificial Sequence
  Synthetic Polynucleotide
taatacgactcactatagggtacatgactcccacaaaagcatagtgattcaacagaggagagaatcaatgtgcttttgtaacctggcggcagcgcaaaagatg

SEQ ID NO: 81677 - DNA, 103 bp, Artificial Sequence
  Synthetic Polynucleotide
taatacgactcactataggggattgtacatgactcccacaaaagcatagtaacagaggagaactatgatgttgtgggagaacctggcggcagcgcaaaagatg

SEQ ID NO: 81678 - DNA, 103 bp, Artificial Sequence
  Synthetic Polynucleotide
taatacgactcactatagggccatagattgtacatgactcccacaaaagcaacagaggagagcttttatgggagtcatgaacctggcggcagcgcaaaagatg

SEQ ID NO: 81679 - DNA, 103 bp, Artificial Sequence
  Synthetic Polynucleotide
taatacgactcactatagggatcttccatagattgtacatgactcccacaaacagaggagatgtgggatgcatgtacaaaacctggcggcagcgcaaaagatg

SEQ ID NO: 81680 - DNA, 103 bp, Artificial Sequence
  Synthetic Polynucleotide
taatacgactcactatagggtcaaaccatggttttcatgcgtaggcaagtaacagaggagaacttgcatgcgcatgaaaaacctggcggcagcgcaaaagatg

SEQ ID NO: 81681 - DNA, 103 bp, Artificial Sequence
  Synthetic Polynucleotide
taatacgactcactatagggttttcatcttccatagattgtacatgactcaacagaggagagagtcaatgacaatctataacctggcggcagcgcaaaagatg

SEQ ID NO: 81682 - DNA, 103 bp, Artificial Sequence
  Synthetic Polynucleotide
taatacgactcactatagggtccagttttcatcttccatagattgtacataacagaggagaatgtacatgctatggaagaacctggcggcagcgcaaaagatg

SEQ ID NO: 81683 - DNA, 103 bp, Artificial Sequence
  Synthetic Polynucleotide
taatacgactcactatagggcggcgtccagttttcatcttccatagattgaacagaggagacaatctatggaagatgaaaacctggcggcagcgcaaaagatg

SEQ ID NO: 81684 - DNA, 103 bp, Artificial Sequence
  Synthetic Polynucleotide
taatacgactcactatagggtcccccggcgtccagttttcatcttccataaacagaggagatatggaatgtgaaaactgaacctggcggcagcgcaaaagatg

SEQ ID NO: 81685 - DNA, 103 bp, Artificial Sequence
  Synthetic Polynucleotide
taatacgactcactatagggcgcgctcccccggcgtccagttttcatcttaacagaggagaaagatgatgactggacgcaacctggcggcagcgcaaaagatg

SEQ ID NO: 81686 - DNA, 103 bp, Artificial Sequence
  Synthetic Polynucleotide
taatacgactcactatagggccattcgcgctcccccggcgtccagttttcaacagaggagagaaaacatgacgccggggaacctggcggcagcgcaaaagatg

SEQ ID NO: 81687 - DNA, 103 bp, Artificial Sequence
  Synthetic Polynucleotide
taatacgactcactatagggtttttccattcgcgctcccccggcgtccagaacagaggagactggacatggggggagcgaacctggcggcagcgcaaaagatg

SEQ ID NO: 81688 - DNA, 103 bp, Artificial Sequence
  Synthetic Polynucleotide
taatacgactcactatagggcaaagtttttccattcgcgctcccccggcgaacagaggagacgccggatgagcgcgaataacctggcggcagcgcaaaagatg

SEQ ID NO: 81689 - DNA, 103 bp, Artificial Sequence
  Synthetic Polynucleotide
taatacgactcactatagggtcacccaaagtttttccattcgcgctccccaacagaggagaggggagatggaatggaaaaacctggcggcagcgcaaaagatg

SEQ ID NO: 81690 - DNA, 103 bp, Artificial Sequence
  Synthetic Polynucleotide
taatacgactcactatagggagacttcacccaaagtttttccattcgcgcaacagaggagagcgcgaatggaaaaacttaacctggcggcagcgcaaaagatg

SEQ ID NO: 81691 - DNA, 103 bp, Artificial Sequence
  Synthetic Polynucleotide
taatacgactcactatagggggtcttcaaaccatggttttcatgcgtaggaacagaggagacctacgatggaaaaccataacctggcggcagcgcaaaagatg

SEQ ID NO: 81692 - DNA, 103 bp, Artificial Sequence
  Synthetic Polynucleotide
taatacgactcactatagggcttccagacttcacccaaagtttttccattaacagaggagaaatggaatgactttgggtaacctggcggcagcgcaaaagatg

SEQ ID NO: 81693 - DNA, 103 bp, Artificial Sequence
  Synthetic Polynucleotide
taatacgactcactatagggtccctcttccagacttcacccaaagtttttaacagaggagaaaaaacatggggtgaagtaacctggcggcagcgcaaaagatg

SEQ ID NO: 81694 - DNA, 103 bp, Artificial Sequence
  Synthetic Polynucleotide
taatacgactcactatagggtcagttccctcttccagacttcacccaaagaacagaggagactttggatgaagtctggaaacctggcggcagcgcaaaagatg

SEQ ID NO: 81695 - DNA, 103 bp, Artificial Sequence
  Synthetic Polynucleotide
taatacgactcactatagggcagattcagttccctcttccagacttcaccaacagaggagaggtgaaatgtggaagaggaacctggcggcagcgcaaaagatg

SEQ ID NO: 81696 - DNA, 103 bp, Artificial Sequence
  Synthetic Polynucleotide
taatacgactcactatagggtccaacagattcagttccctcttccagactaacagaggagaagtctgatggagggaactaacctggcggcagcgcaaaagatg

SEQ ID NO: 81697 - DNA, 103 bp, Artificial Sequence
  Synthetic Polynucleotide
taatacgactcactataggggcttgtccaacagattcagttccctcttccaacagaggagaggaagaatgaactgaatcaacctggcggcagcgcaaaagatg

SEQ ID NO: 81698 - DNA, 103 bp, Artificial Sequence
  Synthetic Polynucleotide
taatacgactcactatagggctgtcgcttgtccaacagattcagttccctaacagaggagaagggaaatgaatctgttgaacctggcggcagcgcaaaagatg

SEQ ID NO: 81699 - DNA, 103 bp, Artificial Sequence
  Synthetic Polynucleotide
taatacgactcactatagggtcaaactgtcgcttgtccaacagattcagtaacagaggagaactgaaatggttggacaaaacctggcggcagcgcaaaagatg

SEQ ID NO: 81700 - DNA, 103 bp, Artificial Sequence
  Synthetic Polynucleotide
taatacgactcactatagggacaactcaaactgtcgcttgtccaacagataacagaggagaatctgtatgacaagcgacaacctggcggcagcgcaaaagatg

SEQ ID NO: 81701 - DNA, 103 bp, Artificial Sequence
  Synthetic Polynucleotide
taatacgactcactatagggtttatacaactcaaactgtcgcttgtccaaaacagaggagattggacatgcgacagtttaacctggcggcagcgcaaaagatg

SEQ ID NO: 81702 - DNA, 103 bp, Artificial Sequence
  Synthetic Polynucleotide
taatacgactcactatagggtgccgggtcttcaaaccatggttttcatgcaacagaggagagcatgaatgccatggtttaacctggcggcagcgcaaaagatg

SEQ ID NO: 81703 - DNA, 103 bp, Artificial Sequence
  Synthetic Polynucleotide
taatacgactcactataggggtccttttatacaactcaaactgtcgcttgaacagaggagacaagcgatggtttgagttaacctggcggcagcgcaaaagatg

SEQ ID NO: 81704 - DNA, 103 bp, Artificial Sequence
  Synthetic Polynucleotide
taatacgactcactatagggtgtcggtccttttatacaactcaaactgtcaacagaggagagacagtatgagttgtataaacctggcggcagcgcaaaagatg

SEQ ID NO: 81705 - DNA, 103 bp, Artificial Sequence
  Synthetic Polynucleotide
taatacgactcactatagggcacaatgtcggtccttttatacaactcaaaaacagaggagatttgagatgtataaaaggaacctggcggcagcgcaaaagatg

SEQ ID NO: 81706 - DNA, 103 bp, Artificial Sequence
  Synthetic Polynucleotide
taatacgactcactatagggacctccacaatgtcggtccttttatacaacaacagaggagagttgtaatgaaggaccgaaacctggcggcagcgcaaaagatg

SEQ ID NO: 81707 - DNA, 103 bp, Artificial Sequence
  Synthetic Polynucleotide
taatacgactcactataggggatccacctccacaatgtcggtccttttataacagaggagaataaaaatgccgacattgaacctggcggcagcgcaaaagatg

SEQ ID NO: 81708 - DNA, 103 bp, Artificial Sequence
  Synthetic Polynucleotide
taatacgactcactatagggatcacgatccacctccacaatgtcggtcctaacagaggagaaggaccatgattgtggagaacctggcggcagcgcaaaagatg

SEQ ID NO: 81709 - DNA, 103 bp, Artificial Sequence
  Synthetic Polynucleotide
taatacgactcactataggggccgtatcacgatccacctccacaatgtcgaacagaggagacgacatatgggaggtggaaacctggcggcagcgcaaaagatg

SEQ ID NO: 81710 - DNA, 103 bp, Artificial Sequence
  Synthetic Polynucleotide
taatacgactcactatagggtgcgtgccgtatcacgatccacctccacaaaacagaggagattgtggatgtggatcgtgaacctggcggcagcgcaaaagatg

SEQ ID NO: 81711 - DNA, 103 bp, Artificial Sequence
  Synthetic Polynucleotide
taatacgactcactatagggatgcctgcgtgccgtatcacgatccacctcaacagaggagagaggtgatgcgtgatacgaacctggcggcagcgcaaaagatg

SEQ ID NO: 81712 - DNA, 103 bp, Artificial Sequence
  Synthetic Polynucleotide
taatacgactcactataggggccaaatgcctgcgtgccgtatcacgatccaacagaggagaggatcgatgtacggcacgaacctggcggcagcgcaaaagatg

SEQ ID NO: 81713 - DNA, 103 bp, Artificial Sequence
  Synthetic Polynucleotide
taatacgactcactatagggtttcttgccgggtcttcaaaccatggttttaacagaggagaaaaaccatggtttgaagaaacctggcggcagcgcaaaagatg

SEQ ID NO: 81714 - DNA, 103 bp, Artificial Sequence
  Synthetic Polynucleotide
taatacgactcactatagggcttcggccaaatgcctgcgtgccgtatcacaacagaggagagtgataatgcacgcaggcaacctggcggcagcgcaaaagatg

SEQ ID NO: 81715 - DNA, 103 bp, Artificial Sequence
  Synthetic Polynucleotide
taatacgactcactatagggcttcccttcggccaaatgcctgcgtgccgtaacagaggagaacggcaatgaggcatttgaacctggcggcagcgcaaaagatg

SEQ ID NO: 81716 - DNA, 103 bp, Artificial Sequence
  Synthetic Polynucleotide
taatacgactcactatagggtccaccttcccttcggccaaatgcctgcgtaacagaggagaacgcagatgtttggccgaaacctggcggcagcgcaaaagatg

SEQ ID NO: 81717 - DNA, 103 bp, Artificial Sequence
  Synthetic Polynucleotide
taatacgactcactatagggcggtgtccaccttcccttcggccaaatgccaacagaggagaggcattatgccgaagggaaacctggcggcagcgcaaaagatg

SEQ ID NO: 81718 - DNA, 103 bp, Artificial Sequence
  Synthetic Polynucleotide
taatacgactcactatagggcaccccggtgtccaccttcccttcggccaaaacagaggagattggccatggggaaggtgaacctggcggcagcgcaaaagatg

SEQ ID NO: 81719 - DNA, 103 bp, Artificial Sequence
  Synthetic Polynucleotide
taatacgactcactatagggaccgccaccccggtgtccaccttcccttcgaacagaggagacgaaggatgggtggacacaacctggcggcagcgcaaaagatg

SEQ ID NO: 81720 - DNA, 103 bp, Artificial Sequence
  Synthetic Polynucleotide
taatacgactcactatagggtggagaccgccaccccggtgtccaccttccaacagaggagaggaaggatgacaccggggaacctggcggcagcgcaaaagatg

SEQ ID NO: 81721 - DNA, 103 bp, Artificial Sequence
  Synthetic Polynucleotide
taatacgactcactatagggccccctggagaccgccaccccggtgtccacaacagaggagagtggacatgggggtggcgaacctggcggcagcgcaaaagatg

SEQ ID NO: 81722 - DNA, 103 bp, Artificial Sequence
  Synthetic Polynucleotide
taatacgactcactataggggcggtccccctggagaccgccaccccggtgaacagaggagacaccggatgggcggtctcaacctggcggcagcgcaaaagatg

SEQ ID NO: 81723 - DNA, 103 bp, Artificial Sequence
  Synthetic Polynucleotide
taatacgactcactatagggactttgcggtccccctggagaccgccacccaacagaggagagggtggatgtctccagggaacctggcggcagcgcaaaagatg

SEQ ID NO: 81724 - DNA, 103 bp, Artificial Sequence
  Synthetic Polynucleotide
taatacgactcactatagggccatttttcttgccgggtcttcaaaccatgaacagaggagacatggtatgaagacccggaacctggcggcagcgcaaaagatg

SEQ ID NO: 81725 - DNA, 103 bp, Artificial Sequence
  Synthetic Polynucleotide
taatacgactcactatagggccttaactttgcggtccccctggagaccgcaacagaggagagcggtcatgagggggaccaacctggcggcagcgcaaaagatg

SEQ ID NO: 81726 - DNA, 103 bp, Artificial Sequence
  Synthetic Polynucleotide
taatacgactcactatagggaaccaccttaactttgcggtccccctggagaacagaggagactccagatggaccgcaaaaacctggcggcagcgcaaaagatg

SEQ ID NO: 81727 - DNA, 103 bp, Artificial Sequence
  Synthetic Polynucleotide
taatacgactcactatagggcatggaaccaccttaactttgcggtcccccaacagaggagagggggaatgcaaagttaaaacctggcggcagcgcaaaagatg

SEQ ID NO: 81728 - DNA, 103 bp, Artificial Sequence
  Synthetic Polynucleotide
taatacgactcactatagggacgctcatggaaccaccttaactttgcggtaacagaggagaaccgcaatgttaaggtggaacctggcggcagcgcaaaagatg

SEQ ID NO: 81729 - DNA, 103 bp, Artificial Sequence
  Synthetic Polynucleotide
taatacgactcactatagggtagccacgctcatggaaccaccttaactttaacagaggagaaaagttatggtggttccaaacctggcggcagcgcaaaagatg

SEQ ID NO: 81730 - DNA, 103 bp, Artificial Sequence
  Synthetic Polynucleotide
taatacgactcactatagggtgacatagccacgctcatggaaccaccttaaacagaggagataaggtatgtccatgagcaacctggcggcagcgcaaaagatg

SEQ ID NO: 81731 - DNA, 103 bp, Artificial Sequence
  Synthetic Polynucleotide
taatacgactcactatagggcagcttgacatagccacgctcatggaaccaaacagaggagatggttcatggagcgtggcaacctggcggcagcgcaaaagatg

SEQ ID NO: 81732 - DNA, 103 bp, Artificial Sequence
  Synthetic Polynucleotide
taatacgactcactatagggccttccagcttgacatagccacgctcatggaacagaggagaccatgaatgtggctatgtaacctggcggcagcgcaaaagatg

SEQ ID NO: 81733 - DNA, 103 bp, Artificial Sequence
  Synthetic Polynucleotide
taatacgactcactatagggccctaccttccagcttgacatagccacgctaacagaggagaagcgtgatgatgtcaagcaacctggcggcagcgcaaaagatg

SEQ ID NO: 81734 - DNA, 103 bp, Artificial Sequence
  Synthetic Polynucleotide
taatacgactcactatagggaatcaccctaccttccagcttgacatagccaacagaggagaggctatatgaagctggaaaacctggcggcagcgcaaaagatg

SEQ ID NO: 81735 - DNA, 103 bp, Artificial Sequence
  Synthetic Polynucleotide
taatacgactcactataggggtcatccatttttcttgccgggtcttcaaaaacagaggagatttgaaatgccggcaagaaacctggcggcagcgcaaaagatg

SEQ ID NO: 81736 - DNA, 103 bp, Artificial Sequence
  Synthetic Polynucleotide
taatacgactcactatagggaggtcaatcaccctaccttccagcttgacaaacagaggagatgtcaaatgggaaggtagaacctggcggcagcgcaaaagatg

SEQ ID NO: 81737 - DNA, 103 bp, Artificial Sequence
  Synthetic Polynucleotide
taatacgactcactatagggaccccaggtcaatcaccctaccttccagctaacagaggagaagctggatggtagggtgaaacctggcggcagcgcaaaagatg

SEQ ID NO: 81738 - DNA, 103 bp, Artificial Sequence
  Synthetic Polynucleotide
taatacgactcactataggggccacaccccaggtcaatcaccctaccttcaacagaggagagaaggtatggtgattgacaacctggcggcagcgcaaaagatg

SEQ ID NO: 81739 - DNA, 103 bp, Artificial Sequence
  Synthetic Polynucleotide
taatacgactcactatagggccgcggccacaccccaggtcaatcaccctaaacagaggagatagggtatgtgacctgggaacctggcggcagcgcaaaagatg

SEQ ID NO: 81740 - DNA, 103 bp, Artificial Sequence
  Synthetic Polynucleotide
taatacgactcactatagggagcctccgcggccacaccccaggtcaatcaaacagaggagatgattgatgtggggtgtgaacctggcggcagcgcaaaagatg

SEQ ID NO: 81741 - DNA, 103 bp, Artificial Sequence
  Synthetic Polynucleotide
taatacgactcactatagggacaccagcctccgcggccacaccccaggtcaacagaggagagacctgatgtgtggccgcaacctggcggcagcgcaaaagatg

SEQ ID NO: 81742 - DNA, 103 bp, Artificial Sequence
  Synthetic Polynucleotide
taatacgactcactatagggtagtaacaccagcctccgcggccacaccccaacagaggagaggggtgatgccgcggaggaacctggcggcagcgcaaaagatg

SEQ ID NO: 81743 - DNA, 103 bp, Artificial Sequence
  Synthetic Polynucleotide
taatacgactcactatagggcagcgtagtaacaccagcctccgcggccacaacagaggagagtggccatggaggctggtaacctggcggcagcgcaaaagatg

SEQ ID NO: 81744 - DNA, 103 bp, Artificial Sequence
  Synthetic Polynucleotide
taatacgactcactatagggcgcagcagcgtagtaacaccagcctccgcgaacagaggagacgcggaatgtggtgttacaacctggcggcagcgcaaaagatg

SEQ ID NO: 81745 - DNA, 103 bp, Artificial Sequence
  Synthetic Polynucleotide
taatacgactcactatagggttttgcgcagcagcgtagtaacaccagcctaacagaggagaaggctgatgttactacgcaacctggcggcagcgcaaaagatg

SEQ ID NO: 81746 - DNA, 103 bp, Artificial Sequence
  Synthetic Polynucleotide
taatacgactcactatagggttccagtcatccatttttcttgccgggtctaacagaggagaagacccatgaagaaaaataacctggcggcagcgcaaaagatg

SEQ ID NO: 81747 - DNA, 103 bp, Artificial Sequence
  Synthetic Polynucleotide
taatacgactcactatagggcttccttttgcgcagcagcgtagtaacaccaacagaggagaggtgttatgacgctgctgaacctggcggcagcgcaaaagatg

SEQ ID NO: 81748 - DNA, 103 bp, Artificial Sequence
  Synthetic Polynucleotide
taatacgactcactatagggactcacttccttttgcgcagcagcgtagtaaacagaggagatactacatggctgcgcaaaacctggcggcagcgcaaaagatg

SEQ ID NO: 81749 - DNA, 103 bp, Artificial Sequence
  Synthetic Polynucleotide
taatacgactcactatagggaccccactcacttccttttgcgcagcagcgaacagaggagacgctgcatggcaaaaggaaacctggcggcagcgcaaaagatg

SEQ ID NO: 81750 - DNA, 103 bp, Artificial Sequence
  Synthetic Polynucleotide
taatacgactcactatagggctttgaccccactcacttccttttgcgcagaacagaggagactgcgcatgaggaagtgaaacctggcggcagcgcaaaagatg

SEQ ID NO: 81751 - DNA, 103 bp, Artificial Sequence
  Synthetic Polynucleotide
taatacgactcactatagggaaatcctttgaccccactcacttccttttgaacagaggagacaaaagatggtgagtgggaacctggcggcagcgcaaaagatg

SEQ ID NO: 81752 - DNA, 103 bp, Artificial Sequence
  Synthetic Polynucleotide
taatacgactcactatagggagagtaaatcctttgaccccactcacttccaacagaggagaggaagtatgtggggtcaaaacctggcggcagcgcaaaagatg

SEQ ID NO: 81753 - DNA, 103 bp, Artificial Sequence
  Synthetic Polynucleotide
taatacgactcactatagggttccaagagtaaatcctttgaccccactcaaacagaggagatgagtgatgtcaaaggataacctggcggcagcgcaaaagatg

SEQ ID NO: 81754 - DNA, 103 bp, Artificial Sequence
  Synthetic Polynucleotide
taatacgactcactataggggtctcttccaagagtaaatcctttgaccccaacagaggagaggggtcatgggatttactaacctggcggcagcgcaaaagatg

SEQ ID NO: 81755 - DNA, 103 bp, Artificial Sequence
  Synthetic Polynucleotide
taatacgactcactatagggtggccgtctcttccaagagtaaatcctttgaacagaggagacaaaggatgtactcttggaacctggcggcagcgcaaaagatg

SEQ ID NO: 81756 - DNA, 103 bp, Artificial Sequence
  Synthetic Polynucleotide
taatacgactcactatagggtctcatggccgtctcttccaagagtaaatcaacagaggagagatttaatgttggaagagaacctggcggcagcgcaaaagatg

SEQ ID NO: 81757 - DNA, 103 bp, Artificial Sequence
  Synthetic Polynucleotide
taatacgactcactatagggcattcttccagtcatccatttttcttgccgaacagaggagacggcaaatgaaatggatgaacctggcggcagcgcaaaagatg

SEQ ID NO: 81758 - DNA, 103 bp, Artificial Sequence
  Synthetic Polynucleotide
taatacgactcactataggggggtttctcatggccgtctcttccaagagtaacagaggagaactcttatgagagacggcaacctggcggcagcgcaaaagatg

SEQ ID NO: 81759 - DNA, 103 bp, Artificial Sequence
  Synthetic Polynucleotide
taatacgactcactatagggttcatgggtttctcatggccgtctcttccaaacagaggagatggaagatgcggccatgaaacctggcggcagcgcaaaagatg

SEQ ID NO: 81760 - DNA, 103 bp, Artificial Sequence
  Synthetic Polynucleotide
taatacgactcactataggggcacattcatgggtttctcatggccgtctcaacagaggagagagacgatgatgagaaacaacctggcggcagcgcaaaagatg

SEQ ID NO: 81761 - DNA, 103 bp, Artificial Sequence
  Synthetic Polynucleotide
taatacgactcactatagggactttgcacattcatgggtttctcatggccaacagaggagaggccatatgaaacccatgaacctggcggcagcgcaaaagatg

SEQ ID NO: 81762 - DNA, 103 bp, Artificial Sequence
  Synthetic Polynucleotide
taatacgactcactatagggcccagactttgcacattcatgggtttctcaaacagaggagatgagaaatgcatgaatgtaacctggcggcagcgcaaaagatg

SEQ ID NO: 81763 - DNA, 103 bp, Artificial Sequence
  Synthetic Polynucleotide
taatacgactcactatagggtccatcccagactttgcacattcatgggttaacagaggagaaacccaatgatgtgcaaaaacctggcggcagcgcaaaagatg

SEQ ID NO: 81764 - DNA, 103 bp, Artificial Sequence
  Synthetic Polynucleotide
taatacgactcactataggggatgttccatcccagactttgcacattcataacagaggagaatgaatatgcaaagtctgaacctggcggcagcgcaaaagatg

SEQ ID NO: 81765 - DNA, 103 bp, Artificial Sequence
  Synthetic Polynucleotide
taatacgactcactataggggtgatgatgttccatcccagactttgcacaaacagaggagatgtgcaatgtctgggatgaacctggcggcagcgcaaaagatg

SEQ ID NO: 81766 - DNA, 103 bp, Artificial Sequence
  Synthetic Polynucleotide
taatacgactcactatagggtgaaggtgatgatgttccatcccagactttaacagaggagaaaagtcatggatggaacaaacctggcggcagcgcaaaagatg

SEQ ID NO: 81767 - DNA, 103 bp, Artificial Sequence
  Synthetic Polynucleotide
taatacgactcactataggggtccttgaaggtgatgatgttccatcccagaacagaggagactgggaatgaacatcatcaacctggcggcagcgcaaaagatg

SEQ ID NO: 81768 - DNA, 103 bp, Artificial Sequence
  Synthetic Polynucleotide
taatacgactcactatagggctctgctaatcgctcaacgaacgattaaaaaacagaggagattttaaatgttcgttgagaacctggcggcagcgcaaaagatg

SEQ ID NO: 81769 - DNA, 103 bp, Artificial Sequence
  Synthetic Polynucleotide
taatacgactcactatagggtcacccattcttccagtcatccatttttctaacagaggagaagaaaaatggatgactggaacctggcggcagcgcaaaagatg

SEQ ID NO: 81770 - DNA, 103 bp, Artificial Sequence
  Synthetic Polynucleotide
taatacgactcactataggggttttgtccttgaaggtgatgatgttccataacagaggagaatggaaatgcatcaccttaacctggcggcagcgcaaaagatg

SEQ ID NO: 81771 - DNA, 103 bp, Artificial Sequence
  Synthetic Polynucleotide
taatacgactcactatagggtatcagttttgtccttgaaggtgatgatgtaacagaggagaacatcaatgccttcaaggaacctggcggcagcgcaaaagatg

SEQ ID NO: 81772 - DNA, 103 bp, Artificial Sequence
  Synthetic Polynucleotide
taatacgactcactataggggtggatatcagttttgtccttgaaggtgataacagaggagaatcaccatgaaggacaaaaacctggcggcagcgcaaaagatg

SEQ ID NO: 81773 - DNA, 103 bp, Artificial Sequence
  Synthetic Polynucleotide
taatacgactcactatagggaggcggtggatatcagttttgtccttgaagaacagaggagacttcaaatgcaaaactgaaacctggcggcagcgcaaaagatg

SEQ ID NO: 81774 - DNA, 103 bp, Artificial Sequence
  Synthetic Polynucleotide
taatacgactcactataggggttctaggcggtggatatcagttttgtcctaacagaggagaaggacaatgctgatatccaacctggcggcagcgcaaaagatg

SEQ ID NO: 81775 - DNA, 103 bp, Artificial Sequence
  Synthetic Polynucleotide
taatacgactcactatagggcactggttctaggcggtggatatcagttttaacagaggagaaaaactatgatccaccgcaacctggcggcagcgcaaaagatg

SEQ ID NO: 81776 - DNA, 103 bp, Artificial Sequence
  Synthetic Polynucleotide
taatacgactcactatagggcatttcactggttctaggcggtggatatcaaacagaggagatgatatatgccgcctagaaacctggcggcagcgcaaaagatg

SEQ ID NO: 81777 - DNA, 103 bp, Artificial Sequence
  Synthetic Polynucleotide
taatacgactcactatagggtgtcacatttcactggttctaggcggtggaaacagaggagatccaccatgtagaaccagaacctggcggcagcgcaaaagatg

SEQ ID NO: 81778 - DNA, 103 bp, Artificial Sequence
  Synthetic Polynucleotide
taatacgactcactatagggaagggtgtcacatttcactggttctaggcgaacagaggagacgcctaatgccagtgaaaaacctggcggcagcgcaaaagatg

SEQ ID NO: 81779 - DNA, 103 bp, Artificial Sequence
  Synthetic Polynucleotide
taatacgactcactatagggcacaaaagggtgtcacatttcactggttctaacagaggagaagaaccatggaaatgtgaaacctggcggcagcgcaaaagatg

SEQ ID NO: 81780 - DNA, 103 bp, Artificial Sequence
  Synthetic Polynucleotide
taatacgactcactataggggcctttcacccattcttccagtcatccattaacagaggagaaatggaatgctggaagaaaacctggcggcagcgcaaaagatg

SEQ ID NO: 81781 - DNA, 103 bp, Artificial Sequence
  Synthetic Polynucleotide
taatacgactcactatagggtgtcacacaaaagggtgtcacatttcactgaacagaggagacagtgaatggtgacacccaacctggcggcagcgcaaaagatg

SEQ ID NO: 81782 - DNA, 103 bp, Artificial Sequence
  Synthetic Polynucleotide
taatacgactcactatagggtccaatgtcacacaaaagggtgtcacatttaacagaggagaaaatgtatgacccttttgaacctggcggcagcgcaaaagatg

SEQ ID NO: 81783 - DNA, 103 bp, Artificial Sequence
  Synthetic Polynucleotide
taatacgactcactataggggactctccaatgtcacacaaaagggtgtcaaacagaggagatgacacatgtttgtgtgaaacctggcggcagcgcaaaagatg

SEQ ID NO: 81784 - DNA, 103 bp, Artificial Sequence
  Synthetic Polynucleotide
taatacgactcactatagggatgatgactctccaatgtcacacaaaagggaacagaggagaccctttatggtgacattgaacctggcggcagcgcaaaagatg

SEQ ID NO: 81785 - DNA, 103 bp, Artificial Sequence
  Synthetic Polynucleotide
taatacgactcactatagggtgacgatgatgactctccaatgtcacacaaaacagaggagattgtgtatgattggagagaacctggcggcagcgcaaaagatg

SEQ ID NO: 81786 - DNA, 103 bp, Artificial Sequence
  Synthetic Polynucleotide
taatacgactcactatagggaccgatgacgatgatgactctccaatgtcaaacagaggagatgacatatgagagtcatcaacctggcggcagcgcaaaagatg

SEQ ID NO: 81787 - DNA, 103 bp, Artificial Sequence
  Synthetic Polynucleotide
taatacgactcactatagggctgtgaccgatgacgatgatgactctccaaaacagaggagattggagatgcatcatcgtaacctggcggcagcgcaaaagatg

SEQ ID NO: 81788 - DNA, 103 bp, Artificial Sequence
  Synthetic Polynucleotide
taatacgactcactatagggcccctctgtgaccgatgacgatgatgactcaacagaggagagagtcaatgtcgtcatcgaacctggcggcagcgcaaaagatg

SEQ ID NO: 81789 - DNA, 103 bp, Artificial Sequence
  Synthetic Polynucleotide
taatacgactcactatagggctttccccctctgtgaccgatgacgatgataacagaggagaatcatcatgatcggtcacaacctggcggcagcgcaaaagatg

SEQ ID NO: 81790 - DNA, 103 bp, Artificial Sequence
  Synthetic Polynucleotide
taatacgactcactatagggcggtcctttccccctctgtgaccgatgacgaacagaggagacgtcatatgtcacagaggaacctggcggcagcgcaaaagatg

SEQ ID NO: 81791 - DNA, 103 bp, Artificial Sequence
  Synthetic Polynucleotide
taatacgactcactataggggagttgcctttcacccattcttccagtcataacagaggagaatgactatgagaatgggtaacctggcggcagcgcaaaagatg

SEQ ID NO: 81792 - DNA, 103 bp, Artificial Sequence
  Synthetic Polynucleotide
taatacgactcactatagggtctcacggtcctttccccctctgtgaccgaaacagaggagatcggtcatggagggggaaaacctggcggcagcgcaaaagatg

SEQ ID NO: 81793 - DNA, 103 bp, Artificial Sequence
  Synthetic Polynucleotide
taatacgactcactatagggagaactctcacggtcctttccccctctgtgaacagaggagacacagaatgggaaaggacaacctggcggcagcgcaaaagatg

SEQ ID NO: 81794 - DNA, 103 bp, Artificial Sequence
  Synthetic Polynucleotide
taatacgactcactatagggtatcaagaactctcacggtcctttccccctaacagaggagaagggggatgggaccgtgaaacctggcggcagcgcaaaagatg

SEQ ID NO: 81795 - DNA, 103 bp, Artificial Sequence
  Synthetic Polynucleotide
taatacgactcactatagggtacagtatcaagaactctcacggtcctttcaacagaggagagaaaggatggtgagagttaacctggcggcagcgcaaaagatg

SEQ ID NO: 81796 - DNA, 103 bp, Artificial Sequence
  Synthetic Polynucleotide
taatacgactcactatagggttttctacagtatcaagaactctcacggtcaacagaggagagaccgtatgagttcttgaaacctggcggcagcgcaaaagatg

SEQ ID NO: 81797 - DNA, 103 bp, Artificial Sequence
  Synthetic Polynucleotide
taatacgactcactataggggccatttttctacagtatcaagaactctcaaacagaggagatgagagatgttgatactgaacctggcggcagcgcaaaagatg

SEQ ID NO: 81798 - DNA, 103 bp, Artificial Sequence
  Synthetic Polynucleotide
taatacgactcactatagggagccagccatttttctacagtatcaagaacaacagaggagagttcttatgactgtagaaaacctggcggcagcgcaaaagatg

SEQ ID NO: 81799 - DNA, 103 bp, Artificial Sequence
  Synthetic Polynucleotide
taatacgactcactatagggccacaagccagccatttttctacagtatcaaacagaggagatgatacatgagaaaaatgaacctggcggcagcgcaaaagatg

SEQ ID NO: 81800 - DNA, 103 bp, Artificial Sequence
  Synthetic Polynucleotide
taatacgactcactatagggcaaccccacaagccagccatttttctacagaacagaggagactgtagatgaatggctggaacctggcggcagcgcaaaagatg

SEQ ID NO: 81801 - DNA, 103 bp, Artificial Sequence
  Synthetic Polynucleotide
taatacgactcactataggggttgtcaaccccacaagccagccatttttcaacagaggagagaaaaaatgctggcttgtaacctggcggcagcgcaaaagatg

SEQ ID NO: 81802 - DNA, 103 bp, Artificial Sequence
  Synthetic Polynucleotide
taatacgactcactatagggttttggagttgcctttcacccattcttccaaacagaggagatggaagatggggtgaaagaacctggcggcagcgcaaaagatg

SEQ ID NO: 81803 - DNA, 103 bp, Artificial Sequence
  Synthetic Polynucleotide
taatacgactcactatagggcagaagttgtcaaccccacaagccagccataacagaggagaatggctatgttgtggggtaacctggcggcagcgcaaaagatg

SEQ ID NO: 81804 - DNA, 103 bp, Artificial Sequence
  Synthetic Polynucleotide
taatacgactcactatagggtcacacagaagttgtcaaccccacaagccaaacagaggagatggcttatggggttgacaaacctggcggcagcgcaaaagatg

SEQ ID NO: 81805 - DNA, 103 bp, Artificial Sequence
  Synthetic Polynucleotide
taatacgactcactatagggcaccttcacacagaagttgtcaaccccacaaacagaggagatgtgggatggacaacttcaacctggcggcagcgcaaaagatg

SEQ ID NO: 81806 - DNA, 103 bp, Artificial Sequence
  Synthetic Polynucleotide
taatacgactcactataggggctaacaccttcacacagaagttgtcaaccaacagaggagaggttgaatgcttctgtgtaacctggcggcagcgcaaaagatg

SEQ ID NO: 81807 - DNA, 103 bp, Artificial Sequence
  Synthetic Polynucleotide
taatacgactcactatagggatggagctaacaccttcacacagaagttgtaacagaggagaacaactatggtgtgaaggaacctggcggcagcgcaaaagatg

SEQ ID NO: 81808 - DNA, 103 bp, Artificial Sequence
  Synthetic Polynucleotide
taatacgactcactatagggcatgtatggagctaacaccttcacacagaaaacagaggagattctgtatgaaggtgttaaacctggcggcagcgcaaaagatg

SEQ ID NO: 81809 - DNA, 103 bp, Artificial Sequence
  Synthetic Polynucleotide
taatacgactcactatagggtctggcatgtatggagctaacaccttcacaaacagaggagatgtgaaatggttagctccaacctggcggcagcgcaaaagatg

SEQ ID NO: 81810 - DNA, 103 bp, Artificial Sequence
  Synthetic Polynucleotide
taatacgactcactataggggaacatctggcatgtatggagctaacacctaacagaggagaaggtgtatgctccatacaaacctggcggcagcgcaaaagatg

SEQ ID NO: 81811 - DNA, 103 bp, Artificial Sequence
  Synthetic Polynucleotide
taatacgactcactatagggctcgagaacatctggcatgtatggagctaaaacagaggagattagctatgtacatgccaaacctggcggcagcgcaaaagatg

SEQ ID NO: 81812 - DNA, 103 bp, Artificial Sequence
  Synthetic Polynucleotide
taatacgactcactatagggagtttctcgagaacatctggcatgtatggaaacagaggagatccataatggccagatgtaacctggcggcagcgcaaaagatg

SEQ ID NO: 81813 - DNA, 103 bp, Artificial Sequence
  Synthetic Polynucleotide
taatacgactcactatagggcaatcttttggagttgcctttcacccattcaacagaggagagaatggatgaaaggcaacaacctggcggcagcgcaaaagatg

SEQ ID NO: 81814 - DNA, 103 bp, Artificial Sequence
  Synthetic Polynucleotide
taatacgactcactatagggattccagtttctcgagaacatctggcatgtaacagaggagaacatgcatgatgttctcgaacctggcggcagcgcaaaagatg

SEQ ID NO: 81815 - DNA, 103 bp, Artificial Sequence
  Synthetic Polynucleotide
taatacgactcactataggggagcaattccagtttctcgagaacatctggaacagaggagaccagatatgctcgagaaaaacctggcggcagcgcaaaagatg

SEQ ID NO: 81816 - DNA, 103 bp, Artificial Sequence
  Synthetic Polynucleotide
taatacgactcactatagggctttggagcaattccagtttctcgagaacaaacagaggagatgttctatggaaactggaaacctggcggcagcgcaaaagatg

SEQ ID NO: 81817 - DNA, 103 bp, Artificial Sequence
  Synthetic Polynucleotide
taatacgactcactatagggacctcctttggagcaattccagtttctcgaaacagaggagatcgagaatgtggaattgcaacctggcggcagcgcaaaagatg

SEQ ID NO: 81818 - DNA, 103 bp, Artificial Sequence
  Synthetic Polynucleotide
taatacgactcactataggggccaaacctcctttggagcaattccagtttaacagaggagaaaactgatgttgctccaaaacctggcggcagcgcaaaagatg

SEQ ID NO: 81819 - DNA, 103 bp, Artificial Sequence
  Synthetic Polynucleotide
taatacgactcactataggggttccgccaaacctcctttggagcaattccaacagaggagaggaattatgccaaaggagaacctggcggcagcgcaaaagatg

SEQ ID NO: 81820 - DNA, 103 bp, Artificial Sequence
  Synthetic Polynucleotide
taatacgactcactatagggtcactgttccgccaaacctcctttggagcaaacagaggagatgctccatgggaggtttgaacctggcggcagcgcaaaagatg

SEQ ID NO: 81821 - DNA, 103 bp, Artificial Sequence
  Synthetic Polynucleotide
taatacgactcactatagggcctgatcactgttccgccaaacctcctttgaacagaggagacaaaggatgtttggcggaaacctggcggcagcgcaaaagatg

SEQ ID NO: 81822 - DNA, 103 bp, Artificial Sequence
  Synthetic Polynucleotide
taatacgactcactataggggggttcctgatcactgttccgccaaacctcaacagaggagagaggttatgcggaacagtaacctggcggcagcgcaaaagatg

SEQ ID NO: 81823 - DNA, 103 bp, Artificial Sequence
  Synthetic Polynucleotide
taatacgactcactatagggagagagggttcctgatcactgttccgccaaaacagaggagattggcgatgcagtgatcaaacctggcggcagcgcaaaagatg

SEQ ID NO: 81824 - DNA, 103 bp, Artificial Sequence
  Synthetic Polynucleotide
taatacgactcactatagggtctctcaatcttttggagttgcctttcaccaacagaggagaggtgaaatgcaactccaaaacctggcggcagcgcaaaagatg

SEQ ID NO: 81825 - DNA, 103 bp, Artificial Sequence
  Synthetic Polynucleotide
taatacgactcactatagggcctggagagagggttcctgatcactgttccaacagaggagaggaacaatgatcaggaacaacctggcggcagcgcaaaagatg

SEQ ID NO: 81826 - DNA, 103 bp, Artificial Sequence
  Synthetic Polynucleotide
taatacgactcactataggggaattcctggagagagggttcctgatcactaacagaggagaagtgatatggaaccctctaacctggcggcagcgcaaaagatg

SEQ ID NO: 81827 - DNA, 103 bp, Artificial Sequence
  Synthetic Polynucleotide
taatacgactcactataggggagtggaattcctggagagagggttcctgaaacagaggagatcaggaatgctctctccaaacctggcggcagcgcaaaagatg

SEQ ID NO: 81828 - DNA, 103 bp, Artificial Sequence
  Synthetic Polynucleotide
taatacgactcactatagggttcatgagtggaattcctggagagagggttaacagaggagaaaccctatgtccaggaataacctggcggcagcgcaaaagatg

SEQ ID NO: 81829 - DNA, 103 bp, Artificial Sequence
  Synthetic Polynucleotide
taatacgactcactatagggtacatttcatgagtggaattcctggagagaaacagaggagatctctcatggaattccacaacctggcggcagcgcaaaagatg

SEQ ID NO: 81830 - DNA, 103 bp, Artificial Sequence
  Synthetic Polynucleotide
taatacgactcactatagggcgtagtacatttcatgagtggaattcctggaacagaggagaccaggaatgccactcatgaacctggcggcagcgcaaaagatg

SEQ ID NO: 81831 - DNA, 103 bp, Artificial Sequence
  Synthetic Polynucleotide
taatacgactcactatagggagacacgtagtacatttcatgagtggaattaacagaggagaaattccatgcatgaaatgaacctggcggcagcgcaaaagatg

SEQ ID NO: 81832 - DNA, 103 bp, Artificial Sequence
  Synthetic Polynucleotide
taatacgactcactataggggctccagacacgtagtacatttcatgagtgaacagaggagacactcaatgaatgtactaaacctggcggcagcgcaaaagatg

SEQ ID NO: 81833 - DNA, 103 bp, Artificial Sequence
  Synthetic Polynucleotide
taatacgactcactatagggtgcgggctccagacacgtagtacatttcataacagaggagaatgaaaatgactacgtgtaacctggcggcagcgcaaaagatg

SEQ ID NO: 81834 - DNA, 103 bp, Artificial Sequence
  Synthetic Polynucleotide
taatacgactcactatagggattgctgcgggctccagacacgtagtacataacagaggagaatgtacatggtgtctggaaacctggcggcagcgcaaaagatg

SEQ ID NO: 81835 - DNA, 103 bp, Artificial Sequence
  Synthetic Polynucleotide
taatacgactcactatagggaaccatctctcaatcttttggagttgccttaacagaggagaaaggcaatgccaaaagataacctggcggcagcgcaaaagatg

SEQ ID NO: 81836 - DNA, 103 bp, Artificial Sequence
  Synthetic Polynucleotide
taatacgactcactataggggtgacattgctgcgggctccagacacgtagaacagaggagactacgtatgtggagcccgaacctggcggcagcgcaaaagatg

SEQ ID NO: 81837 - DNA, 103 bp, Artificial Sequence
  Synthetic Polynucleotide
taatacgactcactatagggtaaatgtgacattgctgcgggctccagacaaacagaggagatgtctgatgcccgcagcaaacctggcggcagcgcaaaagatg

SEQ ID NO: 81838 - DNA, 103 bp, Artificial Sequence
  Synthetic Polynucleotide
taatacgactcactatagggcacagtaaatgtgacattgctgcgggctccaacagaggagaggagccatgagcaatgtcaacctggcggcagcgcaaaagatg

SEQ ID NO: 81839 - DNA, 103 bp, Artificial Sequence
  Synthetic Polynucleotide
taatacgactcactatagggtggttcacagtaaatgtgacattgctgcggaacagaggagaccgcagatgtgtcacattaacctggcggcagcgcaaaagatg

SEQ ID NO: 81840 - DNA, 103 bp, Artificial Sequence
  Synthetic Polynucleotide
taatacgactcactatagggatgtttggttcacagtaaatgtgacattgcaacagaggagagcaatgatgcatttactgaacctggcggcagcgcaaaagatg

SEQ ID NO: 81841 - DNA, 103 bp, Artificial Sequence
  Synthetic Polynucleotide
taatacgactcactataggggcgggatgtttggttcacagtaaatgtgacaacagaggagagtcacaatgactgtgaacaacctggcggcagcgcaaaagatg

SEQ ID NO: 81842 - DNA, 103 bp, Artificial Sequence
  Synthetic Polynucleotide
taatacgactcactatagggaggaggcgggatgtttggttcacagtaaataacagaggagaatttacatggaaccaaacaacctggcggcagcgcaaaagatg

SEQ ID NO: 81843 - DNA, 103 bp, Artificial Sequence
  Synthetic Polynucleotide
taatacgactcactatagggtcatcaggaggcgggatgtttggttcacagaacagaggagactgtgaatgaaacatcccaacctggcggcagcgcaaaagatg

SEQ ID NO: 81844 - DNA, 103 bp, Artificial Sequence
  Synthetic Polynucleotide
taatacgactcactatagggtctcctcatcaggaggcgggatgtttggttaacagaggagaaaccaaatgtcccgcctcaacctggcggcagcgcaaaagatg

SEQ ID NO: 81845 - DNA, 103 bp, Artificial Sequence
  Synthetic Polynucleotide
taatacgactcactatagggctcattctcctcatcaggaggcgggatgttaacagaggagaaacatcatgcctcctgataacctggcggcagcgcaaaagatg

SEQ ID NO: 81846 - DNA, 103 bp, Artificial Sequence
  Synthetic Polynucleotide
taatacgactcactatagggtcacgaaccatctctcaatcttttggagttaacagaggagaaactccatgagattgagaaacctggcggcagcgcaaaagatg

SEQ ID NO: 81847 - DNA, 103 bp, Artificial Sequence
  Synthetic Polynucleotide
taatacgactcactataggggacgcctcattctcctcatcaggaggcgggaacagaggagacccgccatgtgatgaggaaacctggcggcagcgcaaaagatg

SEQ ID NO: 81848 - DNA, 103 bp, Artificial Sequence
  Synthetic Polynucleotide
taatacgactcactatagggagttggacgcctcattctcctcatcaggagaacagaggagactcctgatgaggagaatgaacctggcggcagcgcaaaagatg

SEQ ID NO: 81849 - DNA, 103 bp, Artificial Sequence
  Synthetic Polynucleotide
taatacgactcactatagggtttccagttggacgcctcattctcctcatcaacagaggagagatgagatgaatgaggcgaacctggcggcagcgcaaaagatg

SEQ ID NO: 81850 - DNA, 103 bp, Artificial Sequence
  Synthetic Polynucleotide
taatacgactcactatagggtcacttttccagttggacgcctcattctccaacagaggagaggagaaatgggcgtccaaaacctggcggcagcgcaaaagatg

SEQ ID NO: 81851 - DNA, 103 bp, Artificial Sequence
  Synthetic Polynucleotide
taatacgactcactatagggcagggtcacttttccagttggacgcctcataacagaggagaatgaggatgccaactggaaacctggcggcagcgcaaaagatg

SEQ ID NO: 81852 - DNA, 103 bp, Artificial Sequence
  Synthetic Polynucleotide
taatacgactcactataggggcctccagggtcacttttccagttggacgcaacagaggagagcgtccatgtggaaaagtaacctggcggcagcgcaaaagatg

SEQ ID NO: 81853 - DNA, 103 bp, Artificial Sequence
  Synthetic Polynucleotide
taatacgactcactatagggcgtcagcctccagggtcacttttccagttgaacagaggagacaactgatgaagtgacccaacctggcggcagcgcaaaagatg

SEQ ID NO: 81854 - DNA, 103 bp, Artificial Sequence
  Synthetic Polynucleotide
taatacgactcactataggggatgacgtcagcctccagggtcacttttccaacagaggagaggaaaaatgaccctggagaacctggcggcagcgcaaaagatg

SEQ ID NO: 81855 - DNA, 103 bp, Artificial Sequence
  Synthetic Polynucleotide
taatacgactcactataggggggaggatgacgtcagcctccagggtcactaacagaggagaagtgacatgggaggctgaaacctggcggcagcgcaaaagatg

SEQ ID NO: 81856 - DNA, 103 bp, Artificial Sequence
  Synthetic Polynucleotide
taatacgactcactatagggcaattgggaggatgacgtcagcctccagggaacagaggagaccctggatgctgacgtcaaacctggcggcagcgcaaaagatg

SEQ ID NO: 81857 - DNA, 103 bp, Artificial Sequence
  Synthetic Polynucleotide
taatacgactcactataggggttcctcacgaaccatctctcaatcttttgaacagaggagacaaaagatggagagatggaacctggcggcagcgcaaaagatg

SEQ ID NO: 81858 - DNA, 103 bp, Artificial Sequence
  Synthetic Polynucleotide
taatacgactcactatagggtgtcccaattgggaggatgacgtcagcctcaacagaggagagaggctatggtcatcctcaacctggcggcagcgcaaaagatg

SEQ ID NO: 81859 - DNA, 103 bp, Artificial Sequence
  Synthetic Polynucleotide
taatacgactcactatagggctgcgtgtcccaattgggaggatgacgtcaaacagaggagatgacgtatgcctcccaataacctggcggcagcgcaaaagatg

SEQ ID NO: 81860 - DNA, 103 bp, Artificial Sequence
  Synthetic Polynucleotide
taatacgactcactatagggcaacactgcgtgtcccaattgggaggatgaaacagaggagatcatccatgcaattgggaaacctggcggcagcgcaaaagatg

SEQ ID NO: 81861 - DNA, 103 bp, Artificial Sequence
  Synthetic Polynucleotide
taatacgactcactatagggtgtctcaacactgcgtgtcccaattgggagaacagaggagactcccaatggggacacgcaacctggcggcagcgcaaaagatg

SEQ ID NO: 81862 - DNA, 103 bp, Artificial Sequence
  Synthetic Polynucleotide
taatacgactcactatagggttgtctgtctcaacactgcgtgtcccaattaacagaggagaaattggatgacgcagtgtaacctggcggcagcgcaaaagatg

SEQ ID NO: 81863 - DNA, 103 bp, Artificial Sequence
  Synthetic Polynucleotide
taatacgactcactataggggtcccttgtctgtctcaacactgcgtgtccaacagaggagaggacacatggtgttgagaaacctggcggcagcgcaaaagatg

SEQ ID NO: 81864 - DNA, 103 bp, Artificial Sequence
  Synthetic Polynucleotide
taatacgactcactatagggcaggggtcccttgtctgtctcaacactgcgaacagaggagacgcagtatggagacagacaacctggcggcagcgcaaaagatg

SEQ ID NO: 81865 - DNA, 103 bp, Artificial Sequence
  Synthetic Polynucleotide
taatacgactcactatagggttgtccaggggtcccttgtctgtctcaacaaacagaggagatgttgaatgagacaagggaacctggcggcagcgcaaaagatg

SEQ ID NO: 81866 - DNA, 103 bp, Artificial Sequence
  Synthetic Polynucleotide
taatacgactcactatagggcctctttgtccaggggtcccttgtctgtctaacagaggagaagacagatgagggaccccaacctggcggcagcgcaaaagatg

SEQ ID NO: 81867 - DNA, 103 bp, Artificial Sequence
  Synthetic Polynucleotide
taatacgactcactatagggtatggcctctttgtccaggggtcccttgtcaacagaggagagacaagatgcccctggacaacctggcggcagcgcaaaagatg

SEQ ID NO: 81868 - DNA, 103 bp, Artificial Sequence
  Synthetic Polynucleotide
taatacgactcactatagggaaggggttcctcacgaaccatctctcaatcaacagaggagagattgaatgatggttcgtaacctggcggcagcgcaaaagatg

SEQ ID NO: 81869 - DNA, 103 bp, Artificial Sequence
  Synthetic Polynucleotide
taatacgactcactatagggtcttctatggcctctttgtccaggggtcccaacagaggagagggaccatgggacaaagaaacctggcggcagcgcaaaagatg

SEQ ID NO: 81870 - DNA, 103 bp, Artificial Sequence
  Synthetic Polynucleotide
taatacgactcactatagggccctttcttctatggcctctttgtccagggaacagaggagaccctggatgaagaggccaaacctggcggcagcgcaaaagatg

SEQ ID NO: 81871 - DNA, 103 bp, Artificial Sequence
  Synthetic Polynucleotide
taatacgactcactatagggctcaaccctttcttctatggcctctttgtcaacagaggagagacaaaatggccatagaaaacctggcggcagcgcaaaagatg

SEQ ID NO: 81872 - DNA, 103 bp, Artificial Sequence
  Synthetic Polynucleotide
taatacgactcactatagggatcctctcaaccctttcttctatggcctctaacagaggagaagaggcatgagaagaaagaacctggcggcagcgcaaaagatg

SEQ ID NO: 81873 - DNA, 103 bp, Artificial Sequence
  Synthetic Polynucleotide
taatacgactcactatagggattttatcctctcaaccctttcttctatggaacagaggagaccatagatgaaagggttgaacctggcggcagcgcaaaagatg

SEQ ID NO: 81874 - DNA, 103 bp, Artificial Sequence
  Synthetic Polynucleotide
taatacgactcactatagggctcagattttatcctctcaaccctttcttcaacagaggagagaagaaatggttgagaggaacctggcggcagcgcaaaagatg

SEQ ID NO: 81875 - DNA, 103 bp, Artificial Sequence
  Synthetic Polynucleotide
taatacgactcactatagggatgtactcagattttatcctctcaacccttaacagaggagaaagggtatggaggataaaaacctggcggcagcgcaaaagatg

SEQ ID NO: 81876 - DNA, 103 bp, Artificial Sequence
  Synthetic Polynucleotide
taatacgactcactatagggaggtcatgtactcagattttatcctctcaaaacagaggagattgagaatgtaaaatctgaacctggcggcagcgcaaaagatg

SEQ ID NO: 81877 - DNA, 103 bp, Artificial Sequence
  Synthetic Polynucleotide
taatacgactcactatagggccaagaggtcatgtactcagattttatcctaacagaggagaaggataatgtctgagtacaacctggcggcagcgcaaaagatg

SEQ ID NO: 81878 - DNA, 103 bp, Artificial Sequence
  Synthetic Polynucleotide
taatacgactcactatagggtaaaaccaagaggtcatgtactcagattttaacagaggagaaaaatcatggtacatgacaacctggcggcagcgcaaaagatg

SEQ ID NO: 81879 - DNA, 103 bp, Artificial Sequence
  Synthetic Polynucleotide
taatacgactcactatagggcagttctctgctaatcgctcaacgaacgataacagaggagaatcgttatgtgagcgattaacctggcggcagcgcaaaagatg

SEQ ID NO: 81880 - DNA, 103 bp, Artificial Sequence
  Synthetic Polynucleotide
taatacgactcactatagggcaaaaaaggggttcctcacgaaccatctctaacagaggagaagagatatgtcgtgaggaaacctggcggcagcgcaaaagatg

SEQ ID NO: 81881 - DNA, 103 bp, Artificial Sequence
  Synthetic Polynucleotide
taatacgactcactatagggtgtcataaaaccaagaggtcatgtactcagaacagaggagactgagtatgtgacctcttaacctggcggcagcgcaaaagatg

SEQ ID NO: 81882 - DNA, 103 bp, Artificial Sequence
  Synthetic Polynucleotide
taatacgactcactataggggtcattgtcataaaaccaagaggtcatgtaaacagaggagatacatgatgtcttggtttaacctggcggcagcgcaaaagatg

SEQ ID NO: 81883 - DNA, 103 bp, Artificial Sequence
  Synthetic Polynucleotide
taatacgactcactataggggggttgtcattgtcataaaaccaagaggtcaacagaggagagacctcatggttttatgaaacctggcggcagcgcaaaagatg

SEQ ID NO: 81884 - DNA, 103 bp, Artificial Sequence
  Synthetic Polynucleotide
taatacgactcactatagggtgtaggggttgtcattgtcataaaaccaagaacagaggagacttggtatgatgacaatgaacctggcggcagcgcaaaagatg

SEQ ID NO: 81885 - DNA, 103 bp, Artificial Sequence
  Synthetic Polynucleotide
taatacgactcactatagggggtcctgtaggggttgtcattgtcataaaaaacagaggagattttatatgaatgacaacaacctggcggcagcgcaaaagatg

SEQ ID NO: 81886 - DNA, 103 bp, Artificial Sequence
  Synthetic Polynucleotide
taatacgactcactatagggtgccaggtcctgtaggggttgtcattgtcaaacagaggagatgacaaatgcaacccctaaacctggcggcagcgcaaaagatg

SEQ ID NO: 81887 - DNA, 103 bp, Artificial Sequence
  Synthetic Polynucleotide
taatacgactcactatagggagtagtgccaggtcctgtaggggttgtcataacagaggagaatgacaatgcctacaggaaacctggcggcagcgcaaaagatg

SEQ ID NO: 81888 - DNA, 103 bp, Artificial Sequence
  Synthetic Polynucleotide
taatacgactcactataggggccacagtagtgccaggtcctgtaggggttaacagaggagaaaccccatgaggacctggaacctggcggcagcgcaaaagatg

SEQ ID NO: 81889 - DNA, 103 bp, Artificial Sequence
  Synthetic Polynucleotide
taatacgactcactatagggtaggagccacagtagtgccaggtcctgtagaacagaggagactacagatgctggcactaaacctggcggcagcgcaaaagatg

SEQ ID NO: 81890 - DNA, 103 bp, Artificial Sequence
  Synthetic Polynucleotide
taatacgactcactatagggtgacataggagccacagtagtgccaggtccaacagaggagaggacctatgactactgtgaacctggcggcagcgcaaaagatg

SEQ ID NO: 81891 - DNA, 103 bp, Artificial Sequence
  Synthetic Polynucleotide
taatacgactcactatagggcactgcaaaaaaggggttcctcacgaaccaaacagaggagatggttcatgaggaaccccaacctggcggcagcgcaaaagatg

SEQ ID NO: 81892 - DNA, 103 bp, Artificial Sequence
  Synthetic Polynucleotide
taatacgactcactatagggttttgtgacataggagccacagtagtgccaaacagaggagatggcacatgtgtggctccaacctggcggcagcgcaaaagatg

SEQ ID NO: 81893 - DNA, 103 bp, Artificial Sequence
  Synthetic Polynucleotide
taatacgactcactataggggaggtttttgtgacataggagccacagtagaacagaggagactactgatgctcctatgtaacctggcggcagcgcaaaagatg

SEQ ID NO: 81894 - DNA, 103 bp, Artificial Sequence
  Synthetic Polynucleotide
taatacgactcactatagggttcctgaggtttttgtgacataggagccacaacagaggagagtggctatgatgtcacaaaacctggcggcagcgcaaaagatg

SEQ ID NO: 81895 - DNA, 103 bp, Artificial Sequence
  Synthetic Polynucleotide
taatacgactcactatagggcgcacttcctgaggtttttgtgacataggaaacagaggagatcctatatgacaaaaaccaacctggcggcagcgcaaaagatg

SEQ ID NO: 81896 - DNA, 103 bp, Artificial Sequence
  Synthetic Polynucleotide
taatacgactcactatagggctcgccgcacttcctgaggtttttgtgacaaacagaggagatgtcacatgaacctcaggaacctggcggcagcgcaaaagatg

SEQ ID NO: 81897 - DNA, 103 bp, Artificial Sequence
  Synthetic Polynucleotide
taatacgactcactatagggccatgctcgccgcacttcctgaggtttttgaacagaggagacaaaaaatgcaggaagtgaacctggcggcagcgcaaaagatg

SEQ ID NO: 81898 - DNA, 103 bp, Artificial Sequence
  Synthetic Polynucleotide
taatacgactcactatagggatttaccatgctcgccgcacttcctgaggtaacagaggagaacctcaatgagtgcggcgaacctggcggcagcgcaaaagatg

SEQ ID NO: 81899 - DNA, 103 bp, Artificial Sequence
  Synthetic Polynucleotide
taatacgactcactatagggacaccatttaccatgctcgccgcacttcctaacagaggagaaggaagatgggcgagcataacctggcggcagcgcaaaagatg

SEQ ID NO: 81900 - DNA, 103 bp, Artificial Sequence
  Synthetic Polynucleotide
taatacgactcactatagggtaataacaccatttaccatgctcgccgcacaacagaggagagtgcggatggcatggtaaaacctggcggcagcgcaaaagatg

SEQ ID NO: 81901 - DNA, 103 bp, Artificial Sequence
  Synthetic Polynucleotide
taatacgactcactatagggaattttaataacaccatttaccatgctcgcaacagaggagagcgagcatggtaaatggtaacctggcggcagcgcaaaagatg

SEQ ID NO: 81902 - DNA, 103 bp, Artificial Sequence
  Synthetic Polynucleotide
taatacgactcactataggggccgtcactgcaaaaaaggggttcctcacgaacagaggagacgtgagatgcccctttttaacctggcggcagcgcaaaagatg

SEQ ID NO: 81903 - DNA, 103 bp, Artificial Sequence
  Synthetic Polynucleotide
taatacgactcactataggggtcagaattttaataacaccatttaccatgaacagaggagacatggtatgtggtgttataacctggcggcagcgcaaaagatg

SEQ ID NO: 81904 - DNA, 103 bp, Artificial Sequence
  Synthetic Polynucleotide
taatacgactcactataggggatatgtcagaattttaataacaccatttaaacagaggagataaatgatgttattaaaaaacctggcggcagcgcaaaagatg

SEQ ID NO: 81905 - DNA, 103 bp, Artificial Sequence
  Synthetic Polynucleotide
taatacgactcactatagggccatggatatgtcagaattttaataacaccaacagaggagaggtgttatgaaaattctgaacctggcggcagcgcaaaagatg

SEQ ID NO: 81906 - DNA, 103 bp, Artificial Sequence
  Synthetic Polynucleotide
taatacgactcactatagggctgtcccatggatatgtcagaattttaataaacagaggagatattaaatgtctgacataaacctggcggcagcgcaaaagatg

SEQ ID NO: 81907 - DNA, 103 bp, Artificial Sequence
  Synthetic Polynucleotide
taatacgactcactatagggctatcctgtcccatggatatgtcagaatttaacagaggagaaaattcatgcatatccataacctggcggcagcgcaaaagatg

SEQ ID NO: 81908 - DNA, 103 bp, Artificial Sequence
  Synthetic Polynucleotide
taatacgactcactatagggctcctctatcctgtcccatggatatgtcagaacagaggagactgacaatgccatgggacaacctggcggcagcgcaaaagatg

SEQ ID NO: 81909 - DNA, 103 bp, Artificial Sequence
  Synthetic Polynucleotide
taatacgactcactataggggtgacctcctctatcctgtcccatggatataacagaggagaatatccatgggacaggataacctggcggcagcgcaaaagatg

SEQ ID NO: 81910 - DNA, 103 bp, Artificial Sequence
  Synthetic Polynucleotide
taatacgactcactatagggttcttgtgacctcctctatcctgtcccatgaacagaggagacatgggatgggatagaggaacctggcggcagcgcaaaagatg

SEQ ID NO: 81911 - DNA, 103 bp, Artificial Sequence
  Synthetic Polynucleotide
taatacgactcactatagggtgccattcttgtgacctcctctatcctgtcaacagaggagagacaggatggaggaggtcaacctggcggcagcgcaaaagatg

SEQ ID NO: 81912 - DNA, 103 bp, Artificial Sequence
  Synthetic Polynucleotide
taatacgactcactataggggtcattgccattcttgtgacctcctctatcaacagaggagagatagaatgggtcacaagaacctggcggcagcgcaaaagatg

SEQ ID NO: 81913 - DNA, 103 bp, Artificial Sequence
  Synthetic Polynucleotide
taatacgactcactatagggtcagagccgtcactgcaaaaaaggggttccaacagaggagaggaaccatgtttttgcagaacctggcggcagcgcaaaagatg

SEQ ID NO: 81914 - DNA, 103 bp, Artificial Sequence
  Synthetic Polynucleotide
taatacgactcactatagggtgtcagtcattgccattcttgtgacctcctaacagaggagaaggaggatgcaagaatggaacctggcggcagcgcaaaagatg

SEQ ID NO: 81915 - DNA, 103 bp, Artificial Sequence
  Synthetic Polynucleotide
taatacgactcactatagggggttgtgtcagtcattgccattcttgtgacaacagaggagagtcacaatgatggcaatgaacctggcggcagcgcaaaagatg

SEQ ID NO: 81916 - DNA, 103 bp, Artificial Sequence
  Synthetic Polynucleotide
taatacgactcactatagggaaaggggttgtgtcagtcattgccattcttaacagaggagaaagaatatgaatgactgaaacctggcggcagcgcaaaagatg

SEQ ID NO: 81917 - DNA, 103 bp, Artificial Sequence
  Synthetic Polynucleotide
taatacgactcactataggggtccaaaaggggttgtgtcagtcattgccaaacagaggagatggcaaatgctgacacaaaacctggcggcagcgcaaaagatg

SEQ ID NO: 81918 - DNA, 103 bp, Artificial Sequence
  Synthetic Polynucleotide
taatacgactcactatagggttgctgtccaaaaggggttgtgtcagtcataacagaggagaatgactatgacaacccctaacctggcggcagcgcaaaagatg

SEQ ID NO: 81919 - DNA, 103 bp, Artificial Sequence
  Synthetic Polynucleotide
taatacgactcactatagggactctttgctgtccaaaaggggttgtgtcaaacagaggagatgacacatgcccttttggaacctggcggcagcgcaaaagatg

SEQ ID NO: 81920 - DNA, 103 bp, Artificial Sequence
  Synthetic Polynucleotide
taatacgactcactatagggtaaacactctttgctgtccaaaaggggttgaacagaggagacaacccatgttggacagcaacctggcggcagcgcaaaagatg

SEQ ID NO: 81921 - DNA, 103 bp, Artificial Sequence
  Synthetic Polynucleotide
taatacgactcactatagggttctttaaacactctttgctgtccaaaaggaacagaggagaccttttatgcagcaaagaaacctggcggcagcgcaaaagatg

SEQ ID NO: 81922 - DNA, 103 bp, Artificial Sequence
  Synthetic Polynucleotide
taatacgactcactatagggactttttctttaaacactctttgctgtccaaacagaggagatggacaatgaagagtgttaacctggcggcagcgcaaaagatg

SEQ ID NO: 81923 - DNA, 103 bp, Artificial Sequence
  Synthetic Polynucleotide
taatacgactcactatagggtgtcaactttttctttaaacactctttgctaacagaggagaagcaaaatgtgtttaaagaacctggcggcagcgcaaaagatg

SEQ ID NO: 81924 - DNA, 103 bp, Artificial Sequence
  Synthetic Polynucleotide
taatacgactcactatagggaatggtcagagccgtcactgcaaaaaagggaacagaggagaccctttatggcagtgacgaacctggcggcagcgcaaaagatg

SEQ ID NO: 81925 - DNA, 103 bp, Artificial Sequence
  Synthetic Polynucleotide
taatacgactcactatagggtctggtgtcaactttttctttaaacactctaacagaggagaagagtgatgaaagaaaaaaacctggcggcagcgcaaaagatg

SEQ ID NO: 81926 - DNA, 103 bp, Artificial Sequence
  Synthetic Polynucleotide
taatacgactcactatagggtttgctctggtgtcaactttttctttaaacaacagaggagagtttaaatgaaaagttgaaacctggcggcagcgcaaaagatg

SEQ ID NO: 81927 - DNA, 103 bp, Artificial Sequence
  Synthetic Polynucleotide
taatacgactcactataggggatcctttgctctggtgtcaactttttcttaacagaggagaaagaaaatgttgacaccaaacctggcggcagcgcaaaagatg

SEQ ID NO: 81928 - DNA, 103 bp, Artificial Sequence
  Synthetic Polynucleotide
taatacgactcactatagggtggtggatcctttgctctggtgtcaactttaacagaggagaaaagttatgaccagagcaaacctggcggcagcgcaaaagatg

SEQ ID NO: 81929 - DNA, 103 bp, Artificial Sequence
  Synthetic Polynucleotide
taatacgactcactatagggcccgctggtggatcctttgctctggtgtcaaacagaggagatgacacatgagcaaaggaaacctggcggcagcgcaaaagatg

SEQ ID NO: 81930 - DNA, 103 bp, Artificial Sequence
  Synthetic Polynucleotide
taatacgactcactatagggtagttcccgctggtggatcctttgctctggaacagaggagaccagagatgaggatccacaacctggcggcagcgcaaaagatg

SEQ ID NO: 81931 - DNA, 103 bp, Artificial Sequence
  Synthetic Polynucleotide
taatacgactcactatagggcttcctagttcccgctggtggatcctttgcaacagaggagagcaaagatgccaccagcgaacctggcggcagcgcaaaagatg

SEQ ID NO: 81932 - DNA, 103 bp, Artificial Sequence
  Synthetic Polynucleotide
taatacgactcactatagggatgatcttcctagttcccgctggtggatccaacagaggagaggatccatgagcgggaacaacctggcggcagcgcaaaagatg

SEQ ID NO: 81933 - DNA, 103 bp, Artificial Sequence
  Synthetic Polynucleotide
taatacgactcactatagggctttcatgatcttcctagttcccgctggtgaacagaggagacaccagatggaactaggaaacctggcggcagcgcaaaagatg

SEQ ID NO: 81934 - DNA, 103 bp, Artificial Sequence
  Synthetic Polynucleotide
taatacgactcactataggggacaactttcatgatcttcctagttcccgcaacagaggagagcgggaatgaggaagatcaacctggcggcagcgcaaaagatg

SEQ ID NO: 81935 - DNA, 103 bp, Artificial Sequence
  Synthetic Polynucleotide
taatacgactcactatagggtaggcaatggtcagagccgtcactgcaaaaaacagaggagattttgcatggacggctctaacctggcggcagcgcaaaagatg

SEQ ID NO: 81936 - DNA, 103 bp, Artificial Sequence
  Synthetic Polynucleotide
taatacgactcactatagggctgttgacaactttcatgatcttcctagttaacagaggagaaactagatggatcatgaaaacctggcggcagcgcaaaagatg

SEQ ID NO: 81937 - DNA, 103 bp, Artificial Sequence
  Synthetic Polynucleotide
taatacgactcactataggggccacctgttgacaactttcatgatcttccaacagaggagaggaagaatgtgaaagttgaacctggcggcagcgcaaaagatg

SEQ ID NO: 81938 - DNA, 103 bp, Artificial Sequence
  Synthetic Polynucleotide
taatacgactcactataggggaacagccacctgttgacaactttcatgataacagaggagaatcatgatggttgtcaacaacctggcggcagcgcaaaagatg

SEQ ID NO: 81939 - DNA, 103 bp, Artificial Sequence
  Synthetic Polynucleotide
taatacgactcactatagggtggcggaacagccacctgttgacaactttcaacagaggagagaaagtatgcaacaggtgaacctggcggcagcgcaaaagatg

SEQ ID NO: 81940 - DNA, 103 bp, Artificial Sequence
  Synthetic Polynucleotide
taatacgactcactatagggccaggtggcggaacagccacctgttgacaaaacagaggagattgtcaatgggtggctgtaacctggcggcagcgcaaaagatg

SEQ ID NO: 81941 - DNA, 103 bp, Artificial Sequence
  Synthetic Polynucleotide
taatacgactcactatagggtctggccaggtggcggaacagccacctgttaacagaggagaaacaggatgctgttccgcaacctggcggcagcgcaaaagatg

SEQ ID NO: 81942 - DNA, 103 bp, Artificial Sequence
  Synthetic Polynucleotide
taatacgactcactatagggttttctctggccaggtggcggaacagccacaacagaggagagtggctatgccgccacctaacctggcggcagcgcaaaagatg

SEQ ID NO: 81943 - DNA, 103 bp, Artificial Sequence
  Synthetic Polynucleotide
taatacgactcactatagggggttcttttctctggccaggtggcggaacaaacagaggagatgttccatgacctggccaaacctggcggcagcgcaaaagatg

SEQ ID NO: 81944 - DNA, 103 bp, Artificial Sequence
  Synthetic Polynucleotide
taatacgactcactatagggtctggggttcttttctctggccaggtggcgaacagaggagacgccacatggccagagaaaacctggcggcagcgcaaaagatg

SEQ ID NO: 81945 - DNA, 103 bp, Artificial Sequence
  Synthetic Polynucleotide
taatacgactcactatagggcacagtctggggttcttttctctggccaggaacagaggagacctggcatgagaaaagaaaacctggcggcagcgcaaaagatg

SEQ ID NO: 81946 - DNA, 103 bp, Artificial Sequence
  Synthetic Polynucleotide
taatacgactcactatagggcaaggtaggcaatggtcagagccgtcactgaacagaggagacagtgaatgctctgaccaaacctggcggcagcgcaaaagatg

SEQ ID NO: 81947 - DNA, 103 bp, Artificial Sequence
  Synthetic Polynucleotide
taatacgactcactatagggttgtgcacagtctggggttcttttctctggaacagaggagaccagagatgagaaccccaaacctggcggcagcgcaaaagatg

SEQ ID NO: 81948 - DNA, 103 bp, Artificial Sequence
  Synthetic Polynucleotide
taatacgactcactatagggttcctttgtgcacagtctggggttcttttcaacagaggagagaaaagatgcccagactgaacctggcggcagcgcaaaagatg

SEQ ID NO: 81949 - DNA, 103 bp, Artificial Sequence
  Synthetic Polynucleotide
taatacgactcactatagggaattcttcctttgtgcacagtctggggttcaacagaggagagaacccatgactgtgcacaacctggcggcagcgcaaaagatg

SEQ ID NO: 81950 - DNA, 103 bp, Artificial Sequence
  Synthetic Polynucleotide
taatacgactcactatagggcaataaattcttcctttgtgcacagtctggaacagaggagaccagacatggcacaaaggaacctggcggcagcgcaaaagatg

SEQ ID NO: 81951 - DNA, 103 bp, Artificial Sequence
  Synthetic Polynucleotide
taatacgactcactatagggttttgcaataaattcttcctttgtgcacagaacagaggagactgtgcatgaaggaagaaaacctggcggcagcgcaaaagatg

SEQ ID NO: 81952 - DNA, 103 bp, Artificial Sequence
  Synthetic Polynucleotide
taatacgactcactatagggcggacttttgcaataaattcttcctttgtgaacagaggagacacaaaatgagaatttataacctggcggcagcgcaaaagatg

SEQ ID NO: 81953 - DNA, 103 bp, Artificial Sequence
  Synthetic Polynucleotide
taatacgactcactataggggacttcggacttttgcaataaattcttcctaacagaggagaaggaagatgttattgcaaaacctggcggcagcgcaaaagatg

SEQ ID NO: 81954 - DNA, 103 bp, Artificial Sequence
  Synthetic Polynucleotide
taatacgactcactatagggtgcatgacttcggacttttgcaataaattcaacagaggagagaatttatggcaaaagtcaacctggcggcagcgcaaaagatg

SEQ ID NO: 81955 - DNA, 103 bp, Artificial Sequence
  Synthetic Polynucleotide
taatacgactcactatagggatggctgcatgacttcggacttttgcaataaacagaggagatattgcatgagtccgaagaacctggcggcagcgcaaaagatg

SEQ ID NO: 81956 - DNA, 103 bp, Artificial Sequence
  Synthetic Polynucleotide
taatacgactcactatagggctccaatggctgcatgacttcggacttttgaacagaggagacaaaagatggaagtcatgaacctggcggcagcgcaaaagatg

SEQ ID NO: 81957 - DNA, 103 bp, Artificial Sequence
  Synthetic Polynucleotide
taatacgactcactatagggtcccacaaggtaggcaatggtcagagccgtaacagaggagaacggctatgaccattgccaacctggcggcagcgcaaaagatg

SEQ ID NO: 81958 - DNA, 103 bp, Artificial Sequence
  Synthetic Polynucleotide
taatacgactcactataggggtaagctccaatggctgcatgacttcggacaacagaggagagtccgaatgcatgcagccaacctggcggcagcgcaaaagatg

SEQ ID NO: 81959 - DNA, 103 bp, Artificial Sequence
  Synthetic Polynucleotide
taatacgactcactatagggtccaggtaagctccaatggctgcatgacttaacagaggagaaagtcaatgagccattggaacctggcggcagcgcaaaagatg

SEQ ID NO: 81960 - DNA, 103 bp, Artificial Sequence
  Synthetic Polynucleotide
taatacgactcactataggggttcttccaggtaagctccaatggctgcataacagaggagaatgcagatgttggagcttaacctggcggcagcgcaaaagatg

SEQ ID NO: 81961 - DNA, 103 bp, Artificial Sequence
  Synthetic Polynucleotide
taatacgactcactatagggttcttgttcttccaggtaagctccaatggcaacagaggagagccattatggcttacctgaacctggcggcagcgcaaaagatg

SEQ ID NO: 81962 - DNA, 103 bp, Artificial Sequence
  Synthetic Polynucleotide
taatacgactcactatagggcactgttcttgttcttccaggtaagctccaaacagaggagatggagcatgcctggaagaaacctggcggcagcgcaaaagatg

SEQ ID NO: 81963 - DNA, 103 bp, Artificial Sequence
  Synthetic Polynucleotide
taatacgactcactatagggtcttccactgttcttgttcttccaggtaagaacagaggagacttaccatgaagaacaagaacctggcggcagcgcaaaagatg

SEQ ID NO: 81964 - DNA, 103 bp, Artificial Sequence
  Synthetic Polynucleotide
taatacgactcactatagggggcagtcttccactgttcttgttcttccagaacagaggagactggaaatgcaagaacagaacctggcggcagcgcaaaagatg

SEQ ID NO: 81965 - DNA, 103 bp, Artificial Sequence
  Synthetic Polynucleotide
taatacgactcactatagggtcattggcagtcttccactgttcttgttctaacagaggagaagaacaatgacagtggaaaacctggcggcagcgcaaaagatg

SEQ ID NO: 81966 - DNA, 103 bp, Artificial Sequence
  Synthetic Polynucleotide
taatacgactcactatagggcagcctcattggcagtcttccactgttcttaacagaggagaaagaacatgggaagactgaacctggcggcagcgcaaaagatg

SEQ ID NO: 81967 - DNA, 103 bp, Artificial Sequence
  Synthetic Polynucleotide
taatacgactcactatagggttggacagcctcattggcagtcttccactgaacagaggagacagtggatgactgccaataacctggcggcagcgcaaaagatg

SEQ ID NO: 81968 - DNA, 103 bp, Artificial Sequence
  Synthetic Polynucleotide
taatacgactcactatagggttgcttcccacaaggtaggcaatggtcagaaacagaggagatctgacatgtgcctacctaacctggcggcagcgcaaaagatg

SEQ ID NO: 81969 - DNA, 103 bp, Artificial Sequence
  Synthetic Polynucleotide
taatacgactcactataggggggtcttggacagcctcattggcagtcttcaacagaggagagaagacatgcaatgaggcaacctggcggcagcgcaaaagatg

SEQ ID NO: 81970 - DNA, 103 bp, Artificial Sequence
  Synthetic Polynucleotide
taatacgactcactatagggactttgggtcttggacagcctcattggcagaacagaggagactgccaatgaggctgtccaacctggcggcagcgcaaaagatg

SEQ ID NO: 81971 - DNA, 103 bp, Artificial Sequence
  Synthetic Polynucleotide
taatacgactcactatagggccagaactttgggtcttggacagcctcattaacagaggagaaatgagatggtccaagacaacctggcggcagcgcaaaagatg

SEQ ID NO: 81972 - DNA, 103 bp, Artificial Sequence
  Synthetic Polynucleotide
taatacgactcactatagggagttcccagaactttgggtcttggacagccaacagaggagaggctgtatgagacccaaaaacctggcggcagcgcaaaagatg

SEQ ID NO: 81973 - DNA, 103 bp, Artificial Sequence
  Synthetic Polynucleotide
taatacgactcactatagggccaccagttcccagaactttgggtcttggaaacagaggagatccaagatgcaaagttctaacctggcggcagcgcaaaagatg

SEQ ID NO: 81974 - DNA, 103 bp, Artificial Sequence
  Synthetic Polynucleotide
taatacgactcactatagggttcatccaccagttcccagaactttgggtcaacagaggagagacccaatgttctgggaaaacctggcggcagcgcaaaagatg

SEQ ID NO: 81975 - DNA, 103 bp, Artificial Sequence
  Synthetic Polynucleotide
taatacgactcactatagggctttcttcatccaccagttcccagaactttaacagaggagaaaagttatgggaactggtaacctggcggcagcgcaaaagatg

SEQ ID NO: 81976 - DNA, 103 bp, Artificial Sequence
  Synthetic Polynucleotide
taatacgactcactataggggcttcctttcttcatccaccagttcccagaaacagaggagatctgggatgtggtggatgaacctggcggcagcgcaaaagatg

SEQ ID NO: 81977 - DNA, 103 bp, Artificial Sequence
  Synthetic Polynucleotide
taatacgactcactataggggtgcagcttcctttcttcatccaccagttcaacagaggagagaactgatggatgaagaaaacctggcggcagcgcaaaagatg

SEQ ID NO: 81978 - DNA, 103 bp, Artificial Sequence
  Synthetic Polynucleotide
taatacgactcactatagggtgttggtgcagcttcctttcttcatccaccaacagaggagaggtggaatgagaaaggaaaacctggcggcagcgcaaaagatg

SEQ ID NO: 81979 - DNA, 103 bp, Artificial Sequence
  Synthetic Polynucleotide
taatacgactcactatagggtcatgttgcttcccacaaggtaggcaatggaacagaggagaccattgatgaccttgtggaacctggcggcagcgcaaaagatg

SEQ ID NO: 81980 - DNA, 103 bp, Artificial Sequence
  Synthetic Polynucleotide
taatacgactcactatagggtgccttgttggtgcagcttcctttcttcataacagaggagaatgaagatgggaagctgcaacctggcggcagcgcaaaagatg

SEQ ID NO: 81981 - DNA, 103 bp, Artificial Sequence
  Synthetic Polynucleotide
taatacgactcactatagggacacctgccttgttggtgcagcttcctttcaacagaggagagaaaggatgctgcaccaaaacctggcggcagcgcaaaagatg

SEQ ID NO: 81982 - DNA, 103 bp, Artificial Sequence
  Synthetic Polynucleotide
taatacgactcactataggggtccgacacctgccttgttggtgcagcttcaacagaggagagaagctatgccaacaaggaacctggcggcagcgcaaaagatg

SEQ ID NO: 81983 - DNA, 103 bp, Artificial Sequence
  Synthetic Polynucleotide
taatacgactcactatagggcacaagtccgacacctgccttgttggtgcaaacagaggagatgcaccatgaaggcaggtaacctggcggcagcgcaaaagatg

SEQ ID NO: 81984 - DNA, 103 bp, Artificial Sequence
  Synthetic Polynucleotide
taatacgactcactataggggtacacacaagtccgacacctgccttgttgaacagaggagacaacaaatgaggtgtcggaacctggcggcagcgcaaaagatg

SEQ ID NO: 81985 - DNA, 103 bp, Artificial Sequence
  Synthetic Polynucleotide
taatacgactcactatagggatgttgtacacacaagtccgacacctgcctaacagaggagaaggcagatgtcggacttgaacctggcggcagcgcaaaagatg

SEQ ID NO: 81986 - DNA, 103 bp, Artificial Sequence
  Synthetic Polynucleotide
taatacgactcactatagggccatcatgttgtacacacaagtccgacaccaacagaggagaggtgtcatgcttgtgtgtaacctggcggcagcgcaaaagatg

SEQ ID NO: 81987 - DNA, 103 bp, Artificial Sequence
  Synthetic Polynucleotide
taatacgactcactatagggtttccccatcatgttgtacacacaagtccgaacagaggagacggactatggtgtacaacaacctggcggcagcgcaaaagatg

SEQ ID NO: 81988 - DNA, 103 bp, Artificial Sequence
  Synthetic Polynucleotide
taatacgactcactatagggtctcttttccccatcatgttgtacacacaaaacagaggagattgtgtatgcaacatgataacctggcggcagcgcaaaagatg

SEQ ID NO: 81989 - DNA, 103 bp, Artificial Sequence
  Synthetic Polynucleotide
taatacgactcactatagggtcttctctcttttccccatcatgttgtacaaacagaggagatgtacaatgtgatggggaaacctggcggcagcgcaaaagatg

SEQ ID NO: 81990 - DNA, 103 bp, Artificial Sequence
  Synthetic Polynucleotide
taatacgactcactatagggctggtcagttctctgctaatcgctcaacgaaacagaggagatcgttgatggattagcagaacctggcggcagcgcaaaagatg

SEQ ID NO: 81991 - DNA, 103 bp, Artificial Sequence
  Synthetic Polynucleotide
taatacgactcactatagggttgcgtcatgttgcttcccacaaggtaggcaacagaggagagcctacatggtgggaagcaacctggcggcagcgcaaaagatg

SEQ ID NO: 81992 - DNA, 103 bp, Artificial Sequence
  Synthetic Polynucleotide
taatacgactcactatagggcagcttcttctctcttttccccatcatgttaacagaggagaaacatgatggggaaaagaaacctggcggcagcgcaaaagatg

SEQ ID NO: 81993 - DNA, 103 bp, Artificial Sequence
  Synthetic Polynucleotide
taatacgactcactatagggtctgacagcttcttctctcttttccccatcaacagaggagagatgggatgaagagagaaaacctggcggcagcgcaaaagatg

SEQ ID NO: 81994 - DNA, 103 bp, Artificial Sequence
  Synthetic Polynucleotide
taatacgactcactatagggcaaactctgacagcttcttctctcttttccaacagaggagaggaaaaatgagaagaagcaacctggcggcagcgcaaaagatg

SEQ ID NO: 81995 - DNA, 103 bp, Artificial Sequence
  Synthetic Polynucleotide
taatacgactcactatagggtttcccaaactctgacagcttcttctctctaacagaggagaagagagatgaagctgtcaaacctggcggcagcgcaaaagatg

SEQ ID NO: 81996 - DNA, 103 bp, Artificial Sequence
  Synthetic Polynucleotide
taatacgactcactatagggtttgctttcccaaactctgacagcttcttcaacagaggagagaagaaatggtcagagttaacctggcggcagcgcaaaagatg

SEQ ID NO: 81997 - DNA, 103 bp, Artificial Sequence
  Synthetic Polynucleotide
taatacgactcactatagggttccctttgctttcccaaactctgacagctaacagaggagaagctgtatgagtttgggaaacctggcggcagcgcaaaagatg

SEQ ID NO: 81998 - DNA, 103 bp, Artificial Sequence
  Synthetic Polynucleotide
taatacgactcactatagggacggcttccctttgctttcccaaactctgaaacagaggagatcagagatggggaaagcaaacctggcggcagcgcaaaagatg

SEQ ID NO: 81999 - DNA, 103 bp, Artificial Sequence
  Synthetic Polynucleotide
taatacgactcactatagggatggcacggcttccctttgctttcccaaacaacagaggagagtttggatgagcaaagggaacctggcggcagcgcaaaagatg

SEQ ID NO: 82000 - DNA, 103 bp, Artificial Sequence
  Synthetic Polynucleotide
taatacgactcactatagggaccatatggcacggcttccctttgctttccaacagaggagaggaaagatgagggaagccaacctggcggcagcgcaaaagatg

SEQ ID NO: 82001 - DNA, 103 bp, Artificial Sequence
  Synthetic Polynucleotide
taatacgactcactatagggcatataccatatggcacggcttccctttgcaacagaggagagcaaagatgagccgtgccaacctggcggcagcgcaaaagatg

SEQ ID NO: 82002 - DNA, 103 bp, Artificial Sequence
  Synthetic Polynucleotide
taatacgactcactatagggactcgttgcgtcatgttgcttcccacaaggaacagaggagaccttgtatgaagcaacataacctggcggcagcgcaaaagatg

SEQ ID NO: 82003 - DNA, 103 bp, Artificial Sequence
  Synthetic Polynucleotide
taatacgactcactatagggagccacatataccatatggcacggcttcccaacagaggagagggaagatgtgccatatgaacctggcggcagcgcaaaagatg

SEQ ID NO: 82004 - DNA, 103 bp, Artificial Sequence
  Synthetic Polynucleotide
taatacgactcactatagggctcccagccacatataccatatggcacggcaacagaggagagccgtgatgtatggtataaacctggcggcagcgcaaaagatg

SEQ ID NO: 82005 - DNA, 103 bp, Artificial Sequence
  Synthetic Polynucleotide
taatacgactcactatagggccgcgctcccagccacatataccatatggcaacagaggagagccataatgtatatgtggaacctggcggcagcgcaaaagatg

SEQ ID NO: 82006 - DNA, 103 bp, Artificial Sequence
  Synthetic Polynucleotide
taatacgactcactatagggagataccgcgctcccagccacatataccataacagaggagaatggtaatggtggctgggaacctggcggcagcgcaaaagatg

SEQ ID NO: 82007 - DNA, 103 bp, Artificial Sequence
  Synthetic Polynucleotide
taatacgactcactatagggactcaagataccgcgctcccagccacatataacagaggagaatatgtatgtgggagcgcaacctggcggcagcgcaaaagatg

SEQ ID NO: 82008 - DNA, 103 bp, Artificial Sequence
  Synthetic Polynucleotide
taatacgactcactatagggctcaaactcaagataccgcgctcccagccaaacagaggagatggctgatggcgcggtataacctggcggcagcgcaaaagatg

SEQ ID NO: 82009 - DNA, 103 bp, Artificial Sequence
  Synthetic Polynucleotide
taatacgactcactatagggagggcctcaaactcaagataccgcgctcccaacagaggagagggagcatggtatcttgaaacctggcggcagcgcaaaagatg

SEQ ID NO: 82010 - DNA, 103 bp, Artificial Sequence
  Synthetic Polynucleotide
taatacgactcactatagggatcccagggcctcaaactcaagataccgcgaacagaggagacgcggtatgttgagtttgaacctggcggcagcgcaaaagatg

SEQ ID NO: 82011 - DNA, 103 bp, Artificial Sequence
  Synthetic Polynucleotide
taatacgactcactatagggcaggaatcccagggcctcaaactcaagataaacagaggagatatcttatgtttgaggccaacctggcggcagcgcaaaagatg

SEQ ID NO: 82012 - DNA, 103 bp, Artificial Sequence
  Synthetic Polynucleotide
taatacgactcactatagggtcattcaggaatcccagggcctcaaactcaaacagaggagatgagttatgggccctgggaacctggcggcagcgcaaaagatg

SEQ ID NO: 82013 - DNA, 103 bp, Artificial Sequence
  Synthetic Polynucleotide
taatacgactcactatagggtcacgactcgttgcgtcatgttgcttcccaaacagaggagatgggaaatgacatgacgcaacctggcggcagcgcaaaagatg

SEQ ID NO: 82014 - DNA, 103 bp, Artificial Sequence
  Synthetic Polynucleotide
taatacgactcactatagggggtcctcattcaggaatcccagggcctcaaaacagaggagattgaggatgtgggattccaacctggcggcagcgcaaaagatg

SEQ ID NO: 82015 - DNA, 103 bp, Artificial Sequence
  Synthetic Polynucleotide
taatacgactcactatagggccaatggtcctcattcaggaatcccagggcaacagaggagagccctgatgttcctgaataacctggcggcagcgcaaaagatg

SEQ ID NO: 82016 - DNA, 103 bp, Artificial Sequence
  Synthetic Polynucleotide
taatacgactcactataggggaagcccaatggtcctcattcaggaatcccaacagaggagagggattatggaatgaggaaacctggcggcagcgcaaaagatg

SEQ ID NO: 82017 - DNA, 103 bp, Artificial Sequence
  Synthetic Polynucleotide
taatacgactcactatagggccctggaagcccaatggtcctcattcaggaaacagaggagatcctgaatgaggaccattaacctggcggcagcgcaaaagatg

SEQ ID NO: 82018 - DNA, 103 bp, Artificial Sequence
  Synthetic Polynucleotide
taatacgactcactataggggttttccctggaagcccaatggtcctcattaacagaggagaaatgagatgcattgggctaacctggcggcagcgcaaaagatg

SEQ ID NO: 82019 - DNA, 103 bp, Artificial Sequence
  Synthetic Polynucleotide
taatacgactcactatagggcctgagttttccctggaagcccaatggtccaacagaggagaggaccaatgggcttccagaacctggcggcagcgcaaaagatg

SEQ ID NO: 82020 - DNA, 103 bp, Artificial Sequence
  Synthetic Polynucleotide
taatacgactcactatagggctcctcctgagttttccctggaagcccaataacagaggagaattgggatgccagggaaaaacctggcggcagcgcaaaagatg

SEQ ID NO: 82021 - DNA, 103 bp, Artificial Sequence
  Synthetic Polynucleotide
taatacgactcactatagggcactcctcctcctgagttttccctggaagcaacagaggagagcttccatggaaaactcaaacctggcggcagcgcaaaagatg

SEQ ID NO: 82022 - DNA, 103 bp, Artificial Sequence
  Synthetic Polynucleotide
taatacgactcactatagggccttccactcctcctcctgagttttccctgaacagaggagacagggaatgctcaggaggaacctggcggcagcgcaaaagatg

SEQ ID NO: 82023 - DNA, 103 bp, Artificial Sequence
  Synthetic Polynucleotide
taatacgactcactatagggcaatgccttccactcctcctcctgagttttaacagaggagaaaaactatggaggaggagaacctggcggcagcgcaaaagatg

SEQ ID NO: 82024 - DNA, 103 bp, Artificial Sequence
  Synthetic Polynucleotide
taatacgactcactatagggggcaatcacgactcgttgcgtcatgttgctaacagaggagaagcaacatgacgcaacgaaacctggcggcagcgcaaaagatg

SEQ ID NO: 82025 - DNA, 103 bp, Artificial Sequence
  Synthetic Polynucleotide
taatacgactcactatagggtaagccaatgccttccactcctcctcctgaaacagaggagatcaggaatgggagtggaaaacctggcggcagcgcaaaagatg

SEQ ID NO: 82026 - DNA, 103 bp, Artificial Sequence
  Synthetic Polynucleotide
taatacgactcactatagggtattgtaagccaatgccttccactcctcctaacagaggagaaggaggatgggaaggcataacctggcggcagcgcaaaagatg

SEQ ID NO: 82027 - DNA, 103 bp, Artificial Sequence
  Synthetic Polynucleotide
taatacgactcactatagggctaggtattgtaagccaatgccttccactcaacagaggagagagtggatggcattggctaacctggcggcagcgcaaaagatg

SEQ ID NO: 82028 - DNA, 103 bp, Artificial Sequence
  Synthetic Polynucleotide
taatacgactcactatagggatatcctaggtattgtaagccaatgccttcaacagaggagagaaggcatgggcttacaaaacctggcggcagcgcaaaagatg

SEQ ID NO: 82029 - DNA, 103 bp, Artificial Sequence
  Synthetic Polynucleotide
taatacgactcactatagggatcacatatcctaggtattgtaagccaatgaacagaggagacattggatgacaatacctaacctggcggcagcgcaaaagatg

SEQ ID NO: 82030 - DNA, 103 bp, Artificial Sequence
  Synthetic Polynucleotide
taatacgactcactatagggctctgatcacatatcctaggtattgtaagcaacagaggagagcttacatgacctaggataacctggcggcagcgcaaaagatg

SEQ ID NO: 82031 - DNA, 103 bp, Artificial Sequence
  Synthetic Polynucleotide
taatacgactcactatagggcaggtctctgatcacatatcctaggtattgaacagaggagacaatacatgggatatgtgaacctggcggcagcgcaaaagatg

SEQ ID NO: 82032 - DNA, 103 bp, Artificial Sequence
  Synthetic Polynucleotide
taatacgactcactataggggcagccaggtctctgatcacatatcctaggaacagaggagacctaggatgtgtgatcagaacctggcggcagcgcaaaagatg

SEQ ID NO: 82033 - DNA, 103 bp, Artificial Sequence
  Synthetic Polynucleotide
taatacgactcactatagggccattgcagccaggtctctgatcacatatcaacagaggagagatatgatgtcagagaccaacctggcggcagcgcaaaagatg

SEQ ID NO: 82034 - DNA, 103 bp, Artificial Sequence
  Synthetic Polynucleotide
taatacgactcactatagggaccatccattgcagccaggtctctgatcacaacagaggagagtgatcatggacctggctaacctggcggcagcgcaaaagatg

SEQ ID NO: 82035 - DNA, 103 bp, Artificial Sequence
  Synthetic Polynucleotide
taatacgactcactatagggagtagggcaatcacgactcgttgcgtcatgaacagaggagacatgacatgacgagtcgtaacctggcggcagcgcaaaagatg

SEQ ID NO: 82036 - DNA, 103 bp, Artificial Sequence
  Synthetic Polynucleotide
taatacgactcactatagggccaccaccatccattgcagccaggtctctgaacagaggagacagagaatgggctgcaataacctggcggcagcgcaaaagatg

SEQ ID NO: 82037 - DNA, 103 bp, Artificial Sequence
  Synthetic Polynucleotide
taatacgactcactatagggagaatccaccaccatccattgcagccaggtaacagaggagaacctggatgcaatggatgaacctggcggcagcgcaaaagatg

SEQ ID NO: 82038 - DNA, 103 bp, Artificial Sequence
  Synthetic Polynucleotide
taatacgactcactatagggcgcgtagaatccaccaccatccattgcagcaacagaggagagctgcaatggatggtggtaacctggcggcagcgcaaaagatg

SEQ ID NO: 82039 - DNA, 103 bp, Artificial Sequence
  Synthetic Polynucleotide
taatacgactcactatagggtcatccgcgtagaatccaccaccatccattaacagaggagaaatggaatgtggtggattaacctggcggcagcgcaaaagatg

SEQ ID NO: 82040 - DNA, 103 bp, Artificial Sequence
  Synthetic Polynucleotide
taatacgactcactatagggcggtgtcatccgcgtagaatccaccaccataacagaggagaatggtgatggattctacgaacctggcggcagcgcaaaagatg

SEQ ID NO: 82041 - DNA, 103 bp, Artificial Sequence
  Synthetic Polynucleotide
taatacgactcactatagggtccagcggtgtcatccgcgtagaatccaccaacagaggagaggtggaatgtacgcggataacctggcggcagcgcaaaagatg

SEQ ID NO: 82042 - DNA, 103 bp, Artificial Sequence
  Synthetic Polynucleotide
taatacgactcactatagggtcccatccagcggtgtcatccgcgtagaataacagaggagaattctaatgggatgacacaacctggcggcagcgcaaaagatg

SEQ ID NO: 82043 - DNA, 103 bp, Artificial Sequence
  Synthetic Polynucleotide
taatacgactcactataggggcgtgtcccatccagcggtgtcatccgcgtaacagaggagaacgcggatgacaccgctgaacctggcggcagcgcaaaagatg

SEQ ID NO: 82044 - DNA, 103 bp, Artificial Sequence
  Synthetic Polynucleotide
taatacgactcactataggggatgcgcgtgtcccatccagcggtgtcatcaacagaggagagatgacatggctggatggaacctggcggcagcgcaaaagatg

SEQ ID NO: 82045 - DNA, 103 bp, Artificial Sequence
  Synthetic Polynucleotide
taatacgactcactatagggtctgtgatgcgcgtgtcccatccagcggtgaacagaggagacaccgcatgatgggacacaacctggcggcagcgcaaaagatg

SEQ ID NO: 82046 - DNA, 103 bp, Artificial Sequence
  Synthetic Polynucleotide
taatacgactcactatagggagaccagtagggcaatcacgactcgttgcgaacagaggagacgcaacatgtcgtgattgaacctggcggcagcgcaaaagatg

SEQ ID NO: 82047 - DNA, 103 bp, Artificial Sequence
  Synthetic Polynucleotide
taatacgactcactatagggctgcctctgtgatgcgcgtgtcccatccagaacagaggagactggatatgacacgcgcaaacctggcggcagcgcaaaagatg

SEQ ID NO: 82048 - DNA, 103 bp, Artificial Sequence
  Synthetic Polynucleotide
taatacgactcactatagggaaggtctgcctctgtgatgcgcgtgtcccaaacagaggagatgggacatgcgcatcacaaacctggcggcagcgcaaaagatg

SEQ ID NO: 82049 - DNA, 103 bp, Artificial Sequence
  Synthetic Polynucleotide
taatacgactcactatagggtcatcaaggtctgcctctgtgatgcgcgtgaacagaggagacacgcgatgcacagaggcaacctggcggcagcgcaaaagatg

SEQ ID NO: 82050 - DNA, 103 bp, Artificial Sequence
  Synthetic Polynucleotide
taatacgactcactataggggttcatcatcaaggtctgcctctgtgatgcaacagaggagagcatcaatgaggcagaccaacctggcggcagcgcaaaagatg

SEQ ID NO: 82051 - DNA, 103 bp, Artificial Sequence
  Synthetic Polynucleotide
taatacgactcactatagggctcctgttcatcatcaaggtctgcctctgtaacagaggagaacagagatggaccttgataacctggcggcagcgcaaaagatg

SEQ ID NO: 82052 - DNA, 103 bp, Artificial Sequence
  Synthetic Polynucleotide
taatacgactcactatagggaagatctcctgttcatcatcaaggtctgccaacagaggagaggcagaatgtgatgatgaaacctggcggcagcgcaaaagatg

SEQ ID NO: 82053 - DNA, 103 bp, Artificial Sequence
  Synthetic Polynucleotide
taatacgactcactatagggagttcaagatctcctgttcatcatcaaggtaacagaggagaaccttgatgatgaacaggaacctggcggcagcgcaaaagatg

SEQ ID NO: 82054 - DNA, 103 bp, Artificial Sequence
  Synthetic Polynucleotide
taatacgactcactatagggcatgtagttcaagatctcctgttcatcatcaacagaggagagatgatatgcaggagatcaacctggcggcagcgcaaaagatg

SEQ ID NO: 82055 - DNA, 103 bp, Artificial Sequence
  Synthetic Polynucleotide
taatacgactcactataggggggctcatgtagttcaagatctcctgttcaaacagaggagatgaacaatggatcttgaaaacctggcggcagcgcaaaagatg

SEQ ID NO: 82056 - DNA, 103 bp, Artificial Sequence
  Synthetic Polynucleotide
taatacgactcactataggggatgtgggctcatgtagttcaagatctcctaacagaggagaaggagaatgtgaactacaaacctggcggcagcgcaaaagatg

SEQ ID NO: 82057 - DNA, 103 bp, Artificial Sequence
  Synthetic Polynucleotide
taatacgactcactatagggagccaagaccagtagggcaatcacgactcgaacagaggagacgagtcatgattgccctaaacctggcggcagcgcaaaagatg

SEQ ID NO: 82058 - DNA, 103 bp, Artificial Sequence
  Synthetic Polynucleotide
taatacgactcactatagggtttgtgatgtgggctcatgtagttcaagataacagaggagaatcttgatgtacatgagcaacctggcggcagcgcaaaagatg

SEQ ID NO: 82059 - DNA, 103 bp, Artificial Sequence
  Synthetic Polynucleotide
taatacgactcactatagggagttttttgtgatgtgggctcatgtagttcaacagaggagagaactaatggagcccacaaacctggcggcagcgcaaaagatg

SEQ ID NO: 82060 - DNA, 103 bp, Artificial Sequence
  Synthetic Polynucleotide
taatacgactcactataggggtgccagttttttgtgatgtgggctcatgtaacagaggagaacatgaatgcacatcacaaacctggcggcagcgcaaaagatg

SEQ ID NO: 82061 - DNA, 103 bp, Artificial Sequence
  Synthetic Polynucleotide
taatacgactcactatagggtgcttgtgccagttttttgtgatgtgggctaacagaggagaagcccaatgcacaaaaaaaacctggcggcagcgcaaaagatg

SEQ ID NO: 82062 - DNA, 103 bp, Artificial Sequence
  Synthetic Polynucleotide
taatacgactcactatagggatcactgcttgtgccagttttttgtgatgtaacagaggagaacatcaatgaaaactggcaacctggcggcagcgcaaaagatg

SEQ ID NO: 82063 - DNA, 103 bp, Artificial Sequence
  Synthetic Polynucleotide
taatacgactcactatagggtttccatcactgcttgtgccagttttttgtaacagaggagaacaaaaatgtggcacaagaacctggcggcagcgcaaaagatg

SEQ ID NO: 82064 - DNA, 103 bp, Artificial Sequence
  Synthetic Polynucleotide
taatacgactcactatagggtgtcatttccatcactgcttgtgccagtttaacagaggagaaaactgatgcaagcagtgaacctggcggcagcgcaaaagatg

SEQ ID NO: 82065 - DNA, 103 bp, Artificial Sequence
  Synthetic Polynucleotide
taatacgactcactatagggttgtatgtcatttccatcactgcttgtgccaacagaggagaggcacaatgagtgatggaaacctggcggcagcgcaaaagatg

SEQ ID NO: 82066 - DNA, 103 bp, Artificial Sequence
  Synthetic Polynucleotide
taatacgactcactatagggtgttcttgtatgtcatttccatcactgcttaacagaggagaaagcagatgtggaaatgaaacctggcggcagcgcaaaagatg

SEQ ID NO: 82067 - DNA, 103 bp, Artificial Sequence
  Synthetic Polynucleotide
taatacgactcactatagggcactttgttcttgtatgtcatttccatcacaacagaggagagtgatgatgatgacatacaacctggcggcagcgcaaaagatg

SEQ ID NO: 82068 - DNA, 103 bp, Artificial Sequence
  Synthetic Polynucleotide
taatacgactcactatagggccaacagccaagaccagtagggcaatcacgaacagaggagacgtgatatgcctactggtaacctggcggcagcgcaaaagatg

SEQ ID NO: 82069 - DNA, 103 bp, Artificial Sequence
  Synthetic Polynucleotide
taatacgactcactatagggttcaccactttgttcttgtatgtcatttccaacagaggagaggaaatatgatacaagaaaacctggcggcagcgcaaaagatg

SEQ ID NO: 82070 - DNA, 103 bp, Artificial Sequence
  Synthetic Polynucleotide
taatacgactcactatagggacactttcaccactttgttcttgtatgtcaaacagaggagatgacatatgagaacaaagaacctggcggcagcgcaaaagatg

SEQ ID NO: 82071 - DNA, 103 bp, Artificial Sequence
  Synthetic Polynucleotide
taatacgactcactatagggtctcaacactttcaccactttgttcttgtaaacagaggagatacaagatgaaagtggtgaacctggcggcagcgcaaaagatg

SEQ ID NO: 82072 - DNA, 103 bp, Artificial Sequence
  Synthetic Polynucleotide
taatacgactcactataggggctggtctcaacactttcaccactttgttcaacagaggagagaacaaatgggtgaaagtaacctggcggcagcgcaaaagatg

SEQ ID NO: 82073 - DNA, 103 bp, Artificial Sequence
  Synthetic Polynucleotide
taatacgactcactatagggctggggctggtctcaacactttcaccacttaacagaggagaaagtggatgaagtgttgaaacctggcggcagcgcaaaagatg

SEQ ID NO: 82074 - DNA, 103 bp, Artificial Sequence
  Synthetic Polynucleotide
taatacgactcactatagggccctcctggggctggtctcaacactttcacaacagaggagagtgaaaatgttgagaccaaacctggcggcagcgcaaaagatg

SEQ ID NO: 82075 - DNA, 103 bp, Artificial Sequence
  Synthetic Polynucleotide
taatacgactcactataggggctttccctcctggggctggtctcaacactaacagaggagaagtgttatgaccagccccaacctggcggcagcgcaaaagatg

SEQ ID NO: 82076 - DNA, 103 bp, Artificial Sequence
  Synthetic Polynucleotide
taatacgactcactatagggtgtaggctttccctcctggggctggtctcaaacagaggagatgagacatgccccaggagaacctggcggcagcgcaaaagatg

SEQ ID NO: 82077 - DNA, 103 bp, Artificial Sequence
  Synthetic Polynucleotide
taatacgactcactatagggatccatgtaggctttccctcctggggctggaacagaggagaccagccatgggagggaaaaacctggcggcagcgcaaaagatg

SEQ ID NO: 82078 - DNA, 103 bp, Artificial Sequence
  Synthetic Polynucleotide
taatacgactcactatagggatgacatccatgtaggctttccctcctgggaacagaggagacccaggatggaaagcctaaacctggcggcagcgcaaaagatg

SEQ ID NO: 82079 - DNA, 103 bp, Artificial Sequence
  Synthetic Polynucleotide
taatacgactcactatagggccggaccaacagccaagaccagtagggcaaaacagaggagattgcccatgtggtcttggaacctggcggcagcgcaaaagatg

SEQ ID NO: 82080 - DNA, 103 bp, Artificial Sequence
  Synthetic Polynucleotide
taatacgactcactataggggacttatgacatccatgtaggctttccctcaacagaggagagagggaatgcctacatggaacctggcggcagcgcaaaagatg

SEQ ID NO: 82081 - DNA, 103 bp, Artificial Sequence
  Synthetic Polynucleotide
taatacgactcactatagggtcgtcgacttatgacatccatgtaggctttaacagaggagaaaagccatgatggatgtcaacctggcggcagcgcaaaagatg

SEQ ID NO: 82082 - DNA, 103 bp, Artificial Sequence
  Synthetic Polynucleotide
taatacgactcactatagggtggtctcgtcgacttatgacatccatgtagaacagaggagactacatatgtgtcataagaacctggcggcagcgcaaaagatg

SEQ ID NO: 82083 - DNA, 103 bp, Artificial Sequence
  Synthetic Polynucleotide
taatacgactcactatagggctctctggtctcgtcgacttatgacatccaaacagaggagatggatgatgtaagtcgacaacctggcggcagcgcaaaagatg

SEQ ID NO: 82084 - DNA, 103 bp, Artificial Sequence
  Synthetic Polynucleotide
taatacgactcactatagggggatcctctctggtctcgtcgacttatgacaacagaggagagtcataatgcgacgagacaacctggcggcagcgcaaaagatg

SEQ ID NO: 82085 - DNA, 103 bp, Artificial Sequence
  Synthetic Polynucleotide
taatacgactcactatagggtgcccggatcctctctggtctcgtcgacttaacagaggagaaagtcgatgagaccagagaacctggcggcagcgcaaaagatg

SEQ ID NO: 82086 - DNA, 103 bp, Artificial Sequence
  Synthetic Polynucleotide
taatacgactcactatagggctacctgcccggatcctctctggtctcgtcaacagaggagagacgagatgagagaggataacctggcggcagcgcaaaagatg

SEQ ID NO: 82087 - DNA, 103 bp, Artificial Sequence
  Synthetic Polynucleotide
taatacgactcactatagggagtcactacctgcccggatcctctctggtcaacagaggagagaccagatgggatccgggaacctggcggcagcgcaaaagatg

SEQ ID NO: 82088 - DNA, 103 bp, Artificial Sequence
  Synthetic Polynucleotide
taatacgactcactataggggcataagtcactacctgcccggatcctctcaacagaggagagagaggatgcgggcaggtaacctggcggcagcgcaaaagatg

SEQ ID NO: 82089 - DNA, 103 bp, Artificial Sequence
  Synthetic Polynucleotide
taatacgactcactatagggtcagagcataagtcactacctgcccggatcaacagaggagagatccgatgaggtagtgaaacctggcggcagcgcaaaagatg

SEQ ID NO: 82090 - DNA, 103 bp, Artificial Sequence
  Synthetic Polynucleotide
taatacgactcactataggggtaggccggaccaacagccaagaccagtagaacagaggagactactgatgttggctgttaacctggcggcagcgcaaaagatg

SEQ ID NO: 82091 - DNA, 103 bp, Artificial Sequence
  Synthetic Polynucleotide
taatacgactcactatagggggtgttcagagcataagtcactacctgcccaacagaggagagggcagatggtgacttataacctggcggcagcgcaaaagatg

SEQ ID NO: 82092 - DNA, 103 bp, Artificial Sequence
  Synthetic Polynucleotide
taatacgactcactataggggtgatggtgttcagagcataagtcactaccaacagaggagaggtagtatgttatgctctaacctggcggcagcgcaaaagatg

SEQ ID NO: 82093 - DNA, 103 bp, Artificial Sequence
  Synthetic Polynucleotide
taatacgactcactatagggagttggtgatggtgttcagagcataagtcaaacagaggagatgacttatgctctgaacaaacctggcggcagcgcaaaagatg

SEQ ID NO: 82094 - DNA, 103 bp, Artificial Sequence
  Synthetic Polynucleotide
taatacgactcactatagggtttcaagttggtgatggtgttcagagcataaacagaggagatatgctatgaacaccatcaacctggcggcagcgcaaaagatg

SEQ ID NO: 82095 - DNA, 103 bp, Artificial Sequence
  Synthetic Polynucleotide
taatacgactcactatagggtggactttcaagttggtgatggtgttcagaaacagaggagatctgaaatgcatcaccaaaacctggcggcagcgcaaaagatg

SEQ ID NO: 82096 - DNA, 103 bp, Artificial Sequence
  Synthetic Polynucleotide
taatacgactcactatagggtcaattggactttcaagttggtgatggtgtaacagaggagaacaccaatgccaacttgaaacctggcggcagcgcaaaagatg

SEQ ID NO: 82097 - DNA, 103 bp, Artificial Sequence
  Synthetic Polynucleotide
taatacgactcactatagggtctgatcaattggactttcaagttggtgataacagaggagaatcaccatgttgaaagtcaacctggcggcagcgcaaaagatg

SEQ ID NO: 82098 - DNA, 103 bp, Artificial Sequence
  Synthetic Polynucleotide
taatacgactcactataggggccattctgatcaattggactttcaagttgaacagaggagacaacttatgagtccaattaacctggcggcagcgcaaaagatg

SEQ ID NO: 82099 - DNA, 103 bp, Artificial Sequence
  Synthetic Polynucleotide
taatacgactcactatagggcttctgccattctgatcaattggactttcaaacagaggagatgaaagatgaattgatcaaacctggcggcagcgcaaaagatg

SEQ ID NO: 82100 - DNA, 103 bp, Artificial Sequence
  Synthetic Polynucleotide
taatacgactcactatagggctctgcttctgccattctgatcaattggacaacagaggagagtccaaatgatcagaatgaacctggcggcagcgcaaaagatg

SEQ ID NO: 82101 - DNA, 103 bp, Artificial Sequence
  Synthetic Polynucleotide
taatacgactcactatagggatgttctggtcagttctctgctaatcgctcaacagaggagagagcgaatggcagagaacaacctggcggcagcgcaaaagatg

SEQ ID NO: 82102 - DNA, 103 bp, Artificial Sequence
  Synthetic Polynucleotide
taatacgactcactataggggctgagtaggccggaccaacagccaagaccaacagaggagaggtcttatgtgttggtccaacctggcggcagcgcaaaagatg

SEQ ID NO: 82103 - DNA, 103 bp, Artificial Sequence
  Synthetic Polynucleotide
taatacgactcactatagggaccatctctgcttctgccattctgatcaataacagaggagaattgatatgaatggcagaaacctggcggcagcgcaaaagatg

SEQ ID NO: 82104 - DNA, 103 bp, Artificial Sequence
  Synthetic Polynucleotide
taatacgactcactataggggtatcaccatctctgcttctgccattctgaaacagaggagatcagaaatgcagaagcagaacctggcggcagcgcaaaagatg

SEQ ID NO: 82105 - DNA, 103 bp, Artificial Sequence
  Synthetic Polynucleotide
taatacgactcactataggggtgatgtatcaccatctctgcttctgccataacagaggagaatggcaatggcagagatgaacctggcggcagcgcaaaagatg

SEQ ID NO: 82106 - DNA, 103 bp, Artificial Sequence
  Synthetic Polynucleotide
taatacgactcactatagggtgttggtgatgtatcaccatctctgcttctaacagaggagaagaagcatggatggtgataacctggcggcagcgcaaaagatg

SEQ ID NO: 82107 - DNA, 103 bp, Artificial Sequence
  Synthetic Polynucleotide
taatacgactcactataggggaacatgttggtgatgtatcaccatctctgaacagaggagacagagaatgtgatacatcaacctggcggcagcgcaaaagatg

SEQ ID NO: 82108 - DNA, 103 bp, Artificial Sequence
  Synthetic Polynucleotide
taatacgactcactatagggatcttgaacatgttggtgatgtatcaccataacagaggagaatggtgatgcatcaccaaaacctggcggcagcgcaaaagatg

SEQ ID NO: 82109 - DNA, 103 bp, Artificial Sequence
  Synthetic Polynucleotide
taatacgactcactatagggtcacaatcttgaacatgttggtgatgtatcaacagaggagagatacaatgccaacatgtaacctggcggcagcgcaaaagatg

SEQ ID NO: 82110 - DNA, 103 bp, Artificial Sequence
  Synthetic Polynucleotide
taatacgactcactatagggattcatcacaatcttgaacatgttggtgataacagaggagaatcaccatgatgttcaagaacctggcggcagcgcaaaagatg

SEQ ID NO: 82111 - DNA, 103 bp, Artificial Sequence
  Synthetic Polynucleotide
taatacgactcactatagggaactgattcatcacaatcttgaacatgttgaacagaggagacaacatatgcaagattgtaacctggcggcagcgcaaaagatg

SEQ ID NO: 82112 - DNA, 103 bp, Artificial Sequence
  Synthetic Polynucleotide
taatacgactcactataggggtcagaactgattcatcacaatcttgaacaaacagaggagatgttcaatgttgtgatgaaacctggcggcagcgcaaaagatg

SEQ ID NO: 82113 - DNA, 103 bp, Artificial Sequence
  Synthetic Polynucleotide
taatacgactcactatagggagtgagctgagtaggccggaccaacagccaaacagaggagatggctgatggtccggcctaacctggcggcagcgcaaaagatg

SEQ ID NO: 82114 - DNA, 103 bp, Artificial Sequence
  Synthetic Polynucleotide
taatacgactcactataggggcctggtcagaactgattcatcacaatcttaacagaggagaaagattatgatgaatcagaacctggcggcagcgcaaaagatg

SEQ ID NO: 82115 - DNA, 103 bp, Artificial Sequence
  Synthetic Polynucleotide
taatacgactcactatagggctccagcctggtcagaactgattcatcacaaacagaggagatgtgatatgtcagttctgaacctggcggcagcgcaaaagatg

SEQ ID NO: 82116 - DNA, 103 bp, Artificial Sequence
  Synthetic Polynucleotide
taatacgactcactatagggcatgcctccagcctggtcagaactgattcaaacagaggagatgaatcatgtctgaccagaacctggcggcagcgcaaaagatg

SEQ ID NO: 82117 - DNA, 103 bp, Artificial Sequence
  Synthetic Polynucleotide
taatacgactcactatagggtgagccatgcctccagcctggtcagaactgaacagaggagacagttcatgccaggctggaacctggcggcagcgcaaaagatg

SEQ ID NO: 82118 - DNA, 103 bp, Artificial Sequence
  Synthetic Polynucleotide
taatacgactcactatagggctcagtgagccatgcctccagcctggtcagaacagaggagactgaccatgctggaggcaaacctggcggcagcgcaaaagatg

SEQ ID NO: 82119 - DNA, 103 bp, Artificial Sequence
  Synthetic Polynucleotide
taatacgactcactatagggccgtgctcagtgagccatgcctccagcctgaacagaggagacaggctatgggcatggctaacctggcggcagcgcaaaagatg

SEQ ID NO: 82120 - DNA, 103 bp, Artificial Sequence
  Synthetic Polynucleotide
taatacgactcactatagggcacatccgtgctcagtgagccatgcctccaaacagaggagatggaggatgggctcactgaacctggcggcagcgcaaaagatg

SEQ ID NO: 82121 - DNA, 103 bp, Artificial Sequence
  Synthetic Polynucleotide
taatacgactcactatagggtctgtcacatccgtgctcagtgagccatgcaacagaggagagcatggatgactgagcacaacctggcggcagcgcaaaagatg

SEQ ID NO: 82122 - DNA, 103 bp, Artificial Sequence
  Synthetic Polynucleotide
taatacgactcactatagggttcagtctgtcacatccgtgctcagtgagcaacagaggagagctcacatggcacggatgaacctggcggcagcgcaaaagatg

SEQ ID NO: 82123 - DNA, 103 bp, Artificial Sequence
  Synthetic Polynucleotide
taatacgactcactatagggtcctcttcagtctgtcacatccgtgctcagaacagaggagactgagcatggatgtgacaaacctggcggcagcgcaaaagatg

SEQ ID NO: 82124 - DNA, 103 bp, Artificial Sequence
  Synthetic Polynucleotide
taatacgactcactatagggaatgcagtgagctgagtaggccggaccaacaacagaggagagttggtatggcctactcaaacctggcggcagcgcaaaagatg

SEQ ID NO: 82125 - DNA, 103 bp, Artificial Sequence
  Synthetic Polynucleotide
taatacgactcactatagggcgccatcctcttcagtctgtcacatccgtgaacagaggagacacggaatggacagactgaacctggcggcagcgcaaaagatg

SEQ ID NO: 82126 - DNA, 103 bp, Artificial Sequence
  Synthetic Polynucleotide
taatacgactcactatagggctcaccgccatcctcttcagtctgtcacataacagaggagaatgtgaatgactgaagagaacctggcggcagcgcaaaagatg

SEQ ID NO: 82127 - DNA, 103 bp, Artificial Sequence
  Synthetic Polynucleotide
taatacgactcactatagggctccactcaccgccatcctcttcagtctgtaacagaggagaacagacatgagaggatggaacctggcggcagcgcaaaagatg

SEQ ID NO: 82128 - DNA, 103 bp, Artificial Sequence
  Synthetic Polynucleotide
taatacgactcactataggggtcgtctccactcaccgccatcctcttcagaacagaggagactgaagatgatggcggtgaacctggcggcagcgcaaaagatg

SEQ ID NO: 82129 - DNA, 103 bp, Artificial Sequence
  Synthetic Polynucleotide
taatacgactcactatagggacacagtcgtctccactcaccgccatcctcaacagaggagagaggatatgggtgagtggaacctggcggcagcgcaaaagatg

SEQ ID NO: 82130 - DNA, 103 bp, Artificial Sequence
  Synthetic Polynucleotide
taatacgactcactatagggggaccacacagtcgtctccactcaccgccaaacagaggagatggcggatggtggagacgaacctggcggcagcgcaaaagatg

SEQ ID NO: 82131 - DNA, 103 bp, Artificial Sequence
  Synthetic Polynucleotide
taatacgactcactataggggggccggaccacacagtcgtctccactcacaacagaggagagtgagtatggacgactgtaacctggcggcagcgcaaaagatg

SEQ ID NO: 82132 - DNA, 103 bp, Artificial Sequence
  Synthetic Polynucleotide
taatacgactcactatagggtcgatgggccggaccacacagtcgtctccaaacagaggagatggagaatgctgtgtggtaacctggcggcagcgcaaaagatg

SEQ ID NO: 82133 - DNA, 103 bp, Artificial Sequence
  Synthetic Polynucleotide
taatacgactcactatagggtgtcatcgatgggccggaccacacagtcgtaacagaggagaacgactatgtggtccggcaacctggcggcagcgcaaaagatg

SEQ ID NO: 82134 - DNA, 103 bp, Artificial Sequence
  Synthetic Polynucleotide
taatacgactcactataggggaacctgtcatcgatgggccggaccacacaaacagaggagatgtgtgatgcggcccatcaacctggcggcagcgcaaaagatg

SEQ ID NO: 82135 - DNA, 103 bp, Artificial Sequence
  Synthetic Polynucleotide
taatacgactcactatagggattccaatgcagtgagctgagtaggccggaaacagaggagatccggcatgctcagctcaaacctggcggcagcgcaaaagatg

SEQ ID NO: 82136 - DNA, 103 bp, Artificial Sequence
  Synthetic Polynucleotide
taatacgactcactatagggaggccgaacctgtcatcgatgggccggaccaacagaggagaggtccgatgcatcgatgaaacctggcggcagcgcaaaagatg

SEQ ID NO: 82137 - DNA, 103 bp, Artificial Sequence
  Synthetic Polynucleotide
taatacgactcactataggggggccaggccgaacctgtcatcgatgggccaacagaggagaggcccaatgatgacaggtaacctggcggcagcgcaaaagatg

SEQ ID NO: 82138 - DNA, 103 bp, Artificial Sequence
  Synthetic Polynucleotide
taatacgactcactatagggggacagggccaggccgaacctgtcatcgataacagaggagaatcgatatgaggttcggcaacctggcggcagcgcaaaagatg

SEQ ID NO: 82139 - DNA, 103 bp, Artificial Sequence
  Synthetic Polynucleotide
taatacgactcactatagggagatgggacagggccaggccgaacctgtcaaacagaggagatgacagatgcggcctggcaacctggcggcagcgcaaaagatg

SEQ ID NO: 82140 - DNA, 103 bp, Artificial Sequence
  Synthetic Polynucleotide
taatacgactcactatagggcgttgagatgggacagggccaggccgaaccaacagaggagaggttcgatgtggccctgtaacctggcggcagcgcaaaagatg

SEQ ID NO: 82141 - DNA, 103 bp, Artificial Sequence
  Synthetic Polynucleotide
taatacgactcactatagggcatggcgttgagatgggacagggccaggccaacagaggagaggcctgatgctgtcccataacctggcggcagcgcaaaagatg

SEQ ID NO: 82142 - DNA, 103 bp, Artificial Sequence
  Synthetic Polynucleotide
taatacgactcactatagggttggacatggcgttgagatgggacagggccaacagaggagaggccctatgccatctcaaaacctggcggcagcgcaaaagatg

SEQ ID NO: 82143 - DNA, 103 bp, Artificial Sequence
  Synthetic Polynucleotide
taatacgactcactatagggtaaccttggacatggcgttgagatgggacaaacagaggagatgtcccatgtcaacgccaaacctggcggcagcgcaaaagatg

SEQ ID NO: 82144 - DNA, 103 bp, Artificial Sequence
  Synthetic Polynucleotide
taatacgactcactatagggctttctaaccttggacatggcgttgagatgaacagaggagacatctcatggccatgtccaacctggcggcagcgcaaaagatg

SEQ ID NO: 82145 - DNA, 103 bp, Artificial Sequence
  Synthetic Polynucleotide
taatacgactcactatagggatgtcctttctaaccttggacatggcgttgaacagaggagacaacgcatggtccaaggtaacctggcggcagcgcaaaagatg

SEQ ID NO: 82146 - DNA, 103 bp, Artificial Sequence
  Synthetic Polynucleotide
taatacgactcactatagggcagtaattccaatgcagtgagctgagtaggaacagaggagacctactatgctcactgcaaacctggcggcagcgcaaaagatg

SEQ ID NO: 82147 - DNA, 103 bp, Artificial Sequence
  Synthetic Polynucleotide
taatacgactcactatagggcagatatgtcctttctaaccttggacatggaacagaggagaccatgtatgaggttagaaaacctggcggcagcgcaaaagatg

SEQ ID NO: 82148 - DNA, 103 bp, Artificial Sequence
  Synthetic Polynucleotide
taatacgactcactatagggccattcagatatgtcctttctaaccttggaaacagaggagatccaagatgagaaaggacaacctggcggcagcgcaaaagatg

SEQ ID NO: 82149 - DNA, 103 bp, Artificial Sequence
  Synthetic Polynucleotide
taatacgactcactatagggggctgccattcagatatgtcctttctaaccaacagaggagaggttagatgggacatatcaacctggcggcagcgcaaaagatg

SEQ ID NO: 82150 - DNA, 103 bp, Artificial Sequence
  Synthetic Polynucleotide
taatacgactcactatagggttgatggctgccattcagatatgtcctttcaacagaggagagaaaggatgtatctgaataacctggcggcagcgcaaaagatg

SEQ ID NO: 82151 - DNA, 103 bp, Artificial Sequence
  Synthetic Polynucleotide
taatacgactcactatagggcccttttgatggctgccattcagatatgtcaacagaggagagacataatggaatggcagaacctggcggcagcgcaaaagatg

SEQ ID NO: 82152 - DNA, 103 bp, Artificial Sequence
  Synthetic Polynucleotide
taatacgactcactatagggttccacccttttgatggctgccattcagataacagaggagaatctgaatggcagccatcaacctggcggcagcgcaaaagatg

SEQ ID NO: 82153 - DNA, 103 bp, Artificial Sequence
  Synthetic Polynucleotide
taatacgactcactatagggaatcattccacccttttgatggctgccattaacagaggagaaatggcatgcatcaaaagaacctggcggcagcgcaaaagatg

SEQ ID NO: 82154 - DNA, 103 bp, Artificial Sequence
  Synthetic Polynucleotide
taatacgactcactatagggctcccaatcattccacccttttgatggctgaacagaggagacagccaatgaaagggtggaacctggcggcagcgcaaaagatg

SEQ ID NO: 82155 - DNA, 103 bp, Artificial Sequence
  Synthetic Polynucleotide
taatacgactcactatagggacattctcccaatcattccacccttttgataacagaggagaatcaaaatggtggaatgaaacctggcggcagcgcaaaagatg

SEQ ID NO: 82156 - DNA, 103 bp, Artificial Sequence
  Synthetic Polynucleotide
taatacgactcactatagggagggcacattctcccaatcattccacccttaacagaggagaaagggtatgatgattgggaacctggcggcagcgcaaaagatg

SEQ ID NO: 82157 - DNA, 103 bp, Artificial Sequence
  Synthetic Polynucleotide
taatacgactcactatagggcctgtcagtaattccaatgcagtgagctgaaacagaggagatcagctatgtgcattggaaacctggcggcagcgcaaaagatg

SEQ ID NO: 82158 - DNA, 103 bp, Artificial Sequence
  Synthetic Polynucleotide
taatacgactcactatagggacagaagggcacattctcccaatcattccaaacagaggagatggaatatgtgggagaataacctggcggcagcgcaaaagatg

SEQ ID NO: 82159 - DNA, 103 bp, Artificial Sequence
  Synthetic Polynucleotide
taatacgactcactatagggtgggaacagaagggcacattctcccaatcaaacagaggagatgattgatggaatgtgccaacctggcggcagcgcaaaagatg

SEQ ID NO: 82160 - DNA, 103 bp, Artificial Sequence
  Synthetic Polynucleotide
taatacgactcactatagggagtggtgggaacagaagggcacattctcccaacagaggagagggagaatgtgcccttctaacctggcggcagcgcaaaagatg

SEQ ID NO: 82161 - DNA, 103 bp, Artificial Sequence
  Synthetic Polynucleotide
taatacgactcactatagggatggaagtggtgggaacagaagggcacattaacagaggagaaatgtgatgttctgttccaacctggcggcagcgcaaaagatg

SEQ ID NO: 82162 - DNA, 103 bp, Artificial Sequence
  Synthetic Polynucleotide
taatacgactcactatagggagttcatggaagtggtgggaacagaagggcaacagaggagagcccttatgttcccaccaaacctggcggcagcgcaaaagatg

SEQ ID NO: 82163 - DNA, 103 bp, Artificial Sequence
  Synthetic Polynucleotide
taatacgactcactataggggctgtagttcatggaagtggtgggaacagaaacagaggagatctgttatgaccacttccaacctggcggcagcgcaaaagatg

SEQ ID NO: 82164 - DNA, 103 bp, Artificial Sequence
  Synthetic Polynucleotide
taatacgactcactatagggcttcagctgtagttcatggaagtggtgggaaacagaggagatcccacatgttccatgaaaacctggcggcagcgcaaaagatg

SEQ ID NO: 82165 - DNA, 103 bp, Artificial Sequence
  Synthetic Polynucleotide
taatacgactcactatagggccatccttcagctgtagttcatggaagtggaacagaggagaccacttatgtgaactacaaacctggcggcagcgcaaaagatg

SEQ ID NO: 82166 - DNA, 103 bp, Artificial Sequence
  Synthetic Polynucleotide
taatacgactcactatagggtcctgccatccttcagctgtagttcatggaaacagaggagatccatgatgtacagctgaaacctggcggcagcgcaaaagatg

SEQ ID NO: 82167 - DNA, 103 bp, Artificial Sequence
  Synthetic Polynucleotide
taatacgactcactatagggaatcctcctgccatccttcagctgtagttcaacagaggagagaactaatgctgaaggataacctggcggcagcgcaaaagatg

SEQ ID NO: 82168 - DNA, 103 bp, Artificial Sequence
  Synthetic Polynucleotide
taatacgactcactatagggaaatccctgtcagtaattccaatgcagtgaaacagaggagatcactgatgtggaattacaacctggcggcagcgcaaaagatg

SEQ ID NO: 82169 - DNA, 103 bp, Artificial Sequence
  Synthetic Polynucleotide
taatacgactcactatagggaccacaatcctcctgccatccttcagctgtaacagaggagaacagctatgggatggcagaacctggcggcagcgcaaaagatg

SEQ ID NO: 82170 - DNA, 103 bp, Artificial Sequence
  Synthetic Polynucleotide
taatacgactcactatagggaaggcaccacaatcctcctgccatccttcaaacagaggagatgaaggatggcaggaggaaacctggcggcagcgcaaaagatg

SEQ ID NO: 82171 - DNA, 103 bp, Artificial Sequence
  Synthetic Polynucleotide
taatacgactcactatagggtcggcaaggcaccacaatcctcctgccatcaacagaggagagatggcatgaggattgtgaacctggcggcagcgcaaaagatg

SEQ ID NO: 82172 - DNA, 103 bp, Artificial Sequence
  Synthetic Polynucleotide
taatacgactcactatagggtgttctcggcaaggcaccacaatcctcctgaacagaggagacaggagatgtgtggtgccaacctggcggcagcgcaaaagatg

SEQ ID NO: 82173 - DNA, 103 bp, Artificial Sequence
  Synthetic Polynucleotide
taatacgactcactatagggcgtcctgttctcggcaaggcaccacaatccaacagaggagaggattgatgtgccttgccaacctggcggcagcgcaaaagatg

SEQ ID NO: 82174 - DNA, 103 bp, Artificial Sequence
  Synthetic Polynucleotide
taatacgactcactataggggagctcgtcctgttctcggcaaggcaccacaacagaggagagtggtgatgtgccgagaaaacctggcggcagcgcaaaagatg

SEQ ID NO: 82175 - DNA, 103 bp, Artificial Sequence
  Synthetic Polynucleotide
taatacgactcactatagggccaatgagctcgtcctgttctcggcaaggcaacagaggagagccttgatgagaacaggaaacctggcggcagcgcaaaagatg

SEQ ID NO: 82176 - DNA, 103 bp, Artificial Sequence
  Synthetic Polynucleotide
taatacgactcactatagggctctcccaatgagctcgtcctgttctcggcaacagaggagagccgagatgaggacgagcaacctggcggcagcgcaaaagatg

SEQ ID NO: 82177 - DNA, 103 bp, Artificial Sequence
  Synthetic Polynucleotide
taatacgactcactatagggccttcctctcccaatgagctcgtcctgttcaacagaggagagaacagatggagctcattaacctggcggcagcgcaaaagatg

SEQ ID NO: 82178 - DNA, 103 bp, Artificial Sequence
  Synthetic Polynucleotide
taatacgactcactataggggacacccttcctctcccaatgagctcgtccaacagaggagaggacgaatgcattgggagaacctggcggcagcgcaaaagatg

SEQ ID NO: 82179 - DNA, 103 bp, Artificial Sequence
  Synthetic Polynucleotide
taatacgactcactatagggcaatgaaatccctgtcagtaattccaatgcaacagaggagagcattgatgttactgacaaacctggcggcagcgcaaaagatg

SEQ ID NO: 82180 - DNA, 103 bp, Artificial Sequence
  Synthetic Polynucleotide
taatacgactcactatagggctggagacacccttcctctcccaatgagctaacagaggagaagctcaatgggagaggaaaacctggcggcagcgcaaaagatg

SEQ ID NO: 82181 - DNA, 103 bp, Artificial Sequence
  Synthetic Polynucleotide
taatacgactcactataggggtttcctggagacacccttcctctcccaataacagaggagaattgggatgggaagggtgaacctggcggcagcgcaaaagatg

SEQ ID NO: 82182 - DNA, 103 bp, Artificial Sequence
  Synthetic Polynucleotide
taatacgactcactatagggcagccgtttcctggagacacccttcctctcaacagaggagagagaggatgggtgtctccaacctggcggcagcgcaaaagatg

SEQ ID NO: 82183 - DNA, 103 bp, Artificial Sequence
  Synthetic Polynucleotide
taatacgactcactatagggtcatccagccgtttcctggagacacccttcaacagaggagagaagggatgctccaggaaaacctggcggcagcgcaaaagatg

SEQ ID NO: 82184 - DNA, 103 bp, Artificial Sequence
  Synthetic Polynucleotide
taatacgactcactatagggcttgatcatccagccgtttcctggagacacaacagaggagagtgtctatgggaaacggcaacctggcggcagcgcaaaagatg

SEQ ID NO: 82185 - DNA, 103 bp, Artificial Sequence
  Synthetic Polynucleotide
taatacgactcactataggggtttccttgatcatccagccgtttcctggaaacagaggagatccaggatgcggctggataacctggcggcagcgcaaaagatg

SEQ ID NO: 82186 - DNA, 103 bp, Artificial Sequence
  Synthetic Polynucleotide
taatacgactcactatagggaagctgtttccttgatcatccagccgtttcaacagaggagagaaacgatgggatgatcaaacctggcggcagcgcaaaagatg

SEQ ID NO: 82187 - DNA, 103 bp, Artificial Sequence
  Synthetic Polynucleotide
taatacgactcactataggggaggcaagctgtttccttgatcatccagccaacagaggagaggctggatgatcaaggaaaacctggcggcagcgcaaaagatg

SEQ ID NO: 82188 - DNA, 103 bp, Artificial Sequence
  Synthetic Polynucleotide
taatacgactcactatagggttgctgaggcaagctgtttccttgatcatcaacagaggagagatgatatgggaaacagcaacctggcggcagcgcaaaagatg

SEQ ID NO: 82189 - DNA, 103 bp, Artificial Sequence
  Synthetic Polynucleotide
taatacgactcactatagggaggctttgctgaggcaagctgtttccttgaaacagaggagatcaaggatgcagcttgccaacctggcggcagcgcaaaagatg

SEQ ID NO: 82190 - DNA, 103 bp, Artificial Sequence
  Synthetic Polynucleotide
taatacgactcactatagggcccctcaatgaaatccctgtcagtaattccaacagaggagaggaattatggacagggataacctggcggcagcgcaaaagatg

SEQ ID NO: 82191 - DNA, 103 bp, Artificial Sequence
  Synthetic Polynucleotide
taatacgactcactatagggggcataggctttgctgaggcaagctgtttcaacagaggagagaaacaatgtgcctcagcaacctggcggcagcgcaaaagatg

SEQ ID NO: 82192 - DNA, 103 bp, Artificial Sequence
  Synthetic Polynucleotide
taatacgactcactatagggatgttggcataggctttgctgaggcaagctaacagaggagaagcttgatgcagcaaagcaacctggcggcagcgcaaaagatg

SEQ ID NO: 82193 - DNA, 103 bp, Artificial Sequence
  Synthetic Polynucleotide
taatacgactcactatagggaccacatgttggcataggctttgctgaggcaacagaggagagcctcaatgaagcctatgaacctggcggcagcgcaaaagatg

SEQ ID NO: 82194 - DNA, 103 bp, Artificial Sequence
  Synthetic Polynucleotide
taatacgactcactatagggcagtgaccacatgttggcataggctttgctaacagaggagaagcaaaatgtatgccaacaacctggcggcagcgcaaaagatg

SEQ ID NO: 82195 - DNA, 103 bp, Artificial Sequence
  Synthetic Polynucleotide
taatacgactcactatagggtacatcagtgaccacatgttggcataggctaacagaggagaagcctaatgcaacatgtgaacctggcggcagcgcaaaagatg

SEQ ID NO: 82196 - DNA, 103 bp, Artificial Sequence
  Synthetic Polynucleotide
taatacgactcactataggggaaaatacatcagtgaccacatgttggcataacagaggagaatgccaatgtgtggtcacaacctggcggcagcgcaaaagatg

SEQ ID NO: 82197 - DNA, 103 bp, Artificial Sequence
  Synthetic Polynucleotide
taatacgactcactatagggtttgtgaaaatacatcagtgaccacatgttaacagaggagaaacatgatgtcactgatgaacctggcggcagcgcaaaagatg

SEQ ID NO: 82198 - DNA, 103 bp, Artificial Sequence
  Synthetic Polynucleotide
taatacgactcactatagggtcccttttgtgaaaatacatcagtgaccacaacagaggagagtggtcatggatgtatttaacctggcggcagcgcaaaagatg

SEQ ID NO: 82199 - DNA, 103 bp, Artificial Sequence
  Synthetic Polynucleotide
taatacgactcactatagggtcatgtcccttttgtgaaaatacatcagtgaacagaggagacactgaatgattttcacaaacctggcggcagcgcaaaagatg

SEQ ID NO: 82200 - DNA, 103 bp, Artificial Sequence
  Synthetic Polynucleotide
taatacgactcactatagggtagcctcatgtcccttttgtgaaaatacataacagaggagaatgtatatgcacaaaaggaacctggcggcagcgcaaaagatg

SEQ ID NO: 82201 - DNA, 103 bp, Artificial Sequence
  Synthetic Polynucleotide
taatacgactcactatagggtgcaccccctcaatgaaatccctgtcagtaaacagaggagatactgaatgggatttcataacctggcggcagcgcaaaagatg

SEQ ID NO: 82202 - DNA, 103 bp, Artificial Sequence
  Synthetic Polynucleotide
taatacgactcactataggggacagtagcctcatgtcccttttgtgaaaaaacagaggagattttcaatgaagggacataacctggcggcagcgcaaaagatg

SEQ ID NO: 82203 - DNA, 103 bp, Artificial Sequence
  Synthetic Polynucleotide
taatacgactcactatagggccaatgacagtagcctcatgtcccttttgtaacagaggagaacaaaaatgacatgaggcaacctggcggcagcgcaaaagatg

SEQ ID NO: 82204 - DNA, 103 bp, Artificial Sequence
  Synthetic Polynucleotide
taatacgactcactatagggaacagccaatgacagtagcctcatgtccctaacagaggagaagggacatgaggctactgaacctggcggcagcgcaaaagatg

SEQ ID NO: 82205 - DNA, 103 bp, Artificial Sequence
  Synthetic Polynucleotide
taatacgactcactataggggaggaaacagccaatgacagtagcctcatgaacagaggagacatgagatgactgtcattaacctggcggcagcgcaaaagatg

SEQ ID NO: 82206 - DNA, 103 bp, Artificial Sequence
  Synthetic Polynucleotide
taatacgactcactatagggcagctgaggaaacagccaatgacagtagccaacagaggagaggctacatgcattggctgaacctggcggcagcgcaaaagatg

SEQ ID NO: 82207 - DNA, 103 bp, Artificial Sequence
  Synthetic Polynucleotide
taatacgactcactataggggggaacagctgaggaaacagccaatgacagaacagaggagactgtcaatggctgtttccaacctggcggcagcgcaaaagatg

SEQ ID NO: 82208 - DNA, 103 bp, Artificial Sequence
  Synthetic Polynucleotide
taatacgactcactataggggaggtgggaacagctgaggaaacagccaataacagaggagaattggcatgttcctcagcaacctggcggcagcgcaaaagatg

SEQ ID NO: 82209 - DNA, 103 bp, Artificial Sequence
  Synthetic Polynucleotide
taatacgactcactatagggcccatgaggtgggaacagctgaggaaacagaacagaggagactgtttatgcagctgttcaacctggcggcagcgcaaaagatg

SEQ ID NO: 82210 - DNA, 103 bp, Artificial Sequence
  Synthetic Polynucleotide
taatacgactcactatagggtggaacccatgaggtgggaacagctgaggaaacagaggagatcctcaatggttcccaccaacctggcggcagcgcaaaagatg

SEQ ID NO: 82211 - DNA, 103 bp, Artificial Sequence
  Synthetic Polynucleotide
taatacgactcactatagggccttgtggaacccatgaggtgggaacagctaacagaggagaagctgtatgcacctcatgaacctggcggcagcgcaaaagatg

SEQ ID NO: 82212 - DNA, 103 bp, Artificial Sequence
  Synthetic Polynucleotide
taatacgactcactataggggaccaatgcacctcaattagcacacaggataacagaggagaatcctgatggctaattgaaacctggcggcagcgcaaaagatg

SEQ ID NO: 82213 - DNA, 103 bp, Artificial Sequence
  Synthetic Polynucleotide
taatacgactcactatagggcagacatgttctggtcagttctctgctaataacagaggagaattagcatggaactgaccaacctggcggcagcgcaaaagatg

SEQ ID NO: 82214 - DNA, 103 bp, Artificial Sequence
  Synthetic Polynucleotide
taatacgactcactatagggctccatgcaccccctcaatgaaatccctgtaacagaggagaacagggatgtcattgaggaacctggcggcagcgcaaaagatg

SEQ ID NO: 82215 - DNA, 103 bp, Artificial Sequence
  Synthetic Polynucleotide
taatacgactcactatagggtgcgtccttgtggaacccatgaggtgggaaaacagaggagattcccaatgcatgggttcaacctggcggcagcgcaaaagatg

SEQ ID NO: 82216 - DNA, 103 bp, Artificial Sequence
  Synthetic Polynucleotide
taatacgactcactatagggtgttgtgcgtccttgtggaacccatgaggtaacagaggagaacctcaatggttccacaaaacctggcggcagcgcaaaagatg

SEQ ID NO: 82217 - DNA, 103 bp, Artificial Sequence
  Synthetic Polynucleotide
taatacgactcactataggggaccatgttgtgcgtccttgtggaacccataacagaggagaatgggtatgacaaggacgaacctggcggcagcgcaaaagatg

SEQ ID NO: 82218 - DNA, 103 bp, Artificial Sequence
  Synthetic Polynucleotide
taatacgactcactataggggaatcgaccatgttgtgcgtccttgtggaaaacagaggagattccacatggacgcacaaaacctggcggcagcgcaaaagatg

SEQ ID NO: 82219 - DNA, 103 bp, Artificial Sequence
  Synthetic Polynucleotide
taatacgactcactatagggcccatgaatcgaccatgttgtgcgtccttgaacagaggagacaaggaatgacaacatggaacctggcggcagcgcaaaagatg

SEQ ID NO: 82220 - DNA, 103 bp, Artificial Sequence
  Synthetic Polynucleotide
taatacgactcactatagggcctttcccatgaatcgaccatgttgtgcgtaacagaggagaacgcacatgatggtcgataacctggcggcagcgcaaaagatg

SEQ ID NO: 82221 - DNA, 103 bp, Artificial Sequence
  Synthetic Polynucleotide
taatacgactcactatagggactcccctttcccatgaatcgaccatgttgaacagaggagacaacatatgcgattcatgaacctggcggcagcgcaaaagatg

SEQ ID NO: 82222 - DNA, 103 bp, Artificial Sequence
  Synthetic Polynucleotide
taatacgactcactatagggcatccactcccctttcccatgaatcgaccaaacagaggagatggtcgatgcatgggaaaaacctggcggcagcgcaaaagatg

SEQ ID NO: 82223 - DNA, 103 bp, Artificial Sequence
  Synthetic Polynucleotide
taatacgactcactataggggtggtcatccactcccctttcccatgaatcaacagaggagagattcaatggaaaggggaaacctggcggcagcgcaaaagatg

SEQ ID NO: 82224 - DNA, 103 bp, Artificial Sequence
  Synthetic Polynucleotide
taatacgactcactatagggcttccgtggtcatccactcccctttcccataacagaggagaatgggaatggggagtggaaacctggcggcagcgcaaaagatg

SEQ ID NO: 82225 - DNA, 103 bp, Artificial Sequence
  Synthetic Polynucleotide
taatacgactcactatagggagttcctccatgcaccccctcaatgaaatcaacagaggagagatttcatggagggggtgaacctggcggcagcgcaaaagatg

SEQ ID NO: 82226 - DNA, 103 bp, Artificial Sequence
  Synthetic Polynucleotide
taatacgactcactatagggcatgtcttccgtggtcatccactcccctttaacagaggagaaaagggatgtggatgaccaacctggcggcagcgcaaaagatg

SEQ ID NO: 82227 - DNA, 103 bp, Artificial Sequence
  Synthetic Polynucleotide
taatacgactcactatagggtcaagcatgtcttccgtggtcatccactccaacagaggagaggagtgatggaccacggaaacctggcggcagcgcaaaagatg

SEQ ID NO: 82228 - DNA, 103 bp, Artificial Sequence
  Synthetic Polynucleotide
taatacgactcactatagggacacctcaagcatgtcttccgtggtcatccaacagaggagaggatgaatgcggaagacaaacctggcggcagcgcaaaagatg

SEQ ID NO: 82229 - DNA, 103 bp, Artificial Sequence
  Synthetic Polynucleotide
taatacgactcactataggggttccacacctcaagcatgtcttccgtggtaacagaggagaaccacgatggacatgcttaacctggcggcagcgcaaaagatg

SEQ ID NO: 82230 - DNA, 103 bp, Artificial Sequence
  Synthetic Polynucleotide
taatacgactcactatagggactctgttccacacctcaagcatgtcttccaacagaggagaggaagaatggcttgaggtaacctggcggcagcgcaaaagatg

SEQ ID NO: 82231 - DNA, 103 bp, Artificial Sequence
  Synthetic Polynucleotide
taatacgactcactatagggtccatactctgttccacacctcaagcatgtaacagaggagaacatgcatgaggtgtggaaacctggcggcagcgcaaaagatg

SEQ ID NO: 82232 - DNA, 103 bp, Artificial Sequence
  Synthetic Polynucleotide
taatacgactcactatagggggttatccatactctgttccacacctcaagaacagaggagacttgagatgtggaacagaaacctggcggcagcgcaaaagatg

SEQ ID NO: 82233 - DNA, 103 bp, Artificial Sequence
  Synthetic Polynucleotide
taatacgactcactatagggttgttggttatccatactctgttccacaccaacagaggagaggtgtgatgcagagtatgaacctggcggcagcgcaaaagatg

SEQ ID NO: 82234 - DNA, 103 bp, Artificial Sequence
  Synthetic Polynucleotide
taatacgactcactataggggtgggttgttggttatccatactctgttccaacagaggagaggaacaatgtatggataaaacctggcggcagcgcaaaagatg

SEQ ID NO: 82235 - DNA, 103 bp, Artificial Sequence
  Synthetic Polynucleotide
taatacgactcactatagggcatgtgtgggttgttggttatccatactctaacagaggagaagagtaatgataaccaacaacctggcggcagcgcaaaagatg

SEQ ID NO: 82236 - DNA, 103 bp, Artificial Sequence
  Synthetic Polynucleotide
taatacgactcactatagggacccaagttcctccatgcaccccctcaatgaacagaggagacattgaatgggtgcatggaacctggcggcagcgcaaaagatg

SEQ ID NO: 82237 - DNA, 103 bp, Artificial Sequence
  Synthetic Polynucleotide
taatacgactcactatagggtcctgcatgtgtgggttgttggttatccataacagaggagaatggatatgcaacaacccaacctggcggcagcgcaaaagatg

SEQ ID NO: 82238 - DNA, 103 bp, Artificial Sequence
  Synthetic Polynucleotide
taatacgactcactatagggtcttgtcctgcatgtgtgggttgttggttaaacagaggagataaccaatgacccacacaaacctggcggcagcgcaaaagatg

SEQ ID NO: 82239 - DNA, 103 bp, Artificial Sequence
  Synthetic Polynucleotide
taatacgactcactatagggcattgtcttgtcctgcatgtgtgggttgttaacagaggagaaacaacatgcacatgcagaacctggcggcagcgcaaaagatg

SEQ ID NO: 82240 - DNA, 103 bp, Artificial Sequence
  Synthetic Polynucleotide
taatacgactcactatagggttcaccattgtcttgtcctgcatgtgtgggaacagaggagacccacaatggcaggacaaaacctggcggcagcgcaaaagatg

SEQ ID NO: 82241 - DNA, 103 bp, Artificial Sequence
  Synthetic Polynucleotide
taatacgactcactatagggattttttcaccattgtcttgtcctgcatgtaacagaggagaacatgcatgacaagacaaaacctggcggcagcgcaaaagatg

SEQ ID NO: 82242 - DNA, 103 bp, Artificial Sequence
  Synthetic Polynucleotide
taatacgactcactatagggtctccattttttcaccattgtcttgtcctgaacagaggagacaggacatgacaatggtgaacctggcggcagcgcaaaagatg

SEQ ID NO: 82243 - DNA, 103 bp, Artificial Sequence
  Synthetic Polynucleotide
taatacgactcactatagggacatctctccattttttcaccattgtcttgaacagaggagacaagacatgggtgaaaaaaacctggcggcagcgcaaaagatg

SEQ ID NO: 82244 - DNA, 103 bp, Artificial Sequence
  Synthetic Polynucleotide
taatacgactcactatagggaagggacatctctccattttttcaccattgaacagaggagacaatggatgaaaaatggaaacctggcggcagcgcaaaagatg

SEQ ID NO: 82245 - DNA, 103 bp, Artificial Sequence
  Synthetic Polynucleotide
taatacgactcactatagggtagataagggacatctctccattttttcacaacagaggagagtgaaaatgtggagagataacctggcggcagcgcaaaagatg

SEQ ID NO: 82246 - DNA, 103 bp, Artificial Sequence
  Synthetic Polynucleotide
taatacgactcactatagggttggttagataagggacatctctccattttaacagaggagaaaaatgatgagatgtcccaacctggcggcagcgcaaaagatg

SEQ ID NO: 82247 - DNA, 103 bp, Artificial Sequence
  Synthetic Polynucleotide
taatacgactcactatagggctgaaacccaagttcctccatgcaccccctaacagaggagaagggggatgatggaggaaaacctggcggcagcgcaaaagatg

SEQ ID NO: 82248 - DNA, 103 bp, Artificial Sequence
  Synthetic Polynucleotide
taatacgactcactataggggtctcttggttagataagggacatctctccaacagaggagaggagagatgtcccttatcaacctggcggcagcgcaaaagatg

SEQ ID NO: 82249 - DNA, 103 bp, Artificial Sequence
  Synthetic Polynucleotide
taatacgactcactataggggtcttgtctcttggttagataagggacatcaacagaggagagatgtcatgtatctaaccaacctggcggcagcgcaaaagatg

SEQ ID NO: 82250 - DNA, 103 bp, Artificial Sequence
  Synthetic Polynucleotide
taatacgactcactatagggagcttgtcttgtctcttggttagataagggaacagaggagacccttaatgaaccaagagaacctggcggcagcgcaaaagatg

SEQ ID NO: 82251 - DNA, 103 bp, Artificial Sequence
  Synthetic Polynucleotide
taatacgactcactatagggcgcacagcttgtcttgtctcttggttagataacagaggagaatctaaatgagagacaagaacctggcggcagcgcaaaagatg

SEQ ID NO: 82252 - DNA, 103 bp, Artificial Sequence
  Synthetic Polynucleotide
taatacgactcactatagggtgatccgcacagcttgtcttgtctcttggtaacagaggagaaccaagatgcaagacaagaacctggcggcagcgcaaaagatg

SEQ ID NO: 82253 - DNA, 103 bp, Artificial Sequence
  Synthetic Polynucleotide
taatacgactcactatagggatcagtgatccgcacagcttgtcttgtctcaacagaggagagagacaatgcaagctgtgaacctggcggcagcgcaaaagatg

SEQ ID NO: 82254 - DNA, 103 bp, Artificial Sequence
  Synthetic Polynucleotide
taatacgactcactatagggttccaatcagtgatccgcacagcttgtcttaacagaggagaaagacaatgtgtgcggataacctggcggcagcgcaaaagatg

SEQ ID NO: 82255 - DNA, 103 bp, Artificial Sequence
  Synthetic Polynucleotide
taatacgactcactatagggggtcattccaatcagtgatccgcacagcttaacagaggagaaagctgatgggatcactgaacctggcggcagcgcaaaagatg

SEQ ID NO: 82256 - DNA, 103 bp, Artificial Sequence
  Synthetic Polynucleotide
taatacgactcactatagggctattggtcattccaatcagtgatccgcacaacagaggagagtgcggatgactgattggaacctggcggcagcgcaaaagatg

SEQ ID NO: 82257 - DNA, 103 bp, Artificial Sequence
  Synthetic Polynucleotide
taatacgactcactatagggtggccctattggtcattccaatcagtgatcaacagaggagagatcacatgttggaatgaaacctggcggcagcgcaaaagatg

SEQ ID NO: 82258 - DNA, 103 bp, Artificial Sequence
  Synthetic Polynucleotide
taatacgactcactatagggggtagctgaaacccaagttcctccatgcacaacagaggagagtgcatatgggaacttggaacctggcggcagcgcaaaagatg

SEQ ID NO: 82259 - DNA, 103 bp, Artificial Sequence
  Synthetic Polynucleotide
taatacgactcactatagggccaggtggccctattggtcattccaatcagaacagaggagactgattatgatgaccaataacctggcggcagcgcaaaagatg

SEQ ID NO: 82260 - DNA, 103 bp, Artificial Sequence
  Synthetic Polynucleotide
taatacgactcactataggggaggcccaggtggccctattggtcattccaaacagaggagatggaatatgcaatagggcaacctggcggcagcgcaaaagatg

SEQ ID NO: 82261 - DNA, 103 bp, Artificial Sequence
  Synthetic Polynucleotide
taatacgactcactatagggtgtgggaggcccaggtggccctattggtcaaacagaggagatgaccaatggggccacctaacctggcggcagcgcaaaagatg

SEQ ID NO: 82262 - DNA, 103 bp, Artificial Sequence
  Synthetic Polynucleotide
taatacgactcactatagggatggatgtgggaggcccaggtggccctattaacagaggagaaataggatgacctgggccaacctggcggcagcgcaaaagatg

SEQ ID NO: 82263 - DNA, 103 bp, Artificial Sequence
  Synthetic Polynucleotide
taatacgactcactatagggactaaatggatgtgggaggcccaggtggccaacagaggagaggccacatgggcctcccaaacctggcggcagcgcaaaagatg

SEQ ID NO: 82264 - DNA, 103 bp, Artificial Sequence
  Synthetic Polynucleotide
taatacgactcactatagggggatgactaaatggatgtgggaggcccaggaacagaggagacctgggatgcccacatccaacctggcggcagcgcaaaagatg

SEQ ID NO: 82265 - DNA, 103 bp, Artificial Sequence
  Synthetic Polynucleotide
taatacgactcactatagggacgatggatgactaaatggatgtgggaggcaacagaggagagcctccatgatccatttaaacctggcggcagcgcaaaagatg

SEQ ID NO: 82266 - DNA, 103 bp, Artificial Sequence
  Synthetic Polynucleotide
taatacgactcactatagggcggatacgatggatgactaaatggatgtggaacagaggagaccacatatgtttagtcataacctggcggcagcgcaaaagatg

SEQ ID NO: 82267 - DNA, 103 bp, Artificial Sequence
  Synthetic Polynucleotide
taatacgactcactataggggcgttcggatacgatggatgactaaatggaaacagaggagatccattatgtcatccatcaacctggcggcagcgcaaaagatg

SEQ ID NO: 82268 - DNA, 103 bp, Artificial Sequence
  Synthetic Polynucleotide
taatacgactcactatagggaatcagcgttcggatacgatggatgactaaaacagaggagattagtcatgcatcgtatcaacctggcggcagcgcaaaagatg

SEQ ID NO: 82269 - DNA, 103 bp, Artificial Sequence
  Synthetic Polynucleotide
taatacgactcactatagggtccagggtagctgaaacccaagttcctccaaacagaggagatggaggatgttgggtttcaacctggcggcagcgcaaaagatg

SEQ ID NO: 82270 - DNA, 103 bp, Artificial Sequence
  Synthetic Polynucleotide
taatacgactcactatagggtgtccaatcagcgttcggatacgatggatgaacagaggagacatccaatgtatccgaacaacctggcggcagcgcaaaagatg

SEQ ID NO: 82271 - DNA, 103 bp, Artificial Sequence
  Synthetic Polynucleotide
taatacgactcactatagggtctcctgtccaatcagcgttcggatacgataacagaggagaatcgtaatggaacgctgaaacctggcggcagcgcaaaagatg

SEQ ID NO: 82272 - DNA, 103 bp, Artificial Sequence
  Synthetic Polynucleotide
taatacgactcactataggggtatttctcctgtccaatcagcgttcggataacagaggagaatccgaatgctgattggaaacctggcggcagcgcaaaagatg

SEQ ID NO: 82273 - DNA, 103 bp, Artificial Sequence
  Synthetic Polynucleotide
taatacgactcactatagggtcagtgtatttctcctgtccaatcagcgttaacagaggagaaacgctatgtggacaggaaacctggcggcagcgcaaaagatg

SEQ ID NO: 82274 - DNA, 103 bp, Artificial Sequence
  Synthetic Polynucleotide
taatacgactcactatagggggtagtcagtgtatttctcctgtccaatcaaacagaggagatgattgatgaggagaaataacctggcggcagcgcaaaagatg

SEQ ID NO: 82275 - DNA, 103 bp, Artificial Sequence
  Synthetic Polynucleotide
taatacgactcactatagggtgttaggtagtcagtgtatttctcctgtccaacagaggagaggacagatgaaatacactaacctggcggcagcgcaaaagatg

SEQ ID NO: 82276 - DNA, 103 bp, Artificial Sequence
  Synthetic Polynucleotide
taatacgactcactatagggatgactgttaggtagtcagtgtatttctccaacagaggagaggagaaatgcactgactaaacctggcggcagcgcaaaagatg

SEQ ID NO: 82277 - DNA, 103 bp, Artificial Sequence
  Synthetic Polynucleotide
taatacgactcactatagggtgtccatgactgttaggtagtcagtgtattaacagaggagaaatacaatgactacctaaaacctggcggcagcgcaaaagatg

SEQ ID NO: 82278 - DNA, 103 bp, Artificial Sequence
  Synthetic Polynucleotide
taatacgactcactatagggatacctgtccatgactgttaggtagtcagtaacagaggagaactgacatgctaacagtcaacctggcggcagcgcaaaagatg

SEQ ID NO: 82279 - DNA, 103 bp, Artificial Sequence
  Synthetic Polynucleotide
taatacgactcactatagggacagaatacctgtccatgactgttaggtagaacagaggagactacctatgagtcatggaaacctggcggcagcgcaaaagatg

SEQ ID NO: 82280 - DNA, 103 bp, Artificial Sequence
  Synthetic Polynucleotide
taatacgactcactatagggcttgctccagggtagctgaaacccaagttcaacagaggagagaacttatgtttcagctaaacctggcggcagcgcaaaagatg

SEQ ID NO: 82281 - DNA, 103 bp, Artificial Sequence
  Synthetic Polynucleotide
taatacgactcactatagggcatccacagaatacctgtccatgactgttaaacagaggagataacagatgtggacaggtaacctggcggcagcgcaaaagatg

SEQ ID NO: 82282 - DNA, 103 bp, Artificial Sequence
  Synthetic Polynucleotide
taatacgactcactataggggtcagcatccacagaatacctgtccatgacaacagaggagagtcatgatgaggtattctaacctggcggcagcgcaaaagatg

SEQ ID NO: 82283 - DNA, 103 bp, Artificial Sequence
  Synthetic Polynucleotide
taatacgactcactatagggtgcaggtcagcatccacagaatacctgtccaacagaggagaggacagatgttctgtggaaacctggcggcagcgcaaaagatg

SEQ ID NO: 82284 - DNA, 103 bp, Artificial Sequence
  Synthetic Polynucleotide
taatacgactcactatagggccagttgcaggtcagcatccacagaataccaacagaggagaggtattatgtggatgctgaacctggcggcagcgcaaaagatg

SEQ ID NO: 82285 - DNA, 103 bp, Artificial Sequence
  Synthetic Polynucleotide
taatacgactcactatagggctcacccagttgcaggtcagcatccacagaaacagaggagatctgtgatggctgacctgaacctggcggcagcgcaaaagatg

SEQ ID NO: 82286 - DNA, 103 bp, Artificial Sequence
  Synthetic Polynucleotide
taatacgactcactatagggataagctcacccagttgcaggtcagcatccaacagaggagaggatgcatgcctgcaactaacctggcggcagcgcaaaagatg

SEQ ID NO: 82287 - DNA, 103 bp, Artificial Sequence
  Synthetic Polynucleotide
taatacgactcactatagggttcagataagctcacccagttgcaggtcagaacagaggagactgaccatgaactgggtgaacctggcggcagcgcaaaagatg

SEQ ID NO: 82288 - DNA, 103 bp, Artificial Sequence
  Synthetic Polynucleotide
taatacgactcactatagggggtgtttcagataagctcacccagttgcagaacagaggagactgcaaatgggtgagcttaacctggcggcagcgcaaaagatg

SEQ ID NO: 82289 - DNA, 103 bp, Artificial Sequence
  Synthetic Polynucleotide
taatacgactcactatagggtagatggtgtttcagataagctcacccagtaacagaggagaactgggatggcttatctgaacctggcggcagcgcaaaagatg

SEQ ID NO: 82290 - DNA, 103 bp, Artificial Sequence
  Synthetic Polynucleotide
taatacgactcactatagggcctgttagatggtgtttcagataagctcacaacagaggagagtgagcatgtctgaaacaaacctggcggcagcgcaaaagatg

SEQ ID NO: 82291 - DNA, 103 bp, Artificial Sequence
  Synthetic Polynucleotide
taatacgactcactatagggcttgtcttgctccagggtagctgaaacccaaacagaggagatgggttatggctaccctgaacctggcggcagcgcaaaagatg

SEQ ID NO: 82292 - DNA, 103 bp, Artificial Sequence
  Synthetic Polynucleotide
taatacgactcactatagggttattcctgttagatggtgtttcagataagaacagaggagacttatcatgaacaccatcaacctggcggcagcgcaaaagatg

SEQ ID NO: 82293 - DNA, 103 bp, Artificial Sequence
  Synthetic Polynucleotide
taatacgactcactatagggcccggttattcctgttagatggtgtttcagaacagaggagactgaaaatgcatctaacaaacctggcggcagcgcaaaagatg

SEQ ID NO: 82294 - DNA, 103 bp, Artificial Sequence
  Synthetic Polynucleotide
taatacgactcactatagggtgtatcccggttattcctgttagatggtgtaacagaggagaacaccaatgaacaggaataacctggcggcagcgcaaaagatg

SEQ ID NO: 82295 - DNA, 103 bp, Artificial Sequence
  Synthetic Polynucleotide
taatacgactcactatagggtggtttgtatcccggttattcctgttagataacagaggagaatctaaatggaataaccgaacctggcggcagcgcaaaagatg

SEQ ID NO: 82296 - DNA, 103 bp, Artificial Sequence
  Synthetic Polynucleotide
taatacgactcactatagggacccgtggtttgtatcccggttattcctgtaacagaggagaacaggaatgaccgggataaacctggcggcagcgcaaaagatg

SEQ ID NO: 82297 - DNA, 103 bp, Artificial Sequence
  Synthetic Polynucleotide
taatacgactcactatagggtctccacccgtggtttgtatcccggttattaacagaggagaaataacatggatacaaacaacctggcggcagcgcaaaagatg

SEQ ID NO: 82298 - DNA, 103 bp, Artificial Sequence
  Synthetic Polynucleotide
taatacgactcactatagggccggttctccacccgtggtttgtatcccggaacagaggagaccgggaatgaaaccacggaacctggcggcagcgcaaaagatg

SEQ ID NO: 82299 - DNA, 103 bp, Artificial Sequence
  Synthetic Polynucleotide
taatacgactcactatagggggagtccggttctccacccgtggtttgtataacagaggagaatacaaatgacgggtggaaacctggcggcagcgcaaaagatg

SEQ ID NO: 82300 - DNA, 103 bp, Artificial Sequence
  Synthetic Polynucleotide
taatacgactcactatagggtgtggggagtccggttctccacccgtggttaacagaggagaaaccacatgtggagaaccaacctggcggcagcgcaaaagatg

SEQ ID NO: 82301 - DNA, 103 bp, Artificial Sequence
  Synthetic Polynucleotide
taatacgactcactatagggcaggttgtggggagtccggttctccacccgaacagaggagacgggtgatgaaccggactaacctggcggcagcgcaaaagatg

SEQ ID NO: 82302 - DNA, 103 bp, Artificial Sequence
  Synthetic Polynucleotide
taatacgactcactatagggacacacttgtcttgctccagggtagctgaaaacagaggagattcagcatgcctggagcaaacctggcggcagcgcaaaagatg

SEQ ID NO: 82303 - DNA, 103 bp, Artificial Sequence
  Synthetic Polynucleotide
taatacgactcactatagggggtttcaggttgtggggagtccggttctccaacagaggagaggagaaatggactccccaaacctggcggcagcgcaaaagatg

SEQ ID NO: 82304 - DNA, 103 bp, Artificial Sequence
  Synthetic Polynucleotide
taatacgactcactatagggatcccggtttcaggttgtggggagtccggtaacagaggagaaccggaatgcccacaaccaacctggcggcagcgcaaaagatg

SEQ ID NO: 82305 - DNA, 103 bp, Artificial Sequence
  Synthetic Polynucleotide
taatacgactcactatagggtttatatcccggtttcaggttgtggggagtaacagaggagaactcccatgaacctgaaaaacctggcggcagcgcaaaagatg

SEQ ID NO: 82306 - DNA, 103 bp, Artificial Sequence
  Synthetic Polynucleotide
taatacgactcactatagggcgtggtttatatcccggtttcaggttgtggaacagaggagaccacaaatggaaaccgggaacctggcggcagcgcaaaagatg

SEQ ID NO: 82307 - DNA, 103 bp, Artificial Sequence
  Synthetic Polynucleotide
taatacgactcactatagggccagccgtggtttatatcccggtttcaggtaacagaggagaacctgaatgcgggatataaacctggcggcagcgcaaaagatg

SEQ ID NO: 82308 - DNA, 103 bp, Artificial Sequence
  Synthetic Polynucleotide
taatacgactcactataggggttctccagccgtggtttatatcccggtttaacagaggagaaaaccgatgtataaaccaaacctggcggcagcgcaaaagatg

SEQ ID NO: 82309 - DNA, 103 bp, Artificial Sequence
  Synthetic Polynucleotide
taatacgactcactataggggcccggttctccagccgtggtttatatcccaacagaggagagggataatgaccacggctaacctggcggcagcgcaaaagatg

SEQ ID NO: 82310 - DNA, 103 bp, Artificial Sequence
  Synthetic Polynucleotide
taatacgactcactataggggcggagcccggttctccagccgtggtttataacagaggagaataaacatgggctggagaaacctggcggcagcgcaaaagatg

SEQ ID NO: 82311 - DNA, 103 bp, Artificial Sequence
  Synthetic Polynucleotide
taatacgactcactatagggtaagtgcggagcccggttctccagccgtggaacagaggagaccacggatggagaaccggaacctggcggcagcgcaaaagatg

SEQ ID NO: 82312 - DNA, 103 bp, Artificial Sequence
  Synthetic Polynucleotide
taatacgactcactatagggcattttaagtgcggagcccggttctccagcaacagaggagagctggaatgccgggctccaacctggcggcagcgcaaaagatg

SEQ ID NO: 82313 - DNA, 103 bp, Artificial Sequence
  Synthetic Polynucleotide
taatacgactcactatagggcagtgacacacttgtcttgctccagggtagaacagaggagactacccatgagcaagacaaacctggcggcagcgcaaaagatg

SEQ ID NO: 82314 - DNA, 103 bp, Artificial Sequence
  Synthetic Polynucleotide
taatacgactcactatagggtgtttcattttaagtgcggagcccggttctaacagaggagaagaaccatgctccgcactaacctggcggcagcgcaaaagatg

SEQ ID NO: 82315 - DNA, 103 bp, Artificial Sequence
  Synthetic Polynucleotide
taatacgactcactataggggtttctgtttcattttaagtgcggagcccgaacagaggagacgggctatgcacttaaaaaacctggcggcagcgcaaaagatg

SEQ ID NO: 82316 - DNA, 103 bp, Artificial Sequence
  Synthetic Polynucleotide
taatacgactcactatagggtcccggtttctgtttcattttaagtgcggaaacagaggagatccgcaatgaaaatgaaaaacctggcggcagcgcaaaagatg

SEQ ID NO: 82317 - DNA, 103 bp, Artificial Sequence
  Synthetic Polynucleotide
taatacgactcactatagggttttatcccggtttctgtttcattttaagtaacagaggagaacttaaatggaaacagaaaacctggcggcagcgcaaaagatg

SEQ ID NO: 82318 - DNA, 103 bp, Artificial Sequence
  Synthetic Polynucleotide
taatacgactcactataggggtagtttttatcccggtttctgtttcatttaacagaggagaaaatgaatgagaaaccggaacctggcggcagcgcaaaagatg

SEQ ID NO: 82319 - DNA, 103 bp, Artificial Sequence
  Synthetic Polynucleotide
taatacgactcactatagggcatccgtagtttttatcccggtttctgtttaacagaggagaaaacagatgccgggataaaacctggcggcagcgcaaaagatg

SEQ ID NO: 82320 - DNA, 103 bp, Artificial Sequence
  Synthetic Polynucleotide
taatacgactcactatagggttctccatccgtagtttttatcccggtttcaacagaggagagaaaccatgataaaaactaacctggcggcagcgcaaaagatg

SEQ ID NO: 82321 - DNA, 103 bp, Artificial Sequence
  Synthetic Polynucleotide
taatacgactcactatagggtccggttctccatccgtagtttttatcccgaacagaggagacgggatatgaactacggaaacctggcggcagcgcaaaagatg

SEQ ID NO: 82322 - DNA, 103 bp, Artificial Sequence
  Synthetic Polynucleotide
taatacgactcactatagggtggagtccggttctccatccgtagtttttaaacagaggagataaaaaatgcggatggagaacctggcggcagcgcaaaagatg

SEQ ID NO: 82323 - DNA, 103 bp, Artificial Sequence
  Synthetic Polynucleotide
taatacgactcactatagggatgtgtggagtccggttctccatccgtagtaacagaggagaactacgatgggagaaccgaacctggcggcagcgcaaaagatg

SEQ ID NO: 82324 - DNA, 103 bp, Artificial Sequence
  Synthetic Polynucleotide
taatacgactcactatagggacgaccagacatgttctggtcagttctctgaacagaggagacagagaatggaccagaacaacctggcggcagcgcaaaagatg

SEQ ID NO: 82325 - DNA, 103 bp, Artificial Sequence
  Synthetic Polynucleotide
taatacgactcactatagggcataacagtgacacacttgtcttgctccagaacagaggagactggagatggacaagtgtaacctggcggcagcgcaaaagatg

SEQ ID NO: 82326 - DNA, 103 bp, Artificial Sequence
  Synthetic Polynucleotide
taatacgactcactatagggtctcaatgtgtggagtccggttctccatccaacagaggagaggatggatgaccggactcaacctggcggcagcgcaaaagatg

SEQ ID NO: 82327 - DNA, 103 bp, Artificial Sequence
  Synthetic Polynucleotide
taatacgactcactatagggttctgtctcaatgtgtggagtccggttctcaacagaggagagagaacatgactccacacaacctggcggcagcgcaaaagatg

SEQ ID NO: 82328 - DNA, 103 bp, Artificial Sequence
  Synthetic Polynucleotide
taatacgactcactatagggacttcttctgtctcaatgtgtggagtccggaacagaggagaccggacatgacacattgaaacctggcggcagcgcaaaagatg

SEQ ID NO: 82329 - DNA, 103 bp, Artificial Sequence
  Synthetic Polynucleotide
taatacgactcactatagggtgacaacttcttctgtctcaatgtgtggagaacagaggagactccacatgttgagacagaacctggcggcagcgcaaaagatg

SEQ ID NO: 82330 - DNA, 103 bp, Artificial Sequence
  Synthetic Polynucleotide
taatacgactcactatagggtgggctgacaacttcttctgtctcaatgtgaacagaggagacacattatgacagaagaaaacctggcggcagcgcaaaagatg

SEQ ID NO: 82331 - DNA, 103 bp, Artificial Sequence
  Synthetic Polynucleotide
taatacgactcactatagggggttctgggctgacaacttcttctgtctcaaacagaggagatgagacatgagaagttgtaacctggcggcagcgcaaaagatg

SEQ ID NO: 82332 - DNA, 103 bp, Artificial Sequence
  Synthetic Polynucleotide
taatacgactcactatagggtgtggggttctgggctgacaacttcttctgaacagaggagacagaagatgttgtcagccaacctggcggcagcgcaaaagatg

SEQ ID NO: 82333 - DNA, 103 bp, Artificial Sequence
  Synthetic Polynucleotide
taatacgactcactatagggactcgtgtggggttctgggctgacaacttcaacagaggagagaagttatgagcccagaaaacctggcggcagcgcaaaagatg

SEQ ID NO: 82334 - DNA, 103 bp, Artificial Sequence
  Synthetic Polynucleotide
taatacgactcactataggggcaaaactcgtgtggggttctgggctgacaaacagaggagatgtcagatgagaaccccaaacctggcggcagcgcaaaagatg

SEQ ID NO: 82335 - DNA, 103 bp, Artificial Sequence
  Synthetic Polynucleotide
taatacgactcactatagggcagtggcaaaactcgtgtggggttctgggcaacagaggagagcccagatgcccacacgaaacctggcggcagcgcaaaagatg

SEQ ID NO: 82336 - DNA, 103 bp, Artificial Sequence
  Synthetic Polynucleotide
taatacgactcactatagggggggccataacagtgacacacttgtcttgcaacagaggagagcaagaatggtgtgtcacaacctggcggcagcgcaaaagatg

SEQ ID NO: 82337 - DNA, 103 bp, Artificial Sequence
  Synthetic Polynucleotide
taatacgactcactatagggcttagcagtggcaaaactcgtgtggggttcaacagaggagagaacccatgacgagttttaacctggcggcagcgcaaaagatg

SEQ ID NO: 82338 - DNA, 103 bp, Artificial Sequence
  Synthetic Polynucleotide
taatacgactcactatagggcacagcttagcagtggcaaaactcgtgtggaacagaggagaccacacatgttttgccacaacctggcggcagcgcaaaagatg

SEQ ID NO: 82339 - DNA, 103 bp, Artificial Sequence
  Synthetic Polynucleotide
taatacgactcactatagggtgcctcacagcttagcagtggcaaaactcgaacagaggagacgagttatgccactgctaaacctggcggcagcgcaaaagatg

SEQ ID NO: 82340 - DNA, 103 bp, Artificial Sequence
  Synthetic Polynucleotide
taatacgactcactatagggtgcactgcctcacagcttagcagtggcaaaaacagaggagatttgccatggctaagctgaacctggcggcagcgcaaaagatg

SEQ ID NO: 82341 - DNA, 103 bp, Artificial Sequence
  Synthetic Polynucleotide
taatacgactcactatagggcagcctgcactgcctcacagcttagcagtgaacagaggagacactgcatggctgtgaggaacctggcggcagcgcaaaagatg

SEQ ID NO: 82342 - DNA, 103 bp, Artificial Sequence
  Synthetic Polynucleotide
taatacgactcactatagggtgtcccagcctgcactgcctcacagcttagaacagaggagactaagcatggaggcagtgaacctggcggcagcgcaaaagatg

SEQ ID NO: 82343 - DNA, 103 bp, Artificial Sequence
  Synthetic Polynucleotide
taatacgactcactatagggtcggctgtcccagcctgcactgcctcacagaacagaggagactgtgaatgagtgcaggcaacctggcggcagcgcaaaagatg

SEQ ID NO: 82344 - DNA, 103 bp, Artificial Sequence
  Synthetic Polynucleotide
taatacgactcactatagggggaggtcggctgtcccagcctgcactgcctaacagaggagaaggcagatgaggctgggaaacctggcggcagcgcaaaagatg

SEQ ID NO: 82345 - DNA, 103 bp, Artificial Sequence
  Synthetic Polynucleotide
taatacgactcactatagggaacctggaggtcggctgtcccagcctgcacaacagaggagagtgcagatggggacagccaacctggcggcagcgcaaaagatg

SEQ ID NO: 82346 - DNA, 103 bp, Artificial Sequence
  Synthetic Polynucleotide
taatacgactcactatagggttcgcaacctggaggtcggctgtcccagccaacagaggagaggctggatgagccgacctaacctggcggcagcgcaaaagatg

SEQ ID NO: 82347 - DNA, 103 bp, Artificial Sequence
  Synthetic Polynucleotide
taatacgactcactatagggtgtcaggggccataacagtgacacacttgtaacagaggagaacaagtatgtcactgttaaacctggcggcagcgcaaaagatg

SEQ ID NO: 82348 - DNA, 103 bp, Artificial Sequence
  Synthetic Polynucleotide
taatacgactcactatagggggtttttcgcaacctggaggtcggctgtccaacagaggagaggacagatgacctccaggaacctggcggcagcgcaaaagatg

SEQ ID NO: 82349 - DNA, 103 bp, Artificial Sequence
  Synthetic Polynucleotide
taatacgactcactatagggaaccaggtttttcgcaacctggaggtcggcaacagaggagagccgacatgcaggttgcgaacctggcggcagcgcaaaagatg

SEQ ID NO: 82350 - DNA, 103 bp, Artificial Sequence
  Synthetic Polynucleotide
taatacgactcactatagggccagaaaccaggtttttcgcaacctggaggaacagaggagacctccaatgtgcgaaaaaaacctggcggcagcgcaaaagatg

SEQ ID NO: 82351 - DNA, 103 bp, Artificial Sequence
  Synthetic Polynucleotide
taatacgactcactatagggaggtcccagaaaccaggtttttcgcaacctaacagaggagaaggttgatgaaaacctggaacctggcggcagcgcaaaagatg

SEQ ID NO: 82352 - DNA, 103 bp, Artificial Sequence
  Synthetic Polynucleotide
taatacgactcactataggggtgggaggtcccagaaaccaggtttttcgcaacagaggagagcgaaaatgctggtttctaacctggcggcagcgcaaaagatg

SEQ ID NO: 82353 - DNA, 103 bp, Artificial Sequence
  Synthetic Polynucleotide
taatacgactcactatagggctggggtgggaggtcccagaaaccaggtttaacagaggagaaaacctatgttctgggacaacctggcggcagcgcaaaagatg

SEQ ID NO: 82354 - DNA, 103 bp, Artificial Sequence
  Synthetic Polynucleotide
taatacgactcactatagggttactctggggtgggaggtcccagaaaccaaacagaggagatggtttatgggacctcccaacctggcggcagcgcaaaagatg

SEQ ID NO: 82355 - DNA, 103 bp, Artificial Sequence
  Synthetic Polynucleotide
taatacgactcactatagggtctttttactctggggtgggaggtcccagaaacagaggagatctgggatgtcccaccccaacctggcggcagcgcaaaagatg

SEQ ID NO: 82356 - DNA, 103 bp, Artificial Sequence
  Synthetic Polynucleotide
taatacgactcactatagggtccgttctttttactctggggtgggaggtcaacagaggagagacctcatgccccagagtaacctggcggcagcgcaaaagatg

SEQ ID NO: 82357 - DNA, 103 bp, Artificial Sequence
  Synthetic Polynucleotide
taatacgactcactataggggaggctccgttctttttactctggggtgggaacagaggagacccaccatggagtaaaaaaacctggcggcagcgcaaaagatg

SEQ ID NO: 82358 - DNA, 103 bp, Artificial Sequence
  Synthetic Polynucleotide
taatacgactcactatagggaggcttgtcaggggccataacagtgacacaaacagaggagatgtgtcatggttatggccaacctggcggcagcgcaaaagatg

SEQ ID NO: 82359 - DNA, 103 bp, Artificial Sequence
  Synthetic Polynucleotide
taatacgactcactatagggtagcggaggctccgttctttttactctgggaacagaggagacccagaatgaaaagaacgaacctggcggcagcgcaaaagatg

SEQ ID NO: 82360 - DNA, 103 bp, Artificial Sequence
  Synthetic Polynucleotide
taatacgactcactatagggggtggtagcggaggctccgttctttttactaacagaggagaagtaaaatgaacggagccaacctggcggcagcgcaaaagatg

SEQ ID NO: 82361 - DNA, 103 bp, Artificial Sequence
  Synthetic Polynucleotide
taatacgactcactataggggggagggtggtagcggaggctccgttctttaacagaggagaaaagaaatgagcctccgcaacctggcggcagcgcaaaagatg

SEQ ID NO: 82362 - DNA, 103 bp, Artificial Sequence
  Synthetic Polynucleotide
taatacgactcactatagggcacgtgggagggtggtagcggaggctccgtaacagaggagaacggagatgccgctaccaaacctggcggcagcgcaaaagatg

SEQ ID NO: 82363 - DNA, 103 bp, Artificial Sequence
  Synthetic Polynucleotide
taatacgactcactatagggaccaccacgtgggagggtggtagcggaggcaacagaggagagcctccatgaccaccctcaacctggcggcagcgcaaaagatg

SEQ ID NO: 82364 - DNA, 103 bp, Artificial Sequence
  Synthetic Polynucleotide
taatacgactcactatagggtttctaccaccacgtgggagggtggtagcgaacagaggagacgctacatgcctcccacgaacctggcggcagcgcaaaagatg

SEQ ID NO: 82365 - DNA, 103 bp, Artificial Sequence
  Synthetic Polynucleotide
taatacgactcactatagggccgtctttctaccaccacgtgggagggtggaacagaggagaccacccatgcacgtggtgaacctggcggcagcgcaaaagatg

SEQ ID NO: 82366 - DNA, 103 bp, Artificial Sequence
  Synthetic Polynucleotide
taatacgactcactatagggagaccccgtctttctaccaccacgtgggagaacagaggagactcccaatgggtggtagaaacctggcggcagcgcaaaagatg

SEQ ID NO: 82367 - DNA, 103 bp, Artificial Sequence
  Synthetic Polynucleotide
taatacgactcactatagggcctctagaccccgtctttctaccaccacgtaacagaggagaacgtggatgtagaaagacaacctggcggcagcgcaaaagatg

SEQ ID NO: 82368 - DNA, 103 bp, Artificial Sequence
  Synthetic Polynucleotide
taatacgactcactatagggtctaacctctagaccccgtctttctaccacaacagaggagagtggtaatgagacggggtaacctggcggcagcgcaaaagatg

SEQ ID NO: 82369 - DNA, 103 bp, Artificial Sequence
  Synthetic Polynucleotide
taatacgactcactatagggaatgaaggcttgtcaggggccataacagtgaacagaggagacactgtatgggcccctgaaacctggcggcagcgcaaaagatg

SEQ ID NO: 82370 - DNA, 103 bp, Artificial Sequence
  Synthetic Polynucleotide
taatacgactcactatagggtctcctctaacctctagaccccgtctttctaacagaggagaagaaagatggggtctagaaacctggcggcagcgcaaaagatg

SEQ ID NO: 82371 - DNA, 103 bp, Artificial Sequence
  Synthetic Polynucleotide
taatacgactcactataggggagggtctcctctaacctctagaccccgtcaacagaggagagacgggatgtagaggttaaacctggcggcagcgcaaaagatg

SEQ ID NO: 82372 - DNA, 103 bp, Artificial Sequence
  Synthetic Polynucleotide
taatacgactcactatagggccctggagggtctcctctaacctctagaccaacagaggagaggtctaatggttagaggaaacctggcggcagcgcaaaagatg

SEQ ID NO: 82373 - DNA, 103 bp, Artificial Sequence
  Synthetic Polynucleotide
taatacgactcactatagggttgttccctggagggtctcctctaacctctaacagaggagaagaggtatgaggagacccaacctggcggcagcgcaaaagatg

SEQ ID NO: 82374 - DNA, 103 bp, Artificial Sequence
  Synthetic Polynucleotide
taatacgactcactatagggactatttgttccctggagggtctcctctaaaacagaggagattagagatgaccctccagaacctggcggcagcgcaaaagatg

SEQ ID NO: 82375 - DNA, 103 bp, Artificial Sequence
  Synthetic Polynucleotide
taatacgactcactataggggtcccactatttgttccctggagggtctccaacagaggagaggagacatgccagggaacaacctggcggcagcgcaaaagatg

SEQ ID NO: 82376 - DNA, 103 bp, Artificial Sequence
  Synthetic Polynucleotide
taatacgactcactatagggatatggtcccactatttgttccctggagggaacagaggagaccctccatggaacaaataaacctggcggcagcgcaaaagatg

SEQ ID NO: 82377 - DNA, 103 bp, Artificial Sequence
  Synthetic Polynucleotide
taatacgactcactatagggcgtcaatatggtcccactatttgttccctgaacagaggagacagggaatgaatagtgggaacctggcggcagcgcaaaagatg

SEQ ID NO: 82378 - DNA, 103 bp, Artificial Sequence
  Synthetic Polynucleotide
taatacgactcactatagggcctggcgtcaatatggtcccactatttgttaacagaggagaaacaaaatgtgggaccataacctggcggcagcgcaaaagatg

SEQ ID NO: 82379 - DNA, 103 bp, Artificial Sequence
  Synthetic Polynucleotide
taatacgactcactatagggctttccctggcgtcaatatggtcccactataacagaggagaatagtgatgccatattgaaacctggcggcagcgcaaaagatg

SEQ ID NO: 82380 - DNA, 103 bp, Artificial Sequence
  Synthetic Polynucleotide
taatacgactcactatagggtgtccaatgaaggcttgtcaggggccataaaacagaggagattatggatgctgacaagcaacctggcggcagcgcaaaagatg

SEQ ID NO: 82381 - DNA, 103 bp, Artificial Sequence
  Synthetic Polynucleotide
taatacgactcactatagggccggtctttccctggcgtcaatatggtcccaacagaggagagggaccatgttgacgccaaacctggcggcagcgcaaaagatg

SEQ ID NO: 82382 - DNA, 103 bp, Artificial Sequence
  Synthetic Polynucleotide
taatacgactcactatagggccactccggtctttccctggcgtcaatatgaacagaggagacatattatggccagggaaaacctggcggcagcgcaaaagatg

SEQ ID NO: 82383 - DNA, 103 bp, Artificial Sequence
  Synthetic Polynucleotide
taatacgactcactataggggagaaccactccggtctttccctggcgtcaaacagaggagatgacgcatgggaaagaccaacctggcggcagcgcaaaagatg

SEQ ID NO: 82384 - DNA, 103 bp, Artificial Sequence
  Synthetic Polynucleotide
taatacgactcactatagggaagcagagaaccactccggtctttccctggaacagaggagaccagggatggaccggagtaacctggcggcagcgcaaaagatg

SEQ ID NO: 82385 - DNA, 103 bp, Artificial Sequence
  Synthetic Polynucleotide
taatacgactcactatagggaggaaaagcagagaaccactccggtctttcaacagaggagagaaagaatggagtggttcaacctggcggcagcgcaaaagatg

SEQ ID NO: 82386 - DNA, 103 bp, Artificial Sequence
  Synthetic Polynucleotide
taatacgactcactatagggtctggaggaaaagcagagaaccactccggtaacagaggagaaccggaatggttctctgcaacctggcggcagcgcaaaagatg

SEQ ID NO: 82387 - DNA, 103 bp, Artificial Sequence
  Synthetic Polynucleotide
taatacgactcactatagggagacctctggaggaaaagcagagaaccactaacagaggagaagtggtatgctgcttttcaacctggcggcagcgcaaaagatg

SEQ ID NO: 82388 - DNA, 103 bp, Artificial Sequence
  Synthetic Polynucleotide
taatacgactcactatagggctcacagacctctggaggaaaagcagagaaaacagaggagattctctatgtttcctccaaacctggcggcagcgcaaaagatg

SEQ ID NO: 82389 - DNA, 103 bp, Artificial Sequence
  Synthetic Polynucleotide
taatacgactcactatagggctgtgctcacagacctctggaggaaaagcaaacagaggagatgctttatgtccagaggtaacctggcggcagcgcaaaagatg

SEQ ID NO: 82390 - DNA, 103 bp, Artificial Sequence
  Synthetic Polynucleotide
taatacgactcactataggggcaaactgtgctcacagacctctggaggaaaacagaggagattcctcatgaggtctgtgaacctggcggcagcgcaaaagatg

SEQ ID NO: 82391 - DNA, 103 bp, Artificial Sequence
  Synthetic Polynucleotide
taatacgactcactatagggtgagatgtccaatgaaggcttgtcaggggcaacagaggagagcccctatgaagccttcaaacctggcggcagcgcaaaagatg

SEQ ID NO: 82392 - DNA, 103 bp, Artificial Sequence
  Synthetic Polynucleotide
taatacgactcactatagggcttgagcaaactgtgctcacagacctctggaacagaggagaccagagatgtgtgagcacaacctggcggcagcgcaaaagatg

SEQ ID NO: 82393 - DNA, 103 bp, Artificial Sequence
  Synthetic Polynucleotide
taatacgactcactatagggttattcttgagcaaactgtgctcacagaccaacagaggagaggtctgatggcacagtttaacctggcggcagcgcaaaagatg

SEQ ID NO: 82394 - DNA, 103 bp, Artificial Sequence
  Synthetic Polynucleotide
taatacgactcactatagggtctgcttattcttgagcaaactgtgctcacaacagaggagagtgagcatggtttgctcaaacctggcggcagcgcaaaagatg

SEQ ID NO: 82395 - DNA, 103 bp, Artificial Sequence
  Synthetic Polynucleotide
taatacgactcactatagggaaaggtctgcttattcttgagcaaactgtgaacagaggagacacagtatgctcaagaataacctggcggcagcgcaaaagatg

SEQ ID NO: 82396 - DNA, 103 bp, Artificial Sequence
  Synthetic Polynucleotide
taatacgactcactatagggcatccaaaggtctgcttattcttgagcaaaaacagaggagatttgctatggaataagcaaacctggcggcagcgcaaaagatg

SEQ ID NO: 82397 - DNA, 103 bp, Artificial Sequence
  Synthetic Polynucleotide
taatacgactcactatagggtttgtcatccaaaggtctgcttattcttgaaacagaggagatcaagaatgagcagacctaacctggcggcagcgcaaaagatg

SEQ ID NO: 82398 - DNA, 103 bp, Artificial Sequence
  Synthetic Polynucleotide
taatacgactcactatagggttgtgtttgtcatccaaaggtctgcttattaacagaggagaaataagatgacctttggaaacctggcggcagcgcaaaagatg

SEQ ID NO: 82399 - DNA, 103 bp, Artificial Sequence
  Synthetic Polynucleotide
taatacgactcactatagggtggttttgtgtttgtcatccaaaggtctgcaacagaggagagcagacatgtggatgacaaacctggcggcagcgcaaaagatg

SEQ ID NO: 82400 - DNA, 103 bp, Artificial Sequence
  Synthetic Polynucleotide
taatacgactcactatagggtctagtgagatgtccaatgaaggcttgtcaaacagaggagatgacaaatgttcattggaaacctggcggcagcgcaaaagatg

SEQ ID NO: 82401 - DNA, 103 bp, Artificial Sequence
  Synthetic Polynucleotide
taatacgactcactatagggctgtctctagtgagatgtccaatgaaggctaacagaggagaagccttatgtggacatctaacctggcggcagcgcaaaagatg

SEQ ID NO: 82402 - DNA, 103 bp, Artificial Sequence
  Synthetic Polynucleotide
taatacgactcactatagggggctactgtctctagtgagatgtccaatgaaacagaggagatcattgatgatctcactaaacctggcggcagcgcaaaagatg

SEQ ID NO: 82403 - DNA, 103 bp, Artificial Sequence
  Synthetic Polynucleotide
taatacgactcactataggggctttacgaccagacatgttctggtcagttaacagaggagaaactgaatggaacatgtcaacctggcggcagcgcaaaagatg

SEQ ID NO: 82404 - DNA, 103 bp, Artificial Sequence
  Synthetic Polynucleotide
taatacgactcactatagggtcaatggctactgtctctagtgagatgtccaacagaggagaggacatatgactagagacaacctggcggcagcgcaaaagatg

SEQ ID NO: 82405 - DNA, 103 bp, Artificial Sequence
  Synthetic Polynucleotide
taatacgactcactataggggtctatcaatggctactgtctctagtgagaaacagaggagatctcacatgagacagtagaacctggcggcagcgcaaaagatg

SEQ ID NO: 82406 - DNA, 103 bp, Artificial Sequence
  Synthetic Polynucleotide
taatacgactcactatagggagcaggtctatcaatggctactgtctctagaacagaggagactagagatggtagccattaacctggcggcagcgcaaaagatg

SEQ ID NO: 82407 - DNA, 103 bp, Artificial Sequence
  Synthetic Polynucleotide
taatacgactcactatagggacctcagcaggtctatcaatggctactgtcaacagaggagagacagtatgcattgatagaacctggcggcagcgcaaaagatg

SEQ ID NO: 82408 - DNA, 103 bp, Artificial Sequence
  Synthetic Polynucleotide
taatacgactcactatagggtcctcacctcagcaggtctatcaatggctaaacagaggagatagccaatgatagacctgaacctggcggcagcgcaaaagatg

SEQ ID NO: 82409 - DNA, 103 bp, Artificial Sequence
  Synthetic Polynucleotide
taatacgactcactatagggcactttcctcacctcagcaggtctatcaataacagaggagaattgatatgcctgctgagaacctggcggcagcgcaaaagatg

SEQ ID NO: 82410 - DNA, 103 bp, Artificial Sequence
  Synthetic Polynucleotide
taatacgactcactatagggtaacacactttcctcacctcagcaggtctaaacagaggagatagaccatgtgaggtgagaacctggcggcagcgcaaaagatg

SEQ ID NO: 82411 - DNA, 103 bp, Artificial Sequence
  Synthetic Polynucleotide
taatacgactcactatagggcattgtaacacactttcctcacctcagcagaacagaggagactgctgatgtgaggaaagaacctggcggcagcgcaaaagatg

SEQ ID NO: 82412 - DNA, 103 bp, Artificial Sequence
  Synthetic Polynucleotide
taatacgactcactatagggaactgcattgtaacacactttcctcacctcaacagaggagagaggtgatgaaagtgtgtaacctggcggcagcgcaaaagatg

SEQ ID NO: 82413 - DNA, 103 bp, Artificial Sequence
  Synthetic Polynucleotide
taatacgactcactataggggtgagaactgcattgtaacacactttcctcaacagaggagagaggaaatggtgttacaaaacctggcggcagcgcaaaagatg

SEQ ID NO: 82414 - DNA, 103 bp, Artificial Sequence
  Synthetic Polynucleotide
taatacgactcactatagggcctgagctttacgaccagacatgttctggtaacagaggagaaccagaatgtgtctggtcaacctggcggcagcgcaaaagatg

SEQ ID NO: 82415 - DNA, 103 bp, Artificial Sequence
  Synthetic Polynucleotide
taatacgactcactatagggcatgagtgagaactgcattgtaacacacttaacagaggagaaagtgtatgacaatgcagaacctggcggcagcgcaaaagatg

SEQ ID NO: 82416 - DNA, 103 bp, Artificial Sequence
  Synthetic Polynucleotide
taatacgactcactatagggcttcacatgagtgagaactgcattgtaacaaacagaggagatgttacatggcagttctcaacctggcggcagcgcaaaagatg

SEQ ID NO: 82417 - DNA, 103 bp, Artificial Sequence
  Synthetic Polynucleotide
taatacgactcactatagggttaatcttcacatgagtgagaactgcattgaacagaggagacaatgcatgtctcactcaaacctggcggcagcgcaaaagatg

SEQ ID NO: 82418 - DNA, 103 bp, Artificial Sequence
  Synthetic Polynucleotide
taatacgactcactatagggtgtcattaatcttcacatgagtgagaactgaacagaggagacagttcatgctcatgtgaaacctggcggcagcgcaaaagatg

SEQ ID NO: 82419 - DNA, 103 bp, Artificial Sequence
  Synthetic Polynucleotide
taatacgactcactataggggcacttgtcattaatcttcacatgagtgagaacagaggagactcactatggtgaagattaacctggcggcagcgcaaaagatg

SEQ ID NO: 82420 - DNA, 103 bp, Artificial Sequence
  Synthetic Polynucleotide
taatacgactcactatagggctggggcacttgtcattaatcttcacatgaaacagaggagatcatgtatggattaatgaaacctggcggcagcgcaaaagatg

SEQ ID NO: 82421 - DNA, 103 bp, Artificial Sequence
  Synthetic Polynucleotide
taatacgactcactatagggcagtgctggggcacttgtcattaatcttcaaacagaggagatgaagaatgatgacaagtaacctggcggcagcgcaaaagatg

SEQ ID NO: 82422 - DNA, 103 bp, Artificial Sequence
  Synthetic Polynucleotide
taatacgactcactatagggctctccagtgctggggcacttgtcattaataacagaggagaattaatatgaagtgccccaacctggcggcagcgcaaaagatg

SEQ ID NO: 82423 - DNA, 103 bp, Artificial Sequence
  Synthetic Polynucleotide
taatacgactcactatagggtgggcctctccagtgctggggcacttgtcaaacagaggagatgacaaatgccccagcacaacctggcggcagcgcaaaagatg

SEQ ID NO: 82424 - DNA, 103 bp, Artificial Sequence
  Synthetic Polynucleotide
taatacgactcactatagggctaggtgggcctctccagtgctggggcactaacagaggagaagtgccatggcactggagaacctggcggcagcgcaaaagatg

SEQ ID NO: 82425 - DNA, 103 bp, Artificial Sequence
  Synthetic Polynucleotide
taatacgactcactatagggttttccctgagctttacgaccagacatgttaacagaggagaaacatgatgggtcgtaaaaacctggcggcagcgcaaaagatg

SEQ ID NO: 82426 - DNA, 103 bp, Artificial Sequence
  Synthetic Polynucleotide
taatacgactcactatagggttcagctaggtgggcctctccagtgctgggaacagaggagacccagcatgggagaggccaacctggcggcagcgcaaaagatg

SEQ ID NO: 82427 - DNA, 103 bp, Artificial Sequence
  Synthetic Polynucleotide
taatacgactcactatagggttctcttcagctaggtgggcctctccagtgaacagaggagacactggatgggcccacctaacctggcggcagcgcaaaagatg

SEQ ID NO: 82428 - DNA, 103 bp, Artificial Sequence
  Synthetic Polynucleotide
taatacgactcactatagggcttcgttctcttcagctaggtgggcctctcaacagaggagagagaggatgacctagctgaacctggcggcagcgcaaaagatg

SEQ ID NO: 82429 - DNA, 103 bp, Artificial Sequence
  Synthetic Polynucleotide
taatacgactcactataggggtccccttcgttctcttcagctaggtgggcaacagaggagagcccacatggctgaagagaacctggcggcagcgcaaaagatg

SEQ ID NO: 82430 - DNA, 103 bp, Artificial Sequence
  Synthetic Polynucleotide
taatacgactcactataggggcattgtccccttcgttctcttcagctaggaacagaggagacctagcatgagagaacgaaacctggcggcagcgcaaaagatg

SEQ ID NO: 82431 - DNA, 103 bp, Artificial Sequence
  Synthetic Polynucleotide
taatacgactcactatagggtgcacgcattgtccccttcgttctcttcagaacagaggagactgaagatgacgaaggggaacctggcggcagcgcaaaagatg

SEQ ID NO: 82432 - DNA, 103 bp, Artificial Sequence
  Synthetic Polynucleotide
taatacgactcactataggggcgcttgcacgcattgtccccttcgttctcaacagaggagagagaacatgggggacaataacctggcggcagcgcaaaagatg

SEQ ID NO: 82433 - DNA, 103 bp, Artificial Sequence
  Synthetic Polynucleotide
taatacgactcactatagggtaagtgcgcttgcacgcattgtccccttcgaacagaggagacgaaggatgcaatgcgtgaacctggcggcagcgcaaaagatg

SEQ ID NO: 82434 - DNA, 103 bp, Artificial Sequence
  Synthetic Polynucleotide
taatacgactcactatagggcagaataagtgcgcttgcacgcattgtcccaacagaggagagggacaatgcgtgcaagcaacctggcggcagcgcaaaagatg

SEQ ID NO: 82435 - DNA, 103 bp, Artificial Sequence
  Synthetic Polynucleotide
taatacgactcactatagggtctatcagaataagtgcgcttgcacgcattaacagaggagaaatgcgatgaagcgcactaacctggcggcagcgcaaaagatg

SEQ ID NO: 82436 - DNA, 103 bp, Artificial Sequence
  Synthetic Polynucleotide
taatacgactcactatagggagggtttttccctgagctttacgaccagacaacagaggagagtctggatgtaaagctcaaacctggcggcagcgcaaaagatg

SEQ ID NO: 82437 - DNA, 103 bp, Artificial Sequence
  Synthetic Polynucleotide
taatacgactcactatagggcagcctctatcagaataagtgcgcttgcacaacagaggagagtgcaaatgcacttattcaacctggcggcagcgcaaaagatg

SEQ ID NO: 82438 - DNA, 103 bp, Artificial Sequence
  Synthetic Polynucleotide
taatacgactcactatagggtgccccagcctctatcagaataagtgcgctaacagaggagaagcgcaatgattctgataaacctggcggcagcgcaaaagatg

SEQ ID NO: 82439 - DNA, 103 bp, Artificial Sequence
  Synthetic Polynucleotide
taatacgactcactataggggccattgccccagcctctatcagaataagtaacagaggagaacttatatggatagaggcaacctggcggcagcgcaaaagatg

SEQ ID NO: 82440 - DNA, 103 bp, Artificial Sequence
  Synthetic Polynucleotide
taatacgactcactatagggccacagccattgccccagcctctatcagaaaacagaggagattctgaatgaggctggggaacctggcggcagcgcaaaagatg

SEQ ID NO: 82441 - DNA, 103 bp, Artificial Sequence
  Synthetic Polynucleotide
taatacgactcactatagggataggccacagccattgccccagcctctataacagaggagaatagagatgggggcaatgaacctggcggcagcgcaaaagatg

SEQ ID NO: 82442 - DNA, 103 bp, Artificial Sequence
  Synthetic Polynucleotide
taatacgactcactatagggcccaaataggccacagccattgccccagccaacagaggagaggctggatgaatggctgtaacctggcggcagcgcaaaagatg

SEQ ID NO: 82443 - DNA, 103 bp, Artificial Sequence
  Synthetic Polynucleotide
taatacgactcactatagggcctttcccaaataggccacagccattgcccaacagaggagagggcaaatgctgtggcctaacctggcggcagcgcaaaagatg

SEQ ID NO: 82444 - DNA, 103 bp, Artificial Sequence
  Synthetic Polynucleotide
taatacgactcactatagggtgctccctttcccaaataggccacagccataacagaggagaatggctatggcctatttgaacctggcggcagcgcaaaagatg

SEQ ID NO: 82445 - DNA, 103 bp, Artificial Sequence
  Synthetic Polynucleotide
taatacgactcactatagggcacaatgctccctttcccaaataggccacaaacagaggagatgtggcatgtttgggaaaaacctggcggcagcgcaaaagatg

SEQ ID NO: 82446 - DNA, 103 bp, Artificial Sequence
  Synthetic Polynucleotide
taatacgactcactatagggcatgccacaatgctccctttcccaaataggaacagaggagacctattatggaaagggagaacctggcggcagcgcaaaagatg

SEQ ID NO: 82447 - DNA, 103 bp, Artificial Sequence
  Synthetic Polynucleotide
taatacgactcactatagggcgcccagggtttttccctgagctttacgacaacagaggagagtcgtaatgctcagggaaaacctggcggcagcgcaaaagatg

SEQ ID NO: 82448 - DNA, 103 bp, Artificial Sequence
  Synthetic Polynucleotide
taatacgactcactatagggtggcgcatgccacaatgctccctttcccaaaacagaggagattgggaatgggagcattgaacctggcggcagcgcaaaagatg

SEQ ID NO: 82449 - DNA, 103 bp, Artificial Sequence
  Synthetic Polynucleotide
taatacgactcactataggggaatttggcgcatgccacaatgctccctttaacagaggagaaaagggatgattgtggcaaacctggcggcagcgcaaaagatg

SEQ ID NO: 82450 - DNA, 103 bp, Artificial Sequence
  Synthetic Polynucleotide
taatacgactcactatagggcaagtgaatttggcgcatgccacaatgctcaacagaggagagagcatatgggcatgcgcaacctggcggcagcgcaaaagatg

SEQ ID NO: 82451 - DNA, 103 bp, Artificial Sequence
  Synthetic Polynucleotide
taatacgactcactatagggtggcacaagtgaatttggcgcatgccacaaaacagaggagattgtggatggcgccaaataacctggcggcagcgcaaaagatg

SEQ ID NO: 82452 - DNA, 103 bp, Artificial Sequence
  Synthetic Polynucleotide
taatacgactcactatagggggatttggcacaagtgaatttggcgcatgcaacagaggagagcatgcatgaaattcactaacctggcggcagcgcaaaagatg

SEQ ID NO: 82453 - DNA, 103 bp, Artificial Sequence
  Synthetic Polynucleotide
taatacgactcactatagggctcatggatttggcacaagtgaatttggcgaacagaggagacgccaaatgcacttgtgcaacctggcggcagcgcaaaagatg

SEQ ID NO: 82454 - DNA, 103 bp, Artificial Sequence
  Synthetic Polynucleotide
taatacgactcactatagggacaaactcatggatttggcacaagtgaattaacagaggagaaattcaatggtgccaaataacctggcggcagcgcaaaagatg

SEQ ID NO: 82455 - DNA, 103 bp, Artificial Sequence
  Synthetic Polynucleotide
taatacgactcactatagggctcaaacaaactcatggatttggcacaagtaacagaggagaacttgtatgaaatccatgaacctggcggcagcgcaaaagatg

SEQ ID NO: 82456 - DNA, 103 bp, Artificial Sequence
  Synthetic Polynucleotide
taatacgactcactatagggtcaacctcaaacaaactcatggatttggcaaacagaggagatgccaaatgcatgagtttaacctggcggcagcgcaaaagatg

SEQ ID NO: 82457 - DNA, 103 bp, Artificial Sequence
  Synthetic Polynucleotide
taatacgactcactatagggtctgatcaacctcaaacaaactcatggattaacagaggagaaatccaatggtttgtttgaacctggcggcagcgcaaaagatg

SEQ ID NO: 82458 - DNA, 103 bp, Artificial Sequence
  Synthetic Polynucleotide
taatacgactcactatagggattgacgcccagggtttttccctgagctttaacagaggagaaaagctatgggaaaaaccaacctggcggcagcgcaaaagatg

SEQ ID NO: 82459 - DNA, 103 bp, Artificial Sequence
  Synthetic Polynucleotide
taatacgactcactatagggtttggtctgatcaacctcaaacaaactcataacagaggagaatgagtatgtttgaggttaacctggcggcagcgcaaaagatg

SEQ ID NO: 82460 - DNA, 103 bp, Artificial Sequence
  Synthetic Polynucleotide
taatacgactcactatagggtgaattttggtctgatcaacctcaaacaaaaacagaggagatttgttatgggttgatcaaacctggcggcagcgcaaaagatg

SEQ ID NO: 82461 - DNA, 103 bp, Artificial Sequence
  Synthetic Polynucleotide
taatacgactcactatagggcatactgaattttggtctgatcaacctcaaaacagaggagattgaggatgatcagaccaaacctggcggcagcgcaaaagatg

SEQ ID NO: 82462 - DNA, 103 bp, Artificial Sequence
  Synthetic Polynucleotide
taatacgactcactataggggatgacatactgaattttggtctgatcaacaacagaggagagttgatatgaccaaaattaacctggcggcagcgcaaaagatg

SEQ ID NO: 82463 - DNA, 103 bp, Artificial Sequence
  Synthetic Polynucleotide
taatacgactcactataggggctctgatgacatactgaattttggtctgaaacagaggagatcagacatgaattcagtaaacctggcggcagcgcaaaagatg

SEQ ID NO: 82464 - DNA, 103 bp, Artificial Sequence
  Synthetic Polynucleotide
taatacgactcactatagggattgtgctctgatgacatactgaattttggaacagaggagaccaaaaatgagtatgtcaaacctggcggcagcgcaaaagatg

SEQ ID NO: 82465 - DNA, 103 bp, Artificial Sequence
  Synthetic Polynucleotide
taatacgactcactatagggatgcaattgtgctctgatgacatactgaataacagaggagaattcagatggtcatcagaaacctggcggcagcgcaaaagatg

SEQ ID NO: 82466 - DNA, 103 bp, Artificial Sequence
  Synthetic Polynucleotide
taatacgactcactatagggcctacatgcaattgtgctctgatgacatacaacagaggagagtatgtatgcagagcacaaacctggcggcagcgcaaaagatg

SEQ ID NO: 82467 - DNA, 103 bp, Artificial Sequence
  Synthetic Polynucleotide
taatacgactcactatagggtggcccctacatgcaattgtgctctgatgaaacagaggagatcatcaatgcacaattgcaacctggcggcagcgcaaaagatg

SEQ ID NO: 82468 - DNA, 103 bp, Artificial Sequence
  Synthetic Polynucleotide
taatacgactcactatagggctgcttggcccctacatgcaattgtgctctaacagaggagaagagcaatgttgcatgtaaacctggcggcagcgcaaaagatg

SEQ ID NO: 82469 - DNA, 103 bp, Artificial Sequence
  Synthetic Polynucleotide
taatacgactcactatagggaccatattgacgcccagggtttttccctgaaacagaggagatcagggatgaaccctgggaacctggcggcagcgcaaaagatg

SEQ ID NO: 82470 - DNA, 103 bp, Artificial Sequence
  Synthetic Polynucleotide
taatacgactcactatagggttttcctgcttggcccctacatgcaattgtaacagaggagaacaattatgtgtaggggcaacctggcggcagcgcaaaagatg

SEQ ID NO: 82471 - DNA, 103 bp, Artificial Sequence
  Synthetic Polynucleotide
taatacgactcactatagggtccaattttcctgcttggcccctacatgcaaacagaggagatgcatgatggggccaagcaacctggcggcagcgcaaaagatg

SEQ ID NO: 82472 - DNA, 103 bp, Artificial Sequence
  Synthetic Polynucleotide
taatacgactcactatagggggtattccaattttcctgcttggcccctacaacagaggagagtagggatgaagcaggaaaacctggcggcagcgcaaaagatg

SEQ ID NO: 82473 - DNA, 103 bp, Artificial Sequence
  Synthetic Polynucleotide
taatacgactcactatagggatgtcggtattccaattttcctgcttggccaacagaggagaggccaaatgggaaaattgaacctggcggcagcgcaaaagatg

SEQ ID NO: 82474 - DNA, 103 bp, Artificial Sequence
  Synthetic Polynucleotide
taatacgactcactatagggtcttaatgtcggtattccaattttcctgctaacagaggagaagcaggatgattggaataaacctggcggcagcgcaaaagatg

SEQ ID NO: 82475 - DNA, 103 bp, Artificial Sequence
  Synthetic Polynucleotide
taatacgactcactataggggagagtcttaatgtcggtattccaattttcaacagaggagagaaaatatgaataccgacaacctggcggcagcgcaaaagatg

SEQ ID NO: 82476 - DNA, 103 bp, Artificial Sequence
  Synthetic Polynucleotide
taatacgactcactatagggaacttgagagtcttaatgtcggtattccaaaacagaggagattggaaatgcgacattaaaacctggcggcagcgcaaaagatg

SEQ ID NO: 82477 - DNA, 103 bp, Artificial Sequence
  Synthetic Polynucleotide
taatacgactcactatagggcatcaaacttgagagtcttaatgtcggtataacagaggagaataccgatgttaagactcaacctggcggcagcgcaaaagatg

SEQ ID NO: 82478 - DNA, 103 bp, Artificial Sequence
  Synthetic Polynucleotide
taatacgactcactatagggcagggcatcaaacttgagagtcttaatgtcaacagaggagagacattatgactctcaagaacctggcggcagcgcaaaagatg

SEQ ID NO: 82479 - DNA, 103 bp, Artificial Sequence
  Synthetic Polynucleotide
taatacgactcactatagggcctgacagggcatcaaacttgagagtcttaaacagaggagataagacatgcaagtttgaaacctggcggcagcgcaaaagatg

SEQ ID NO: 82480 - DNA, 103 bp, Artificial Sequence
  Synthetic Polynucleotide
taatacgactcactataggggtcgtaccatattgacgcccagggtttttcaacagaggagagaaaaaatgtgggcgtcaaacctggcggcagcgcaaaagatg

SEQ ID NO: 82481 - DNA, 103 bp, Artificial Sequence
  Synthetic Polynucleotide
taatacgactcactataggggggagcctgacagggcatcaaacttgagagaacagaggagactctcaatgttgatgcccaacctggcggcagcgcaaaagatg

SEQ ID NO: 82482 - DNA, 103 bp, Artificial Sequence
  Synthetic Polynucleotide
taatacgactcactatagggttcctgggagcctgacagggcatcaaacttaacagaggagaaagtttatggccctgtcaaacctggcggcagcgcaaaagatg

SEQ ID NO: 82483 - DNA, 103 bp, Artificial Sequence
  Synthetic Polynucleotide
taatacgactcactatagggtcgacttcctgggagcctgacagggcatcaaacagaggagatgatgcatggtcaggctcaacctggcggcagcgcaaaagatg

SEQ ID NO: 82484 - DNA, 103 bp, Artificial Sequence
  Synthetic Polynucleotide
taatacgactcactatagggtgaactcgacttcctgggagcctgacagggaacagaggagaccctgtatggctcccaggaacctggcggcagcgcaaaagatg

SEQ ID NO: 82485 - DNA, 103 bp, Artificial Sequence
  Synthetic Polynucleotide
taatacgactcactatagggcccaatgaactcgacttcctgggagcctgaaacagaggagatcaggcatgcaggaagtcaacctggcggcagcgcaaaagatg

SEQ ID NO: 82486 - DNA, 103 bp, Artificial Sequence
  Synthetic Polynucleotide
taatacgactcactatagggccatacccaatgaactcgacttcctgggagaacagaggagactcccaatgagtcgagttaacctggcggcagcgcaaaagatg

SEQ ID NO: 82487 - DNA, 103 bp, Artificial Sequence
  Synthetic Polynucleotide
taatacgactcactatagggcttttccatacccaatgaactcgacttcctaacagaggagaaggaagatgagttcattgaacctggcggcagcgcaaaagatg

SEQ ID NO: 82488 - DNA, 103 bp, Artificial Sequence
  Synthetic Polynucleotide
taatacgactcactatagggtgtagcttttccatacccaatgaactcgacaacagaggagagtcgagatgattgggtataacctggcggcagcgcaaaagatg

SEQ ID NO: 82489 - DNA, 103 bp, Artificial Sequence
  Synthetic Polynucleotide
taatacgactcactatagggtccagtgtagcttttccatacccaatgaacaacagaggagagttcatatggtatggaaaaacctggcggcagcgcaaaagatg

SEQ ID NO: 82490 - DNA, 103 bp, Artificial Sequence
  Synthetic Polynucleotide
taatacgactcactatagggggcattccagtgtagcttttccatacccaaaacagaggagattgggtatggaaaagctaaacctggcggcagcgcaaaagatg

SEQ ID NO: 82491 - DNA, 103 bp, Artificial Sequence
  Synthetic Polynucleotide
taatacgactcactatagggttgcagaccaatgcacctcaattagcacacaacagaggagagtgtgcatgttgaggtgcaacctggcggcagcgcaaaagatg

SEQ ID NO: 82492 - DNA, 103 bp, Artificial Sequence
  Synthetic Polynucleotide
taatacgactcactatagggtcctcgtcgtaccatattgacgcccagggtaacagaggagaaccctgatggtcaatatgaacctggcggcagcgcaaaagatg

SEQ ID NO: 82493 - DNA, 103 bp, Artificial Sequence
  Synthetic Polynucleotide
taatacgactcactatagggcacctggcattccagtgtagcttttccataaacagaggagatatggaatggctacactgaacctggcggcagcgcaaaagatg

SEQ ID NO: 82494 - DNA, 103 bp, Artificial Sequence
  Synthetic Polynucleotide
taatacgactcactataggggtttgcacctggcattccagtgtagcttttaacagaggagaaaaagcatgactggaatgaacctggcggcagcgcaaaagatg

SEQ ID NO: 82495 - DNA, 103 bp, Artificial Sequence
  Synthetic Polynucleotide
taatacgactcactatagggccgcagtttgcacctggcattccagtgtagaacagaggagactacacatgaatgccaggaacctggcggcagcgcaaaagatg

SEQ ID NO: 82496 - DNA, 103 bp, Artificial Sequence
  Synthetic Polynucleotide
taatacgactcactataggggtccaccgcagtttgcacctggcattccagaacagaggagactggaaatgcaggtgcaaaacctggcggcagcgcaaaagatg

SEQ ID NO: 82497 - DNA, 103 bp, Artificial Sequence
  Synthetic Polynucleotide
taatacgactcactatagggccaaagtccaccgcagtttgcacctggcataacagaggagaatgccaatggcaaactgcaacctggcggcagcgcaaaagatg

SEQ ID NO: 82498 - DNA, 103 bp, Artificial Sequence
  Synthetic Polynucleotide
taatacgactcactatagggtgttaccaaagtccaccgcagtttgcacctaacagaggagaaggtgcatgctgcggtggaacctggcggcagcgcaaaagatg

SEQ ID NO: 82499 - DNA, 103 bp, Artificial Sequence
  Synthetic Polynucleotide
taatacgactcactataggggtaactgttaccaaagtccaccgcagtttgaacagaggagacaaactatggtggactttaacctggcggcagcgcaaaagatg

SEQ ID NO: 82500 - DNA, 103 bp, Artificial Sequence
  Synthetic Polynucleotide
taatacgactcactataggggcgatgtaactgttaccaaagtccaccgcaaacagaggagatgcggtatgctttggtaaaacctggcggcagcgcaaaagatg

SEQ ID NO: 82501 - DNA, 103 bp, Artificial Sequence
  Synthetic Polynucleotide
taatacgactcactatagggtctcagcgatgtaactgttaccaaagtccaaacagaggagatggactatggtaacagttaacctggcggcagcgcaaaagatg

SEQ ID NO: 82502 - DNA, 103 bp, Artificial Sequence
  Synthetic Polynucleotide
taatacgactcactatagggttccatctcagcgatgtaactgttaccaaaaacagaggagatttggtatgagttacatcaacctggcggcagcgcaaaagatg

SEQ ID NO: 82503 - DNA, 103 bp, Artificial Sequence
  Synthetic Polynucleotide
taatacgactcactatagggcgaactcctcgtcgtaccatattgacgcccaacagaggagagggcgtatgtatggtacgaacctggcggcagcgcaaaagatg

SEQ ID NO: 82504 - DNA, 103 bp, Artificial Sequence
  Synthetic Polynucleotide
taatacgactcactatagggtctgtttccatctcagcgatgtaactgttaaacagaggagataacagatgcatcgctgaaacctggcggcagcgcaaaagatg

SEQ ID NO: 82505 - DNA, 103 bp, Artificial Sequence
  Synthetic Polynucleotide
taatacgactcactatagggagctctctgtttccatctcagcgatgtaacaacagaggagagttacaatgctgagatggaacctggcggcagcgcaaaagatg

SEQ ID NO: 82506 - DNA, 103 bp, Artificial Sequence
  Synthetic Polynucleotide
taatacgactcactatagggtatccagctctctgtttccatctcagcgataacagaggagaatcgctatgatggaaacaaacctggcggcagcgcaaaagatg

SEQ ID NO: 82507 - DNA, 103 bp, Artificial Sequence
  Synthetic Polynucleotide
taatacgactcactatagggtccactatccagctctctgtttccatctcaaacagaggagatgagatatgaacagagagaacctggcggcagcgcaaaagatg

SEQ ID NO: 82508 - DNA, 103 bp, Artificial Sequence
  Synthetic Polynucleotide
taatacgactcactataggggtctgtccactatccagctctctgtttccaaacagaggagatggaaaatgagagctggaaacctggcggcagcgcaaaagatg

SEQ ID NO: 82509 - DNA, 103 bp, Artificial Sequence
  Synthetic Polynucleotide
taatacgactcactatagggccactgtctgtccactatccagctctctgtaacagaggagaacagagatgtggatagtgaacctggcggcagcgcaaaagatg

SEQ ID NO: 82510 - DNA, 103 bp, Artificial Sequence
  Synthetic Polynucleotide
taatacgactcactatagggtgggcccactgtctgtccactatccagctcaacagaggagagagctgatgagtggacagaacctggcggcagcgcaaaagatg

SEQ ID NO: 82511 - DNA, 103 bp, Artificial Sequence
  Synthetic Polynucleotide
taatacgactcactatagggagtcctgggcccactgtctgtccactatccaacagaggagaggatagatgacagacagtaacctggcggcagcgcaaaagatg

SEQ ID NO: 82512 - DNA, 103 bp, Artificial Sequence
  Synthetic Polynucleotide
taatacgactcactatagggggtcaagtcctgggcccactgtctgtccacaacagaggagagtggacatgcagtgggccaacctggcggcagcgcaaaagatg

SEQ ID NO: 82513 - DNA, 103 bp, Artificial Sequence
  Synthetic Polynucleotide
taatacgactcactatagggggcagggtcaagtcctgggcccactgtctgaacagaggagacagacaatgggcccaggaaacctggcggcagcgcaaaagatg

SEQ ID NO: 82514 - DNA, 103 bp, Artificial Sequence
  Synthetic Polynucleotide
taatacgactcactatagggaggagcgaactcctcgtcgtaccatattgaaacagaggagatcaataatgtacgacgagaacctggcggcagcgcaaaagatg

SEQ ID NO: 82515 - DNA, 103 bp, Artificial Sequence
  Synthetic Polynucleotide
taatacgactcactataggggccatggcagggtcaagtcctgggcccactaacagaggagaagtgggatgaggacttgaaacctggcggcagcgcaaaagatg

SEQ ID NO: 82516 - DNA, 103 bp, Artificial Sequence
  Synthetic Polynucleotide
taatacgactcactatagggactctgccatggcagggtcaagtcctgggcaacagaggagagcccagatgttgaccctgaacctggcggcagcgcaaaagatg

SEQ ID NO: 82517 - DNA, 103 bp, Artificial Sequence
  Synthetic Polynucleotide
taatacgactcactatagggcttccactctgccatggcagggtcaagtccaacagaggagaggacttatgcctgccatgaacctggcggcagcgcaaaagatg

SEQ ID NO: 82518 - DNA, 103 bp, Artificial Sequence
  Synthetic Polynucleotide
taatacgactcactatagggcgccacttccactctgccatggcagggtcaaacagaggagatgacccatgcatggcagaaacctggcggcagcgcaaaagatg

SEQ ID NO: 82519 - DNA, 103 bp, Artificial Sequence
  Synthetic Polynucleotide
taatacgactcactatagggcaccccgccacttccactctgccatggcagaacagaggagactgccaatgcagagtggaaacctggcggcagcgcaaaagatg

SEQ ID NO: 82520 - DNA, 103 bp, Artificial Sequence
  Synthetic Polynucleotide
taatacgactcactatagggctccacaccccgccacttccactctgccataacagaggagaatggcaatgtggaagtggaacctggcggcagcgcaaaagatg

SEQ ID NO: 82521 - DNA, 103 bp, Artificial Sequence
  Synthetic Polynucleotide
taatacgactcactatagggtctctctccacaccccgccacttccactctaacagaggagaagagtgatggtggcggggaacctggcggcagcgcaaaagatg

SEQ ID NO: 82522 - DNA, 103 bp, Artificial Sequence
  Synthetic Polynucleotide
taatacgactcactatagggatgcatctctctccacaccccgccacttccaacagaggagaggaagtatgggggtgtggaacctggcggcagcgcaaaagatg

SEQ ID NO: 82523 - DNA, 103 bp, Artificial Sequence
  Synthetic Polynucleotide
taatacgactcactatagggagatgatgcatctctctccacaccccgccaaacagaggagatggcggatggtggagagaaacctggcggcagcgcaaaagatg

SEQ ID NO: 82524 - DNA, 103 bp, Artificial Sequence
  Synthetic Polynucleotide
taatacgactcactatagggcgacaagatgatgcatctctctccacacccaacagaggagagggtgtatggagagatgcaacctggcggcagcgcaaaagatg

SEQ ID NO: 82525 - DNA, 103 bp, Artificial Sequence
  Synthetic Polynucleotide
taatacgactcactatagggtgacaaggagcgaactcctcgtcgtaccataacagaggagaatggtaatgcgaggagttaacctggcggcagcgcaaaagatg

SEQ ID NO: 82526 - DNA, 103 bp, Artificial Sequence
  Synthetic Polynucleotide
taatacgactcactatagggaaattcgacaagatgatgcatctctctccaaacagaggagatggagaatgatgcatcataacctggcggcagcgcaaaagatg

SEQ ID NO: 82527 - DNA, 103 bp, Artificial Sequence
  Synthetic Polynucleotide
taatacgactcactatagggggttcaaattcgacaagatgatgcatctctaacagaggagaagagatatgtcatcttgtaacctggcggcagcgcaaaagatg

SEQ ID NO: 82528 - DNA, 103 bp, Artificial Sequence
  Synthetic Polynucleotide
taatacgactcactataggggcggaggttcaaattcgacaagatgatgcaaacagaggagatgcatcatgttgtcgaataacctggcggcagcgcaaaagatg

SEQ ID NO: 82529 - DNA, 103 bp, Artificial Sequence
  Synthetic Polynucleotide
taatacgactcactatagggggcatgcggaggttcaaattcgacaagatgaacagaggagacatcttatggaatttgaaaacctggcggcagcgcaaaagatg

SEQ ID NO: 82530 - DNA, 103 bp, Artificial Sequence
  Synthetic Polynucleotide
taatacgactcactataggggtggcggcatgcggaggttcaaattcgacaaacagaggagatgtcgaatgtgaacctccaacctggcggcagcgcaaaagatg

SEQ ID NO: 82531 - DNA, 103 bp, Artificial Sequence
  Synthetic Polynucleotide
taatacgactcactatagggtgatagtggcggcatgcggaggttcaaattaacagaggagaaatttgatgctccgcatgaacctggcggcagcgcaaaagatg

SEQ ID NO: 82532 - DNA, 103 bp, Artificial Sequence
  Synthetic Polynucleotide
taatacgactcactatagggtactctgatagtggcggcatgcggaggttcaacagaggagagaacctatgcatgccgccaacctggcggcagcgcaaaagatg

SEQ ID NO: 82533 - DNA, 103 bp, Artificial Sequence
  Synthetic Polynucleotide
taatacgactcactataggggccagtactctgatagtggcggcatgcggaaacagaggagatccgcaatgcgccactataacctggcggcagcgcaaaagatg

SEQ ID NO: 82534 - DNA, 103 bp, Artificial Sequence
  Synthetic Polynucleotide
taatacgactcactatagggccagggccagtactctgatagtggcggcataacagaggagaatgccgatgctatcagagaacctggcggcagcgcaaaagatg

SEQ ID NO: 82535 - DNA, 103 bp, Artificial Sequence
  Synthetic Polynucleotide
taatacgactcactataggggtttcccagggccagtactctgatagtggcaacagaggagagccactatgagagtactgaacctggcggcagcgcaaaagatg

SEQ ID NO: 82536 - DNA, 103 bp, Artificial Sequence
  Synthetic Polynucleotide
taatacgactcactatagggttgtttgacaaggagcgaactcctcgtcgtaacagaggagaacgacgatgagttcgctcaacctggcggcagcgcaaaagatg

SEQ ID NO: 82537 - DNA, 103 bp, Artificial Sequence
  Synthetic Polynucleotide
taatacgactcactatagggtcctggtttcccagggccagtactctgataaacagaggagatatcagatgactggccctaacctggcggcagcgcaaaagatg

SEQ ID NO: 82538 - DNA, 103 bp, Artificial Sequence
  Synthetic Polynucleotide
taatacgactcactatagggagccttcctggtttcccagggccagtactcaacagaggagagagtacatgccctgggaaaacctggcggcagcgcaaaagatg

SEQ ID NO: 82539 - DNA, 103 bp, Artificial Sequence
  Synthetic Polynucleotide
taatacgactcactatagggcaaggagccttcctggtttcccagggccagaacagaggagactggccatgggaaaccagaacctggcggcagcgcaaaagatg

SEQ ID NO: 82540 - DNA, 103 bp, Artificial Sequence
  Synthetic Polynucleotide
taatacgactcactataggggttttcaaggagccttcctggtttcccaggaacagaggagacctgggatgccaggaaggaacctggcggcagcgcaaaagatg

SEQ ID NO: 82541 - DNA, 103 bp, Artificial Sequence
  Synthetic Polynucleotide
taatacgactcactataggggagctgttttcaaggagccttcctggtttcaacagaggagagaaaccatgaaggctcctaacctggcggcagcgcaaaagatg

SEQ ID NO: 82542 - DNA, 103 bp, Artificial Sequence
  Synthetic Polynucleotide
taatacgactcactatagggagtaagagctgttttcaaggagccttcctgaacagaggagacaggaaatgtccttgaaaaacctggcggcagcgcaaaagatg

SEQ ID NO: 82543 - DNA, 103 bp, Artificial Sequence
  Synthetic Polynucleotide
taatacgactcactataggggcgccagtaagagctgttttcaaggagcctaacagaggagaaggctcatggaaaacagcaacctggcggcagcgcaaaagatg

SEQ ID NO: 82544 - DNA, 103 bp, Artificial Sequence
  Synthetic Polynucleotide
taatacgactcactatagggtcattgcgccagtaagagctgttttcaaggaacagaggagaccttgaatgcagctcttaaacctggcggcagcgcaaaagatg

SEQ ID NO: 82545 - DNA, 103 bp, Artificial Sequence
  Synthetic Polynucleotide
taatacgactcactatagggaaccctcattgcgccagtaagagctgttttaacagaggagaaaaacaatgcttactggcaacctggcggcagcgcaaaagatg

SEQ ID NO: 82546 - DNA, 103 bp, Artificial Sequence
  Synthetic Polynucleotide
taatacgactcactatagggtttgtaaccctcattgcgccagtaagagctaacagaggagaagctctatgtggcgcaataacctggcggcagcgcaaaagatg

SEQ ID NO: 82547 - DNA, 103 bp, Artificial Sequence
  Synthetic Polynucleotide
taatacgactcactatagggttattttgtttgacaaggagcgaactcctcaacagaggagagaggagatggctccttgtaacctggcggcagcgcaaaagatg

SEQ ID NO: 82548 - DNA, 103 bp, Artificial Sequence
  Synthetic Polynucleotide
taatacgactcactatagggtgtcctttgtaaccctcattgcgccagtaaaacagaggagattactgatgcaatgagggaacctggcggcagcgcaaaagatg

SEQ ID NO: 82549 - DNA, 103 bp, Artificial Sequence
  Synthetic Polynucleotide
taatacgactcactatagggatttgtgtcctttgtaaccctcattgcgccaacagaggagaggcgcaatgagggttacaaacctggcggcagcgcaaaagatg

SEQ ID NO: 82550 - DNA, 103 bp, Artificial Sequence
  Synthetic Polynucleotide
taatacgactcactatagggttgtcatttgtgtcctttgtaaccctcattaacagaggagaaatgagatgtacaaaggaaacctggcggcagcgcaaaagatg

SEQ ID NO: 82551 - DNA, 103 bp, Artificial Sequence
  Synthetic Polynucleotide
taatacgactcactatagggggttgttgtcatttgtgtcctttgtaacccaacagaggagagggttaatgaggacacaaaacctggcggcagcgcaaaagatg

SEQ ID NO: 82552 - DNA, 103 bp, Artificial Sequence
  Synthetic Polynucleotide
taatacgactcactataggggtaaaggttgttgtcatttgtgtcctttgtaacagaggagaacaaagatgacaaatgacaacctggcggcagcgcaaaagatg

SEQ ID NO: 82553 - DNA, 103 bp, Artificial Sequence
  Synthetic Polynucleotide
taatacgactcactatagggagtttgtaaaggttgttgtcatttgtgtccaacagaggagaggacacatgtgacaacaaaacctggcggcagcgcaaaagatg

SEQ ID NO: 82554 - DNA, 103 bp, Artificial Sequence
  Synthetic Polynucleotide
taatacgactcactatagggcatgtagtttgtaaaggttgttgtcatttgaacagaggagacaaatgatgacaacctttaacctggcggcagcgcaaaagatg

SEQ ID NO: 82555 - DNA, 103 bp, Artificial Sequence
  Synthetic Polynucleotide
taatacgactcactatagggtccaccatgtagtttgtaaaggttgttgtcaacagaggagagacaacatgctttacaaaaacctggcggcagcgcaaaagatg

SEQ ID NO: 82556 - DNA, 103 bp, Artificial Sequence
  Synthetic Polynucleotide
taatacgactcactatagggacatgtccaccatgtagtttgtaaaggttgaacagaggagacaacctatgcaaactacaaacctggcggcagcgcaaaagatg

SEQ ID NO: 82557 - DNA, 103 bp, Artificial Sequence
  Synthetic Polynucleotide
taatacgactcactatagggaagaaacatgtccaccatgtagtttgtaaaaacagaggagatttacaatgtacatggtgaacctggcggcagcgcaaaagatg

SEQ ID NO: 82558 - DNA, 103 bp, Artificial Sequence
  Synthetic Polynucleotide
taatacgactcactatagggttgttttattttgtttgacaaggagcgaacaacagaggagagttcgcatgttgtcaaacaacctggcggcagcgcaaaagatg

SEQ ID NO: 82559 - DNA, 103 bp, Artificial Sequence
  Synthetic Polynucleotide
taatacgactcactatagggtctgcaagaaacatgtccaccatgtagtttaacagaggagaaaactaatgggtggacataacctggcggcagcgcaaaagatg

SEQ ID NO: 82560 - DNA, 103 bp, Artificial Sequence
  Synthetic Polynucleotide
taatacgactcactatagggttcactctgcaagaaacatgtccaccatgtaacagaggagaacatggatgacatgtttcaacctggcggcagcgcaaaagatg

SEQ ID NO: 82561 - DNA, 103 bp, Artificial Sequence
  Synthetic Polynucleotide
taatacgactcactatagggacaatttcactctgcaagaaacatgtccacaacagaggagagtggacatgtttcttgcaaacctggcggcagcgcaaaagatg

SEQ ID NO: 82562 - DNA, 103 bp, Artificial Sequence
  Synthetic Polynucleotide
taatacgactcactatagggagctgacaatttcactctgcaagaaacatgaacagaggagacatgttatgtgcagagtgaacctggcggcagcgcaaaagatg

SEQ ID NO: 82563 - DNA, 103 bp, Artificial Sequence
  Synthetic Polynucleotide
taatacgactcactataggggtcaaagctgacaatttcactctgcaagaaaacagaggagattcttgatgagtgaaattaacctggcggcagcgcaaaagatg

SEQ ID NO: 82564 - DNA, 103 bp, Artificial Sequence
  Synthetic Polynucleotide
taatacgactcactatagggtgagtgtcaaagctgacaatttcactctgcaacagaggagagcagagatgaattgtcagaacctggcggcagcgcaaaagatg

SEQ ID NO: 82565 - DNA, 103 bp, Artificial Sequence
  Synthetic Polynucleotide
taatacgactcactatagggccccttgagtgtcaaagctgacaatttcacaacagaggagagtgaaaatgtcagctttgaacctggcggcagcgcaaaagatg

SEQ ID NO: 82566 - DNA, 103 bp, Artificial Sequence
  Synthetic Polynucleotide
taatacgactcactataggggatgtccccttgagtgtcaaagctgacaataacagaggagaattgtcatgtttgacactaacctggcggcagcgcaaaagatg

SEQ ID NO: 82567 - DNA, 103 bp, Artificial Sequence
  Synthetic Polynucleotide
taatacgactcactatagggtgtaggatgtccccttgagtgtcaaagctgaacagaggagacagcttatgcactcaaggaacctggcggcagcgcaaaagatg

SEQ ID NO: 82568 - DNA, 103 bp, Artificial Sequence
  Synthetic Polynucleotide
taatacgactcactatagggtattttgtaggatgtccccttgagtgtcaaaacagaggagattgacaatgaaggggacaaacctggcggcagcgcaaaagatg

SEQ ID NO: 82569 - DNA, 103 bp, Artificial Sequence
  Synthetic Polynucleotide
taatacgactcactataggggttttttgttttattttgtttgacaaggagaacagaggagactccttatgaaacaaaataacctggcggcagcgcaaaagatg

SEQ ID NO: 82570 - DNA, 103 bp, Artificial Sequence
  Synthetic Polynucleotide
taatacgactcactataggggtgcatattttgtaggatgtccccttgagtaacagaggagaactcaaatggacatcctaaacctggcggcagcgcaaaagatg

SEQ ID NO: 82571 - DNA, 103 bp, Artificial Sequence
  Synthetic Polynucleotide
taatacgactcactatagggtgtcagtgcatattttgtaggatgtcccctaacagaggagaaggggaatgcctacaaaaaacctggcggcagcgcaaaagatg

SEQ ID NO: 82572 - DNA, 103 bp, Artificial Sequence
  Synthetic Polynucleotide
taatacgactcactatagggcattttgtcagtgcatattttgtaggatgtaacagaggagaacatccatgaaaatatgcaacctggcggcagcgcaaaagatg

SEQ ID NO: 82573 - DNA, 103 bp, Artificial Sequence
  Synthetic Polynucleotide
taatacgactcactatagggaaaaacattttgtcagtgcatattttgtagaacagaggagactacaaatgatgcactgaaacctggcggcagcgcaaaagatg

SEQ ID NO: 82574 - DNA, 103 bp, Artificial Sequence
  Synthetic Polynucleotide
taatacgactcactatagggtgacaaaaaacattttgtcagtgcatatttaacagaggagaaaatatatgctgacaaaaaacctggcggcagcgcaaaagatg

SEQ ID NO: 82575 - DNA, 103 bp, Artificial Sequence
  Synthetic Polynucleotide
taatacgactcactataggggttcttgacaaaaaacattttgtcagtgcaaacagaggagatgcactatgaaaatgtttaacctggcggcagcgcaaaagatg

SEQ ID NO: 82576 - DNA, 103 bp, Artificial Sequence
  Synthetic Polynucleotide
taatacgactcactataggggttgggttcttgacaaaaaacattttgtcaaacagaggagatgacaaatggttttttgtaacctggcggcagcgcaaaagatg

SEQ ID NO: 82577 - DNA, 103 bp, Artificial Sequence
  Synthetic Polynucleotide
taatacgactcactatagggtgtcagttgggttcttgacaaaaaacatttaacagaggagaaaatgtatgttgtcaagaaacctggcggcagcgcaaaagatg

SEQ ID NO: 82578 - DNA, 103 bp, Artificial Sequence
  Synthetic Polynucleotide
taatacgactcactataggggccagtgtcagttgggttcttgacaaaaaaaacagaggagattttttatgaagaacccaaacctggcggcagcgcaaaagatg

SEQ ID NO: 82579 - DNA, 103 bp, Artificial Sequence
  Synthetic Polynucleotide
taatacgactcactatagggccatggccagtgtcagttgggttcttgacaaacagaggagatgtcaaatgcccaactgaaacctggcggcagcgcaaaagatg

SEQ ID NO: 82580 - DNA, 103 bp, Artificial Sequence
  Synthetic Polynucleotide
taatacgactcactataggggttttgttttttgttttattttgtttgacaaacagaggagatgtcaaatgaaataaaacaacctggcggcagcgcaaaagatg

SEQ ID NO: 82581 - DNA, 103 bp, Artificial Sequence
  Synthetic Polynucleotide
taatacgactcactatagggcagtgccatggccagtgtcagttgggttctaacagaggagaagaaccatgctgacactgaacctggcggcagcgcaaaagatg

SEQ ID NO: 82582 - DNA, 103 bp, Artificial Sequence
  Synthetic Polynucleotide
taatacgactcactatagggcacaacagtgccatggccagtgtcagttggaacagaggagaccaactatgactggccataacctggcggcagcgcaaaagatg

SEQ ID NO: 82583 - DNA, 103 bp, Artificial Sequence
  Synthetic Polynucleotide
taatacgactcactatagggtgcatcacaacagtgccatggccagtgtcaaacagaggagatgacacatgccatggcacaacctggcggcagcgcaaaagatg

SEQ ID NO: 82584 - DNA, 103 bp, Artificial Sequence
  Synthetic Polynucleotide
taatacgactcactatagggtcacctgcatcacaacagtgccatggccagaacagaggagactggccatggcactgttgaacctggcggcagcgcaaaagatg

SEQ ID NO: 82585 - DNA, 103 bp, Artificial Sequence
  Synthetic Polynucleotide
taatacgactcactatagggcactttcacctgcatcacaacagtgccatgaacagaggagacatggcatggttgtgatgaacctggcggcagcgcaaaagatg

SEQ ID NO: 82586 - DNA, 103 bp, Artificial Sequence
  Synthetic Polynucleotide
taatacgactcactatagggtttgacactttcacctgcatcacaacagtgaacagaggagacactgtatggatgcaggtaacctggcggcagcgcaaaagatg

SEQ ID NO: 82587 - DNA, 103 bp, Artificial Sequence
  Synthetic Polynucleotide
taatacgactcactatagggctccttttgacactttcacctgcatcacaaaacagaggagattgtgaatgaggtgaaagaacctggcggcagcgcaaaagatg

SEQ ID NO: 82588 - DNA, 103 bp, Artificial Sequence
  Synthetic Polynucleotide
taatacgactcactataggggggggctccttttgacactttcacctgcataacagaggagaatgcagatgaaagtgtcaaacctggcggcagcgcaaaagatg

SEQ ID NO: 82589 - DNA, 103 bp, Artificial Sequence
  Synthetic Polynucleotide
taatacgactcactatagggctgcagggggctccttttgacactttcaccaacagaggagaggtgaaatggtcaaaaggaacctggcggcagcgcaaaagatg

SEQ ID NO: 82590 - DNA, 103 bp, Artificial Sequence
  Synthetic Polynucleotide
taatacgactcactataggggaatcctgcagggggctccttttgacacttaacagaggagaaagtgtatgaaggagcccaacctggcggcagcgcaaaagatg

SEQ ID NO: 82591 - DNA, 103 bp, Artificial Sequence
  Synthetic Polynucleotide
taatacgactcactatagggaatttgttttgttttttgttttattttgttaacagaggagaaacaaaatgaaacaaaaaaacctggcggcagcgcaaaagatg

SEQ ID NO: 82592 - DNA, 103 bp, Artificial Sequence
  Synthetic Polynucleotide
taatacgactcactatagggcactggaatcctgcagggggctccttttgaaacagaggagatcaaaaatggccccctgcaacctggcggcagcgcaaaagatg

SEQ ID NO: 82593 - DNA, 103 bp, Artificial Sequence
  Synthetic Polynucleotide
taatacgactcactatagggactatcactggaatcctgcagggggctcctaacagaggagaaggagcatgctgcaggataacctggcggcagcgcaaaagatg

SEQ ID NO: 82594 - DNA, 103 bp, Artificial Sequence
  Synthetic Polynucleotide
taatacgactcactatagggcagctactatcactggaatcctgcagggggaacagaggagaccccctatgggattccagaacctggcggcagcgcaaaagatg

SEQ ID NO: 82595 - DNA, 103 bp, Artificial Sequence
  Synthetic Polynucleotide
taatacgactcactatagggatcatcagctactatcactggaatcctgcaaacagaggagatgcaggatgccagtgataaacctggcggcagcgcaaaagatg

SEQ ID NO: 82596 - DNA, 103 bp, Artificial Sequence
  Synthetic Polynucleotide
taatacgactcactataggggtaagatcatcagctactatcactggaatcaacagaggagagattccatggatagtagcaacctggcggcagcgcaaaagatg

SEQ ID NO: 82597 - DNA, 103 bp, Artificial Sequence
  Synthetic Polynucleotide
taatacgactcactatagggccgctgtaagatcatcagctactatcactgaacagaggagacagtgaatgtagctgatgaacctggcggcagcgcaaaagatg

SEQ ID NO: 82598 - DNA, 103 bp, Artificial Sequence
  Synthetic Polynucleotide
taatacgactcactataggggattgccgctgtaagatcatcagctactataacagaggagaatagtaatggatgatcttaacctggcggcagcgcaaaagatg

SEQ ID NO: 82599 - DNA, 103 bp, Artificial Sequence
  Synthetic Polynucleotide
taatacgactcactatagggttattgattgccgctgtaagatcatcagctaacagaggagaagctgaatgtcttacagcaacctggcggcagcgcaaaagatg

SEQ ID NO: 82600 - DNA, 103 bp, Artificial Sequence
  Synthetic Polynucleotide
taatacgactcactatagggtgcctttattgattgccgctgtaagatcataacagaggagaatgatcatgcagcggcaaaacctggcggcagcgcaaaagatg

SEQ ID NO: 82601 - DNA, 103 bp, Artificial Sequence
  Synthetic Polynucleotide
taatacgactcactatagggcaaaatgcctttattgattgccgctgtaagaacagaggagacttacaatggcaatcaataacctggcggcagcgcaaaagatg

SEQ ID NO: 82602 - DNA, 103 bp, Artificial Sequence
  Synthetic Polynucleotide
taatacgactcactatagggtcgatttgcagaccaatgcacctcaattagaacagaggagactaattatggtgcattggaacctggcggcagcgcaaaagatg

SEQ ID NO: 82603 - DNA, 103 bp, Artificial Sequence
  Synthetic Polynucleotide
taatacgactcactatagggtttccaatttgttttgttttttgttttattaacagaggagaaataaaatgaaaaacaaaaacctggcggcagcgcaaaagatg

SEQ ID NO: 82604 - DNA, 103 bp, Artificial Sequence
  Synthetic Polynucleotide
taatacgactcactataggggtaaccaaaatgcctttattgattgccgctaacagaggagaagcggcatgcaataaaggaacctggcggcagcgcaaaagatg

SEQ ID NO: 82605 - DNA, 103 bp, Artificial Sequence
  Synthetic Polynucleotide
taatacgactcactatagggtaactgtaaccaaaatgcctttattgattgaacagaggagacaatcaatgaaggcatttaacctggcggcagcgcaaaagatg

SEQ ID NO: 82606 - DNA, 103 bp, Artificial Sequence
  Synthetic Polynucleotide
taatacgactcactatagggggggttaactgtaaccaaaatgcctttattaacagaggagaaataaaatgattttggttaacctggcggcagcgcaaaagatg

SEQ ID NO: 82607 - DNA, 103 bp, Artificial Sequence
  Synthetic Polynucleotide
taatacgactcactataggggcgatggggttaactgtaaccaaaatgcctaacagaggagaaggcatatgggttacagtaacctggcggcagcgcaaaagatg

SEQ ID NO: 82608 - DNA, 103 bp, Artificial Sequence
  Synthetic Polynucleotide
taatacgactcactatagggttgaggcgatggggttaactgtaaccaaaaaacagaggagattttggatgcagttaaccaacctggcggcagcgcaaaagatg

SEQ ID NO: 82609 - DNA, 103 bp, Artificial Sequence
  Synthetic Polynucleotide
taatacgactcactatagggattggttgaggcgatggggttaactgtaacaacagaggagagttacaatgaaccccatcaacctggcggcagcgcaaaagatg

SEQ ID NO: 82610 - DNA, 103 bp, Artificial Sequence
  Synthetic Polynucleotide
taatacgactcactatagggtcatcattggttgaggcgatggggttaactaacagaggagaagttaaatgcatcgcctcaacctggcggcagcgcaaaagatg

SEQ ID NO: 82611 - DNA, 103 bp, Artificial Sequence
  Synthetic Polynucleotide
taatacgactcactatagggcttcatcatcattggttgaggcgatggggtaacagaggagaaccccaatgcctcaaccaaacctggcggcagcgcaaaagatg

SEQ ID NO: 82612 - DNA, 103 bp, Artificial Sequence
  Synthetic Polynucleotide
taatacgactcactatagggcagcacttcatcatcattggttgaggcgataacagaggagaatcgccatgaccaatgataacctggcggcagcgcaaaagatg

SEQ ID NO: 82613 - DNA, 103 bp, Artificial Sequence
  Synthetic Polynucleotide
taatacgactcactatagggtcaatcagcacttcatcatcattggttgagaacagaggagactcaacatgtgatgatgaaacctggcggcagcgcaaaagatg

SEQ ID NO: 82614 - DNA, 103 bp, Artificial Sequence
  Synthetic Polynucleotide
taatacgactcactataggggtctgtttccaatttgttttgttttttgttaacagaggagaaacaaaatgcaaaacaaaaacctggcggcagcgcaaaagatg

SEQ ID NO: 82615 - DNA, 103 bp, Artificial Sequence
  Synthetic Polynucleotide
taatacgactcactatagggtcacctcaatcagcacttcatcatcattggaacagaggagaccaatgatgatgaagtgcaacctggcggcagcgcaaaagatg

SEQ ID NO: 82616 - DNA, 103 bp, Artificial Sequence
  Synthetic Polynucleotide
taatacgactcactatagggtgggttcacctcaatcagcacttcatcatcaacagaggagagatgatatggtgctgattaacctggcggcagcgcaaaagatg

SEQ ID NO: 82617 - DNA, 103 bp, Artificial Sequence
  Synthetic Polynucleotide
taatacgactcactatagggaaaggtgggttcacctcaatcagcacttcaaacagaggagatgaagtatggattgaggtaacctggcggcagcgcaaaagatg

SEQ ID NO: 82618 - DNA, 103 bp, Artificial Sequence
  Synthetic Polynucleotide
taatacgactcactatagggctccaaaaggtgggttcacctcaatcagcaaacagaggagatgctgaatgaggtgaaccaacctggcggcagcgcaaaagatg

SEQ ID NO: 82619 - DNA, 103 bp, Artificial Sequence
  Synthetic Polynucleotide
taatacgactcactataggggctgtctccaaaaggtgggttcacctcaataacagaggagaattgagatgaacccacctaacctggcggcagcgcaaaagatg

SEQ ID NO: 82620 - DNA, 103 bp, Artificial Sequence
  Synthetic Polynucleotide
taatacgactcactatagggatgtagctgtctccaaaaggtgggttcaccaacagaggagaggtgaaatgaccttttggaacctggcggcagcgcaaaagatg

SEQ ID NO: 82621 - DNA, 103 bp, Artificial Sequence
  Synthetic Polynucleotide
taatacgactcactatagggcgataatgtagctgtctccaaaaggtgggtaacagaggagaacccacatgttggagacaaacctggcggcagcgcaaaagatg

SEQ ID NO: 82622 - DNA, 103 bp, Artificial Sequence
  Synthetic Polynucleotide
taatacgactcactatagggcccaacgataatgtagctgtctccaaaaggaacagaggagaccttttatggacagctacaacctggcggcagcgcaaaagatg

SEQ ID NO: 82623 - DNA, 103 bp, Artificial Sequence
  Synthetic Polynucleotide
taatacgactcactatagggcctctcccaacgataatgtagctgtctccaaacagaggagatggagaatgctacattataacctggcggcagcgcaaaagatg

SEQ ID NO: 82624 - DNA, 103 bp, Artificial Sequence
  Synthetic Polynucleotide
taatacgactcactatagggaatctcctctcccaacgataatgtagctgtaacagaggagaacagctatgttatcgttgaacctggcggcagcgcaaaagatg

SEQ ID NO: 82625 - DNA, 103 bp, Artificial Sequence
  Synthetic Polynucleotide
taatacgactcactatagggtccaggtctgtttccaatttgttttgttttaacagaggagaaaaacaatgcaaattggaaacctggcggcagcgcaaaagatg

SEQ ID NO: 82626 - DNA, 103 bp, Artificial Sequence
  Synthetic Polynucleotide
taatacgactcactatagggacgtgaatctcctctcccaacgataatgtaaacagaggagatacattatggttgggagaaacctggcggcagcgcaaaagatg

SEQ ID NO: 82627 - DNA, 103 bp, Artificial Sequence
  Synthetic Polynucleotide
taatacgactcactataggggtgagacgtgaatctcctctcccaacgataaacagaggagatatcgtatggagaggagaaacctggcggcagcgcaaaagatg

SEQ ID NO: 82628 - DNA, 103 bp, Artificial Sequence
  Synthetic Polynucleotide
taatacgactcactatagggggtaagtgagacgtgaatctcctctcccaaaacagaggagattgggaatggagattcacaacctggcggcagcgcaaaagatg

SEQ ID NO: 82629 - DNA, 103 bp, Artificial Sequence
  Synthetic Polynucleotide
taatacgactcactatagggccactggtaagtgagacgtgaatctcctctaacagaggagaagaggaatgtcacgtctcaacctggcggcagcgcaaaagatg

SEQ ID NO: 82630 - DNA, 103 bp, Artificial Sequence
  Synthetic Polynucleotide
taatacgactcactatagggttgtgccactggtaagtgagacgtgaatctaacagaggagaagattcatgtctcacttaaacctggcggcagcgcaaaagatg

SEQ ID NO: 82631 - DNA, 103 bp, Artificial Sequence
  Synthetic Polynucleotide
taatacgactcactatagggcctctttgtgccactggtaagtgagacgtgaacagaggagacacgtcatgcttaccagtaacctggcggcagcgcaaaagatg

SEQ ID NO: 82632 - DNA, 103 bp, Artificial Sequence
  Synthetic Polynucleotide
taatacgactcactataggggcttccctctttgtgccactggtaagtgagaacagaggagactcactatgcagtggcacaacctggcggcagcgcaaaagatg

SEQ ID NO: 82633 - DNA, 103 bp, Artificial Sequence
  Synthetic Polynucleotide
taatacgactcactatagggattgagcttccctctttgtgccactggtaaaacagaggagattaccaatggcacaaagaaacctggcggcagcgcaaaagatg

SEQ ID NO: 82634 - DNA, 103 bp, Artificial Sequence
  Synthetic Polynucleotide
taatacgactcactatagggttcctattgagcttccctctttgtgccactaacagaggagaagtggcatgaagagggaaaacctggcggcagcgcaaaagatg

SEQ ID NO: 82635 - DNA, 103 bp, Artificial Sequence
  Synthetic Polynucleotide
taatacgactcactatagggcaactttcctattgagcttccctctttgtgaacagaggagacacaaaatgggaagctcaaacctggcggcagcgcaaaagatg

SEQ ID NO: 82636 - DNA, 103 bp, Artificial Sequence
  Synthetic Polynucleotide
taatacgactcactataggggaaggtccaggtctgtttccaatttgttttaacagaggagaaaaacaatgtggaaacagaacctggcggcagcgcaaaagatg

SEQ ID NO: 82637 - DNA, 103 bp, Artificial Sequence
  Synthetic Polynucleotide
taatacgactcactataggggtgaacaactttcctattgagcttccctctaacagaggagaagagggatgctcaataggaacctggcggcagcgcaaaagatg

SEQ ID NO: 82638 - DNA, 103 bp, Artificial Sequence
  Synthetic Polynucleotide
taatacgactcactatagggtctgagtgaacaactttcctattgagcttcaacagaggagagaagctatgtaggaaagtaacctggcggcagcgcaaaagatg

SEQ ID NO: 82639 - DNA, 103 bp, Artificial Sequence
  Synthetic Polynucleotide
taatacgactcactatagggcatggtctgagtgaacaactttcctattgaaacagaggagatcaataatgaagttgttcaacctggcggcagcgcaaaagatg

SEQ ID NO: 82640 - DNA, 103 bp, Artificial Sequence
  Synthetic Polynucleotide
taatacgactcactatagggcctttcatggtctgagtgaacaactttcctaacagaggagaaggaaaatggttcactcaaacctggcggcagcgcaaaagatg

SEQ ID NO: 82641 - DNA, 103 bp, Artificial Sequence
  Synthetic Polynucleotide
taatacgactcactatagggccacgcctttcatggtctgagtgaacaactaacagaggagaagttgtatgctcagaccaaacctggcggcagcgcaaaagatg

SEQ ID NO: 82642 - DNA, 103 bp, Artificial Sequence
  Synthetic Polynucleotide
taatacgactcactataggggcgttccacgcctttcatggtctgagtgaaaacagaggagattcactatgaccatgaaaaacctggcggcagcgcaaaagatg

SEQ ID NO: 82643 - DNA, 103 bp, Artificial Sequence
  Synthetic Polynucleotide
taatacgactcactataggggccaggcgttccacgcctttcatggtctgaaacagaggagatcagacatggaaaggcgtaacctggcggcagcgcaaaagatg

SEQ ID NO: 82644 - DNA, 103 bp, Artificial Sequence
  Synthetic Polynucleotide
taatacgactcactatagggtgacggccaggcgttccacgcctttcatggaacagaggagaccatgaatggcgtggaacaacctggcggcagcgcaaaagatg

SEQ ID NO: 82645 - DNA, 103 bp, Artificial Sequence
  Synthetic Polynucleotide
taatacgactcactatagggtcccatgacggccaggcgttccacgcctttaacagaggagaaaaggcatggaacgcctgaacctggcggcagcgcaaaagatg

SEQ ID NO: 82646 - DNA, 103 bp, Artificial Sequence
  Synthetic Polynucleotide
taatacgactcactataggggtgtctcccatgacggccaggcgttccacgaacagaggagacgtggaatgcctggccgtaacctggcggcagcgcaaaagatg

SEQ ID NO: 82647 - DNA, 103 bp, Artificial Sequence
  Synthetic Polynucleotide
taatacgactcactatagggctcttgaaggtccaggtctgtttccaatttaacagaggagaaaattgatgacagacctgaacctggcggcagcgcaaaagatg

SEQ ID NO: 82648 - DNA, 103 bp, Artificial Sequence
  Synthetic Polynucleotide
taatacgactcactatagggaggcggtgtctcccatgacggccaggcgttaacagaggagaaacgccatgccgtcatggaacctggcggcagcgcaaaagatg

SEQ ID NO: 82649 - DNA, 103 bp, Artificial Sequence
  Synthetic Polynucleotide
taatacgactcactatagggatcccaggcggtgtctcccatgacggccagaacagaggagactggccatgatgggagacaacctggcggcagcgcaaaagatg

SEQ ID NO: 82650 - DNA, 103 bp, Artificial Sequence
  Synthetic Polynucleotide
taatacgactcactatagggctgaaatcccaggcggtgtctcccatgacgaacagaggagacgtcatatgagacaccgcaacctggcggcagcgcaaaagatg

SEQ ID NO: 82651 - DNA, 103 bp, Artificial Sequence
  Synthetic Polynucleotide
taatacgactcactatagggcggagctgaaatcccaggcggtgtctcccaaacagaggagatgggagatgccgcctgggaacctggcggcagcgcaaaagatg

SEQ ID NO: 82652 - DNA, 103 bp, Artificial Sequence
  Synthetic Polynucleotide
taatacgactcactatagggtccagcggagctgaaatcccaggcggtgtcaacagaggagagacaccatgtgggatttcaacctggcggcagcgcaaaagatg

SEQ ID NO: 82653 - DNA, 103 bp, Artificial Sequence
  Synthetic Polynucleotide
taatacgactcactatagggaaccctccagcggagctgaaatcccaggcgaacagaggagacgcctgatgtttcagctcaacctggcggcagcgcaaaagatg

SEQ ID NO: 82654 - DNA, 103 bp, Artificial Sequence
  Synthetic Polynucleotide
taatacgactcactatagggtgaagaaccctccagcggagctgaaatcccaacagaggagagggattatggctccgctgaacctggcggcagcgcaaaagatg

SEQ ID NO: 82655 - DNA, 103 bp, Artificial Sequence
  Synthetic Polynucleotide
taatacgactcactatagggcgaagtgaagaaccctccagcggagctgaaaacagaggagattcagcatggctggagggaacctggcggcagcgcaaaagatg

SEQ ID NO: 82656 - DNA, 103 bp, Artificial Sequence
  Synthetic Polynucleotide
taatacgactcactatagggccaaccgaagtgaagaaccctccagcggagaacagaggagactccgcatgagggttcttaacctggcggcagcgcaaaagatg

SEQ ID NO: 82657 - DNA, 103 bp, Artificial Sequence
  Synthetic Polynucleotide
taatacgactcactatagggctttcccaaccgaagtgaagaaccctccagaacagaggagactggagatgtcttcacttaacctggcggcagcgcaaaagatg

SEQ ID NO: 82658 - DNA, 103 bp, Artificial Sequence
  Synthetic Polynucleotide
taatacgactcactatagggaacacctcttgaaggtccaggtctgtttccaacagaggagaggaaacatgcctggacctaacctggcggcagcgcaaaagatg

SEQ ID NO: 82659 - DNA, 103 bp, Artificial Sequence
  Synthetic Polynucleotide
taatacgactcactatagggaattcctttcccaaccgaagtgaagaacccaacagaggagagggttcatgacttcggttaacctggcggcagcgcaaaagatg

SEQ ID NO: 82660 - DNA, 103 bp, Artificial Sequence
  Synthetic Polynucleotide
taatacgactcactataggggtatgaattcctttcccaaccgaagtgaagaacagaggagacttcacatgggttgggaaaacctggcggcagcgcaaaagatg

SEQ ID NO: 82661 - DNA, 103 bp, Artificial Sequence
  Synthetic Polynucleotide
taatacgactcactatagggacaccgtatgaattcctttcccaaccgaagaacagaggagacttcggatgggaaaggaaaacctggcggcagcgcaaaagatg

SEQ ID NO: 82662 - DNA, 103 bp, Artificial Sequence
  Synthetic Polynucleotide
taatacgactcactataggggccaaacaccgtatgaattcctttcccaacaacagaggagagttgggatgggaattcataacctggcggcagcgcaaaagatg

SEQ ID NO: 82663 - DNA, 103 bp, Artificial Sequence
  Synthetic Polynucleotide
taatacgactcactataggggcagagccaaacaccgtatgaattcctttcaacagaggagagaaaggatgtcatacggtaacctggcggcagcgcaaaagatg

SEQ ID NO: 82664 - DNA, 103 bp, Artificial Sequence
  Synthetic Polynucleotide
taatacgactcactataggggaaaggcagagccaaacaccgtatgaattcaacagaggagagaattcatgcggtgtttgaacctggcggcagcgcaaaagatg

SEQ ID NO: 82665 - DNA, 103 bp, Artificial Sequence
  Synthetic Polynucleotide
taatacgactcactatagggcccctgaaaggcagagccaaacaccgtatgaacagaggagacatacgatgtttggctctaacctggcggcagcgcaaaagatg

SEQ ID NO: 82666 - DNA, 103 bp, Artificial Sequence
  Synthetic Polynucleotide
taatacgactcactatagggaatagcccctgaaaggcagagccaaacaccaacagaggagaggtgttatgctctgccttaacctggcggcagcgcaaaagatg

SEQ ID NO: 82667 - DNA, 103 bp, Artificial Sequence
  Synthetic Polynucleotide
taatacgactcactatagggcgccaaatagcccctgaaaggcagagccaaaacagaggagattggctatgcctttcaggaacctggcggcagcgcaaaagatg

SEQ ID NO: 82668 - DNA, 103 bp, Artificial Sequence
  Synthetic Polynucleotide
taatacgactcactatagggcaagccgccaaatagcccctgaaaggcagaaacagaggagatctgccatgcaggggctaaacctggcggcagcgcaaaagatg

SEQ ID NO: 82669 - DNA, 103 bp, Artificial Sequence
  Synthetic Polynucleotide
taatacgactcactatagggccttgaacacctcttgaaggtccaggtctgaacagaggagacagaccatgaccttcaagaacctggcggcagcgcaaaagatg

SEQ ID NO: 82670 - DNA, 103 bp, Artificial Sequence
  Synthetic Polynucleotide
taatacgactcactatagggcagttcaagccgccaaatagcccctgaaagaacagaggagactttcaatggctatttggaacctggcggcagcgcaaaagatg

SEQ ID NO: 82671 - DNA, 103 bp, Artificial Sequence
  Synthetic Polynucleotide
taatacgactcactatagggttatccagttcaagccgccaaatagcccctaacagaggagaaggggcatgttggcggctaacctggcggcagcgcaaaagatg

SEQ ID NO: 82672 - DNA, 103 bp, Artificial Sequence
  Synthetic Polynucleotide
taatacgactcactatagggctttgttatccagttcaagccgccaaatagaacagaggagactatttatgggcttgaacaacctggcggcagcgcaaaagatg

SEQ ID NO: 82673 - DNA, 103 bp, Artificial Sequence
  Synthetic Polynucleotide
taatacgactcactatagggatgacctttgttatccagttcaagccgccaaacagaggagatggcggatggaactggataacctggcggcagcgcaaaagatg

SEQ ID NO: 82674 - DNA, 103 bp, Artificial Sequence
  Synthetic Polynucleotide
taatacgactcactatagggccatgatgacctttgttatccagttcaagcaacagaggagagcttgaatgggataacaaaacctggcggcagcgcaaaagatg

SEQ ID NO: 82675 - DNA, 103 bp, Artificial Sequence
  Synthetic Polynucleotide
taatacgactcactatagggcgcccccatgatgacctttgttatccagttaacagaggagaaactggatgacaaaggtcaacctggcggcagcgcaaaagatg

SEQ ID NO: 82676 - DNA, 103 bp, Artificial Sequence
  Synthetic Polynucleotide
taatacgactcactatagggagtaccgcccccatgatgacctttgttatcaacagaggagagataacatgggtcatcataacctggcggcagcgcaaaagatg

SEQ ID NO: 82677 - DNA, 103 bp, Artificial Sequence
  Synthetic Polynucleotide
taatacgactcactatagggatataagtaccgcccccatgatgacctttgaacagaggagacaaaggatgtcatgggggaacctggcggcagcgcaaaagatg

SEQ ID NO: 82678 - DNA, 103 bp, Artificial Sequence
  Synthetic Polynucleotide
taatacgactcactatagggaacccatataagtaccgcccccatgatgacaacagaggagagtcatcatgggggcggtaaacctggcggcagcgcaaaagatg

SEQ ID NO: 82679 - DNA, 103 bp, Artificial Sequence
  Synthetic Polynucleotide
taatacgactcactatagggatgccaacccatataagtaccgcccccatgaacagaggagacatgggatgggtacttataacctggcggcagcgcaaaagatg

SEQ ID NO: 82680 - DNA, 103 bp, Artificial Sequence
  Synthetic Polynucleotide
taatacgactcactatagggtaaatccttgaacacctcttgaaggtccagaacagaggagactggacatgcaagaggtgaacctggcggcagcgcaaaagatg

SEQ ID NO: 82681 - DNA, 103 bp, Artificial Sequence
  Synthetic Polynucleotide
taatacgactcactatagggtgttgatgccaacccatataagtaccgcccaacagaggagagggcggatgttatatgggaacctggcggcagcgcaaaagatg

SEQ ID NO: 82682 - DNA, 103 bp, Artificial Sequence
  Synthetic Polynucleotide
taatacgactcactatagggtcttgtgttgatgccaacccatataagtacaacagaggagagtacttatgtgggttggcaacctggcggcagcgcaaaagatg

SEQ ID NO: 82683 - DNA, 103 bp, Artificial Sequence
  Synthetic Polynucleotide
taatacgactcactatagggatgtttcttgtgttgatgccaacccatataaacagaggagatatatgatgtggcatcaaaacctggcggcagcgcaaaagatg

SEQ ID NO: 82684 - DNA, 103 bp, Artificial Sequence
  Synthetic Polynucleotide
taatacgactcactatagggttgtcatgtttcttgtgttgatgccaacccaacagaggagagggttgatgtcaacacaaaacctggcggcagcgcaaaagatg

SEQ ID NO: 82685 - DNA, 103 bp, Artificial Sequence
  Synthetic Polynucleotide
taatacgactcactatagggggacattgtcatgtttcttgtgttgatgccaacagaggagaggcatcatgacaagaaacaacctggcggcagcgcaaaagatg

SEQ ID NO: 82686 - DNA, 103 bp, Artificial Sequence
  Synthetic Polynucleotide
taatacgactcactatagggctcatggacattgtcatgtttcttgtgttgaacagaggagacaacacatgaaacatgacaacctggcggcagcgcaaaagatg

SEQ ID NO: 82687 - DNA, 103 bp, Artificial Sequence
  Synthetic Polynucleotide
taatacgactcactatagggtcatgctcatggacattgtcatgtttcttgaacagaggagacaagaaatgtgacaatgtaacctggcggcagcgcaaaagatg

SEQ ID NO: 82688 - DNA, 103 bp, Artificial Sequence
  Synthetic Polynucleotide
taatacgactcactatagggcaagatcatgctcatggacattgtcatgttaacagaggagaaacatgatgatgtccatgaacctggcggcagcgcaaaagatg

SEQ ID NO: 82689 - DNA, 103 bp, Artificial Sequence
  Synthetic Polynucleotide
taatacgactcactatagggcctaccaagatcatgctcatggacattgtcaacagaggagagacaatatgcatgagcataacctggcggcagcgcaaaagatg

SEQ ID NO: 82690 - DNA, 103 bp, Artificial Sequence
  Synthetic Polynucleotide
taatacgactcactatagggtcactcctaccaagatcatgctcatggacaaacagaggagatgtccaatggcatgatctaacctggcggcagcgcaaaagatg

SEQ ID NO: 82691 - DNA, 103 bp, Artificial Sequence
  Synthetic Polynucleotide
taatacgactcactatagggaaagataaatccttgaacacctcttgaaggaacagaggagaccttcaatgggtgttcaaaacctggcggcagcgcaaaagatg

SEQ ID NO: 82692 - DNA, 103 bp, Artificial Sequence
  Synthetic Polynucleotide
taatacgactcactatagggcatgatcactcctaccaagatcatgctcataacagaggagaatgagcatgatcttggtaaacctggcggcagcgcaaaagatg

SEQ ID NO: 82693 - DNA, 103 bp, Artificial Sequence
  Synthetic Polynucleotide
taatacgactcactatagggaacatcatgatcactcctaccaagatcatgaacagaggagacatgatatgggtaggagtaacctggcggcagcgcaaaagatg

SEQ ID NO: 82694 - DNA, 103 bp, Artificial Sequence
  Synthetic Polynucleotide
taatacgactcactatagggacaaaaacatcatgatcactcctaccaagaaacagaggagatcttggatggagtgatcaaacctggcggcagcgcaaaagatg

SEQ ID NO: 82695 - DNA, 103 bp, Artificial Sequence
  Synthetic Polynucleotide
taatacgactcactatagggtagagacaaaaacatcatgatcactcctacaacagaggagagtaggaatgatcatgatgaacctggcggcagcgcaaaagatg

SEQ ID NO: 82696 - DNA, 103 bp, Artificial Sequence
  Synthetic Polynucleotide
taatacgactcactatagggactcctagagacaaaaacatcatgatcactaacagaggagaagtgatatggatgtttttaacctggcggcagcgcaaaagatg

SEQ ID NO: 82697 - DNA, 103 bp, Artificial Sequence
  Synthetic Polynucleotide
taatacgactcactatagggccccaactcctagagacaaaaacatcatgaaacagaggagatcatgaatgttttgtctcaacctggcggcagcgcaaaagatg

SEQ ID NO: 82698 - DNA, 103 bp, Artificial Sequence
  Synthetic Polynucleotide
taatacgactcactatagggatccgccccaactcctagagacaaaaacataacagaggagaatgtttatgtctctaggaaacctggcggcagcgcaaaagatg

SEQ ID NO: 82699 - DNA, 103 bp, Artificial Sequence
  Synthetic Polynucleotide
taatacgactcactatagggccttgatccgccccaactcctagagacaaaaacagaggagatttgtcatgaggagttggaacctggcggcagcgcaaaagatg

SEQ ID NO: 82700 - DNA, 103 bp, Artificial Sequence
  Synthetic Polynucleotide
taatacgactcactatagggcgcatccttgatccgccccaactcctagagaacagaggagactctagatgttggggcggaacctggcggcagcgcaaaagatg

SEQ ID NO: 82701 - DNA, 103 bp, Artificial Sequence
  Synthetic Polynucleotide
taatacgactcactataggggatggcgcatccttgatccgccccaactccaacagaggagaggagttatggcggatcaaaacctggcggcagcgcaaaagatg

SEQ ID NO: 82702 - DNA, 103 bp, Artificial Sequence
  Synthetic Polynucleotide
taatacgactcactatagggaagaaaaagataaatccttgaacacctcttaacagaggagaaagaggatgtcaaggattaacctggcggcagcgcaaaagatg

SEQ ID NO: 82703 - DNA, 103 bp, Artificial Sequence
  Synthetic Polynucleotide
taatacgactcactatagggaagttgatggcgcatccttgatccgccccaaacagaggagatggggcatgtcaaggatgaacctggcggcagcgcaaaagatg

SEQ ID NO: 82704 - DNA, 103 bp, Artificial Sequence
  Synthetic Polynucleotide
taatacgactcactatagggtgccaaagttgatggcgcatccttgatccgaacagaggagacggatcatggatgcgccaaacctggcggcagcgcaaaagatg

SEQ ID NO: 82705 - DNA, 103 bp, Artificial Sequence
  Synthetic Polynucleotide
taatacgactcactatagggtctcttgccaaagttgatggcgcatccttgaacagaggagacaaggaatggccatcaacaacctggcggcagcgcaaaagatg

SEQ ID NO: 82706 - DNA, 103 bp, Artificial Sequence
  Synthetic Polynucleotide
taatacgactcactatagggagctctctcttgccaaagttgatggcgcataacagaggagaatgcgcatgcaactttggaacctggcggcagcgcaaaagatg

SEQ ID NO: 82707 - DNA, 103 bp, Artificial Sequence
  Synthetic Polynucleotide
taatacgactcactatagggacttgagctctctcttgccaaagttgatggaacagaggagaccatcaatgttggcaagaaacctggcggcagcgcaaaagatg

SEQ ID NO: 82708 - DNA, 103 bp, Artificial Sequence
  Synthetic Polynucleotide
taatacgactcactatagggtccgcacttgagctctctcttgccaaagttaacagaggagaaactttatgaagagagagaacctggcggcagcgcaaaagatg

SEQ ID NO: 82709 - DNA, 103 bp, Artificial Sequence
  Synthetic Polynucleotide
taatacgactcactatagggccatctccgcacttgagctctctcttgccaaacagaggagatggcaaatgagagctcaaaacctggcggcagcgcaaaagatg

SEQ ID NO: 82710 - DNA, 103 bp, Artificial Sequence
  Synthetic Polynucleotide
taatacgactcactatagggagataccatctccgcacttgagctctctctaacagaggagaagagagatgtcaagtgcgaacctggcggcagcgcaaaagatg

SEQ ID NO: 82711 - DNA, 103 bp, Artificial Sequence
  Synthetic Polynucleotide
taatacgactcactatagggtatgaagataccatctccgcacttgagctcaacagaggagagagctcatgtgcggagataacctggcggcagcgcaaaagatg

SEQ ID NO: 82712 - DNA, 103 bp, Artificial Sequence
  Synthetic Polynucleotide
taatacgactcactatagggctaaatatgaagataccatctccgcacttgaacagaggagacaagtgatgagatggtataacctggcggcagcgcaaaagatg

SEQ ID NO: 82713 - DNA, 103 bp, Artificial Sequence
  Synthetic Polynucleotide
taatacgactcactataggggcaactcgatttgcagaccaatgcacctcaaacagaggagatgaggtatgttggtctgcaacctggcggcagcgcaaaagatg

SEQ ID NO: 82714 - DNA, 103 bp, Artificial Sequence
  Synthetic Polynucleotide
taatacgactcactatagggacaaaaagaaaaagataaatccttgaacacaacagaggagagtgttcatggatttatctaacctggcggcagcgcaaaagatg

SEQ ID NO: 82715 - DNA, 103 bp, Artificial Sequence
  Synthetic Polynucleotide
taatacgactcactatagggagtctctaaatatgaagataccatctccgcaacagaggagagcggagatggtatcttcaaacctggcggcagcgcaaaagatg

SEQ ID NO: 82716 - DNA, 103 bp, Artificial Sequence
  Synthetic Polynucleotide
taatacgactcactatagggatcagagtctctaaatatgaagataccatcaacagaggagagatggtatgttcatatttaacctggcggcagcgcaaaagatg

SEQ ID NO: 82717 - DNA, 103 bp, Artificial Sequence
  Synthetic Polynucleotide
taatacgactcactatagggcagtcatcagagtctctaaatatgaagataaacagaggagatatcttatgatttagagaaacctggcggcagcgcaaaagatg

SEQ ID NO: 82718 - DNA, 103 bp, Artificial Sequence
  Synthetic Polynucleotide
taatacgactcactatagggtcagccagtcatcagagtctctaaatatgaaacagaggagatcatatatggagactctgaacctggcggcagcgcaaaagatg

SEQ ID NO: 82719 - DNA, 103 bp, Artificial Sequence
  Synthetic Polynucleotide
taatacgactcactatagggcttgttcagccagtcatcagagtctctaaaaacagaggagatttagaatgtctgatgacaacctggcggcagcgcaaaagatg

SEQ ID NO: 82720 - DNA, 103 bp, Artificial Sequence
  Synthetic Polynucleotide
taatacgactcactataggggagtacttgttcagccagtcatcagagtctaacagaggagaagactcatgtgactggctaacctggcggcagcgcaaaagatg

SEQ ID NO: 82721 - DNA, 103 bp, Artificial Sequence
  Synthetic Polynucleotide
taatacgactcactatagggagtatgagtacttgttcagccagtcatcagaacagaggagactgatgatgggctgaacaaacctggcggcagcgcaaaagatg

SEQ ID NO: 82722 - DNA, 103 bp, Artificial Sequence
  Synthetic Polynucleotide
taatacgactcactatagggtggatagtatgagtacttgttcagccagtcaacagaggagagactggatgaacaagtacaacctggcggcagcgcaaaagatg

SEQ ID NO: 82723 - DNA, 103 bp, Artificial Sequence
  Synthetic Polynucleotide
taatacgactcactatagggtcttctggatagtatgagtacttgttcagcaacagaggagagctgaaatggtactcataaacctggcggcagcgcaaaagatg

SEQ ID NO: 82724 - DNA, 103 bp, Artificial Sequence
  Synthetic Polynucleotide
taatacgactcactatagggcaggatcttctggatagtatgagtacttgtaacagaggagaacaagtatgcatactatcaacctggcggcagcgcaaaagatg

SEQ ID NO: 82725 - DNA, 103 bp, Artificial Sequence
  Synthetic Polynucleotide
taatacgactcactataggggttgaacaaaaagaaaaagataaatccttgaacagaggagacaaggaatgatctttttcaacctggcggcagcgcaaaagatg

SEQ ID NO: 82726 - DNA, 103 bp, Artificial Sequence
  Synthetic Polynucleotide
taatacgactcactatagggcttcacaggatcttctggatagtatgagtaaacagaggagatactcaatgtatccagaaaacctggcggcagcgcaaaagatg

SEQ ID NO: 82727 - DNA, 103 bp, Artificial Sequence
  Synthetic Polynucleotide
taatacgactcactataggggcaagcttcacaggatcttctggatagtataacagaggagaatactaatgagaagatccaacctggcggcagcgcaaaagatg

SEQ ID NO: 82728 - DNA, 103 bp, Artificial Sequence
  Synthetic Polynucleotide
taatacgactcactatagggttgatgcaagcttcacaggatcttctggataacagaggagaatccagatgatcctgtgaaacctggcggcagcgcaaaagatg

SEQ ID NO: 82729 - DNA, 103 bp, Artificial Sequence
  Synthetic Polynucleotide
taatacgactcactatagggcactattgatgcaagcttcacaggatcttcaacagaggagagaagatatggtgaagcttaacctggcggcagcgcaaaagatg

SEQ ID NO: 82730 - DNA, 103 bp, Artificial Sequence
  Synthetic Polynucleotide
taatacgactcactataggggctttcactattgatgcaagcttcacaggaaacagaggagatcctgtatggcttgcatcaacctggcggcagcgcaaaagatg

SEQ ID NO: 82731 - DNA, 103 bp, Artificial Sequence
  Synthetic Polynucleotide
taatacgactcactatagggaagaggctttcactattgatgcaagcttcaaacagaggagatgaagcatgcatcaatagaacctggcggcagcgcaaaagatg

SEQ ID NO: 82732 - DNA, 103 bp, Artificial Sequence
  Synthetic Polynucleotide
taatacgactcactatagggttcaaaagaggctttcactattgatgcaagaacagaggagacttgcaatgatagtgaaaaacctggcggcagcgcaaaagatg

SEQ ID NO: 82733 - DNA, 103 bp, Artificial Sequence
  Synthetic Polynucleotide
taatacgactcactatagggccttcttcaaaagaggctttcactattgataacagaggagaatcaatatggaaagcctcaacctggcggcagcgcaaaagatg

SEQ ID NO: 82734 - DNA, 103 bp, Artificial Sequence
  Synthetic Polynucleotide
taatacgactcactatagggacttcccttcttcaaaagaggctttcactaaacagaggagatagtgaatgcctcttttgaacctggcggcagcgcaaaagatg

SEQ ID NO: 82735 - DNA, 103 bp, Artificial Sequence
  Synthetic Polynucleotide
taatacgactcactataggggccacacttcccttcttcaaaagaggctttaacagaggagaaaagccatgtttgaagaaaacctggcggcagcgcaaaagatg

SEQ ID NO: 82736 - DNA, 103 bp, Artificial Sequence
  Synthetic Polynucleotide
taatacgactcactatagggaaaatgttgaacaaaaagaaaaagataaataacagaggagaatttatatgtttctttttaacctggcggcagcgcaaaagatg

SEQ ID NO: 82737 - DNA, 103 bp, Artificial Sequence
  Synthetic Polynucleotide
taatacgactcactatagggtttaggccacacttcccttcttcaaaagagaacagaggagactctttatgagaagggaaaacctggcggcagcgcaaaagatg

SEQ ID NO: 82738 - DNA, 103 bp, Artificial Sequence
  Synthetic Polynucleotide
taatacgactcactatagggctgaatttaggccacacttcccttcttcaaaacagaggagattgaagatgggaagtgtgaacctggcggcagcgcaaaagatg

SEQ ID NO: 82739 - DNA, 103 bp, Artificial Sequence
  Synthetic Polynucleotide
taatacgactcactataggggtcaactgaatttaggccacacttcccttcaacagaggagagaagggatgtgtggcctaaacctggcggcagcgcaaaagatg

SEQ ID NO: 82740 - DNA, 103 bp, Artificial Sequence
  Synthetic Polynucleotide
taatacgactcactatagggagggagtcaactgaatttaggccacacttcaacagaggagagaagtgatgcctaaattcaacctggcggcagcgcaaaagatg

SEQ ID NO: 82741 - DNA, 103 bp, Artificial Sequence
  Synthetic Polynucleotide
taatacgactcactataggggctcaagggagtcaactgaatttaggccacaacagaggagagtggccatgattcagttgaacctggcggcagcgcaaaagatg

SEQ ID NO: 82742 - DNA, 103 bp, Artificial Sequence
  Synthetic Polynucleotide
taatacgactcactatagggctcatgctcaagggagtcaactgaatttagaacagaggagactaaatatggttgactccaacctggcggcagcgcaaaagatg

SEQ ID NO: 82743 - DNA, 103 bp, Artificial Sequence
  Synthetic Polynucleotide
taatacgactcactatagggcacatctcatgctcaagggagtcaactgaaaacagaggagattcagtatgctcccttgaaacctggcggcagcgcaaaagatg

SEQ ID NO: 82744 - DNA, 103 bp, Artificial Sequence
  Synthetic Polynucleotide
taatacgactcactatagggttctccacatctcatgctcaagggagtcaaaacagaggagattgactatgttgagcatgaacctggcggcagcgcaaaagatg

SEQ ID NO: 82745 - DNA, 103 bp, Artificial Sequence
  Synthetic Polynucleotide
taatacgactcactatagggcctgcttctccacatctcatgctcaagggaaacagaggagatcccttatgcatgagatgaacctggcggcagcgcaaaagatg

SEQ ID NO: 82746 - DNA, 103 bp, Artificial Sequence
  Synthetic Polynucleotide
taatacgactcactatagggtctgccctgcttctccacatctcatgctcaaacagaggagatgagcaatggatgtggagaacctggcggcagcgcaaaagatg

SEQ ID NO: 82747 - DNA, 103 bp, Artificial Sequence
  Synthetic Polynucleotide
taatacgactcactatagggcagtcaaaatgttgaacaaaaagaaaaagaaacagaggagatcttttatgttttgttcaaacctggcggcagcgcaaaagatg

SEQ ID NO: 82748 - DNA, 103 bp, Artificial Sequence
  Synthetic Polynucleotide
taatacgactcactatagggtctcatctgccctgcttctccacatctcataacagaggagaatgagaatgggagaagcaaacctggcggcagcgcaaaagatg

SEQ ID NO: 82749 - DNA, 103 bp, Artificial Sequence
  Synthetic Polynucleotide
taatacgactcactatagggattgatctcatctgccctgcttctccacataacagaggagaatgtggatgagcagggcaaacctggcggcagcgcaaaagatg

SEQ ID NO: 82750 - DNA, 103 bp, Artificial Sequence
  Synthetic Polynucleotide
taatacgactcactatagggatggcattgatctcatctgccctgcttctcaacagaggagagagaagatgggcagatgaaacctggcggcagcgcaaaagatg

SEQ ID NO: 82751 - DNA, 103 bp, Artificial Sequence
  Synthetic Polynucleotide
taatacgactcactatagggcaaaaatggcattgatctcatctgccctgcaacagaggagagcagggatgatgagatcaaacctggcggcagcgcaaaagatg

SEQ ID NO: 82752 - DNA, 103 bp, Artificial Sequence
  Synthetic Polynucleotide
taatacgactcactatagggttcctcaaaaatggcattgatctcatctgcaacagaggagagcagatatgatcaatgccaacctggcggcagcgcaaaagatg

SEQ ID NO: 82753 - DNA, 103 bp, Artificial Sequence
  Synthetic Polynucleotide
taatacgactcactatagggtcgttttcctcaaaaatggcattgatctcaaacagaggagatgagatatgtgccattttaacctggcggcagcgcaaaagatg

SEQ ID NO: 82754 - DNA, 103 bp, Artificial Sequence
  Synthetic Polynucleotide
taatacgactcactatagggccacctcgttttcctcaaaaatggcattgaaacagaggagatcaatgatgtttttgaggaacctggcggcagcgcaaaagatg

SEQ ID NO: 82755 - DNA, 103 bp, Artificial Sequence
  Synthetic Polynucleotide
taatacgactcactatagggaatgtccacctcgttttcctcaaaaatggcaacagaggagagccattatggaggaaaacaacctggcggcagcgcaaaagatg

SEQ ID NO: 82756 - DNA, 103 bp, Artificial Sequence
  Synthetic Polynucleotide
taatacgactcactatagggacagaaatgtccacctcgttttcctcaaaaaacagaggagattttgaatgaaacgaggtaacctggcggcagcgcaaaagatg

SEQ ID NO: 82757 - DNA, 103 bp, Artificial Sequence
  Synthetic Polynucleotide
taatacgactcactatagggcgacaacagaaatgtccacctcgttttcctaacagaggagaaggaaaatgaggtggacaaacctggcggcagcgcaaaagatg

SEQ ID NO: 82758 - DNA, 103 bp, Artificial Sequence
  Synthetic Polynucleotide
taatacgactcactatagggttttccagtcaaaatgttgaacaaaaagaaaacagaggagattctttatgttcaacattaacctggcggcagcgcaaaagatg

SEQ ID NO: 82759 - DNA, 103 bp, Artificial Sequence
  Synthetic Polynucleotide
taatacgactcactatagggctgcacgacaacagaaatgtccacctcgttaacagaggagaaacgagatggacatttctaacctggcggcagcgcaaaagatg

SEQ ID NO: 82760 - DNA, 103 bp, Artificial Sequence
  Synthetic Polynucleotide
taatacgactcactatagggggatcctgcacgacaacagaaatgtccaccaacagaggagaggtggaatgttctgttgtaacctggcggcagcgcaaaagatg

SEQ ID NO: 82761 - DNA, 103 bp, Artificial Sequence
  Synthetic Polynucleotide
taatacgactcactatagggtctttggatcctgcacgacaacagaaatgtaacagaggagaacatttatgttgtcgtgcaacctggcggcagcgcaaaagatg

SEQ ID NO: 82762 - DNA, 103 bp, Artificial Sequence
  Synthetic Polynucleotide
taatacgactcactatagggaacattctttggatcctgcacgacaacagaaacagaggagatctgttatggtgcaggataacctggcggcagcgcaaaagatg

SEQ ID NO: 82763 - DNA, 103 bp, Artificial Sequence
  Synthetic Polynucleotide
taatacgactcactatagggtggtaaacattctttggatcctgcacgacaaacagaggagatgtcgtatgggatccaaaaacctggcggcagcgcaaaagatg

SEQ ID NO: 82764 - DNA, 103 bp, Artificial Sequence
  Synthetic Polynucleotide
taatacgactcactatagggctctctggtaaacattctttggatcctgcaaacagaggagatgcaggatgcaaagaatgaacctggcggcagcgcaaaagatg

SEQ ID NO: 82765 - DNA, 103 bp, Artificial Sequence
  Synthetic Polynucleotide
taatacgactcactatagggagttcctctctggtaaacattctttggatcaacagaggagagatccaatgaatgtttacaacctggcggcagcgcaaaagatg

SEQ ID NO: 82766 - DNA, 103 bp, Artificial Sequence
  Synthetic Polynucleotide
taatacgactcactatagggggatgagttcctctctggtaaacattctttaacagaggagaaaagaaatgttaccagagaacctggcggcagcgcaaaagatg

SEQ ID NO: 82767 - DNA, 103 bp, Artificial Sequence
  Synthetic Polynucleotide
taatacgactcactatagggaaaatggatgagttcctctctggtaaacataacagaggagaatgtttatgagagaggaaaacctggcggcagcgcaaaagatg

SEQ ID NO: 82768 - DNA, 103 bp, Artificial Sequence
  Synthetic Polynucleotide
taatacgactcactatagggtctggaaaatggatgagttcctctctggtaaacagaggagataccagatgggaactcataacctggcggcagcgcaaaagatg

SEQ ID NO: 82769 - DNA, 103 bp, Artificial Sequence
  Synthetic Polynucleotide
taatacgactcactatagggatcttttttccagtcaaaatgttgaacaaaaacagaggagatttgttatgcattttgacaacctggcggcagcgcaaaagatg

SEQ ID NO: 82770 - DNA, 103 bp, Artificial Sequence
  Synthetic Polynucleotide
taatacgactcactatagggcgaattctggaaaatggatgagttcctctcaacagaggagagagaggatgtcatccattaacctggcggcagcgcaaaagatg

SEQ ID NO: 82771 - DNA, 103 bp, Artificial Sequence
  Synthetic Polynucleotide
taatacgactcactatagggcatcccgaattctggaaaatggatgagttcaacagaggagagaactcatgcattttccaaacctggcggcagcgcaaaagatg

SEQ ID NO: 82772 - DNA, 103 bp, Artificial Sequence
  Synthetic Polynucleotide
taatacgactcactatagggcagaccatcccgaattctggaaaatggatgaacagaggagacatccaatgtccagaattaacctggcggcagcgcaaaagatg

SEQ ID NO: 82773 - DNA, 103 bp, Artificial Sequence
  Synthetic Polynucleotide
taatacgactcactatagggtactgcagaccatcccgaattctggaaaataacagaggagaattttcatgaattcgggaaacctggcggcagcgcaaaagatg

SEQ ID NO: 82774 - DNA, 103 bp, Artificial Sequence
  Synthetic Polynucleotide
taatacgactcactatagggaaccatactgcagaccatcccgaattctggaacagaggagaccagaaatggggatggtcaacctggcggcagcgcaaaagatg

SEQ ID NO: 82775 - DNA, 103 bp, Artificial Sequence
  Synthetic Polynucleotide
taatacgactcactatagggcttccaaccatactgcagaccatcccgaataacagaggagaattcggatgggtctgcagaacctggcggcagcgcaaaagatg

SEQ ID NO: 82776 - DNA, 103 bp, Artificial Sequence
  Synthetic Polynucleotide
taatacgactcactatagggcaagtcttccaaccatactgcagaccatccaacagaggagaggatggatggcagtatggaacctggcggcagcgcaaaagatg

SEQ ID NO: 82777 - DNA, 103 bp, Artificial Sequence
  Synthetic Polynucleotide
taatacgactcactatagggtaccccaagtcttccaaccatactgcagacaacagaggagagtctgcatgatggttggaaacctggcggcagcgcaaaagatg

SEQ ID NO: 82778 - DNA, 103 bp, Artificial Sequence
  Synthetic Polynucleotide
taatacgactcactataggggttcttaccccaagtcttccaaccatactgaacagaggagacagtatatgtggaagactaacctggcggcagcgcaaaagatg

SEQ ID NO: 82779 - DNA, 103 bp, Artificial Sequence
  Synthetic Polynucleotide
taatacgactcactatagggacaaggttcttaccccaagtcttccaaccaaacagaggagatggttgatggacttggggaacctggcggcagcgcaaaagatg

SEQ ID NO: 82780 - DNA, 103 bp, Artificial Sequence
  Synthetic Polynucleotide
taatacgactcactatagggctgtgatcttttttccagtcaaaatgttgaaacagaggagatcaacaatgtgactggaaaacctggcggcagcgcaaaagatg

SEQ ID NO: 82781 - DNA, 103 bp, Artificial Sequence
  Synthetic Polynucleotide
taatacgactcactatagggagaacacaaggttcttaccccaagtcttccaacagaggagaggaagaatgggggtaagaaacctggcggcagcgcaaaagatg

SEQ ID NO: 82782 - DNA, 103 bp, Artificial Sequence
  Synthetic Polynucleotide
taatacgactcactatagggtggggagaacacaaggttcttaccccaagtaacagaggagaacttggatgaagaaccttaacctggcggcagcgcaaaagatg

SEQ ID NO: 82783 - DNA, 103 bp, Artificial Sequence
  Synthetic Polynucleotide
taatacgactcactatagggctccctggggagaacacaaggttcttacccaacagaggagagggtaaatgccttgtgttaacctggcggcagcgcaaaagatg

SEQ ID NO: 82784 - DNA, 103 bp, Artificial Sequence
  Synthetic Polynucleotide
taatacgactcactatagggtcttcctccctggggagaacacaaggttctaacagaggagaagaaccatgtgttctcccaacctggcggcagcgcaaaagatg

SEQ ID NO: 82785 - DNA, 103 bp, Artificial Sequence
  Synthetic Polynucleotide
taatacgactcactatagggtccattcttcctccctggggagaacacaagaacagaggagacttgtgatgtccccagggaacctggcggcagcgcaaaagatg

SEQ ID NO: 82786 - DNA, 103 bp, Artificial Sequence
  Synthetic Polynucleotide
taatacgactcactatagggaagcttccattcttcctccctggggagaacaacagaggagagttctcatgagggaggaaaacctggcggcagcgcaaaagatg

SEQ ID NO: 82787 - DNA, 103 bp, Artificial Sequence
  Synthetic Polynucleotide
taatacgactcactatagggtgatgaagcttccattcttcctccctggggaacagaggagaccccagatgggaagaatgaacctggcggcagcgcaaaagatg

SEQ ID NO: 82788 - DNA, 103 bp, Artificial Sequence
  Synthetic Polynucleotide
taatacgactcactatagggatctatgatgaagcttccattcttcctcccaacagaggagagggaggatgaatggaagcaacctggcggcagcgcaaaagatg

SEQ ID NO: 82789 - DNA, 103 bp, Artificial Sequence
  Synthetic Polynucleotide
taatacgactcactatagggtttccatctatgatgaagcttccattcttcaacagaggagagaagaaatgaagcttcataacctggcggcagcgcaaaagatg

SEQ ID NO: 82790 - DNA, 103 bp, Artificial Sequence
  Synthetic Polynucleotide
taatacgactcactatagggtggactttccatctatgatgaagcttccataacagaggagaatggaaatgtcatcatagaacctggcggcagcgcaaaagatg

SEQ ID NO: 82791 - DNA, 103 bp, Artificial Sequence
  Synthetic Polynucleotide
taatacgactcactataggggtgggctgtgatcttttttccagtcaaaataacagaggagaattttgatgggaaaaaagaacctggcggcagcgcaaaagatg

SEQ ID NO: 82792 - DNA, 103 bp, Artificial Sequence
  Synthetic Polynucleotide
taatacgactcactatagggtttcctggactttccatctatgatgaagctaacagaggagaagcttcatgatagatggaaacctggcggcagcgcaaaagatg

SEQ ID NO: 82793 - DNA, 103 bp, Artificial Sequence
  Synthetic Polynucleotide
taatacgactcactatagggcattctttcctggactttccatctatgatgaacagaggagacatcatatgtggaaagtcaacctggcggcagcgcaaaagatg

SEQ ID NO: 82794 - DNA, 103 bp, Artificial Sequence
  Synthetic Polynucleotide
taatacgactcactatagggacgggcattctttcctggactttccatctaaacagaggagatagatgatgagtccaggaaacctggcggcagcgcaaaagatg

SEQ ID NO: 82795 - DNA, 103 bp, Artificial Sequence
  Synthetic Polynucleotide
taatacgactcactatagggtgaaaacgggcattctttcctggactttccaacagaggagaggaaagatgaggaaagaaaacctggcggcagcgcaaaagatg

SEQ ID NO: 82796 - DNA, 103 bp, Artificial Sequence
  Synthetic Polynucleotide
taatacgactcactatagggcggtttgaaaacgggcattctttcctggacaacagaggagagtccagatgagaatgcccaacctggcggcagcgcaaaagatg

SEQ ID NO: 82797 - DNA, 103 bp, Artificial Sequence
  Synthetic Polynucleotide
taatacgactcactatagggagacccggtttgaaaacgggcattctttccaacagaggagaggaaagatggcccgttttaacctggcggcagcgcaaaagatg

SEQ ID NO: 82798 - DNA, 103 bp, Artificial Sequence
  Synthetic Polynucleotide
taatacgactcactatagggattccagacccggtttgaaaacgggcattcaacagaggagagaatgcatgttttcaaacaacctggcggcagcgcaaaagatg

SEQ ID NO: 82799 - DNA, 103 bp, Artificial Sequence
  Synthetic Polynucleotide
taatacgactcactatagggaaagaattccagacccggtttgaaaacgggaacagaggagacccgttatgaaaccgggtaacctggcggcagcgcaaaagatg

SEQ ID NO: 82800 - DNA, 103 bp, Artificial Sequence
  Synthetic Polynucleotide
taatacgactcactatagggtctggaaagaattccagacccggtttgaaaaacagaggagatttcaaatggggtctggaaacctggcggcagcgcaaaagatg

SEQ ID NO: 82801 - DNA, 103 bp, Artificial Sequence
  Synthetic Polynucleotide
taatacgactcactatagggctctatctggaaagaattccagacccggttaacagaggagaaaccggatgtggaattctaacctggcggcagcgcaaaagatg

SEQ ID NO: 82802 - DNA, 103 bp, Artificial Sequence
  Synthetic Polynucleotide
taatacgactcactatagggtttaggtgggctgtgatcttttttccagtcaacagaggagagactggatgaaagatcacaacctggcggcagcgcaaaagatg

SEQ ID NO: 82803 - DNA, 103 bp, Artificial Sequence
  Synthetic Polynucleotide
taatacgactcactatagggaactcctctatctggaaagaattccagaccaacagaggagaggtctgatgttctttccaaacctggcggcagcgcaaaagatg

SEQ ID NO: 82804 - DNA, 103 bp, Artificial Sequence
  Synthetic Polynucleotide
taatacgactcactatagggtcccaaactcctctatctggaaagaattccaacagaggagaggaattatgtccagatagaacctggcggcagcgcaaaagatg

SEQ ID NO: 82805 - DNA, 103 bp, Artificial Sequence
  Synthetic Polynucleotide
taatacgactcactatagggtcccgtcccaaactcctctatctggaaagaaacagaggagatctttcatgatagaggagaacctggcggcagcgcaaaagatg

SEQ ID NO: 82806 - DNA, 103 bp, Artificial Sequence
  Synthetic Polynucleotide
taatacgactcactatagggaacactcccgtcccaaactcctctatctggaacagaggagaccagatatgggagtttggaacctggcggcagcgcaaaagatg

SEQ ID NO: 82807 - DNA, 103 bp, Artificial Sequence
  Synthetic Polynucleotide
taatacgactcactatagggtggtgaacactcccgtcccaaactcctctaaacagaggagatagaggatgttgggacggaacctggcggcagcgcaaaagatg

SEQ ID NO: 82808 - DNA, 103 bp, Artificial Sequence
  Synthetic Polynucleotide
taatacgactcactataggggcgtgtggtgaacactcccgtcccaaactcaacagaggagagagtttatgacgggagtgaacctggcggcagcgcaaaagatg

SEQ ID NO: 82809 - DNA, 103 bp, Artificial Sequence
  Synthetic Polynucleotide
taatacgactcactatagggtacacgcgtgtggtgaacactcccgtcccaaacagaggagatgggacatgagtgttcacaacctggcggcagcgcaaaagatg

SEQ ID NO: 82810 - DNA, 103 bp, Artificial Sequence
  Synthetic Polynucleotide
taatacgactcactatagggccatgtacacgcgtgtggtgaacactcccgaacagaggagacgggagatgtcaccacacaacctggcggcagcgcaaaagatg

SEQ ID NO: 82811 - DNA, 103 bp, Artificial Sequence
  Synthetic Polynucleotide
taatacgactcactatagggtgcgtccatgtacacgcgtgtggtgaacacaacagaggagagtgttcatgacacgcgtgaacctggcggcagcgcaaaagatg

SEQ ID NO: 82812 - DNA, 103 bp, Artificial Sequence
  Synthetic Polynucleotide
taatacgactcactatagggaagactgcgtccatgtacacgcgtgtggtgaacagaggagacaccacatgcgtgtacataacctggcggcagcgcaaaagatg

SEQ ID NO: 82813 - DNA, 103 bp, Artificial Sequence
  Synthetic Polynucleotide
taatacgactcactatagggacctctttaggtgggctgtgatcttttttcaacagaggagagaaaaaatgtcacagcccaacctggcggcagcgcaaaagatg

SEQ ID NO: 82814 - DNA, 103 bp, Artificial Sequence
  Synthetic Polynucleotide
taatacgactcactatagggattcaaagactgcgtccatgtacacgcgtgaacagaggagacacgcgatgacatggacgaacctggcggcagcgcaaaagatg

SEQ ID NO: 82815 - DNA, 103 bp, Artificial Sequence
  Synthetic Polynucleotide
taatacgactcactatagggggtgtattcaaagactgcgtccatgtacacaacagaggagagtgtacatggacgcagtcaacctggcggcagcgcaaaagatg

SEQ ID NO: 82816 - DNA, 103 bp, Artificial Sequence
  Synthetic Polynucleotide
taatacgactcactatagggtctatggtgtattcaaagactgcgtccatgaacagaggagacatggaatgagtctttgaaacctggcggcagcgcaaaagatg

SEQ ID NO: 82817 - DNA, 103 bp, Artificial Sequence
  Synthetic Polynucleotide
taatacgactcactatagggcgcagtctatggtgtattcaaagactgcgtaacagaggagaacgcagatgttgaatacaaacctggcggcagcgcaaaagatg

SEQ ID NO: 82818 - DNA, 103 bp, Artificial Sequence
  Synthetic Polynucleotide
taatacgactcactatagggtccatcgcagtctatggtgtattcaaagacaacagaggagagtctttatgtacaccataaacctggcggcagcgcaaaagatg

SEQ ID NO: 82819 - DNA, 103 bp, Artificial Sequence
  Synthetic Polynucleotide
taatacgactcactatagggatagatccatcgcagtctatggtgtattcaaacagaggagatgaataatgcatagactgaacctggcggcagcgcaaaagatg

SEQ ID NO: 82820 - DNA, 103 bp, Artificial Sequence
  Synthetic Polynucleotide
taatacgactcactatagggccaagatagatccatcgcagtctatggtgtaacagaggagaacaccaatgactgcgatgaacctggcggcagcgcaaaagatg

SEQ ID NO: 82821 - DNA, 103 bp, Artificial Sequence
  Synthetic Polynucleotide
taatacgactcactatagggtgcacccaagatagatccatcgcagtctataacagaggagaatagacatggatggatctaacctggcggcagcgcaaaagatg

SEQ ID NO: 82822 - DNA, 103 bp, Artificial Sequence
  Synthetic Polynucleotide
taatacgactcactatagggaccgctgcacccaagatagatccatcgcagaacagaggagactgcgaatgatctatcttaacctggcggcagcgcaaaagatg

SEQ ID NO: 82823 - DNA, 103 bp, Artificial Sequence
  Synthetic Polynucleotide
taatacgactcactatagggcgttcaccgctgcacccaagatagatccataacagaggagaatggatatgtcttgggtgaacctggcggcagcgcaaaagatg

SEQ ID NO: 82824 - DNA, 103 bp, Artificial Sequence
  Synthetic Polynucleotide
taatacgactcactataggggcctagcaactcgatttgcagaccaatgcaaacagaggagatgcattatgctgcaaatcaacctggcggcagcgcaaaagatg

SEQ ID NO: 82825 - DNA, 103 bp, Artificial Sequence
  Synthetic Polynucleotide
taatacgactcactatagggccacaacctctttaggtgggctgtgatcttaacagaggagaaagatcatggcccacctaaacctggcggcagcgcaaaagatg

SEQ ID NO: 82826 - DNA, 103 bp, Artificial Sequence
  Synthetic Polynucleotide
taatacgactcactatagggttttccgttcaccgctgcacccaagatagaaacagaggagatctatcatgggtgcagcgaacctggcggcagcgcaaaagatg

SEQ ID NO: 82827 - DNA, 103 bp, Artificial Sequence
  Synthetic Polynucleotide
taatacgactcactatagggctcttttttccgttcaccgctgcacccaagaacagaggagacttgggatgagcggtgaaaacctggcggcagcgcaaaagatg

SEQ ID NO: 82828 - DNA, 103 bp, Artificial Sequence
  Synthetic Polynucleotide
taatacgactcactataggggggcactcttttttccgttcaccgctgcacaacagaggagagtgcagatgtgaacggaaaacctggcggcagcgcaaaagatg

SEQ ID NO: 82829 - DNA, 103 bp, Artificial Sequence
  Synthetic Polynucleotide
taatacgactcactataggggccatgggcactcttttttccgttcaccgcaacagaggagagcggtgatgggaaaaaagaacctggcggcagcgcaaaagatg

SEQ ID NO: 82830 - DNA, 103 bp, Artificial Sequence
  Synthetic Polynucleotide
taatacgactcactatagggggagagccatgggcactcttttttccgttcaacagaggagagaacggatgaaagagtgcaacctggcggcagcgcaaaagatg

SEQ ID NO: 82831 - DNA, 103 bp, Artificial Sequence
  Synthetic Polynucleotide
taatacgactcactatagggatgttggagagccatgggcactcttttttcaacagaggagagaaaaaatggtgcccatgaacctggcggcagcgcaaaagatg

SEQ ID NO: 82832 - DNA, 103 bp, Artificial Sequence
  Synthetic Polynucleotide
taatacgactcactatagggccaaaatgttggagagccatgggcactcttaacagaggagaaagagtatgcatggctctaacctggcggcagcgcaaaagatg

SEQ ID NO: 82833 - DNA, 103 bp, Artificial Sequence
  Synthetic Polynucleotide
taatacgactcactatagggcccatccaaaatgttggagagccatgggcaaacagaggagatgcccaatgctctccaacaacctggcggcagcgcaaaagatg

SEQ ID NO: 82834 - DNA, 103 bp, Artificial Sequence
  Synthetic Polynucleotide
taatacgactcactataggggacttcccatccaaaatgttggagagccataacagaggagaatggctatgcaacattttaacctggcggcagcgcaaaagatg

SEQ ID NO: 82835 - DNA, 103 bp, Artificial Sequence
  Synthetic Polynucleotide
taatacgactcactatagggttcatgacttcccatccaaaatgttggagaaacagaggagatctccaatgttttggatgaacctggcggcagcgcaaaagatg

SEQ ID NO: 82836 - DNA, 103 bp, Artificial Sequence
  Synthetic Polynucleotide
taatacgactcactatagggattttccacaacctctttaggtgggctgtgaacagaggagacacagcatgcctaaagagaacctggcggcagcgcaaaagatg

SEQ ID NO: 82837 - DNA, 103 bp, Artificial Sequence
  Synthetic Polynucleotide
taatacgactcactatagggtttacttcatgacttcccatccaaaatgttaacagaggagaaacattatggatgggaagaacctggcggcagcgcaaaagatg

SEQ ID NO: 82838 - DNA, 103 bp, Artificial Sequence
  Synthetic Polynucleotide
taatacgactcactatagggtcccatttacttcatgacttcccatccaaaaacagaggagatttggaatggaagtcatgaacctggcggcagcgcaaaagatg

SEQ ID NO: 82839 - DNA, 103 bp, Artificial Sequence
  Synthetic Polynucleotide
taatacgactcactatagggccatgtcccatttacttcatgacttcccataacagaggagaatgggaatgcatgaagtaaacctggcggcagcgcaaaagatg

SEQ ID NO: 82840 - DNA, 103 bp, Artificial Sequence
  Synthetic Polynucleotide
taatacgactcactatagggatcatccatgtcccatttacttcatgacttaacagaggagaaagtcaatgagtaaatggaacctggcggcagcgcaaaagatg

SEQ ID NO: 82841 - DNA, 103 bp, Artificial Sequence
  Synthetic Polynucleotide
taatacgactcactatagggtgtggatcatccatgtcccatttacttcataacagaggagaatgaagatgatgggacataacctggcggcagcgcaaaagatg

SEQ ID NO: 82842 - DNA, 103 bp, Artificial Sequence
  Synthetic Polynucleotide
taatacgactcactatagggcaaggtgtggatcatccatgtcccatttacaacagaggagagtaaatatgacatggatgaacctggcggcagcgcaaaagatg

SEQ ID NO: 82843 - DNA, 103 bp, Artificial Sequence
  Synthetic Polynucleotide
taatacgactcactataggggcctccaaggtgtggatcatccatgtcccaaacagaggagatgggacatggatgatccaaacctggcggcagcgcaaaagatg

SEQ ID NO: 82844 - DNA, 103 bp, Artificial Sequence
  Synthetic Polynucleotide
taatacgactcactatagggctaatgcctccaaggtgtggatcatccatgaacagaggagacatggaatgtccacacctaacctggcggcagcgcaaaagatg

SEQ ID NO: 82845 - DNA, 103 bp, Artificial Sequence
  Synthetic Polynucleotide
taatacgactcactataggggtaatctaatgcctccaaggtgtggatcataacagaggagaatgatcatgaccttggagaacctggcggcagcgcaaaagatg

SEQ ID NO: 82846 - DNA, 103 bp, Artificial Sequence
  Synthetic Polynucleotide
taatacgactcactatagggtccttgtaatctaatgcctccaaggtgtggaacagaggagaccacacatgggaggcattaacctggcggcagcgcaaaagatg

SEQ ID NO: 82847 - DNA, 103 bp, Artificial Sequence
  Synthetic Polynucleotide
taatacgactcactatagggccagcattttccacaacctctttaggtgggaacagaggagacccaccatgagaggttgtaacctggcggcagcgcaaaagatg

SEQ ID NO: 82848 - DNA, 103 bp, Artificial Sequence
  Synthetic Polynucleotide
taatacgactcactatagggcacactccttgtaatctaatgcctccaaggaacagaggagaccttggatgcattagattaacctggcggcagcgcaaaagatg

SEQ ID NO: 82849 - DNA, 103 bp, Artificial Sequence
  Synthetic Polynucleotide
taatacgactcactatagggccactcacactccttgtaatctaatgcctcaacagaggagagaggcaatggattacaagaacctggcggcagcgcaaaagatg

SEQ ID NO: 82850 - DNA, 103 bp, Artificial Sequence
  Synthetic Polynucleotide
taatacgactcactatagggagtggccactcacactccttgtaatctaataacagaggagaattagaatgcaaggagtgaacctggcggcagcgcaaaagatg

SEQ ID NO: 82851 - DNA, 103 bp, Artificial Sequence
  Synthetic Polynucleotide
taatacgactcactataggggtgtcagtggccactcacactccttgtaataacagaggagaattacaatgagtgtgagtaacctggcggcagcgcaaaagatg

SEQ ID NO: 82852 - DNA, 103 bp, Artificial Sequence
  Synthetic Polynucleotide
taatacgactcactatagggcgtatgtgtcagtggccactcacactccttaacagaggagaaaggagatggagtggccaaacctggcggcagcgcaaaagatg

SEQ ID NO: 82853 - DNA, 103 bp, Artificial Sequence
  Synthetic Polynucleotide
taatacgactcactatagggccaatcgtatgtgtcagtggccactcacacaacagaggagagtgtgaatggccactgacaacctggcggcagcgcaaaagatg

SEQ ID NO: 82854 - DNA, 103 bp, Artificial Sequence
  Synthetic Polynucleotide
taatacgactcactatagggatgttccaatcgtatgtgtcagtggccactaacagaggagaagtggcatgtgacacataaacctggcggcagcgcaaaagatg

SEQ ID NO: 82855 - DNA, 103 bp, Artificial Sequence
  Synthetic Polynucleotide
taatacgactcactatagggaactgatgttccaatcgtatgtgtcagtggaacagaggagaccactgatgcatacgattaacctggcggcagcgcaaaagatg

SEQ ID NO: 82856 - DNA, 103 bp, Artificial Sequence
  Synthetic Polynucleotide
taatacgactcactatagggtcttcaactgatgttccaatcgtatgtgtcaacagaggagagacacaatggattggaacaacctggcggcagcgcaaaagatg

SEQ ID NO: 82857 - DNA, 103 bp, Artificial Sequence
  Synthetic Polynucleotide
taatacgactcactatagggcactctcttcaactgatgttccaatcgtataacagaggagaatacgaatggaacatcagaacctggcggcagcgcaaaagatg

SEQ ID NO: 82858 - DNA, 103 bp, Artificial Sequence
  Synthetic Polynucleotide
taatacgactcactatagggtgggtccagcattttccacaacctctttagaacagaggagactaaagatgttgtggaaaaacctggcggcagcgcaaaagatg

SEQ ID NO: 82859 - DNA, 103 bp, Artificial Sequence
  Synthetic Polynucleotide
taatacgactcactatagggcatttcactctcttcaactgatgttccaataacagaggagaattggaatgtcagttgaaaacctggcggcagcgcaaaagatg

SEQ ID NO: 82860 - DNA, 103 bp, Artificial Sequence
  Synthetic Polynucleotide
taatacgactcactatagggatgaacatttcactctcttcaactgatgttaacagaggagaaacatcatgtgaagagagaacctggcggcagcgcaaaagatg

SEQ ID NO: 82861 - DNA, 103 bp, Artificial Sequence
  Synthetic Polynucleotide
taatacgactcactatagggtcggcatgaacatttcactctcttcaactgaacagaggagacagttgatgagagtgaaaaacctggcggcagcgcaaaagatg

SEQ ID NO: 82862 - DNA, 103 bp, Artificial Sequence
  Synthetic Polynucleotide
taatacgactcactatagggtgatctcggcatgaacatttcactctcttcaacagaggagagaagagatggaaatgttcaacctggcggcagcgcaaaagatg

SEQ ID NO: 82863 - DNA, 103 bp, Artificial Sequence
  Synthetic Polynucleotide
taatacgactcactatagggccgattgatctcggcatgaacatttcactcaacagaggagagagtgaatggttcatgccaacctggcggcagcgcaaaagatg

SEQ ID NO: 82864 - DNA, 103 bp, Artificial Sequence
  Synthetic Polynucleotide
taatacgactcactatagggggcctccgattgatctcggcatgaacatttaacagaggagaaaatgtatgtgccgagataacctggcggcagcgcaaaagatg

SEQ ID NO: 82865 - DNA, 103 bp, Artificial Sequence
  Synthetic Polynucleotide
taatacgactcactatagggaactgggcctccgattgatctcggcatgaaaacagaggagattcatgatgagatcaatcaacctggcggcagcgcaaaagatg

SEQ ID NO: 82866 - DNA, 103 bp, Artificial Sequence
  Synthetic Polynucleotide
taatacgactcactataggggagctaactgggcctccgattgatctcggcaacagaggagagccgagatgaatcggaggaacctggcggcagcgcaaaagatg

SEQ ID NO: 82867 - DNA, 103 bp, Artificial Sequence
  Synthetic Polynucleotide
taatacgactcactatagggtgtgagagctaactgggcctccgattgatcaacagaggagagatcaaatggaggcccagaacctggcggcagcgcaaaagatg

SEQ ID NO: 82868 - DNA, 103 bp, Artificial Sequence
  Synthetic Polynucleotide
taatacgactcactatagggatgattgtgagagctaactgggcctccgataacagaggagaatcggaatgccagttagcaacctggcggcagcgcaaaagatg

SEQ ID NO: 82869 - DNA, 103 bp, Artificial Sequence
  Synthetic Polynucleotide
taatacgactcactatagggtgtcttgggtccagcattttccacaacctcaacagaggagagaggttatggaaaatgctaacctggcggcagcgcaaaagatg

SEQ ID NO: 82870 - DNA, 103 bp, Artificial Sequence
  Synthetic Polynucleotide
taatacgactcactataggggggatatgattgtgagagctaactgggcctaacagaggagaaggcccatgtagctctcaaacctggcggcagcgcaaaagatg

SEQ ID NO: 82871 - DNA, 103 bp, Artificial Sequence
  Synthetic Polynucleotide
taatacgactcactatagggatccagggatatgattgtgagagctaactgaacagaggagacagttaatgctcacaatcaacctggcggcagcgcaaaagatg

SEQ ID NO: 82872 - DNA, 103 bp, Artificial Sequence
  Synthetic Polynucleotide
taatacgactcactatagggcttgtatccagggatatgattgtgagagctaacagaggagaagctctatgaatcatatcaacctggcggcagcgcaaaagatg

SEQ ID NO: 82873 - DNA, 103 bp, Artificial Sequence
  Synthetic Polynucleotide
taatacgactcactatagggtgaaccttgtatccagggatatgattgtgaaacagaggagatcacaaatgtatccctggaacctggcggcagcgcaaaagatg

SEQ ID NO: 82874 - DNA, 103 bp, Artificial Sequence
  Synthetic Polynucleotide
taatacgactcactatagggtcgtctgaaccttgtatccagggatatgataacagaggagaatcataatgctggatacaaacctggcggcagcgcaaaagatg

SEQ ID NO: 82875 - DNA, 103 bp, Artificial Sequence
  Synthetic Polynucleotide
taatacgactcactatagggtccgttcgtctgaaccttgtatccagggataacagaggagaatccctatgtacaaggttaacctggcggcagcgcaaaagatg

SEQ ID NO: 82876 - DNA, 103 bp, Artificial Sequence
  Synthetic Polynucleotide
taatacgactcactatagggcaaggtccgttcgtctgaaccttgtatccaaacagaggagatggataatgggttcagacaacctggcggcagcgcaaaagatg

SEQ ID NO: 82877 - DNA, 103 bp, Artificial Sequence
  Synthetic Polynucleotide
taatacgactcactataggggcatccaaggtccgttcgtctgaaccttgtaacagaggagaacaaggatgagacgaacgaacctggcggcagcgcaaaagatg

SEQ ID NO: 82878 - DNA, 103 bp, Artificial Sequence
  Synthetic Polynucleotide
taatacgactcactatagggtacctgcatccaaggtccgttcgtctgaacaacagaggagagttcagatgaacggacctaacctggcggcagcgcaaaagatg

SEQ ID NO: 82879 - DNA, 103 bp, Artificial Sequence
  Synthetic Polynucleotide
taatacgactcactatagggagtggtacctgcatccaaggtccgttcgtcaacagaggagagacgaaatgaccttggataacctggcggcagcgcaaaagatg

SEQ ID NO: 82880 - DNA, 103 bp, Artificial Sequence
  Synthetic Polynucleotide
taatacgactcactatagggagccttgtcttgggtccagcattttccacaaacagaggagatgtggaatgtgctggaccaacctggcggcagcgcaaaagatg

SEQ ID NO: 82881 - DNA, 103 bp, Artificial Sequence
  Synthetic Polynucleotide
taatacgactcactatagggcttctagtggtacctgcatccaaggtccgtaacagaggagaacggacatgggatgcaggaacctggcggcagcgcaaaagatg

SEQ ID NO: 82882 - DNA, 103 bp, Artificial Sequence
  Synthetic Polynucleotide
taatacgactcactatagggcttcacttctagtggtacctgcatccaaggaacagaggagaccttggatgcaggtaccaaacctggcggcagcgcaaaagatg

SEQ ID NO: 82883 - DNA, 103 bp, Artificial Sequence
  Synthetic Polynucleotide
taatacgactcactatagggtctctcttcacttctagtggtacctgcatcaacagaggagagatgcaatgaccactagaaacctggcggcagcgcaaaagatg

SEQ ID NO: 82884 - DNA, 103 bp, Artificial Sequence
  Synthetic Polynucleotide
taatacgactcactatagggaagcttctctcttcacttctagtggtacctaacagaggagaaggtacatgtagaagtgaaacctggcggcagcgcaaaagatg

SEQ ID NO: 82885 - DNA, 103 bp, Artificial Sequence
  Synthetic Polynucleotide
taatacgactcactatagggtgggcaagcttctctcttcacttctagtggaacagaggagaccactaatggtgaagagaaacctggcggcagcgcaaaagatg

SEQ ID NO: 82886 - DNA, 103 bp, Artificial Sequence
  Synthetic Polynucleotide
taatacgactcactataggggtccctgggcaagcttctctcttcacttctaacagaggagaagaagtatggagagaagcaacctggcggcagcgcaaaagatg

SEQ ID NO: 82887 - DNA, 103 bp, Artificial Sequence
  Synthetic Polynucleotide
taatacgactcactatagggcgctagtccctgggcaagcttctctcttcaaacagaggagatgaagaatgaagcttgccaacctggcggcagcgcaaaagatg

SEQ ID NO: 82888 - DNA, 103 bp, Artificial Sequence
  Synthetic Polynucleotide
taatacgactcactataggggatcacgctagtccctgggcaagcttctctaacagaggagaagagaaatgtgcccagggaacctggcggcagcgcaaaagatg

SEQ ID NO: 82889 - DNA, 103 bp, Artificial Sequence
  Synthetic Polynucleotide
taatacgactcactatagggtcaatgatcacgctagtccctgggcaagctaacagaggagaagcttgatgagggactagaacctggcggcagcgcaaaagatg

SEQ ID NO: 82890 - DNA, 103 bp, Artificial Sequence
  Synthetic Polynucleotide
taatacgactcactatagggtgccatcaatgatcacgctagtccctgggcaacagaggagagcccagatgctagcgtgaaacctggcggcagcgcaaaagatg

SEQ ID NO: 82891 - DNA, 103 bp, Artificial Sequence
  Synthetic Polynucleotide
taatacgactcactatagggagccaagccttgtcttgggtccagcattttaacagaggagaaaaatgatggacccaagaaacctggcggcagcgcaaaagatg

SEQ ID NO: 82892 - DNA, 103 bp, Artificial Sequence
  Synthetic Polynucleotide
taatacgactcactatagggacagttgccatcaatgatcacgctagtcccaacagaggagagggactatggtgatcattaacctggcggcagcgcaaaagatg

SEQ ID NO: 82893 - DNA, 103 bp, Artificial Sequence
  Synthetic Polynucleotide
taatacgactcactatagggccatcacagttgccatcaatgatcacgctaaacagaggagatagcgtatgcattgatggaacctggcggcagcgcaaaagatg

SEQ ID NO: 82894 - DNA, 103 bp, Artificial Sequence
  Synthetic Polynucleotide
taatacgactcactatagggcccgtccatcacagttgccatcaatgatcaaacagaggagatgatcaatgatggcaactaacctggcggcagcgcaaaagatg

SEQ ID NO: 82895 - DNA, 103 bp, Artificial Sequence
  Synthetic Polynucleotide
taatacgactcactatagggttttccccgtccatcacagttgccatcaataacagaggagaattgatatgaactgtgataacctggcggcagcgcaaaagatg

SEQ ID NO: 82896 - DNA, 103 bp, Artificial Sequence
  Synthetic Polynucleotide
taatacgactcactataggggttgattttccccgtccatcacagttgccaaacagaggagatggcaaatgtgatggacgaacctggcggcagcgcaaaagatg

SEQ ID NO: 82897 - DNA, 103 bp, Artificial Sequence
  Synthetic Polynucleotide
taatacgactcactatagggatctggttgattttccccgtccatcacagtaacagaggagaactgtgatggacggggaaaacctggcggcagcgcaaaagatg

SEQ ID NO: 82898 - DNA, 103 bp, Artificial Sequence
  Synthetic Polynucleotide
taatacgactcactatagggggtggatctggttgattttccccgtccatcaacagaggagagatggaatgggaaaatcaaacctggcggcagcgcaaaagatg

SEQ ID NO: 82899 - DNA, 103 bp, Artificial Sequence
  Synthetic Polynucleotide
taatacgactcactatagggtccgtggtggatctggttgattttccccgtaacagaggagaacggggatgatcaaccagaacctggcggcagcgcaaaagatg

SEQ ID NO: 82900 - DNA, 103 bp, Artificial Sequence
  Synthetic Polynucleotide
taatacgactcactatagggcgctatccgtggtggatctggttgattttcaacagaggagagaaaatatgccagatccaaacctggcggcagcgcaaaagatg

SEQ ID NO: 82901 - DNA, 103 bp, Artificial Sequence
  Synthetic Polynucleotide
taatacgactcactatagggtttcccgctatccgtggtggatctggttgaaacagaggagatcaaccatgtccaccacgaacctggcggcagcgcaaaagatg

SEQ ID NO: 82902 - DNA, 103 bp, Artificial Sequence
  Synthetic Polynucleotide
taatacgactcactatagggagaacagccaagccttgtcttgggtccagcaacagaggagagctggaatgaagacaaggaacctggcggcagcgcaaaagatg

SEQ ID NO: 82903 - DNA, 103 bp, Artificial Sequence
  Synthetic Polynucleotide
taatacgactcactatagggataactttcccgctatccgtggtggatctgaacagaggagacagatcatgcacggatagaacctggcggcagcgcaaaagatg

SEQ ID NO: 82904 - DNA, 103 bp, Artificial Sequence
  Synthetic Polynucleotide
taatacgactcactatagggcaggaataactttcccgctatccgtggtggaacagaggagaccaccaatgatagcgggaaacctggcggcagcgcaaaagatg

SEQ ID NO: 82905 - DNA, 103 bp, Artificial Sequence
  Synthetic Polynucleotide
taatacgactcactatagggccattcaggaataactttcccgctatccgtaacagaggagaacggatatggggaaagttaacctggcggcagcgcaaaagatg

SEQ ID NO: 82906 - DNA, 103 bp, Artificial Sequence
  Synthetic Polynucleotide
taatacgactcactatagggcaacaccattcaggaataactttcccgctaaacagaggagatagcggatgagttattccaacctggcggcagcgcaaaagatg

SEQ ID NO: 82907 - DNA, 103 bp, Artificial Sequence
  Synthetic Polynucleotide
taatacgactcactatagggagcggcaacaccattcaggaataactttccaacagaggagaggaaagatgttcctgaataacctggcggcagcgcaaaagatg

SEQ ID NO: 82908 - DNA, 103 bp, Artificial Sequence
  Synthetic Polynucleotide
taatacgactcactataggggcaggagcggcaacaccattcaggaataacaacagaggagagttattatggaatggtgtaacctggcggcagcgcaaaagatg

SEQ ID NO: 82909 - DNA, 103 bp, Artificial Sequence
  Synthetic Polynucleotide
taatacgactcactatagggattgtgcaggagcggcaacaccattcaggaaacagaggagatcctgaatggtgttgccgaacctggcggcagcgcaaaagatg

SEQ ID NO: 82910 - DNA, 103 bp, Artificial Sequence
  Synthetic Polynucleotide
taatacgactcactataggggcggcattgtgcaggagcggcaacaccattaacagaggagaaatggtatggccgctcctaacctggcggcagcgcaaaagatg

SEQ ID NO: 82911 - DNA, 103 bp, Artificial Sequence
  Synthetic Polynucleotide
taatacgactcactatagggcacaggcggcattgtgcaggagcggcaacaaacagaggagatgttgcatgtcctgcacaaacctggcggcagcgcaaaagatg

SEQ ID NO: 82912 - DNA, 103 bp, Artificial Sequence
  Synthetic Polynucleotide
taatacgactcactatagggaagctcacaggcggcattgtgcaggagcggaacagaggagaccgctcatgcacaatgccaacctggcggcagcgcaaaagatg

SEQ ID NO: 82913 - DNA, 103 bp, Artificial Sequence
  Synthetic Polynucleotide
taatacgactcactatagggtccttagaacagccaagccttgtcttgggtaacagaggagaacccaaatgaaggcttggaacctggcggcagcgcaaaagatg

SEQ ID NO: 82914 - DNA, 103 bp, Artificial Sequence
  Synthetic Polynucleotide
taatacgactcactatagggcatggaagctcacaggcggcattgtgcaggaacagaggagacctgcaatgtgccgcctgaacctggcggcagcgcaaaagatg

SEQ ID NO: 82915 - DNA, 103 bp, Artificial Sequence
  Synthetic Polynucleotide
taatacgactcactatagggactaccatggaagctcacaggcggcattgtaacagaggagaacaatgatgcctgtgagcaacctggcggcagcgcaaaagatg

SEQ ID NO: 82916 - DNA, 103 bp, Artificial Sequence
  Synthetic Polynucleotide
taatacgactcactatagggccatcactaccatggaagctcacaggcggcaacagaggagagccgccatggagcttccaaacctggcggcagcgcaaaagatg

SEQ ID NO: 82917 - DNA, 103 bp, Artificial Sequence
  Synthetic Polynucleotide
taatacgactcactatagggaacacccatcactaccatggaagctcacagaacagaggagactgtgaatgtccatggtaaacctggcggcagcgcaaaagatg

SEQ ID NO: 82918 - DNA, 103 bp, Artificial Sequence
  Synthetic Polynucleotide
taatacgactcactatagggataccaacacccatcactaccatggaagctaacagaggagaagcttcatgggtagtgataacctggcggcagcgcaaaagatg

SEQ ID NO: 82919 - DNA, 103 bp, Artificial Sequence
  Synthetic Polynucleotide
taatacgactcactatagggatgggataccaacacccatcactaccatggaacagaggagaccatggatgtgatgggtgaacctggcggcagcgcaaaagatg

SEQ ID NO: 82920 - DNA, 103 bp, Artificial Sequence
  Synthetic Polynucleotide
taatacgactcactatagggtttccatgggataccaacacccatcactacaacagaggagagtagtgatgggtgttggtaacctggcggcagcgcaaaagatg

SEQ ID NO: 82921 - DNA, 103 bp, Artificial Sequence
  Synthetic Polynucleotide
taatacgactcactatagggcctaatttccatgggataccaacacccatcaacagaggagagatgggatgtggtatcccaacctggcggcagcgcaaaagatg

SEQ ID NO: 82922 - DNA, 103 bp, Artificial Sequence
  Synthetic Polynucleotide
taatacgactcactatagggcttggcctaatttccatgggataccaacacaacagaggagagtgttgatgtcccatggaaacctggcggcagcgcaaaagatg

SEQ ID NO: 82923 - DNA, 103 bp, Artificial Sequence
  Synthetic Polynucleotide
taatacgactcactatagggttttccttggcctaatttccatgggataccaacagaggagaggtatcatgtggaaattaaacctggcggcagcgcaaaagatg

SEQ ID NO: 82924 - DNA, 103 bp, Artificial Sequence
  Synthetic Polynucleotide
taatacgactcactataggggactttccttagaacagccaagccttgtctaacagaggagaagacaaatgttggctgttaacctggcggcagcgcaaaagatg

SEQ ID NO: 82925 - DNA, 103 bp, Artificial Sequence
  Synthetic Polynucleotide
taatacgactcactatagggatgcgttttccttggcctaatttccatgggaacagaggagacccatgatgattaggccaaacctggcggcagcgcaaaagatg

SEQ ID NO: 82926 - DNA, 103 bp, Artificial Sequence
  Synthetic Polynucleotide
taatacgactcactatagggctttcatgcgttttccttggcctaatttccaacagaggagaggaaatatggccaaggaaaacctggcggcagcgcaaaagatg

SEQ ID NO: 82927 - DNA, 103 bp, Artificial Sequence
  Synthetic Polynucleotide
taatacgactcactataggggatggctttcatgcgttttccttggcctaaaacagaggagattaggcatgggaaaacgcaacctggcggcagcgcaaaagatg

SEQ ID NO: 82928 - DNA, 103 bp, Artificial Sequence
  Synthetic Polynucleotide
taatacgactcactatagggcaccagatggctttcatgcgttttccttggaacagaggagaccaaggatgacgcatgaaaacctggcggcagcgcaaaagatg

SEQ ID NO: 82929 - DNA, 103 bp, Artificial Sequence
  Synthetic Polynucleotide
taatacgactcactataggggagcgcaccagatggctttcatgcgttttcaacagaggagagaaaacatgtgaaagccaaacctggcggcagcgcaaaagatg

SEQ ID NO: 82930 - DNA, 103 bp, Artificial Sequence
  Synthetic Polynucleotide
taatacgactcactatagggcccaggagcgcaccagatggctttcatgcgaacagaggagacgcatgatggccatctggaacctggcggcagcgcaaaagatg

SEQ ID NO: 82931 - DNA, 103 bp, Artificial Sequence
  Synthetic Polynucleotide
taatacgactcactatagggtgtaacccaggagcgcaccagatggctttcaacagaggagagaaagcatgctggtgcgcaacctggcggcagcgcaaaagatg

SEQ ID NO: 82932 - DNA, 103 bp, Artificial Sequence
  Synthetic Polynucleotide
taatacgactcactatagggccagctgtaacccaggagcgcaccagatggaacagaggagaccatctatggcgctcctgaacctggcggcagcgcaaaagatg

SEQ ID NO: 82933 - DNA, 103 bp, Artificial Sequence
  Synthetic Polynucleotide
taatacgactcactatagggtttctccagctgtaacccaggagcgcaccaaacagaggagatggtgcatgcctgggttaaacctggcggcagcgcaaaagatg

SEQ ID NO: 82934 - DNA, 103 bp, Artificial Sequence
  Synthetic Polynucleotide
taatacgactcactatagggatgtatttctccagctgtaacccaggagcgaacagaggagacgctccatggttacagctaacctggcggcagcgcaaaagatg

SEQ ID NO: 82935 - DNA, 103 bp, Artificial Sequence
  Synthetic Polynucleotide
taatacgactcactatagggttattgcctagcaactcgatttgcagaccaaacagaggagatggtctatgaatcgagttaacctggcggcagcgcaaaagatg

SEQ ID NO: 82936 - DNA, 103 bp, Artificial Sequence
  Synthetic Polynucleotide
taatacgactcactatagggctcttgactttccttagaacagccaagcctaacagaggagaaggcttatgtgttctaagaacctggcggcagcgcaaaagatg

SEQ ID NO: 82937 - DNA, 103 bp, Artificial Sequence
  Synthetic Polynucleotide
taatacgactcactatagggacagcatgtatttctccagctgtaacccagaacagaggagactgggtatgagctggagaaacctggcggcagcgcaaaagatg

SEQ ID NO: 82938 - DNA, 103 bp, Artificial Sequence
  Synthetic Polynucleotide
taatacgactcactatagggaagggacagcatgtatttctccagctgtaaaacagaggagattacagatggagaaatacaacctggcggcagcgcaaaagatg

SEQ ID NO: 82939 - DNA, 103 bp, Artificial Sequence
  Synthetic Polynucleotide
taatacgactcactatagggaccaaaagggacagcatgtatttctccagcaacagaggagagctggaatgatacatgctaacctggcggcagcgcaaaagatg

SEQ ID NO: 82940 - DNA, 103 bp, Artificial Sequence
  Synthetic Polynucleotide
taatacgactcactatagggaccaaaccaaaagggacagcatgtatttctaacagaggagaagaaatatgtgctgtcccaacctggcggcagcgcaaaagatg

SEQ ID NO: 82941 - DNA, 103 bp, Artificial Sequence
  Synthetic Polynucleotide
taatacgactcactatagggtgctcaccaaaccaaaagggacagcatgtaaacagaggagatacatgatgtcccttttgaacctggcggcagcgcaaaagatg

SEQ ID NO: 82942 - DNA, 103 bp, Artificial Sequence
  Synthetic Polynucleotide
taatacgactcactatagggcatcatgctcaccaaaccaaaagggacagcaacagaggagagctgtcatgtttggtttgaacctggcggcagcgcaaaagatg

SEQ ID NO: 82943 - DNA, 103 bp, Artificial Sequence
  Synthetic Polynucleotide
taatacgactcactataggggctatcatcatgctcaccaaaccaaaagggaacagaggagaccctttatgtttggtgagaacctggcggcagcgcaaaagatg

SEQ ID NO: 82944 - DNA, 103 bp, Artificial Sequence
  Synthetic Polynucleotide
taatacgactcactatagggccattgctatcatcatgctcaccaaaccaaaacagaggagattggttatgtgagcatgaaacctggcggcagcgcaaaagatg

SEQ ID NO: 82945 - DNA, 103 bp, Artificial Sequence
  Synthetic Polynucleotide
taatacgactcactatagggcacttccattgctatcatcatgctcaccaaaacagaggagattggtgatgatgatgataaacctggcggcagcgcaaaagatg

SEQ ID NO: 82946 - DNA, 103 bp, Artificial Sequence
  Synthetic Polynucleotide
taatacgactcactatagggaggaccacttccattgctatcatcatgctcaacagaggagagagcatatggatagcaataacctggcggcagcgcaaaagatg

SEQ ID NO: 82947 - DNA, 103 bp, Artificial Sequence
  Synthetic Polynucleotide
taatacgactcactatagggccactctcttgactttccttagaacagccaaacagaggagatggctgatgtaaggaaagaacctggcggcagcgcaaaagatg

SEQ ID NO: 82948 - DNA, 103 bp, Artificial Sequence
  Synthetic Polynucleotide
taatacgactcactatagggtccttaggaccacttccattgctatcatcaaacagaggagatgatgaatgcaatggaagaacctggcggcagcgcaaaagatg

SEQ ID NO: 82949 - DNA, 103 bp, Artificial Sequence
  Synthetic Polynucleotide
taatacgactcactatagggtcttttccttaggaccacttccattgctataacagaggagaatagcaatggaagtggtcaacctggcggcagcgcaaaagatg

SEQ ID NO: 82950 - DNA, 103 bp, Artificial Sequence
  Synthetic Polynucleotide
taatacgactcactatagggccctgtcttttccttaggaccacttccattaacagaggagaaatggaatgggtcctaagaacctggcggcagcgcaaaagatg

SEQ ID NO: 82951 - DNA, 103 bp, Artificial Sequence
  Synthetic Polynucleotide
taatacgactcactatagggttggtccctgtcttttccttaggaccacttaacagaggagaaagtggatgtaaggaaaaaacctggcggcagcgcaaaagatg

SEQ ID NO: 82952 - DNA, 103 bp, Artificial Sequence
  Synthetic Polynucleotide
taatacgactcactatagggttgctttggtccctgtcttttccttaggacaacagaggagagtcctaatgaaaagacagaacctggcggcagcgcaaaagatg

SEQ ID NO: 82953 - DNA, 103 bp, Artificial Sequence
  Synthetic Polynucleotide
taatacgactcactatagggaacatttgctttggtccctgtcttttccttaacagaggagaaaggaaatgacagggaccaacctggcggcagcgcaaaagatg

SEQ ID NO: 82954 - DNA, 103 bp, Artificial Sequence
  Synthetic Polynucleotide
taatacgactcactatagggcaaccaacatttgctttggtccctgtctttaacagaggagaaaagacatggaccaaagcaacctggcggcagcgcaaaagatg

SEQ ID NO: 82955 - DNA, 103 bp, Artificial Sequence
  Synthetic Polynucleotide
taatacgactcactatagggtcctccaaccaacatttgctttggtccctgaacagaggagacagggaatgaagcaaatgaacctggcggcagcgcaaaagatg

SEQ ID NO: 82956 - DNA, 103 bp, Artificial Sequence
  Synthetic Polynucleotide
taatacgactcactatagggactactcctccaaccaacatttgctttggtaacagaggagaaccaaaatgaatgttggtaacctggcggcagcgcaaaagatg

SEQ ID NO: 82957 - DNA, 103 bp, Artificial Sequence
  Synthetic Polynucleotide
taatacgactcactatagggagagcactactcctccaaccaacatttgctaacagaggagaagcaaaatgtggttggagaacctggcggcagcgcaaaagatg

SEQ ID NO: 82958 - DNA, 103 bp, Artificial Sequence
  Synthetic Polynucleotide
taatacgactcactatagggggccaccactctcttgactttccttagaacaacagaggagagttctaatgaaagtcaagaacctggcggcagcgcaaaagatg

SEQ ID NO: 82959 - DNA, 103 bp, Artificial Sequence
  Synthetic Polynucleotide
taatacgactcactatagggtcccaagagcactactcctccaaccaacataacagaggagaatgttgatgggaggagtaaacctggcggcagcgcaaaagatg

SEQ ID NO: 82960 - DNA, 103 bp, Artificial Sequence
  Synthetic Polynucleotide
taatacgactcactatagggattgctcccaagagcactactcctccaaccaacagaggagaggttggatgagtagtgctaacctggcggcagcgcaaaagatg

SEQ ID NO: 82961 - DNA, 103 bp, Artificial Sequence
  Synthetic Polynucleotide
taatacgactcactatagggccagcattgctcccaagagcactactcctcaacagaggagagaggagatgtgctcttggaacctggcggcagcgcaaaagatg

SEQ ID NO: 82962 - DNA, 103 bp, Artificial Sequence
  Synthetic Polynucleotide
taatacgactcactatagggcccgaccagcattgctcccaagagcactacaacagaggagagtagtgatgttgggagcaaacctggcggcagcgcaaaagatg

SEQ ID NO: 82963 - DNA, 103 bp, Artificial Sequence
  Synthetic Polynucleotide
taatacgactcactatagggacttgcccgaccagcattgctcccaagagcaacagaggagagctcttatgagcaatgctaacctggcggcagcgcaaaagatg

SEQ ID NO: 82964 - DNA, 103 bp, Artificial Sequence
  Synthetic Polynucleotide
taatacgactcactataggggagttacttgcccgaccagcattgctcccaaacagaggagatgggagatgtgctggtcgaacctggcggcagcgcaaaagatg

SEQ ID NO: 82965 - DNA, 103 bp, Artificial Sequence
  Synthetic Polynucleotide
taatacgactcactatagggaaggagagttacttgcccgaccagcattgcaacagaggagagcaatgatggtcgggcaaaacctggcggcagcgcaaaagatg

SEQ ID NO: 82966 - DNA, 103 bp, Artificial Sequence
  Synthetic Polynucleotide
taatacgactcactatagggaaatcaaggagagttacttgcccgaccagcaacagaggagagctggtatggcaagtaacaacctggcggcagcgcaaaagatg

SEQ ID NO: 82967 - DNA, 103 bp, Artificial Sequence
  Synthetic Polynucleotide
taatacgactcactatagggtcagcaaatcaaggagagttacttgcccgaaacagaggagatcgggcatgtaactctccaacctggcggcagcgcaaaagatg

SEQ ID NO: 82968 - DNA, 103 bp, Artificial Sequence
  Synthetic Polynucleotide
taatacgactcactataggggagtttcagcaaatcaaggagagttacttgaacagaggagacaagtaatgctccttgataacctggcggcagcgcaaaagatg

SEQ ID NO: 82969 - DNA, 103 bp, Artificial Sequence
  Synthetic Polynucleotide
taatacgactcactatagggaaactggccaccactctcttgactttccttaacagaggagaaaggaaatgcaagagagtaacctggcggcagcgcaaaagatg

SEQ ID NO: 82970 - DNA, 103 bp, Artificial Sequence
  Synthetic Polynucleotide
taatacgactcactatagggactgtgagtttcagcaaatcaaggagagttaacagaggagaaactctatgtgatttgctaacctggcggcagcgcaaaagatg

SEQ ID NO: 82971 - DNA, 103 bp, Artificial Sequence
  Synthetic Polynucleotide
taatacgactcactatagggcagccactgtgagtttcagcaaatcaaggaaacagaggagatccttgatgtgctgaaacaacctggcggcagcgcaaaagatg

SEQ ID NO: 82972 - DNA, 103 bp, Artificial Sequence
  Synthetic Polynucleotide
taatacgactcactatagggtcccacagccactgtgagtttcagcaaatcaacagaggagagatttgatgaaactcacaaacctggcggcagcgcaaaagatg

SEQ ID NO: 82973 - DNA, 103 bp, Artificial Sequence
  Synthetic Polynucleotide
taatacgactcactatagggtgcaatcccacagccactgtgagtttcagcaacagaggagagctgaaatgcacagtggcaacctggcggcagcgcaaaagatg

SEQ ID NO: 82974 - DNA, 103 bp, Artificial Sequence
  Synthetic Polynucleotide
taatacgactcactatagggggaaatgcaatcccacagccactgtgagttaacagaggagaaactcaatgtggctgtggaacctggcggcagcgcaaaagatg

SEQ ID NO: 82975 - DNA, 103 bp, Artificial Sequence
  Synthetic Polynucleotide
taatacgactcactatagggctcatggaaatgcaatcccacagccactgtaacagaggagaacagtgatggtgggattgaacctggcggcagcgcaaaagatg

SEQ ID NO: 82976 - DNA, 103 bp, Artificial Sequence
  Synthetic Polynucleotide
taatacgactcactatagggttcatctcatggaaatgcaatcccacagccaacagaggagaggctgtatgattgcatttaacctggcggcagcgcaaaagatg

SEQ ID NO: 82977 - DNA, 103 bp, Artificial Sequence
  Synthetic Polynucleotide
taatacgactcactatagggcattgttcatctcatggaaatgcaatcccaaacagaggagatgggatatgatttccatgaacctggcggcagcgcaaaagatg

SEQ ID NO: 82978 - DNA, 103 bp, Artificial Sequence
  Synthetic Polynucleotide
taatacgactcactatagggtcctccattgttcatctcatggaaatgcaaaacagaggagattgcatatgcatgagatgaacctggcggcagcgcaaaagatg

SEQ ID NO: 82979 - DNA, 103 bp, Artificial Sequence
  Synthetic Polynucleotide
taatacgactcactataggggcgtctcctccattgttcatctcatggaaaaacagaggagatttccaatggatgaacaaaacctggcggcagcgcaaaagatg

SEQ ID NO: 82980 - DNA, 103 bp, Artificial Sequence
  Synthetic Polynucleotide
taatacgactcactatagggtcatcaaactggccaccactctcttgacttaacagaggagaaagtcaatggagtggtggaacctggcggcagcgcaaaagatg

SEQ ID NO: 82981 - DNA, 103 bp, Artificial Sequence
  Synthetic Polynucleotide
taatacgactcactatagggacatggcgtctcctccattgttcatctcataacagaggagaatgagaatgacaatggagaacctggcggcagcgcaaaagatg

SEQ ID NO: 82982 - DNA, 103 bp, Artificial Sequence
  Synthetic Polynucleotide
taatacgactcactatagggcatatacatggcgtctcctccattgttcataacagaggagaatgaacatgggaggagacaacctggcggcagcgcaaaagatg

SEQ ID NO: 82983 - DNA, 103 bp, Artificial Sequence
  Synthetic Polynucleotide
taatacgactcactatagggaacgccatatacatggcgtctcctccattgaacagaggagacaatggatgagacgccataacctggcggcagcgcaaaagatg

SEQ ID NO: 82984 - DNA, 103 bp, Artificial Sequence
  Synthetic Polynucleotide
taatacgactcactatagggcaatcaacgccatatacatggcgtctcctcaacagaggagagaggagatgccatgtataaacctggcggcagcgcaaaagatg

SEQ ID NO: 82985 - DNA, 103 bp, Artificial Sequence
  Synthetic Polynucleotide
taatacgactcactatagggggcagcaatcaacgccatatacatggcgtcaacagaggagagacgccatgtatatggcgaacctggcggcagcgcaaaagatg

SEQ ID NO: 82986 - DNA, 103 bp, Artificial Sequence
  Synthetic Polynucleotide
taatacgactcactataggggaaaaggcagcaatcaacgccatatacatgaacagaggagacatgtaatgggcgttgataacctggcggcagcgcaaaagatg

SEQ ID NO: 82987 - DNA, 103 bp, Artificial Sequence
  Synthetic Polynucleotide
taatacgactcactatagggtgattgaaaaggcagcaatcaacgccatataacagaggagaatatggatgtgattgctgaacctggcggcagcgcaaaagatg

SEQ ID NO: 82988 - DNA, 103 bp, Artificial Sequence
  Synthetic Polynucleotide
taatacgactcactatagggtggtctgattgaaaaggcagcaatcaacgcaacagaggagagcgttgatggctgcctttaacctggcggcagcgcaaaagatg

SEQ ID NO: 82989 - DNA, 103 bp, Artificial Sequence
  Synthetic Polynucleotide
taatacgactcactatagggagccctggtctgattgaaaaggcagcaatcaacagaggagagattgcatgcttttcaataacctggcggcagcgcaaaagatg

SEQ ID NO: 82990 - DNA, 103 bp, Artificial Sequence
  Synthetic Polynucleotide
taatacgactcactatagggtgagcagccctggtctgattgaaaaggcagaacagaggagactgcctatgcaatcagacaacctggcggcagcgcaaaagatg

SEQ ID NO: 82991 - DNA, 103 bp, Artificial Sequence
  Synthetic Polynucleotide
taatacgactcactatagggtcctctcatcaaactggccaccactctcttaacagaggagaaagagaatggtggccagtaacctggcggcagcgcaaaagatg

SEQ ID NO: 82992 - DNA, 103 bp, Artificial Sequence
  Synthetic Polynucleotide
taatacgactcactataggggccgatgagcagccctggtctgattgaaaaaacagaggagattttcaatgagaccagggaacctggcggcagcgcaaaagatg

SEQ ID NO: 82993 - DNA, 103 bp, Artificial Sequence
  Synthetic Polynucleotide
taatacgactcactatagggccaaagccgatgagcagccctggtctgattaacagaggagaaatcagatgagggctgctaacctggcggcagcgcaaaagatg

SEQ ID NO: 82994 - DNA, 103 bp, Artificial Sequence
  Synthetic Polynucleotide
taatacgactcactatagggtgagcccaaagccgatgagcagccctggtcaacagaggagagaccagatgtgctcatcgaacctggcggcagcgcaaaagatg

SEQ ID NO: 82995 - DNA, 103 bp, Artificial Sequence
  Synthetic Polynucleotide
taatacgactcactatagggggtcctgagcccaaagccgatgagcagcccaacagaggagagggctgatgatcggctttaacctggcggcagcgcaaaagatg

SEQ ID NO: 82996 - DNA, 103 bp, Artificial Sequence
  Synthetic Polynucleotide
taatacgactcactatagggcatagggtcctgagcccaaagccgatgagcaacagaggagagctcatatgctttgggctaacctggcggcagcgcaaaagatg

SEQ ID NO: 82997 - DNA, 103 bp, Artificial Sequence
  Synthetic Polynucleotide
taatacgactcactatagggggctccatagggtcctgagcccaaagccgaaacagaggagatcggctatgggctcaggaaacctggcggcagcgcaaaagatg

SEQ ID NO: 82998 - DNA, 103 bp, Artificial Sequence
  Synthetic Polynucleotide
taatacgactcactatagggccgagggctccatagggtcctgagcccaaaaacagaggagatttgggatgaggaccctaaacctggcggcagcgcaaaagatg

SEQ ID NO: 82999 - DNA, 103 bp, Artificial Sequence
  Synthetic Polynucleotide
taatacgactcactatagggcgttcccgagggctccatagggtcctgagcaacagaggagagctcagatgcctatggagaacctggcggcagcgcaaaagatg

SEQ ID NO: 83000 - DNA, 103 bp, Artificial Sequence
  Synthetic Polynucleotide
taatacgactcactatagggcaaggcgttcccgagggctccatagggtccaacagaggagaggacccatgggagccctcaacctggcggcagcgcaaaagatg

SEQ ID NO: 83001 - DNA, 103 bp, Artificial Sequence
  Synthetic Polynucleotide
taatacgactcactatagggcagcacaaggcgttcccgagggctccatagaacagaggagactatggatgcctcgggaaaacctggcggcagcgcaaaagatg

SEQ ID NO: 83002 - DNA, 103 bp, Artificial Sequence
  Synthetic Polynucleotide
taatacgactcactataggggacaatcctctcatcaaactggccaccactaacagaggagaagtggtatgcagtttgataacctggcggcagcgcaaaagatg

SEQ ID NO: 83003 - DNA, 103 bp, Artificial Sequence
  Synthetic Polynucleotide
taatacgactcactatagggagggtcagcacaaggcgttcccgagggctcaacagaggagagagcccatgggaacgcctaacctggcggcagcgcaaaagatg

SEQ ID NO: 83004 - DNA, 103 bp, Artificial Sequence
  Synthetic Polynucleotide
taatacgactcactatagggctcctagggtcagcacaaggcgttcccgagaacagaggagactcgggatggccttgtgcaacctggcggcagcgcaaaagatg

SEQ ID NO: 83005 - DNA, 103 bp, Artificial Sequence
  Synthetic Polynucleotide
taatacgactcactatagggggctgctcctagggtcagcacaaggcgttcaacagaggagagaacgcatggtgctgaccaacctggcggcagcgcaaaagatg

SEQ ID NO: 83006 - DNA, 103 bp, Artificial Sequence
  Synthetic Polynucleotide
taatacgactcactatagggaccatggctgctcctagggtcagcacaaggaacagaggagaccttgtatggaccctaggaacctggcggcagcgcaaaagatg

SEQ ID NO: 83007 - DNA, 103 bp, Artificial Sequence
  Synthetic Polynucleotide
taatacgactcactatagggtctccaccatggctgctcctagggtcagcaaacagaggagatgctgaatgtaggagcagaacctggcggcagcgcaaaagatg

SEQ ID NO: 83008 - DNA, 103 bp, Artificial Sequence
  Synthetic Polynucleotide
taatacgactcactatagggggcaatctccaccatggctgctcctagggtaacagaggagaaccctaatggcagccatgaacctggcggcagcgcaaaagatg

SEQ ID NO: 83009 - DNA, 103 bp, Artificial Sequence
  Synthetic Polynucleotide
taatacgactcactatagggcccaaggcaatctccaccatggctgctcctaacagaggagaaggagcatgcatggtggaaacctggcggcagcgcaaaagatg

SEQ ID NO: 83010 - DNA, 103 bp, Artificial Sequence
  Synthetic Polynucleotide
taatacgactcactatagggcgccacccaaggcaatctccaccatggctgaacagaggagacagccaatgtggagattgaacctggcggcagcgcaaaagatg

SEQ ID NO: 83011 - DNA, 103 bp, Artificial Sequence
  Synthetic Polynucleotide
taatacgactcactatagggcatcacgccacccaaggcaatctccaccataacagaggagaatggtgatgattgccttgaacctggcggcagcgcaaaagatg

SEQ ID NO: 83012 - DNA, 103 bp, Artificial Sequence
  Synthetic Polynucleotide
taatacgactcactatagggccgcccatcacgccacccaaggcaatctccaacagaggagaggagatatgcttgggtggaacctggcggcagcgcaaaagatg

SEQ ID NO: 83013 - DNA, 103 bp, Artificial Sequence
  Synthetic Polynucleotide
taatacgactcactatagggttgaggacaatcctctcatcaaactggccaaacagaggagatggccaatgtgatgagagaacctggcggcagcgcaaaagatg

SEQ ID NO: 83014 - DNA, 103 bp, Artificial Sequence
  Synthetic Polynucleotide
taatacgactcactatagggacaggccgcccatcacgccacccaaggcaaaacagaggagattgcctatggtggcgtgaaacctggcggcagcgcaaaagatg

SEQ ID NO: 83015 - DNA, 103 bp, Artificial Sequence
  Synthetic Polynucleotide
taatacgactcactatagggcttccacaggccgcccatcacgccacccaaaacagaggagattgggtatggtgatgggcaacctggcggcagcgcaaaagatg

SEQ ID NO: 83016 - DNA, 103 bp, Artificial Sequence
  Synthetic Polynucleotide
taatacgactcactatagggagatacttccacaggccgcccatcacgccaaacagaggagatggcgtatggggcggcctaacctggcggcagcgcaaaagatg

SEQ ID NO: 83017 - DNA, 103 bp, Artificial Sequence
  Synthetic Polynucleotide
taatacgactcactatagggcatttagatacttccacaggccgcccatcaaacagaggagatgatggatggcctgtggaaacctggcggcagcgcaaaagatg

SEQ ID NO: 83018 - DNA, 103 bp, Artificial Sequence
  Synthetic Polynucleotide
taatacgactcactatagggaactgcatttagatacttccacaggccgccaacagaggagaggcggcatgtggaagtataacctggcggcagcgcaaaagatg

SEQ ID NO: 83019 - DNA, 103 bp, Artificial Sequence
  Synthetic Polynucleotide
taatacgactcactatagggagagaaactgcatttagatacttccacaggaacagaggagacctgtgatggtatctaaaaacctggcggcagcgcaaaagatg

SEQ ID NO: 83020 - DNA, 103 bp, Artificial Sequence
  Synthetic Polynucleotide
taatacgactcactatagggtgcagagagaaactgcatttagatacttccaacagaggagaggaagtatgtaaatgcagaacctggcggcagcgcaaaagatg

SEQ ID NO: 83021 - DNA, 103 bp, Artificial Sequence
  Synthetic Polynucleotide
taatacgactcactatagggcaggatgcagagagaaactgcatttagataaacagaggagatatctaatggcagtttctaacctggcggcagcgcaaaagatg

SEQ ID NO: 83022 - DNA, 103 bp, Artificial Sequence
  Synthetic Polynucleotide
taatacgactcactatagggattgtcaggatgcagagagaaactgcatttaacagaggagaaaatgcatgttctctctgaacctggcggcagcgcaaaagatg

SEQ ID NO: 83023 - DNA, 103 bp, Artificial Sequence
  Synthetic Polynucleotide
taatacgactcactatagggcatttattgtcaggatgcagagagaaactgaacagaggagacagtttatgtctgcatccaacctggcggcagcgcaaaagatg

SEQ ID NO: 83024 - DNA, 103 bp, Artificial Sequence
  Synthetic Polynucleotide
taatacgactcactatagggtttccttgaggacaatcctctcatcaaactaacagaggagaagtttgatgagaggattgaacctggcggcagcgcaaaagatg

SEQ ID NO: 83025 - DNA, 103 bp, Artificial Sequence
  Synthetic Polynucleotide
taatacgactcactatagggaacagcatttattgtcaggatgcagagagaaacagaggagatctctcatgatcctgacaaacctggcggcagcgcaaaagatg

SEQ ID NO: 83026 - DNA, 103 bp, Artificial Sequence
  Synthetic Polynucleotide
taatacgactcactataggggaagcaacagcatttattgtcaggatgcagaacagaggagactgcatatggacaataaaaacctggcggcagcgcaaaagatg

SEQ ID NO: 83027 - DNA, 103 bp, Artificial Sequence
  Synthetic Polynucleotide
taatacgactcactatagggtcctagaagcaacagcatttattgtcaggaaacagaggagatcctgaatgtaaatgctgaacctggcggcagcgcaaaagatg

SEQ ID NO: 83028 - DNA, 103 bp, Artificial Sequence
  Synthetic Polynucleotide
taatacgactcactatagggtgctttcctagaagcaacagcatttattgtaacagaggagaacaataatggctgttgctaacctggcggcagcgcaaaagatg

SEQ ID NO: 83029 - DNA, 103 bp, Artificial Sequence
  Synthetic Polynucleotide
taatacgactcactatagggtttgatgctttcctagaagcaacagcatttaacagaggagaaaatgcatgtgcttctagaacctggcggcagcgcaaaagatg

SEQ ID NO: 83030 - DNA, 103 bp, Artificial Sequence
  Synthetic Polynucleotide
taatacgactcactatagggtggtatttgatgctttcctagaagcaacagaacagaggagactgttgatgctaggaaagaacctggcggcagcgcaaaagatg

SEQ ID NO: 83031 - DNA, 103 bp, Artificial Sequence
  Synthetic Polynucleotide
taatacgactcactatagggcaagatggtatttgatgctttcctagaagcaacagaggagagcttctatgaaagcatcaaacctggcggcagcgcaaaagatg

SEQ ID NO: 83032 - DNA, 103 bp, Artificial Sequence
  Synthetic Polynucleotide
taatacgactcactatagggaggggcaagatggtatttgatgctttcctaaacagaggagataggaaatgatcaaatacaacctggcggcagcgcaaaagatg

SEQ ID NO: 83033 - DNA, 103 bp, Artificial Sequence
  Synthetic Polynucleotide
taatacgactcactatagggccatgaggggcaagatggtatttgatgcttaacagaggagaaagcatatgataccatctaacctggcggcagcgcaaaagatg

SEQ ID NO: 83034 - DNA, 103 bp, Artificial Sequence
  Synthetic Polynucleotide
taatacgactcactatagggcagagccatgaggggcaagatggtatttgaaacagaggagatcaaatatgatcttgcccaacctggcggcagcgcaaaagatg

SEQ ID NO: 83035 - DNA, 103 bp, Artificial Sequence
  Synthetic Polynucleotide
taatacgactcactatagggcggcgtttccttgaggacaatcctctcatcaacagaggagagatgagatgattgtcctcaacctggcggcagcgcaaaagatg

SEQ ID NO: 83036 - DNA, 103 bp, Artificial Sequence
  Synthetic Polynucleotide
taatacgactcactataggggtcaacagagccatgaggggcaagatggtaaacagaggagataccatatggcccctcataacctggcggcagcgcaaaagatg

SEQ ID NO: 83037 - DNA, 103 bp, Artificial Sequence
  Synthetic Polynucleotide
taatacgactcactatagggcaggtgtcaacagagccatgaggggcaagaaacagaggagatcttgcatgtcatggctcaacctggcggcagcgcaaaagatg

SEQ ID NO: 83038 - DNA, 103 bp, Artificial Sequence
  Synthetic Polynucleotide
taatacgactcactatagggagtgacaggtgtcaacagagccatgaggggaacagaggagacccctcatggctctgttgaacctggcggcagcgcaaaagatg

SEQ ID NO: 83039 - DNA, 103 bp, Artificial Sequence
  Synthetic Polynucleotide
taatacgactcactataggggccatagtgacaggtgtcaacagagccatgaacagaggagacatggcatggttgacaccaacctggcggcagcgcaaaagatg

SEQ ID NO: 83040 - DNA, 103 bp, Artificial Sequence
  Synthetic Polynucleotide
taatacgactcactatagggcctcagccatagtgacaggtgtcaacagagaacagaggagactctgtatgcacctgtcaaacctggcggcagcgcaaaagatg

SEQ ID NO: 83041 - DNA, 103 bp, Artificial Sequence
  Synthetic Polynucleotide
taatacgactcactatagggtctcacctcagccatagtgacaggtgtcaaaacagaggagattgacaatggtcactatgaacctggcggcagcgcaaaagatg

SEQ ID NO: 83042 - DNA, 103 bp, Artificial Sequence
  Synthetic Polynucleotide
taatacgactcactataggggcaagtctcacctcagccatagtgacaggtaacagaggagaacctgtatgtatggctgaaacctggcggcagcgcaaaagatg

SEQ ID NO: 83043 - DNA, 103 bp, Artificial Sequence
  Synthetic Polynucleotide
taatacgactcactatagggttgcggcaagtctcacctcagccatagtgaaacagaggagatcactaatgctgaggtgaaacctggcggcagcgcaaaagatg

SEQ ID NO: 83044 - DNA, 103 bp, Artificial Sequence
  Synthetic Polynucleotide
taatacgactcactataggggaacattgcggcaagtctcacctcagccataacagaggagaatggctatggtgagacttaacctggcggcagcgcaaaagatg

SEQ ID NO: 83045 - DNA, 103 bp, Artificial Sequence
  Synthetic Polynucleotide
taatacgactcactatagggcaaaagaacattgcggcaagtctcacctcaaacagaggagatgaggtatgacttgccgcaacctggcggcagcgcaaaagatg

SEQ ID NO: 83046 - DNA, 103 bp, Artificial Sequence
  Synthetic Polynucleotide
taatacgactcactatagggtgtgtttattgcctagcaactcgatttgcaaacagaggagatgcaaaatgagttgctagaacctggcggcagcgcaaaagatg

SEQ ID NO: 83047 - DNA, 103 bp, Artificial Sequence
  Synthetic Polynucleotide
taatacgactcactataggggggaacggcgtttccttgaggacaatcctcaacagaggagagaggatatgcctcaaggaaacctggcggcagcgcaaaagatg

SEQ ID NO: 83048 - DNA, 103 bp, Artificial Sequence
  Synthetic Polynucleotide
taatacgactcactatagggcggcacaaaagaacattgcggcaagtctcaaacagaggagatgagacatgccgcaatgtaacctggcggcagcgcaaaagatg

SEQ ID NO: 83049 - DNA, 103 bp, Artificial Sequence
  Synthetic Polynucleotide
taatacgactcactatagggaaccacggcacaaaagaacattgcggcaagaacagaggagacttgccatgatgttctttaacctggcggcagcgcaaaagatg

SEQ ID NO: 83050 - DNA, 103 bp, Artificial Sequence
  Synthetic Polynucleotide
taatacgactcactatagggatgataaccacggcacaaaagaacattgcgaacagaggagacgcaatatgcttttgtgcaacctggcggcagcgcaaaagatg

SEQ ID NO: 83051 - DNA, 103 bp, Artificial Sequence
  Synthetic Polynucleotide
taatacgactcactatagggcccctatgataaccacggcacaaaagaacaaacagaggagatgttctatggtgccgtggaacctggcggcagcgcaaaagatg

SEQ ID NO: 83052 - DNA, 103 bp, Artificial Sequence
  Synthetic Polynucleotide
taatacgactcactatagggaaggacccctatgataaccacggcacaaaaaacagaggagattttgtatggtggttatcaacctggcggcagcgcaaaagatg

SEQ ID NO: 83053 - DNA, 103 bp, Artificial Sequence
  Synthetic Polynucleotide
taatacgactcactatagggtggtgaaggacccctatgataaccacggcaaacagaggagatgccgtatgtatcataggaacctggcggcagcgcaaaagatg

SEQ ID NO: 83054 - DNA, 103 bp, Artificial Sequence
  Synthetic Polynucleotide
taatacgactcactatagggaattctggtgaaggacccctatgataaccaaacagaggagatggttaatgtaggggtccaacctggcggcagcgcaaaagatg

SEQ ID NO: 83055 - DNA, 103 bp, Artificial Sequence
  Synthetic Polynucleotide
taatacgactcactatagggcttgaaattctggtgaaggacccctatgataacagaggagaatcataatggtccttcacaacctggcggcagcgcaaaagatg

SEQ ID NO: 83056 - DNA, 103 bp, Artificial Sequence
  Synthetic Polynucleotide
taatacgactcactataggggtgtccttgaaattctggtgaaggacccctaacagaggagaaggggtatgtcaccagaaaacctggcggcagcgcaaaagatg

SEQ ID NO: 83057 - DNA, 103 bp, Artificial Sequence
  Synthetic Polynucleotide
taatacgactcactatagggtggaggtgtccttgaaattctggtgaaggaaacagaggagatccttcatgagaatttcaaacctggcggcagcgcaaaagatg

SEQ ID NO: 83058 - DNA, 103 bp, Artificial Sequence
  Synthetic Polynucleotide
taatacgactcactatagggatcatgggaacggcgtttccttgaggacaaaacagaggagattgtccatgaggaaacgcaacctggcggcagcgcaaaagatg

SEQ ID NO: 83059 - DNA, 103 bp, Artificial Sequence
  Synthetic Polynucleotide
taatacgactcactatagggctgcatggaggtgtccttgaaattctggtgaacagaggagacaccagatgttcaaggacaacctggcggcagcgcaaaagatg

SEQ ID NO: 83060 - DNA, 103 bp, Artificial Sequence
  Synthetic Polynucleotide
taatacgactcactataggggtcttctgcatggaggtgtccttgaaattcaacagaggagagaatttatgggacacctcaacctggcggcagcgcaaaagatg

SEQ ID NO: 83061 - DNA, 103 bp, Artificial Sequence
  Synthetic Polynucleotide
taatacgactcactataggggtatagtcttctgcatggaggtgtccttgaaacagaggagatcaaggatgcctccatgcaacctggcggcagcgcaaaagatg

SEQ ID NO: 83062 - DNA, 103 bp, Artificial Sequence
  Synthetic Polynucleotide
taatacgactcactatagggcagaggtatagtcttctgcatggaggtgtcaacagaggagagacaccatgatgcagaagaacctggcggcagcgcaaaagatg

SEQ ID NO: 83063 - DNA, 103 bp, Artificial Sequence
  Synthetic Polynucleotide
taatacgactcactataggggccaccagaggtatagtcttctgcatggagaacagaggagactccatatggaagactataacctggcggcagcgcaaaagatg

SEQ ID NO: 83064 - DNA, 103 bp, Artificial Sequence
  Synthetic Polynucleotide
taatacgactcactatagggtgagggccaccagaggtatagtcttctgcaaacagaggagatgcagaatgctatacctcaacctggcggcagcgcaaaagatg

SEQ ID NO: 83065 - DNA, 103 bp, Artificial Sequence
  Synthetic Polynucleotide
taatacgactcactataggggagtgtgagggccaccagaggtatagtcttaacagaggagaaagactatgcctctggtgaacctggcggcagcgcaaaagatg

SEQ ID NO: 83066 - DNA, 103 bp, Artificial Sequence
  Synthetic Polynucleotide
taatacgactcactataggggatgtgagtgtgagggccaccagaggtataaacagaggagatataccatgggtggccctaacctggcggcagcgcaaaagatg

SEQ ID NO: 83067 - DNA, 103 bp, Artificial Sequence
  Synthetic Polynucleotide
taatacgactcactatagggggtaagatgtgagtgtgagggccaccagagaacagaggagactctggatgccctcacacaacctggcggcagcgcaaaagatg

SEQ ID NO: 83068 - DNA, 103 bp, Artificial Sequence
  Synthetic Polynucleotide
taatacgactcactataggggcccaggtaagatgtgagtgtgagggccacaacagaggagagtggccatgacactcacaaacctggcggcagcgcaaaagatg

SEQ ID NO: 83069 - DNA, 103 bp, Artificial Sequence
  Synthetic Polynucleotide
taatacgactcactatagggagaacatcatgggaacggcgtttccttgagaacagaggagactcaagatgacgccgttcaacctggcggcagcgcaaaagatg

SEQ ID NO: 83070 - DNA, 103 bp, Artificial Sequence
  Synthetic Polynucleotide
taatacgactcactataggggtcaagcccaggtaagatgtgagtgtgaggaacagaggagacctcacatgcacatcttaaacctggcggcagcgcaaaagatg

SEQ ID NO: 83071 - DNA, 103 bp, Artificial Sequence
  Synthetic Polynucleotide
taatacgactcactataggggttgtgtcaagcccaggtaagatgtgagtgaacagaggagacactcaatgcttacctggaacctggcggcagcgcaaaagatg

SEQ ID NO: 83072 - DNA, 103 bp, Artificial Sequence
  Synthetic Polynucleotide
taatacgactcactatagggaaaaggttgtgtcaagcccaggtaagatgtaacagaggagaacatctatgctgggcttgaacctggcggcagcgcaaaagatg

SEQ ID NO: 83073 - DNA, 103 bp, Artificial Sequence
  Synthetic Polynucleotide
taatacgactcactatagggcccaaaaaaggttgtgtcaagcccaggtaaaacagaggagattacctatgcttgacacaaacctggcggcagcgcaaaagatg

SEQ ID NO: 83074 - DNA, 103 bp, Artificial Sequence
  Synthetic Polynucleotide
taatacgactcactatagggacaggcccaaaaaaggttgtgtcaagcccaaacagaggagatgggctatgcacaaccttaacctggcggcagcgcaaaagatg

SEQ ID NO: 83075 - DNA, 103 bp, Artificial Sequence
  Synthetic Polynucleotide
taatacgactcactatagggtgcacacaggcccaaaaaaggttgtgtcaaaacagaggagattgacaatgccttttttgaacctggcggcagcgcaaaagatg

SEQ ID NO: 83076 - DNA, 103 bp, Artificial Sequence
  Synthetic Polynucleotide
taatacgactcactatagggagaaatgcacacaggcccaaaaaaggttgtaacagaggagaacaaccatgtttgggcctaacctggcggcagcgcaaaagatg

SEQ ID NO: 83077 - DNA, 103 bp, Artificial Sequence
  Synthetic Polynucleotide
taatacgactcactatagggttgccagaaatgcacacaggcccaaaaaagaacagaggagactttttatggcctgtgtgaacctggcggcagcgcaaaagatg

SEQ ID NO: 83078 - DNA, 103 bp, Artificial Sequence
  Synthetic Polynucleotide
taatacgactcactataggggcgggttgccagaaatgcacacaggcccaaaacagaggagattgggcatgtgtgcatttaacctggcggcagcgcaaaagatg

SEQ ID NO: 83079 - DNA, 103 bp, Artificial Sequence
  Synthetic Polynucleotide
taatacgactcactatagggaatatgcgggttgccagaaatgcacacaggaacagaggagacctgtgatgatttctggcaacctggcggcagcgcaaaagatg

SEQ ID NO: 83080 - DNA, 103 bp, Artificial Sequence
  Synthetic Polynucleotide
taatacgactcactatagggcagtcagaacatcatgggaacggcgtttccaacagaggagaggaaacatggttcccatgaacctggcggcagcgcaaaagatg

SEQ ID NO: 83081 - DNA, 103 bp, Artificial Sequence
  Synthetic Polynucleotide
taatacgactcactataggggcccaaatatgcgggttgccagaaatgcacaacagaggagagtgcatatgtggcaacccaacctggcggcagcgcaaaagatg

SEQ ID NO: 83082 - DNA, 103 bp, Artificial Sequence
  Synthetic Polynucleotide
taatacgactcactatagggccttcgcccaaatatgcgggttgccagaaaaacagaggagatttctgatgacccgcataaacctggcggcagcgcaaaagatg

SEQ ID NO: 83083 - DNA, 103 bp, Artificial Sequence
  Synthetic Polynucleotide
taatacgactcactatagggatactccttcgcccaaatatgcgggttgccaacagaggagaggcaacatgcatatttggaacctggcggcagcgcaaaagatg

SEQ ID NO: 83084 - DNA, 103 bp, Artificial Sequence
  Synthetic Polynucleotide
taatacgactcactatagggctgggatactccttcgcccaaatatgcgggaacagaggagacccgcaatgttgggcgaaaacctggcggcagcgcaaaagatg

SEQ ID NO: 83085 - DNA, 103 bp, Artificial Sequence
  Synthetic Polynucleotide
taatacgactcactatagggattcactgggatactccttcgcccaaatataacagaggagaatatttatgcgaaggagtaacctggcggcagcgcaaaagatg

SEQ ID NO: 83086 - DNA, 103 bp, Artificial Sequence
  Synthetic Polynucleotide
taatacgactcactataggggcctcattcactgggatactccttcgcccaaacagaggagatgggcgatggagtatcccaacctggcggcagcgcaaaagatg

SEQ ID NO: 83087 - DNA, 103 bp, Artificial Sequence
  Synthetic Polynucleotide
taatacgactcactatagggcgagtgcctcattcactgggatactccttcaacagaggagagaaggaatgtcccagtgaaacctggcggcagcgcaaaagatg

SEQ ID NO: 83088 - DNA, 103 bp, Artificial Sequence
  Synthetic Polynucleotide
taatacgactcactatagggtgctgcgagtgcctcattcactgggatactaacagaggagaagtatcatggtgaatgagaacctggcggcagcgcaaaagatg

SEQ ID NO: 83089 - DNA, 103 bp, Artificial Sequence
  Synthetic Polynucleotide
taatacgactcactatagggccagctgctgcgagtgcctcattcactgggaacagaggagacccagtatgtgaggcactaacctggcggcagcgcaaaagatg

SEQ ID NO: 83090 - DNA, 103 bp, Artificial Sequence
  Synthetic Polynucleotide
taatacgactcactatagggctagaccagctgctgcgagtgcctcattcaaacagaggagatgaatgatgcactcgcagaacctggcggcagcgcaaaagatg

SEQ ID NO: 83091 - DNA, 103 bp, Artificial Sequence
  Synthetic Polynucleotide
taatacgactcactatagggttgcacagtcagaacatcatgggaacggcgaacagaggagacgccgtatgcatgatgttaacctggcggcagcgcaaaagatg

SEQ ID NO: 83092 - DNA, 103 bp, Artificial Sequence
  Synthetic Polynucleotide
taatacgactcactatagggtcccactagaccagctgctgcgagtgcctcaacagaggagagaggcaatggcagcagctaacctggcggcagcgcaaaagatg

SEQ ID NO: 83093 - DNA, 103 bp, Artificial Sequence
  Synthetic Polynucleotide
taatacgactcactatagggagcactcccactagaccagctgctgcgagtaacagaggagaactcgcatgagctggtctaacctggcggcagcgcaaaagatg

SEQ ID NO: 83094 - DNA, 103 bp, Artificial Sequence
  Synthetic Polynucleotide
taatacgactcactatagggctgccagcactcccactagaccagctgctgaacagaggagacagcagatggtctagtggaacctggcggcagcgcaaaagatg

SEQ ID NO: 83095 - DNA, 103 bp, Artificial Sequence
  Synthetic Polynucleotide
taatacgactcactatagggcagtcctgccagcactcccactagaccagcaacagaggagagctggtatggtgggagtgaacctggcggcagcgcaaaagatg

SEQ ID NO: 83096 - DNA, 103 bp, Artificial Sequence
  Synthetic Polynucleotide
taatacgactcactatagggaaagccagtcctgccagcactcccactagaaacagaggagatctagtatgagtgctggcaacctggcggcagcgcaaaagatg

SEQ ID NO: 83097 - DNA, 103 bp, Artificial Sequence
  Synthetic Polynucleotide
taatacgactcactatagggcctgaaaagccagtcctgccagcactcccaaacagaggagatgggagatgtggcaggacaacctggcggcagcgcaaaagatg

SEQ ID NO: 83098 - DNA, 103 bp, Artificial Sequence
  Synthetic Polynucleotide
taatacgactcactatagggcatctcctgaaaagccagtcctgccagcacaacagaggagagtgctgatgggactggctaacctggcggcagcgcaaaagatg

SEQ ID NO: 83099 - DNA, 103 bp, Artificial Sequence
  Synthetic Polynucleotide
taatacgactcactatagggttctccatctcctgaaaagccagtcctgccaacagaggagaggcaggatgggcttttcaaacctggcggcagcgcaaaagatg

SEQ ID NO: 83100 - DNA, 103 bp, Artificial Sequence
  Synthetic Polynucleotide
taatacgactcactatagggggaagttctccatctcctgaaaagccagtcaacagaggagagactggatgttcaggagaaacctggcggcagcgcaaaagatg

SEQ ID NO: 83101 - DNA, 103 bp, Artificial Sequence
  Synthetic Polynucleotide
taatacgactcactatagggaccaaggaagttctccatctcctgaaaagcaacagaggagagcttttatggagatggagaacctggcggcagcgcaaaagatg

SEQ ID NO: 83102 - DNA, 103 bp, Artificial Sequence
  Synthetic Polynucleotide
taatacgactcactatagggaggaattgcacagtcagaacatcatgggaaaacagaggagattcccaatgtgttctgacaacctggcggcagcgcaaaagatg

SEQ ID NO: 83103 - DNA, 103 bp, Artificial Sequence
  Synthetic Polynucleotide
taatacgactcactatagggatcggaccaaggaagttctccatctcctgaaacagaggagatcaggaatgggagaacttaacctggcggcagcgcaaaagatg

SEQ ID NO: 83104 - DNA, 103 bp, Artificial Sequence
  Synthetic Polynucleotide
taatacgactcactatagggctgcaatcggaccaaggaagttctccatctaacagaggagaagatggatgacttccttgaacctggcggcagcgcaaaagatg

SEQ ID NO: 83105 - DNA, 103 bp, Artificial Sequence
  Synthetic Polynucleotide
taatacgactcactatagggtccaactgcaatcggaccaaggaagttctcaacagaggagagagaacatgcttggtccgaacctggcggcagcgcaaaagatg

SEQ ID NO: 83106 - DNA, 103 bp, Artificial Sequence
  Synthetic Polynucleotide
taatacgactcactatagggagtcctccaactgcaatcggaccaaggaagaacagaggagacttcctatgtccgattgcaacctggcggcagcgcaaaagatg

SEQ ID NO: 83107 - DNA, 103 bp, Artificial Sequence
  Synthetic Polynucleotide
taatacgactcactatagggtcaggagtcctccaactgcaatcggaccaaaacagaggagattggtcatgttgcagttgaacctggcggcagcgcaaaagatg

SEQ ID NO: 83108 - DNA, 103 bp, Artificial Sequence
  Synthetic Polynucleotide
taatacgactcactatagggcatcatcaggagtcctccaactgcaatcggaacagaggagaccgattatggttggaggaaacctggcggcagcgcaaaagatg

SEQ ID NO: 83109 - DNA, 103 bp, Artificial Sequence
  Synthetic Polynucleotide
taatacgactcactatagggaccagcatcatcaggagtcctccaactgcaaacagaggagatgcagtatgaggactcctaacctggcggcagcgcaaaagatg

SEQ ID NO: 83110 - DNA, 103 bp, Artificial Sequence
  Synthetic Polynucleotide
taatacgactcactatagggcgctaaccagcatcatcaggagtcctccaaaacagaggagattggagatgtcctgatgaaacctggcggcagcgcaaaagatg

SEQ ID NO: 83111 - DNA, 103 bp, Artificial Sequence
  Synthetic Polynucleotide
taatacgactcactatagggagccacgctaaccagcatcatcaggagtccaacagaggagaggactcatgatgatgctgaacctggcggcagcgcaaaagatg

SEQ ID NO: 83112 - DNA, 103 bp, Artificial Sequence
  Synthetic Polynucleotide
taatacgactcactatagggctcccagccacgctaaccagcatcatcaggaacagaggagacctgatatggctggttagaacctggcggcagcgcaaaagatg

SEQ ID NO: 83113 - DNA, 103 bp, Artificial Sequence
  Synthetic Polynucleotide
taatacgactcactatagggaaattaggaattgcacagtcagaacatcataacagaggagaatgatgatgtgactgtgcaacctggcggcagcgcaaaagatg

SEQ ID NO: 83114 - DNA, 103 bp, Artificial Sequence
  Synthetic Polynucleotide
taatacgactcactatagggccaccctcccagccacgctaaccagcatcaaacagaggagatgatgcatgttagcgtggaacctggcggcagcgcaaaagatg

SEQ ID NO: 83115 - DNA, 103 bp, Artificial Sequence
  Synthetic Polynucleotide
taatacgactcactatagggcccatccaccctcccagccacgctaaccagaacagaggagactggttatggtggctgggaacctggcggcagcgcaaaagatg

SEQ ID NO: 83116 - DNA, 103 bp, Artificial Sequence
  Synthetic Polynucleotide
taatacgactcactatagggtctagcccatccaccctcccagccacgctaaacagaggagatagcgtatgtgggagggtaacctggcggcagcgcaaaagatg

SEQ ID NO: 83117 - DNA, 103 bp, Artificial Sequence
  Synthetic Polynucleotide
taatacgactcactatagggtgagctctagcccatccaccctcccagccaaacagaggagatggctgatggggtggatgaacctggcggcagcgcaaaagatg

SEQ ID NO: 83118 - DNA, 103 bp, Artificial Sequence
  Synthetic Polynucleotide
taatacgactcactatagggcttcttgagctctagcccatccaccctcccaacagaggagagggaggatggatgggctaaacctggcggcagcgcaaaagatg

SEQ ID NO: 83119 - DNA, 103 bp, Artificial Sequence
  Synthetic Polynucleotide
taatacgactcactatagggccaagcttcttgagctctagcccatccaccaacagaggagaggtggaatggctagagctaacctggcggcagcgcaaaagatg

SEQ ID NO: 83120 - DNA, 103 bp, Artificial Sequence
  Synthetic Polynucleotide
taatacgactcactatagggcttcaccaagcttcttgagctctagcccataacagaggagaatgggcatgagctcaagaaacctggcggcagcgcaaaagatg

SEQ ID NO: 83121 - DNA, 103 bp, Artificial Sequence
  Synthetic Polynucleotide
taatacgactcactatagggtgaaacttcaccaagcttcttgagctctagaacagaggagactagagatgaagaagcttaacctggcggcagcgcaaaagatg

SEQ ID NO: 83122 - DNA, 103 bp, Artificial Sequence
  Synthetic Polynucleotide
taatacgactcactatagggtcccatgaaacttcaccaagcttcttgagcaacagaggagagctcaaatggcttggtgaaacctggcggcagcgcaaaagatg

SEQ ID NO: 83123 - DNA, 103 bp, Artificial Sequence
  Synthetic Polynucleotide
taatacgactcactatagggcctcttcccatgaaacttcaccaagcttctaacagaggagaagaagcatggtgaagtttaacctggcggcagcgcaaaagatg

SEQ ID NO: 83124 - DNA, 103 bp, Artificial Sequence
  Synthetic Polynucleotide
taatacgactcactatagggtcccaaaattaggaattgcacagtcagaacaacagaggagagttctgatggtgcaattcaacctggcggcagcgcaaaagatg

SEQ ID NO: 83125 - DNA, 103 bp, Artificial Sequence
  Synthetic Polynucleotide
taatacgactcactatagggcgcctcctcttcccatgaaacttcaccaagaacagaggagacttggtatggtttcatggaacctggcggcagcgcaaaagatg

SEQ ID NO: 83126 - DNA, 103 bp, Artificial Sequence
  Synthetic Polynucleotide
taatacgactcactatagggatctccgcctcctcttcccatgaaacttcaaacagaggagatgaagtatgatgggaagaaacctggcggcagcgcaaaagatg

SEQ ID NO: 83127 - DNA, 103 bp, Artificial Sequence
  Synthetic Polynucleotide
taatacgactcactatagggcgctgatctccgcctcctcttcccatgaaaaacagaggagatttcatatgaagaggaggaacctggcggcagcgcaaaagatg

SEQ ID NO: 83128 - DNA, 103 bp, Artificial Sequence
  Synthetic Polynucleotide
taatacgactcactatagggactcccgctgatctccgcctcctcttcccaaacagaggagatgggaaatggaggcggagaacctggcggcagcgcaaaagatg

SEQ ID NO: 83129 - DNA, 103 bp, Artificial Sequence
  Synthetic Polynucleotide
taatacgactcactataggggcggaactcccgctgatctccgcctcctctaacagaggagaagaggaatgggagatcagaacctggcggcagcgcaaaagatg

SEQ ID NO: 83130 - DNA, 103 bp, Artificial Sequence
  Synthetic Polynucleotide
taatacgactcactatagggagcgggcggaactcccgctgatctccgcctaacagaggagaaggcggatgtcagcgggaaacctggcggcagcgcaaaagatg

SEQ ID NO: 83131 - DNA, 103 bp, Artificial Sequence
  Synthetic Polynucleotide
taatacgactcactatagggatcatagcgggcggaactcccgctgatctcaacagaggagagagatcatggggagttccaacctggcggcagcgcaaaagatg

SEQ ID NO: 83132 - DNA, 103 bp, Artificial Sequence
  Synthetic Polynucleotide
taatacgactcactataggggccacatcatagcgggcggaactcccgctgaacagaggagacagcggatgttccgcccgaacctggcggcagcgcaaaagatg

SEQ ID NO: 83133 - DNA, 103 bp, Artificial Sequence
  Synthetic Polynucleotide
taatacgactcactatagggtgagtgccacatcatagcgggcggaactccaacagaggagaggagttatgcccgctatgaacctggcggcagcgcaaaagatg

SEQ ID NO: 83134 - DNA, 103 bp, Artificial Sequence
  Synthetic Polynucleotide
taatacgactcactatagggttcactgagtgccacatcatagcgggcggaaacagaggagatccgccatgtatgatgtgaacctggcggcagcgcaaaagatg

SEQ ID NO: 83135 - DNA, 103 bp, Artificial Sequence
  Synthetic Polynucleotide
taatacgactcactatagggagcattcccaaaattaggaattgcacagtcaacagaggagagactgtatgattcctaataacctggcggcagcgcaaaagatg

SEQ ID NO: 83136 - DNA, 103 bp, Artificial Sequence
  Synthetic Polynucleotide
taatacgactcactatagggccttgttcactgagtgccacatcatagcggaacagaggagaccgctaatgtgtggcactaacctggcggcagcgcaaaagatg

SEQ ID NO: 83137 - DNA, 103 bp, Artificial Sequence
  Synthetic Polynucleotide
taatacgactcactatagggactccccttgttcactgagtgccacatcataacagaggagaatgatgatgcactcagtgaacctggcggcagcgcaaaagatg

SEQ ID NO: 83138 - DNA, 103 bp, Artificial Sequence
  Synthetic Polynucleotide
taatacgactcactatagggcttgaactccccttgttcactgagtgccacaacagaggagagtggcaatgagtgaacaaaacctggcggcagcgcaaaagatg

SEQ ID NO: 83139 - DNA, 103 bp, Artificial Sequence
  Synthetic Polynucleotide
taatacgactcactatagggagcagcttgaactccccttgttcactgagtaacagaggagaactcagatgacaaggggaaacctggcggcagcgcaaaagatg

SEQ ID NO: 83140 - DNA, 103 bp, Artificial Sequence
  Synthetic Polynucleotide
taatacgactcactatagggcagaaagcagcttgaactccccttgttcacaacagaggagagtgaacatggggagttcaaacctggcggcagcgcaaaagatg

SEQ ID NO: 83141 - DNA, 103 bp, Artificial Sequence
  Synthetic Polynucleotide
taatacgactcactatagggctcttcagaaagcagcttgaactccccttgaacagaggagacaagggatgttcaagctgaacctggcggcagcgcaaaagatg

SEQ ID NO: 83142 - DNA, 103 bp, Artificial Sequence
  Synthetic Polynucleotide
taatacgactcactatagggactttctcttcagaaagcagcttgaactccaacagaggagaggagttatggctgctttcaacctggcggcagcgcaaaagatg

SEQ ID NO: 83143 - DNA, 103 bp, Artificial Sequence
  Synthetic Polynucleotide
taatacgactcactatagggatggcactttctcttcagaaagcagcttgaaacagaggagatcaagcatgtttctgaagaacctggcggcagcgcaaaagatg

SEQ ID NO: 83144 - DNA, 103 bp, Artificial Sequence
  Synthetic Polynucleotide
taatacgactcactataggggtcccatggcactttctcttcagaaagcagaacagaggagactgcttatggaagagaaaaacctggcggcagcgcaaaagatg

SEQ ID NO: 83145 - DNA, 103 bp, Artificial Sequence
  Synthetic Polynucleotide
taatacgactcactatagggacctggtcccatggcactttctcttcagaaaacagaggagattctgaatggaaagtgccaacctggcggcagcgcaaaagatg

SEQ ID NO: 83146 - DNA, 103 bp, Artificial Sequence
  Synthetic Polynucleotide
taatacgactcactatagggtcaacagcattcccaaaattaggaattgcaaacagaggagatgcaatatgtaattttggaacctggcggcagcgcaaaagatg

SEQ ID NO: 83147 - DNA, 103 bp, Artificial Sequence
  Synthetic Polynucleotide
taatacgactcactatagggtcacaacctggtcccatggcactttctcttaacagaggagaaagagaatgtgccatgggaacctggcggcagcgcaaaagatg

SEQ ID NO: 83148 - DNA, 103 bp, Artificial Sequence
  Synthetic Polynucleotide
taatacgactcactatagggggtcatcacaacctggtcccatggcactttaacagaggagaaaagtgatgtgggaccagaacctggcggcagcgcaaaagatg

SEQ ID NO: 83149 - DNA, 103 bp, Artificial Sequence
  Synthetic Polynucleotide
taatacgactcactatagggagcgaggtcatcacaacctggtcccatggcaacagaggagagccatgatgccaggttgtaacctggcggcagcgcaaaagatg

SEQ ID NO: 83150 - DNA, 103 bp, Artificial Sequence
  Synthetic Polynucleotide
taatacgactcactatagggaggccagcgaggtcatcacaacctggtcccaacagaggagagggaccatgttgtgatgaaacctggcggcagcgcaaaagatg

SEQ ID NO: 83151 - DNA, 103 bp, Artificial Sequence
  Synthetic Polynucleotide
taatacgactcactatagggaaccaaggccagcgaggtcatcacaacctgaacagaggagacaggttatgatgacctcgaacctggcggcagcgcaaaagatg

SEQ ID NO: 83152 - DNA, 103 bp, Artificial Sequence
  Synthetic Polynucleotide
taatacgactcactataggggccccaaccaaggccagcgaggtcatcacaaacagaggagatgtgatatgctcgctggcaacctggcggcagcgcaaaagatg

SEQ ID NO: 83153 - DNA, 103 bp, Artificial Sequence
  Synthetic Polynucleotide
taatacgactcactataggggggcagccccaaccaaggccagcgaggtcaaacagaggagatgacctatgtggccttggaacctggcggcagcgcaaaagatg

SEQ ID NO: 83154 - DNA, 103 bp, Artificial Sequence
  Synthetic Polynucleotide
taatacgactcactatagggatggagggcagccccaaccaaggccagcgaaacagaggagatcgctgatgttggttgggaacctggcggcagcgcaaaagatg

SEQ ID NO: 83155 - DNA, 103 bp, Artificial Sequence
  Synthetic Polynucleotide
taatacgactcactatagggaatggatggagggcagccccaaccaaggccaacagaggagaggccttatgtggggctgcaacctggcggcagcgcaaaagatg

SEQ ID NO: 83156 - DNA, 103 bp, Artificial Sequence
  Synthetic Polynucleotide
taatacgactcactataggggagcaaatggatggagggcagccccaaccaaacagaggagatggttgatgctgccctccaacctggcggcagcgcaaaagatg

SEQ ID NO: 83157 - DNA, 103 bp, Artificial Sequence
  Synthetic Polynucleotide
taatacgactcactatagggccaaatgtgtttattgcctagcaactcgataacagaggagaatcgagatgctaggcaataacctggcggcagcgcaaaagatg

SEQ ID NO: 83158 - DNA, 103 bp, Artificial Sequence
  Synthetic Polynucleotide
taatacgactcactatagggcgtcatcaacagcattcccaaaattaggaaaacagaggagattcctaatgttgggaatgaacctggcggcagcgcaaaagatg

SEQ ID NO: 83159 - DNA, 103 bp, Artificial Sequence
  Synthetic Polynucleotide
taatacgactcactatagggcagaagagcaaatggatggagggcagccccaacagaggagaggggctatgctccatccaaacctggcggcagcgcaaaagatg

SEQ ID NO: 83160 - DNA, 103 bp, Artificial Sequence
  Synthetic Polynucleotide
taatacgactcactatagggaccagcagaagagcaaatggatggagggcaaacagaggagatgccctatgtccatttgcaacctggcggcagcgcaaaagatg

SEQ ID NO: 83161 - DNA, 103 bp, Artificial Sequence
  Synthetic Polynucleotide
taatacgactcactatagggcaaggaccagcagaagagcaaatggatggaaacagaggagatccatcatgttgctcttcaacctggcggcagcgcaaaagatg

SEQ ID NO: 83162 - DNA, 103 bp, Artificial Sequence
  Synthetic Polynucleotide
taatacgactcactatagggcccagcaaggaccagcagaagagcaaatggaacagaggagaccatttatgcttctgctgaacctggcggcagcgcaaaagatg

SEQ ID NO: 83163 - DNA, 103 bp, Artificial Sequence
  Synthetic Polynucleotide
taatacgactcactatagggagccacccagcaaggaccagcagaagagcaaacagaggagatgctctatggctggtcctaacctggcggcagcgcaaaagatg

SEQ ID NO: 83164 - DNA, 103 bp, Artificial Sequence
  Synthetic Polynucleotide
taatacgactcactataggggaaacagccacccagcaaggaccagcagaaaacagaggagattctgcatgtccttgctgaacctggcggcagcgcaaaagatg

SEQ ID NO: 83165 - DNA, 103 bp, Artificial Sequence
  Synthetic Polynucleotide
taatacgactcactataggggacatgaaacagccacccagcaaggaccagaacagaggagactggtcatggctgggtggaacctggcggcagcgcaaaagatg

SEQ ID NO: 83166 - DNA, 103 bp, Artificial Sequence
  Synthetic Polynucleotide
taatacgactcactatagggcccctgacatgaaacagccacccagcaaggaacagaggagaccttgcatggtggctgttaacctggcggcagcgcaaaagatg

SEQ ID NO: 83167 - DNA, 103 bp, Artificial Sequence
  Synthetic Polynucleotide
taatacgactcactatagggtagctcccctgacatgaaacagccacccagaacagaggagactgggtatgtgtttcatgaacctggcggcagcgcaaaagatg

SEQ ID NO: 83168 - DNA, 103 bp, Artificial Sequence
  Synthetic Polynucleotide
taatacgactcactatagggtctcctagctcccctgacatgaaacagccaaacagaggagatggctgatgcatgtcaggaacctggcggcagcgcaaaagatg

SEQ ID NO: 83169 - DNA, 103 bp, Artificial Sequence
  Synthetic Polynucleotide
taatacgactcactatagggccacccgtcatcaacagcattcccaaaattaacagaggagaaattttatgaatgctgttaacctggcggcagcgcaaaagatg

SEQ ID NO: 83170 - DNA, 103 bp, Artificial Sequence
  Synthetic Polynucleotide
taatacgactcactatagggccacttctcctagctcccctgacatgaaacaacagaggagagtttcaatgcaggggagcaacctggcggcagcgcaaaagatg

SEQ ID NO: 83171 - DNA, 103 bp, Artificial Sequence
  Synthetic Polynucleotide
taatacgactcactatagggcatccccacttctcctagctcccctgacataacagaggagaatgtcaatggagctaggaaacctggcggcagcgcaaaagatg

SEQ ID NO: 83172 - DNA, 103 bp, Artificial Sequence
  Synthetic Polynucleotide
taatacgactcactatagggcaagacatccccacttctcctagctcccctaacagaggagaaggggaatgaggagaagtaacctggcggcagcgcaaaagatg

SEQ ID NO: 83173 - DNA, 103 bp, Artificial Sequence
  Synthetic Polynucleotide
taatacgactcactatagggtcccacaagacatccccacttctcctagctaacagaggagaagctagatgaagtggggaaacctggcggcagcgcaaaagatg

SEQ ID NO: 83174 - DNA, 103 bp, Artificial Sequence
  Synthetic Polynucleotide
taatacgactcactataggggaatatcccacaagacatccccacttctccaacagaggagaggagaaatggggatgtctaacctggcggcagcgcaaaagatg

SEQ ID NO: 83175 - DNA, 103 bp, Artificial Sequence
  Synthetic Polynucleotide
taatacgactcactatagggagtgggaatatcccacaagacatccccactaacagaggagaagtgggatggtcttgtggaacctggcggcagcgcaaaagatg

SEQ ID NO: 83176 - DNA, 103 bp, Artificial Sequence
  Synthetic Polynucleotide
taatacgactcactatagggttaggagtgggaatatcccacaagacatccaacagaggagaggatgtatggtgggatataacctggcggcagcgcaaaagatg

SEQ ID NO: 83177 - DNA, 103 bp, Artificial Sequence
  Synthetic Polynucleotide
taatacgactcactatagggtgatcttaggagtgggaatatcccacaagaaacagaggagatcttgtatgatattcccaaacctggcggcagcgcaaaagatg

SEQ ID NO: 83178 - DNA, 103 bp, Artificial Sequence
  Synthetic Polynucleotide
taatacgactcactatagggctcgatgatcttaggagtgggaatatcccaaacagaggagatgggatatgcccactcctaacctggcggcagcgcaaaagatg

SEQ ID NO: 83179 - DNA, 103 bp, Artificial Sequence
  Synthetic Polynucleotide
taatacgactcactatagggcattcctcgatgatcttaggagtgggaataaacagaggagatattccatgtcctaagataacctggcggcagcgcaaaagatg

SEQ ID NO: 83180 - DNA, 103 bp, Artificial Sequence
  Synthetic Polynucleotide
taatacgactcactatagggtcactccacccgtcatcaacagcattcccaaacagaggagatgggaaatgtgttgatgaaacctggcggcagcgcaaaagatg

SEQ ID NO: 83181 - DNA, 103 bp, Artificial Sequence
  Synthetic Polynucleotide
taatacgactcactataggggttcacattcctcgatgatcttaggagtggaacagaggagaccactcatgagatcatcgaacctggcggcagcgcaaaagatg

SEQ ID NO: 83182 - DNA, 103 bp, Artificial Sequence
  Synthetic Polynucleotide
taatacgactcactatagggcagatgttcacattcctcgatgatcttaggaacagaggagacctaagatgatcgaggaaaacctggcggcagcgcaaaagatg

SEQ ID NO: 83183 - DNA, 103 bp, Artificial Sequence
  Synthetic Polynucleotide
taatacgactcactatagggtcctccagatgttcacattcctcgatgatcaacagaggagagatcatatgggaatgtgaaacctggcggcagcgcaaaagatg

SEQ ID NO: 83184 - DNA, 103 bp, Artificial Sequence
  Synthetic Polynucleotide
taatacgactcactatagggtcccatcctccagatgttcacattcctcgaaacagaggagatcgaggatggtgaacatcaacctggcggcagcgcaaaagatg

SEQ ID NO: 83185 - DNA, 103 bp, Artificial Sequence
  Synthetic Polynucleotide
taatacgactcactatagggataaatcccatcctccagatgttcacattcaacagaggagagaatgtatgcatctggagaacctggcggcagcgcaaaagatg

SEQ ID NO: 83186 - DNA, 103 bp, Artificial Sequence
  Synthetic Polynucleotide
taatacgactcactatagggatgccataaatcccatcctccagatgttcaaacagaggagatgaacaatgggaggatggaacctggcggcagcgcaaaagatg

SEQ ID NO: 83187 - DNA, 103 bp, Artificial Sequence
  Synthetic Polynucleotide
taatacgactcactatagggggaatatgccataaatcccatcctccagataacagaggagaatctggatgatgggatttaacctggcggcagcgcaaaagatg

SEQ ID NO: 83188 - DNA, 103 bp, Artificial Sequence
  Synthetic Polynucleotide
taatacgactcactatagggtgactggaatatgccataaatcccatcctcaacagaggagagaggatatgatttatggcaacctggcggcagcgcaaaagatg

SEQ ID NO: 83189 - DNA, 103 bp, Artificial Sequence
  Synthetic Polynucleotide
taatacgactcactatagggaaggttgactggaatatgccataaatcccaaacagaggagatgggatatgtggcatattaacctggcggcagcgcaaaagatg

SEQ ID NO: 83190 - DNA, 103 bp, Artificial Sequence
  Synthetic Polynucleotide
taatacgactcactatagggccaagaaggttgactggaatatgccataaaaacagaggagatttatgatgtattccagtaacctggcggcagcgcaaaagatg

SEQ ID NO: 83191 - DNA, 103 bp, Artificial Sequence
  Synthetic Polynucleotide
taatacgactcactatagggcaaggtcactccacccgtcatcaacagcataacagaggagaatgctgatgatgacgggtaacctggcggcagcgcaaaagatg

SEQ ID NO: 83192 - DNA, 103 bp, Artificial Sequence
  Synthetic Polynucleotide
taatacgactcactatagggggcccccaagaaggttgactggaatatgccaacagaggagaggcataatgcagtcaaccaacctggcggcagcgcaaaagatg

SEQ ID NO: 83193 - DNA, 103 bp, Artificial Sequence
  Synthetic Polynucleotide
taatacgactcactatagggtgggaggcccccaagaaggttgactggaataacagaggagaattccaatgaaccttcttaacctggcggcagcgcaaaagatg

SEQ ID NO: 83194 - DNA, 103 bp, Artificial Sequence
  Synthetic Polynucleotide
taatacgactcactatagggctcgctgggaggcccccaagaaggttgactaacagaggagaagtcaaatgtcttgggggaacctggcggcagcgcaaaagatg

SEQ ID NO: 83195 - DNA, 103 bp, Artificial Sequence
  Synthetic Polynucleotide
taatacgactcactatagggcactcctcgctgggaggcccccaagaaggtaacagaggagaaccttcatgggggcctccaacctggcggcagcgcaaaagatg

SEQ ID NO: 83196 - DNA, 103 bp, Artificial Sequence
  Synthetic Polynucleotide
taatacgactcactatagggactcccactcctcgctgggaggcccccaagaacagaggagacttgggatgctcccagcgaacctggcggcagcgcaaaagatg

SEQ ID NO: 83197 - DNA, 103 bp, Artificial Sequence
  Synthetic Polynucleotide
taatacgactcactataggggtgccactcccactcctcgctgggaggcccaacagaggagagggcctatgagcgaggagaacctggcggcagcgcaaaagatg

SEQ ID NO: 83198 - DNA, 103 bp, Artificial Sequence
  Synthetic Polynucleotide
taatacgactcactatagggtccctgtgccactcccactcctcgctgggaaacagaggagatcccagatgggagtgggaaacctggcggcagcgcaaaagatg

SEQ ID NO: 83199 - DNA, 103 bp, Artificial Sequence
  Synthetic Polynucleotide
taatacgactcactatagggacccctccctgtgccactcccactcctcgcaacagaggagagcgaggatggggagtggcaacctggcggcagcgcaaaagatg

SEQ ID NO: 83200 - DNA, 103 bp, Artificial Sequence
  Synthetic Polynucleotide
taatacgactcactatagggggaacacccctccctgtgccactcccactcaacagaggagagagtggatgtggcacaggaacctggcggcagcgcaaaagatg

SEQ ID NO: 83201 - DNA, 103 bp, Artificial Sequence
  Synthetic Polynucleotide
taatacgactcactatagggtgtgtggaacacccctccctgtgccactccaacagaggagaggagtgatgcagggagggaacctggcggcagcgcaaaagatg

SEQ ID NO: 83202 - DNA, 103 bp, Artificial Sequence
  Synthetic Polynucleotide
taatacgactcactatagggcgcaccaaggtcactccacccgtcatcaacaacagaggagagttgatatggggtggagtaacctggcggcagcgcaaaagatg

SEQ ID NO: 83203 - DNA, 103 bp, Artificial Sequence
  Synthetic Polynucleotide
taatacgactcactatagggcacattgtgtggaacacccctccctgtgccaacagaggagaggcacaatgaggggtgttaacctggcggcagcgcaaaagatg

SEQ ID NO: 83204 - DNA, 103 bp, Artificial Sequence
  Synthetic Polynucleotide
taatacgactcactatagggcatgccacattgtgtggaacacccctccctaacagaggagaagggagatgtgttccacaaacctggcggcagcgcaaaagatg

SEQ ID NO: 83205 - DNA, 103 bp, Artificial Sequence
  Synthetic Polynucleotide
taatacgactcactatagggtgtgacatgccacattgtgtggaacaccccaacagaggagaggggtgatgcacacaatgaacctggcggcagcgcaaaagatg

SEQ ID NO: 83206 - DNA, 103 bp, Artificial Sequence
  Synthetic Polynucleotide
taatacgactcactatagggcctcttgtgacatgccacattgtgtggaacaacagaggagagttccaatgaatgtggcaaacctggcggcagcgcaaaagatg

SEQ ID NO: 83207 - DNA, 103 bp, Artificial Sequence
  Synthetic Polynucleotide
taatacgactcactatagggaagctcctcttgtgacatgccacattgtgtaacagaggagaacacaaatgggcatgtcaaacctggcggcagcgcaaaagatg

SEQ ID NO: 83208 - DNA, 103 bp, Artificial Sequence
  Synthetic Polynucleotide
taatacgactcactatagggaaggaaagctcctcttgtgacatgccacataacagaggagaatgtggatggtcacaagaaacctggcggcagcgcaaaagatg

SEQ ID NO: 83209 - DNA, 103 bp, Artificial Sequence
  Synthetic Polynucleotide
taatacgactcactatagggctgacaaggaaagctcctcttgtgacatgcaacagaggagagcatgtatgaagaggagcaacctggcggcagcgcaaaagatg

SEQ ID NO: 83210 - DNA, 103 bp, Artificial Sequence
  Synthetic Polynucleotide
taatacgactcactatagggcattcctgacaaggaaagctcctcttgtgaaacagaggagatcacaaatggagctttccaacctggcggcagcgcaaaagatg

SEQ ID NO: 83211 - DNA, 103 bp, Artificial Sequence
  Synthetic Polynucleotide
taatacgactcactatagggcttgccattcctgacaaggaaagctcctctaacagaggagaagaggaatgttccttgtcaacctggcggcagcgcaaaagatg

SEQ ID NO: 83212 - DNA, 103 bp, Artificial Sequence
  Synthetic Polynucleotide
taatacgactcactatagggaacttcttgccattcctgacaaggaaagctaacagaggagaagctttatgtgtcaggaaaacctggcggcagcgcaaaagatg

SEQ ID NO: 83213 - DNA, 103 bp, Artificial Sequence
  Synthetic Polynucleotide
taatacgactcactatagggttttccgcaccaaggtcactccacccgtcaaacagaggagatgacggatggagtgacctaacctggcggcagcgcaaaagatg

SEQ ID NO: 83214 - DNA, 103 bp, Artificial Sequence
  Synthetic Polynucleotide
taatacgactcactataggggaatcaacttcttgccattcctgacaaggaaacagaggagatccttgatgggaatggcaaacctggcggcagcgcaaaagatg

SEQ ID NO: 83215 - DNA, 103 bp, Artificial Sequence
  Synthetic Polynucleotide
taatacgactcactatagggagatggaatcaacttcttgccattcctgacaacagaggagagtcaggatgggcaagaagaacctggcggcagcgcaaaagatg

SEQ ID NO: 83216 - DNA, 103 bp, Artificial Sequence
  Synthetic Polynucleotide
taatacgactcactataggggcccaagatggaatcaacttcttgccattcaacagaggagagaatggatggaagttgataacctggcggcagcgcaaaagatg

SEQ ID NO: 83217 - DNA, 103 bp, Artificial Sequence
  Synthetic Polynucleotide
taatacgactcactatagggctgaagcccaagatggaatcaacttcttgcaacagaggagagcaagaatgtgattccataacctggcggcagcgcaaaagatg

SEQ ID NO: 83218 - DNA, 103 bp, Artificial Sequence
  Synthetic Polynucleotide
taatacgactcactatagggctttactgaagcccaagatggaatcaacttaacagaggagaaagttgatgccatcttggaacctggcggcagcgcaaaagatg

SEQ ID NO: 83219 - DNA, 103 bp, Artificial Sequence
  Synthetic Polynucleotide
taatacgactcactatagggtcttcctttactgaagcccaagatggaatcaacagaggagagattccatgttgggcttcaacctggcggcagcgcaaaagatg

SEQ ID NO: 83220 - DNA, 103 bp, Artificial Sequence
  Synthetic Polynucleotide
taatacgactcactatagggcaaggtcttcctttactgaagcccaagatgaacagaggagacatcttatgcttcagtaaaacctggcggcagcgcaaaagatg

SEQ ID NO: 83221 - DNA, 103 bp, Artificial Sequence
  Synthetic Polynucleotide
taatacgactcactatagggggcgacaaggtcttcctttactgaagcccaaacagaggagatgggctatggtaaaggaaaacctggcggcagcgcaaaagatg

SEQ ID NO: 83222 - DNA, 103 bp, Artificial Sequence
  Synthetic Polynucleotide
taatacgactcactatagggccataggcgacaaggtcttcctttactgaaaacagaggagattcagtatgggaagacctaacctggcggcagcgcaaaagatg

SEQ ID NO: 83223 - DNA, 103 bp, Artificial Sequence
  Synthetic Polynucleotide
taatacgactcactatagggagccaccataggcgacaaggtcttcctttaaacagaggagataaaggatgaccttgtcgaacctggcggcagcgcaaaagatg

SEQ ID NO: 83224 - DNA, 103 bp, Artificial Sequence
  Synthetic Polynucleotide
taatacgactcactatagggtctgtttttccgcaccaaggtcactccaccaacagaggagaggtggaatgaccttggtgaacctggcggcagcgcaaaagatg

SEQ ID NO: 83225 - DNA, 103 bp, Artificial Sequence
  Synthetic Polynucleotide
taatacgactcactatagggccatgagccaccataggcgacaaggtcttcaacagaggagagaagacatggtcgcctataacctggcggcagcgcaaaagatg

SEQ ID NO: 83226 - DNA, 103 bp, Artificial Sequence
  Synthetic Polynucleotide
taatacgactcactatagggaacttccatgagccaccataggcgacaaggaacagaggagaccttgtatgctatggtggaacctggcggcagcgcaaaagatg

SEQ ID NO: 83227 - DNA, 103 bp, Artificial Sequence
  Synthetic Polynucleotide
taatacgactcactatagggcttccaacttccatgagccaccataggcgaaacagaggagatcgcctatggtggctcataacctggcggcagcgcaaaagatg

SEQ ID NO: 83228 - DNA, 103 bp, Artificial Sequence
  Synthetic Polynucleotide
taatacgactcactatagggtctgccttccaacttccatgagccaccataaacagaggagatatggtatgtcatggaagaacctggcggcagcgcaaaagatg

SEQ ID NO: 83229 - DNA, 103 bp, Artificial Sequence
  Synthetic Polynucleotide
taatacgactcactatagggtcccatctgccttccaacttccatgagccaaacagaggagatggctcatggaagttggaaacctggcggcagcgcaaaagatg

SEQ ID NO: 83230 - DNA, 103 bp, Artificial Sequence
  Synthetic Polynucleotide
taatacgactcactatagggctccatcccatctgccttccaacttccatgaacagaggagacatggaatgtggaaggcaaacctggcggcagcgcaaaagatg

SEQ ID NO: 83231 - DNA, 103 bp, Artificial Sequence
  Synthetic Polynucleotide
taatacgactcactatagggttcctctccatcccatctgccttccaacttaacagaggagaaagttgatgggcagatggaacctggcggcagcgcaaaagatg

SEQ ID NO: 83232 - DNA, 103 bp, Artificial Sequence
  Synthetic Polynucleotide
taatacgactcactatagggacctcttcctctccatcccatctgccttccaacagaggagaggaaggatgatgggatggaacctggcggcagcgcaaaagatg

SEQ ID NO: 83233 - DNA, 103 bp, Artificial Sequence
  Synthetic Polynucleotide
taatacgactcactatagggactggacctcttcctctccatcccatctgcaacagaggagagcagatatgatggagaggaacctggcggcagcgcaaaagatg

SEQ ID NO: 83234 - DNA, 103 bp, Artificial Sequence
  Synthetic Polynucleotide
taatacgactcactataggggatcaactggacctcttcctctccatcccaaacagaggagatgggatatggaggaagagaacctggcggcagcgcaaaagatg

SEQ ID NO: 83235 - DNA, 103 bp, Artificial Sequence
  Synthetic Polynucleotide
taatacgactcactatagggaaccatctgtttttccgcaccaaggtcactaacagaggagaagtgacatgggtgcggaaaacctggcggcagcgcaaaagatg

SEQ ID NO: 83236 - DNA, 103 bp, Artificial Sequence
  Synthetic Polynucleotide
taatacgactcactataggggccgcgatcaactggacctcttcctctccaaacagaggagatggagaatgagaggtccaaacctggcggcagcgcaaaagatg

SEQ ID NO: 83237 - DNA, 103 bp, Artificial Sequence
  Synthetic Polynucleotide
taatacgactcactataggggaacagccgcgatcaactggacctcttcctaacagaggagaaggaagatgtccagttgaaacctggcggcagcgcaaaagatg

SEQ ID NO: 83238 - DNA, 103 bp, Artificial Sequence
  Synthetic Polynucleotide
taatacgactcactatagggtcctggaacagccgcgatcaactggacctcaacagaggagagaggtcatgttgatcgcgaacctggcggcagcgcaaaagatg

SEQ ID NO: 83239 - DNA, 103 bp, Artificial Sequence
  Synthetic Polynucleotide
taatacgactcactatagggttctttcctggaacagccgcgatcaactggaacagaggagaccagttatgcgcggctgtaacctggcggcagcgcaaaagatg

SEQ ID NO: 83240 - DNA, 103 bp, Artificial Sequence
  Synthetic Polynucleotide
taatacgactcactatagggccacgttctttcctggaacagccgcgatcaaacagaggagatgatcgatgctgttccagaacctggcggcagcgcaaaagatg

SEQ ID NO: 83241 - DNA, 103 bp, Artificial Sequence
  Synthetic Polynucleotide
taatacgactcactataggggttgaccacgttctttcctggaacagccgcaacagaggagagcggctatgccaggaaagaacctggcggcagcgcaaaagatg

SEQ ID NO: 83242 - DNA, 103 bp, Artificial Sequence
  Synthetic Polynucleotide
taatacgactcactatagggtggacgttgaccacgttctttcctggaacaaacagaggagatgttccatgaaagaacgtaacctggcggcagcgcaaaagatg

SEQ ID NO: 83243 - DNA, 103 bp, Artificial Sequence
  Synthetic Polynucleotide
taatacgactcactatagggttgtctggacgttgaccacgttctttcctgaacagaggagacaggaaatgacgtggtcaaacctggcggcagcgcaaaagatg

SEQ ID NO: 83244 - DNA, 103 bp, Artificial Sequence
  Synthetic Polynucleotide
taatacgactcactatagggcggttttgtctggacgttgaccacgttcttaacagaggagaaagaacatggtcaacgtcaacctggcggcagcgcaaaagatg

SEQ ID NO: 83245 - DNA, 103 bp, Artificial Sequence
  Synthetic Polynucleotide
taatacgactcactatagggaagctcggttttgtctggacgttgaccacgaacagaggagacgtggtatgcgtccagacaacctggcggcagcgcaaaagatg

SEQ ID NO: 83246 - DNA, 103 bp, Artificial Sequence
  Synthetic Polynucleotide
taatacgactcactatagggggagcaaccatctgtttttccgcaccaaggaacagaggagaccttggatgggaaaaacaaacctggcggcagcgcaaaagatg

SEQ ID NO: 83247 - DNA, 103 bp, Artificial Sequence
  Synthetic Polynucleotide
taatacgactcactatagggtgaacaagctcggttttgtctggacgttgaaacagaggagatcaacgatgagacaaaacaacctggcggcagcgcaaaagatg

SEQ ID NO: 83248 - DNA, 103 bp, Artificial Sequence
  Synthetic Polynucleotide
taatacgactcactatagggcactttgaacaagctcggttttgtctggacaacagaggagagtccagatgaaaccgagcaacctggcggcagcgcaaaagatg

SEQ ID NO: 83249 - DNA, 103 bp, Artificial Sequence
  Synthetic Polynucleotide
taatacgactcactatagggttcctcactttgaacaagctcggttttgtcaacagaggagagacaaaatggagcttgttaacctggcggcagcgcaaaagatg

SEQ ID NO: 83250 - DNA, 103 bp, Artificial Sequence
  Synthetic Polynucleotide
taatacgactcactatagggccccattcctcactttgaacaagctcggttaacagaggagaaaccgaatgtgttcaaagaacctggcggcagcgcaaaagatg

SEQ ID NO: 83251 - DNA, 103 bp, Artificial Sequence
  Synthetic Polynucleotide
taatacgactcactatagggttctcccccattcctcactttgaacaagctaacagaggagaagcttgatgaaagtgaggaacctggcggcagcgcaaaagatg

SEQ ID NO: 83252 - DNA, 103 bp, Artificial Sequence
  Synthetic Polynucleotide
taatacgactcactatagggccgatttctcccccattcctcactttgaacaacagaggagagttcaaatggaggaatggaacctggcggcagcgcaaaagatg

SEQ ID NO: 83253 - DNA, 103 bp, Artificial Sequence
  Synthetic Polynucleotide
taatacgactcactatagggcagccccgatttctcccccattcctcacttaacagaggagaaagtgaatgatgggggagaacctggcggcagcgcaaaagatg

SEQ ID NO: 83254 - DNA, 103 bp, Artificial Sequence
  Synthetic Polynucleotide
taatacgactcactatagggagcgacagccccgatttctcccccattcctaacagaggagaaggaatatgggagaaatcaacctggcggcagcgcaaaagatg

SEQ ID NO: 83255 - DNA, 103 bp, Artificial Sequence
  Synthetic Polynucleotide
taatacgactcactatagggtcaagagcgacagccccgatttctcccccaaacagaggagatgggggatgaatcggggcaacctggcggcagcgcaaaagatg

SEQ ID NO: 83256 - DNA, 103 bp, Artificial Sequence
  Synthetic Polynucleotide
taatacgactcactataggggatagtcaagagcgacagccccgatttctcaacagaggagagagaaaatggggctgtcgaacctggcggcagcgcaaaagatg

SEQ ID NO: 83257 - DNA, 103 bp, Artificial Sequence
  Synthetic Polynucleotide
taatacgactcactatagggatttaggagcaaccatctgtttttccgcacaacagaggagagtgcggatgaacagatggaacctggcggcagcgcaaaagatg

SEQ ID NO: 83258 - DNA, 103 bp, Artificial Sequence
  Synthetic Polynucleotide
taatacgactcactatagggactcggatagtcaagagcgacagccccgataacagaggagaatcgggatggtcgctcttaacctggcggcagcgcaaaagatg

SEQ ID NO: 83259 - DNA, 103 bp, Artificial Sequence
  Synthetic Polynucleotide
taatacgactcactataggggtgccactcggatagtcaagagcgacagccaacagaggagaggctgtatgtcttgactaaacctggcggcagcgcaaaagatg

SEQ ID NO: 83260 - DNA, 103 bp, Artificial Sequence
  Synthetic Polynucleotide
taatacgactcactatagggctgaagtgccactcggatagtcaagagcgaaacagaggagatcgctcatgactatccgaaacctggcggcagcgcaaaagatg

SEQ ID NO: 83261 - DNA, 103 bp, Artificial Sequence
  Synthetic Polynucleotide
taatacgactcactatagggagatcctgaagtgccactcggatagtcaagaacagaggagacttgacatgccgagtggcaacctggcggcagcgcaaaagatg

SEQ ID NO: 83262 - DNA, 103 bp, Artificial Sequence
  Synthetic Polynucleotide
taatacgactcactatagggataggagatcctgaagtgccactcggatagaacagaggagactatccatgtggcacttcaacctggcggcagcgcaaaagatg

SEQ ID NO: 83263 - DNA, 103 bp, Artificial Sequence
  Synthetic Polynucleotide
taatacgactcactatagggtaacaataggagatcctgaagtgccactcgaacagaggagacgagtgatgcttcaggataacctggcggcagcgcaaaagatg

SEQ ID NO: 83264 - DNA, 103 bp, Artificial Sequence
  Synthetic Polynucleotide
taatacgactcactatagggcctgttaacaataggagatcctgaagtgccaacagaggagaggcactatgggatctcctaacctggcggcagcgcaaaagatg

SEQ ID NO: 83265 - DNA, 103 bp, Artificial Sequence
  Synthetic Polynucleotide
taatacgactcactatagggccgttcctgttaacaataggagatcctgaaaacagaggagattcaggatgtcctattgtaacctggcggcagcgcaaaagatg

SEQ ID NO: 83266 - DNA, 103 bp, Artificial Sequence
  Synthetic Polynucleotide
taatacgactcactatagggcctctccgttcctgttaacaataggagatcaacagaggagagatctcatgttgttaacaaacctggcggcagcgcaaaagatg

SEQ ID NO: 83267 - DNA, 103 bp, Artificial Sequence
  Synthetic Polynucleotide
taatacgactcactatagggaatcacctctccgttcctgttaacaataggaacagaggagacctattatgaacaggaacaacctggcggcagcgcaaaagatg

SEQ ID NO: 83268 - DNA, 103 bp, Artificial Sequence
  Synthetic Polynucleotide
taatacgactcactatagggtcgcagtctgattcacacagatcaacaactaacagaggagaagttgtatgtctgtgtgaaacctggcggcagcgcaaaagatg

SEQ ID NO: 83269 - DNA, 103 bp, Artificial Sequence
  Synthetic Polynucleotide
taatacgactcactatagggaaacctgttgatactgttgctagctttcgcaacagaggagagcgaaaatgagcaacagtaacctggcggcagcgcaaaagatg

SEQ ID NO: 83270 - DNA, 103 bp, Artificial Sequence
  Synthetic Polynucleotide
taatacgactcactatagggcgtttctgtccaagtacatatagtatgcacaacagaggagagtgcatatgatatgtactaacctggcggcagcgcaaaagatg

SEQ ID NO: 83271 - DNA, 103 bp, Artificial Sequence
  Synthetic Polynucleotide
taatacgactcactataggggagatcctgaagttcctgctgggtaatccaaacagaggagatggattatgcagcaggaaaacctggcggcagcgcaaaagatg

SEQ ID NO: 83272 - DNA, 103 bp, Artificial Sequence
  Synthetic Polynucleotide
taatacgactcactataggggattggagatcctgaagttcctgctgggtaaacagaggagatacccaatgggaacttcaaacctggcggcagcgcaaaagatg

SEQ ID NO: 83273 - DNA, 103 bp, Artificial Sequence
  Synthetic Polynucleotide
taatacgactcactatagggtctaggattggagatcctgaagttcctgctaacagaggagaagcaggatgttcaggatcaacctggcggcagcgcaaaagatg

SEQ ID NO: 83274 - DNA, 103 bp, Artificial Sequence
  Synthetic Polynucleotide
taatacgactcactatagggacttgtctaggattggagatcctgaagttcaacagaggagagaacttatggatctccaaaacctggcggcagcgcaaaagatg

SEQ ID NO: 83275 - DNA, 103 bp, Artificial Sequence
  Synthetic Polynucleotide
taatacgactcactatagggcccacacttgtctaggattggagatcctgaaacagaggagatcaggaatgccaatcctaaacctggcggcagcgcaaaagatg

SEQ ID NO: 83276 - DNA, 103 bp, Artificial Sequence
  Synthetic Polynucleotide
taatacgactcactatagggactctcccacacttgtctaggattggagataacagaggagaatctccatgcctagacaaaacctggcggcagcgcaaaagatg

SEQ ID NO: 83277 - DNA, 103 bp, Artificial Sequence
  Synthetic Polynucleotide
taatacgactcactatagggctatcactctcccacacttgtctaggattgaacagaggagacaatccatgacaagtgtgaacctggcggcagcgcaaaagatg

SEQ ID NO: 83278 - DNA, 103 bp, Artificial Sequence
  Synthetic Polynucleotide
taatacgactcactatagggaagtcctatcactctcccacacttgtctagaacagaggagactagacatgtgtgggagaaacctggcggcagcgcaaaagatg

SEQ ID NO: 83279 - DNA, 103 bp, Artificial Sequence
  Synthetic Polynucleotide
taatacgactcactatagggccataaagtcctatcactctcccacacttgaacagaggagacaagtgatggagagtgataacctggcggcagcgcaaaagatg

SEQ ID NO: 83280 - DNA, 103 bp, Artificial Sequence
  Synthetic Polynucleotide
taatacgactcactatagggcattgccataaagtcctatcactctcccacaacagaggagagtgggaatgtgataggacaacctggcggcagcgcaaaagatg

SEQ ID NO: 83281 - DNA, 103 bp, Artificial Sequence
  Synthetic Polynucleotide
taatacgactcactatagggagcatcgtttctgtccaagtacatatagtaaacagaggagatactatatgtacttggacaacctggcggcagcgcaaaagatg

SEQ ID NO: 83282 - DNA, 103 bp, Artificial Sequence
  Synthetic Polynucleotide
taatacgactcactataggggaccccattgccataaagtcctatcactctaacagaggagaagagtgatgggactttataacctggcggcagcgcaaaagatg

SEQ ID NO: 83283 - DNA, 103 bp, Artificial Sequence
  Synthetic Polynucleotide
taatacgactcactatagggatcacgaccccattgccataaagtcctatcaacagaggagagataggatgttatggcaaaacctggcggcagcgcaaaagatg

SEQ ID NO: 83284 - DNA, 103 bp, Artificial Sequence
  Synthetic Polynucleotide
taatacgactcactatagggttttgatcacgaccccattgccataaagtcaacagaggagagactttatggcaatggggaacctggcggcagcgcaaaagatg

SEQ ID NO: 83285 - DNA, 103 bp, Artificial Sequence
  Synthetic Polynucleotide
taatacgactcactatagggcccatttttgatcacgaccccattgccataaacagaggagatatggcatgggggtcgtgaacctggcggcagcgcaaaagatg

SEQ ID NO: 83286 - DNA, 103 bp, Artificial Sequence
  Synthetic Polynucleotide
taatacgactcactatagggtaactcccatttttgatcacgaccccattgaacagaggagacaatggatgcgtgatcaaaacctggcggcagcgcaaaagatg

SEQ ID NO: 83287 - DNA, 103 bp, Artificial Sequence
  Synthetic Polynucleotide
taatacgactcactatagggtaacataactcccatttttgatcacgacccaacagaggagagggtcgatgtcaaaaatgaacctggcggcagcgcaaaagatg

SEQ ID NO: 83288 - DNA, 103 bp, Artificial Sequence
  Synthetic Polynucleotide
taatacgactcactatagggggcactaacataactcccatttttgatcacaacagaggagagtgatcatgaatgggagtaacctggcggcagcgcaaaagatg

SEQ ID NO: 83289 - DNA, 103 bp, Artificial Sequence
  Synthetic Polynucleotide
taatacgactcactataggggtgatggcactaacataactcccatttttgaacagaggagacaaaaaatggagttatgtaacctggcggcagcgcaaaagatg

SEQ ID NO: 83290 - DNA, 103 bp, Artificial Sequence
  Synthetic Polynucleotide
taatacgactcactatagggcttgggtgatggcactaacataactcccataacagaggagaatgggaatgatgttagtgaacctggcggcagcgcaaaagatg

SEQ ID NO: 83291 - DNA, 103 bp, Artificial Sequence
  Synthetic Polynucleotide
taatacgactcactatagggcctcccttgggtgatggcactaacataactaacagaggagaagttatatgagtgccatcaacctggcggcagcgcaaaagatg

SEQ ID NO: 83292 - DNA, 103 bp, Artificial Sequence
  Synthetic Polynucleotide
taatacgactcactatagggtccccagcatcgtttctgtccaagtacataaacagaggagatatgtaatgggacagaaaaacctggcggcagcgcaaaagatg

SEQ ID NO: 83293 - DNA, 103 bp, Artificial Sequence
  Synthetic Polynucleotide
taatacgactcactatagggtccctcctcccttgggtgatggcactaacaaacagaggagatgttagatgcatcacccaaacctggcggcagcgcaaaagatg

SEQ ID NO: 83294 - DNA, 103 bp, Artificial Sequence
  Synthetic Polynucleotide
taatacgactcactatagggcttcctccctcctcccttgggtgatggcacaacagaggagagtgccaatgcccaagggaaacctggcggcagcgcaaaagatg

SEQ ID NO: 83295 - DNA, 103 bp, Artificial Sequence
  Synthetic Polynucleotide
taatacgactcactatagggagtctcttcctccctcctcccttgggtgataacagaggagaatcaccatggggaggaggaacctggcggcagcgcaaaagatg

SEQ ID NO: 83296 - DNA, 103 bp, Artificial Sequence
  Synthetic Polynucleotide
taatacgactcactatagggacaggagtctcttcctccctcctcccttggaacagaggagaccaaggatggagggaggaaacctggcggcagcgcaaaagatg

SEQ ID NO: 83297 - DNA, 103 bp, Artificial Sequence
  Synthetic Polynucleotide
taatacgactcactatagggactcaacaggagtctcttcctccctcctccaacagaggagaggaggaatgaggaagagaaacctggcggcagcgcaaaagatg

SEQ ID NO: 83298 - DNA, 103 bp, Artificial Sequence
  Synthetic Polynucleotide
taatacgactcactataggggaagcactcaacaggagtctcttcctccctaacagaggagaagggagatggagactcctaacctggcggcagcgcaaaagatg

SEQ ID NO: 83299 - DNA, 103 bp, Artificial Sequence
  Synthetic Polynucleotide
taatacgactcactatagggggctcgaagcactcaacaggagtctcttccaacagaggagaggaagaatgtcctgttgaaacctggcggcagcgcaaaagatg

SEQ ID NO: 83300 - DNA, 103 bp, Artificial Sequence
  Synthetic Polynucleotide
taatacgactcactatagggtcgaaggctcgaagcactcaacaggagtctaacagaggagaagactcatgttgagtgctaacctggcggcagcgcaaaagatg

SEQ ID NO: 83301 - DNA, 103 bp, Artificial Sequence
  Synthetic Polynucleotide
taatacgactcactatagggcagcatcgaaggctcgaagcactcaacaggaacagaggagacctgttatgtgcttcgagaacctggcggcagcgcaaaagatg

SEQ ID NO: 83302 - DNA, 103 bp, Artificial Sequence
  Synthetic Polynucleotide
taatacgactcactatagggttcttcagcatcgaaggctcgaagcactcaaacagaggagatgagtgatgcgagccttcaacctggcggcagcgcaaaagatg

SEQ ID NO: 83303 - DNA, 103 bp, Artificial Sequence
  Synthetic Polynucleotide
taatacgactcactatagggtggcctccccagcatcgtttctgtccaagtaacagaggagaacttggatggaaacgatgaacctggcggcagcgcaaaagatg

SEQ ID NO: 83304 - DNA, 103 bp, Artificial Sequence
  Synthetic Polynucleotide
taatacgactcactataggggcttcttcttcagcatcgaaggctcgaagcaacagaggagagcttcgatgcttcgatgcaacctggcggcagcgcaaaagatg

SEQ ID NO: 83305 - DNA, 103 bp, Artificial Sequence
  Synthetic Polynucleotide
taatacgactcactatagggtagctgcttcttcttcagcatcgaaggctcaacagaggagagagcctatgatgctgaagaacctggcggcagcgcaaaagatg

SEQ ID NO: 83306 - DNA, 103 bp, Artificial Sequence
  Synthetic Polynucleotide
taatacgactcactatagggacagttagctgcttcttcttcagcatcgaaaacagaggagattcgatatggaagaagaaaacctggcggcagcgcaaaagatg

SEQ ID NO: 83307 - DNA, 103 bp, Artificial Sequence
  Synthetic Polynucleotide
taatacgactcactatagggctaagacagttagctgcttcttcttcagcaaacagaggagatgctgaatgagaagcagcaacctggcggcagcgcaaaagatg

SEQ ID NO: 83308 - DNA, 103 bp, Artificial Sequence
  Synthetic Polynucleotide
taatacgactcactatagggcaagtctaagacagttagctgcttcttcttaacagaggagaaagaagatgcagctaactaacctggcggcagcgcaaaagatg

SEQ ID NO: 83309 - DNA, 103 bp, Artificial Sequence
  Synthetic Polynucleotide
taatacgactcactatagggggatgcaagtctaagacagttagctgcttcaacagaggagagaagcaatgaactgtcttaacctggcggcagcgcaaaagatg

SEQ ID NO: 83310 - DNA, 103 bp, Artificial Sequence
  Synthetic Polynucleotide
taatacgactcactatagggctccaggatgcaagtctaagacagttagctaacagaggagaagctaaatgtcttagactaacctggcggcagcgcaaaagatg

SEQ ID NO: 83311 - DNA, 103 bp, Artificial Sequence
  Synthetic Polynucleotide
taatacgactcactatagggcccagctccaggatgcaagtctaagacagtaacagaggagaactgtcatggacttgcataacctggcggcagcgcaaaagatg

SEQ ID NO: 83312 - DNA, 103 bp, Artificial Sequence
  Synthetic Polynucleotide
taatacgactcactataggggttttcccagctccaggatgcaagtctaagaacagaggagacttagaatggcatcctggaacctggcggcagcgcaaaagatg

SEQ ID NO: 83313 - DNA, 103 bp, Artificial Sequence
  Synthetic Polynucleotide
taatacgactcactatagggtcctggttttcccagctccaggatgcaagtaacagaggagaacttgcatgctggagctgaacctggcggcagcgcaaaagatg

SEQ ID NO: 83314 - DNA, 103 bp, Artificial Sequence
  Synthetic Polynucleotide
taatacgactcactatagggagatatggcctccccagcatcgtttctgtcaacagaggagagacagaatggatgctgggaacctggcggcagcgcaaaagatg

SEQ ID NO: 83315 - DNA, 103 bp, Artificial Sequence
  Synthetic Polynucleotide
taatacgactcactatagggaactctcctggttttcccagctccaggatgaacagaggagacatcctatggctgggaaaaacctggcggcagcgcaaaagatg

SEQ ID NO: 83316 - DNA, 103 bp, Artificial Sequence
  Synthetic Polynucleotide
taatacgactcactatagggggaagaactctcctggttttcccagctccaaacagaggagatggagcatggaaaaccagaacctggcggcagcgcaaaagatg

SEQ ID NO: 83317 - DNA, 103 bp, Artificial Sequence
  Synthetic Polynucleotide
taatacgactcactatagggtttcaggaagaactctcctggttttcccagaacagaggagactgggaatgccaggagagaacctggcggcagcgcaaaagatg

SEQ ID NO: 83318 - DNA, 103 bp, Artificial Sequence
  Synthetic Polynucleotide
taatacgactcactataggggactatttcaggaagaactctcctggttttaacagaggagaaaaaccatgagagttcttaacctggcggcagcgcaaaagatg

SEQ ID NO: 83319 - DNA, 103 bp, Artificial Sequence
  Synthetic Polynucleotide
taatacgactcactatagggtcacggactatttcaggaagaactctcctgaacagaggagacaggagatgtcttcctgaaacctggcggcagcgcaaaagatg

SEQ ID NO: 83320 - DNA, 103 bp, Artificial Sequence
  Synthetic Polynucleotide
taatacgactcactatagggtggcttcacggactatttcaggaagaactcaacagaggagagagttcatgctgaaatagaacctggcggcagcgcaaaagatg

SEQ ID NO: 83321 - DNA, 103 bp, Artificial Sequence
  Synthetic Polynucleotide
taatacgactcactatagggttttatggcttcacggactatttcaggaagaacagaggagacttcctatgatagtccgtaacctggcggcagcgcaaaagatg

SEQ ID NO: 83322 - DNA, 103 bp, Artificial Sequence
  Synthetic Polynucleotide
taatacgactcactatagggcttgtttttatggcttcacggactatttcaaacagaggagatgaaatatgccgtgaagcaacctggcggcagcgcaaaagatg

SEQ ID NO: 83323 - DNA, 103 bp, Artificial Sequence
  Synthetic Polynucleotide
taatacgactcactatagggggagtcttgtttttatggcttcacggactaaacagaggagatagtccatgaagccataaaacctggcggcagcgcaaaagatg

SEQ ID NO: 83324 - DNA, 103 bp, Artificial Sequence
  Synthetic Polynucleotide
taatacgactcactatagggagtacggagtcttgtttttatggcttcacgaacagaggagacgtgaaatgataaaaacaaacctggcggcagcgcaaaagatg

SEQ ID NO: 83325 - DNA, 103 bp, Artificial Sequence
  Synthetic Polynucleotide
taatacgactcactatagggggaaaagatatggcctccccagcatcgtttaacagaggagaaaacgaatgtggggaggcaacctggcggcagcgcaaaagatg

SEQ ID NO: 83326 - DNA, 103 bp, Artificial Sequence
  Synthetic Polynucleotide
taatacgactcactatagggatcacagtacggagtcttgtttttatggctaacagaggagaagccatatgaacaagactaacctggcggcagcgcaaaagatg

SEQ ID NO: 83327 - DNA, 103 bp, Artificial Sequence
  Synthetic Polynucleotide
taatacgactcactatagggctaagatcacagtacggagtcttgtttttaaacagaggagataaaaaatggactccgtaaacctggcggcagcgcaaaagatg

SEQ ID NO: 83328 - DNA, 103 bp, Artificial Sequence
  Synthetic Polynucleotide
taatacgactcactatagggtggagctaagatcacagtacggagtcttgtaacagaggagaacaagaatgcgtactgtgaacctggcggcagcgcaaaagatg

SEQ ID NO: 83329 - DNA, 103 bp, Artificial Sequence
  Synthetic Polynucleotide
taatacgactcactatagggctggttggagctaagatcacagtacggagtaacagaggagaactccgatgtgtgatcttaacctggcggcagcgcaaaagatg

SEQ ID NO: 83330 - DNA, 103 bp, Artificial Sequence
  Synthetic Polynucleotide
taatacgactcactatagggcaaccctggttggagctaagatcacagtacaacagaggagagtactgatgtcttagctcaacctggcggcagcgcaaaagatg

SEQ ID NO: 83331 - DNA, 103 bp, Artificial Sequence
  Synthetic Polynucleotide
taatacgactcactatagggagcgacaaccctggttggagctaagatcacaacagaggagagtgatcatggctccaaccaacctggcggcagcgcaaaagatg

SEQ ID NO: 83332 - DNA, 103 bp, Artificial Sequence
  Synthetic Polynucleotide
taatacgactcactatagggtcagcagcgacaaccctggttggagctaagaacagaggagacttagcatgaaccagggtaacctggcggcagcgcaaaagatg

SEQ ID NO: 83333 - DNA, 103 bp, Artificial Sequence
  Synthetic Polynucleotide
taatacgactcactatagggccatttcagcagcgacaaccctggttggagaacagaggagactccaaatggggttgtcgaacctggcggcagcgcaaaagatg

SEQ ID NO: 83334 - DNA, 103 bp, Artificial Sequence
  Synthetic Polynucleotide
taatacgactcactatagggttcctccatttcagcagcgacaaccctggtaacagaggagaaccaggatggtcgctgctaacctggcggcagcgcaaaagatg

SEQ ID NO: 83335 - DNA, 103 bp, Artificial Sequence
  Synthetic Polynucleotide
taatacgactcactatagggagggcttcctccatttcagcagcgacaaccaacagaggagaggttgtatgtgctgaaataacctggcggcagcgcaaaagatg

SEQ ID NO: 83336 - DNA, 103 bp, Artificial Sequence
  Synthetic Polynucleotide
taatacgactcactatagggtggttggaaaagatatggcctccccagcataacagaggagaatgctgatgaggccatataacctggcggcagcgcaaaagatg

SEQ ID NO: 83337 - DNA, 103 bp, Artificial Sequence
  Synthetic Polynucleotide
taatacgactcactatagggctctaagggcttcctccatttcagcagcgaaacagaggagatcgctgatgaaatggaggaacctggcggcagcgcaaaagatg

SEQ ID NO: 83338 - DNA, 103 bp, Artificial Sequence
  Synthetic Polynucleotide
taatacgactcactatagggaagccctctaagggcttcctccatttcagcaacagaggagagctgaaatggaggaagccaacctggcggcagcgcaaaagatg

SEQ ID NO: 83339 - DNA, 103 bp, Artificial Sequence
  Synthetic Polynucleotide
taatacgactcactatagggactggaagccctctaagggcttcctccattaacagaggagaaatggaatgagcccttagaacctggcggcagcgcaaaagatg

SEQ ID NO: 83340 - DNA, 103 bp, Artificial Sequence
  Synthetic Polynucleotide
taatacgactcactatagggaacgcactggaagccctctaagggcttcctaacagaggagaaggaagatgttagagggcaacctggcggcagcgcaaaagatg

SEQ ID NO: 83341 - DNA, 103 bp, Artificial Sequence
  Synthetic Polynucleotide
taatacgactcactatagggcatataacgcactggaagccctctaagggcaacagaggagagcccttatggggcttccaaacctggcggcagcgcaaaagatg

SEQ ID NO: 83342 - DNA, 103 bp, Artificial Sequence
  Synthetic Polynucleotide
taatacgactcactataggggttgtcatataacgcactggaagccctctaaacagaggagatagaggatgtccagtgcgaacctggcggcagcgcaaaagatg

SEQ ID NO: 83343 - DNA, 103 bp, Artificial Sequence
  Synthetic Polynucleotide
taatacgactcactatagggctgctgttgtcatataacgcactggaagccaacagaggagaggcttcatgtgcgttataaacctggcggcagcgcaaaagatg

SEQ ID NO: 83344 - DNA, 103 bp, Artificial Sequence
  Synthetic Polynucleotide
taatacgactcactatagggattgactgctgttgtcatataacgcactggaacagaggagaccagtgatgtatatgacaaacctggcggcagcgcaaaagatg

SEQ ID NO: 83345 - DNA, 103 bp, Artificial Sequence
  Synthetic Polynucleotide
taatacgactcactataggggtgacattgactgctgttgtcatataacgcaacagaggagagcgttaatggacaacagcaacctggcggcagcgcaaaagatg

SEQ ID NO: 83346 - DNA, 103 bp, Artificial Sequence
  Synthetic Polynucleotide
taatacgactcactatagggagtgggtgacattgactgctgttgtcatataacagaggagaatatgaatgcagcagtcaaacctggcggcagcgcaaaagatg

SEQ ID NO: 83347 - DNA, 103 bp, Artificial Sequence
  Synthetic Polynucleotide
taatacgactcactatagggcaatgtggttggaaaagatatggcctccccaacagaggagaggggagatgatatcttttaacctggcggcagcgcaaaagatg

SEQ ID NO: 83348 - DNA, 103 bp, Artificial Sequence
  Synthetic Polynucleotide
taatacgactcactatagggtccagagtgggtgacattgactgctgttgtaacagaggagaacaacaatggtcaatgtcaacctggcggcagcgcaaaagatg

SEQ ID NO: 83349 - DNA, 103 bp, Artificial Sequence
  Synthetic Polynucleotide
taatacgactcactatagggtctgttccagagtgggtgacattgactgctaacagaggagaagcagtatgtgtcacccaaacctggcggcagcgcaaaagatg

SEQ ID NO: 83350 - DNA, 103 bp, Artificial Sequence
  Synthetic Polynucleotide
taatacgactcactatagggcgatttctgttccagagtgggtgacattgaaacagaggagatcaatgatgcccactctgaacctggcggcagcgcaaaagatg

SEQ ID NO: 83351 - DNA, 103 bp, Artificial Sequence
  Synthetic Polynucleotide
taatacgactcactataggggtcgacgatttctgttccagagtgggtgacaacagaggagagtcaccatgtctggaacaaacctggcggcagcgcaaaagatg

SEQ ID NO: 83352 - DNA, 103 bp, Artificial Sequence
  Synthetic Polynucleotide
taatacgactcactatagggattaagtcgacgatttctgttccagagtggaacagaggagaccactcatgaacagaaataacctggcggcagcgcaaaagatg

SEQ ID NO: 83353 - DNA, 103 bp, Artificial Sequence
  Synthetic Polynucleotide
taatacgactcactatagggggcacattaagtcgacgatttctgttccagaacagaggagactggaaatgaaatcgtcgaacctggcggcagcgcaaaagatg

SEQ ID NO: 83354 - DNA, 103 bp, Artificial Sequence
  Synthetic Polynucleotide
taatacgactcactatagggggcatggcacattaagtcgacgatttctgtaacagaggagaacagaaatggtcgacttaaacctggcggcagcgcaaaagatg

SEQ ID NO: 83355 - DNA, 103 bp, Artificial Sequence
  Synthetic Polynucleotide
taatacgactcactatagggaaggtggcatggcacattaagtcgacgattaacagaggagaaatcgtatgcttaatgtgaacctggcggcagcgcaaaagatg

SEQ ID NO: 83356 - DNA, 103 bp, Artificial Sequence
  Synthetic Polynucleotide
taatacgactcactatagggaagtgaaggtggcatggcacattaagtcgaaacagaggagatcgactatgtgtgccatgaacctggcggcagcgcaaaagatg

SEQ ID NO: 83357 - DNA, 103 bp, Artificial Sequence
  Synthetic Polynucleotide
taatacgactcactatagggacgtgaagtgaaggtggcatggcacattaaaacagaggagattaatgatgcatgccaccaacctggcggcagcgcaaaagatg

SEQ ID NO: 83358 - DNA, 103 bp, Artificial Sequence
  Synthetic Polynucleotide
taatacgactcactatagggatccccaatgtggttggaaaagatatggccaacagaggagaggccatatgttttccaacaacctggcggcagcgcaaaagatg

SEQ ID NO: 83359 - DNA, 103 bp, Artificial Sequence
  Synthetic Polynucleotide
taatacgactcactatagggagtagacgtgaagtgaaggtggcatggcacaacagaggagagtgccaatgcaccttcacaacctggcggcagcgcaaaagatg

SEQ ID NO: 83360 - DNA, 103 bp, Artificial Sequence
  Synthetic Polynucleotide
taatacgactcactataggggctgtagtagacgtgaagtgaaggtggcataacagaggagaatgccaatgtcacttcacaacctggcggcagcgcaaaagatg

SEQ ID NO: 83361 - DNA, 103 bp, Artificial Sequence
  Synthetic Polynucleotide
taatacgactcactataggggattggctgtagtagacgtgaagtgaaggtaacagaggagaaccttcatgtcacgtctaaacctggcggcagcgcaaaagatg

SEQ ID NO: 83362 - DNA, 103 bp, Artificial Sequence
  Synthetic Polynucleotide
taatacgactcactatagggactctgattggctgtagtagacgtgaagtgaacagaggagacacttcatgtctactacaaacctggcggcagcgcaaaagatg

SEQ ID NO: 83363 - DNA, 103 bp, Artificial Sequence
  Synthetic Polynucleotide
taatacgactcactatagggtggggactctgattggctgtagtagacgtgaacagaggagacacgtcatgtacagccaaaacctggcggcagcgcaaaagatg

SEQ ID NO: 83364 - DNA, 103 bp, Artificial Sequence
  Synthetic Polynucleotide
taatacgactcactatagggatagttggggactctgattggctgtagtagaacagaggagactactaatgccaatcagaaacctggcggcagcgcaaaagatg

SEQ ID NO: 83365 - DNA, 103 bp, Artificial Sequence
  Synthetic Polynucleotide
taatacgactcactatagggagattatagttggggactctgattggctgtaacagaggagaacagccatgcagagtcccaacctggcggcagcgcaaaagatg

SEQ ID NO: 83366 - DNA, 103 bp, Artificial Sequence
  Synthetic Polynucleotide
taatacgactcactatagggtatacagattatagttggggactctgattgaacagaggagacaatcaatgtccccaactaacctggcggcagcgcaaaagatg

SEQ ID NO: 83367 - DNA, 103 bp, Artificial Sequence
  Synthetic Polynucleotide
taatacgactcactatagggcataatatacagattatagttggggactctaacagaggagaagagtcatgaactataataacctggcggcagcgcaaaagatg

SEQ ID NO: 83368 - DNA, 103 bp, Artificial Sequence
  Synthetic Polynucleotide
taatacgactcactatagggtcatccataatatacagattatagttggggaacagaggagaccccaaatgtaatctgtaaacctggcggcagcgcaaaagatg

SEQ ID NO: 83369 - DNA, 103 bp, Artificial Sequence
  Synthetic Polynucleotide
taatacgactcactatagggtattcatccccaatgtggttggaaaagataaacagaggagatatcttatgcaaccacataacctggcggcagcgcaaaagatg

SEQ ID NO: 83370 - DNA, 103 bp, Artificial Sequence
  Synthetic Polynucleotide
taatacgactcactataggggggcctcatccataatatacagattatagtaacagaggagaactataatgtgtatattaaacctggcggcagcgcaaaagatg

SEQ ID NO: 83371 - DNA, 103 bp, Artificial Sequence
  Synthetic Polynucleotide
taatacgactcactataggggaagtgggcctcatccataatatacagattaacagaggagaaatctgatgattatggataacctggcggcagcgcaaaagatg

SEQ ID NO: 83372 - DNA, 103 bp, Artificial Sequence
  Synthetic Polynucleotide
taatacgactcactatagggtctgtgaagtgggcctcatccataatatacaacagaggagagtatatatgggatgaggcaacctggcggcagcgcaaaagatg

SEQ ID NO: 83373 - DNA, 103 bp, Artificial Sequence
  Synthetic Polynucleotide
taatacgactcactatagggagggatctgtgaagtgggcctcatccataaaacagaggagattatggatgaggcccactaacctggcggcagcgcaaaagatg

SEQ ID NO: 83374 - DNA, 103 bp, Artificial Sequence
  Synthetic Polynucleotide
taatacgactcactatagggacttgagggatctgtgaagtgggcctcatcaacagaggagagatgagatgcacttcacaaacctggcggcagcgcaaaagatg

SEQ ID NO: 83375 - DNA, 103 bp, Artificial Sequence
  Synthetic Polynucleotide
taatacgactcactataggggctatacttgagggatctgtgaagtgggccaacagaggagaggcccaatgcacagatccaacctggcggcagcgcaaaagatg

SEQ ID NO: 83376 - DNA, 103 bp, Artificial Sequence
  Synthetic Polynucleotide
taatacgactcactatagggttgctgctatacttgagggatctgtgaagtaacagaggagaacttcaatgatccctcaaaacctggcggcagcgcaaaagatg

SEQ ID NO: 83377 - DNA, 103 bp, Artificial Sequence
  Synthetic Polynucleotide
taatacgactcactatagggtcctcttgctgctatacttgagggatctgtaacagaggagaacagatatgtcaagtataaacctggcggcagcgcaaaagatg

SEQ ID NO: 83378 - DNA, 103 bp, Artificial Sequence
  Synthetic Polynucleotide
taatacgactcactatagggatgtatcctcttgctgctatacttgagggaaacagaggagatccctcatgtatagcagcaacctggcggcagcgcaaaagatg

SEQ ID NO: 83379 - DNA, 103 bp, Artificial Sequence
  Synthetic Polynucleotide
taatacgactcactatagggttgaaatgtatcctcttgctgctatacttgaacagaggagacaagtaatgcagcaagagaacctggcggcagcgcaaaagatg

SEQ ID NO: 83380 - DNA, 103 bp, Artificial Sequence
  Synthetic Polynucleotide
taatacgactcactatagggaaataaaacctgttgatactgttgctagctaacagaggagaagctagatgcagtatcaaaacctggcggcagcgcaaaagatg

SEQ ID NO: 83381 - DNA, 103 bp, Artificial Sequence
  Synthetic Polynucleotide
taatacgactcactatagggacacttattcatccccaatgtggttggaaaaacagaggagatttccaatgacattggggaacctggcggcagcgcaaaagatg

SEQ ID NO: 83382 - DNA, 103 bp, Artificial Sequence
  Synthetic Polynucleotide
taatacgactcactatagggccttgttgaaatgtatcctcttgctgctataacagaggagaatagcaatgagaggatacaacctggcggcagcgcaaaagatg

SEQ ID NO: 83383 - DNA, 103 bp, Artificial Sequence
  Synthetic Polynucleotide
taatacgactcactatagggtcaacccttgttgaaatgtatcctcttgctaacagaggagaagcaagatgatacatttcaacctggcggcagcgcaaaagatg

SEQ ID NO: 83384 - DNA, 103 bp, Artificial Sequence
  Synthetic Polynucleotide
taatacgactcactatagggccatctcaacccttgttgaaatgtatcctcaacagaggagagaggatatgtttcaacaaaacctggcggcagcgcaaaagatg

SEQ ID NO: 83385 - DNA, 103 bp, Artificial Sequence
  Synthetic Polynucleotide
taatacgactcactatagggctcgcccatctcaacccttgttgaaatgtaaacagaggagatacattatgacaagggttaacctggcggcagcgcaaaagatg

SEQ ID NO: 83386 - DNA, 103 bp, Artificial Sequence
  Synthetic Polynucleotide
taatacgactcactataggggccgcctcgcccatctcaacccttgttgaaaacagaggagattcaacatgggttgagataacctggcggcagcgcaaaagatg

SEQ ID NO: 83387 - DNA, 103 bp, Artificial Sequence
  Synthetic Polynucleotide
taatacgactcactatagggtggcagccgcctcgcccatctcaacccttgaacagaggagacaagggatgagatgggcgaacctggcggcagcgcaaaagatg

SEQ ID NO: 83388 - DNA, 103 bp, Artificial Sequence
  Synthetic Polynucleotide
taatacgactcactataggggaagatggcagccgcctcgcccatctcaacaacagaggagagttgagatgggcgaggcgaacctggcggcagcgcaaaagatg

SEQ ID NO: 83389 - DNA, 103 bp, Artificial Sequence
  Synthetic Polynucleotide
taatacgactcactataggggtcatgaagatggcagccgcctcgcccatcaacagaggagagatgggatgggcggctgcaacctggcggcagcgcaaaagatg

SEQ ID NO: 83390 - DNA, 103 bp, Artificial Sequence
  Synthetic Polynucleotide
taatacgactcactatagggtggcggtcatgaagatggcagccgcctcgcaacagaggagagcgaggatgctgccatctaacctggcggcagcgcaaaagatg

SEQ ID NO: 83391 - DNA, 103 bp, Artificial Sequence
  Synthetic Polynucleotide
taatacgactcactatagggtggcgtggcggtcatgaagatggcagccgcaacagaggagagcggctatgatcttcatgaacctggcggcagcgcaaaagatg

SEQ ID NO: 83392 - DNA, 103 bp, Artificial Sequence
  Synthetic Polynucleotide
taatacgactcactatagggatataacacttattcatccccaatgtggttaacagaggagaaaccacatgggggatgaaaacctggcggcagcgcaaaagatg

SEQ ID NO: 83393 - DNA, 103 bp, Artificial Sequence
  Synthetic Polynucleotide
taatacgactcactatagggcctggtggcgtggcggtcatgaagatggcaaacagaggagatgccatatgcatgaccgcaacctggcggcagcgcaaaagatg

SEQ ID NO: 83394 - DNA, 103 bp, Artificial Sequence
  Synthetic Polynucleotide
taatacgactcactataggggggttcctggtggcgtggcggtcatgaagaaacagaggagatcttcaatgccgccacgcaacctggcggcagcgcaaaagatg

SEQ ID NO: 83395 - DNA, 103 bp, Artificial Sequence
  Synthetic Polynucleotide
taatacgactcactataggggtcacgggttcctggtggcgtggcggtcataacagaggagaatgaccatgacgccaccaaacctggcggcagcgcaaaagatg

SEQ ID NO: 83396 - DNA, 103 bp, Artificial Sequence
  Synthetic Polynucleotide
taatacgactcactatagggaatgcgtcacgggttcctggtggcgtggcgaacagaggagacgccacatgaccaggaacaacctggcggcagcgcaaaagatg

SEQ ID NO: 83397 - DNA, 103 bp, Artificial Sequence
  Synthetic Polynucleotide
taatacgactcactatagggccggaaatgcgtcacgggttcctggtggcgaacagaggagacgccacatggaacccgtgaacctggcggcagcgcaaaagatg

SEQ ID NO: 83398 - DNA, 103 bp, Artificial Sequence
  Synthetic Polynucleotide
taatacgactcactatagggggagtccggaaatgcgtcacgggttcctggaacagaggagaccaggaatgcgtgacgcaaacctggcggcagcgcaaaagatg

SEQ ID NO: 83399 - DNA, 103 bp, Artificial Sequence
  Synthetic Polynucleotide
taatacgactcactataggggagttggagtccggaaatgcgtcacgggttaacagaggagaaacccgatgcgcatttccaacctggcggcagcgcaaaagatg

SEQ ID NO: 83400 - DNA, 103 bp, Artificial Sequence
  Synthetic Polynucleotide
taatacgactcactatagggttggtgagttggagtccggaaatgcgtcacaacagaggagagtgacgatgttccggactaacctggcggcagcgcaaaagatg

SEQ ID NO: 83401 - DNA, 103 bp, Artificial Sequence
  Synthetic Polynucleotide
taatacgactcactatagggcataattggtgagttggagtccggaaatgcaacagaggagagcatttatggactccaacaacctggcggcagcgcaaaagatg

SEQ ID NO: 83402 - DNA, 103 bp, Artificial Sequence
  Synthetic Polynucleotide
taatacgactcactataggggtgtccataattggtgagttggagtccggaaacagaggagatccggaatgcaactcaccaacctggcggcagcgcaaaagatg

SEQ ID NO: 83403 - DNA, 103 bp, Artificial Sequence
  Synthetic Polynucleotide
taatacgactcactatagggtctgtatataacacttattcatccccaatgaacagaggagacattggatgtgaataagtaacctggcggcagcgcaaaagatg

SEQ ID NO: 83404 - DNA, 103 bp, Artificial Sequence
  Synthetic Polynucleotide
taatacgactcactatagggcttcggtgtccataattggtgagttggagtaacagaggagaactccaatgcaccaattaaacctggcggcagcgcaaaagatg

SEQ ID NO: 83405 - DNA, 103 bp, Artificial Sequence
  Synthetic Polynucleotide
taatacgactcactatagggttccacttcggtgtccataattggtgagttaacagaggagaaactcaatgattatggacaacctggcggcagcgcaaaagatg

SEQ ID NO: 83406 - DNA, 103 bp, Artificial Sequence
  Synthetic Polynucleotide
taatacgactcactataggggggacttccacttcggtgtccataattggtaacagaggagaaccaatatgggacaccgaaacctggcggcagcgcaaaagatg

SEQ ID NO: 83407 - DNA, 103 bp, Artificial Sequence
  Synthetic Polynucleotide
taatacgactcactatagggtctctgggacttccacttcggtgtccataaaacagaggagattatggatgccgaagtggaacctggcggcagcgcaaaagatg

SEQ ID NO: 83408 - DNA, 103 bp, Artificial Sequence
  Synthetic Polynucleotide
taatacgactcactatagggggctctctctgggacttccacttcggtgtcaacagaggagagacaccatggtggaagtcaacctggcggcagcgcaaaagatg

SEQ ID NO: 83409 - DNA, 103 bp, Artificial Sequence
  Synthetic Polynucleotide
taatacgactcactatagggctccaggctctctctgggacttccacttcgaacagaggagacgaagtatgagtcccagaaacctggcggcagcgcaaaagatg

SEQ ID NO: 83410 - DNA, 103 bp, Artificial Sequence
  Synthetic Polynucleotide
taatacgactcactatagggctgagctccaggctctctctgggacttccaaacagaggagatggaagatgcagagagagaacctggcggcagcgcaaaagatg

SEQ ID NO: 83411 - DNA, 103 bp, Artificial Sequence
  Synthetic Polynucleotide
taatacgactcactatagggaaagcctgagctccaggctctctctgggacaacagaggagagtcccaatgagagcctggaacctggcggcagcgcaaaagatg

SEQ ID NO: 83412 - DNA, 103 bp, Artificial Sequence
  Synthetic Polynucleotide
taatacgactcactatagggcaatcaaagcctgagctccaggctctctctaacagaggagaagagagatgctggagctcaacctggcggcagcgcaaaagatg

SEQ ID NO: 83413 - DNA, 103 bp, Artificial Sequence
  Synthetic Polynucleotide
taatacgactcactatagggtcacccaatcaaagcctgagctccaggctcaacagaggagagagcctatggctcaggctaacctggcggcagcgcaaaagatg

SEQ ID NO: 83414 - DNA, 103 bp, Artificial Sequence
  Synthetic Polynucleotide
taatacgactcactatagggcatgatctgtatataacacttattcatcccaacagaggagagggatgatgaagtgttataacctggcggcagcgcaaaagatg

SEQ ID NO: 83415 - DNA, 103 bp, Artificial Sequence
  Synthetic Polynucleotide
taatacgactcactatagggatccgtcacccaatcaaagcctgagctccaaacagaggagatggagcatgggctttgataacctggcggcagcgcaaaagatg

SEQ ID NO: 83416 - DNA, 103 bp, Artificial Sequence
  Synthetic Polynucleotide
taatacgactcactataggggaatgatccgtcacccaatcaaagcctgagaacagaggagactcaggatgtgattgggtaacctggcggcagcgcaaaagatg

SEQ ID NO: 83417 - DNA, 103 bp, Artificial Sequence
  Synthetic Polynucleotide
taatacgactcactatagggttccagaatgatccgtcacccaatcaaagcaacagaggagagctttgatggggtgacggaacctggcggcagcgcaaaagatg

SEQ ID NO: 83418 - DNA, 103 bp, Artificial Sequence
  Synthetic Polynucleotide
taatacgactcactatagggtgtttttccagaatgatccgtcacccaatcaacagaggagagattggatgacggatcataacctggcggcagcgcaaaagatg

SEQ ID NO: 83419 - DNA, 103 bp, Artificial Sequence
  Synthetic Polynucleotide
taatacgactcactatagggcaaactgtttttccagaatgatccgtcaccaacagaggagaggtgacatgtcattctggaacctggcggcagcgcaaaagatg

SEQ ID NO: 83420 - DNA, 103 bp, Artificial Sequence
  Synthetic Polynucleotide
taatacgactcactatagggcaaaccaaactgtttttccagaatgatccgaacagaggagacggatcatgctggaaaaaaacctggcggcagcgcaaaagatg

SEQ ID NO: 83421 - DNA, 103 bp, Artificial Sequence
  Synthetic Polynucleotide
taatacgactcactatagggtggaacaaaccaaactgtttttccagaatgaacagaggagacattctatgaaaacagttaacctggcggcagcgcaaaagatg

SEQ ID NO: 83422 - DNA, 103 bp, Artificial Sequence
  Synthetic Polynucleotide
taatacgactcactatagggacgcttggaacaaaccaaactgtttttccaaacagaggagatggaaaatgagtttggttaacctggcggcagcgcaaaagatg

SEQ ID NO: 83423 - DNA, 103 bp, Artificial Sequence
  Synthetic Polynucleotide
taatacgactcactatagggtcctcacgcttggaacaaaccaaactgtttaacagaggagaaaacagatgggtttgttcaacctggcggcagcgcaaaagatg

SEQ ID NO: 83424 - DNA, 103 bp, Artificial Sequence
  Synthetic Polynucleotide
taatacgactcactataggggccgttcctcacgcttggaacaaaccaaacaacagaggagagtttggatggttccaagcaacctggcggcagcgcaaaagatg

SEQ ID NO: 83425 - DNA, 103 bp, Artificial Sequence
  Synthetic Polynucleotide
taatacgactcactatagggagatccatgatctgtatataacacttattcaacagaggagagaataaatgttatatacaaacctggcggcagcgcaaaagatg

SEQ ID NO: 83426 - DNA, 103 bp, Artificial Sequence
  Synthetic Polynucleotide
taatacgactcactatagggtcattgccgttcctcacgcttggaacaaacaacagaggagagtttgtatgaagcgtgagaacctggcggcagcgcaaaagatg

SEQ ID NO: 83427 - DNA, 103 bp, Artificial Sequence
  Synthetic Polynucleotide
taatacgactcactatagggcgatctcattgccgttcctcacgcttggaaaacagaggagattccaaatgtgaggaacgaacctggcggcagcgcaaaagatg

SEQ ID NO: 83428 - DNA, 103 bp, Artificial Sequence
  Synthetic Polynucleotide
taatacgactcactatagggagctgcgatctcattgccgttcctcacgctaacagaggagaagcgtgatgaacggcaataacctggcggcagcgcaaaagatg

SEQ ID NO: 83429 - DNA, 103 bp, Artificial Sequence
  Synthetic Polynucleotide
taatacgactcactatagggagacaagctgcgatctcattgccgttcctcaacagaggagagaggaaatgcaatgagataacctggcggcagcgcaaaagatg

SEQ ID NO: 83430 - DNA, 103 bp, Artificial Sequence
  Synthetic Polynucleotide
taatacgactcactatagggttgtcagacaagctgcgatctcattgccgtaacagaggagaacggcaatgagatcgcagaacctggcggcagcgcaaaagatg

SEQ ID NO: 83431 - DNA, 103 bp, Artificial Sequence
  Synthetic Polynucleotide
taatacgactcactatagggagcctttgtcagacaagctgcgatctcattaacagaggagaaatgagatggcagcttgtaacctggcggcagcgcaaaagatg

SEQ ID NO: 83432 - DNA, 103 bp, Artificial Sequence
  Synthetic Polynucleotide
taatacgactcactatagggtttccagcctttgtcagacaagctgcgatcaacagaggagagatcgcatgttgtctgacaacctggcggcagcgcaaaagatg

SEQ ID NO: 83433 - DNA, 103 bp, Artificial Sequence
  Synthetic Polynucleotide
taatacgactcactatagggcccgttttccagcctttgtcagacaagctgaacagaggagacagcttatgtgacaaaggaacctggcggcagcgcaaaagatg

SEQ ID NO: 83434 - DNA, 103 bp, Artificial Sequence
  Synthetic Polynucleotide
taatacgactcactatagggtatgacccgttttccagcctttgtcagacaaacagaggagatgtctgatgaaggctggaaacctggcggcagcgcaaaagatg

SEQ ID NO: 83435 - DNA, 103 bp, Artificial Sequence
  Synthetic Polynucleotide
taatacgactcactatagggagctgtatgacccgttttccagcctttgtcaacagaggagagacaaaatgtggaaaacgaacctggcggcagcgcaaaagatg

SEQ ID NO: 83436 - DNA, 103 bp, Artificial Sequence
  Synthetic Polynucleotide
taatacgactcactataggggtccaagatccatgatctgtatataacactaacagaggagaagtgttatgtacagatcaaacctggcggcagcgcaaaagatg

SEQ ID NO: 83437 - DNA, 103 bp, Artificial Sequence
  Synthetic Polynucleotide
taatacgactcactatagggtgctgagctgtatgacccgttttccagcctaacagaggagaaggctgatgaacgggtcaaacctggcggcagcgcaaaagatg

SEQ ID NO: 83438 - DNA, 103 bp, Artificial Sequence
  Synthetic Polynucleotide
taatacgactcactatagggctttctgctgagctgtatgacccgttttccaacagaggagaggaaaaatggtcatacagaacctggcggcagcgcaaaagatg

SEQ ID NO: 83439 - DNA, 103 bp, Artificial Sequence
  Synthetic Polynucleotide
taatacgactcactatagggaaagtctttctgctgagctgtatgacccgtaacagaggagaacgggtatgacagctcagaacctggcggcagcgcaaaagatg

SEQ ID NO: 83440 - DNA, 103 bp, Artificial Sequence
  Synthetic Polynucleotide
taatacgactcactatagggtctcaaaagtctttctgctgagctgtatgaaacagaggagatcatacatgtcagcagaaaacctggcggcagcgcaaaagatg

SEQ ID NO: 83441 - DNA, 103 bp, Artificial Sequence
  Synthetic Polynucleotide
taatacgactcactatagggctctgtctcaaaagtctttctgctgagctgaacagaggagacagctcatgagaaagactaacctggcggcagcgcaaaagatg

SEQ ID NO: 83442 - DNA, 103 bp, Artificial Sequence
  Synthetic Polynucleotide
taatacgactcactatagggtggaactctgtctcaaaagtctttctgctgaacagaggagacagcagatggacttttgaaacctggcggcagcgcaaaagatg

SEQ ID NO: 83443 - DNA, 103 bp, Artificial Sequence
  Synthetic Polynucleotide
taatacgactcactatagggttttctggaactctgtctcaaaagtctttcaacagaggagagaaagaatgttgagacagaacctggcggcagcgcaaaagatg

SEQ ID NO: 83444 - DNA, 103 bp, Artificial Sequence
  Synthetic Polynucleotide
taatacgactcactatagggttttgttttctggaactctgtctcaaaagtaacagaggagaacttttatgacagagttcaacctggcggcagcgcaaaagatg

SEQ ID NO: 83445 - DNA, 103 bp, Artificial Sequence
  Synthetic Polynucleotide
taatacgactcactatagggtgatgttttgttttctggaactctgtctcaaacagaggagatgagacatggttccagaaaacctggcggcagcgcaaaagatg

SEQ ID NO: 83446 - DNA, 103 bp, Artificial Sequence
  Synthetic Polynucleotide
taatacgactcactatagggactcttgatgttttgttttctggaactctgaacagaggagacagagtatgagaaaacaaaacctggcggcagcgcaaaagatg

SEQ ID NO: 83447 - DNA, 103 bp, Artificial Sequence
  Synthetic Polynucleotide
taatacgactcactatagggcatgtgtccaagatccatgatctgtatataaacagaggagatatataatgatcatggataacctggcggcagcgcaaaagatg

SEQ ID NO: 83448 - DNA, 103 bp, Artificial Sequence
  Synthetic Polynucleotide
taatacgactcactataggggtcccactcttgatgttttgttttctggaaaacagaggagattccagatgacaaaacataacctggcggcagcgcaaaagatg

SEQ ID NO: 83449 - DNA, 103 bp, Artificial Sequence
  Synthetic Polynucleotide
taatacgactcactatagggacaaagtcccactcttgatgttttgttttcaacagaggagagaaaacatgacatcaagaaacctggcggcagcgcaaaagatg

SEQ ID NO: 83450 - DNA, 103 bp, Artificial Sequence
  Synthetic Polynucleotide
taatacgactcactatagggtcacgacaaagtcccactcttgatgttttgaacagaggagacaaaacatgaagagtgggaacctggcggcagcgcaaaagatg

SEQ ID NO: 83451 - DNA, 103 bp, Artificial Sequence
  Synthetic Polynucleotide
taatacgactcactatagggagttgtcacgacaaagtcccactcttgatgaacagaggagacatcaaatgtgggactttaacctggcggcagcgcaaaagatg

SEQ ID NO: 83452 - DNA, 103 bp, Artificial Sequence
  Synthetic Polynucleotide
taatacgactcactatagggatgtcagttgtcacgacaaagtcccactctaacagaggagaagagtgatgctttgtcgtaacctggcggcagcgcaaaagatg

SEQ ID NO: 83453 - DNA, 103 bp, Artificial Sequence
  Synthetic Polynucleotide
taatacgactcactatagggctgaaatgtcagttgtcacgacaaagtcccaacagaggagagggactatgtcgtgacaaaacctggcggcagcgcaaaagatg

SEQ ID NO: 83454 - DNA, 103 bp, Artificial Sequence
  Synthetic Polynucleotide
taatacgactcactatagggcatctctgaaatgtcagttgtcacgacaaaaacagaggagatttgtcatgacaactgacaacctggcggcagcgcaaaagatg

SEQ ID NO: 83455 - DNA, 103 bp, Artificial Sequence
  Synthetic Polynucleotide
taatacgactcactataggggcgcccatctctgaaatgtcagttgtcacgaacagaggagacgtgacatgtgacatttcaacctggcggcagcgcaaaagatg

SEQ ID NO: 83456 - DNA, 103 bp, Artificial Sequence
  Synthetic Polynucleotide
taatacgactcactatagggagttggcgcccatctctgaaatgtcagttgaacagaggagacaactgatgtttcagagaaacctggcggcagcgcaaaagatg

SEQ ID NO: 83457 - DNA, 103 bp, Artificial Sequence
  Synthetic Polynucleotide
taatacgactcactatagggtttaaagttggcgcccatctctgaaatgtcaacagaggagagacattatggagatgggcaacctggcggcagcgcaaaagatg

SEQ ID NO: 83458 - DNA, 103 bp, Artificial Sequence
  Synthetic Polynucleotide
taatacgactcactatagggtcacacatgtgtccaagatccatgatctgtaacagaggagaacagatatgggatcttggaacctggcggcagcgcaaaagatg

SEQ ID NO: 83459 - DNA, 103 bp, Artificial Sequence
  Synthetic Polynucleotide
taatacgactcactatagggtcagctttaaagttggcgcccatctctgaaaacagaggagattcagaatggggcgccaaaacctggcggcagcgcaaaagatg

SEQ ID NO: 83460 - DNA, 103 bp, Artificial Sequence
  Synthetic Polynucleotide
taatacgactcactatagggcacggtcagctttaaagttggcgcccatctaacagaggagaagatggatgccaactttaaacctggcggcagcgcaaaagatg

SEQ ID NO: 83461 - DNA, 103 bp, Artificial Sequence
  Synthetic Polynucleotide
taatacgactcactatagggtatgacacggtcagctttaaagttggcgccaacagaggagaggcgccatgtttaaagctaacctggcggcagcgcaaaagatg

SEQ ID NO: 83462 - DNA, 103 bp, Artificial Sequence
  Synthetic Polynucleotide
taatacgactcactataggggaatctatgacacggtcagctttaaagttgaacagaggagacaacttatgagctgaccgaacctggcggcagcgcaaaagatg

SEQ ID NO: 83463 - DNA, 103 bp, Artificial Sequence
  Synthetic Polynucleotide
taatacgactcactatagggtcctggaatctatgacacggtcagctttaaaacagaggagattaaagatgaccgtgtcaaacctggcggcagcgcaaaagatg

SEQ ID NO: 83464 - DNA, 103 bp, Artificial Sequence
  Synthetic Polynucleotide
taatacgactcactataggggcatctcctggaatctatgacacggtcagcaacagaggagagctgacatggtcatagataacctggcggcagcgcaaaagatg

SEQ ID NO: 83465 - DNA, 103 bp, Artificial Sequence
  Synthetic Polynucleotide
taatacgactcactatagggtttaggcatctcctggaatctatgacacggaacagaggagaccgtgtatgagattccagaacctggcggcagcgcaaaagatg

SEQ ID NO: 83466 - DNA, 103 bp, Artificial Sequence
  Synthetic Polynucleotide
taatacgactcactatagggccggctttaggcatctcctggaatctatgaaacagaggagatcatagatgccaggagataacctggcggcagcgcaaaagatg

SEQ ID NO: 83467 - DNA, 103 bp, Artificial Sequence
  Synthetic Polynucleotide
taatacgactcactatagggtatgaccggctttaggcatctcctggaatcaacagaggagagattccatgagatgcctaaacctggcggcagcgcaaaagatg

SEQ ID NO: 83468 - DNA, 103 bp, Artificial Sequence
  Synthetic Polynucleotide
taatacgactcactatagggtcaagtatgaccggctttaggcatctcctgaacagaggagacaggagatgcctaaagccaacctggcggcagcgcaaaagatg

SEQ ID NO: 83469 - DNA, 103 bp, Artificial Sequence
  Synthetic Polynucleotide
taatacgactcactatagggtggcatcacacatgtgtccaagatccatgaaacagaggagatcatggatgttggacacaaacctggcggcagcgcaaaagatg

SEQ ID NO: 83470 - DNA, 103 bp, Artificial Sequence
  Synthetic Polynucleotide
taatacgactcactatagggcgccatcaagtatgaccggctttaggcatcaacagaggagagatgccatgagccggtcaaacctggcggcagcgcaaaagatg

SEQ ID NO: 83471 - DNA, 103 bp, Artificial Sequence
  Synthetic Polynucleotide
taatacgactcactatagggtctctcgccatcaagtatgaccggctttagaacagaggagactaaagatggtcatacttaacctggcggcagcgcaaaagatg

SEQ ID NO: 83472 - DNA, 103 bp, Artificial Sequence
  Synthetic Polynucleotide
taatacgactcactatagggatgactctctcgccatcaagtatgaccggcaacagaggagagccggtatgacttgatggaacctggcggcagcgcaaaagatg

SEQ ID NO: 83473 - DNA, 103 bp, Artificial Sequence
  Synthetic Polynucleotide
taatacgactcactatagggccaaaatgactctctcgccatcaagtatgaaacagaggagatcatacatgatggcgagaaacctggcggcagcgcaaaagatg

SEQ ID NO: 83474 - DNA, 103 bp, Artificial Sequence
  Synthetic Polynucleotide
taatacgactcactatagggtccagccaaaatgactctctcgccatcaagaacagaggagacttgatatggagagagtcaacctggcggcagcgcaaaagatg

SEQ ID NO: 83475 - DNA, 103 bp, Artificial Sequence
  Synthetic Polynucleotide
taatacgactcactatagggatgggtccagccaaaatgactctctcgccaaacagaggagatggcgaatgagtcattttaacctggcggcagcgcaaaagatg

SEQ ID NO: 83476 - DNA, 103 bp, Artificial Sequence
  Synthetic Polynucleotide
taatacgactcactatagggcaggcatgggtccagccaaaatgactctctaacagaggagaagagagatgttttggctgaacctggcggcagcgcaaaagatg

SEQ ID NO: 83477 - DNA, 103 bp, Artificial Sequence
  Synthetic Polynucleotide
taatacgactcactatagggtgtgacaggcatgggtccagccaaaatgacaacagaggagagtcattatggctggacccaacctggcggcagcgcaaaagatg

SEQ ID NO: 83478 - DNA, 103 bp, Artificial Sequence
  Synthetic Polynucleotide
taatacgactcactataggggcatgtgtgacaggcatgggtccagccaaaaacagaggagatttggcatgacccatgccaacctggcggcagcgcaaaagatg

SEQ ID NO: 83479 - DNA, 103 bp, Artificial Sequence
  Synthetic Polynucleotide
taatacgactcactatagggcgctggcatgtgtgacaggcatgggtccagaacagaggagactggacatgtgcctgtcaaacctggcggcagcgcaaaagatg

SEQ ID NO: 83480 - DNA, 103 bp, Artificial Sequence
  Synthetic Polynucleotide
taatacgactcactatagggcatggtggcatcacacatgtgtccaagatcaacagaggagagatcttatgcacatgtgtaacctggcggcagcgcaaaagatg

SEQ ID NO: 83481 - DNA, 103 bp, Artificial Sequence
  Synthetic Polynucleotide
taatacgactcactatagggggcagcgctggcatgtgtgacaggcatgggaacagaggagacccatgatggtcacacataacctggcggcagcgcaaaagatg

SEQ ID NO: 83482 - DNA, 103 bp, Artificial Sequence
  Synthetic Polynucleotide
taatacgactcactatagggctctgggcagcgctggcatgtgtgacaggcaacagaggagagcctgtatgacatgccagaacctggcggcagcgcaaaagatg

SEQ ID NO: 83483 - DNA, 103 bp, Artificial Sequence
  Synthetic Polynucleotide
taatacgactcactatagggccctcctctgggcagcgctggcatgtgtgaaacagaggagatcacacatgccagcgctgaacctggcggcagcgcaaaagatg

SEQ ID NO: 83484 - DNA, 103 bp, Artificial Sequence
  Synthetic Polynucleotide
taatacgactcactataggggcgccccctcctctgggcagcgctggcatgaacagaggagacatgccatggctgcccagaacctggcggcagcgcaaaagatg

SEQ ID NO: 83485 - DNA, 103 bp, Artificial Sequence
  Synthetic Polynucleotide
taatacgactcactatagggcctatgcgccccctcctctgggcagcgctgaacagaggagacagcgcatgccagaggagaacctggcggcagcgcaaaagatg

SEQ ID NO: 83486 - DNA, 103 bp, Artificial Sequence
  Synthetic Polynucleotide
taatacgactcactatagggtcctgcctatgcgccccctcctctgggcagaacagaggagactgcccatgggagggggcaacctggcggcagcgcaaaagatg

SEQ ID NO: 83487 - DNA, 103 bp, Artificial Sequence
  Synthetic Polynucleotide
taatacgactcactataggggggattcctgcctatgcgccccctcctctgaacagaggagacagaggatggggcgcataaacctggcggcagcgcaaaagatg

SEQ ID NO: 83488 - DNA, 103 bp, Artificial Sequence
  Synthetic Polynucleotide
taatacgactcactatagggttgttgggattcctgcctatgcgccccctcaacagaggagagaggggatgcataggcagaacctggcggcagcgcaaaagatg

SEQ ID NO: 83489 - DNA, 103 bp, Artificial Sequence
  Synthetic Polynucleotide
taatacgactcactatagggcaggtttgttgggattcctgcctatgcgccaacagaggagaggcgcaatggcaggaatcaacctggcggcagcgcaaaagatg

SEQ ID NO: 83490 - DNA, 103 bp, Artificial Sequence
  Synthetic Polynucleotide
taatacgactcactatagggatctccaggtttgttgggattcctgcctataacagaggagaataggcatgaatcccaacaacctggcggcagcgcaaaagatg

SEQ ID NO: 83491 - DNA, 103 bp, Artificial Sequence
  Synthetic Polynucleotide
taatacgactcactatagggatccaaaataaaacctgttgatactgttgcaacagaggagagcaacaatgtcaacaggtaacctggcggcagcgcaaaagatg

SEQ ID NO: 83492 - DNA, 103 bp, Artificial Sequence
  Synthetic Polynucleotide
taatacgactcactatagggtagctcatggtggcatcacacatgtgtccaaacagaggagatggacaatggtgtgatgcaacctggcggcagcgcaaaagatg

SEQ ID NO: 83493 - DNA, 103 bp, Artificial Sequence
  Synthetic Polynucleotide
taatacgactcactatagggtactcatctccaggtttgttgggattcctgaacagaggagacaggaaatgcaacaaaccaacctggcggcagcgcaaaagatg

SEQ ID NO: 83494 - DNA, 103 bp, Artificial Sequence
  Synthetic Polynucleotide
taatacgactcactatagggacagatactcatctccaggtttgttgggataacagaggagaatcccaatgaacctggagaacctggcggcagcgcaaaagatg

SEQ ID NO: 83495 - DNA, 103 bp, Artificial Sequence
  Synthetic Polynucleotide
taatacgactcactatagggtccatacagatactcatctccaggtttgttaacagaggagaaacaaaatgggagatgagaacctggcggcagcgcaaaagatg

SEQ ID NO: 83496 - DNA, 103 bp, Artificial Sequence
  Synthetic Polynucleotide
taatacgactcactatagggccacctccatacagatactcatctccaggtaacagaggagaacctggatgtgagtatctaacctggcggcagcgcaaaagatg

SEQ ID NO: 83497 - DNA, 103 bp, Artificial Sequence
  Synthetic Polynucleotide
taatacgactcactatagggcgcacccacctccatacagatactcatctcaacagaggagagagatgatgatctgtatgaacctggcggcagcgcaaaagatg

SEQ ID NO: 83498 - DNA, 103 bp, Artificial Sequence
  Synthetic Polynucleotide
taatacgactcactatagggctctgcgcacccacctccatacagatactcaacagaggagagagtatatgtatggaggtaacctggcggcagcgcaaaagatg

SEQ ID NO: 83499 - DNA, 103 bp, Artificial Sequence
  Synthetic Polynucleotide
taatacgactcactatagggtcagtctctgcgcacccacctccatacagaaacagaggagatctgtaatgaggtgggtgaacctggcggcagcgcaaaagatg

SEQ ID NO: 83500 - DNA, 103 bp, Artificial Sequence
  Synthetic Polynucleotide
taatacgactcactatagggcttcgtcagtctctgcgcacccacctccataacagaggagaatggagatgggtgcgcagaacctggcggcagcgcaaaagatg

SEQ ID NO: 83501 - DNA, 103 bp, Artificial Sequence
  Synthetic Polynucleotide
taatacgactcactatagggatggtcttcgtcagtctctgcgcacccaccaacagaggagaggtgggatggcagagactaacctggcggcagcgcaaaagatg

SEQ ID NO: 83502 - DNA, 103 bp, Artificial Sequence
  Synthetic Polynucleotide
taatacgactcactatagggtgtgcatggtcttcgtcagtctctgcgcacaacagaggagagtgcgcatggactgacgaaacctggcggcagcgcaaaagatg

SEQ ID NO: 83503 - DNA, 103 bp, Artificial Sequence
  Synthetic Polynucleotide
taatacgactcactatagggattcatagctcatggtggcatcacacatgtaacagaggagaacatgtatgatgccaccaaacctggcggcagcgcaaaagatg

SEQ ID NO: 83504 - DNA, 103 bp, Artificial Sequence
  Synthetic Polynucleotide
taatacgactcactataggggccagtgtgcatggtcttcgtcagtctctgaacagaggagacagagaatgacgaagaccaacctggcggcagcgcaaaagatg

SEQ ID NO: 83505 - DNA, 103 bp, Artificial Sequence
  Synthetic Polynucleotide
taatacgactcactatagggttcaagccagtgtgcatggtcttcgtcagtaacagaggagaactgacatggaccatgcaaacctggcggcagcgcaaaagatg

SEQ ID NO: 83506 - DNA, 103 bp, Artificial Sequence
  Synthetic Polynucleotide
taatacgactcactatagggcttgcttcaagccagtgtgcatggtcttcgaacagaggagacgaagaatgtgcacactgaacctggcggcagcgcaaaagatg

SEQ ID NO: 83507 - DNA, 103 bp, Artificial Sequence
  Synthetic Polynucleotide
taatacgactcactataggggcattcttgcttcaagccagtgtgcatggtaacagaggagaaccatgatgactggcttgaacctggcggcagcgcaaaagatg

SEQ ID NO: 83508 - DNA, 103 bp, Artificial Sequence
  Synthetic Polynucleotide
taatacgactcactatagggaaggagcattcttgcttcaagccagtgtgcaacagaggagagcacacatgcttgaagcaaacctggcggcagcgcaaaagatg

SEQ ID NO: 83509 - DNA, 103 bp, Artificial Sequence
  Synthetic Polynucleotide
taatacgactcactatagggttgtcaaggagcattcttgcttcaagccagaacagaggagactggctatgagcaagaataacctggcggcagcgcaaaagatg

SEQ ID NO: 83510 - DNA, 103 bp, Artificial Sequence
  Synthetic Polynucleotide
taatacgactcactatagggaaatattgtcaaggagcattcttgcttcaaaacagaggagattgaagatggaatgctccaacctggcggcagcgcaaaagatg

SEQ ID NO: 83511 - DNA, 103 bp, Artificial Sequence
  Synthetic Polynucleotide
taatacgactcactataggggaggtaaatattgtcaaggagcattcttgcaacagaggagagcaagaatgctccttgacaacctggcggcagcgcaaaagatg

SEQ ID NO: 83512 - DNA, 103 bp, Artificial Sequence
  Synthetic Polynucleotide
taatacgactcactatagggtcttggaggtaaatattgtcaaggagcattaacagaggagaaatgctatgtgacaatataacctggcggcagcgcaaaagatg

SEQ ID NO: 83513 - DNA, 103 bp, Artificial Sequence
  Synthetic Polynucleotide
taatacgactcactatagggggccatcttggaggtaaatattgtcaaggaaacagaggagatccttgatgatatttaccaacctggcggcagcgcaaaagatg

SEQ ID NO: 83514 - DNA, 103 bp, Artificial Sequence
  Synthetic Polynucleotide
taatacgactcactatagggagggcattcatagctcatggtggcatcacaaacagaggagatgtgatatgaccatgagcaacctggcggcagcgcaaaagatg

SEQ ID NO: 83515 - DNA, 103 bp, Artificial Sequence
  Synthetic Polynucleotide
taatacgactcactatagggtatgaggccatcttggaggtaaatattgtcaacagaggagagacaatatgtacctccaaaacctggcggcagcgcaaaagatg

SEQ ID NO: 83516 - DNA, 103 bp, Artificial Sequence
  Synthetic Polynucleotide
taatacgactcactataggggaggctatgaggccatcttggaggtaaataaacagaggagatatttaatgccaagatggaacctggcggcagcgcaaaagatg

SEQ ID NO: 83517 - DNA, 103 bp, Artificial Sequence
  Synthetic Polynucleotide
taatacgactcactatagggagagcgaggctatgaggccatcttggaggtaacagaggagaacctccatgatggcctcaaacctggcggcagcgcaaaagatg

SEQ ID NO: 83518 - DNA, 103 bp, Artificial Sequence
  Synthetic Polynucleotide
taatacgactcactatagggtcgatagagcgaggctatgaggccatcttgaacagaggagacaagatatgctcatagccaacctggcggcagcgcaaaagatg

SEQ ID NO: 83519 - DNA, 103 bp, Artificial Sequence
  Synthetic Polynucleotide
taatacgactcactatagggtcaggtcgatagagcgaggctatgaggccaaacagaggagatggcctatgagcctcgctaacctggcggcagcgcaaaagatg

SEQ ID NO: 83520 - DNA, 103 bp, Artificial Sequence
  Synthetic Polynucleotide
taatacgactcactatagggcggcctcaggtcgatagagcgaggctatgaaacagaggagatcatagatgcgctctatcaacctggcggcagcgcaaaagatg

SEQ ID NO: 83521 - DNA, 103 bp, Artificial Sequence
  Synthetic Polynucleotide
taatacgactcactatagggtttgtcggcctcaggtcgatagagcgaggcaacagaggagagcctcgatgtatcgacctaacctggcggcagcgcaaaagatg

SEQ ID NO: 83522 - DNA, 103 bp, Artificial Sequence
  Synthetic Polynucleotide
taatacgactcactataggggctactttgtcggcctcaggtcgatagagcaacagaggagagctctaatgacctgaggcaacctggcggcagcgcaaaagatg

SEQ ID NO: 83523 - DNA, 103 bp, Artificial Sequence
  Synthetic Polynucleotide
taatacgactcactatagggtggctgctactttgtcggcctcaggtcgataacagaggagaatcgacatgaggccgacaaacctggcggcagcgcaaaagatg

SEQ ID NO: 83524 - DNA, 103 bp, Artificial Sequence
  Synthetic Polynucleotide
taatacgactcactatagggctcaatggctgctactttgtcggcctcaggaacagaggagacctgagatggacaaagtaaacctggcggcagcgcaaaagatg

SEQ ID NO: 83525 - DNA, 103 bp, Artificial Sequence
  Synthetic Polynucleotide
taatacgactcactatagggagcatagggcattcatagctcatggtggcaaacagaggagatgccacatggagctatgaaacctggcggcagcgcaaaagatg

SEQ ID NO: 83526 - DNA, 103 bp, Artificial Sequence
  Synthetic Polynucleotide
taatacgactcactatagggtctccctcaatggctgctactttgtcggccaacagaggagaggccgaatgagtagcagcaacctggcggcagcgcaaaagatg

SEQ ID NO: 83527 - DNA, 103 bp, Artificial Sequence
  Synthetic Polynucleotide
taatacgactcactatagggtgaactctccctcaatggctgctactttgtaacagaggagaacaaagatgcagccattgaacctggcggcagcgcaaaagatg

SEQ ID NO: 83528 - DNA, 103 bp, Artificial Sequence
  Synthetic Polynucleotide
taatacgactcactatagggaagcttgaactctccctcaatggctgctacaacagaggagagtagcaatgattgagggaaacctggcggcagcgcaaaagatg

SEQ ID NO: 83529 - DNA, 103 bp, Artificial Sequence
  Synthetic Polynucleotide
taatacgactcactataggggtcctaagcttgaactctccctcaatggctaacagaggagaagccatatggggagagttaacctggcggcagcgcaaaagatg

SEQ ID NO: 83530 - DNA, 103 bp, Artificial Sequence
  Synthetic Polynucleotide
taatacgactcactataggggctccgtcctaagcttgaactctccctcaaaacagaggagattgaggatgagttcaagcaacctggcggcagcgcaaaagatg

SEQ ID NO: 83531 - DNA, 103 bp, Artificial Sequence
  Synthetic Polynucleotide
taatacgactcactatagggcctttgctccgtcctaagcttgaactctccaacagaggagaggagagatgaagcttaggaacctggcggcagcgcaaaagatg

SEQ ID NO: 83532 - DNA, 103 bp, Artificial Sequence
  Synthetic Polynucleotide
taatacgactcactataggggtcttcctttgctccgtcctaagcttgaacaacagaggagagttcaaatgtaggacggaaacctggcggcagcgcaaaagatg

SEQ ID NO: 83533 - DNA, 103 bp, Artificial Sequence
  Synthetic Polynucleotide
taatacgactcactatagggcaaaggtcttcctttgctccgtcctaagctaacagaggagaagcttaatgcggagcaaaaacctggcggcagcgcaaaagatg

SEQ ID NO: 83534 - DNA, 103 bp, Artificial Sequence
  Synthetic Polynucleotide
taatacgactcactatagggttccacaaaggtcttcctttgctccgtcctaacagaggagaaggacgatgcaaaggaagaacctggcggcagcgcaaaagatg

SEQ ID NO: 83535 - DNA, 103 bp, Artificial Sequence
  Synthetic Polynucleotide
taatacgactcactatagggatgagttccacaaaggtcttcctttgctccaacagaggagaggagcaatggaagaccttaacctggcggcagcgcaaaagatg

SEQ ID NO: 83536 - DNA, 103 bp, Artificial Sequence
  Synthetic Polynucleotide
taatacgactcactatagggcatccagcatagggcattcatagctcatggaacagaggagaccatgaatgatgaatgccaacctggcggcagcgcaaaagatg

SEQ ID NO: 83537 - DNA, 103 bp, Artificial Sequence
  Synthetic Polynucleotide
taatacgactcactatagggttttcatgagttccacaaaggtcttcctttaacagaggagaaaaggaatgcctttgtggaacctggcggcagcgcaaaagatg

SEQ ID NO: 83538 - DNA, 103 bp, Artificial Sequence
  Synthetic Polynucleotide
taatacgactcactatagggtcctcttttcatgagttccacaaaggtcttaacagaggagaaagaccatggtggaactcaacctggcggcagcgcaaaagatg

SEQ ID NO: 83539 - DNA, 103 bp, Artificial Sequence
  Synthetic Polynucleotide
taatacgactcactatagggagatctcctcttttcatgagttccacaaagaacagaggagactttgtatgactcatgaaaacctggcggcagcgcaaaagatg

SEQ ID NO: 83540 - DNA, 103 bp, Artificial Sequence
  Synthetic Polynucleotide
taatacgactcactatagggcaggaagatctcctcttttcatgagttccaaacagaggagatggaacatgtgaaaagagaacctggcggcagcgcaaaagatg

SEQ ID NO: 83541 - DNA, 103 bp, Artificial Sequence
  Synthetic Polynucleotide
taatacgactcactatagggccaaacaggaagatctcctcttttcatgagaacagaggagactcatgatgagaggagataacctggcggcagcgcaaaagatg

SEQ ID NO: 83542 - DNA, 103 bp, Artificial Sequence
  Synthetic Polynucleotide
taatacgactcactataggggccagccaaacaggaagatctcctcttttcaacagaggagagaaaagatgagatcttccaacctggcggcagcgcaaaagatg

SEQ ID NO: 83543 - DNA, 103 bp, Artificial Sequence
  Synthetic Polynucleotide
taatacgactcactataggggataggccagccaaacaggaagatctcctcaacagaggagagaggagatgttcctgtttaacctggcggcagcgcaaaagatg

SEQ ID NO: 83544 - DNA, 103 bp, Artificial Sequence
  Synthetic Polynucleotide
taatacgactcactatagggaacctgataggccagccaaacaggaagatcaacagaggagagatcttatggtttggctgaacctggcggcagcgcaaaagatg

SEQ ID NO: 83545 - DNA, 103 bp, Artificial Sequence
  Synthetic Polynucleotide
taatacgactcactataggggatgcaacctgataggccagccaaacaggaaacagaggagatcctgtatggctggcctaaacctggcggcagcgcaaaagatg

SEQ ID NO: 83546 - DNA, 103 bp, Artificial Sequence
  Synthetic Polynucleotide
taatacgactcactatagggcggcagatgcaacctgataggccagccaaaaacagaggagatttggcatgcctatcaggaacctggcggcagcgcaaaagatg

SEQ ID NO: 83547 - DNA, 103 bp, Artificial Sequence
  Synthetic Polynucleotide
taatacgactcactatagggcccctcatccagcatagggcattcatagctaacagaggagaagctatatgtgccctatgaacctggcggcagcgcaaaagatg

SEQ ID NO: 83548 - DNA, 103 bp, Artificial Sequence
  Synthetic Polynucleotide
taatacgactcactatagggtattccggcagatgcaacctgataggccagaacagaggagactggccatgcaggttgcaaacctggcggcagcgcaaaagatg

SEQ ID NO: 83549 - DNA, 103 bp, Artificial Sequence
  Synthetic Polynucleotide
taatacgactcactatagggtaggttattccggcagatgcaacctgatagaacagaggagactatcaatgtgcatctgcaacctggcggcagcgcaaaagatg

SEQ ID NO: 83550 - DNA, 103 bp, Artificial Sequence
  Synthetic Polynucleotide
taatacgactcactatagggctgtgtaggttattccggcagatgcaacctaacagaggagaaggttgatgctgccggaaaacctggcggcagcgcaaaagatg

SEQ ID NO: 83551 - DNA, 103 bp, Artificial Sequence
  Synthetic Polynucleotide
taatacgactcactatagggtctatctgtgtaggttattccggcagatgcaacagaggagagcatctatgggaataaccaacctggcggcagcgcaaaagatg

SEQ ID NO: 83552 - DNA, 103 bp, Artificial Sequence
  Synthetic Polynucleotide
taatacgactcactatagggcatcttctatctgtgtaggttattccggcaaacagaggagatgccggatgaacctacacaacctggcggcagcgcaaaagatg

SEQ ID NO: 83553 - DNA, 103 bp, Artificial Sequence
  Synthetic Polynucleotide
taatacgactcactatagggagcaccatcttctatctgtgtaggttattcaacagaggagagaataaatgacacagataaacctggcggcagcgcaaaagatg

SEQ ID NO: 83554 - DNA, 103 bp, Artificial Sequence
  Synthetic Polynucleotide
taatacgactcactatagggatcaaagcaccatcttctatctgtgtaggtaacagaggagaacctacatggatagaagaaacctggcggcagcgcaaaagatg

SEQ ID NO: 83555 - DNA, 103 bp, Artificial Sequence
  Synthetic Polynucleotide
taatacgactcactataggggtgccatcaaagcaccatcttctatctgtgaacagaggagacacagaatgaagatggtgaacctggcggcagcgcaaaagatg

SEQ ID NO: 83556 - DNA, 103 bp, Artificial Sequence
  Synthetic Polynucleotide
taatacgactcactatagggtggtcgtgccatcaaagcaccatcttctataacagaggagaatagaaatgggtgctttgaacctggcggcagcgcaaaagatg

SEQ ID NO: 83557 - DNA, 103 bp, Artificial Sequence
  Synthetic Polynucleotide
taatacgactcactataggggttgttggtcgtgccatcaaagcaccatctaacagaggagaagatggatgtttgatggcaacctggcggcagcgcaaaagatg

SEQ ID NO: 83558 - DNA, 103 bp, Artificial Sequence
  Synthetic Polynucleotide
taatacgactcactatagggtccaccccctcatccagcatagggcattcaaacagaggagatgaatgatgtatgctggaaacctggcggcagcgcaaaagatg

SEQ ID NO: 83559 - DNA, 103 bp, Artificial Sequence
  Synthetic Polynucleotide
taatacgactcactatagggatggtgttgttggtcgtgccatcaaagcacaacagaggagagtgcttatgtggcacgacaacctggcggcagcgcaaaagatg

SEQ ID NO: 83560 - DNA, 103 bp, Artificial Sequence
  Synthetic Polynucleotide
taatacgactcactatagggccattatggtgttgttggtcgtgccatcaaaacagaggagattgatgatgcgaccaacaaacctggcggcagcgcaaaagatg

SEQ ID NO: 83561 - DNA, 103 bp, Artificial Sequence
  Synthetic Polynucleotide
taatacgactcactataggggtcttccattatggtgttgttggtcgtgccaacagaggagaggcacgatgaacaacaccaacctggcggcagcgcaaaagatg

SEQ ID NO: 83562 - DNA, 103 bp, Artificial Sequence
  Synthetic Polynucleotide
taatacgactcactatagggacactgtcttccattatggtgttgttggtcaacagaggagagaccaaatgcaccataataacctggcggcagcgcaaaagatg

SEQ ID NO: 83563 - DNA, 103 bp, Artificial Sequence
  Synthetic Polynucleotide
taatacgactcactatagggccggcacactgtcttccattatggtgttgtaacagaggagaacaacaatgtaatggaagaacctggcggcagcgcaaaagatg

SEQ ID NO: 83564 - DNA, 103 bp, Artificial Sequence
  Synthetic Polynucleotide
taatacgactcactatagggctctgccggcacactgtcttccattatggtaacagaggagaaccataatggaagacagtaacctggcggcagcgcaaaagatg

SEQ ID NO: 83565 - DNA, 103 bp, Artificial Sequence
  Synthetic Polynucleotide
taatacgactcactatagggcacacctctgccggcacactgtcttccattaacagaggagaaatggaatgcagtgtgccaacctggcggcagcgcaaaagatg

SEQ ID NO: 83566 - DNA, 103 bp, Artificial Sequence
  Synthetic Polynucleotide
taatacgactcactatagggtggtccacacctctgccggcacactgtcttaacagaggagaaagacaatgtgccggcagaacctggcggcagcgcaaaagatg

SEQ ID NO: 83567 - DNA, 103 bp, Artificial Sequence
  Synthetic Polynucleotide
taatacgactcactataggggtgtctggtccacacctctgccggcacactaacagaggagaagtgtgatggcagaggtgaacctggcggcagcgcaaaagatg

SEQ ID NO: 83568 - DNA, 103 bp, Artificial Sequence
  Synthetic Polynucleotide
taatacgactcactatagggtctccgtgtctggtccacacctctgccggcaacagaggagagccggcatgggtgtggacaacctggcggcagcgcaaaagatg

SEQ ID NO: 83569 - DNA, 103 bp, Artificial Sequence
  Synthetic Polynucleotide
taatacgactcactatagggctggttccaccccctcatccagcatagggcaacagaggagagccctaatgtggatgaggaacctggcggcagcgcaaaagatg

SEQ ID NO: 83570 - DNA, 103 bp, Artificial Sequence
  Synthetic Polynucleotide
taatacgactcactatagggttttctctccgtgtctggtccacacctctgaacagaggagacagaggatgggaccagacaacctggcggcagcgcaaaagatg

SEQ ID NO: 83571 - DNA, 103 bp, Artificial Sequence
  Synthetic Polynucleotide
taatacgactcactatagggcactcttttctctccgtgtctggtccacacaacagaggagagtgtggatgagacacggaaacctggcggcagcgcaaaagatg

SEQ ID NO: 83572 - DNA, 103 bp, Artificial Sequence
  Synthetic Polynucleotide
taatacgactcactatagggttgagcactcttttctctccgtgtctggtcaacagaggagagaccagatgcggagagaaaacctggcggcagcgcaaaagatg

SEQ ID NO: 83573 - DNA, 103 bp, Artificial Sequence
  Synthetic Polynucleotide
taatacgactcactatagggtcggtttgagcactcttttctctccgtgtcaacagaggagagacacgatgagaaaagagaacctggcggcagcgcaaaagatg

SEQ ID NO: 83574 - DNA, 103 bp, Artificial Sequence
  Synthetic Polynucleotide
taatacgactcactatagggccacctcggtttgagcactcttttctctccaacagaggagaggagagatgagagtgctcaacctggcggcagcgcaaaagatg

SEQ ID NO: 83575 - DNA, 103 bp, Artificial Sequence
  Synthetic Polynucleotide
taatacgactcactatagggtccatccacctcggtttgagcactcttttcaacagaggagagaaaagatggctcaaaccaacctggcggcagcgcaaaagatg

SEQ ID NO: 83576 - DNA, 103 bp, Artificial Sequence
  Synthetic Polynucleotide
taatacgactcactatagggtggcgtccatccacctcggtttgagcactcaacagaggagagagtgcatgaaccgaggtaacctggcggcagcgcaaaagatg

SEQ ID NO: 83577 - DNA, 103 bp, Artificial Sequence
  Synthetic Polynucleotide
taatacgactcactatagggaactctggcgtccatccacctcggtttgagaacagaggagactcaaaatgaggtggatgaacctggcggcagcgcaaaagatg

SEQ ID NO: 83578 - DNA, 103 bp, Artificial Sequence
  Synthetic Polynucleotide
taatacgactcactataggggaacaaactctggcgtccatccacctcggtaacagaggagaaccgagatggatggacgcaacctggcggcagcgcaaaagatg

SEQ ID NO: 83579 - DNA, 103 bp, Artificial Sequence
  Synthetic Polynucleotide
taatacgactcactataggggatctgaacaaactctggcgtccatccaccaacagaggagaggtggaatgacgccagagaacctggcggcagcgcaaaagatg

SEQ ID NO: 83580 - DNA, 103 bp, Artificial Sequence
  Synthetic Polynucleotide
taatacgactcactataggggtcatctggttccaccccctcatccagcataacagaggagaatgctgatggagggggtgaacctggcggcagcgcaaaagatg

SEQ ID NO: 83581 - DNA, 103 bp, Artificial Sequence
  Synthetic Polynucleotide
taatacgactcactatagggcgcatgatctgaacaaactctggcgtccataacagaggagaatggacatgagagtttgtaacctggcggcagcgcaaaagatg

SEQ ID NO: 83582 - DNA, 103 bp, Artificial Sequence
  Synthetic Polynucleotide
taatacgactcactatagggagggccgcatgatctgaacaaactctggcgaacagaggagacgccagatgttgttcagaaacctggcggcagcgcaaaagatg

SEQ ID NO: 83583 - DNA, 103 bp, Artificial Sequence
  Synthetic Polynucleotide
taatacgactcactatagggacttcagggccgcatgatctgaacaaactcaacagaggagagagtttatgcagatcatgaacctggcggcagcgcaaaagatg

SEQ ID NO: 83584 - DNA, 103 bp, Artificial Sequence
  Synthetic Polynucleotide
taatacgactcactataggggaatgacttcagggccgcatgatctgaacaaacagaggagatgttcaatgcatgcggccaacctggcggcagcgcaaaagatg

SEQ ID NO: 83585 - DNA, 103 bp, Artificial Sequence
  Synthetic Polynucleotide
taatacgactcactatagggtccttgaatgacttcagggccgcatgatctaacagaggagaagatcaatgggccctgaaaacctggcggcagcgcaaaagatg

SEQ ID NO: 83586 - DNA, 103 bp, Artificial Sequence
  Synthetic Polynucleotide
taatacgactcactatagggcaaactccttgaatgacttcagggccgcataacagaggagaatgcggatgtgaagtcataacctggcggcagcgcaaaagatg

SEQ ID NO: 83587 - DNA, 103 bp, Artificial Sequence
  Synthetic Polynucleotide
taatacgactcactatagggagcggcaaactccttgaatgacttcagggcaacagaggagagccctgatgtcattcaagaacctggcggcagcgcaaaagatg

SEQ ID NO: 83588 - DNA, 103 bp, Artificial Sequence
  Synthetic Polynucleotide
taatacgactcactatagggttcccagcggcaaactccttgaatgacttcaacagaggagagaagtcatgcaaggagttaacctggcggcagcgcaaaagatg

SEQ ID NO: 83589 - DNA, 103 bp, Artificial Sequence
  Synthetic Polynucleotide
taatacgactcactatagggctcttttcccagcggcaaactccttgaatgaacagaggagacattcaatgagtttgccgaacctggcggcagcgcaaaagatg

SEQ ID NO: 83590 - DNA, 103 bp, Artificial Sequence
  Synthetic Polynucleotide
taatacgactcactatagggcgctcctcttttcccagcggcaaactccttaacagaggagaaaggagatggccgctgggaacctggcggcagcgcaaaagatg

SEQ ID NO: 83591 - DNA, 103 bp, Artificial Sequence
  Synthetic Polynucleotide
taatacgactcactatagggtcgacgtcatctggttccaccccctcatccaacagaggagaggatgaatgggtggaaccaacctggcggcagcgcaaaagatg

SEQ ID NO: 83592 - DNA, 103 bp, Artificial Sequence
  Synthetic Polynucleotide
taatacgactcactatagggaaagccgctcctcttttcccagcggcaaacaacagaggagagtttgcatgtgggaaaagaacctggcggcagcgcaaaagatg

SEQ ID NO: 83593 - DNA, 103 bp, Artificial Sequence
  Synthetic Polynucleotide
taatacgactcactatagggctccaaaagccgctcctcttttcccagcggaacagaggagaccgctgatgaaagaggagaacctggcggcagcgcaaaagatg

SEQ ID NO: 83594 - DNA, 103 bp, Artificial Sequence
  Synthetic Polynucleotide
taatacgactcactatagggcatcactccaaaagccgctcctcttttcccaacagaggagagggaaaatgggagcggctaacctggcggcagcgcaaaagatg

SEQ ID NO: 83595 - DNA, 103 bp, Artificial Sequence
  Synthetic Polynucleotide
taatacgactcactataggggcttccatcactccaaaagccgctcctcttaacagaggagaaagaggatgggcttttggaacctggcggcagcgcaaaagatg

SEQ ID NO: 83596 - DNA, 103 bp, Artificial Sequence
  Synthetic Polynucleotide
taatacgactcactatagggccagggcttccatcactccaaaagccgctcaacagaggagagagcggatgttggagtgaaacctggcggcagcgcaaaagatg

SEQ ID NO: 83597 - DNA, 103 bp, Artificial Sequence
  Synthetic Polynucleotide
taatacgactcactatagggtgttcccagggcttccatcactccaaaagcaacagaggagagcttttatggtgatggaaaacctggcggcagcgcaaaagatg

SEQ ID NO: 83598 - DNA, 103 bp, Artificial Sequence
  Synthetic Polynucleotide
taatacgactcactatagggggcagtgttcccagggcttccatcactccaaacagaggagatggagtatgggaagccctaacctggcggcagcgcaaaagatg

SEQ ID NO: 83599 - DNA, 103 bp, Artificial Sequence
  Synthetic Polynucleotide
taatacgactcactataggggtcctggcagtgttcccagggcttccatcaaacagaggagatgatggatgccctgggaaaacctggcggcagcgcaaaagatg

SEQ ID NO: 83600 - DNA, 103 bp, Artificial Sequence
  Synthetic Polynucleotide
taatacgactcactatagggcatgtgtcctggcagtgttcccagggcttcaacagaggagagaagccatgggaacactgaacctggcggcagcgcaaaagatg

SEQ ID NO: 83601 - DNA, 103 bp, Artificial Sequence
  Synthetic Polynucleotide
taatacgactcactatagggtctgtcatgtgtcctggcagtgttcccaggaacagaggagacctgggatgactgccaggaacctggcggcagcgcaaaagatg

SEQ ID NO: 83602 - DNA, 103 bp, Artificial Sequence
  Synthetic Polynucleotide
taatacgactcactatagggtccaaatccaaaataaaacctgttgatactaacagaggagaagtatcatgaggttttataacctggcggcagcgcaaaagatg

SEQ ID NO: 83603 - DNA, 103 bp, Artificial Sequence
  Synthetic Polynucleotide
taatacgactcactatagggaacaatcgacgtcatctggttccaccccctaacagaggagaagggggatgaaccagatgaacctggcggcagcgcaaaagatg

SEQ ID NO: 83604 - DNA, 103 bp, Artificial Sequence
  Synthetic Polynucleotide
taatacgactcactatagggatctctctgtcatgtgtcctggcagtgttcaacagaggagagaacacatgcaggacacaaacctggcggcagcgcaaaagatg

SEQ ID NO: 83605 - DNA, 103 bp, Artificial Sequence
  Synthetic Polynucleotide
taatacgactcactatagggctggaatctctctgtcatgtgtcctggcagaacagaggagactgccaatgcacatgacaaacctggcggcagcgcaaaagatg

SEQ ID NO: 83606 - DNA, 103 bp, Artificial Sequence
  Synthetic Polynucleotide
taatacgactcactataggggcttcctggaatctctctgtcatgtgtcctaacagaggagaaggacaatggacagagagaacctggcggcagcgcaaaagatg

SEQ ID NO: 83607 - DNA, 103 bp, Artificial Sequence
  Synthetic Polynucleotide
taatacgactcactatagggcaatggcttcctggaatctctctgtcatgtaacagaggagaacatgaatgagagattccaacctggcggcagcgcaaaagatg

SEQ ID NO: 83608 - DNA, 103 bp, Artificial Sequence
  Synthetic Polynucleotide
taatacgactcactataggggttgtcaatggcttcctggaatctctctgtaacagaggagaacagagatgttccaggaaaacctggcggcagcgcaaaagatg

SEQ ID NO: 83609 - DNA, 103 bp, Artificial Sequence
  Synthetic Polynucleotide
taatacgactcactataggggcgaggttgtcaatggcttcctggaatctcaacagaggagagagattatgggaagccataacctggcggcagcgcaaaagatg

SEQ ID NO: 83610 - DNA, 103 bp, Artificial Sequence
  Synthetic Polynucleotide
taatacgactcactataggggcacagcgaggttgtcaatggcttcctggaaacagaggagatccaggatgccattgacaaacctggcggcagcgcaaaagatg

SEQ ID NO: 83611 - DNA, 103 bp, Artificial Sequence
  Synthetic Polynucleotide
taatacgactcactatagggcatgagcacagcgaggttgtcaatggcttcaacagaggagagaagccatggacaacctcaacctggcggcagcgcaaaagatg

SEQ ID NO: 83612 - DNA, 103 bp, Artificial Sequence
  Synthetic Polynucleotide
taatacgactcactataggggcccgcatgagcacagcgaggttgtcaatgaacagaggagacattgaatgcctcgctgtaacctggcggcagcgcaaaagatg

SEQ ID NO: 83613 - DNA, 103 bp, Artificial Sequence
  Synthetic Polynucleotide
taatacgactcactatagggtctctgcccgcatgagcacagcgaggttgtaacagaggagaacaaccatgctgtgctcaaacctggcggcagcgcaaaagatg

SEQ ID NO: 83614 - DNA, 103 bp, Artificial Sequence
  Synthetic Polynucleotide
taatacgactcactataggggcaccaacaatcgacgtcatctggttccacaacagaggagagtggaaatggatgacgtcaacctggcggcagcgcaaaagatg

SEQ ID NO: 83615 - DNA, 103 bp, Artificial Sequence
  Synthetic Polynucleotide
taatacgactcactatagggtccagtctctgcccgcatgagcacagcgagaacagaggagactcgctatgctcatgcggaacctggcggcagcgcaaaagatg

SEQ ID NO: 83616 - DNA, 103 bp, Artificial Sequence
  Synthetic Polynucleotide
taatacgactcactatagggctgcttccagtctctgcccgcatgagcacaaacagaggagatgtgctatggcgggcagaaacctggcggcagcgcaaaagatg

SEQ ID NO: 83617 - DNA, 103 bp, Artificial Sequence
  Synthetic Polynucleotide
taatacgactcactatagggaaggcctgcttccagtctctgcccgcatgaaacagaggagatcatgcatgcagagactgaacctggcggcagcgcaaaagatg

SEQ ID NO: 83618 - DNA, 103 bp, Artificial Sequence
  Synthetic Polynucleotide
taatacgactcactatagggtttgtaaggcctgcttccagtctctgcccgaacagaggagacgggcaatgactggaagcaacctggcggcagcgcaaaagatg

SEQ ID NO: 83619 - DNA, 103 bp, Artificial Sequence
  Synthetic Polynucleotide
taatacgactcactataggggcggctttgtaaggcctgcttccagtctctaacagaggagaagagacatgaagcaggccaacctggcggcagcgcaaaagatg

SEQ ID NO: 83620 - DNA, 103 bp, Artificial Sequence
  Synthetic Polynucleotide
taatacgactcactatagggccgccgcggctttgtaaggcctgcttccagaacagaggagactggaaatgggccttacaaacctggcggcagcgcaaaagatg

SEQ ID NO: 83621 - DNA, 103 bp, Artificial Sequence
  Synthetic Polynucleotide
taatacgactcactatagggttgggccgccgcggctttgtaaggcctgctaacagaggagaagcaggatgtacaaagccaacctggcggcagcgcaaaagatg

SEQ ID NO: 83622 - DNA, 103 bp, Artificial Sequence
  Synthetic Polynucleotide
taatacgactcactatagggggcaattgggccgccgcggctttgtaaggcaacagaggagagccttaatgagccgcggcaacctggcggcagcgcaaaagatg

SEQ ID NO: 83623 - DNA, 103 bp, Artificial Sequence
  Synthetic Polynucleotide
taatacgactcactatagggtctccggcaattgggccgccgcggctttgtaacagaggagaacaaagatgcggcggcccaacctggcggcagcgcaaaagatg

SEQ ID NO: 83624 - DNA, 103 bp, Artificial Sequence
  Synthetic Polynucleotide
taatacgactcactatagggtagggtctccggcaattgggccgccgcggcaacagaggagagccgcgatggcccaattgaacctggcggcagcgcaaaagatg

SEQ ID NO: 83625 - DNA, 103 bp, Artificial Sequence
  Synthetic Polynucleotide
taatacgactcactataggggtgttgcaccaacaatcgacgtcatctggtaacagaggagaaccagaatgcgtcgattgaacctggcggcagcgcaaaagatg

SEQ ID NO: 83626 - DNA, 103 bp, Artificial Sequence
  Synthetic Polynucleotide
taatacgactcactataggggtctctagggtctccggcaattgggccgccaacagaggagaggcggcatgattgccggaaacctggcggcagcgcaaaagatg

SEQ ID NO: 83627 - DNA, 103 bp, Artificial Sequence
  Synthetic Polynucleotide
taatacgactcactatagggtaatggtctctagggtctccggcaattgggaacagaggagacccaatatgcggagacccaacctggcggcagcgcaaaagatg

SEQ ID NO: 83628 - DNA, 103 bp, Artificial Sequence
  Synthetic Polynucleotide
taatacgactcactatagggaagcataatggtctctagggtctccggcaaaacagaggagattgccgatgaccctagagaacctggcggcagcgcaaaagatg

SEQ ID NO: 83629 - DNA, 103 bp, Artificial Sequence
  Synthetic Polynucleotide
taatacgactcactatagggcccaaaagcataatggtctctagggtctccaacagaggagaggagacatgagagaccataacctggcggcagcgcaaaagatg

SEQ ID NO: 83630 - DNA, 103 bp, Artificial Sequence
  Synthetic Polynucleotide
taatacgactcactataggggcaaccccaaaagcataatggtctctagggaacagaggagaccctagatgccattatgcaacctggcggcagcgcaaaagatg

SEQ ID NO: 83631 - DNA, 103 bp, Artificial Sequence
  Synthetic Polynucleotide
taatacgactcactatagggtcccagcaaccccaaaagcataatggtctcaacagaggagagagaccatgatgcttttgaacctggcggcagcgcaaaagatg

SEQ ID NO: 83632 - DNA, 103 bp, Artificial Sequence
  Synthetic Polynucleotide
taatacgactcactatagggactgttcccagcaaccccaaaagcataatgaacagaggagacattatatgtttggggttaacctggcggcagcgcaaaagatg

SEQ ID NO: 83633 - DNA, 103 bp, Artificial Sequence
  Synthetic Polynucleotide
taatacgactcactataggggcgagactgttcccagcaaccccaaaagcaaacagaggagatgctttatgggttgctggaacctggcggcagcgcaaaagatg

SEQ ID NO: 83634 - DNA, 103 bp, Artificial Sequence
  Synthetic Polynucleotide
taatacgactcactatagggtcccagcgagactgttcccagcaaccccaaaacagaggagattggggatgctgggaacaaacctggcggcagcgcaaaagatg

SEQ ID NO: 83635 - DNA, 103 bp, Artificial Sequence
  Synthetic Polynucleotide
taatacgactcactatagggaagattcccagcgagactgttcccagcaacaacagaggagagttgctatgaacagtctcaacctggcggcagcgcaaaagatg

SEQ ID NO: 83636 - DNA, 103 bp, Artificial Sequence
  Synthetic Polynucleotide
taatacgactcactatagggacgtcgtgttgcaccaacaatcgacgtcataacagaggagaatgacgatgattgttggtaacctggcggcagcgcaaaagatg

SEQ ID NO: 83637 - DNA, 103 bp, Artificial Sequence
  Synthetic Polynucleotide
taatacgactcactatagggcgaaaaagattcccagcgagactgttcccaaacagaggagatgggaaatgtctcgctggaacctggcggcagcgcaaaagatg

SEQ ID NO: 83638 - DNA, 103 bp, Artificial Sequence
  Synthetic Polynucleotide
taatacgactcactatagggcaagacgaaaaagattcccagcgagactgtaacagaggagaacagtcatgctgggaatcaacctggcggcagcgcaaaagatg

SEQ ID NO: 83639 - DNA, 103 bp, Artificial Sequence
  Synthetic Polynucleotide
taatacgactcactatagggctcatcaagacgaaaaagattcccagcgagaacagaggagactcgctatgaatctttttaacctggcggcagcgcaaaagatg

SEQ ID NO: 83640 - DNA, 103 bp, Artificial Sequence
  Synthetic Polynucleotide
taatacgactcactatagggtgttcctcatcaagacgaaaaagattcccaaacagaggagatgggaaatgttttcgtctaacctggcggcagcgcaaaagatg

SEQ ID NO: 83641 - DNA, 103 bp, Artificial Sequence
  Synthetic Polynucleotide
taatacgactcactataggggcccttgttcctcatcaagacgaaaaagataacagaggagaatctttatggtcttgatgaacctggcggcagcgcaaaagatg

SEQ ID NO: 83642 - DNA, 103 bp, Artificial Sequence
  Synthetic Polynucleotide
taatacgactcactatagggcctatgcccttgttcctcatcaagacgaaaaacagaggagatttcgtatggatgaggaaaacctggcggcagcgcaaaagatg

SEQ ID NO: 83643 - DNA, 103 bp, Artificial Sequence
  Synthetic Polynucleotide
taatacgactcactatagggtcttccctatgcccttgttcctcatcaagaaacagaggagatcttgaatgggaacaaggaacctggcggcagcgcaaaagatg

SEQ ID NO: 83644 - DNA, 103 bp, Artificial Sequence
  Synthetic Polynucleotide
taatacgactcactataggggcccatcttccctatgcccttgttcctcataacagaggagaatgaggatgaagggcataaacctggcggcagcgcaaaagatg

SEQ ID NO: 83645 - DNA, 103 bp, Artificial Sequence
  Synthetic Polynucleotide
taatacgactcactatagggccaaagcccatcttccctatgcccttgttcaacagaggagagaacaaatgcatagggaaaacctggcggcagcgcaaaagatg

SEQ ID NO: 83646 - DNA, 103 bp, Artificial Sequence
  Synthetic Polynucleotide
taatacgactcactatagggccattccaaagcccatcttccctatgccctaacagaggagaagggcaatgggaagatggaacctggcggcagcgcaaaagatg

SEQ ID NO: 83647 - DNA, 103 bp, Artificial Sequence
  Synthetic Polynucleotide
taatacgactcactatagggagttgacgtcgtgttgcaccaacaatcgacaacagaggagagtcgatatgtggtgcaacaacctggcggcagcgcaaaagatg

SEQ ID NO: 83648 - DNA, 103 bp, Artificial Sequence
  Synthetic Polynucleotide
taatacgactcactatagggagtcaccattccaaagcccatcttccctataacagaggagaatagggatgatgggctttaacctggcggcagcgcaaaagatg

SEQ ID NO: 83649 - DNA, 103 bp, Artificial Sequence
  Synthetic Polynucleotide
taatacgactcactatagggccaagagtcaccattccaaagcccatcttcaacagaggagagaagatatgctttggaataacctggcggcagcgcaaaagatg

SEQ ID NO: 83650 - DNA, 103 bp, Artificial Sequence
  Synthetic Polynucleotide
taatacgactcactatagggtggccccaagagtcaccattccaaagcccaaacagaggagatgggctatggaatggtgaaacctggcggcagcgcaaaagatg

SEQ ID NO: 83651 - DNA, 103 bp, Artificial Sequence
  Synthetic Polynucleotide
taatacgactcactatagggtgcgctggccccaagagtcaccattccaaaaacagaggagatttggaatggtgactcttaacctggcggcagcgcaaaagatg

SEQ ID NO: 83652 - DNA, 103 bp, Artificial Sequence
  Synthetic Polynucleotide
taatacgactcactatagggagccatgcgctggccccaagagtcaccattaacagaggagaaatggtatgtcttggggcaacctggcggcagcgcaaaagatg

SEQ ID NO: 83653 - DNA, 103 bp, Artificial Sequence
  Synthetic Polynucleotide
taatacgactcactatagggacatgagccatgcgctggccccaagagtcaaacagaggagatgactcatggggccagcgaacctggcggcagcgcaaaagatg

SEQ ID NO: 83654 - DNA, 103 bp, Artificial Sequence
  Synthetic Polynucleotide
taatacgactcactataggggagccacatgagccatgcgctggccccaagaacagaggagacttgggatgagcgcatggaacctggcggcagcgcaaaagatg

SEQ ID NO: 83655 - DNA, 103 bp, Artificial Sequence
  Synthetic Polynucleotide
taatacgactcactatagggtccgagagccacatgagccatgcgctggccaacagaggagaggccagatgatggctcataacctggcggcagcgcaaaagatg

SEQ ID NO: 83656 - DNA, 103 bp, Artificial Sequence
  Synthetic Polynucleotide
taatacgactcactatagggcaatttccgagagccacatgagccatgcgcaacagaggagagcgcatatgtcatgtggcaacctggcggcagcgcaaaagatg

SEQ ID NO: 83657 - DNA, 103 bp, Artificial Sequence
  Synthetic Polynucleotide
taatacgactcactatagggtggctcaatttccgagagccacatgagccaaacagaggagatggctcatgtggctctcgaacctggcggcagcgcaaaagatg

SEQ ID NO: 83658 - DNA, 103 bp, Artificial Sequence
  Synthetic Polynucleotide
taatacgactcactatagggacccaagttgacgtcgtgttgcaccaacaaaacagaggagattgttgatgcaacacgacaacctggcggcagcgcaaaagatg

SEQ ID NO: 83659 - DNA, 103 bp, Artificial Sequence
  Synthetic Polynucleotide
taatacgactcactatagggctggctggctcaatttccgagagccacatgaacagaggagacatgtgatgctcggaaataacctggcggcagcgcaaaagatg

SEQ ID NO: 83660 - DNA, 103 bp, Artificial Sequence
  Synthetic Polynucleotide
taatacgactcactatagggcaattctggctggctcaatttccgagagccaacagaggagaggctctatgaaattgagcaacctggcggcagcgcaaaagatg

SEQ ID NO: 83661 - DNA, 103 bp, Artificial Sequence
  Synthetic Polynucleotide
taatacgactcactatagggacatgcaattctggctggctcaatttccgaaacagaggagatcggaaatggagccagccaacctggcggcagcgcaaaagatg

SEQ ID NO: 83662 - DNA, 103 bp, Artificial Sequence
  Synthetic Polynucleotide
taatacgactcactatagggaggacacatgcaattctggctggctcaattaacagaggagaaattgaatgagccagaataacctggcggcagcgcaaaagatg

SEQ ID NO: 83663 - DNA, 103 bp, Artificial Sequence
  Synthetic Polynucleotide
taatacgactcactatagggcaatgaggacacatgcaattctggctggctaacagaggagaagccagatggaattgcataacctggcggcagcgcaaaagatg

SEQ ID NO: 83664 - DNA, 103 bp, Artificial Sequence
  Synthetic Polynucleotide
taatacgactcactatagggcacaacaatgaggacacatgcaattctggcaacagaggagagccagaatggcatgtgtcaacctggcggcagcgcaaaagatg

SEQ ID NO: 83665 - DNA, 103 bp, Artificial Sequence
  Synthetic Polynucleotide
taatacgactcactatagggaggaacacaacaatgaggacacatgcaattaacagaggagaaattgcatgtgtcctcataacctggcggcagcgcaaaagatg

SEQ ID NO: 83666 - DNA, 103 bp, Artificial Sequence
  Synthetic Polynucleotide
taatacgactcactataggggcaataggaacacaacaatgaggacacatgaacagaggagacatgtgatgtcattgttgaacctggcggcagcgcaaaagatg

SEQ ID NO: 83667 - DNA, 103 bp, Artificial Sequence
  Synthetic Polynucleotide
taatacgactcactatagggcaccagcaataggaacacaacaatgaggacaacagaggagagtcctcatggttgtgttcaacctggcggcagcgcaaaagatg

SEQ ID NO: 83668 - DNA, 103 bp, Artificial Sequence
  Synthetic Polynucleotide
taatacgactcactatagggagcaccaccagcaataggaacacaacaatgaacagaggagacattgtatggttcctattaacctggcggcagcgcaaaagatg

SEQ ID NO: 83669 - DNA, 103 bp, Artificial Sequence
  Synthetic Polynucleotide
taatacgactcactatagggacacaacccaagttgacgtcgtgttgcaccaacagaggagaggtgcaatgcgacgtcaaaacctggcggcagcgcaaaagatg

SEQ ID NO: 83670 - DNA, 103 bp, Artificial Sequence
  Synthetic Polynucleotide
taatacgactcactataggggtatgagcaccaccagcaataggaacacaaaacagaggagattgtgtatgtattgctggaacctggcggcagcgcaaaagatg

SEQ ID NO: 83671 - DNA, 103 bp, Artificial Sequence
  Synthetic Polynucleotide
taatacgactcactatagggctcaggtatgagcaccaccagcaataggaaaacagaggagattcctaatgctggtggtgaacctggcggcagcgcaaaagatg

SEQ ID NO: 83672 - DNA, 103 bp, Artificial Sequence
  Synthetic Polynucleotide
taatacgactcactatagggtctggctcaggtatgagcaccaccagcaataacagaggagaattgctatgggtgctcataacctggcggcagcgcaaaagatg

SEQ ID NO: 83673 - DNA, 103 bp, Artificial Sequence
  Synthetic Polynucleotide
taatacgactcactataggggcttttctggctcaggtatgagcaccaccaaacagaggagatggtggatgtcatacctgaacctggcggcagcgcaaaagatg

SEQ ID NO: 83674 - DNA, 103 bp, Artificial Sequence
  Synthetic Polynucleotide
taatacgactcactatagggtctttgcttttctggctcaggtatgagcacaacagaggagagtgctcatgcctgagccaaacctggcggcagcgcaaaagatg

SEQ ID NO: 83675 - DNA, 103 bp, Artificial Sequence
  Synthetic Polynucleotide
taatacgactcactatagggggagatctttgcttttctggctcaggtatgaacagaggagacataccatggccagaaaaaacctggcggcagcgcaaaagatg

SEQ ID NO: 83676 - DNA, 103 bp, Artificial Sequence
  Synthetic Polynucleotide
taatacgactcactatagggcctggggagatctttgcttttctggctcagaacagaggagactgagcatgaaaagcaaaaacctggcggcagcgcaaaagatg

SEQ ID NO: 83677 - DNA, 103 bp, Artificial Sequence
  Synthetic Polynucleotide
taatacgactcactataggggttgtcctggggagatctttgcttttctggaacagaggagaccagaaatgcaaagatctaacctggcggcagcgcaaaagatg

SEQ ID NO: 83678 - DNA, 103 bp, Artificial Sequence
  Synthetic Polynucleotide
taatacgactcactatagggatttggttgtcctggggagatctttgctttaacagaggagaaaagcaatgatctccccaaacctggcggcagcgcaaaagatg

SEQ ID NO: 83679 - DNA, 103 bp, Artificial Sequence
  Synthetic Polynucleotide
taatacgactcactatagggttgccatttggttgtcctggggagatctttaacagaggagaaaagatatgcccaggacaaacctggcggcagcgcaaaagatg

SEQ ID NO: 83680 - DNA, 103 bp, Artificial Sequence
  Synthetic Polynucleotide
taatacgactcactatagggtccgtacacaacccaagttgacgtcgtgttaacagaggagaaacacgatgtcaacttggaacctggcggcagcgcaaaagatg

SEQ ID NO: 83681 - DNA, 103 bp, Artificial Sequence
  Synthetic Polynucleotide
taatacgactcactataggggatgattgccatttggttgtcctggggagaaacagaggagatctcccatggacaaccaaaacctggcggcagcgcaaaagatg

SEQ ID NO: 83682 - DNA, 103 bp, Artificial Sequence
  Synthetic Polynucleotide
taatacgactcactatagggatgatgatgattgccatttggttgtcctggaacagaggagaccaggaatgccaaatggcaacctggcggcagcgcaaaagatg

SEQ ID NO: 83683 - DNA, 103 bp, Artificial Sequence
  Synthetic Polynucleotide
taatacgactcactatagggctaccatgatgatgattgccatttggttgtaacagaggagaacaaccatgtggcaatcaaacctggcggcagcgcaaaagatg

SEQ ID NO: 83684 - DNA, 103 bp, Artificial Sequence
  Synthetic Polynucleotide
taatacgactcactatagggtactgctaccatgatgatgattgccatttgaacagaggagacaaatgatgatcatcatcaacctggcggcagcgcaaaagatg

SEQ ID NO: 83685 - DNA, 103 bp, Artificial Sequence
  Synthetic Polynucleotide
taatacgactcactatagggagacctactgctaccatgatgatgattgccaacagaggagaggcaatatgcatcatggtaacctggcggcagcgcaaaagatg

SEQ ID NO: 83686 - DNA, 103 bp, Artificial Sequence
  Synthetic Polynucleotide
taatacgactcactatagggccagaagacctactgctaccatgatgatgaaacagaggagatcatcaatgtggtagcagaacctggcggcagcgcaaaagatg

SEQ ID NO: 83687 - DNA, 103 bp, Artificial Sequence
  Synthetic Polynucleotide
taatacgactcactatagggcaagcccagaagacctactgctaccatgataacagaggagaatcatgatggcagtaggtaacctggcggcagcgcaaaagatg

SEQ ID NO: 83688 - DNA, 103 bp, Artificial Sequence
  Synthetic Polynucleotide
taatacgactcactataggggtaatcaagcccagaagacctactgctaccaacagaggagaggtagcatgaggtcttctaacctggcggcagcgcaaaagatg

SEQ ID NO: 83689 - DNA, 103 bp, Artificial Sequence
  Synthetic Polynucleotide
taatacgactcactatagggtggcggtaatcaagcccagaagacctactgaacagaggagacagtagatgttctgggctaacctggcggcagcgcaaaagatg

SEQ ID NO: 83690 - DNA, 103 bp, Artificial Sequence
  Synthetic Polynucleotide
taatacgactcactatagggttcattggcggtaatcaagcccagaagaccaacagaggagaggtcttatgggcttgattaacctggcggcagcgcaaaagatg

SEQ ID NO: 83691 - DNA, 103 bp, Artificial Sequence
  Synthetic Polynucleotide
taatacgactcactatagggcaggttccgtacacaacccaagttgacgtcaacagaggagagacgtcatgttgggttgtaacctggcggcagcgcaaaagatg

SEQ ID NO: 83692 - DNA, 103 bp, Artificial Sequence
  Synthetic Polynucleotide
taatacgactcactatagggccgagttcattggcggtaatcaagcccagaaacagaggagatctgggatggattaccgcaacctggcggcagcgcaaaagatg

SEQ ID NO: 83693 - DNA, 103 bp, Artificial Sequence
  Synthetic Polynucleotide
taatacgactcactatagggaccatccgagttcattggcggtaatcaagcaacagaggagagcttgaatgccgccaatgaacctggcggcagcgcaaaagatg

SEQ ID NO: 83694 - DNA, 103 bp, Artificial Sequence
  Synthetic Polynucleotide
taatacgactcactatagggctccaaccatccgagttcattggcggtaataacagaggagaattaccatgaatgaactcaacctggcggcagcgcaaaagatg

SEQ ID NO: 83695 - DNA, 103 bp, Artificial Sequence
  Synthetic Polynucleotide
taatacgactcactataggggttctctccaaccatccgagttcattggcgaacagaggagacgccaaatgactcggatgaacctggcggcagcgcaaaagatg

SEQ ID NO: 83696 - DNA, 103 bp, Artificial Sequence
  Synthetic Polynucleotide
taatacgactcactatagggtctttgttctctccaaccatccgagttcataacagaggagaatgaacatggatggttggaacctggcggcagcgcaaaagatg

SEQ ID NO: 83697 - DNA, 103 bp, Artificial Sequence
  Synthetic Polynucleotide
taatacgactcactataggggtcactctttgttctctccaaccatccgagaacagaggagactcggaatgttggagagaaacctggcggcagcgcaaaagatg

SEQ ID NO: 83698 - DNA, 103 bp, Artificial Sequence
  Synthetic Polynucleotide
taatacgactcactatagggcttaggtcactctttgttctctccaaccataacagaggagaatggttatggagaacaaaaacctggcggcagcgcaaaagatg

SEQ ID NO: 83699 - DNA, 103 bp, Artificial Sequence
  Synthetic Polynucleotide
taatacgactcactataggggatggcttaggtcactctttgttctctccaaacagaggagatggagaatgcaaagagtgaacctggcggcagcgcaaaagatg

SEQ ID NO: 83700 - DNA, 103 bp, Artificial Sequence
  Synthetic Polynucleotide
taatacgactcactatagggcattagatggcttaggtcactctttgttctaacagaggagaagaacaatgagtgacctaaacctggcggcagcgcaaaagatg

SEQ ID NO: 83701 - DNA, 103 bp, Artificial Sequence
  Synthetic Polynucleotide
taatacgactcactatagggcttcccattagatggcttaggtcactctttaacagaggagaaaagagatgcctaagccaaacctggcggcagcgcaaaagatg

SEQ ID NO: 83702 - DNA, 103 bp, Artificial Sequence
  Synthetic Polynucleotide
taatacgactcactataggggatggcaggttccgtacacaacccaagttgaacagaggagacaacttatgttgtgtacgaacctggcggcagcgcaaaagatg

SEQ ID NO: 83703 - DNA, 103 bp, Artificial Sequence
  Synthetic Polynucleotide
taatacgactcactatagggctctccttcccattagatggcttaggtcacaacagaggagagtgaccatggccatctaaaacctggcggcagcgcaaaagatg

SEQ ID NO: 83704 - DNA, 103 bp, Artificial Sequence
  Synthetic Polynucleotide
taatacgactcactatagggctcctctctccttcccattagatggcttagaacagaggagactaagcatgctaatgggaaacctggcggcagcgcaaaagatg

SEQ ID NO: 83705 - DNA, 103 bp, Artificial Sequence
  Synthetic Polynucleotide
taatacgactcactataggggctccctcctctctccttcccattagatggaacagaggagaccatctatggggaaggagaacctggcggcagcgcaaaagatg

SEQ ID NO: 83706 - DNA, 103 bp, Artificial Sequence
  Synthetic Polynucleotide
taatacgactcactatagggtggttgctccctcctctctccttcccattaaacagaggagataatggatgggagagaggaacctggcggcagcgcaaaagatg

SEQ ID NO: 83707 - DNA, 103 bp, Artificial Sequence
  Synthetic Polynucleotide
taatacgactcactatagggtcctatggttgctccctcctctctccttccaacagaggagaggaaggatggaggagggaaacctggcggcagcgcaaaagatg

SEQ ID NO: 83708 - DNA, 103 bp, Artificial Sequence
  Synthetic Polynucleotide
taatacgactcactataggggagaatcctatggttgctccctcctctctcaacagaggagagagagaatggggagcaacaacctggcggcagcgcaaaagatg

SEQ ID NO: 83709 - DNA, 103 bp, Artificial Sequence
  Synthetic Polynucleotide
taatacgactcactatagggccattgagaatcctatggttgctccctcctaacagaggagaaggaggatgcaaccatagaacctggcggcagcgcaaaagatg

SEQ ID NO: 83710 - DNA, 103 bp, Artificial Sequence
  Synthetic Polynucleotide
taatacgactcactatagggaatgtccattgagaatcctatggttgctccaacagaggagaggagcaatgataggattcaacctggcggcagcgcaaaagatg

SEQ ID NO: 83711 - DNA, 103 bp, Artificial Sequence
  Synthetic Polynucleotide
taatacgactcactatagggaggtcaatgtccattgagaatcctatggttaacagaggagaaaccatatgattctcaataacctggcggcagcgcaaaagatg

SEQ ID NO: 83712 - DNA, 103 bp, Artificial Sequence
  Synthetic Polynucleotide
taatacgactcactataggggccgcaggtcaatgtccattgagaatcctaaacagaggagataggatatgcaatggacaaacctggcggcagcgcaaaagatg

SEQ ID NO: 83713 - DNA, 103 bp, Artificial Sequence
  Synthetic Polynucleotide
taatacgactcactatagggtcgtttccaaatccaaaataaaacctgttgaacagaggagacaacagatgttattttggaacctggcggcagcgcaaaagatg

SEQ ID NO: 83714 - DNA, 103 bp, Artificial Sequence
  Synthetic Polynucleotide
taatacgactcactatagggtttgtgatggcaggttccgtacacaacccaaacagaggagatgggttatgtacggaaccaacctggcggcagcgcaaaagatg

SEQ ID NO: 83715 - DNA, 103 bp, Artificial Sequence
  Synthetic Polynucleotide
taatacgactcactatagggggctggccgcaggtcaatgtccattgagaaaacagaggagattctcaatggacattgacaacctggcggcagcgcaaaagatg

SEQ ID NO: 83716 - DNA, 103 bp, Artificial Sequence
  Synthetic Polynucleotide
taatacgactcactataggggctgaggctggccgcaggtcaatgtccattaacagaggagaaatggaatgtgacctgcgaacctggcggcagcgcaaaagatg

SEQ ID NO: 83717 - DNA, 103 bp, Artificial Sequence
  Synthetic Polynucleotide
taatacgactcactatagggcccaagctgaggctggccgcaggtcaatgtaacagaggagaacattgatgtgcggccagaacctggcggcagcgcaaaagatg

SEQ ID NO: 83718 - DNA, 103 bp, Artificial Sequence
  Synthetic Polynucleotide
taatacgactcactataggggatggcccaagctgaggctggccgcaggtcaacagaggagagacctgatgccagcctcaaacctggcggcagcgcaaaagatg

SEQ ID NO: 83719 - DNA, 103 bp, Artificial Sequence
  Synthetic Polynucleotide
taatacgactcactataggggcatagatggcccaagctgaggctggccgcaacagaggagagcggccatgctcagcttgaacctggcggcagcgcaaaagatg

SEQ ID NO: 83720 - DNA, 103 bp, Artificial Sequence
  Synthetic Polynucleotide
taatacgactcactatagggaggcagcatagatggcccaagctgaggctgaacagaggagacagcctatgcttgggccaaacctggcggcagcgcaaaagatg

SEQ ID NO: 83721 - DNA, 103 bp, Artificial Sequence
  Synthetic Polynucleotide
taatacgactcactatagggtgtcaaggcagcatagatggcccaagctgaaacagaggagatcagctatggccatctataacctggcggcagcgcaaaagatg

SEQ ID NO: 83722 - DNA, 103 bp, Artificial Sequence
  Synthetic Polynucleotide
taatacgactcactatagggaaagttgtcaaggcagcatagatggcccaaaacagaggagattgggcatgctatgctgcaacctggcggcagcgcaaaagatg

SEQ ID NO: 83723 - DNA, 103 bp, Artificial Sequence
  Synthetic Polynucleotide
taatacgactcactatagggtaatgaaagttgtcaaggcagcatagatggaacagaggagaccatctatgctgccttgaaacctggcggcagcgcaaaagatg

SEQ ID NO: 83724 - DNA, 103 bp, Artificial Sequence
  Synthetic Polynucleotide
taatacgactcactatagggtggggtaatgaaagttgtcaaggcagcataaacagaggagatatgctatgttgacaactaacctggcggcagcgcaaaagatg

SEQ ID NO: 83725 - DNA, 103 bp, Artificial Sequence
  Synthetic Polynucleotide
taatacgactcactatagggccttttttgtgatggcaggttccgtacacaaacagaggagatgtgtaatgaacctgccaaacctggcggcagcgcaaaagatg

SEQ ID NO: 83726 - DNA, 103 bp, Artificial Sequence
  Synthetic Polynucleotide
taatacgactcactatagggacggctggggtaatgaaagttgtcaaggcaaacagaggagatgccttatgaactttcataacctggcggcagcgcaaaagatg

SEQ ID NO: 83727 - DNA, 103 bp, Artificial Sequence
  Synthetic Polynucleotide
taatacgactcactataggggttggacggctggggtaatgaaagttgtcaaacagaggagatgacaaatgtcattacccaacctggcggcagcgcaaaagatg

SEQ ID NO: 83728 - DNA, 103 bp, Artificial Sequence
  Synthetic Polynucleotide
taatacgactcactatagggtgcatgttggacggctggggtaatgaaagtaacagaggagaactttcatgaccccagccaacctggcggcagcgcaaaagatg

SEQ ID NO: 83729 - DNA, 103 bp, Artificial Sequence
  Synthetic Polynucleotide
taatacgactcactataggggtcactgcatgttggacggctggggtaatgaacagaggagacattacatgagccgtccaaacctggcggcagcgcaaaagatg

SEQ ID NO: 83730 - DNA, 103 bp, Artificial Sequence
  Synthetic Polynucleotide
taatacgactcactatagggaagtggtcactgcatgttggacggctggggaacagaggagaccccagatgtccaacatgaacctggcggcagcgcaaaagatg

SEQ ID NO: 83731 - DNA, 103 bp, Artificial Sequence
  Synthetic Polynucleotide
taatacgactcactataggggtatgaagtggtcactgcatgttggacggcaacagaggagagccgtcatgcatgcagtgaacctggcggcagcgcaaaagatg

SEQ ID NO: 83732 - DNA, 103 bp, Artificial Sequence
  Synthetic Polynucleotide
taatacgactcactatagggttgttgtatgaagtggtcactgcatgttggaacagaggagaccaacaatgagtgaccacaacctggcggcagcgcaaaagatg

SEQ ID NO: 83733 - DNA, 103 bp, Artificial Sequence
  Synthetic Polynucleotide
taatacgactcactatagggagtagttgttgtatgaagtggtcactgcataacagaggagaatgcagatgccacttcataacctggcggcagcgcaaaagatg

SEQ ID NO: 83734 - DNA, 103 bp, Artificial Sequence
  Synthetic Polynucleotide
taatacgactcactatagggtaaggagtagttgttgtatgaagtggtcacaacagaggagagtgaccatgtcatacaacaacctggcggcagcgcaaaagatg

SEQ ID NO: 83735 - DNA, 103 bp, Artificial Sequence
  Synthetic Polynucleotide
taatacgactcactataggggccattaaggagtagttgttgtatgaagtgaacagaggagacacttcatgcaacaactaaacctggcggcagcgcaaaagatg

SEQ ID NO: 83736 - DNA, 103 bp, Artificial Sequence
  Synthetic Polynucleotide
taatacgactcactatagggcttcaccttttttgtgatggcaggttccgtaacagaggagaacggaaatggccatcacaaacctggcggcagcgcaaaagatg

SEQ ID NO: 83737 - DNA, 103 bp, Artificial Sequence
  Synthetic Polynucleotide
taatacgactcactatagggccatcgccattaaggagtagttgttgtatgaacagaggagacatacaatgactactcctaacctggcggcagcgcaaaagatg

SEQ ID NO: 83738 - DNA, 103 bp, Artificial Sequence
  Synthetic Polynucleotide
taatacgactcactatagggcgtggccatcgccattaaggagtagttgttaacagaggagaaacaacatgtccttaatgaacctggcggcagcgcaaaagatg

SEQ ID NO: 83739 - DNA, 103 bp, Artificial Sequence
  Synthetic Polynucleotide
taatacgactcactataggggcttgcgtggccatcgccattaaggagtagaacagaggagactactcatgaatggcgataacctggcggcagcgcaaaagatg

SEQ ID NO: 83740 - DNA, 103 bp, Artificial Sequence
  Synthetic Polynucleotide
taatacgactcactatagggctccagcttgcgtggccatcgccattaaggaacagaggagaccttaaatgcgatggccaaacctggcggcagcgcaaaagatg

SEQ ID NO: 83741 - DNA, 103 bp, Artificial Sequence
  Synthetic Polynucleotide
taatacgactcactatagggcaacactccagcttgcgtggccatcgccataacagaggagaatggcgatggccacgcaaaacctggcggcagcgcaaaagatg

SEQ ID NO: 83742 - DNA, 103 bp, Artificial Sequence
  Synthetic Polynucleotide
taatacgactcactatagggccaaacaacactccagcttgcgtggccatcaacagaggagagatggcatggcaagctggaacctggcggcagcgcaaaagatg

SEQ ID NO: 83743 - DNA, 103 bp, Artificial Sequence
  Synthetic Polynucleotide
taatacgactcactatagggccataccaaacaacactccagcttgcgtggaacagaggagaccacgcatgctggagtgtaacctggcggcagcgcaaaagatg

SEQ ID NO: 83744 - DNA, 103 bp, Artificial Sequence
  Synthetic Polynucleotide
taatacgactcactatagggtttgcccataccaaacaacactccagcttgaacagaggagacaagctatggtgttgtttaacctggcggcagcgcaaaagatg

SEQ ID NO: 83745 - DNA, 103 bp, Artificial Sequence
  Synthetic Polynucleotide
taatacgactcactatagggatccctttgcccataccaaacaacactccaaacagaggagatggagtatggtttggtataacctggcggcagcgcaaaagatg

SEQ ID NO: 83746 - DNA, 103 bp, Artificial Sequence
  Synthetic Polynucleotide
taatacgactcactatagggatggcatccctttgcccataccaaacaacaaacagaggagatgttgtatggtatgggcaaacctggcggcagcgcaaaagatg

SEQ ID NO: 83747 - DNA, 103 bp, Artificial Sequence
  Synthetic Polynucleotide
taatacgactcactatagggccgtgcttcaccttttttgtgatggcaggtaacagaggagaacctgcatgcacaaaaaaaacctggcggcagcgcaaaagatg

SEQ ID NO: 83748 - DNA, 103 bp, Artificial Sequence
  Synthetic Polynucleotide
taatacgactcactataggggtagaatggcatccctttgcccataccaaaaacagaggagatttggtatgggcaaagggaacctggcggcagcgcaaaagatg

SEQ ID NO: 83749 - DNA, 103 bp, Artificial Sequence
  Synthetic Polynucleotide
taatacgactcactatagggcatgcgtagaatggcatccctttgcccataaacagaggagatatgggatgagggatgccaacctggcggcagcgcaaaagatg

SEQ ID NO: 83750 - DNA, 103 bp, Artificial Sequence
  Synthetic Polynucleotide
taatacgactcactatagggagtcccatgcgtagaatggcatccctttgcaacagaggagagcaaagatgtgccattctaacctggcggcagcgcaaaagatg

SEQ ID NO: 83751 - DNA, 103 bp, Artificial Sequence
  Synthetic Polynucleotide
taatacgactcactatagggtccaaagtcccatgcgtagaatggcatcccaacagaggagagggatgatgttctacgcaaacctggcggcagcgcaaaagatg

SEQ ID NO: 83752 - DNA, 103 bp, Artificial Sequence
  Synthetic Polynucleotide
taatacgactcactataggggggactccaaagtcccatgcgtagaatggcaacagaggagagccattatgcgcatgggaaacctggcggcagcgcaaaagatg

SEQ ID NO: 83753 - DNA, 103 bp, Artificial Sequence
  Synthetic Polynucleotide
taatacgactcactataggggcagcgggactccaaagtcccatgcgtagaaacagaggagatctacgatggggactttgaacctggcggcagcgcaaaagatg

SEQ ID NO: 83754 - DNA, 103 bp, Artificial Sequence
  Synthetic Polynucleotide
taatacgactcactatagggcattagcagcgggactccaaagtcccatgcaacagaggagagcatggatgtttggagtcaacctggcggcagcgcaaaagatg

SEQ ID NO: 83755 - DNA, 103 bp, Artificial Sequence
  Synthetic Polynucleotide
taatacgactcactatagggcctatcattagcagcgggactccaaagtccaacagaggagaggacttatgagtcccgctaacctggcggcagcgcaaaagatg

SEQ ID NO: 83756 - DNA, 103 bp, Artificial Sequence
  Synthetic Polynucleotide
taatacgactcactatagggagcaacctatcattagcagcgggactccaaaacagaggagattggagatgcgctgctaaaacctggcggcagcgcaaaagatg

SEQ ID NO: 83757 - DNA, 103 bp, Artificial Sequence
  Synthetic Polynucleotide
taatacgactcactatagggtgagtagcaacctatcattagcagcgggacaacagaggagagtcccgatgctaatgataaacctggcggcagcgcaaaagatg

SEQ ID NO: 83758 - DNA, 103 bp, Artificial Sequence
  Synthetic Polynucleotide
taatacgactcactataggggatctccgtgcttcaccttttttgtgatggaacagaggagaccatcaatgaaaaggtgaaacctggcggcagcgcaaaagatg

SEQ ID NO: 83759 - DNA, 103 bp, Artificial Sequence
  Synthetic Polynucleotide
taatacgactcactatagggaattgtgagtagcaacctatcattagcagcaacagaggagagctgctatggataggttgaacctggcggcagcgcaaaagatg

SEQ ID NO: 83760 - DNA, 103 bp, Artificial Sequence
  Synthetic Polynucleotide
taatacgactcactataggggtgttaattgtgagtagcaacctatcattaaacagaggagataatgaatggttgctactaacctggcggcagcgcaaaagatg

SEQ ID NO: 83761 - DNA, 103 bp, Artificial Sequence
  Synthetic Polynucleotide
taatacgactcactatagggcaggggtgttaattgtgagtagcaacctataacagaggagaataggtatgtactcacaaaacctggcggcagcgcaaaagatg

SEQ ID NO: 83762 - DNA, 103 bp, Artificial Sequence
  Synthetic Polynucleotide
taatacgactcactatagggagggtcaggggtgttaattgtgagtagcaaaacagaggagattgctaatgacaattaacaacctggcggcagcgcaaaagatg

SEQ ID NO: 83763 - DNA, 103 bp, Artificial Sequence
  Synthetic Polynucleotide
taatacgactcactatagggctattagggtcaggggtgttaattgtgagtaacagaggagaactcacatgtaacaccccaacctggcggcagcgcaaaagatg

SEQ ID NO: 83764 - DNA, 103 bp, Artificial Sequence
  Synthetic Polynucleotide
taatacgactcactatagggggccactattagggtcaggggtgttaattgaacagaggagacaattaatgcccctgaccaacctggcggcagcgcaaaagatg

SEQ ID NO: 83765 - DNA, 103 bp, Artificial Sequence
  Synthetic Polynucleotide
taatacgactcactatagggatgatggccactattagggtcaggggtgttaacagaggagaaacaccatggaccctaataacctggcggcagcgcaaaagatg

SEQ ID NO: 83766 - DNA, 103 bp, Artificial Sequence
  Synthetic Polynucleotide
taatacgactcactataggggcaaaatgatggccactattagggtcagggaacagaggagaccctgaatgtaatagtggaacctggcggcagcgcaaaagatg

SEQ ID NO: 83767 - DNA, 103 bp, Artificial Sequence
  Synthetic Polynucleotide
taatacgactcactatagggcacgagcaaaatgatggccactattagggtaacagaggagaaccctaatggtggccatcaacctggcggcagcgcaaaagatg

SEQ ID NO: 83768 - DNA, 103 bp, Artificial Sequence
  Synthetic Polynucleotide
taatacgactcactatagggtgcgccacgagcaaaatgatggccactattaacagaggagaaatagtatgcatcattttaacctggcggcagcgcaaaagatg

SEQ ID NO: 83769 - DNA, 103 bp, Artificial Sequence
  Synthetic Polynucleotide
taatacgactcactatagggttctagatctccgtgcttcaccttttttgtaacagaggagaacaaaaatggtgaagcacaacctggcggcagcgcaaaagatg

SEQ ID NO: 83770 - DNA, 103 bp, Artificial Sequence
  Synthetic Polynucleotide
taatacgactcactatagggtgtagtgcgccacgagcaaaatgatggccaaacagaggagatggccaatgttttgctcgaacctggcggcagcgcaaaagatg

SEQ ID NO: 83771 - DNA, 103 bp, Artificial Sequence
  Synthetic Polynucleotide
taatacgactcactataggggtacatgtagtgcgccacgagcaaaatgataacagaggagaatcattatgctcgtggcgaacctggcggcagcgcaaaagatg

SEQ ID NO: 83772 - DNA, 103 bp, Artificial Sequence
  Synthetic Polynucleotide
taatacgactcactatagggatcaagtacatgtagtgcgccacgagcaaaaacagaggagatttgctatgggcgcactaaacctggcggcagcgcaaaagatg

SEQ ID NO: 83773 - DNA, 103 bp, Artificial Sequence
  Synthetic Polynucleotide
taatacgactcactatagggctgggatcaagtacatgtagtgcgccacgaaacagaggagatcgtggatgactacatgtaacctggcggcagcgcaaaagatg

SEQ ID NO: 83774 - DNA, 103 bp, Artificial Sequence
  Synthetic Polynucleotide
taatacgactcactatagggcagccctgggatcaagtacatgtagtgcgcaacagaggagagcgcacatgatgtacttgaacctggcggcagcgcaaaagatg

SEQ ID NO: 83775 - DNA, 103 bp, Artificial Sequence
  Synthetic Polynucleotide
taatacgactcactataggggcctgcagccctgggatcaagtacatgtagaacagaggagactacatatgcttgatcccaacctggcggcagcgcaaaagatg

SEQ ID NO: 83776 - DNA, 103 bp, Artificial Sequence
  Synthetic Polynucleotide
taatacgactcactatagggctgctgcctgcagccctgggatcaagtacaaacagaggagatgtactatgtcccagggcaacctggcggcagcgcaaaagatg

SEQ ID NO: 83777 - DNA, 103 bp, Artificial Sequence
  Synthetic Polynucleotide
taatacgactcactatagggcgcagctgctgcctgcagccctgggatcaaaacagaggagattgatcatggggctgcagaacctggcggcagcgcaaaagatg

SEQ ID NO: 83778 - DNA, 103 bp, Artificial Sequence
  Synthetic Polynucleotide
taatacgactcactataggggcacgcgcagctgctgcctgcagccctgggaacagaggagacccaggatggcaggcagcaacctggcggcagcgcaaaagatg

SEQ ID NO: 83779 - DNA, 103 bp, Artificial Sequence
  Synthetic Polynucleotide
taatacgactcactataggggggcagcacgcgcagctgctgcctgcagccaacagaggagaggctgcatgcagcagctgaacctggcggcagcgcaaaagatg

SEQ ID NO: 83780 - DNA, 103 bp, Artificial Sequence
  Synthetic Polynucleotide
taatacgactcactatagggagctcttctagatctccgtgcttcacctttaacagaggagaaaaggtatggcacggagaaacctggcggcagcgcaaaagatg

SEQ ID NO: 83781 - DNA, 103 bp, Artificial Sequence
  Synthetic Polynucleotide
taatacgactcactatagggcttctgggcagcacgcgcagctgctgcctgaacagaggagacaggcaatggctgcgcgtaacctggcggcagcgcaaaagatg

SEQ ID NO: 83782 - DNA, 103 bp, Artificial Sequence
  Synthetic Polynucleotide
taatacgactcactataggggttctcttctgggcagcacgcgcagctgctaacagaggagaagcagcatggcgtgctgcaacctggcggcagcgcaaaagatg

SEQ ID NO: 83783 - DNA, 103 bp, Artificial Sequence
  Synthetic Polynucleotide
taatacgactcactatagggctgccgttctcttctgggcagcacgcgcagaacagaggagactgcgcatgctgcccagaaacctggcggcagcgcaaaagatg

SEQ ID NO: 83784 - DNA, 103 bp, Artificial Sequence
  Synthetic Polynucleotide
taatacgactcactataggggccagctgccgttctcttctgggcagcacgaacagaggagacgtgctatgcagaagagaaacctggcggcagcgcaaaagatg

SEQ ID NO: 83785 - DNA, 103 bp, Artificial Sequence
  Synthetic Polynucleotide
taatacgactcactatagggatgatgccagctgccgttctcttctgggcaaacagaggagatgcccaatggagaacggcaacctggcggcagcgcaaaagatg

SEQ ID NO: 83786 - DNA, 103 bp, Artificial Sequence
  Synthetic Polynucleotide
taatacgactcactatagggtcttcatgatgccagctgccgttctcttctaacagaggagaagaagaatgcggcagctgaacctggcggcagcgcaaaagatg

SEQ ID NO: 83787 - DNA, 103 bp, Artificial Sequence
  Synthetic Polynucleotide
taatacgactcactatagggagggttcttcatgatgccagctgccgttctaacagaggagaagaacgatggctggcatcaacctggcggcagcgcaaaagatg

SEQ ID NO: 83788 - DNA, 103 bp, Artificial Sequence
  Synthetic Polynucleotide
taatacgactcactatagggacaacagggttcttcatgatgccagctgccaacagaggagaggcagcatgcatcatgaaaacctggcggcagcgcaaaagatg

SEQ ID NO: 83789 - DNA, 103 bp, Artificial Sequence
  Synthetic Polynucleotide
taatacgactcactatagggcatccacaacagggttcttcatgatgccagaacagaggagactggcaatgtgaagaaccaacctggcggcagcgcaaaagatg

SEQ ID NO: 83790 - DNA, 103 bp, Artificial Sequence
  Synthetic Polynucleotide
taatacgactcactatagggtattccatccacaacagggttcttcatgataacagaggagaatcatgatgaaccctgttaacctggcggcagcgcaaaagatg

SEQ ID NO: 83791 - DNA, 103 bp, Artificial Sequence
  Synthetic Polynucleotide
taatacgactcactataggggtcacagctcttctagatctccgtgcttcaaacagaggagatgaagcatggagatctagaacctggcggcagcgcaaaagatg

SEQ ID NO: 83792 - DNA, 103 bp, Artificial Sequence
  Synthetic Polynucleotide
taatacgactcactatagggaccactattccatccacaacagggttcttcaacagaggagagaagaaatgtgttgtggaaacctggcggcagcgcaaaagatg

SEQ ID NO: 83793 - DNA, 103 bp, Artificial Sequence
  Synthetic Polynucleotide
taatacgactcactatagggcagtcaccactattccatccacaacagggtaacagaggagaaccctgatgtggatggaaaacctggcggcagcgcaaaagatg

SEQ ID NO: 83794 - DNA, 103 bp, Artificial Sequence
  Synthetic Polynucleotide
taatacgactcactatagggaatgtcagtcaccactattccatccacaacaacagaggagagttgtgatgggaatagtgaacctggcggcagcgcaaaagatg

SEQ ID NO: 83795 - DNA, 103 bp, Artificial Sequence
  Synthetic Polynucleotide
taatacgactcactataggggtgtcaatgtcagtcaccactattccatccaacagaggagaggatggatgagtggtgacaacctggcggcagcgcaaaagatg

SEQ ID NO: 83796 - DNA, 103 bp, Artificial Sequence
  Synthetic Polynucleotide
taatacgactcactatagggtcattgtgtcaatgtcagtcaccactattcaacagaggagagaatagatgtgactgacaaacctggcggcagcgcaaaagatg

SEQ ID NO: 83797 - DNA, 103 bp, Artificial Sequence
  Synthetic Polynucleotide
taatacgactcactatagggaattgtcattgtgtcaatgtcagtcaccacaacagaggagagtggtgatggacattgacaacctggcggcagcgcaaaagatg

SEQ ID NO: 83798 - DNA, 103 bp, Artificial Sequence
  Synthetic Polynucleotide
taatacgactcactataggggggtcaattgtcattgtgtcaatgtcagtcaacagaggagagactgaatgtgacacaataacctggcggcagcgcaaaagatg

SEQ ID NO: 83799 - DNA, 103 bp, Artificial Sequence
  Synthetic Polynucleotide
taatacgactcactatagggcttgggggtcaattgtcattgtgtcaatgtaacagaggagaacattgatgcaatgacaaaacctggcggcagcgcaaaagatg

SEQ ID NO: 83800 - DNA, 103 bp, Artificial Sequence
  Synthetic Polynucleotide
taatacgactcactatagggctccacttgggggtcaattgtcattgtgtcaacagaggagagacacaatgacaattgacaacctggcggcagcgcaaaagatg

SEQ ID NO: 83801 - DNA, 103 bp, Artificial Sequence
  Synthetic Polynucleotide
taatacgactcactatagggtttttctccacttgggggtcaattgtcattaacagaggagaaatgacatgtgacccccaaacctggcggcagcgcaaaagatg

SEQ ID NO: 83802 - DNA, 103 bp, Artificial Sequence
  Synthetic Polynucleotide
taatacgactcactatagggggagcgtcacagctcttctagatctccgtgaacagaggagacacggaatgctagaagagaacctggcggcagcgcaaaagatg

SEQ ID NO: 83803 - DNA, 103 bp, Artificial Sequence
  Synthetic Polynucleotide
taatacgactcactatagggccatctttttctccacttgggggtcaattgaacagaggagacaattgatgcccaagtggaacctggcggcagcgcaaaagatg

SEQ ID NO: 83804 - DNA, 103 bp, Artificial Sequence
  Synthetic Polynucleotide
taatacgactcactatagggctgtcccatctttttctccacttgggggtcaacagaggagagaccccatggtggagaaaaacctggcggcagcgcaaaagatg

SEQ ID NO: 83805 - DNA, 103 bp, Artificial Sequence
  Synthetic Polynucleotide
taatacgactcactatagggagcacctgtcccatctttttctccacttggaacagaggagaccaagtatggaaaaagataacctggcggcagcgcaaaagatg

SEQ ID NO: 83806 - DNA, 103 bp, Artificial Sequence
  Synthetic Polynucleotide
taatacgactcactatagggtgagtagcacctgtcccatctttttctccaaacagaggagatggagaatgagatgggacaacctggcggcagcgcaaaagatg

SEQ ID NO: 83807 - DNA, 103 bp, Artificial Sequence
  Synthetic Polynucleotide
taatacgactcactatagggtgctatgagtagcacctgtcccatctttttaacagaggagaaaaaagatgggacaggtgaacctggcggcagcgcaaaagatg

SEQ ID NO: 83808 - DNA, 103 bp, Artificial Sequence
  Synthetic Polynucleotide
taatacgactcactataggggctactgctatgagtagcacctgtcccatcaacagaggagagatgggatgggtgctactaacctggcggcagcgcaaaagatg

SEQ ID NO: 83809 - DNA, 103 bp, Artificial Sequence
  Synthetic Polynucleotide
taatacgactcactatagggagactgctactgctatgagtagcacctgtcaacagaggagagacaggatgtactcatagaacctggcggcagcgcaaaagatg

SEQ ID NO: 83810 - DNA, 103 bp, Artificial Sequence
  Synthetic Polynucleotide
taatacgactcactataggggctggagactgctactgctatgagtagcacaacagaggagagtgctaatgatagcagtaaacctggcggcagcgcaaaagatg

SEQ ID NO: 83811 - DNA, 103 bp, Artificial Sequence
  Synthetic Polynucleotide
taatacgactcactatagggatggcgctggagactgctactgctatgagtaacagaggagaactcatatgagtagcagtaacctggcggcagcgcaaaagatg

SEQ ID NO: 83812 - DNA, 103 bp, Artificial Sequence
  Synthetic Polynucleotide
taatacgactcactatagggacagtatggcgctggagactgctactgctaaacagaggagatagcagatgcagtctccaaacctggcggcagcgcaaaagatg

SEQ ID NO: 83813 - DNA, 103 bp, Artificial Sequence
  Synthetic Polynucleotide
taatacgactcactatagggggaggggagcgtcacagctcttctagatctaacagaggagaagatctatgagagctgtgaacctggcggcagcgcaaaagatg

SEQ ID NO: 83814 - DNA, 103 bp, Artificial Sequence
  Synthetic Polynucleotide
taatacgactcactatagggccgcgacagtatggcgctggagactgctacaacagaggagagtagcaatgtccagcgccaacctggcggcagcgcaaaagatg

SEQ ID NO: 83815 - DNA, 103 bp, Artificial Sequence
  Synthetic Polynucleotide
taatacgactcactataggggcggtccgcgacagtatggcgctggagactaacagaggagaagtctcatgcgccatactaacctggcggcagcgcaaaagatg

SEQ ID NO: 83816 - DNA, 103 bp, Artificial Sequence
  Synthetic Polynucleotide
taatacgactcactatagggcccaggcggtccgcgacagtatggcgctggaacagaggagaccagcgatgtactgtcgcaacctggcggcagcgcaaaagatg

SEQ ID NO: 83817 - DNA, 103 bp, Artificial Sequence
  Synthetic Polynucleotide
taatacgactcactatagggccacccccaggcggtccgcgacagtatggcaacagaggagagccataatgtcgcggaccaacctggcggcagcgcaaaagatg

SEQ ID NO: 83818 - DNA, 103 bp, Artificial Sequence
  Synthetic Polynucleotide
taatacgactcactatagggtccccccacccccaggcggtccgcgacagtaacagaggagaactgtcatggaccgcctgaacctggcggcagcgcaaaagatg

SEQ ID NO: 83819 - DNA, 103 bp, Artificial Sequence
  Synthetic Polynucleotide
taatacgactcactatagggcagcctccccccacccccaggcggtccgcgaacagaggagacgcggaatgcctgggggtaacctggcggcagcgcaaaagatg

SEQ ID NO: 83820 - DNA, 103 bp, Artificial Sequence
  Synthetic Polynucleotide
taatacgactcactatagggggccccagcctccccccacccccaggcggtaacagaggagaaccgccatggggtgggggaacctggcggcagcgcaaaagatg

SEQ ID NO: 83821 - DNA, 103 bp, Artificial Sequence
  Synthetic Polynucleotide
taatacgactcactatagggatcagggccccagcctccccccacccccagaacagaggagactggggatggggggaggcaacctggcggcagcgcaaaagatg

SEQ ID NO: 83822 - DNA, 103 bp, Artificial Sequence
  Synthetic Polynucleotide
taatacgactcactatagggctgtgatcagggccccagcctccccccaccaacagaggagaggtgggatgaggctggggaacctggcggcagcgcaaaagatg

SEQ ID NO: 83823 - DNA, 103 bp, Artificial Sequence
  Synthetic Polynucleotide
taatacgactcactatagggtgcggctgtgatcagggccccagcctccccaacagaggagaggggagatgggggccctgaacctggcggcagcgcaaaagatg

SEQ ID NO: 83824 - DNA, 103 bp, Artificial Sequence
  Synthetic Polynucleotide
taatacgactcactatagggaactctcgtttccaaatccaaaataaaaccaacagaggagaggttttatgttggatttgaacctggcggcagcgcaaaagatg

SEQ ID NO: 83825 - DNA, 103 bp, Artificial Sequence
  Synthetic Polynucleotide
taatacgactcactataggggaatgggaggggagcgtcacagctcttctaaacagaggagatagaagatgtgtgacgctaacctggcggcagcgcaaaagatg

SEQ ID NO: 83826 - DNA, 103 bp, Artificial Sequence
  Synthetic Polynucleotide
taatacgactcactataggggaagttgcggctgtgatcagggccccagccaacagaggagaggctggatgcctgatcacaacctggcggcagcgcaaaagatg

SEQ ID NO: 83827 - DNA, 103 bp, Artificial Sequence
  Synthetic Polynucleotide
taatacgactcactatagggaagtggaagttgcggctgtgatcagggcccaacagaggagagggcccatgtcacagccgaacctggcggcagcgcaaaagatg

SEQ ID NO: 83828 - DNA, 103 bp, Artificial Sequence
  Synthetic Polynucleotide
taatacgactcactatagggccacaaagtggaagttgcggctgtgatcagaacagaggagactgatcatggccgcaactaacctggcggcagcgcaaaagatg

SEQ ID NO: 83829 - DNA, 103 bp, Artificial Sequence
  Synthetic Polynucleotide
taatacgactcactatagggccttcccacaaagtggaagttgcggctgtgaacagaggagacacagcatgaacttccacaacctggcggcagcgcaaaagatg

SEQ ID NO: 83830 - DNA, 103 bp, Artificial Sequence
  Synthetic Polynucleotide
taatacgactcactataggggagagccttcccacaaagtggaagttgcggaacagaggagaccgcaaatgccactttgtaacctggcggcagcgcaaaagatg

SEQ ID NO: 83831 - DNA, 103 bp, Artificial Sequence
  Synthetic Polynucleotide
taatacgactcactataggggttcggagagccttcccacaaagtggaagtaacagaggagaacttccatgttgtgggaaaacctggcggcagcgcaaaagatg

SEQ ID NO: 83832 - DNA, 103 bp, Artificial Sequence
  Synthetic Polynucleotide
taatacgactcactatagggtacttgttcggagagccttcccacaaagtgaacagaggagacactttatgggaaggctcaacctggcggcagcgcaaaagatg

SEQ ID NO: 83833 - DNA, 103 bp, Artificial Sequence
  Synthetic Polynucleotide
taatacgactcactatagggtccagtacttgttcggagagccttcccacaaacagaggagatgtgggatggctctccgaaacctggcggcagcgcaaaagatg

SEQ ID NO: 83834 - DNA, 103 bp, Artificial Sequence
  Synthetic Polynucleotide
taatacgactcactatagggggagttccagtacttgttcggagagccttcaacagaggagagaaggcatgccgaacaagaacctggcggcagcgcaaaagatg

SEQ ID NO: 83835 - DNA, 103 bp, Artificial Sequence
  Synthetic Polynucleotide
taatacgactcactataggggtagaggagttccagtacttgttcggagagaacagaggagactctccatgcaagtactgaacctggcggcagcgcaaaagatg

SEQ ID NO: 83836 - DNA, 103 bp, Artificial Sequence
  Synthetic Polynucleotide
taatacgactcactatagggtagtggaatgggaggggagcgtcacagctcaacagaggagagagctgatgcgctcccctaacctggcggcagcgcaaaagatg

SEQ ID NO: 83837 - DNA, 103 bp, Artificial Sequence
  Synthetic Polynucleotide
taatacgactcactatagggtggctgtagaggagttccagtacttgttcgaacagaggagacgaacaatgactggaactaacctggcggcagcgcaaaagatg

SEQ ID NO: 83838 - DNA, 103 bp, Artificial Sequence
  Synthetic Polynucleotide
taatacgactcactatagggtgaagtggctgtagaggagttccagtacttaacagaggagaaagtacatgaactcctctaacctggcggcagcgcaaaagatg

SEQ ID NO: 83839 - DNA, 103 bp, Artificial Sequence
  Synthetic Polynucleotide
taatacgactcactatagggcacagtgaagtggctgtagaggagttccagaacagaggagactggaaatgctctacagcaacctggcggcagcgcaaaagatg

SEQ ID NO: 83840 - DNA, 103 bp, Artificial Sequence
  Synthetic Polynucleotide
taatacgactcactatagggtgttacacagtgaagtggctgtagaggagtaacagaggagaactcctatgcagccacttaacctggcggcagcgcaaaagatg

SEQ ID NO: 83841 - DNA, 103 bp, Artificial Sequence
  Synthetic Polynucleotide
taatacgactcactatagggaaaaatgttacacagtgaagtggctgtagaaacagaggagatctacaatgacttcactgaacctggcggcagcgcaaaagatg

SEQ ID NO: 83842 - DNA, 103 bp, Artificial Sequence
  Synthetic Polynucleotide
taatacgactcactatagggcccctaaaaatgttacacagtgaagtggctaacagaggagaagccacatgactgtgtaaaacctggcggcagcgcaaaagatg

SEQ ID NO: 83843 - DNA, 103 bp, Artificial Sequence
  Synthetic Polynucleotide
taatacgactcactatagggaacttcccctaaaaatgttacacagtgaagaacagaggagacttcacatggtaacatttaacctggcggcagcgcaaaagatg

SEQ ID NO: 83844 - DNA, 103 bp, Artificial Sequence
  Synthetic Polynucleotide
taatacgactcactatagggcaagtaacttcccctaaaaatgttacacagaacagaggagactgtgtatgatttttaggaacctggcggcagcgcaaaagatg

SEQ ID NO: 83845 - DNA, 103 bp, Artificial Sequence
  Synthetic Polynucleotide
taatacgactcactatagggccagccaagtaacttcccctaaaaatgttaaacagaggagataacatatgtaggggaagaacctggcggcagcgcaaaagatg

SEQ ID NO: 83846 - DNA, 103 bp, Artificial Sequence
  Synthetic Polynucleotide
taatacgactcactatagggaagctccagccaagtaacttcccctaaaaaaacagaggagatttttaatggaagttactaacctggcggcagcgcaaaagatg

SEQ ID NO: 83847 - DNA, 103 bp, Artificial Sequence
  Synthetic Polynucleotide
taatacgactcactatagggcttcctagtggaatgggaggggagcgtcacaacagaggagagtgacgatgccctcccataacctggcggcagcgcaaaagatg

SEQ ID NO: 83848 - DNA, 103 bp, Artificial Sequence
  Synthetic Polynucleotide
taatacgactcactatagggtagagaagctccagccaagtaacttcccctaacagaggagaaggggaatgtacttggctaacctggcggcagcgcaaaagatg

SEQ ID NO: 83849 - DNA, 103 bp, Artificial Sequence
  Synthetic Polynucleotide
taatacgactcactatagggtagattagagaagctccagccaagtaacttaacagaggagaaagttaatgggctggagcaacctggcggcagcgcaaaagatg

SEQ ID NO: 83850 - DNA, 103 bp, Artificial Sequence
  Synthetic Polynucleotide
taatacgactcactatagggctatgtagattagagaagctccagccaagtaacagaggagaacttggatggagcttctcaacctggcggcagcgcaaaagatg

SEQ ID NO: 83851 - DNA, 103 bp, Artificial Sequence
  Synthetic Polynucleotide
taatacgactcactatagggtgttactatgtagattagagaagctccagcaacagaggagagctggaatgtctctaatcaacctggcggcagcgcaaaagatg

SEQ ID NO: 83852 - DNA, 103 bp, Artificial Sequence
  Synthetic Polynucleotide
taatacgactcactatagggtttcttgttactatgtagattagagaagctaacagaggagaagcttcatgaatctacataacctggcggcagcgcaaaagatg

SEQ ID NO: 83853 - DNA, 103 bp, Artificial Sequence
  Synthetic Polynucleotide
taatacgactcactatagggcagcgtttcttgttactatgtagattagagaacagaggagactctaaatgacatagtaaaacctggcggcagcgcaaaagatg

SEQ ID NO: 83854 - DNA, 103 bp, Artificial Sequence
  Synthetic Polynucleotide
taatacgactcactatagggcaagccagcgtttcttgttactatgtagataacagaggagaatctacatggtaacaagaaacctggcggcagcgcaaaagatg

SEQ ID NO: 83855 - DNA, 103 bp, Artificial Sequence
  Synthetic Polynucleotide
taatacgactcactatagggttgaccaagccagcgtttcttgttactatgaacagaggagacatagtatgaagaaacgcaacctggcggcagcgcaaaagatg

SEQ ID NO: 83856 - DNA, 103 bp, Artificial Sequence
  Synthetic Polynucleotide
taatacgactcactataggggtctcttgaccaagccagcgtttcttgttaaacagaggagataacaaatgacgctggctaacctggcggcagcgcaaaagatg

SEQ ID NO: 83857 - DNA, 103 bp, Artificial Sequence
  Synthetic Polynucleotide
taatacgactcactatagggcccacgtctcttgaccaagccagcgtttctaacagaggagaagaaacatgggcttggtcaacctggcggcagcgcaaaagatg

SEQ ID NO: 83858 - DNA, 103 bp, Artificial Sequence
  Synthetic Polynucleotide
taatacgactcactatagggtgcagcttcctagtggaatgggaggggagcaacagaggagagctcccatgccattccacaacctggcggcagcgcaaaagatg

SEQ ID NO: 83859 - DNA, 103 bp, Artificial Sequence
  Synthetic Polynucleotide
taatacgactcactatagggccacccccacgtctcttgaccaagccagcgaacagaggagacgctggatgggtcaagagaacctggcggcagcgcaaaagatg

SEQ ID NO: 83860 - DNA, 103 bp, Artificial Sequence
  Synthetic Polynucleotide
taatacgactcactatagggctgttccacccccacgtctcttgaccaagcaacagaggagagcttggatgagagacgtgaacctggcggcagcgcaaaagatg

SEQ ID NO: 83861 - DNA, 103 bp, Artificial Sequence
  Synthetic Polynucleotide
taatacgactcactatagggctctcctgttccacccccacgtctcttgacaacagaggagagtcaagatgcgtgggggtaacctggcggcagcgcaaaagatg

SEQ ID NO: 83862 - DNA, 103 bp, Artificial Sequence
  Synthetic Polynucleotide
taatacgactcactatagggagggtctctcctgttccacccccacgtctcaacagaggagagagacgatggggtggaacaacctggcggcagcgcaaaagatg

SEQ ID NO: 83863 - DNA, 103 bp, Artificial Sequence
  Synthetic Polynucleotide
taatacgactcactatagggctcccagggtctctcctgttccacccccacaacagaggagagtggggatggaacaggagaacctggcggcagcgcaaaagatg

SEQ ID NO: 83864 - DNA, 103 bp, Artificial Sequence
  Synthetic Polynucleotide
taatacgactcactatagggtttctctcccagggtctctcctgttccaccaacagaggagaggtggaatgggagagaccaacctggcggcagcgcaaaagatg

SEQ ID NO: 83865 - DNA, 103 bp, Artificial Sequence
  Synthetic Polynucleotide
taatacgactcactatagggttccatttctctcccagggtctctcctgttaacagaggagaaacaggatggaccctgggaacctggcggcagcgcaaaagatg

SEQ ID NO: 83866 - DNA, 103 bp, Artificial Sequence
  Synthetic Polynucleotide
taatacgactcactataggggggccttccatttctctcccagggtctctcaacagaggagagagagaatgtgggagagaaacctggcggcagcgcaaaagatg

SEQ ID NO: 83867 - DNA, 103 bp, Artificial Sequence
  Synthetic Polynucleotide
taatacgactcactatagggcaagcgggccttccatttctctcccagggtaacagaggagaaccctgatggagaaatggaacctggcggcagcgcaaaagatg

SEQ ID NO: 83868 - DNA, 103 bp, Artificial Sequence
  Synthetic Polynucleotide
taatacgactcactatagggtggttcaagcgggccttccatttctctcccaacagaggagagggagaatgatggaaggcaacctggcggcagcgcaaaagatg

SEQ ID NO: 83869 - DNA, 103 bp, Artificial Sequence
  Synthetic Polynucleotide
taatacgactcactataggggcgtttgcagcttcctagtggaatgggaggaacagaggagacctcccatgccactaggaaacctggcggcagcgcaaaagatg

SEQ ID NO: 83870 - DNA, 103 bp, Artificial Sequence
  Synthetic Polynucleotide
taatacgactcactatagggacatctggttcaagcgggccttccatttctaacagaggagaagaaatatgaggcccgctaacctggcggcagcgcaaaagatg

SEQ ID NO: 83871 - DNA, 103 bp, Artificial Sequence
  Synthetic Polynucleotide
taatacgactcactatagggggccgacatctggttcaagcgggccttccaaacagaggagatggaagatgcgcttgaacaacctggcggcagcgcaaaagatg

SEQ ID NO: 83872 - DNA, 103 bp, Artificial Sequence
  Synthetic Polynucleotide
taatacgactcactatagggtccagggccgacatctggttcaagcgggccaacagaggagaggcccgatggaaccagataacctggcggcagcgcaaaagatg

SEQ ID NO: 83873 - DNA, 103 bp, Artificial Sequence
  Synthetic Polynucleotide
taatacgactcactatagggagaactccagggccgacatctggttcaagcaacagaggagagcttgaatgagatgtcggaacctggcggcagcgcaaaagatg

SEQ ID NO: 83874 - DNA, 103 bp, Artificial Sequence
  Synthetic Polynucleotide
taatacgactcactatagggggagtagaactccagggccgacatctggttaacagaggagaaaccagatgtcggccctgaacctggcggcagcgcaaaagatg

SEQ ID NO: 83875 - DNA, 103 bp, Artificial Sequence
  Synthetic Polynucleotide
taatacgactcactatagggttgtaggagtagaactccagggccgacatcaacagaggagagatgtcatgcctggagttaacctggcggcagcgcaaaagatg

SEQ ID NO: 83876 - DNA, 103 bp, Artificial Sequence
  Synthetic Polynucleotide
taatacgactcactatagggactttttgtaggagtagaactccagggccgaacagaggagacggcccatgagttctactaacctggcggcagcgcaaaagatg

SEQ ID NO: 83877 - DNA, 103 bp, Artificial Sequence
  Synthetic Polynucleotide
taatacgactcactataggggcctgactttttgtaggagtagaactccagaacagaggagactggagatgtactcctacaacctggcggcagcgcaaaagatg

SEQ ID NO: 83878 - DNA, 103 bp, Artificial Sequence
  Synthetic Polynucleotide
taatacgactcactataggggtgatgcctgactttttgtaggagtagaacaacagaggagagttctaatgctacaaaaaaacctggcggcagcgcaaaagatg

SEQ ID NO: 83879 - DNA, 103 bp, Artificial Sequence
  Synthetic Polynucleotide
taatacgactcactatagggcctcggtgatgcctgactttttgtaggagtaacagaggagaactcctatgaaaagtcagaacctggcggcagcgcaaaagatg

SEQ ID NO: 83880 - DNA, 103 bp, Artificial Sequence
  Synthetic Polynucleotide
taatacgactcactatagggcgaccgcgtttgcagcttcctagtggaatgaacagaggagacattccatgaggaagctgaacctggcggcagcgcaaaagatg

SEQ ID NO: 83881 - DNA, 103 bp, Artificial Sequence
  Synthetic Polynucleotide
taatacgactcactataggggcacacctcggtgatgcctgactttttgtaaacagaggagatacaaaatgtcaggcatcaacctggcggcagcgcaaaagatg

SEQ ID NO: 83882 - DNA, 103 bp, Artificial Sequence
  Synthetic Polynucleotide
taatacgactcactatagggtctctgcacacctcggtgatgcctgactttaacagaggagaaaagtcatgcatcaccgaaacctggcggcagcgcaaaagatg

SEQ ID NO: 83883 - DNA, 103 bp, Artificial Sequence
  Synthetic Polynucleotide
taatacgactcactatagggcctcttctctgcacacctcggtgatgcctgaacagaggagacaggcaatgccgaggtgtaacctggcggcagcgcaaaagatg

SEQ ID NO: 83884 - DNA, 103 bp, Artificial Sequence
  Synthetic Polynucleotide
taatacgactcactataggggcgggcctcttctctgcacacctcggtgataacagaggagaatcaccatggtgtgcagaaacctggcggcagcgcaaaagatg

SEQ ID NO: 83885 - DNA, 103 bp, Artificial Sequence
  Synthetic Polynucleotide
taatacgactcactataggggcgcggcgggcctcttctctgcacacctcgaacagaggagacgaggtatgcagagaagaaacctggcggcagcgcaaaagatg

SEQ ID NO: 83886 - DNA, 103 bp, Artificial Sequence
  Synthetic Polynucleotide
taatacgactcactatagggtgagggcgcggcgggcctcttctctgcacaaacagaggagatgtgcaatgaagaggcccaacctggcggcagcgcaaaagatg

SEQ ID NO: 83887 - DNA, 103 bp, Artificial Sequence
  Synthetic Polynucleotide
taatacgactcactatagggatccttgagggcgcggcgggcctcttctctaacagaggagaagagaaatggcccgccgcaacctggcggcagcgcaaaagatg

SEQ ID NO: 83888 - DNA, 103 bp, Artificial Sequence
  Synthetic Polynucleotide
taatacgactcactatagggacaccatccttgagggcgcggcgggcctctaacagaggagaagaggcatgccgcgccctaacctggcggcagcgcaaaagatg

SEQ ID NO: 83889 - DNA, 103 bp, Artificial Sequence
  Synthetic Polynucleotide
taatacgactcactatagggttgccacaccatccttgagggcgcggcgggaacagaggagacccgccatgccctcaaggaacctggcggcagcgcaaaagatg

SEQ ID NO: 83890 - DNA, 103 bp, Artificial Sequence
  Synthetic Polynucleotide
taatacgactcactatagggtcccgttgccacaccatccttgagggcgcgaacagaggagacgcgccatgaaggatggtaacctggcggcagcgcaaaagatg

SEQ ID NO: 83891 - DNA, 103 bp, Artificial Sequence
  Synthetic Polynucleotide
taatacgactcactataggggtttgcgaccgcgtttgcagcttcctagtgaacagaggagacactagatggctgcaaacaacctggcggcagcgcaaaagatg

SEQ ID NO: 83892 - DNA, 103 bp, Artificial Sequence
  Synthetic Polynucleotide
taatacgactcactatagggtggcctcccgttgccacaccatccttgaggaacagaggagacctcaaatgtggtgtggcaacctggcggcagcgcaaaagatg

SEQ ID NO: 83893 - DNA, 103 bp, Artificial Sequence
  Synthetic Polynucleotide
taatacgactcactatagggcagcatggcctcccgttgccacaccatcctaacagaggagaaggatgatgtggcaacggaacctggcggcagcgcaaaagatg

SEQ ID NO: 83894 - DNA, 103 bp, Artificial Sequence
  Synthetic Polynucleotide
taatacgactcactatagggggacacagcatggcctcccgttgccacaccaacagaggagaggtgtgatgacgggaggcaacctggcggcagcgcaaaagatg

SEQ ID NO: 83895 - DNA, 103 bp, Artificial Sequence
  Synthetic Polynucleotide
taatacgactcactatagggcctcgggacacagcatggcctcccgttgccaacagaggagaggcaacatgaggccatgcaacctggcggcagcgcaaaagatg

SEQ ID NO: 83896 - DNA, 103 bp, Artificial Sequence
  Synthetic Polynucleotide
taatacgactcactatagggcacttcctcgggacacagcatggcctcccgaacagaggagacgggagatgatgctgtgtaacctggcggcagcgcaaaagatg

SEQ ID NO: 83897 - DNA, 103 bp, Artificial Sequence
  Synthetic Polynucleotide
taatacgactcactatagggctttgcacttcctcgggacacagcatggccaacagaggagaggccatatggtgtcccgaaacctggcggcagcgcaaaagatg

SEQ ID NO: 83898 - DNA, 103 bp, Artificial Sequence
  Synthetic Polynucleotide
taatacgactcactatagggctcagctttgcacttcctcgggacacagcaaacagaggagatgctgtatgccgaggaagaacctggcggcagcgcaaaagatg

SEQ ID NO: 83899 - DNA, 103 bp, Artificial Sequence
  Synthetic Polynucleotide
taatacgactcactatagggaccatctcagctttgcacttcctcgggacaaacagaggagatgtcccatggaagtgcaaaacctggcggcagcgcaaaagatg

SEQ ID NO: 83900 - DNA, 103 bp, Artificial Sequence
  Synthetic Polynucleotide
taatacgactcactatagggcaccaaccatctcagctttgcacttcctcgaacagaggagacgaggaatggcaaagctgaacctggcggcagcgcaaaagatg

SEQ ID NO: 83901 - DNA, 103 bp, Artificial Sequence
  Synthetic Polynucleotide
taatacgactcactatagggcgctccaccaaccatctcagctttgcacttaacagaggagaaagtgcatggctgagatgaacctggcggcagcgcaaaagatg

SEQ ID NO: 83902 - DNA, 103 bp, Artificial Sequence
  Synthetic Polynucleotide
taatacgactcactatagggaccaggtttgcgaccgcgtttgcagcttccaacagaggagaggaagcatgaaacgcggtaacctggcggcagcgcaaaagatg

SEQ ID NO: 83903 - DNA, 103 bp, Artificial Sequence
  Synthetic Polynucleotide
taatacgactcactatagggatccccgctccaccaaccatctcagctttgaacagaggagacaaagcatggatggttggaacctggcggcagcgcaaaagatg

SEQ ID NO: 83904 - DNA, 103 bp, Artificial Sequence
  Synthetic Polynucleotide
taatacgactcactatagggcaggtatccccgctccaccaaccatctcagaacagaggagactgagaatgttggtggagaacctggcggcagcgcaaaagatg

SEQ ID NO: 83905 - DNA, 103 bp, Artificial Sequence
  Synthetic Polynucleotide
taatacgactcactatagggggctgcaggtatccccgctccaccaaccataacagaggagaatggttatgggagcggggaacctggcggcagcgcaaaagatg

SEQ ID NO: 83906 - DNA, 103 bp, Artificial Sequence
  Synthetic Polynucleotide
taatacgactcactatagggcatagggctgcaggtatccccgctccaccaaacagaggagatggtggatgggggataccaacctggcggcagcgcaaaagatg

SEQ ID NO: 83907 - DNA, 103 bp, Artificial Sequence
  Synthetic Polynucleotide
taatacgactcactatagggctttccatagggctgcaggtatccccgctcaacagaggagagagcggatgtacctgcagaacctggcggcagcgcaaaagatg

SEQ ID NO: 83908 - DNA, 103 bp, Artificial Sequence
  Synthetic Polynucleotide
taatacgactcactatagggatgacctttccatagggctgcaggtatcccaacagaggagagggataatggcagccctaaacctggcggcagcgcaaaagatg

SEQ ID NO: 83909 - DNA, 103 bp, Artificial Sequence
  Synthetic Polynucleotide
taatacgactcactataggggatcaatgacctttccatagggctgcaggtaacagaggagaacctgcatgcctatggaaaacctggcggcagcgcaaaagatg

SEQ ID NO: 83910 - DNA, 103 bp, Artificial Sequence
  Synthetic Polynucleotide
taatacgactcactatagggtccaagatcaatgacctttccatagggctgaacagaggagacagcccatgggaaaggtcaacctggcggcagcgcaaaagatg

SEQ ID NO: 83911 - DNA, 103 bp, Artificial Sequence
  Synthetic Polynucleotide
taatacgactcactatagggccacatccaagatcaatgacctttccatagaacagaggagactatggatgggtcattgaaacctggcggcagcgcaaaagatg

SEQ ID NO: 83912 - DNA, 103 bp, Artificial Sequence
  Synthetic Polynucleotide
taatacgactcactatagggctctgccacatccaagatcaatgacctttcaacagaggagagaaaggatgttgatcttgaacctggcggcagcgcaaaagatg

SEQ ID NO: 83913 - DNA, 103 bp, Artificial Sequence
  Synthetic Polynucleotide
taatacgactcactatagggttccaaccaggtttgcgaccgcgtttgcagaacagaggagactgcaaatgcggtcgcaaaacctggcggcagcgcaaaagatg

SEQ ID NO: 83914 - DNA, 103 bp, Artificial Sequence
  Synthetic Polynucleotide
taatacgactcactataggggccccctctgccacatccaagatcaatgacaacagaggagagtcattatgcttggatgtaacctggcggcagcgcaaaagatg

SEQ ID NO: 83915 - DNA, 103 bp, Artificial Sequence
  Synthetic Polynucleotide
taatacgactcactatagggctccagccccctctgccacatccaagatcaaacagaggagatgatctatgatgtggcagaacctggcggcagcgcaaaagatg

SEQ ID NO: 83916 - DNA, 103 bp, Artificial Sequence
  Synthetic Polynucleotide
taatacgactcactatagggagtaactccagccccctctgccacatccaaaacagaggagattggatatggcagaggggaacctggcggcagcgcaaaagatg

SEQ ID NO: 83917 - DNA, 103 bp, Artificial Sequence
  Synthetic Polynucleotide
taatacgactcactatagggggcgtagtaactccagccccctctgccacaaacagaggagatgtggcatggggggctggaacctggcggcagcgcaaaagatg

SEQ ID NO: 83918 - DNA, 103 bp, Artificial Sequence
  Synthetic Polynucleotide
taatacgactcactataggggtggcggcgtagtaactccagccccctctgaacagaggagacagaggatgctggagttaaacctggcggcagcgcaaaagatg

SEQ ID NO: 83919 - DNA, 103 bp, Artificial Sequence
  Synthetic Polynucleotide
taatacgactcactatagggggatggtggcggcgtagtaactccagccccaacagaggagaggggctatggttactacgaacctggcggcagcgcaaaagatg

SEQ ID NO: 83920 - DNA, 103 bp, Artificial Sequence
  Synthetic Polynucleotide
taatacgactcactatagggtttgcggatggtggcggcgtagtaactccaaacagaggagatggagtatgtacgccgccaacctggcggcagcgcaaaagatg

SEQ ID NO: 83921 - DNA, 103 bp, Artificial Sequence
  Synthetic Polynucleotide
taatacgactcactatagggtgaactttgcggatggtggcggcgtagtaaaacagaggagattactaatgcgccaccataacctggcggcagcgcaaaagatg

SEQ ID NO: 83922 - DNA, 103 bp, Artificial Sequence
  Synthetic Polynucleotide
taatacgactcactatagggcttcttgaactttgcggatggtggcggcgtaacagaggagaacgccgatgccatccgcaaacctggcggcagcgcaaaagatg

SEQ ID NO: 83923 - DNA, 103 bp, Artificial Sequence
  Synthetic Polynucleotide
taatacgactcactatagggtttcacttcttgaactttgcggatggtggcaacagaggagagccaccatgcgcaaagttaacctggcggcagcgcaaaagatg

SEQ ID NO: 83924 - DNA, 103 bp, Artificial Sequence
  Synthetic Polynucleotide
taatacgactcactatagggcttgattccaaccaggtttgcgaccgcgttaacagaggagaaacgcgatggcaaacctgaacctggcggcagcgcaaaagatg

SEQ ID NO: 83925 - DNA, 103 bp, Artificial Sequence
  Synthetic Polynucleotide
taatacgactcactatagggtatcctttcacttcttgaactttgcggatgaacagaggagacatccgatgagttcaagaaacctggcggcagcgcaaaagatg

SEQ ID NO: 83926 - DNA, 103 bp, Artificial Sequence
  Synthetic Polynucleotide
taatacgactcactatagggttgtgtatcctttcacttcttgaactttgcaacagaggagagcaaagatgaagaagtgaaacctggcggcagcgcaaaagatg

SEQ ID NO: 83927 - DNA, 103 bp, Artificial Sequence
  Synthetic Polynucleotide
taatacgactcactatagggtccttttgtgtatcctttcacttcttgaacaacagaggagagttcaaatggtgaaaggaaacctggcggcagcgcaaaagatg

SEQ ID NO: 83928 - DNA, 103 bp, Artificial Sequence
  Synthetic Polynucleotide
taatacgactcactataggggggcctccttttgtgtatcctttcacttctaacagaggagaagaagtatgaggatacacaacctggcggcagcgcaaaagatg

SEQ ID NO: 83929 - DNA, 103 bp, Artificial Sequence
  Synthetic Polynucleotide
taatacgactcactataggggaccagggcctccttttgtgtatcctttcaaacagaggagatgaaagatgacacaaaagaacctggcggcagcgcaaaagatg

SEQ ID NO: 83930 - DNA, 103 bp, Artificial Sequence
  Synthetic Polynucleotide
taatacgactcactatagggttcatgaccagggcctccttttgtgtatccaacagaggagaggatacatgaaaggaggcaacctggcggcagcgcaaaagatg

SEQ ID NO: 83931 - DNA, 103 bp, Artificial Sequence
  Synthetic Polynucleotide
taatacgactcactatagggggttcttcatgaccagggcctccttttgtgaacagaggagacacaaaatgaggccctggaacctggcggcagcgcaaaagatg

SEQ ID NO: 83932 - DNA, 103 bp, Artificial Sequence
  Synthetic Polynucleotide
taatacgactcactatagggacacgggttcttcatgaccagggcctccttaacagaggagaaaggagatgctggtcatgaacctggcggcagcgcaaaagatg

SEQ ID NO: 83933 - DNA, 103 bp, Artificial Sequence
  Synthetic Polynucleotide
taatacgactcactatagggcaccaacacgggttcttcatgaccagggccaacagaggagaggccctatgcatgaagaaaacctggcggcagcgcaaaagatg

SEQ ID NO: 83934 - DNA, 103 bp, Artificial Sequence
  Synthetic Polynucleotide
taatacgactcactatagggctttgcaccaacacgggttcttcatgaccaaacagaggagatggtcaatgagaacccgtaacctggcggcagcgcaaaagatg

SEQ ID NO: 83935 - DNA, 103 bp, Artificial Sequence
  Synthetic Polynucleotide
taatacgactcactatagggccagaaactctcgtttccaaatccaaaataaacagaggagatattttatgtttggaaacaacctggcggcagcgcaaaagatg

SEQ ID NO: 83936 - DNA, 103 bp, Artificial Sequence
  Synthetic Polynucleotide
taatacgactcactatagggattctcttgattccaaccaggtttgcgaccaacagaggagaggtcgcatgcctggttggaacctggcggcagcgcaaaagatg

SEQ ID NO: 83937 - DNA, 103 bp, Artificial Sequence
  Synthetic Polynucleotide
taatacgactcactatagggcatagctttgcaccaacacgggttcttcataacagaggagaatgaagatgccgtgttggaacctggcggcagcgcaaaagatg

SEQ ID NO: 83938 - DNA, 103 bp, Artificial Sequence
  Synthetic Polynucleotide
taatacgactcactatagggccacccatagctttgcaccaacacgggttcaacagaggagagaacccatgttggtgcaaaacctggcggcagcgcaaaagatg

SEQ ID NO: 83939 - DNA, 103 bp, Artificial Sequence
  Synthetic Polynucleotide
taatacgactcactatagggatgttccacccatagctttgcaccaacacgaacagaggagacgtgttatggcaaagctaaacctggcggcagcgcaaaagatg

SEQ ID NO: 83940 - DNA, 103 bp, Artificial Sequence
  Synthetic Polynucleotide
taatacgactcactatagggggactatgttccacccatagctttgcaccaaacagaggagatggtgcatggctatgggtaacctggcggcagcgcaaaagatg

SEQ ID NO: 83941 - DNA, 103 bp, Artificial Sequence
  Synthetic Polynucleotide
taatacgactcactatagggaagacggactatgttccacccatagctttgaacagaggagacaaagcatggggtggaacaacctggcggcagcgcaaaagatg

SEQ ID NO: 83942 - DNA, 103 bp, Artificial Sequence
  Synthetic Polynucleotide
taatacgactcactatagggctcttaagacggactatgttccacccatagaacagaggagactatggatggaacatagtaacctggcggcagcgcaaaagatg

SEQ ID NO: 83943 - DNA, 103 bp, Artificial Sequence
  Synthetic Polynucleotide
taatacgactcactatagggccccactcttaagacggactatgttccaccaacagaggagaggtggaatgtagtccgtcaacctggcggcagcgcaaaagatg

SEQ ID NO: 83944 - DNA, 103 bp, Artificial Sequence
  Synthetic Polynucleotide
taatacgactcactataggggtccaccccactcttaagacggactatgttaacagaggagaaacataatgcgtcttaagaacctggcggcagcgcaaaagatg

SEQ ID NO: 83945 - DNA, 103 bp, Artificial Sequence
  Synthetic Polynucleotide
taatacgactcactatagggaagacgtccaccccactcttaagacggactaacagaggagaagtccgatgtaagagtggaacctggcggcagcgcaaaagatg

SEQ ID NO: 83946 - DNA, 103 bp, Artificial Sequence
  Synthetic Polynucleotide
taatacgactcactatagggtatgaaagacgtccaccccactcttaagacaacagaggagagtcttaatggtggggtggaacctggcggcagcgcaaaagatg

SEQ ID NO: 83947 - DNA, 103 bp, Artificial Sequence
  Synthetic Polynucleotide
taatacgactcactatagggtgtgtattctcttgattccaaccaggtttgaacagaggagacaaaccatgttggaatcaaacctggcggcagcgcaaaagatg

SEQ ID NO: 83948 - DNA, 103 bp, Artificial Sequence
  Synthetic Polynucleotide
taatacgactcactatagggcgccatatgaaagacgtccaccccactcttaacagaggagaaagagtatggtggacgtcaacctggcggcagcgcaaaagatg

SEQ ID NO: 83949 - DNA, 103 bp, Artificial Sequence
  Synthetic Polynucleotide
taatacgactcactatagggtcagccgccatatgaaagacgtccaccccaaacagaggagatggggtatgcgtctttcaaacctggcggcagcgcaaaagatg

SEQ ID NO: 83950 - DNA, 103 bp, Artificial Sequence
  Synthetic Polynucleotide
taatacgactcactatagggacggctcagccgccatatgaaagacgtccaaacagaggagatggacgatgttcatatggaacctggcggcagcgcaaaagatg

SEQ ID NO: 83951 - DNA, 103 bp, Artificial Sequence
  Synthetic Polynucleotide
taatacgactcactataggggtcacacggctcagccgccatatgaaagacaacagaggagagtctttatgatggcggctaacctggcggcagcgcaaaagatg

SEQ ID NO: 83952 - DNA, 103 bp, Artificial Sequence
  Synthetic Polynucleotide
taatacgactcactatagggaacgtgtcacacggctcagccgccatatgaaacagaggagatcatatatgggctgagccaacctggcggcagcgcaaaagatg

SEQ ID NO: 83953 - DNA, 103 bp, Artificial Sequence
  Synthetic Polynucleotide
taatacgactcactatagggacagcaacgtgtcacacggctcagccgccaaacagaggagatggcggatgagccgtgtgaacctggcggcagcgcaaaagatg

SEQ ID NO: 83954 - DNA, 103 bp, Artificial Sequence
  Synthetic Polynucleotide
taatacgactcactataggggtcacacagcaacgtgtcacacggctcagcaacagaggagagctgagatgtgtgacacgaacctggcggcagcgcaaaagatg

SEQ ID NO: 83955 - DNA, 103 bp, Artificial Sequence
  Synthetic Polynucleotide
taatacgactcactatagggcctatgtcacacagcaacgtgtcacacggcaacagaggagagccgtgatgcacgttgctaacctggcggcagcgcaaaagatg

SEQ ID NO: 83956 - DNA, 103 bp, Artificial Sequence
  Synthetic Polynucleotide
taatacgactcactatagggactcacctatgtcacacagcaacgtgtcacaacagaggagagtgacaatgtgctgtgtgaacctggcggcagcgcaaaagatg

SEQ ID NO: 83957 - DNA, 103 bp, Artificial Sequence
  Synthetic Polynucleotide
taatacgactcactatagggtgatgactcacctatgtcacacagcaacgtaacagaggagaacgttgatgtgtgacataaacctggcggcagcgcaaaagatg

SEQ ID NO: 83958 - DNA, 103 bp, Artificial Sequence
  Synthetic Polynucleotide
taatacgactcactatagggtgctttgtgtattctcttgattccaaccagaacagaggagactggttatgatcaagagaaacctggcggcagcgcaaaagatg

SEQ ID NO: 83959 - DNA, 103 bp, Artificial Sequence
  Synthetic Polynucleotide
taatacgactcactatagggctagatgatgactcacctatgtcacacagcaacagaggagagctgtgatgcataggtgaaacctggcggcagcgcaaaagatg

SEQ ID NO: 83960 - DNA, 103 bp, Artificial Sequence
  Synthetic Polynucleotide
taatacgactcactatagggcaggactagatgatgactcacctatgtcacaacagaggagagtgacaatggtgagtcataacctggcggcagcgcaaaagatg

SEQ ID NO: 83961 - DNA, 103 bp, Artificial Sequence
  Synthetic Polynucleotide
taatacgactcactatagggcacttcaggactagatgatgactcacctataacagaggagaataggtatgtcatcatctaacctggcggcagcgcaaaagatg

SEQ ID NO: 83962 - DNA, 103 bp, Artificial Sequence
  Synthetic Polynucleotide
taatacgactcactatagggtcttccacttcaggactagatgatgactcaaacagaggagatgagtcatgatctagtccaacctggcggcagcgcaaaagatg

SEQ ID NO: 83963 - DNA, 103 bp, Artificial Sequence
  Synthetic Polynucleotide
taatacgactcactataggggtgcttcttccacttcaggactagatgatgaacagaggagacatcatatggtcctgaagaacctggcggcagcgcaaaagatg

SEQ ID NO: 83964 - DNA, 103 bp, Artificial Sequence
  Synthetic Polynucleotide
taatacgactcactatagggcgtccgtgcttcttccacttcaggactagaaacagaggagatctagtatggaagtggaaaacctggcggcagcgcaaaagatg

SEQ ID NO: 83965 - DNA, 103 bp, Artificial Sequence
  Synthetic Polynucleotide
taatacgactcactatagggctgagcgtccgtgcttcttccacttcaggaaacagaggagatcctgaatgggaagaagcaacctggcggcagcgcaaaagatg

SEQ ID NO: 83966 - DNA, 103 bp, Artificial Sequence
  Synthetic Polynucleotide
taatacgactcactatagggggactctgagcgtccgtgcttcttccacttaacagaggagaaagtggatgaagcacggaaacctggcggcagcgcaaaagatg

SEQ ID NO: 83967 - DNA, 103 bp, Artificial Sequence
  Synthetic Polynucleotide
taatacgactcactatagggggagaggactctgagcgtccgtgcttcttcaacagaggagagaagaaatgcggacgctcaacctggcggcagcgcaaaagatg

SEQ ID NO: 83968 - DNA, 103 bp, Artificial Sequence
  Synthetic Polynucleotide
taatacgactcactatagggaccatggagaggactctgagcgtccgtgctaacagaggagaagcacgatggctcagagtaacctggcggcagcgcaaaagatg

SEQ ID NO: 83969 - DNA, 103 bp, Artificial Sequence
  Synthetic Polynucleotide
taatacgactcactatagggtcaagtgctttgtgtattctcttgattccaaacagaggagatggaatatggagaatacaaacctggcggcagcgcaaaagatg

SEQ ID NO: 83970 - DNA, 103 bp, Artificial Sequence
  Synthetic Polynucleotide
taatacgactcactatagggcccccaccatggagaggactctgagcgtccaacagaggagaggacgcatggagtcctctaacctggcggcagcgcaaaagatg

SEQ ID NO: 83971 - DNA, 103 bp, Artificial Sequence
  Synthetic Polynucleotide
taatacgactcactatagggccaatcccccaccatggagaggactctgagaacagaggagactcagaatgctctccatgaacctggcggcagcgcaaaagatg

SEQ ID NO: 83972 - DNA, 103 bp, Artificial Sequence
  Synthetic Polynucleotide
taatacgactcactatagggtcaagccaatcccccaccatggagaggactaacagaggagaagtcctatgcatggtgggaacctggcggcagcgcaaaagatg

SEQ ID NO: 83973 - DNA, 103 bp, Artificial Sequence
  Synthetic Polynucleotide
taatacgactcactatagggttttttcaagccaatcccccaccatggagaaacagaggagatctccaatgtgggggattaacctggcggcagcgcaaaagatg

SEQ ID NO: 83974 - DNA, 103 bp, Artificial Sequence
  Synthetic Polynucleotide
taatacgactcactatagggtggtcttttttcaagccaatcccccaccataacagaggagaatggtgatggattggcttaacctggcggcagcgcaaaagatg

SEQ ID NO: 83975 - DNA, 103 bp, Artificial Sequence
  Synthetic Polynucleotide
taatacgactcactataggggctcctggtcttttttcaagccaatcccccaacagaggagagggggaatggcttgaaaaaacctggcggcagcgcaaaagatg

SEQ ID NO: 83976 - DNA, 103 bp, Artificial Sequence
  Synthetic Polynucleotide
taatacgactcactatagggaaaaggctcctggtcttttttcaagccaataacagaggagaattggcatgaaaaaagacaacctggcggcagcgcaaaagatg

SEQ ID NO: 83977 - DNA, 103 bp, Artificial Sequence
  Synthetic Polynucleotide
taatacgactcactatagggtatacaaaaggctcctggtcttttttcaagaacagaggagacttgaaatgagaccaggaaacctggcggcagcgcaaaagatg

SEQ ID NO: 83978 - DNA, 103 bp, Artificial Sequence
  Synthetic Polynucleotide
taatacgactcactatagggacttttatacaaaaggctcctggtctttttaacagaggagaaaaaagatgaggagccttaacctggcggcagcgcaaaagatg

SEQ ID NO: 83979 - DNA, 103 bp, Artificial Sequence
  Synthetic Polynucleotide
taatacgactcactatagggacaacacttttatacaaaaggctcctggtcaacagaggagagaccagatgccttttgtaaacctggcggcagcgcaaaagatg

SEQ ID NO: 83980 - DNA, 103 bp, Artificial Sequence
  Synthetic Polynucleotide
taatacgactcactatagggtctaatcaagtgctttgtgtattctcttgaaacagaggagatcaagaatgtacacaaagaacctggcggcagcgcaaaagatg

SEQ ID NO: 83981 - DNA, 103 bp, Artificial Sequence
  Synthetic Polynucleotide
taatacgactcactatagggtgggcacaacacttttatacaaaaggctccaacagaggagaggagccatgtgtataaaaaacctggcggcagcgcaaaagatg

SEQ ID NO: 83982 - DNA, 103 bp, Artificial Sequence
  Synthetic Polynucleotide
taatacgactcactataggggtgtatgggcacaacacttttatacaaaagaacagaggagacttttgatgaaaagtgttaacctggcggcagcgcaaaagatg

SEQ ID NO: 83983 - DNA, 103 bp, Artificial Sequence
  Synthetic Polynucleotide
taatacgactcactatagggtgctggtgtatgggcacaacacttttatacaacagaggagagtataaatgtgttgtgccaacctggcggcagcgcaaaagatg

SEQ ID NO: 83984 - DNA, 103 bp, Artificial Sequence
  Synthetic Polynucleotide
taatacgactcactatagggcatagtgctggtgtatgggcacaacactttaacagaggagaaaagtgatgtgcccatacaacctggcggcagcgcaaaagatg

SEQ ID NO: 83985 - DNA, 103 bp, Artificial Sequence
  Synthetic Polynucleotide
taatacgactcactatagggtccatcatagtgctggtgtatgggcacaacaacagaggagagttgtgatgatacaccagaacctggcggcagcgcaaaagatg

SEQ ID NO: 83986 - DNA, 103 bp, Artificial Sequence
  Synthetic Polynucleotide
taatacgactcactataggggggtttccatcatagtgctggtgtatgggcaacagaggagagcccatatgccagcactaaacctggcggcagcgcaaaagatg

SEQ ID NO: 83987 - DNA, 103 bp, Artificial Sequence
  Synthetic Polynucleotide
taatacgactcactatagggctccagggtttccatcatagtgctggtgtaaacagaggagatacaccatgactatgatgaacctggcggcagcgcaaaagatg

SEQ ID NO: 83988 - DNA, 103 bp, Artificial Sequence
  Synthetic Polynucleotide
taatacgactcactatagggagtcgctccagggtttccatcatagtgctgaacagaggagacagcacatggatggaaacaacctggcggcagcgcaaaagatg

SEQ ID NO: 83989 - DNA, 103 bp, Artificial Sequence
  Synthetic Polynucleotide
taatacgactcactataggggctgcagtcgctccagggtttccatcatagaacagaggagactatgaatgaaaccctggaacctggcggcagcgcaaaagatg

SEQ ID NO: 83990 - DNA, 103 bp, Artificial Sequence
  Synthetic Polynucleotide
taatacgactcactatagggcctacgctgcagtcgctccagggtttccataacagaggagaatggaaatgctggagcgaaacctggcggcagcgcaaaagatg

SEQ ID NO: 83991 - DNA, 103 bp, Artificial Sequence
  Synthetic Polynucleotide
taatacgactcactatagggtcgactctaatcaagtgctttgtgtattctaacagaggagaagaataatgaaagcacttaacctggcggcagcgcaaaagatg

SEQ ID NO: 83992 - DNA, 103 bp, Artificial Sequence
  Synthetic Polynucleotide
taatacgactcactatagggccatacctacgctgcagtcgctccagggttaacagaggagaaaccctatggcgactgcaaacctggcggcagcgcaaaagatg

SEQ ID NO: 83993 - DNA, 103 bp, Artificial Sequence
  Synthetic Polynucleotide
taatacgactcactatagggctcccccatacctacgctgcagtcgctccaaacagaggagatggagcatgtgcagcgtaaacctggcggcagcgcaaaagatg

SEQ ID NO: 83994 - DNA, 103 bp, Artificial Sequence
  Synthetic Polynucleotide
taatacgactcactatagggcagtcctcccccatacctacgctgcagtcgaacagaggagacgactgatgcgtaggtataacctggcggcagcgcaaaagatg

SEQ ID NO: 83995 - DNA, 103 bp, Artificial Sequence
  Synthetic Polynucleotide
taatacgactcactatagggctgaccagtcctcccccatacctacgctgcaacagaggagagcagcgatggtatgggggaacctggcggcagcgcaaaagatg

SEQ ID NO: 83996 - DNA, 103 bp, Artificial Sequence
  Synthetic Polynucleotide
taatacgactcactataggggcactctgaccagtcctcccccatacctacaacagaggagagtaggtatgggggaggacaacctggcggcagcgcaaaagatg

SEQ ID NO: 83997 - DNA, 103 bp, Artificial Sequence
  Synthetic Polynucleotide
taatacgactcactataggggagtggcactctgaccagtcctcccccataaacagaggagatatgggatgggactggtcaacctggcggcagcgcaaaagatg

SEQ ID NO: 83998 - DNA, 103 bp, Artificial Sequence
  Synthetic Polynucleotide
taatacgactcactatagggcgggagagtggcactctgaccagtcctcccaacagaggagagggaggatgggtcagagtaacctggcggcagcgcaaaagatg

SEQ ID NO: 83999 - DNA, 103 bp, Artificial Sequence
  Synthetic Polynucleotide
taatacgactcactatagggagttgcgggagagtggcactctgaccagtcaacagaggagagactggatggagtgccacaacctggcggcagcgcaaaagatg

SEQ ID NO: 84000 - DNA, 103 bp, Artificial Sequence
  Synthetic Polynucleotide
taatacgactcactatagggtgtagagttgcgggagagtggcactctgacaacagaggagagtcagaatgccactctccaacctggcggcagcgcaaaagatg

SEQ ID NO: 84001 - DNA, 103 bp, Artificial Sequence
  Synthetic Polynucleotide
taatacgactcactatagggtcatgtgtagagttgcgggagagtggcactaacagaggagaagtgccatgctcccgcaaaacctggcggcagcgcaaaagatg

SEQ ID NO: 84002 - DNA, 103 bp, Artificial Sequence
  Synthetic Polynucleotide
taatacgactcactatagggaattttcgactctaatcaagtgctttgtgtaacagaggagaacacaaatgacttgattaaacctggcggcagcgcaaaagatg

SEQ ID NO: 84003 - DNA, 103 bp, Artificial Sequence
  Synthetic Polynucleotide
taatacgactcactatagggacatctcatgtgtagagttgcgggagagtgaacagaggagacactctatggcaactctaaacctggcggcagcgcaaaagatg

SEQ ID NO: 84004 - DNA, 103 bp, Artificial Sequence
  Synthetic Polynucleotide
taatacgactcactatagggccagtacatctcatgtgtagagttgcgggaaacagaggagatcccgcatgtctacacataacctggcggcagcgcaaaagatg

SEQ ID NO: 84005 - DNA, 103 bp, Artificial Sequence
  Synthetic Polynucleotide
taatacgactcactataggggagacccagtacatctcatgtgtagagttgaacagaggagacaactcatgacatgagataacctggcggcagcgcaaaagatg

SEQ ID NO: 84006 - DNA, 103 bp, Artificial Sequence
  Synthetic Polynucleotide
taatacgactcactatagggctccagagacccagtacatctcatgtgtagaacagaggagactacacatgagatgtactaacctggcggcagcgcaaaagatg

SEQ ID NO: 84007 - DNA, 103 bp, Artificial Sequence
  Synthetic Polynucleotide
taatacgactcactatagggtttcgctccagagacccagtacatctcatgaacagaggagacatgagatgtactgggtcaacctggcggcagcgcaaaagatg

SEQ ID NO: 84008 - DNA, 103 bp, Artificial Sequence
  Synthetic Polynucleotide
taatacgactcactatagggttgcttttcgctccagagacccagtacatcaacagaggagagatgtaatgggtctctggaacctggcggcagcgcaaaagatg

SEQ ID NO: 84009 - DNA, 103 bp, Artificial Sequence
  Synthetic Polynucleotide
taatacgactcactatagggtggtgttgcttttcgctccagagacccagtaacagaggagaactgggatgctggagcgaaacctggcggcagcgcaaaagatg

SEQ ID NO: 84010 - DNA, 103 bp, Artificial Sequence
  Synthetic Polynucleotide
taatacgactcactatagggttttatggtgttgcttttcgctccagagacaacagaggagagtctctatggcgaaaagcaacctggcggcagcgcaaaagatg

SEQ ID NO: 84011 - DNA, 103 bp, Artificial Sequence
  Synthetic Polynucleotide
taatacgactcactatagggacactttttatggtgttgcttttcgctccaaacagaggagatggagcatgaagcaacacaacctggcggcagcgcaaaagatg

SEQ ID NO: 84012 - DNA, 103 bp, Artificial Sequence
  Synthetic Polynucleotide
taatacgactcactatagggtggacacactttttatggtgttgcttttcgaacagaggagacgaaaaatgacaccataaaacctggcggcagcgcaaaagatg

SEQ ID NO: 84013 - DNA, 103 bp, Artificial Sequence
  Synthetic Polynucleotide
taatacgactcactatagggtatccaattttcgactctaatcaagtgcttaacagaggagaaagcacatgattagagtcaacctggcggcagcgcaaaagatg

SEQ ID NO: 84014 - DNA, 103 bp, Artificial Sequence
  Synthetic Polynucleotide
taatacgactcactatagggcgtggtggacacactttttatggtgttgctaacagaggagaagcaacatgataaaaagtaacctggcggcagcgcaaaagatg

SEQ ID NO: 84015 - DNA, 103 bp, Artificial Sequence
  Synthetic Polynucleotide
taatacgactcactatagggtggctcgtggtggacacactttttatggtgaacagaggagacaccatatgaagtgtgtcaacctggcggcagcgcaaaagatg

SEQ ID NO: 84016 - DNA, 103 bp, Artificial Sequence
  Synthetic Polynucleotide
taatacgactcactatagggggagctggctcgtggtggacacactttttaaacagaggagataaaaaatgtgtccaccaaacctggcggcagcgcaaaagatg

SEQ ID NO: 84017 - DNA, 103 bp, Artificial Sequence
  Synthetic Polynucleotide
taatacgactcactatagggcaagaggagctggctcgtggtggacacactaacagaggagaagtgtgatgaccacgagcaacctggcggcagcgcaaaagatg

SEQ ID NO: 84018 - DNA, 103 bp, Artificial Sequence
  Synthetic Polynucleotide
taatacgactcactatagggcgccccaagaggagctggctcgtggtggacaacagaggagagtccacatggagccagctaacctggcggcagcgcaaaagatg

SEQ ID NO: 84019 - DNA, 103 bp, Artificial Sequence
  Synthetic Polynucleotide
taatacgactcactatagggccatgcgccccaagaggagctggctcgtggaacagaggagaccacgaatgagctcctctaacctggcggcagcgcaaaagatg

SEQ ID NO: 84020 - DNA, 103 bp, Artificial Sequence
  Synthetic Polynucleotide
taatacgactcactatagggcccgtccatgcgccccaagaggagctggctaacagaggagaagccagatgctcttggggaacctggcggcagcgcaaaagatg

SEQ ID NO: 84021 - DNA, 103 bp, Artificial Sequence
  Synthetic Polynucleotide
taatacgactcactatagggctaggcccgtccatgcgccccaagaggagcaacagaggagagctcctatgggggcgcataacctggcggcagcgcaaaagatg

SEQ ID NO: 84022 - DNA, 103 bp, Artificial Sequence
  Synthetic Polynucleotide
taatacgactcactataggggcctcctaggcccgtccatgcgccccaagaaacagaggagatcttggatggcatggacgaacctggcggcagcgcaaaagatg

SEQ ID NO: 84023 - DNA, 103 bp, Artificial Sequence
  Synthetic Polynucleotide
taatacgactcactatagggcactggcctcctaggcccgtccatgcgcccaacagaggagagggcgcatggacgggcctaacctggcggcagcgcaaaagatg

SEQ ID NO: 84024 - DNA, 103 bp, Artificial Sequence
  Synthetic Polynucleotide
taatacgactcactatagggctgaatatccaattttcgactctaatcaagaacagaggagacttgatatgagtcgaaaaaacctggcggcagcgcaaaagatg

SEQ ID NO: 84025 - DNA, 103 bp, Artificial Sequence
  Synthetic Polynucleotide
taatacgactcactatagggtatttcactggcctcctaggcccgtccatgaacagaggagacatggaatggcctaggagaacctggcggcagcgcaaaagatg

SEQ ID NO: 84026 - DNA, 103 bp, Artificial Sequence
  Synthetic Polynucleotide
taatacgactcactatagggcctcatatttcactggcctcctaggcccgtaacagaggagaacgggcatgggaggccagaacctggcggcagcgcaaaagatg

SEQ ID NO: 84027 - DNA, 103 bp, Artificial Sequence
  Synthetic Polynucleotide
taatacgactcactatagggatcctcctcatatttcactggcctcctaggaacagaggagacctaggatgccagtgaaaaacctggcggcagcgcaaaagatg

SEQ ID NO: 84028 - DNA, 103 bp, Artificial Sequence
  Synthetic Polynucleotide
taatacgactcactatagggttcacatcctcctcatatttcactggcctcaacagaggagagaggccatggaaatatgaaacctggcggcagcgcaaaagatg

SEQ ID NO: 84029 - DNA, 103 bp, Artificial Sequence
  Synthetic Polynucleotide
taatacgactcactatagggcgagattcacatcctcctcatatttcactgaacagaggagacagtgaatgatgaggaggaacctggcggcagcgcaaaagatg

SEQ ID NO: 84030 - DNA, 103 bp, Artificial Sequence
  Synthetic Polynucleotide
taatacgactcactatagggagagccgagattcacatcctcctcatatttaacagaggagaaaatatatggaggatgtgaacctggcggcagcgcaaaagatg

SEQ ID NO: 84031 - DNA, 103 bp, Artificial Sequence
  Synthetic Polynucleotide
taatacgactcactataggggtgccagagccgagattcacatcctcctcaaacagaggagatgaggaatgtgtgaatctaacctggcggcagcgcaaaagatg

SEQ ID NO: 84032 - DNA, 103 bp, Artificial Sequence
  Synthetic Polynucleotide
taatacgactcactatagggcccgcgtgccagagccgagattcacatcctaacagaggagaaggatgatgatctcggctaacctggcggcagcgcaaaagatg

SEQ ID NO: 84033 - DNA, 103 bp, Artificial Sequence
  Synthetic Polynucleotide
taatacgactcactatagggcacagcccgcgtgccagagccgagattcacaacagaggagagtgaatatgggctctggcaacctggcggcagcgcaaaagatg

SEQ ID NO: 84034 - DNA, 103 bp, Artificial Sequence
  Synthetic Polynucleotide
taatacgactcactatagggcttaccacagcccgcgtgccagagccgagaaacagaggagatctcggatgtggcacgcgaacctggcggcagcgcaaaagatg

SEQ ID NO: 84035 - DNA, 103 bp, Artificial Sequence
  Synthetic Polynucleotide
taatacgactcactatagggggttcctgaatatccaattttcgactctaaaacagaggagattagagatgaaaattggaaacctggcggcagcgcaaaagatg

SEQ ID NO: 84036 - DNA, 103 bp, Artificial Sequence
  Synthetic Polynucleotide
taatacgactcactatagggcgcagcttaccacagcccgcgtgccagagcaacagaggagagctctgatgcgcgggctgaacctggcggcagcgcaaaagatg

SEQ ID NO: 84037 - DNA, 103 bp, Artificial Sequence
  Synthetic Polynucleotide
taatacgactcactatagggttcagcgcagcttaccacagcccgcgtgccaacagaggagaggcacgatggctgtggtaaacctggcggcagcgcaaaagatg

SEQ ID NO: 84038 - DNA, 103 bp, Artificial Sequence
  Synthetic Polynucleotide
taatacgactcactatagggggagcttcagcgcagcttaccacagcccgcaacagaggagagcgggcatgggtaagctgaacctggcggcagcgcaaaagatg

SEQ ID NO: 84039 - DNA, 103 bp, Artificial Sequence
  Synthetic Polynucleotide
taatacgactcactatagggtgttgggagcttcagcgcagcttaccacagaacagaggagactgtggatggctgcgctgaacctggcggcagcgcaaaagatg

SEQ ID NO: 84040 - DNA, 103 bp, Artificial Sequence
  Synthetic Polynucleotide
taatacgactcactatagggcttcatgttgggagcttcagcgcagcttacaacagaggagagtaagcatggctgaagctaacctggcggcagcgcaaaagatg

SEQ ID NO: 84041 - DNA, 103 bp, Artificial Sequence
  Synthetic Polynucleotide
taatacgactcactatagggatgatcttcatgttgggagcttcagcgcagaacagaggagactgcgcatgagctcccaaaacctggcggcagcgcaaaagatg

SEQ ID NO: 84042 - DNA, 103 bp, Artificial Sequence
  Synthetic Polynucleotide
taatacgactcactatagggtaccaatgatcttcatgttgggagcttcagaacagaggagactgaagatgccaacatgaaacctggcggcagcgcaaaagatg

SEQ ID NO: 84043 - DNA, 103 bp, Artificial Sequence
  Synthetic Polynucleotide
taatacgactcactataggggcggttaccaatgatcttcatgttgggagcaacagaggagagctcccatgatgaagatcaacctggcggcagcgcaaaagatg

SEQ ID NO: 84044 - DNA, 103 bp, Artificial Sequence
  Synthetic Polynucleotide
taatacgactcactatagggtcaatgcggttaccaatgatcttcatgttgaacagaggagacaacatatggatcattggaacctggcggcagcgcaaaagatg

SEQ ID NO: 84045 - DNA, 103 bp, Artificial Sequence
  Synthetic Polynucleotide
taatacgactcactatagggtcctttcaatgcggttaccaatgatcttcaaacagaggagatgaagaatgttggtaaccaacctggcggcagcgcaaaagatg

SEQ ID NO: 84046 - DNA, 103 bp, Artificial Sequence
  Synthetic Polynucleotide
taatacgactcactatagggcatgaccagaaactctcgtttccaaatccaaacagaggagatggattatgaaacgagagaacctggcggcagcgcaaaagatg

SEQ ID NO: 84047 - DNA, 103 bp, Artificial Sequence
  Synthetic Polynucleotide
taatacgactcactataggggccagggttcctgaatatccaattttcgacaacagaggagagtcgaaatgtggatattcaacctggcggcagcgcaaaagatg

SEQ ID NO: 84048 - DNA, 103 bp, Artificial Sequence
  Synthetic Polynucleotide
taatacgactcactataggggcggatcctttcaatgcggttaccaatgataacagaggagaatcattatgaaccgcattaacctggcggcagcgcaaaagatg

SEQ ID NO: 84049 - DNA, 103 bp, Artificial Sequence
  Synthetic Polynucleotide
taatacgactcactatagggtcactgcggatcctttcaatgcggttaccaaacagaggagatggtaaatgcattgaaagaacctggcggcagcgcaaaagatg

SEQ ID NO: 84050 - DNA, 103 bp, Artificial Sequence
  Synthetic Polynucleotide
taatacgactcactatagggcgtgctcactgcggatcctttcaatgcggtaacagaggagaaccgcaatgaaaggatccaacctggcggcagcgcaaaagatg

SEQ ID NO: 84051 - DNA, 103 bp, Artificial Sequence
  Synthetic Polynucleotide
taatacgactcactatagggttccgcgtgctcactgcggatcctttcaataacagaggagaattgaaatgatccgcagtaacctggcggcagcgcaaaagatg

SEQ ID NO: 84052 - DNA, 103 bp, Artificial Sequence
  Synthetic Polynucleotide
taatacgactcactatagggcacgtttccgcgtgctcactgcggatccttaacagaggagaaaggatatgcagtgagcaaacctggcggcagcgcaaaagatg

SEQ ID NO: 84053 - DNA, 103 bp, Artificial Sequence
  Synthetic Polynucleotide
taatacgactcactatagggagaaccacgtttccgcgtgctcactgcggaaacagaggagatccgcaatgagcacgcggaacctggcggcagcgcaaaagatg

SEQ ID NO: 84054 - DNA, 103 bp, Artificial Sequence
  Synthetic Polynucleotide
taatacgactcactataggggtcaaagaaccacgtttccgcgtgctcactaacagaggagaagtgagatggcggaaacgaacctggcggcagcgcaaaagatg

SEQ ID NO: 84055 - DNA, 103 bp, Artificial Sequence
  Synthetic Polynucleotide
taatacgactcactatagggttctcgtcaaagaaccacgtttccgcgtgcaacagaggagagcacgcatgaacgtggttaacctggcggcagcgcaaaagatg

SEQ ID NO: 84056 - DNA, 103 bp, Artificial Sequence
  Synthetic Polynucleotide
taatacgactcactatagggggtggttctcgtcaaagaaccacgtttccgaacagaggagacggaaaatgggttctttgaacctggcggcagcgcaaaagatg

SEQ ID NO: 84057 - DNA, 103 bp, Artificial Sequence
  Synthetic Polynucleotide
taatacgactcactatagggatatgggtggttctcgtcaaagaaccacgtaacagaggagaacgtggatgtttgacgagaacctggcggcagcgcaaaagatg

SEQ ID NO: 84058 - DNA, 103 bp, Artificial Sequence
  Synthetic Polynucleotide
taatacgactcactataggggcgaagccagggttcctgaatatccaatttaacagaggagaaaattgatgattcaggaaaacctggcggcagcgcaaaagatg

SEQ ID NO: 84059 - DNA, 103 bp, Artificial Sequence
  Synthetic Polynucleotide
taatacgactcactataggggtcctatatgggtggttctcgtcaaagaacaacagaggagagttcttatgcgagaaccaaacctggcggcagcgcaaaagatg

SEQ ID NO: 84060 - DNA, 103 bp, Artificial Sequence
  Synthetic Polynucleotide
taatacgactcactatagggcccatgtcctatatgggtggttctcgtcaaaacagaggagattgacgatgaccacccataacctggcggcagcgcaaaagatg

SEQ ID NO: 84061 - DNA, 103 bp, Artificial Sequence
  Synthetic Polynucleotide
taatacgactcactataggggtaagcccatgtcctatatgggtggttctcaacagaggagagagaacatgccatataggaacctggcggcagcgcaaaagatg

SEQ ID NO: 84062 - DNA, 103 bp, Artificial Sequence
  Synthetic Polynucleotide
taatacgactcactatagggccatggtaagcccatgtcctatatgggtggaacagaggagaccacccatgtaggacatgaacctggcggcagcgcaaaagatg

SEQ ID NO: 84063 - DNA, 103 bp, Artificial Sequence
  Synthetic Polynucleotide
taatacgactcactatagggagcttccatggtaagcccatgtcctatatgaacagaggagacatataatgcatgggcttaacctggcggcagcgcaaaagatg

SEQ ID NO: 84064 - DNA, 103 bp, Artificial Sequence
  Synthetic Polynucleotide
taatacgactcactatagggctcatagcttccatggtaagcccatgtcctaacagaggagaaggacaatggcttaccataacctggcggcagcgcaaaagatg

SEQ ID NO: 84065 - DNA, 103 bp, Artificial Sequence
  Synthetic Polynucleotide
taatacgactcactatagggggggcctcatagcttccatggtaagcccataacagaggagaatgggcatgccatggaagaacctggcggcagcgcaaaagatg

SEQ ID NO: 84066 - DNA, 103 bp, Artificial Sequence
  Synthetic Polynucleotide
taatacgactcactataggggtgtgggggcctcatagcttccatggtaagaacagaggagacttaccatggaagctatgaacctggcggcagcgcaaaagatg

SEQ ID NO: 84067 - DNA, 103 bp, Artificial Sequence
  Synthetic Polynucleotide
taatacgactcactatagggcccttgtgtgggggcctcatagcttccatgaacagaggagacatggaatgtatgaggccaacctggcggcagcgcaaaagatg

SEQ ID NO: 84068 - DNA, 103 bp, Artificial Sequence
  Synthetic Polynucleotide
taatacgactcactataggggctgacccttgtgtgggggcctcatagcttaacagaggagaaagctaatgggcccccacaacctggcggcagcgcaaaagatg

SEQ ID NO: 84069 - DNA, 103 bp, Artificial Sequence
  Synthetic Polynucleotide
taatacgactcactatagggctaacgcgaagccagggttcctgaatatccaacagaggagaggatatatgggaaccctgaacctggcggcagcgcaaaagatg

SEQ ID NO: 84070 - DNA, 103 bp, Artificial Sequence
  Synthetic Polynucleotide
taatacgactcactatagggaggacgctgacccttgtgtgggggcctcataacagaggagaatgaggatgccacacaagaacctggcggcagcgcaaaagatg

SEQ ID NO: 84071 - DNA, 103 bp, Artificial Sequence
  Synthetic Polynucleotide
taatacgactcactatagggtagagaggacgctgacccttgtgtgggggcaacagaggagagcccccatgcaagggtcaaacctggcggcagcgcaaaagatg

SEQ ID NO: 84072 - DNA, 103 bp, Artificial Sequence
  Synthetic Polynucleotide
taatacgactcactatagggtttattagagaggacgctgacccttgtgtgaacagaggagacacacaatggtcagcgtcaacctggcggcagcgcaaaagatg

SEQ ID NO: 84073 - DNA, 103 bp, Artificial Sequence
  Synthetic Polynucleotide
taatacgactcactatagggccccgtttattagagaggacgctgacccttaacagaggagaaagggtatgcgtcctctcaacctggcggcagcgcaaaagatg

SEQ ID NO: 84074 - DNA, 103 bp, Artificial Sequence
  Synthetic Polynucleotide
taatacgactcactataggggacaaccccgtttattagagaggacgctgaaacagaggagatcagcgatgtctctaataaacctggcggcagcgcaaaagatg

SEQ ID NO: 84075 - DNA, 103 bp, Artificial Sequence
  Synthetic Polynucleotide
taatacgactcactatagggagcctgacaaccccgtttattagagaggacaacagaggagagtcctcatgaataaacggaacctggcggcagcgcaaaagatg

SEQ ID NO: 84076 - DNA, 103 bp, Artificial Sequence
  Synthetic Polynucleotide
taatacgactcactatagggacaggagcctgacaaccccgtttattagagaacagaggagactctaaatgacggggttgaacctggcggcagcgcaaaagatg

SEQ ID NO: 84077 - DNA, 103 bp, Artificial Sequence
  Synthetic Polynucleotide
taatacgactcactatagggttttgacaggagcctgacaaccccgtttataacagaggagaataaacatggttgtcaggaacctggcggcagcgcaaaagatg

SEQ ID NO: 84078 - DNA, 103 bp, Artificial Sequence
  Synthetic Polynucleotide
taatacgactcactatagggcagggttttgacaggagcctgacaaccccgaacagaggagacggggtatgcaggctcctaacctggcggcagcgcaaaagatg

SEQ ID NO: 84079 - DNA, 103 bp, Artificial Sequence
  Synthetic Polynucleotide
taatacgactcactatagggcatcccagggttttgacaggagcctgacaaaacagaggagattgtcaatgtcctgtcaaaacctggcggcagcgcaaaagatg

SEQ ID NO: 84080 - DNA, 103 bp, Artificial Sequence
  Synthetic Polynucleotide
taatacgactcactatagggtgctgctaacgcgaagccagggttcctgaaaacagaggagattcaggatgcctggcttcaacctggcggcagcgcaaaagatg

SEQ ID NO: 84081 - DNA, 103 bp, Artificial Sequence
  Synthetic Polynucleotide
taatacgactcactatagggcaccacatcccagggttttgacaggagcctaacagaggagaaggctcatgtcaaaacccaacctggcggcagcgcaaaagatg

SEQ ID NO: 84082 - DNA, 103 bp, Artificial Sequence
  Synthetic Polynucleotide
taatacgactcactatagggccagtcaccacatcccagggttttgacaggaacagaggagacctgtcatgaccctgggaaacctggcggcagcgcaaaagatg

SEQ ID NO: 84083 - DNA, 103 bp, Artificial Sequence
  Synthetic Polynucleotide
taatacgactcactatagggtgactccagtcaccacatcccagggttttgaacagaggagacaaaacatggggatgtggaacctggcggcagcgcaaaagatg

SEQ ID NO: 84084 - DNA, 103 bp, Artificial Sequence
  Synthetic Polynucleotide
taatacgactcactatagggtcctgtgactccagtcaccacatcccagggaacagaggagaccctggatggtggtgactaacctggcggcagcgcaaaagatg

SEQ ID NO: 84085 - DNA, 103 bp, Artificial Sequence
  Synthetic Polynucleotide
taatacgactcactataggggctattcctgtgactccagtcaccacatccaacagaggagaggatgtatggactggagtaacctggcggcagcgcaaaagatg

SEQ ID NO: 84086 - DNA, 103 bp, Artificial Sequence
  Synthetic Polynucleotide
taatacgactcactatagggtcatggctattcctgtgactccagtcaccaaacagaggagatggtgaatggagtcacagaacctggcggcagcgcaaaagatg

SEQ ID NO: 84087 - DNA, 103 bp, Artificial Sequence
  Synthetic Polynucleotide
taatacgactcactataggggtcggtcatggctattcctgtgactccagtaacagaggagaactggaatgacaggaataaacctggcggcagcgcaaaagatg

SEQ ID NO: 84088 - DNA, 103 bp, Artificial Sequence
  Synthetic Polynucleotide
taatacgactcactataggggtggtgtcggtcatggctattcctgtgactaacagaggagaagtcacatgaatagccataacctggcggcagcgcaaaagatg

SEQ ID NO: 84089 - DNA, 103 bp, Artificial Sequence
  Synthetic Polynucleotide
taatacgactcactatagggacggtgtggtgtcggtcatggctattcctgaacagaggagacaggaaatgccatgaccgaacctggcggcagcgcaaaagatg

SEQ ID NO: 84090 - DNA, 103 bp, Artificial Sequence
  Synthetic Polynucleotide
taatacgactcactatagggaccatacggtgtggtgtcggtcatggctataacagaggagaatagccatgaccgacaccaacctggcggcagcgcaaaagatg

SEQ ID NO: 84091 - DNA, 103 bp, Artificial Sequence
  Synthetic Polynucleotide
taatacgactcactataggggcagctgctgctaacgcgaagccagggttcaacagaggagagaacccatgcttcgcgttaacctggcggcagcgcaaaagatg

SEQ ID NO: 84092 - DNA, 103 bp, Artificial Sequence
  Synthetic Polynucleotide
taatacgactcactatagggtgctgaccatacggtgtggtgtcggtcatgaacagaggagacatgacatgcaccacaccaacctggcggcagcgcaaaagatg

SEQ ID NO: 84093 - DNA, 103 bp, Artificial Sequence
  Synthetic Polynucleotide
taatacgactcactatagggctctttgctgaccatacggtgtggtgtcggaacagaggagaccgacaatgcaccgtatgaacctggcggcagcgcaaaagatg

SEQ ID NO: 84094 - DNA, 103 bp, Artificial Sequence
  Synthetic Polynucleotide
taatacgactcactataggggaaaactctttgctgaccatacggtgtggtaacagaggagaaccacaatgtatggtcagaacctggcggcagcgcaaaagatg

SEQ ID NO: 84095 - DNA, 103 bp, Artificial Sequence
  Synthetic Polynucleotide
taatacgactcactatagggtccttgaaaactctttgctgaccatacggtaacagaggagaaccgtaatgtcagcaaagaacctggcggcagcgcaaaagatg

SEQ ID NO: 84096 - DNA, 103 bp, Artificial Sequence
  Synthetic Polynucleotide
taatacgactcactatagggctttttccttgaaaactctttgctgaccataacagaggagaatggtcatgaaagagtttaacctggcggcagcgcaaaagatg

SEQ ID NO: 84097 - DNA, 103 bp, Artificial Sequence
  Synthetic Polynucleotide
taatacgactcactataggggtccactttttccttgaaaactctttgctgaacagaggagacagcaaatggttttcaagaacctggcggcagcgcaaaagatg

SEQ ID NO: 84098 - DNA, 103 bp, Artificial Sequence
  Synthetic Polynucleotide
taatacgactcactatagggctagtgtccactttttccttgaaaactcttaacagaggagaaagagtatgcaaggaaaaaacctggcggcagcgcaaaagatg

SEQ ID NO: 84099 - DNA, 103 bp, Artificial Sequence
  Synthetic Polynucleotide
taatacgactcactataggggcaccctagtgtccactttttccttgaaaaaacagaggagattttcaatgaaaaagtggaacctggcggcagcgcaaaagatg

SEQ ID NO: 84100 - DNA, 103 bp, Artificial Sequence
  Synthetic Polynucleotide
taatacgactcactataggggtctggcaccctagtgtccactttttccttaacagaggagaaaggaaatggtggacactaacctggcggcagcgcaaaagatg

SEQ ID NO: 84101 - DNA, 103 bp, Artificial Sequence
  Synthetic Polynucleotide
taatacgactcactatagggtgggggtctggcaccctagtgtccacttttaacagaggagaaaaagtatgcactagggtaacctggcggcagcgcaaaagatg

SEQ ID NO: 84102 - DNA, 103 bp, Artificial Sequence
  Synthetic Polynucleotide
taatacgactcactatagggcgatggcagctgctgctaacgcgaagccagaacagaggagactggctatgcgttagcagaacctggcggcagcgcaaaagatg

SEQ ID NO: 84103 - DNA, 103 bp, Artificial Sequence
  Synthetic Polynucleotide
taatacgactcactatagggcttcttgggggtctggcaccctagtgtccaaacagaggagatggacaatggggtgccagaacctggcggcagcgcaaaagatg

SEQ ID NO: 84104 - DNA, 103 bp, Artificial Sequence
  Synthetic Polynucleotide
taatacgactcactatagggagtgccttcttgggggtctggcaccctagtaacagaggagaactaggatgccagaccccaacctggcggcagcgcaaaagatg

SEQ ID NO: 84105 - DNA, 103 bp, Artificial Sequence
  Synthetic Polynucleotide
taatacgactcactatagggtgacgagtgccttcttgggggtctggcaccaacagaggagaggtgccatgcccccaagaaacctggcggcagcgcaaaagatg

SEQ ID NO: 84106 - DNA, 103 bp, Artificial Sequence
  Synthetic Polynucleotide
taatacgactcactatagggtaacctgacgagtgccttcttgggggtctgaacagaggagacagaccatgaagaaggcaaacctggcggcagcgcaaaagatg

SEQ ID NO: 84107 - DNA, 103 bp, Artificial Sequence
  Synthetic Polynucleotide
taatacgactcactataggggctcataacctgacgagtgccttcttggggaacagaggagaccccaaatgggcactcgtaacctggcggcagcgcaaaagatg

SEQ ID NO: 84108 - DNA, 103 bp, Artificial Sequence
  Synthetic Polynucleotide
taatacgactcactatagggaccatgctcataacctgacgagtgccttctaacagaggagaagaaggatgtcgtcaggtaacctggcggcagcgcaaaagatg

SEQ ID NO: 84109 - DNA, 103 bp, Artificial Sequence
  Synthetic Polynucleotide
taatacgactcactatagggaagagaccatgctcataacctgacgagtgcaacagaggagagcactcatgaggttatgaaacctggcggcagcgcaaaagatg

SEQ ID NO: 84110 - DNA, 103 bp, Artificial Sequence
  Synthetic Polynucleotide
taatacgactcactatagggccaggaagagaccatgctcataacctgacgaacagaggagacgtcagatgatgagcatgaacctggcggcagcgcaaaagatg

SEQ ID NO: 84111 - DNA, 103 bp, Artificial Sequence
  Synthetic Polynucleotide
taatacgactcactatagggcacaaccaggaagagaccatgctcataaccaacagaggagaggttatatgcatggtctcaacctggcggcagcgcaaaagatg

SEQ ID NO: 84112 - DNA, 103 bp, Artificial Sequence
  Synthetic Polynucleotide
taatacgactcactatagggctttccacaaccaggaagagaccatgctcaaacagaggagatgagcaatgtctcttcctaacctggcggcagcgcaaaagatg

SEQ ID NO: 84113 - DNA, 103 bp, Artificial Sequence
  Synthetic Polynucleotide
taatacgactcactatagggccaagcgatggcagctgctgctaacgcgaaaacagaggagattcgcgatggcagcagctaacctggcggcagcgcaaaagatg

SEQ ID NO: 84114 - DNA, 103 bp, Artificial Sequence
  Synthetic Polynucleotide
taatacgactcactatagggtagctctttccacaaccaggaagagaccataacagaggagaatggtcatgtcctggttgaacctggcggcagcgcaaaagatg

SEQ ID NO: 84115 - DNA, 103 bp, Artificial Sequence
  Synthetic Polynucleotide
taatacgactcactatagggttgcctagctctttccacaaccaggaagagaacagaggagactcttcatggttgtggaaaacctggcggcagcgcaaaagatg

SEQ ID NO: 84116 - DNA, 103 bp, Artificial Sequence
  Synthetic Polynucleotide
taatacgactcactatagggtgtgtttgcctagctctttccacaaccaggaacagaggagacctggtatgggaaagagcaacctggcggcagcgcaaaagatg

SEQ ID NO: 84117 - DNA, 103 bp, Artificial Sequence
  Synthetic Polynucleotide
taatacgactcactatagggccgtttgtgtttgcctagctctttccacaaaacagaggagattgtggatggagctaggcaacctggcggcagcgcaaaagatg

SEQ ID NO: 84118 - DNA, 103 bp, Artificial Sequence
  Synthetic Polynucleotide
taatacgactcactatagggcgtggccgtttgtgtttgcctagctctttcaacagaggagagaaagaatgaggcaaacaaacctggcggcagcgcaaaagatg

SEQ ID NO: 84119 - DNA, 103 bp, Artificial Sequence
  Synthetic Polynucleotide
taatacgactcactatagggagactcgtggccgtttgtgtttgcctagctaacagaggagaagctagatgaacacaaacaacctggcggcagcgcaaaagatg

SEQ ID NO: 84120 - DNA, 103 bp, Artificial Sequence
  Synthetic Polynucleotide
taatacgactcactatagggggtacagactcgtggccgtttgtgtttgccaacagaggagaggcaaaatgaaacggccaaacctggcggcagcgcaaaagatg

SEQ ID NO: 84121 - DNA, 103 bp, Artificial Sequence
  Synthetic Polynucleotide
taatacgactcactatagggtctttggtacagactcgtggccgtttgtgtaacagaggagaacacaaatggccacgagtaacctggcggcagcgcaaaagatg

SEQ ID NO: 84122 - DNA, 103 bp, Artificial Sequence
  Synthetic Polynucleotide
taatacgactcactatagggactcttctttggtacagactcgtggccgttaacagaggagaaacggcatggagtctgtaaacctggcggcagcgcaaaagatg

SEQ ID NO: 84123 - DNA, 103 bp, Artificial Sequence
  Synthetic Polynucleotide
taatacgactcactataggggatgaactcttctttggtacagactcgtggaacagaggagaccacgaatgtgtaccaaaaacctggcggcagcgcaaaagatg

SEQ ID NO: 84124 - DNA, 103 bp, Artificial Sequence
  Synthetic Polynucleotide
taatacgactcactatagggaaaagccaagcgatggcagctgctgctaacaacagaggagagttagcatgagctgccataacctggcggcagcgcaaaagatg

SEQ ID NO: 84125 - DNA, 103 bp, Artificial Sequence
  Synthetic Polynucleotide
taatacgactcactatagggttgttgatgaactcttctttggtacagactaacagaggagaagtctgatgcaaagaagaaacctggcggcagcgcaaaagatg

SEQ ID NO: 84126 - DNA, 103 bp, Artificial Sequence
  Synthetic Polynucleotide
taatacgactcactataggggaaccttgttgatgaactcttctttggtacaacagaggagagtaccaatgaagagttcaaacctggcggcagcgcaaaagatg

SEQ ID NO: 84127 - DNA, 103 bp, Artificial Sequence
  Synthetic Polynucleotide
taatacgactcactataggggctacgaaccttgttgatgaactcttctttaacagaggagaaaagaaatgttcatcaacaacctggcggcagcgcaaaagatg

SEQ ID NO: 84128 - DNA, 103 bp, Artificial Sequence
  Synthetic Polynucleotide
taatacgactcactataggggcattgctacgaaccttgttgatgaactctaacagaggagaagagttatgcaacaaggtaacctggcggcagcgcaaaagatg

SEQ ID NO: 84129 - DNA, 103 bp, Artificial Sequence
  Synthetic Polynucleotide
taatacgactcactatagggatgctgcattgctacgaaccttgttgatgaaacagaggagatcatcaatgaggttcgtaaacctggcggcagcgcaaaagatg

SEQ ID NO: 84130 - DNA, 103 bp, Artificial Sequence
  Synthetic Polynucleotide
taatacgactcactatagggccctaatgctgcattgctacgaaccttgttaacagaggagaaacaagatgcgtagcaataacctggcggcagcgcaaaagatg

SEQ ID NO: 84131 - DNA, 103 bp, Artificial Sequence
  Synthetic Polynucleotide
taatacgactcactatagggattgcccctaatgctgcattgctacgaaccaacagaggagaggttcgatgcaatgcagcaacctggcggcagcgcaaaagatg

SEQ ID NO: 84132 - DNA, 103 bp, Artificial Sequence
  Synthetic Polynucleotide
taatacgactcactatagggcaaatattgcccctaatgctgcattgctacaacagaggagagtagcaatgcagcattagaacctggcggcagcgcaaaagatg

SEQ ID NO: 84133 - DNA, 103 bp, Artificial Sequence
  Synthetic Polynucleotide
taatacgactcactatagggctcttcaaatattgcccctaatgctgcattaacagaggagaaatgcaatgttaggggcaaacctggcggcagcgcaaaagatg

SEQ ID NO: 84134 - DNA, 103 bp, Artificial Sequence
  Synthetic Polynucleotide
taatacgactcactatagggttttcctcttcaaatattgcccctaatgctaacagaggagaagcattatgggcaatattaacctggcggcagcgcaaaagatg

SEQ ID NO: 84135 - DNA, 103 bp, Artificial Sequence
  Synthetic Polynucleotide
taatacgactcactatagggttcccaaaagccaagcgatggcagctgctgaacagaggagacagcagatgccatcgcttaacctggcggcagcgcaaaagatg

SEQ ID NO: 84136 - DNA, 103 bp, Artificial Sequence
  Synthetic Polynucleotide
taatacgactcactatagggactctttttcctcttcaaatattgcccctaaacagaggagataggggatgtatttgaagaacctggcggcagcgcaaaagatg

SEQ ID NO: 84137 - DNA, 103 bp, Artificial Sequence
  Synthetic Polynucleotide
taatacgactcactatagggcttccactctttttcctcttcaaatattgcaacagaggagagcaataatggaagaggaaaacctggcggcagcgcaaaagatg

SEQ ID NO: 84138 - DNA, 103 bp, Artificial Sequence
  Synthetic Polynucleotide
taatacgactcactataggggcagtcttccactctttttcctcttcaaataacagaggagaatttgaatgggaaaaagaaacctggcggcagcgcaaaagatg

SEQ ID NO: 84139 - DNA, 103 bp, Artificial Sequence
  Synthetic Polynucleotide
taatacgactcactatagggccactgcagtcttccactctttttcctcttaacagaggagaaagaggatgaagagtggaaacctggcggcagcgcaaaagatg

SEQ ID NO: 84140 - DNA, 103 bp, Artificial Sequence
  Synthetic Polynucleotide
taatacgactcactatagggagcttccactgcagtcttccactctttttcaacagaggagagaaaaaatgtggaagactaacctggcggcagcgcaaaagatg

SEQ ID NO: 84141 - DNA, 103 bp, Artificial Sequence
  Synthetic Polynucleotide
taatacgactcactatagggttcacagcttccactgcagtcttccactctaacagaggagaagagtgatggactgcagtaacctggcggcagcgcaaaagatg

SEQ ID NO: 84142 - DNA, 103 bp, Artificial Sequence
  Synthetic Polynucleotide
taatacgactcactataggggatcgttcacagcttccactgcagtcttccaacagaggagaggaagaatgcagtggaagaacctggcggcagcgcaaaagatg

SEQ ID NO: 84143 - DNA, 103 bp, Artificial Sequence
  Synthetic Polynucleotide
taatacgactcactatagggccttggatcgttcacagcttccactgcagtaacagaggagaactgcaatggaagctgtgaacctggcggcagcgcaaaagatg

SEQ ID NO: 84144 - DNA, 103 bp, Artificial Sequence
  Synthetic Polynucleotide
taatacgactcactatagggcagaaccttggatcgttcacagcttccactaacagaggagaagtggaatgtgtgaacgaaacctggcggcagcgcaaaagatg

SEQ ID NO: 84145 - DNA, 103 bp, Artificial Sequence
  Synthetic Polynucleotide
taatacgactcactataggggagcccagaaccttggatcgttcacagcttaacagaggagaaagctgatgacgatccaaaacctggcggcagcgcaaaagatg

SEQ ID NO: 84146 - DNA, 103 bp, Artificial Sequence
  Synthetic Polynucleotide
taatacgactcactatagggtgagcttcccaaaagccaagcgatggcagcaacagaggagagctgccatggcttggcttaacctggcggcagcgcaaaagatg

SEQ ID NO: 84147 - DNA, 103 bp, Artificial Sequence
  Synthetic Polynucleotide
taatacgactcactatagggcactagagcccagaaccttggatcgttcacaacagaggagagtgaacatgccaaggttcaacctggcggcagcgcaaaagatg

SEQ ID NO: 84148 - DNA, 103 bp, Artificial Sequence
  Synthetic Polynucleotide
taatacgactcactatagggttgtccactagagcccagaaccttggatcgaacagaggagacgatccatggttctgggcaacctggcggcagcgcaaaagatg

SEQ ID NO: 84149 - DNA, 103 bp, Artificial Sequence
  Synthetic Polynucleotide
taatacgactcactatagggtttccttgtccactagagcccagaaccttgaacagaggagacaaggtatggggctctagaacctggcggcagcgcaaaagatg

SEQ ID NO: 84150 - DNA, 103 bp, Artificial Sequence
  Synthetic Polynucleotide
taatacgactcactatagggctctctttccttgtccactagagcccagaaaacagaggagattctggatgctagtggacaacctggcggcagcgcaaaagatg

SEQ ID NO: 84151 - DNA, 103 bp, Artificial Sequence
  Synthetic Polynucleotide
taatacgactcactatagggtggtgctctctttccttgtccactagagccaacagaggagaggctctatgggacaaggaaacctggcggcagcgcaaaagatg

SEQ ID NO: 84152 - DNA, 103 bp, Artificial Sequence
  Synthetic Polynucleotide
taatacgactcactatagggtcaggtggtgctctctttccttgtccactaaacagaggagatagtggatgaggaaagagaacctggcggcagcgcaaaagatg

SEQ ID NO: 84153 - DNA, 103 bp, Artificial Sequence
  Synthetic Polynucleotide
taatacgactcactatagggtcctctcaggtggtgctctctttccttgtcaacagaggagagacaagatgagagagcacaacctggcggcagcgcaaaagatg

SEQ ID NO: 84154 - DNA, 103 bp, Artificial Sequence
  Synthetic Polynucleotide
taatacgactcactatagggcactctcctctcaggtggtgctctctttccaacagaggagaggaaagatggcaccacctaacctggcggcagcgcaaaagatg

SEQ ID NO: 84155 - DNA, 103 bp, Artificial Sequence
  Synthetic Polynucleotide
taatacgactcactatagggtctggcactctcctctcaggtggtgctctcaacagaggagagagagcatgacctgagagaacctggcggcagcgcaaaagatg

SEQ ID NO: 84156 - DNA, 103 bp, Artificial Sequence
  Synthetic Polynucleotide
taatacgactcactatagggacaactctggcactctcctctcaggtggtgaacagaggagacaccacatgagaggagagaacctggcggcagcgcaaaagatg

SEQ ID NO: 84157 - DNA, 103 bp, Artificial Sequence
  Synthetic Polynucleotide
taatacgactcactatagggtttttcatgaccagaaactctcgtttccaaaacagaggagattggaaatgagagtttctaacctggcggcagcgcaaaagatg

SEQ ID NO: 84158 - DNA, 103 bp, Artificial Sequence
  Synthetic Polynucleotide
taatacgactcactatagggctcgttgagcttcccaaaagccaagcgatgaacagaggagacatcgcatggcttttgggaacctggcggcagcgcaaaagatg

SEQ ID NO: 84159 - DNA, 103 bp, Artificial Sequence
  Synthetic Polynucleotide
taatacgactcactatagggtacacacaactctggcactctcctctcaggaacagaggagacctgagatgagagtgccaaacctggcggcagcgcaaaagatg

SEQ ID NO: 84160 - DNA, 103 bp, Artificial Sequence
  Synthetic Polynucleotide
taatacgactcactatagggtgttgtacacacaactctggcactctcctcaacagaggagagaggagatggccagagttaacctggcggcagcgcaaaagatg

SEQ ID NO: 84161 - DNA, 103 bp, Artificial Sequence
  Synthetic Polynucleotide
taatacgactcactatagggcatcatgttgtacacacaactctggcactcaacagaggagagagtgcatgagttgtgtgaacctggcggcagcgcaaaagatg

SEQ ID NO: 84162 - DNA, 103 bp, Artificial Sequence
  Synthetic Polynucleotide
taatacgactcactatagggtttcccatcatgttgtacacacaactctggaacagaggagaccagagatgtgtgtacaaaacctggcggcagcgcaaaagatg

SEQ ID NO: 84163 - DNA, 103 bp, Artificial Sequence
  Synthetic Polynucleotide
taatacgactcactatagggctctttttcccatcatgttgtacacacaacaacagaggagagttgtgatgacaacatgaaacctggcggcagcgcaaaagatg

SEQ ID NO: 84164 - DNA, 103 bp, Artificial Sequence
  Synthetic Polynucleotide
taatacgactcactatagggcttttctctttttcccatcatgttgtacacaacagaggagagtgtacatgatgatgggaaacctggcggcagcgcaaaagatg

SEQ ID NO: 84165 - DNA, 103 bp, Artificial Sequence
  Synthetic Polynucleotide
taatacgactcactatagggtgtttcttttctctttttcccatcatgttgaacagaggagacaacatatggggaaaaagaacctggcggcagcgcaaaagatg

SEQ ID NO: 84166 - DNA, 103 bp, Artificial Sequence
  Synthetic Polynucleotide
taatacgactcactatagggccccttgtttcttttctctttttcccatcaaacagaggagatgatggatgaaagagaaaaacctggcggcagcgcaaaagatg

SEQ ID NO: 84167 - DNA, 103 bp, Artificial Sequence
  Synthetic Polynucleotide
taatacgactcactatagggaaattccccttgtttcttttctctttttccaacagaggagaggaaaaatggaaaagaaaaacctggcggcagcgcaaaagatg

SEQ ID NO: 84168 - DNA, 103 bp, Artificial Sequence
  Synthetic Polynucleotide
taatacgactcactatagggtttccaaattccccttgtttcttttctcttaacagaggagaaagagaatggaaacaaggaacctggcggcagcgcaaaagatg

SEQ ID NO: 84169 - DNA, 103 bp, Artificial Sequence
  Synthetic Polynucleotide
taatacgactcactatagggtttggctcgttgagcttcccaaaagccaagaacagaggagacttggcatgtgggaagctaacctggcggcagcgcaaaagatg

SEQ ID NO: 84170 - DNA, 103 bp, Artificial Sequence
  Synthetic Polynucleotide
taatacgactcactatagggtggcctttccaaattccccttgtttcttttaacagaggagaaaaagaatgaaggggaataacctggcggcagcgcaaaagatg

SEQ ID NO: 84171 - DNA, 103 bp, Artificial Sequence
  Synthetic Polynucleotide
taatacgactcactataggggcccttggcctttccaaattccccttgtttaacagaggagaaaacaaatggaatttggaaacctggcggcagcgcaaaagatg

SEQ ID NO: 84172 - DNA, 103 bp, Artificial Sequence
  Synthetic Polynucleotide
taatacgactcactatagggcggctgcccttggcctttccaaattcccctaacagaggagaaggggaatgtggaaaggcaacctggcggcagcgcaaaagatg

SEQ ID NO: 84173 - DNA, 103 bp, Artificial Sequence
  Synthetic Polynucleotide
taatacgactcactatagggtggcgcggctgcccttggcctttccaaattaacagaggagaaatttgatgaggccaaggaacctggcggcagcgcaaaagatg

SEQ ID NO: 84174 - DNA, 103 bp, Artificial Sequence
  Synthetic Polynucleotide
taatacgactcactatagggccagatggcgcggctgcccttggcctttccaacagaggagaggaaagatgaagggcagcaacctggcggcagcgcaaaagatg

SEQ ID NO: 84175 - DNA, 103 bp, Artificial Sequence
  Synthetic Polynucleotide
taatacgactcactatagggatataccagatggcgcggctgcccttggccaacagaggagaggccaaatgcagccgcgcaacctggcggcagcgcaaaagatg

SEQ ID NO: 84176 - DNA, 103 bp, Artificial Sequence
  Synthetic Polynucleotide
taatacgactcactataggggccacatataccagatggcgcggctgccctaacagaggagaagggcaatggcgccatctaacctggcggcagcgcaaaagatg

SEQ ID NO: 84177 - DNA, 103 bp, Artificial Sequence
  Synthetic Polynucleotide
taatacgactcactatagggccctagccacatataccagatggcgcggctaacagaggagaagccgcatgatctggtataacctggcggcagcgcaaaagatg

SEQ ID NO: 84178 - DNA, 103 bp, Artificial Sequence
  Synthetic Polynucleotide
taatacgactcactatagggctagcccctagccacatataccagatggcgaacagaggagacgccatatggtatatgtgaacctggcggcagcgcaaaagatg

SEQ ID NO: 84179 - DNA, 103 bp, Artificial Sequence
  Synthetic Polynucleotide
taatacgactcactataggggaaatctagcccctagccacatataccagaaacagaggagatctggtatgtgtggctagaacctggcggcagcgcaaaagatg

SEQ ID NO: 84180 - DNA, 103 bp, Artificial Sequence
  Synthetic Polynucleotide
taatacgactcactataggggactttttggctcgttgagcttcccaaaagaacagaggagacttttgatgagctcaacgaacctggcggcagcgcaaaagatg

SEQ ID NO: 84181 - DNA, 103 bp, Artificial Sequence
  Synthetic Polynucleotide
taatacgactcactatagggctctagaaatctagcccctagccacatataaacagaggagatatatgatgctaggggctaacctggcggcagcgcaaaagatg

SEQ ID NO: 84182 - DNA, 103 bp, Artificial Sequence
  Synthetic Polynucleotide
taatacgactcactatagggtcgaactctagaaatctagcccctagccacaacagaggagagtggctatgggctagattaacctggcggcagcgcaaaagatg

SEQ ID NO: 84183 - DNA, 103 bp, Artificial Sequence
  Synthetic Polynucleotide
taatacgactcactataggggggcttcgaactctagaaatctagcccctaaacagaggagataggggatggatttctagaacctggcggcagcgcaaaagatg

SEQ ID NO: 84184 - DNA, 103 bp, Artificial Sequence
  Synthetic Polynucleotide
taatacgactcactatagggtccaagggcttcgaactctagaaatctagcaacagaggagagctagaatgctagagttcaacctggcggcagcgcaaaagatg

SEQ ID NO: 84185 - DNA, 103 bp, Artificial Sequence
  Synthetic Polynucleotide
taatacgactcactatagggaagaatccaagggcttcgaactctagaaataacagaggagaatttctatggttcgaagcaacctggcggcagcgcaaaagatg

SEQ ID NO: 84186 - DNA, 103 bp, Artificial Sequence
  Synthetic Polynucleotide
taatacgactcactatagggcgttcaagaatccaagggcttcgaactctaaacagaggagatagagtatgaagcccttgaacctggcggcagcgcaaaagatg

SEQ ID NO: 84187 - DNA, 103 bp, Artificial Sequence
  Synthetic Polynucleotide
taatacgactcactatagggatcctcgttcaagaatccaagggcttcgaaaacagaggagattcgaaatgcttggattcaacctggcggcagcgcaaaagatg

SEQ ID NO: 84188 - DNA, 103 bp, Artificial Sequence
  Synthetic Polynucleotide
taatacgactcactatagggcagtgatcctcgttcaagaatccaagggctaacagaggagaagccctatgattcttgaaaacctggcggcagcgcaaaagatg

SEQ ID NO: 84189 - DNA, 103 bp, Artificial Sequence
  Synthetic Polynucleotide
taatacgactcactatagggccatccagtgatcctcgttcaagaatccaaaacagaggagattggatatgtgaacgaggaacctggcggcagcgcaaaagatg

SEQ ID NO: 84190 - DNA, 103 bp, Artificial Sequence
  Synthetic Polynucleotide
taatacgactcactatagggtctccccatccagtgatcctcgttcaagaaaacagaggagattcttgatggaggatcacaacctggcggcagcgcaaaagatg

SEQ ID NO: 84191 - DNA, 103 bp, Artificial Sequence
  Synthetic Polynucleotide
taatacgactcactatagggtatatgactttttggctcgttgagcttcccaacagaggagagggaagatgaacgagccaaacctggcggcagcgcaaaagatg

SEQ ID NO: 84192 - DNA, 103 bp, Artificial Sequence
  Synthetic Polynucleotide
taatacgactcactatagggttctctctccccatccagtgatcctcgttcaacagaggagagaacgaatgtcactggataacctggcggcagcgcaaaagatg

SEQ ID NO: 84193 - DNA, 103 bp, Artificial Sequence
  Synthetic Polynucleotide
taatacgactcactatagggctgagttctctctccccatccagtgatcctaacagaggagaaggatcatgggatggggaaacctggcggcagcgcaaaagatg

SEQ ID NO: 84194 - DNA, 103 bp, Artificial Sequence
  Synthetic Polynucleotide
taatacgactcactatagggacctcctgagttctctctccccatccagtgaacagaggagacactggatggggagagagaacctggcggcagcgcaaaagatg

SEQ ID NO: 84195 - DNA, 103 bp, Artificial Sequence
  Synthetic Polynucleotide
taatacgactcactatagggacaccacctcctgagttctctctccccatcaacagaggagagatgggatgagagaactcaacctggcggcagcgcaaaagatg

SEQ ID NO: 84196 - DNA, 103 bp, Artificial Sequence
  Synthetic Polynucleotide
taatacgactcactatagggcttcaacaccacctcctgagttctctctccaacagaggagaggagagatgactcaggagaacctggcggcagcgcaaaagatg

SEQ ID NO: 84197 - DNA, 103 bp, Artificial Sequence
  Synthetic Polynucleotide
taatacgactcactatagggcagcccttcaacaccacctcctgagttctcaacagaggagagagaacatgggaggtggtaacctggcggcagcgcaaaagatg

SEQ ID NO: 84198 - DNA, 103 bp, Artificial Sequence
  Synthetic Polynucleotide
taatacgactcactatagggaatcccagcccttcaacaccacctcctgagaacagaggagactcaggatgtggtgttgaaacctggcggcagcgcaaaagatg

SEQ ID NO: 84199 - DNA, 103 bp, Artificial Sequence
  Synthetic Polynucleotide
taatacgactcactatagggtttgtaatcccagcccttcaacaccacctcaacagaggagagaggtgatgttgaagggcaacctggcggcagcgcaaaagatg

SEQ ID NO: 84200 - DNA, 103 bp, Artificial Sequence
  Synthetic Polynucleotide
taatacgactcactataggggagtctttgtaatcccagcccttcaacaccaacagaggagaggtgttatggggctgggaaacctggcggcagcgcaaaagatg

SEQ ID NO: 84201 - DNA, 103 bp, Artificial Sequence
  Synthetic Polynucleotide
taatacgactcactatagggtatccgagtctttgtaatcccagcccttcaaacagaggagatgaaggatggggattacaaacctggcggcagcgcaaaagatg

SEQ ID NO: 84202 - DNA, 103 bp, Artificial Sequence
  Synthetic Polynucleotide
taatacgactcactatagggccaagtatatgactttttggctcgttgagcaacagaggagagctcaaatggccaaaaagaacctggcggcagcgcaaaagatg

SEQ ID NO: 84203 - DNA, 103 bp, Artificial Sequence
  Synthetic Polynucleotide
taatacgactcactatagggggacatatccgagtctttgtaatcccagccaacagaggagaggctggatgtacaaagacaacctggcggcagcgcaaaagatg

SEQ ID NO: 84204 - DNA, 103 bp, Artificial Sequence
  Synthetic Polynucleotide
taatacgactcactatagggttctaggacatatccgagtctttgtaatccaacagaggagaggattaatgagactcggaaacctggcggcagcgcaaaagatg

SEQ ID NO: 84205 - DNA, 103 bp, Artificial Sequence
  Synthetic Polynucleotide
taatacgactcactatagggatctcttctaggacatatccgagtctttgtaacagaggagaacaaagatgcggatatgtaacctggcggcagcgcaaaagatg

SEQ ID NO: 84206 - DNA, 103 bp, Artificial Sequence
  Synthetic Polynucleotide
taatacgactcactataggggactcatctcttctaggacatatccgagtcaacagaggagagactcgatgatgtcctagaacctggcggcagcgcaaaagatg

SEQ ID NO: 84207 - DNA, 103 bp, Artificial Sequence
  Synthetic Polynucleotide
taatacgactcactatagggtatgcgactcatctcttctaggacatatccaacagaggagaggatatatgctagaagagaacctggcggcagcgcaaaagatg

SEQ ID NO: 84208 - DNA, 103 bp, Artificial Sequence
  Synthetic Polynucleotide
taatacgactcactatagggcctggtatgcgactcatctcttctaggacaaacagaggagatgtcctatgagagatgagaacctggcggcagcgcaaaagatg

SEQ ID NO: 84209 - DNA, 103 bp, Artificial Sequence
  Synthetic Polynucleotide
taatacgactcactatagggttcctcctggtatgcgactcatctcttctaaacagaggagatagaagatgtgagtcgcaaacctggcggcagcgcaaaagatg

SEQ ID NO: 84210 - DNA, 103 bp, Artificial Sequence
  Synthetic Polynucleotide
taatacgactcactatagggcatccttcctcctggtatgcgactcatctcaacagaggagagagatgatgcgcataccaaacctggcggcagcgcaaaagatg

SEQ ID NO: 84211 - DNA, 103 bp, Artificial Sequence
  Synthetic Polynucleotide
taatacgactcactataggggcatacatccttcctcctggtatgcgactcaacagaggagagagtcgatgaccaggaggaacctggcggcagcgcaaaagatg

SEQ ID NO: 84212 - DNA, 103 bp, Artificial Sequence
  Synthetic Polynucleotide
taatacgactcactatagggcatctgcatacatccttcctcctggtatgcaacagaggagagcatacatggaggaaggaaacctggcggcagcgcaaaagatg

SEQ ID NO: 84213 - DNA, 103 bp, Artificial Sequence
  Synthetic Polynucleotide
taatacgactcactatagggcatgaccaagtatatgactttttggctcgtaacagaggagaacgagcatgaaagtcataaacctggcggcagcgcaaaagatg

SEQ ID NO: 84214 - DNA, 103 bp, Artificial Sequence
  Synthetic Polynucleotide
taatacgactcactatagggagtgtcatctgcatacatccttcctcctggaacagaggagaccaggaatgaggatgtataacctggcggcagcgcaaaagatg

SEQ ID NO: 84215 - DNA, 103 bp, Artificial Sequence
  Synthetic Polynucleotide
taatacgactcactatagggccagcagtgtcatctgcatacatccttcctaacagaggagaaggaagatggtatgcagaaacctggcggcagcgcaaaagatg

SEQ ID NO: 84216 - DNA, 103 bp, Artificial Sequence
  Synthetic Polynucleotide
taatacgactcactatagggcccagccagcagtgtcatctgcatacatccaacagaggagaggatgtatgcagatgacaaacctggcggcagcgcaaaagatg

SEQ ID NO: 84217 - DNA, 103 bp, Artificial Sequence
  Synthetic Polynucleotide
taatacgactcactatagggggtgtcccagccagcagtgtcatctgcataaacagaggagatatgcaatggacactgctaacctggcggcagcgcaaaagatg

SEQ ID NO: 84218 - DNA, 103 bp, Artificial Sequence
  Synthetic Polynucleotide
taatacgactcactatagggatgcgggtgtcccagccagcagtgtcatctaacagaggagaagatgaatgtgctggctgaacctggcggcagcgcaaaagatg

SEQ ID NO: 84219 - DNA, 103 bp, Artificial Sequence
  Synthetic Polynucleotide
taatacgactcactatagggtgctgatgcgggtgtcccagccagcagtgtaacagaggagaacactgatggctgggacaaacctggcggcagcgcaaaagatg

SEQ ID NO: 84220 - DNA, 103 bp, Artificial Sequence
  Synthetic Polynucleotide
taatacgactcactataggggaacctgctgatgcgggtgtcccagccagcaacagaggagagctggcatggacacccgcaacctggcggcagcgcaaaagatg

SEQ ID NO: 84221 - DNA, 103 bp, Artificial Sequence
  Synthetic Polynucleotide
taatacgactcactatagggagatcgaacctgctgatgcgggtgtcccagaacagaggagactgggaatgccgcatcagaacctggcggcagcgcaaaagatg

SEQ ID NO: 84222 - DNA, 103 bp, Artificial Sequence
  Synthetic Polynucleotide
taatacgactcactatagggtctccagatcgaacctgctgatgcgggtgtaacagaggagaacacccatgtcagcaggtaacctggcggcagcgcaaaagatg

SEQ ID NO: 84223 - DNA, 103 bp, Artificial Sequence
  Synthetic Polynucleotide
taatacgactcactatagggttcattctccagatcgaacctgctgatgcgaacagaggagacgcatcatgaggttcgataacctggcggcagcgcaaaagatg

SEQ ID NO: 84224 - DNA, 103 bp, Artificial Sequence
  Synthetic Polynucleotide
taatacgactcactatagggagtatcatgaccaagtatatgactttttggaacagaggagaccaaaaatgcatatacttaacctggcggcagcgcaaaagatg

SEQ ID NO: 84225 - DNA, 103 bp, Artificial Sequence
  Synthetic Polynucleotide
taatacgactcactatagggagagcttcattctccagatcgaacctgctgaacagaggagacagcagatgcgatctggaaacctggcggcagcgcaaaagatg

SEQ ID NO: 84226 - DNA, 103 bp, Artificial Sequence
  Synthetic Polynucleotide
taatacgactcactatagggtgattagagcttcattctccagatcgaaccaacagaggagaggttcgatgtggagaatgaacctggcggcagcgcaaaagatg

SEQ ID NO: 84227 - DNA, 103 bp, Artificial Sequence
  Synthetic Polynucleotide
taatacgactcactataggggttggtgattagagcttcattctccagatcaacagaggagagatctgatgaatgaagctaacctggcggcagcgcaaaagatg

SEQ ID NO: 84228 - DNA, 103 bp, Artificial Sequence
  Synthetic Polynucleotide
taatacgactcactatagggatttggttggtgattagagcttcattctccaacagaggagaggagaaatgagctctaataacctggcggcagcgcaaaagatg

SEQ ID NO: 84229 - DNA, 103 bp, Artificial Sequence
  Synthetic Polynucleotide
taatacgactcactatagggtctccatttggttggtgattagagcttcataacagaggagaatgaagatgtaatcaccaaacctggcggcagcgcaaaagatg

SEQ ID NO: 84230 - DNA, 103 bp, Artificial Sequence
  Synthetic Polynucleotide
taatacgactcactatagggccctttctccatttggttggtgattagagcaacagaggagagctctaatgaccaaccaaaacctggcggcagcgcaaaagatg

SEQ ID NO: 84231 - DNA, 103 bp, Artificial Sequence
  Synthetic Polynucleotide
taatacgactcactatagggctatgccctttctccatttggttggtgattaacagaggagaaatcacatgccaaatggaaacctggcggcagcgcaaaagatg

SEQ ID NO: 84232 - DNA, 103 bp, Artificial Sequence
  Synthetic Polynucleotide
taatacgactcactatagggaggccctatgccctttctccatttggttggaacagaggagaccaaccatgtggagaaagaacctggcggcagcgcaaaagatg

SEQ ID NO: 84233 - DNA, 103 bp, Artificial Sequence
  Synthetic Polynucleotide
taatacgactcactatagggtgccaaggccctatgccctttctccatttgaacagaggagacaaatgatgaaagggcataacctggcggcagcgcaaaagatg

SEQ ID NO: 84234 - DNA, 103 bp, Artificial Sequence
  Synthetic Polynucleotide
taatacgactcactataggggccaatgccaaggccctatgccctttctccaacagaggagaggagaaatggcatagggcaacctggcggcagcgcaaaagatg

SEQ ID NO: 84235 - DNA, 103 bp, Artificial Sequence
  Synthetic Polynucleotide
taatacgactcactatagggtcagcagtatcatgaccaagtatatgacttaacagaggagaaagtcaatgacttggtcaaacctggcggcagcgcaaaagatg

SEQ ID NO: 84236 - DNA, 103 bp, Artificial Sequence
  Synthetic Polynucleotide
taatacgactcactatagggttatggccaatgccaaggccctatgcccttaacagaggagaaagggcatggggccttggaacctggcggcagcgcaaaagatg

SEQ ID NO: 84237 - DNA, 103 bp, Artificial Sequence
  Synthetic Polynucleotide
taatacgactcactatagggcttgattatggccaatgccaaggccctatgaacagaggagacataggatgttggcattgaacctggcggcagcgcaaaagatg

SEQ ID NO: 84238 - DNA, 103 bp, Artificial Sequence
  Synthetic Polynucleotide
taatacgactcactataggggtgtacttgattatggccaatgccaaggccaacagaggagaggccttatgattggccataacctggcggcagcgcaaaagatg

SEQ ID NO: 84239 - DNA, 103 bp, Artificial Sequence
  Synthetic Polynucleotide
taatacgactcactatagggggtatgtgtacttgattatggccaatgccaaacagaggagatggcatatgccataatcaaacctggcggcagcgcaaaagatg

SEQ ID NO: 84240 - DNA, 103 bp, Artificial Sequence
  Synthetic Polynucleotide
taatacgactcactataggggttttggtatgtgtacttgattatggccaaaacagaggagattggccatgatcaagtacaacctggcggcagcgcaaaagatg

SEQ ID NO: 84241 - DNA, 103 bp, Artificial Sequence
  Synthetic Polynucleotide
taatacgactcactatagggactttgttttggtatgtgtacttgattatgaacagaggagacataatatggtacacataaacctggcggcagcgcaaaagatg

SEQ ID NO: 84242 - DNA, 103 bp, Artificial Sequence
  Synthetic Polynucleotide
taatacgactcactatagggttaccactttgttttggtatgtgtacttgaaacagaggagatcaagtatgcataccaaaaacctggcggcagcgcaaaagatg

SEQ ID NO: 84243 - DNA, 103 bp, Artificial Sequence
  Synthetic Polynucleotide
taatacgactcactataggggacctttaccactttgttttggtatgtgtaaacagaggagatacacaatgcaaaacaaaaacctggcggcagcgcaaaagatg

SEQ ID NO: 84244 - DNA, 103 bp, Artificial Sequence
  Synthetic Polynucleotide
taatacgactcactatagggctaaggacctttaccactttgttttggtataacagaggagaataccaatgcaaagtggtaacctggcggcagcgcaaaagatg

SEQ ID NO: 84245 - DNA, 103 bp, Artificial Sequence
  Synthetic Polynucleotide
taatacgactcactatagggctggtctaaggacctttaccactttgttttaacagaggagaaaaacaatgtggtaaaggaacctggcggcagcgcaaaagatg

SEQ ID NO: 84246 - DNA, 103 bp, Artificial Sequence
  Synthetic Polynucleotide
taatacgactcactatagggggcaatcagcagtatcatgaccaagtatataacagaggagaatatacatggtcatgataaacctggcggcagcgcaaaagatg

SEQ ID NO: 84247 - DNA, 103 bp, Artificial Sequence
  Synthetic Polynucleotide
taatacgactcactatagggttcagctggtctaaggacctttaccactttaacagaggagaaaagtgatgaaggtccttaacctggcggcagcgcaaaagatg

SEQ ID NO: 84248 - DNA, 103 bp, Artificial Sequence
  Synthetic Polynucleotide
taatacgactcactatagggcctttttcagctggtctaaggacctttaccaacagaggagaggtaaaatgccttagaccaacctggcggcagcgcaaaagatg

SEQ ID NO: 84249 - DNA, 103 bp, Artificial Sequence
  Synthetic Polynucleotide
taatacgactcactatagggttttccctttttcagctggtctaaggacctaacagaggagaaggtccatggaccagctgaacctggcggcagcgcaaaagatg

SEQ ID NO: 84250 - DNA, 103 bp, Artificial Sequence
  Synthetic Polynucleotide
taatacgactcactatagggaactgttttccctttttcagctggtctaagaacagaggagacttagaatggctgaaaaaaacctggcggcagcgcaaaagatg

SEQ ID NO: 84251 - DNA, 103 bp, Artificial Sequence
  Synthetic Polynucleotide
taatacgactcactatagggtccataactgttttccctttttcagctggtaacagaggagaaccagcatgaaaagggaaaacctggcggcagcgcaaaagatg

SEQ ID NO: 84252 - DNA, 103 bp, Artificial Sequence
  Synthetic Polynucleotide
taatacgactcactatagggtaatgtccataactgttttccctttttcagaacagaggagactgaaaatgggaaaacagaacctggcggcagcgcaaaagatg

SEQ ID NO: 84253 - DNA, 103 bp, Artificial Sequence
  Synthetic Polynucleotide
taatacgactcactatagggcgaaataatgtccataactgttttccctttaacagaggagaaaagggatgacagttatgaacctggcggcagcgcaaaagatg

SEQ ID NO: 84254 - DNA, 103 bp, Artificial Sequence
  Synthetic Polynucleotide
taatacgactcactatagggtgtctcgaaataatgtccataactgttttcaacagaggagagaaaacatgtatggacataacctggcggcagcgcaaaagatg

SEQ ID NO: 84255 - DNA, 103 bp, Artificial Sequence
  Synthetic Polynucleotide
taatacgactcactatagggggtcttgtctcgaaataatgtccataactgaacagaggagacagttaatgacattatttaacctggcggcagcgcaaaagatg

SEQ ID NO: 84256 - DNA, 103 bp, Artificial Sequence
  Synthetic Polynucleotide
taatacgactcactatagggcctttggtcttgtctcgaaataatgtccataacagaggagaatggacatgatttcgagaaacctggcggcagcgcaaaagatg

SEQ ID NO: 84257 - DNA, 103 bp, Artificial Sequence
  Synthetic Polynucleotide
taatacgactcactataggggccggggcaatcagcagtatcatgaccaagaacagaggagacttggtatggatactgctaacctggcggcagcgcaaaagatg

SEQ ID NO: 84258 - DNA, 103 bp, Artificial Sequence
  Synthetic Polynucleotide
taatacgactcactatagggctccccctttggtcttgtctcgaaataatgaacagaggagacattatatggagacaagaaacctggcggcagcgcaaaagatg

SEQ ID NO: 84259 - DNA, 103 bp, Artificial Sequence
  Synthetic Polynucleotide
taatacgactcactataggggtccgctccccctttggtcttgtctcgaaaaacagaggagatttcgaatgaagaccaaaaacctggcggcagcgcaaaagatg

SEQ ID NO: 84260 - DNA, 103 bp, Artificial Sequence
  Synthetic Polynucleotide
taatacgactcactatagggaacttgtccgctccccctttggtcttgtctaacagaggagaagacaaatgcaaagggggaacctggcggcagcgcaaaagatg

SEQ ID NO: 84261 - DNA, 103 bp, Artificial Sequence
  Synthetic Polynucleotide
taatacgactcactataggggtgacaacttgtccgctccccctttggtctaacagaggagaagaccaatgggggagcggaacctggcggcagcgcaaaagatg

SEQ ID NO: 84262 - DNA, 103 bp, Artificial Sequence
  Synthetic Polynucleotide
taatacgactcactatagggcgtaagtgacaacttgtccgctccccctttaacagaggagaaaagggatggcggacaagaacctggcggcagcgcaaaagatg

SEQ ID NO: 84263 - DNA, 103 bp, Artificial Sequence
  Synthetic Polynucleotide
taatacgactcactatagggaagagcgtaagtgacaacttgtccgctcccaacagaggagagggagcatgcaagttgtcaacctggcggcagcgcaaaagatg

SEQ ID NO: 84264 - DNA, 103 bp, Artificial Sequence
  Synthetic Polynucleotide
taatacgactcactataggggtgttaagagcgtaagtgacaacttgtccgaacagaggagacggacaatgtgtcacttaaacctggcggcagcgcaaaagatg

SEQ ID NO: 84265 - DNA, 103 bp, Artificial Sequence
  Synthetic Polynucleotide
taatacgactcactatagggtaaatgtgttaagagcgtaagtgacaacttaacagaggagaaagttgatgcttacgctcaacctggcggcagcgcaaaagatg

SEQ ID NO: 84266 - DNA, 103 bp, Artificial Sequence
  Synthetic Polynucleotide
taatacgactcactataggggttggtaaatgtgttaagagcgtaagtgacaacagaggagagtcactatggctcttaacaacctggcggcagcgcaaaagatg

SEQ ID NO: 84267 - DNA, 103 bp, Artificial Sequence
  Synthetic Polynucleotide
taatacgactcactatagggactaggttggtaaatgtgttaagagcgtaaaacagaggagattacgcatgtaacacattaacctggcggcagcgcaaaagatg

SEQ ID NO: 84268 - DNA, 103 bp, Artificial Sequence
  Synthetic Polynucleotide
taatacgactcactatagggttgggtttttcatgaccagaaactctcgttaacagaggagaaacgagatgttctggtcaaacctggcggcagcgcaaaagatg

SEQ ID NO: 84269 - DNA, 103 bp, Artificial Sequence
  Synthetic Polynucleotide
taatacgactcactatagggtgtatgccggggcaatcagcagtatcatgaaacagaggagatcatgaatgtgctgattgaacctggcggcagcgcaaaagatg

SEQ ID NO: 84270 - DNA, 103 bp, Artificial Sequence
  Synthetic Polynucleotide
taatacgactcactataggggcaccactaggttggtaaatgtgttaagagaacagaggagactcttaatgcatttaccaaacctggcggcagcgcaaaagatg

SEQ ID NO: 84271 - DNA, 103 bp, Artificial Sequence
  Synthetic Polynucleotide
taatacgactcactataggggagttgcaccactaggttggtaaatgtgttaacagaggagaaacacaatgaccaacctaaacctggcggcagcgcaaaagatg

SEQ ID NO: 84272 - DNA, 103 bp, Artificial Sequence
  Synthetic Polynucleotide
taatacgactcactatagggcgaatgagttgcaccactaggttggtaaataacagaggagaatttacatgcctagtggtaacctggcggcagcgcaaaagatg

SEQ ID NO: 84273 - DNA, 103 bp, Artificial Sequence
  Synthetic Polynucleotide
taatacgactcactatagggtattccgaatgagttgcaccactaggttggaacagaggagaccaaccatgtggtgcaacaacctggcggcagcgcaaaagatg

SEQ ID NO: 84274 - DNA, 103 bp, Artificial Sequence
  Synthetic Polynucleotide
taatacgactcactatagggctccatattccgaatgagttgcaccactagaacagaggagactagtgatgcaactcattaacctggcggcagcgcaaaagatg

SEQ ID NO: 84275 - DNA, 103 bp, Artificial Sequence
  Synthetic Polynucleotide
taatacgactcactatagggtcagcctccatattccgaatgagttgcaccaacagaggagaggtgcaatgcattcggaaaacctggcggcagcgcaaaagatg

SEQ ID NO: 84276 - DNA, 103 bp, Artificial Sequence
  Synthetic Polynucleotide
taatacgactcactatagggcttcctcagcctccatattccgaatgagttaacagaggagaaactcaatgggaatatggaacctggcggcagcgcaaaagatg

SEQ ID NO: 84277 - DNA, 103 bp, Artificial Sequence
  Synthetic Polynucleotide
taatacgactcactatagggtagaacttcctcagcctccatattccgaataacagaggagaattcggatgatggaggctaacctggcggcagcgcaaaagatg

SEQ ID NO: 84278 - DNA, 103 bp, Artificial Sequence
  Synthetic Polynucleotide
taatacgactcactatagggatctctagaacttcctcagcctccatattcaacagaggagagaatatatgggctgaggaaacctggcggcagcgcaaaagatg

SEQ ID NO: 84279 - DNA, 103 bp, Artificial Sequence
  Synthetic Polynucleotide
taatacgactcactatagggcttgcatctctagaacttcctcagcctccaaacagaggagatggaggatgaggaagttcaacctggcggcagcgcaaaagatg

SEQ ID NO: 84280 - DNA, 103 bp, Artificial Sequence
  Synthetic Polynucleotide
taatacgactcactataggggatgctgtatgccggggcaatcagcagtataacagaggagaatactgatgattgccccgaacctggcggcagcgcaaaagatg

SEQ ID NO: 84281 - DNA, 103 bp, Artificial Sequence
  Synthetic Polynucleotide
taatacgactcactatagggcaagtcttgcatctctagaacttcctcagcaacagaggagagctgagatggttctagagaacctggcggcagcgcaaaagatg

SEQ ID NO: 84282 - DNA, 103 bp, Artificial Sequence
  Synthetic Polynucleotide
taatacgactcactatagggagccacaagtcttgcatctctagaacttccaacagaggagaggaagtatgagagatgcaaacctggcggcagcgcaaaagatg

SEQ ID NO: 84283 - DNA, 103 bp, Artificial Sequence
  Synthetic Polynucleotide
taatacgactcactataggggcagcagccacaagtcttgcatctctagaaaacagaggagattctagatgtgcaagactaacctggcggcagcgcaaaagatg

SEQ ID NO: 84284 - DNA, 103 bp, Artificial Sequence
  Synthetic Polynucleotide
taatacgactcactatagggcctccgcagcagccacaagtcttgcatctcaacagaggagagagatgatggacttgtggaacctggcggcagcgcaaaagatg

SEQ ID NO: 84285 - DNA, 103 bp, Artificial Sequence
  Synthetic Polynucleotide
taatacgactcactatagggtctgacctccgcagcagccacaagtcttgcaacagaggagagcaagaatggtggctgctaacctggcggcagcgcaaaagatg

SEQ ID NO: 84286 - DNA, 103 bp, Artificial Sequence
  Synthetic Polynucleotide
taatacgactcactatagggctttctctgacctccgcagcagccacaagtaacagaggagaacttgtatgtgctgcggaaacctggcggcagcgcaaaagatg

SEQ ID NO: 84287 - DNA, 103 bp, Artificial Sequence
  Synthetic Polynucleotide
taatacgactcactatagggggtcactttctctgacctccgcagcagccaaacagaggagatggctgatgcggaggtcaaacctggcggcagcgcaaaagatg

SEQ ID NO: 84288 - DNA, 103 bp, Artificial Sequence
  Synthetic Polynucleotide
taatacgactcactatagggcagttggtcactttctctgacctccgcagcaacagaggagagctgcgatggtcagagaaaacctggcggcagcgcaaaagatg

SEQ ID NO: 84289 - DNA, 103 bp, Artificial Sequence
  Synthetic Polynucleotide
taatacgactcactataggggcaaccagttggtcactttctctgacctccaacagaggagaggaggtatgagaaagtgaaacctggcggcagcgcaaaagatg

SEQ ID NO: 84290 - DNA, 103 bp, Artificial Sequence
  Synthetic Polynucleotide
taatacgactcactataggggctctgcaaccagttggtcactttctctgaaacagaggagatcagagatggtgaccaacaacctggcggcagcgcaaaagatg

SEQ ID NO: 84291 - DNA, 103 bp, Artificial Sequence
  Synthetic Polynucleotide
taatacgactcactatagggcacctgatgctgtatgccggggcaatcagcaacagaggagagctgatatgcccggcataaacctggcggcagcgcaaaagatg

SEQ ID NO: 84292 - DNA, 103 bp, Artificial Sequence
  Synthetic Polynucleotide
taatacgactcactatagggccgttgctctgcaaccagttggtcactttcaacagaggagagaaagtatgcaactggttaacctggcggcagcgcaaaagatg

SEQ ID NO: 84293 - DNA, 103 bp, Artificial Sequence
  Synthetic Polynucleotide
taatacgactcactatagggcccatccgttgctctgcaaccagttggtcaaacagaggagatgaccaatgggttgcagaaacctggcggcagcgcaaaagatg

SEQ ID NO: 84294 - DNA, 103 bp, Artificial Sequence
  Synthetic Polynucleotide
taatacgactcactatagggcctatcccatccgttgctctgcaaccagttaacagaggagaaactggatgcagagcaacaacctggcggcagcgcaaaagatg

SEQ ID NO: 84295 - DNA, 103 bp, Artificial Sequence
  Synthetic Polynucleotide
taatacgactcactatagggttgagcctatcccatccgttgctctgcaacaacagaggagagttgcaatgcaacggatgaacctggcggcagcgcaaaagatg

SEQ ID NO: 84296 - DNA, 103 bp, Artificial Sequence
  Synthetic Polynucleotide
taatacgactcactatagggttcgtttgagcctatcccatccgttgctctaacagaggagaagagcaatggatgggataaacctggcggcagcgcaaaagatg

SEQ ID NO: 84297 - DNA, 103 bp, Artificial Sequence
  Synthetic Polynucleotide
taatacgactcactatagggtgccattcgtttgagcctatcccatccgttaacagaggagaaacggaatggataggctcaacctggcggcagcgcaaaagatg

SEQ ID NO: 84298 - DNA, 103 bp, Artificial Sequence
  Synthetic Polynucleotide
taatacgactcactatagggctgactgccattcgtttgagcctatcccataacagaggagaatgggaatggctcaaacgaacctggcggcagcgcaaaagatg

SEQ ID NO: 84299 - DNA, 103 bp, Artificial Sequence
  Synthetic Polynucleotide
taatacgactcactatagggctccactgactgccattcgtttgagcctataacagaggagaataggcatgaacgaatggaacctggcggcagcgcaaaagatg

SEQ ID NO: 84300 - DNA, 103 bp, Artificial Sequence
  Synthetic Polynucleotide
taatacgactcactatagggatcatctccactgactgccattcgtttgagaacagaggagactcaaaatgatggcagtcaacctggcggcagcgcaaaagatg

SEQ ID NO: 84301 - DNA, 103 bp, Artificial Sequence
  Synthetic Polynucleotide
taatacgactcactatagggacgcaatcatctccactgactgccattcgtaacagaggagaacgaatatgagtcagtggaacctggcggcagcgcaaaagatg

SEQ ID NO: 84302 - DNA, 103 bp, Artificial Sequence
  Synthetic Polynucleotide
taatacgactcactatagggctatgcacctgatgctgtatgccggggcaaaacagaggagattgcccatgcatacagcaaacctggcggcagcgcaaaagatg

SEQ ID NO: 84303 - DNA, 103 bp, Artificial Sequence
  Synthetic Polynucleotide
taatacgactcactatagggtcacaacgcaatcatctccactgactgccaaacagaggagatggcagatggtggagatgaacctggcggcagcgcaaaagatg

SEQ ID NO: 84304 - DNA, 103 bp, Artificial Sequence
  Synthetic Polynucleotide
taatacgactcactatagggtggcttcacaacgcaatcatctccactgacaacagaggagagtcagtatggatgattgcaacctggcggcagcgcaaaagatg

SEQ ID NO: 84305 - DNA, 103 bp, Artificial Sequence
  Synthetic Polynucleotide
taatacgactcactatagggtcaattggcttcacaacgcaatcatctccaaacagaggagatggagaatgttgcgttgtaacctggcggcagcgcaaaagatg

SEQ ID NO: 84306 - DNA, 103 bp, Artificial Sequence
  Synthetic Polynucleotide
taatacgactcactatagggtatcatcaattggcttcacaacgcaatcataacagaggagaatgattatgttgtgaagcaacctggcggcagcgcaaaagatg

SEQ ID NO: 84307 - DNA, 103 bp, Artificial Sequence
  Synthetic Polynucleotide
taatacgactcactatagggaaacctatcatcaattggcttcacaacgcaaacagaggagatgcgttatgaagccaattaacctggcggcagcgcaaaagatg

SEQ ID NO: 84308 - DNA, 103 bp, Artificial Sequence
  Synthetic Polynucleotide
taatacgactcactatagggtgtgcaaacctatcatcaattggcttcacaaacagaggagatgtgaaatgaattgatgaaacctggcggcagcgcaaaagatg

SEQ ID NO: 84309 - DNA, 103 bp, Artificial Sequence
  Synthetic Polynucleotide
taatacgactcactataggggggcatgtgcaaacctatcatcaattggctaacagaggagaagccaaatgatgataggtaacctggcggcagcgcaaaagatg

SEQ ID NO: 84310 - DNA, 103 bp, Artificial Sequence
  Synthetic Polynucleotide
taatacgactcactatagggcctgagggcatgtgcaaacctatcatcaataacagaggagaattgatatgaggtttgcaaacctggcggcagcgcaaaagatg

SEQ ID NO: 84311 - DNA, 103 bp, Artificial Sequence
  Synthetic Polynucleotide
taatacgactcactatagggaagaacctgagggcatgtgcaaacctatcaaacagaggagatgatagatgtgcacatgcaacctggcggcagcgcaaaagatg

SEQ ID NO: 84312 - DNA, 103 bp, Artificial Sequence
  Synthetic Polynucleotide
taatacgactcactatagggcattcaagaacctgagggcatgtgcaaaccaacagaggagaggtttgatgatgccctcaaacctggcggcagcgcaaaagatg

SEQ ID NO: 84313 - DNA, 103 bp, Artificial Sequence
  Synthetic Polynucleotide
taatacgactcactataggggactcctatgcacctgatgctgtatgccggaacagaggagaccggcaatgagcatcaggaacctggcggcagcgcaaaagatg

SEQ ID NO: 84314 - DNA, 103 bp, Artificial Sequence
  Synthetic Polynucleotide
taatacgactcactatagggcatatcattcaagaacctgagggcatgtgcaacagaggagagcacatatgctcaggttcaacctggcggcagcgcaaaagatg

SEQ ID NO: 84315 - DNA, 103 bp, Artificial Sequence
  Synthetic Polynucleotide
taatacgactcactatagggtttcccatatcattcaagaacctgagggcaaacagaggagatgccctatggttcttgaaaacctggcggcagcgcaaaagatg

SEQ ID NO: 84316 - DNA, 103 bp, Artificial Sequence
  Synthetic Polynucleotide
taatacgactcactatagggtaacttttcccatatcattcaagaacctgaaacagaggagatcaggtatgtgaatgataaacctggcggcagcgcaaaagatg

SEQ ID NO: 84317 - DNA, 103 bp, Artificial Sequence
  Synthetic Polynucleotide
taatacgactcactatagggcttcctaacttttcccatatcattcaagaaaacagaggagattcttgatggatatgggaaacctggcggcagcgcaaaagatg

SEQ ID NO: 84318 - DNA, 103 bp, Artificial Sequence
  Synthetic Polynucleotide
taatacgactcactataggggtgtccttcctaacttttcccatatcattcaacagaggagagaatgaatggggaaaagtaacctggcggcagcgcaaaagatg

SEQ ID NO: 84319 - DNA, 103 bp, Artificial Sequence
  Synthetic Polynucleotide
taatacgactcactatagggcttgtgtgtccttcctaacttttcccatataacagaggagaatatggatgaagttaggaaacctggcggcagcgcaaaagatg

SEQ ID NO: 84320 - DNA, 103 bp, Artificial Sequence
  Synthetic Polynucleotide
taatacgactcactatagggccactcttgtgtgtccttcctaacttttccaacagaggagaggaaaaatgaggaaggacaacctggcggcagcgcaaaagatg

SEQ ID NO: 84321 - DNA, 103 bp, Artificial Sequence
  Synthetic Polynucleotide
taatacgactcactatagggggtttccactcttgtgtgtccttcctaactaacagaggagaagttagatgggacacacaaacctggcggcagcgcaaaagatg

SEQ ID NO: 84322 - DNA, 103 bp, Artificial Sequence
  Synthetic Polynucleotide
taatacgactcactatagggttgagggtttccactcttgtgtgtccttccaacagaggagaggaaggatgcacaagagtaacctggcggcagcgcaaaagatg

SEQ ID NO: 84323 - DNA, 103 bp, Artificial Sequence
  Synthetic Polynucleotide
taatacgactcactatagggtccagttgagggtttccactcttgtgtgtcaacagaggagagacacaatggagtggaaaaacctggcggcagcgcaaaagatg

SEQ ID NO: 84324 - DNA, 103 bp, Artificial Sequence
  Synthetic Polynucleotide
taatacgactcactatagggttgctgactcctatgcacctgatgctgtataacagaggagaatacagatgcaggtgcataacctggcggcagcgcaaaagatg

SEQ ID NO: 84325 - DNA, 103 bp, Artificial Sequence
  Synthetic Polynucleotide
taatacgactcactatagggtcccatccagttgagggtttccactcttgtaacagaggagaacaagaatggaaaccctcaacctggcggcagcgcaaaagatg

SEQ ID NO: 84326 - DNA, 103 bp, Artificial Sequence
  Synthetic Polynucleotide
taatacgactcactatagggagttgtcccatccagttgagggtttccactaacagaggagaagtggaatgcctcaactgaacctggcggcagcgcaaaagatg

SEQ ID NO: 84327 - DNA, 103 bp, Artificial Sequence
  Synthetic Polynucleotide
taatacgactcactatagggttcccagttgtcccatccagttgagggtttaacagaggagaaaacccatgactggatggaacctggcggcagcgcaaaagatg

SEQ ID NO: 84328 - DNA, 103 bp, Artificial Sequence
  Synthetic Polynucleotide
taatacgactcactatagggacttcttcccagttgtcccatccagttgagaacagaggagactcaacatgatgggacaaaacctggcggcagcgcaaaagatg

SEQ ID NO: 84329 - DNA, 103 bp, Artificial Sequence
  Synthetic Polynucleotide
taatacgactcactatagggacggaacttcttcccagttgtcccatccagaacagaggagactggatatgacaactgggaacctggcggcagcgcaaaagatg

SEQ ID NO: 84330 - DNA, 103 bp, Artificial Sequence
  Synthetic Polynucleotide
taatacgactcactataggggcaaaacggaacttcttcccagttgtcccaaacagaggagatgggacatgtgggaagaaaacctggcggcagcgcaaaagatg

SEQ ID NO: 84331 - DNA, 103 bp, Artificial Sequence
  Synthetic Polynucleotide
taatacgactcactatagggtgggagcaaaacggaacttcttcccagttgaacagaggagacaactgatgagaagttccaacctggcggcagcgcaaaagatg

SEQ ID NO: 84332 - DNA, 103 bp, Artificial Sequence
  Synthetic Polynucleotide
taatacgactcactatagggagtggtgggagcaaaacggaacttcttcccaacagaggagagggaagatgttccgttttaacctggcggcagcgcaaaagatg

SEQ ID NO: 84333 - DNA, 103 bp, Artificial Sequence
  Synthetic Polynucleotide
taatacgactcactataggggttgaagtggtgggagcaaaacggaacttcaacagaggagagaagttatgttttgctccaacctggcggcagcgcaaaagatg

SEQ ID NO: 84334 - DNA, 103 bp, Artificial Sequence
  Synthetic Polynucleotide
taatacgactcactatagggagcttgttgaagtggtgggagcaaaacggaaacagaggagatccgttatgctcccaccaaacctggcggcagcgcaaaagatg

SEQ ID NO: 84335 - DNA, 103 bp, Artificial Sequence
  Synthetic Polynucleotide
taatacgactcactatagggccctattgctgactcctatgcacctgatgcaacagaggagagcatcaatggcataggagaacctggcggcagcgcaaaagatg

SEQ ID NO: 84336 - DNA, 103 bp, Artificial Sequence
  Synthetic Polynucleotide
taatacgactcactataggggatggagcttgttgaagtggtgggagcaaaaacagaggagatttgctatgaccacttcaaacctggcggcagcgcaaaagatg

SEQ ID NO: 84337 - DNA, 103 bp, Artificial Sequence
  Synthetic Polynucleotide
taatacgactcactatagggcttgagatggagcttgttgaagtggtgggaaacagaggagatcccacatgttcaacaagaacctggcggcagcgcaaaagatg

SEQ ID NO: 84338 - DNA, 103 bp, Artificial Sequence
  Synthetic Polynucleotide
taatacgactcactatagggccgtccttgagatggagcttgttgaagtggaacagaggagaccacttatgcaagctccaaacctggcggcagcgcaaaagatg

SEQ ID NO: 84339 - DNA, 103 bp, Artificial Sequence
  Synthetic Polynucleotide
taatacgactcactatagggacctcccgtccttgagatggagcttgttgaaacagaggagatcaacaatgtccatctcaaacctggcggcagcgcaaaagatg

SEQ ID NO: 84340 - DNA, 103 bp, Artificial Sequence
  Synthetic Polynucleotide
taatacgactcactatagggaatggacctcccgtccttgagatggagcttaacagaggagaaagctcatgctcaaggacaacctggcggcagcgcaaaagatg

SEQ ID NO: 84341 - DNA, 103 bp, Artificial Sequence
  Synthetic Polynucleotide
taatacgactcactatagggaccacaatggacctcccgtccttgagatggaacagaggagaccatctatgggacgggagaacctggcggcagcgcaaaagatg

SEQ ID NO: 84342 - DNA, 103 bp, Artificial Sequence
  Synthetic Polynucleotide
taatacgactcactatagggagggaaccacaatggacctcccgtccttgaaacagaggagatcaaggatgggaggtccaaacctggcggcagcgcaaaagatg

SEQ ID NO: 84343 - DNA, 103 bp, Artificial Sequence
  Synthetic Polynucleotide
taatacgactcactataggggcggcagggaaccacaatggacctcccgtcaacagaggagagacgggatgtccattgtgaacctggcggcagcgcaaaagatg

SEQ ID NO: 84344 - DNA, 103 bp, Artificial Sequence
  Synthetic Polynucleotide
taatacgactcactatagggtggtggcggcagggaaccacaatggacctcaacagaggagagaggtcatgtgtggttccaacctggcggcagcgcaaaagatg

SEQ ID NO: 84345 - DNA, 103 bp, Artificial Sequence
  Synthetic Polynucleotide
taatacgactcactatagggcatcttggtggcggcagggaaccacaatggaacagaggagaccattgatgttccctgccaacctggcggcagcgcaaaagatg

SEQ ID NO: 84346 - DNA, 103 bp, Artificial Sequence
  Synthetic Polynucleotide
taatacgactcactatagggaaagtccctattgctgactcctatgcacctaacagaggagaaggtgcatgggagtcagcaacctggcggcagcgcaaaagatg

SEQ ID NO: 84347 - DNA, 103 bp, Artificial Sequence
  Synthetic Polynucleotide
taatacgactcactatagggcagttcatcttggtggcggcagggaaccacaacagaggagagtggttatgtgccgccacaacctggcggcagcgcaaaagatg

SEQ ID NO: 84348 - DNA, 103 bp, Artificial Sequence
  Synthetic Polynucleotide
taatacgactcactatagggccaatcagttcatcttggtggcggcagggaaacagaggagatccctgatgccaccaagaaacctggcggcagcgcaaaagatg

SEQ ID NO: 84349 - DNA, 103 bp, Artificial Sequence
  Synthetic Polynucleotide
taatacgactcactatagggcccggccaatcagttcatcttggtggcggcaacagaggagagccgccatgaagatgaacaacctggcggcagcgcaaaagatg

SEQ ID NO: 84350 - DNA, 103 bp, Artificial Sequence
  Synthetic Polynucleotide
taatacgactcactataggggcgggcccggccaatcagttcatcttggtgaacagaggagacaccaaatggaactgattaacctggcggcagcgcaaaagatg

SEQ ID NO: 84351 - DNA, 103 bp, Artificial Sequence
  Synthetic Polynucleotide
taatacgactcactataggggagacgcgggcccggccaatcagttcatctaacagaggagaagatgaatggattggccgaacctggcggcagcgcaaaagatg

SEQ ID NO: 84352 - DNA, 103 bp, Artificial Sequence
  Synthetic Polynucleotide
taatacgactcactatagggctggagagacgcgggcccggccaatcagttaacagaggagaaactgaatggccgggcccaacctggcggcagcgcaaaagatg

SEQ ID NO: 84353 - DNA, 103 bp, Artificial Sequence
  Synthetic Polynucleotide
taatacgactcactatagggcgcccctggagagacgcgggcccggccaataacagaggagaattggcatggcccgcgtcaacctggcggcagcgcaaaagatg

SEQ ID NO: 84354 - DNA, 103 bp, Artificial Sequence
  Synthetic Polynucleotide
taatacgactcactatagggcatcccgcccctggagagacgcgggcccggaacagaggagaccgggcatgcgtctctccaacctggcggcagcgcaaaagatg

SEQ ID NO: 84355 - DNA, 103 bp, Artificial Sequence
  Synthetic Polynucleotide
taatacgactcactatagggtgctccatcccgcccctggagagacgcgggaacagaggagacccgcgatgctccaggggaacctggcggcagcgcaaaagatg

SEQ ID NO: 84356 - DNA, 103 bp, Artificial Sequence
  Synthetic Polynucleotide
taatacgactcactatagggccggatgctccatcccgcccctggagagacaacagaggagagtctctatgggggcgggaaacctggcggcagcgcaaaagatg

SEQ ID NO: 84357 - DNA, 103 bp, Artificial Sequence
  Synthetic Polynucleotide
taatacgactcactatagggtccacaaagtccctattgctgactcctatgaacagaggagacataggatgcagcaatagaacctggcggcagcgcaaaagatg

SEQ ID NO: 84358 - DNA, 103 bp, Artificial Sequence
  Synthetic Polynucleotide
taatacgactcactataggggtctcccggatgctccatcccgcccctggaaacagaggagatccaggatggggatggagaacctggcggcagcgcaaaagatg

SEQ ID NO: 84359 - DNA, 103 bp, Artificial Sequence
  Synthetic Polynucleotide
taatacgactcactatagggaagcagtctcccggatgctccatcccgcccaacagaggagagggcggatgggagcatccaacctggcggcagcgcaaaagatg

SEQ ID NO: 84360 - DNA, 103 bp, Artificial Sequence
  Synthetic Polynucleotide
taatacgactcactatagggtaggcaagcagtctcccggatgctccatccaacagaggagaggatggatgatccgggagaacctggcggcagcgcaaaagatg

SEQ ID NO: 84361 - DNA, 103 bp, Artificial Sequence
  Synthetic Polynucleotide
taatacgactcactatagggtttgctaggcaagcagtctcccggatgctcaacagaggagagagcatatgggagactgcaacctggcggcagcgcaaaagatg

SEQ ID NO: 84362 - DNA, 103 bp, Artificial Sequence
  Synthetic Polynucleotide
taatacgactcactatagggatgattttgctaggcaagcagtctcccggaaacagaggagatccgggatgctgcttgccaacctggcggcagcgcaaaagatg

SEQ ID NO: 84363 - DNA, 103 bp, Artificial Sequence
  Synthetic Polynucleotide
taatacgactcactatagggcgcatatgattttgctaggcaagcagtctcaacagaggagagagactatgtgcctagcaaacctggcggcagcgcaaaagatg

SEQ ID NO: 84364 - DNA, 103 bp, Artificial Sequence
  Synthetic Polynucleotide
taatacgactcactatagggatttgcgcatatgattttgctaggcaagcaaacagaggagatgcttgatgagcaaaatcaacctggcggcagcgcaaaagatg

SEQ ID NO: 84365 - DNA, 103 bp, Artificial Sequence
  Synthetic Polynucleotide
taatacgactcactataggggccacatttgcgcatatgattttgctaggcaacagaggagagcctagatgaatcatatgaacctggcggcagcgcaaaagatg

SEQ ID NO: 84366 - DNA, 103 bp, Artificial Sequence
  Synthetic Polynucleotide
taatacgactcactataggggagctgccacatttgcgcatatgattttgcaacagaggagagcaaaaatgtatgcgcaaaacctggcggcagcgcaaaagatg

SEQ ID NO: 84367 - DNA, 103 bp, Artificial Sequence
  Synthetic Polynucleotide
taatacgactcactatagggtaaaggagctgccacatttgcgcatatgataacagaggagaatcataatggcaaatgtgaacctggcggcagcgcaaaagatg

SEQ ID NO: 84368 - DNA, 103 bp, Artificial Sequence
  Synthetic Polynucleotide
taatacgactcactatagggtaccttccacaaagtccctattgctgactcaacagaggagagagtcaatgatagggactaacctggcggcagcgcaaaagatg

SEQ ID NO: 84369 - DNA, 103 bp, Artificial Sequence
  Synthetic Polynucleotide
taatacgactcactatagggggaaataaaggagctgccacatttgcgcataacagaggagaatgcgcatgtgtggcagcaacctggcggcagcgcaaaagatg

SEQ ID NO: 84370 - DNA, 103 bp, Artificial Sequence
  Synthetic Polynucleotide
taatacgactcactatagggtctgtggaaataaaggagctgccacatttgaacagaggagacaaatgatgcagctccttaacctggcggcagcgcaaaagatg

SEQ ID NO: 84371 - DNA, 103 bp, Artificial Sequence
  Synthetic Polynucleotide
taatacgactcactatagggtcccttctgtggaaataaaggagctgccacaacagaggagagtggcaatgcctttatttaacctggcggcagcgcaaaagatg

SEQ ID NO: 84372 - DNA, 103 bp, Artificial Sequence
  Synthetic Polynucleotide
taatacgactcactatagggggaggtcccttctgtggaaataaaggagctaacagaggagaagctccatgatttccacaaacctggcggcagcgcaaaagatg

SEQ ID NO: 84373 - DNA, 103 bp, Artificial Sequence
  Synthetic Polynucleotide
taatacgactcactatagggcagtcggaggtcccttctgtggaaataaagaacagaggagactttatatgcacagaaggaacctggcggcagcgcaaaagatg

SEQ ID NO: 84374 - DNA, 103 bp, Artificial Sequence
  Synthetic Polynucleotide
taatacgactcactataggggccatcagtcggaggtcccttctgtggaaaaacagaggagatttccaatgaagggacctaacctggcggcagcgcaaaagatg

SEQ ID NO: 84375 - DNA, 103 bp, Artificial Sequence
  Synthetic Polynucleotide
taatacgactcactatagggcattggccatcagtcggaggtcccttctgtaacagaggagaacagaaatgacctccgacaacctggcggcagcgcaaaagatg

SEQ ID NO: 84376 - DNA, 103 bp, Artificial Sequence
  Synthetic Polynucleotide
taatacgactcactatagggaatggcattggccatcagtcggaggtccctaacagaggagaagggacatgcgactgatgaacctggcggcagcgcaaaagatg

SEQ ID NO: 84377 - DNA, 103 bp, Artificial Sequence
  Synthetic Polynucleotide
taatacgactcactataggggaacaaatggcattggccatcagtcggaggaacagaggagacctccgatggatggccaaaacctggcggcagcgcaaaagatg

SEQ ID NO: 84378 - DNA, 103 bp, Artificial Sequence
  Synthetic Polynucleotide
taatacgactcactatagggcagatgaacaaatggcattggccatcagtcaacagaggagagactgaatgccaatgccaaacctggcggcagcgcaaaagatg

SEQ ID NO: 84379 - DNA, 103 bp, Artificial Sequence
  Synthetic Polynucleotide
taatacgactcactatagggaactgtcgcagtctgattcacacagatcaaaacagaggagattgatcatggtgaatcagaacctggcggcagcgcaaaagatg

SEQ ID NO: 84380 - DNA, 103 bp, Artificial Sequence
  Synthetic Polynucleotide
taatacgactcactatagggcttttttgggtttttcatgaccagaaactcaacagaggagagagtttatggtcatgaaaaacctggcggcagcgcaaaagatg

SEQ ID NO: 84381 - DNA, 103 bp, Artificial Sequence
  Synthetic Polynucleotide
taatacgactcactatagggtgacataccttccacaaagtccctattgctaacagaggagaagcaatatggactttgtgaacctggcggcagcgcaaaagatg

SEQ ID NO: 84382 - DNA, 103 bp, Artificial Sequence
  Synthetic Polynucleotide
taatacgactcactatagggtggcacagatgaacaaatggcattggccataacagaggagaatggccatggccatttgtaacctggcggcagcgcaaaagatg

SEQ ID NO: 84383 - DNA, 103 bp, Artificial Sequence
  Synthetic Polynucleotide
taatacgactcactatagggtcaactggcacagatgaacaaatggcattgaacagaggagacaatgcatgttgttcatcaacctggcggcagcgcaaaagatg

SEQ ID NO: 84384 - DNA, 103 bp, Artificial Sequence
  Synthetic Polynucleotide
taatacgactcactatagggcccagtcaactggcacagatgaacaaatggaacagaggagaccatttatgcatctgtgcaacctggcggcagcgcaaaagatg

SEQ ID NO: 84385 - DNA, 103 bp, Artificial Sequence
  Synthetic Polynucleotide
taatacgactcactatagggtggaacccagtcaactggcacagatgaacaaacagaggagatgttcaatggtgccagttaacctggcggcagcgcaaaagatg

SEQ ID NO: 84386 - DNA, 103 bp, Artificial Sequence
  Synthetic Polynucleotide
taatacgactcactatagggccagttggaacccagtcaactggcacagataacagaggagaatctgtatgagttgactgaacctggcggcagcgcaaaagatg

SEQ ID NO: 84387 - DNA, 103 bp, Artificial Sequence
  Synthetic Polynucleotide
taatacgactcactatagggttctcccagttggaacccagtcaactggcaaacagaggagatgccagatgactgggttcaacctggcggcagcgcaaaagatg

SEQ ID NO: 84388 - DNA, 103 bp, Artificial Sequence
  Synthetic Polynucleotide
taatacgactcactatagggggtagttctcccagttggaacccagtcaacaacagaggagagttgacatggttccaactaacctggcggcagcgcaaaagatg

SEQ ID NO: 84389 - DNA, 103 bp, Artificial Sequence
  Synthetic Polynucleotide
taatacgactcactataggggaccaggtagttctcccagttggaacccagaacagaggagactgggtatgaactgggagaacctggcggcagcgcaaaagatg

SEQ ID NO: 84390 - DNA, 103 bp, Artificial Sequence
  Synthetic Polynucleotide
taatacgactcactatagggggattgaccaggtagttctcccagttggaaaacagaggagattccaaatgggagaactaaacctggcggcagcgcaaaagatg

SEQ ID NO: 84391 - DNA, 103 bp, Artificial Sequence
  Synthetic Polynucleotide
taatacgactcactatagggtccatggattgaccaggtagttctcccagtaacagaggagaactgggatgactacctggaacctggcggcagcgcaaaagatg

SEQ ID NO: 84392 - DNA, 103 bp, Artificial Sequence
  Synthetic Polynucleotide
taatacgactcactatagggccacctgacataccttccacaaagtccctaaacagaggagatagggaatgtgtggaaggaacctggcggcagcgcaaaagatg

SEQ ID NO: 84393 - DNA, 103 bp, Artificial Sequence
  Synthetic Polynucleotide
taatacgactcactatagggccctttccatggattgaccaggtagttctcaacagaggagagagaacatgctggtcaataacctggcggcagcgcaaaagatg

SEQ ID NO: 84394 - DNA, 103 bp, Artificial Sequence
  Synthetic Polynucleotide
taatacgactcactatagggattctccctttccatggattgaccaggtagaacagaggagactacctatgcaatccatgaacctggcggcagcgcaaaagatg

SEQ ID NO: 84395 - DNA, 103 bp, Artificial Sequence
  Synthetic Polynucleotide
taatacgactcactatagggcatccattctccctttccatggattgaccaaacagaggagatggtcaatgcatggaaagaacctggcggcagcgcaaaagatg

SEQ ID NO: 84396 - DNA, 103 bp, Artificial Sequence
  Synthetic Polynucleotide
taatacgactcactataggggtggtcatccattctccctttccatggattaacagaggagaaatccaatgaaagggagaaacctggcggcagcgcaaaagatg

SEQ ID NO: 84397 - DNA, 103 bp, Artificial Sequence
  Synthetic Polynucleotide
taatacgactcactatagggcttcagtggtcatccattctccctttccataacagaggagaatggaaatggagaatggaaacctggcggcagcgcaaaagatg

SEQ ID NO: 84398 - DNA, 103 bp, Artificial Sequence
  Synthetic Polynucleotide
taatacgactcactatagggcatgtcttcagtggtcatccattctcccttaacagaggagaaagggaatgtggatgaccaacctggcggcagcgcaaaagatg

SEQ ID NO: 84399 - DNA, 103 bp, Artificial Sequence
  Synthetic Polynucleotide
taatacgactcactatagggacaagcatgtcttcagtggtcatccattctaacagaggagaagaatgatggaccactgaaacctggcggcagcgcaaaagatg

SEQ ID NO: 84400 - DNA, 103 bp, Artificial Sequence
  Synthetic Polynucleotide
taatacgactcactatagggacaccacaagcatgtcttcagtggtcatccaacagaggagaggatgaatgctgaagacaaacctggcggcagcgcaaaagatg

SEQ ID NO: 84401 - DNA, 103 bp, Artificial Sequence
  Synthetic Polynucleotide
taatacgactcactataggggttccacaccacaagcatgtcttcagtggtaacagaggagaaccactatggacatgcttaacctggcggcagcgcaaaagatg

SEQ ID NO: 84402 - DNA, 103 bp, Artificial Sequence
  Synthetic Polynucleotide
taatacgactcactatagggactctgttccacaccacaagcatgtcttcaaacagaggagatgaagaatggcttgtggtaacctggcggcagcgcaaaagatg

SEQ ID NO: 84403 - DNA, 103 bp, Artificial Sequence
  Synthetic Polynucleotide
taatacgactcactatagggaagtcccacctgacataccttccacaaagtaacagaggagaactttgatgaaggtatgtaacctggcggcagcgcaaaagatg

SEQ ID NO: 84404 - DNA, 103 bp, Artificial Sequence
  Synthetic Polynucleotide
taatacgactcactatagggtccacactctgttccacaccacaagcatgtaacagaggagaacatgcatgtggtgtggaaacctggcggcagcgcaaaagatg

SEQ ID NO: 84405 - DNA, 103 bp, Artificial Sequence
  Synthetic Polynucleotide
taatacgactcactatagggctcaatccacactctgttccacaccacaagaacagaggagacttgtgatgtggaacagaaacctggcggcagcgcaaaagatg

SEQ ID NO: 84406 - DNA, 103 bp, Artificial Sequence
  Synthetic Polynucleotide
taatacgactcactatagggttctcctcaatccacactctgttccacaccaacagaggagaggtgtgatgcagagtgtgaacctggcggcagcgcaaaagatg

SEQ ID NO: 84407 - DNA, 103 bp, Artificial Sequence
  Synthetic Polynucleotide
taatacgactcactatagggggtcgttctcctcaatccacactctgttccaacagaggagaggaacaatgtgtggattgaacctggcggcagcgcaaaagatg

SEQ ID NO: 84408 - DNA, 103 bp, Artificial Sequence
  Synthetic Polynucleotide
taatacgactcactatagggcatgtggtcgttctcctcaatccacactctaacagaggagaagagtgatgattgaggagaacctggcggcagcgcaaaagatg

SEQ ID NO: 84409 - DNA, 103 bp, Artificial Sequence
  Synthetic Polynucleotide
taatacgactcactatagggtcttccatgtggtcgttctcctcaatccacaacagaggagagtggatatgggagaacgaaacctggcggcagcgcaaaagatg

SEQ ID NO: 84410 - DNA, 103 bp, Artificial Sequence
  Synthetic Polynucleotide
taatacgactcactatagggtcttgtcttccatgtggtcgttctcctcaaaacagaggagattgaggatgacgaccacaaacctggcggcagcgcaaaagatg

SEQ ID NO: 84411 - DNA, 103 bp, Artificial Sequence
  Synthetic Polynucleotide
taatacgactcactatagggtggggtcttgtcttccatgtggtcgttctcaacagaggagagagaacatgcacatggaaaacctggcggcagcgcaaaagatg

SEQ ID NO: 84412 - DNA, 103 bp, Artificial Sequence
  Synthetic Polynucleotide
taatacgactcactataggggtaactggggtcttgtcttccatgtggtcgaacagaggagacgaccaatgggaagacaaaacctggcggcagcgcaaaagatg

SEQ ID NO: 84413 - DNA, 103 bp, Artificial Sequence
  Synthetic Polynucleotide
taatacgactcactatagggatttcgtaactggggtcttgtcttccatgtaacagaggagaacatggatgacaagacccaacctggcggcagcgcaaaagatg

SEQ ID NO: 84414 - DNA, 103 bp, Artificial Sequence
  Synthetic Polynucleotide
taatacgactcactatagggaacccaagtcccacctgacataccttccacaacagaggagagtggaaatgatgtcaggtaacctggcggcagcgcaaaagatg

SEQ ID NO: 84415 - DNA, 103 bp, Artificial Sequence
  Synthetic Polynucleotide
taatacgactcactatagggtgtccatttcgtaactggggtcttgtcttcaacagaggagagaagacatgaccccagttaacctggcggcagcgcaaaagatg

SEQ ID NO: 84416 - DNA, 103 bp, Artificial Sequence
  Synthetic Polynucleotide
taatacgactcactatagggatgtctgtccatttcgtaactggggtcttgaacagaggagacaagacatgagttacgaaaacctggcggcagcgcaaaagatg

SEQ ID NO: 84417 - DNA, 103 bp, Artificial Sequence
  Synthetic Polynucleotide
taatacgactcactatagggagggaatgtctgtccatttcgtaactggggaacagaggagaccccagatgcgaaatggaaacctggcggcagcgcaaaagatg

SEQ ID NO: 84418 - DNA, 103 bp, Artificial Sequence
  Synthetic Polynucleotide
taatacgactcactatagggcaaatagggaatgtctgtccatttcgtaacaacagaggagagttacgatgtggacagacaacctggcggcagcgcaaaagatg

SEQ ID NO: 84419 - DNA, 103 bp, Artificial Sequence
  Synthetic Polynucleotide
taatacgactcactatagggtttcccaaatagggaatgtctgtccatttcaacagaggagagaaatgatgagacattccaacctggcggcagcgcaaaagatg

SEQ ID NO: 84420 - DNA, 103 bp, Artificial Sequence
  Synthetic Polynucleotide
taatacgactcactatagggccctttttcccaaatagggaatgtctgtccaacagaggagaggacagatgttccctattaacctggcggcagcgcaaaagatg

SEQ ID NO: 84421 - DNA, 103 bp, Artificial Sequence
  Synthetic Polynucleotide
taatacgactcactataggggtcttccctttttcccaaatagggaatgtcaacagaggagagacattatgtatttgggaaacctggcggcagcgcaaaagatg

SEQ ID NO: 84422 - DNA, 103 bp, Artificial Sequence
  Synthetic Polynucleotide
taatacgactcactatagggcacaagtcttccctttttcccaaatagggaaacagaggagatccctaatggggaaaaagaacctggcggcagcgcaaaagatg

SEQ ID NO: 84423 - DNA, 103 bp, Artificial Sequence
  Synthetic Polynucleotide
taatacgactcactatagggcacaccacaagtcttccctttttcccaaataacagaggagaatttggatgaaagggaagaacctggcggcagcgcaaaagatg

SEQ ID NO: 84424 - DNA, 103 bp, Artificial Sequence
  Synthetic Polynucleotide
taatacgactcactatagggagatccacaccacaagtcttccctttttccaacagaggagaggaaaaatggaagacttgaacctggcggcagcgcaaaagatg

SEQ ID NO: 84425 - DNA, 103 bp, Artificial Sequence
  Synthetic Polynucleotide
taatacgactcactatagggacatcaacccaagtcccacctgacatacctaacagaggagaaggtatatgaggtgggacaacctggcggcagcgcaaaagatg

SEQ ID NO: 84426 - DNA, 103 bp, Artificial Sequence
  Synthetic Polynucleotide
taatacgactcactatagggatgagagatccacaccacaagtcttcccttaacagaggagaaagggaatgcttgtggtgaacctggcggcagcgcaaaagatg

SEQ ID NO: 84427 - DNA, 103 bp, Artificial Sequence
  Synthetic Polynucleotide
taatacgactcactataggggccctatgagagatccacaccacaagtcttaacagaggagaaagactatgggtgtggataacctggcggcagcgcaaaagatg

SEQ ID NO: 84428 - DNA, 103 bp, Artificial Sequence
  Synthetic Polynucleotide
taatacgactcactatagggtctgtgccctatgagagatccacaccacaaaacagaggagattgtggatgggatctctcaacctggcggcagcgcaaaagatg

SEQ ID NO: 84429 - DNA, 103 bp, Artificial Sequence
  Synthetic Polynucleotide
taatacgactcactatagggcgcggtctgtgccctatgagagatccacacaacagaggagagtgtggatgtctcataggaacctggcggcagcgcaaaagatg

SEQ ID NO: 84430 - DNA, 103 bp, Artificial Sequence
  Synthetic Polynucleotide
taatacgactcactatagggtggtgcgcggtctgtgccctatgagagatcaacagaggagagatctcatgtagggcacaaacctggcggcagcgcaaaagatg

SEQ ID NO: 84431 - DNA, 103 bp, Artificial Sequence
  Synthetic Polynucleotide
taatacgactcactatagggccaggtggtgcgcggtctgtgccctatgagaacagaggagactcataatgcacagaccgaacctggcggcagcgcaaaagatg

SEQ ID NO: 84432 - DNA, 103 bp, Artificial Sequence
  Synthetic Polynucleotide
taatacgactcactatagggtcagcccaggtggtgcgcggtctgtgccctaacagaggagaagggcaatgaccgcgcacaacctggcggcagcgcaaaagatg

SEQ ID NO: 84433 - DNA, 103 bp, Artificial Sequence
  Synthetic Polynucleotide
taatacgactcactatagggtgttctcagcccaggtggtgcgcggtctgtaacagaggagaacagacatggcaccacctaacctggcggcagcgcaaaagatg

SEQ ID NO: 84434 - DNA, 103 bp, Artificial Sequence
  Synthetic Polynucleotide
taatacgactcactatagggtttaatgttctcagcccaggtggtgcgcggaacagaggagaccgcgcatgacctgggctaacctggcggcagcgcaaaagatg

SEQ ID NO: 84435 - DNA, 103 bp, Artificial Sequence
  Synthetic Polynucleotide
taatacgactcactataggggtgtttttaatgttctcagcccaggtggtgaacagaggagacaccacatgggctgagaaaacctggcggcagcgcaaaagatg

SEQ ID NO: 84436 - DNA, 103 bp, Artificial Sequence
  Synthetic Polynucleotide
taatacgactcactatagggagacaacatcaacccaagtcccacctgacaaacagaggagatgtcagatgggacttgggaacctggcggcagcgcaaaagatg

SEQ ID NO: 84437 - DNA, 103 bp, Artificial Sequence
  Synthetic Polynucleotide
taatacgactcactatagggtgactgtgtttttaatgttctcagcccaggaacagaggagacctgggatgagaacattaaacctggcggcagcgcaaaagatg

SEQ ID NO: 84438 - DNA, 103 bp, Artificial Sequence
  Synthetic Polynucleotide
taatacgactcactatagggcatgttgactgtgtttttaatgttctcagcaacagaggagagctgagatgattaaaaacaacctggcggcagcgcaaaagatg

SEQ ID NO: 84439 - DNA, 103 bp, Artificial Sequence
  Synthetic Polynucleotide
taatacgactcactatagggcgcaccatgttgactgtgtttttaatgttcaacagaggagagaacatatgaaacacagtaacctggcggcagcgcaaaagatg

SEQ ID NO: 84440 - DNA, 103 bp, Artificial Sequence
  Synthetic Polynucleotide
taatacgactcactatagggtcctgcgcaccatgttgactgtgtttttaaaacagaggagattaaaaatgcagtcaacaaacctggcggcagcgcaaaagatg

SEQ ID NO: 84441 - DNA, 103 bp, Artificial Sequence
  Synthetic Polynucleotide
taatacgactcactatagggtatgatcctgcgcaccatgttgactgtgttaacagaggagaaacacaatgaacatggtgaacctggcggcagcgcaaaagatg

SEQ ID NO: 84442 - DNA, 103 bp, Artificial Sequence
  Synthetic Polynucleotide
taatacgactcactatagggtcacctatgatcctgcgcaccatgttgactaacagaggagaagtcaaatgggtgcgcagaacctggcggcagcgcaaaagatg

SEQ ID NO: 84443 - DNA, 103 bp, Artificial Sequence
  Synthetic Polynucleotide
taatacgactcactatagggcttcatcacctatgatcctgcgcaccatgtaacagaggagaacatggatggcaggatcaaacctggcggcagcgcaaaagatg

SEQ ID NO: 84444 - DNA, 103 bp, Artificial Sequence
  Synthetic Polynucleotide
taatacgactcactatagggcttttcttcatcacctatgatcctgcgcacaacagaggagagtgcgcatgatcataggtaacctggcggcagcgcaaaagatg

SEQ ID NO: 84445 - DNA, 103 bp, Artificial Sequence
  Synthetic Polynucleotide
taatacgactcactatagggatgtacttttcttcatcacctatgatcctgaacagaggagacaggatatgaggtgatgaaacctggcggcagcgcaaaagatg

SEQ ID NO: 84446 - DNA, 103 bp, Artificial Sequence
  Synthetic Polynucleotide
taatacgactcactatagggagtccatgtacttttcttcatcacctatgaaacagaggagatcatagatgatgaagaaaaacctggcggcagcgcaaaagatg

SEQ ID NO: 84447 - DNA, 103 bp, Artificial Sequence
  Synthetic Polynucleotide
taatacgactcactatagggttccaagacaacatcaacccaagtcccaccaacagaggagaggtgggatgtgggttgataacctggcggcagcgcaaaagatg

SEQ ID NO: 84448 - DNA, 103 bp, Artificial Sequence
  Synthetic Polynucleotide
taatacgactcactatagggtaggtagtccatgtacttttcttcatcaccaacagaggagaggtgatatggaaaagtacaacctggcggcagcgcaaaagatg

SEQ ID NO: 84449 - DNA, 103 bp, Artificial Sequence
  Synthetic Polynucleotide
taatacgactcactataggggtggataggtagtccatgtacttttcttcaaacagaggagatgaagaatggtacatggaaacctggcggcagcgcaaaagatg

SEQ ID NO: 84450 - DNA, 103 bp, Artificial Sequence
  Synthetic Polynucleotide
taatacgactcactatagggcttgggtggataggtagtccatgtacttttaacagaggagaaaaagtatgtggactaccaacctggcggcagcgcaaaagatg

SEQ ID NO: 84451 - DNA, 103 bp, Artificial Sequence
  Synthetic Polynucleotide
taatacgactcactataggggcgaacttgggtggataggtagtccatgtaaacagaggagatacatgatgtacctatccaacctggcggcagcgcaaaagatg

SEQ ID NO: 84452 - DNA, 103 bp, Artificial Sequence
  Synthetic Polynucleotide
taatacgactcactatagggaagtagcgaacttgggtggataggtagtccaacagaggagaggactaatgatccacccaaacctggcggcagcgcaaaagatg

SEQ ID NO: 84453 - DNA, 103 bp, Artificial Sequence
  Synthetic Polynucleotide
taatacgactcactatagggcacccaagtagcgaacttgggtggataggtaacagaggagaacctatatgcccaagttcaacctggcggcagcgcaaaagatg

SEQ ID NO: 84454 - DNA, 103 bp, Artificial Sequence
  Synthetic Polynucleotide
taatacgactcactatagggttcttcacccaagtagcgaacttgggtggaaacagaggagatccaccatggttcgctacaacctggcggcagcgcaaaagatg

SEQ ID NO: 84455 - DNA, 103 bp, Artificial Sequence
  Synthetic Polynucleotide
taatacgactcactataggggacccttcttcacccaagtagcgaacttggaacagaggagaccaagtatgctacttgggaacctggcggcagcgcaaaagatg

SEQ ID NO: 84456 - DNA, 103 bp, Artificial Sequence
  Synthetic Polynucleotide
taatacgactcactataggggtgtagacccttcttcacccaagtagcgaaaacagaggagattcgctatgtgggtgaagaacctggcggcagcgcaaaagatg

SEQ ID NO: 84457 - DNA, 103 bp, Artificial Sequence
  Synthetic Polynucleotide
taatacgactcactatagggtccaggtgtagacccttcttcacccaagtaaacagaggagatacttgatggaagaagggaacctggcggcagcgcaaaagatg

SEQ ID NO: 84458 - DNA, 103 bp, Artificial Sequence
  Synthetic Polynucleotide
taatacgactcactatagggccatgttccaagacaacatcaacccaagtcaacagaggagagacttgatgtgatgttgtaacctggcggcagcgcaaaagatg

SEQ ID NO: 84459 - DNA, 103 bp, Artificial Sequence
  Synthetic Polynucleotide
taatacgactcactatagggagcactccaggtgtagacccttcttcacccaacagaggagagggtgaatgagggtctacaacctggcggcagcgcaaaagatg

SEQ ID NO: 84460 - DNA, 103 bp, Artificial Sequence
  Synthetic Polynucleotide
taatacgactcactatagggcttacagcactccaggtgtagacccttcttaacagaggagaaagaagatgctacacctgaacctggcggcagcgcaaaagatg

SEQ ID NO: 84461 - DNA, 103 bp, Artificial Sequence
  Synthetic Polynucleotide
taatacgactcactatagggtggtgcttacagcactccaggtgtagacccaacagaggagagggtctatgcctggagtgaacctggcggcagcgcaaaagatg

SEQ ID NO: 84462 - DNA, 103 bp, Artificial Sequence
  Synthetic Polynucleotide
taatacgactcactatagggaagattggtgcttacagcactccaggtgtaaacagaggagatacaccatgagtgctgtaaacctggcggcagcgcaaaagatg

SEQ ID NO: 84463 - DNA, 103 bp, Artificial Sequence
  Synthetic Polynucleotide
taatacgactcactatagggacattaagattggtgcttacagcactccagaacagaggagactggagatgtgtaagcacaacctggcggcagcgcaaaagatg

SEQ ID NO: 84464 - DNA, 103 bp, Artificial Sequence
  Synthetic Polynucleotide
taatacgactcactatagggtgacaacattaagattggtgcttacagcacaacagaggagagtgctgatggcaccaatcaacctggcggcagcgcaaaagatg

SEQ ID NO: 84465 - DNA, 103 bp, Artificial Sequence
  Synthetic Polynucleotide
taatacgactcactatagggaggcctgacaacattaagattggtgcttacaacagaggagagtaagcatgaatcttaataacctggcggcagcgcaaaagatg

SEQ ID NO: 84466 - DNA, 103 bp, Artificial Sequence
  Synthetic Polynucleotide
taatacgactcactatagggctagcaggcctgacaacattaagattggtgaacagaggagacaccaaatgtaatgttgtaacctggcggcagcgcaaaagatg

SEQ ID NO: 84467 - DNA, 103 bp, Artificial Sequence
  Synthetic Polynucleotide
taatacgactcactataggggctgactagcaggcctgacaacattaagataacagaggagaatcttaatgttgtcaggcaacctggcggcagcgcaaaagatg

SEQ ID NO: 84468 - DNA, 103 bp, Artificial Sequence
  Synthetic Polynucleotide
taatacgactcactatagggctgtggctgactagcaggcctgacaacattaacagaggagaaatgttatgaggcctgctaacctggcggcagcgcaaaagatg

SEQ ID NO: 84469 - DNA, 103 bp, Artificial Sequence
  Synthetic Polynucleotide
taatacgactcactatagggaacctccatgttccaagacaacatcaacccaacagaggagagggttgatgttgtcttggaacctggcggcagcgcaaaagatg

SEQ ID NO: 84470 - DNA, 103 bp, Artificial Sequence
  Synthetic Polynucleotide
taatacgactcactatagggccaagctgtggctgactagcaggcctgacaaacagaggagatgtcagatgtgctagtcaaacctggcggcagcgcaaaagatg

SEQ ID NO: 84471 - DNA, 103 bp, Artificial Sequence
  Synthetic Polynucleotide
taatacgactcactatagggtttccccaagctgtggctgactagcaggccaacagaggagaggcctgatggtcagccacaacctggcggcagcgcaaaagatg

SEQ ID NO: 84472 - DNA, 103 bp, Artificial Sequence
  Synthetic Polynucleotide
taatacgactcactatagggacagctttccccaagctgtggctgactagcaacagaggagagctagtatgccacagcttaacctggcggcagcgcaaaagatg

SEQ ID NO: 84473 - DNA, 103 bp, Artificial Sequence
  Synthetic Polynucleotide
taatacgactcactataggggctgcacagctttccccaagctgtggctgaaacagaggagatcagccatggcttggggaaacctggcggcagcgcaaaagatg

SEQ ID NO: 84474 - DNA, 103 bp, Artificial Sequence
  Synthetic Polynucleotide
taatacgactcactatagggcacaggctgcacagctttccccaagctgtgaacagaggagacacagcatggggaaagctaacctggcggcagcgcaaaagatg

SEQ ID NO: 84475 - DNA, 103 bp, Artificial Sequence
  Synthetic Polynucleotide
taatacgactcactatagggggggtcacaggctgcacagctttccccaagaacagaggagacttgggatgagctgtgcaaacctggcggcagcgcaaaagatg

SEQ ID NO: 84476 - DNA, 103 bp, Artificial Sequence
  Synthetic Polynucleotide
taatacgactcactatagggctgggggggtcacaggctgcacagctttccaacagaggagaggaaagatgtgcagcctgaacctggcggcagcgcaaaagatg

SEQ ID NO: 84477 - DNA, 103 bp, Artificial Sequence
  Synthetic Polynucleotide
taatacgactcactatagggttctcctgggggggtcacaggctgcacagcaacagaggagagctgtgatgcctgtgaccaacctggcggcagcgcaaaagatg

SEQ ID NO: 84478 - DNA, 103 bp, Artificial Sequence
  Synthetic Polynucleotide
taatacgactcactatagggccagcttctcctgggggggtcacaggctgcaacagaggagagcagccatggacccccccaacctggcggcagcgcaaaagatg

SEQ ID NO: 84479 - DNA, 103 bp, Artificial Sequence
  Synthetic Polynucleotide
taatacgactcactataggggtttcccagcttctcctgggggggtcacagaacagaggagactgtgaatgccccaggagaacctggcggcagcgcaaaagatg

SEQ ID NO: 84480 - DNA, 103 bp, Artificial Sequence
  Synthetic Polynucleotide
taatacgactcactataggggacacaacctccatgttccaagacaacatcaacagaggagagatgttatgttggaacataacctggcggcagcgcaaaagatg

SEQ ID NO: 84481 - DNA, 103 bp, Artificial Sequence
  Synthetic Polynucleotide
taatacgactcactataggggcttggtttcccagcttctcctgggggggtaacagaggagaacccccatgggagaagctaacctggcggcagcgcaaaagatg

SEQ ID NO: 84482 - DNA, 103 bp, Artificial Sequence
  Synthetic Polynucleotide
taatacgactcactatagggtataggcttggtttcccagcttctcctgggaacagaggagacccaggatgagctgggaaaacctggcggcagcgcaaaagatg

SEQ ID NO: 84483 - DNA, 103 bp, Artificial Sequence
  Synthetic Polynucleotide
taatacgactcactatagggctgactataggcttggtttcccagcttctcaacagaggagagagaagatgggaaaccaaaacctggcggcagcgcaaaagatg

SEQ ID NO: 84484 - DNA, 103 bp, Artificial Sequence
  Synthetic Polynucleotide
taatacgactcactatagggtcggcctgactataggcttggtttcccagcaacagaggagagctgggatgccaagcctaaacctggcggcagcgcaaaagatg

SEQ ID NO: 84485 - DNA, 103 bp, Artificial Sequence
  Synthetic Polynucleotide
taatacgactcactatagggcgttctcggcctgactataggcttggtttcaacagaggagagaaaccatgcctatagtcaacctggcggcagcgcaaaagatg

SEQ ID NO: 84486 - DNA, 103 bp, Artificial Sequence
  Synthetic Polynucleotide
taatacgactcactatagggcatggcgttctcggcctgactataggcttgaacagaggagacaagccatgagtcaggccaacctggcggcagcgcaaaagatg

SEQ ID NO: 84487 - DNA, 103 bp, Artificial Sequence
  Synthetic Polynucleotide
taatacgactcactatagggcgtgccatggcgttctcggcctgactatagaacagaggagactatagatgggccgagaaaacctggcggcagcgcaaaagatg

SEQ ID NO: 84488 - DNA, 103 bp, Artificial Sequence
  Synthetic Polynucleotide
taatacgactcactatagggtcttccgtgccatggcgttctcggcctgacaacagaggagagtcaggatgagaacgccaaacctggcggcagcgcaaaagatg

SEQ ID NO: 84489 - DNA, 103 bp, Artificial Sequence
  Synthetic Polynucleotide
taatacgactcactatagggtggcttcttccgtgccatggcgttctcggcaacagaggagagccgagatggccatggcaaacctggcggcagcgcaaaagatg

SEQ ID NO: 84490 - DNA, 103 bp, Artificial Sequence
  Synthetic Polynucleotide
taatacgactcactatagggcagcatggcttcttccgtgccatggcgttcaacagaggagagaacgcatgggcacggaaaacctggcggcagcgcaaaagatg

SEQ ID NO: 84491 - DNA, 103 bp, Artificial Sequence
  Synthetic Polynucleotide
taatacgactcactataggggatttcttttttgggtttttcatgaccagaaacagaggagatctggtatggaaaaacccaacctggcggcagcgcaaaagatg

SEQ ID NO: 84492 - DNA, 103 bp, Artificial Sequence
  Synthetic Polynucleotide
taatacgactcactatagggacggtgacacaacctccatgttccaagacaaacagaggagatgtcttatgacatggaggaacctggcggcagcgcaaaagatg

SEQ ID NO: 84493 - DNA, 103 bp, Artificial Sequence
  Synthetic Polynucleotide
taatacgactcactatagggacaggcagcatggcttcttccgtgccatggaacagaggagaccatggatgggaagaagcaacctggcggcagcgcaaaagatg

SEQ ID NO: 84494 - DNA, 103 bp, Artificial Sequence
  Synthetic Polynucleotide
taatacgactcactatagggggctcacaggcagcatggcttcttccgtgcaacagaggagagcacggatgaagccatgcaacctggcggcagcgcaaaagatg

SEQ ID NO: 84495 - DNA, 103 bp, Artificial Sequence
  Synthetic Polynucleotide
taatacgactcactatagggtgaggggctcacaggcagcatggcttcttcaacagaggagagaagaaatgatgctgcctaacctggcggcagcgcaaaagatg

SEQ ID NO: 84496 - DNA, 103 bp, Artificial Sequence
  Synthetic Polynucleotide
taatacgactcactatagggtcctctgaggggctcacaggcagcatggctaacagaggagaagccatatggcctgtgagaacctggcggcagcgcaaaagatg

SEQ ID NO: 84497 - DNA, 103 bp, Artificial Sequence
  Synthetic Polynucleotide
taatacgactcactatagggcagtgtcctctgaggggctcacaggcagcaaacagaggagatgctgcatgtgagcccctaacctggcggcagcgcaaaagatg

SEQ ID NO: 84498 - DNA, 103 bp, Artificial Sequence
  Synthetic Polynucleotide
taatacgactcactatagggtgactcagtgtcctctgaggggctcacaggaacagaggagacctgtgatgccctcagagaacctggcggcagcgcaaaagatg

SEQ ID NO: 84499 - DNA, 103 bp, Artificial Sequence
  Synthetic Polynucleotide
taatacgactcactatagggttttttgactcagtgtcctctgaggggctcaacagaggagagagcccatgagaggacacaacctggcggcagcgcaaaagatg

SEQ ID NO: 84500 - DNA, 103 bp, Artificial Sequence
  Synthetic Polynucleotide
taatacgactcactatagggtggggttttttgactcagtgtcctctgaggaacagaggagacctcagatgacactgagtaacctggcggcagcgcaaaagatg

SEQ ID NO: 84501 - DNA, 103 bp, Artificial Sequence
  Synthetic Polynucleotide
taatacgactcactataggggcgcatggggttttttgactcagtgtcctcaacagaggagagaggacatggagtcaaaaaacctggcggcagcgcaaaagatg

SEQ ID NO: 84502 - DNA, 103 bp, Artificial Sequence
  Synthetic Polynucleotide
taatacgactcactatagggtccaagcgcatggggttttttgactcagtgaacagaggagacactgaatgaaaaaacccaacctggcggcagcgcaaaagatg

SEQ ID NO: 84503 - DNA, 103 bp, Artificial Sequence
  Synthetic Polynucleotide
taatacgactcactatagggccattacggtgacacaacctccatgttccaaacagaggagatggaacatggaggttgtgaacctggcggcagcgcaaaagatg

SEQ ID NO: 84504 - DNA, 103 bp, Artificial Sequence
  Synthetic Polynucleotide
taatacgactcactataggggcgcctccaagcgcatggggttttttgactaacagaggagaagtcaaatgaccccatgcaacctggcggcagcgcaaaagatg

SEQ ID NO: 84505 - DNA, 103 bp, Artificial Sequence
  Synthetic Polynucleotide
taatacgactcactatagggatcctgcgcctccaagcgcatggggtttttaacagaggagaaaaaacatgatgcgcttgaacctggcggcagcgcaaaagatg

SEQ ID NO: 84506 - DNA, 103 bp, Artificial Sequence
  Synthetic Polynucleotide
taatacgactcactatagggttcccatcctgcgcctccaagcgcatggggaacagaggagaccccatatgcttggaggcaacctggcggcagcgcaaaagatg

SEQ ID NO: 84507 - DNA, 103 bp, Artificial Sequence
  Synthetic Polynucleotide
taatacgactcactatagggttcttttcccatcctgcgcctccaagcgcaaacagaggagatgcgctatgaggcgcaggaacctggcggcagcgcaaaagatg

SEQ ID NO: 84508 - DNA, 103 bp, Artificial Sequence
  Synthetic Polynucleotide
taatacgactcactatagggccaccttcttttcccatcctgcgcctccaaaacagaggagattggagatgcaggatgggaacctggcggcagcgcaaaagatg

SEQ ID NO: 84509 - DNA, 103 bp, Artificial Sequence
  Synthetic Polynucleotide
taatacgactcactatagggggtcgccaccttcttttcccatcctgcgccaacagaggagaggcgcaatgtgggaaaagaacctggcggcagcgcaaaagatg

SEQ ID NO: 84510 - DNA, 103 bp, Artificial Sequence
  Synthetic Polynucleotide
taatacgactcactataggggggaaggtcgccaccttcttttcccatcctaacagaggagaaggatgatgaaagaaggtaacctggcggcagcgcaaaagatg

SEQ ID NO: 84511 - DNA, 103 bp, Artificial Sequence
  Synthetic Polynucleotide
taatacgactcactataggggggtggggaaggtcgccaccttcttttcccaacagaggagagggaaaatgaggtggcgaaacctggcggcagcgcaaaagatg

SEQ ID NO: 84512 - DNA, 103 bp, Artificial Sequence
  Synthetic Polynucleotide
taatacgactcactatagggttgaagggtggggaaggtcgccaccttcttaacagaggagaaagaagatggcgaccttcaacctggcggcagcgcaaaagatg

SEQ ID NO: 84513 - DNA, 103 bp, Artificial Sequence
  Synthetic Polynucleotide
taatacgactcactatagggccagattgaagggtggggaaggtcgccaccaacagaggagaggtggcatgcttccccacaacctggcggcagcgcaaaagatg

SEQ ID NO: 84514 - DNA, 103 bp, Artificial Sequence
  Synthetic Polynucleotide
taatacgactcactatagggctgtgccattacggtgacacaacctccatgaacagaggagacatggaatgtgtgtcaccaacctggcggcagcgcaaaagatg

SEQ ID NO: 84515 - DNA, 103 bp, Artificial Sequence
  Synthetic Polynucleotide
taatacgactcactatagggaggccccagattgaagggtggggaaggtcgaacagaggagacgacctatgccacccttcaacctggcggcagcgcaaaagatg

SEQ ID NO: 84516 - DNA, 103 bp, Artificial Sequence
  Synthetic Polynucleotide
taatacgactcactatagggagttcaggccccagattgaagggtggggaaaacagaggagattccccatgcttcaatctaacctggcggcagcgcaaaagatg

SEQ ID NO: 84517 - DNA, 103 bp, Artificial Sequence
  Synthetic Polynucleotide
taatacgactcactatagggtctccagttcaggccccagattgaagggtgaacagaggagacaccctatgatctggggcaacctggcggcagcgcaaaagatg

SEQ ID NO: 84518 - DNA, 103 bp, Artificial Sequence
  Synthetic Polynucleotide
taatacgactcactataggggctgatctccagttcaggccccagattgaaaacagaggagattcaatatggggcctgaaaacctggcggcagcgcaaaagatg

SEQ ID NO: 84519 - DNA, 103 bp, Artificial Sequence
  Synthetic Polynucleotide
taatacgactcactatagggccacagctgatctccagttcaggccccagaaacagaggagatctgggatgtgaactggaaacctggcggcagcgcaaaagatg

SEQ ID NO: 84520 - DNA, 103 bp, Artificial Sequence
  Synthetic Polynucleotide
taatacgactcactataggggagatccacagctgatctccagttcaggccaacagaggagaggcctgatgtggagatcaaacctggcggcagcgcaaaagatg

SEQ ID NO: 84521 - DNA, 103 bp, Artificial Sequence
  Synthetic Polynucleotide
taatacgactcactatagggttctggagatccacagctgatctccagttcaacagaggagagaactgatgatcagctgtaacctggcggcagcgcaaaagatg

SEQ ID NO: 84522 - DNA, 103 bp, Artificial Sequence
  Synthetic Polynucleotide
taatacgactcactatagggccctcttctggagatccacagctgatctccaacagaggagaggagatatgctgtggatcaacctggcggcagcgcaaaagatg

SEQ ID NO: 84523 - DNA, 103 bp, Artificial Sequence
  Synthetic Polynucleotide
taatacgactcactatagggctagtccctcttctggagatccacagctgaaacagaggagatcagctatggatctccagaacctggcggcagcgcaaaagatg

SEQ ID NO: 84524 - DNA, 103 bp, Artificial Sequence
  Synthetic Polynucleotide
taatacgactcactatagggaaccactagtccctcttctggagatccacaaacagaggagatgtggaatgccagaagagaacctggcggcagcgcaaaagatg

SEQ ID NO: 84525 - DNA, 103 bp, Artificial Sequence
  Synthetic Polynucleotide
taatacgactcactatagggttgtcctgtgccattacggtgacacaacctaacagaggagaaggttgatgcaccgtaataacctggcggcagcgcaaaagatg

SEQ ID NO: 84526 - DNA, 103 bp, Artificial Sequence
  Synthetic Polynucleotide
taatacgactcactatagggcctctaaccactagtccctcttctggagataacagaggagaatctccatgagagggactaacctggcggcagcgcaaaagatg

SEQ ID NO: 84527 - DNA, 103 bp, Artificial Sequence
  Synthetic Polynucleotide
taatacgactcactatagggggtctcctctaaccactagtccctcttctgaacagaggagacagaagatggactagtggaacctggcggcagcgcaaaagatg

SEQ ID NO: 84528 - DNA, 103 bp, Artificial Sequence
  Synthetic Polynucleotide
taatacgactcactatagggcggggggtctcctctaaccactagtccctcaacagaggagagagggaatggtggttagaaacctggcggcagcgcaaaagatg

SEQ ID NO: 84529 - DNA, 103 bp, Artificial Sequence
  Synthetic Polynucleotide
taatacgactcactatagggttttccggggggtctcctctaaccactagtaacagaggagaactagtatgtagaggagaaacctggcggcagcgcaaaagatg

SEQ ID NO: 84530 - DNA, 103 bp, Artificial Sequence
  Synthetic Polynucleotide
taatacgactcactatagggttgcgttttccggggggtctcctctaaccaaacagaggagatggttaatggagacccccaacctggcggcagcgcaaaagatg

SEQ ID NO: 84531 - DNA, 103 bp, Artificial Sequence
  Synthetic Polynucleotide
taatacgactcactatagggctgttttgcgttttccggggggtctcctctaacagaggagaagaggaatgcccccggaaaacctggcggcagcgcaaaagatg

SEQ ID NO: 84532 - DNA, 103 bp, Artificial Sequence
  Synthetic Polynucleotide
taatacgactcactatagggatatgctgttttgcgttttccggggggtctaacagaggagaagacccatgggaaaacgcaacctggcggcagcgcaaaagatg

SEQ ID NO: 84533 - DNA, 103 bp, Artificial Sequence
  Synthetic Polynucleotide
taatacgactcactatagggcgtcaatatgctgttttgcgttttccggggaacagaggagaccccggatgacgcaaaacaacctggcggcagcgcaaaagatg

SEQ ID NO: 84534 - DNA, 103 bp, Artificial Sequence
  Synthetic Polynucleotide
taatacgactcactatagggcccagcgtcaatatgctgttttgcgttttcaacagaggagagaaaacatgaaacagcataacctggcggcagcgcaaaagatg

SEQ ID NO: 84535 - DNA, 103 bp, Artificial Sequence
  Synthetic Polynucleotide
taatacgactcactatagggtctttcccagcgtcaatatgctgttttgcgaacagaggagacgcaaaatggcatattgaaacctggcggcagcgcaaaagatg

SEQ ID NO: 84536 - DNA, 103 bp, Artificial Sequence
  Synthetic Polynucleotide
taatacgactcactatagggtcggtttgtcctgtgccattacggtgacacaacagaggagagtgtcaatgtaatggcacaacctggcggcagcgcaaaagatg

SEQ ID NO: 84537 - DNA, 103 bp, Artificial Sequence
  Synthetic Polynucleotide
taatacgactcactatagggtctggtctttcccagcgtcaatatgctgttaacagaggagaaacagcatgttgacgctgaacctggcggcagcgcaaaagatg

SEQ ID NO: 84538 - DNA, 103 bp, Artificial Sequence
  Synthetic Polynucleotide
taatacgactcactataggggagtctctggtctttcccagcgtcaatatgaacagaggagacatattatggctgggaaaaacctggcggcagcgcaaaagatg

SEQ ID NO: 84539 - DNA, 103 bp, Artificial Sequence
  Synthetic Polynucleotide
taatacgactcactatagggtcatggagtctctggtctttcccagcgtcaaacagaggagatgacgcatggaaagaccaaacctggcggcagcgcaaaagatg

SEQ ID NO: 84540 - DNA, 103 bp, Artificial Sequence
  Synthetic Polynucleotide
taatacgactcactataggggaaactcatggagtctctggtctttcccagaacagaggagactgggaatgaccagagacaacctggcggcagcgcaaaagatg

SEQ ID NO: 84541 - DNA, 103 bp, Artificial Sequence
  Synthetic Polynucleotide
taatacgactcactatagggtggtggaaactcatggagtctctggtctttaacagaggagaaaagacatgagactccataacctggcggcagcgcaaaagatg

SEQ ID NO: 84542 - DNA, 103 bp, Artificial Sequence
  Synthetic Polynucleotide
taatacgactcactatagggcagcgtggtggaaactcatggagtctctggaacagaggagaccagagatgccatgagttaacctggcggcagcgcaaaagatg

SEQ ID NO: 84543 - DNA, 103 bp, Artificial Sequence
  Synthetic Polynucleotide
taatacgactcactataggggcggccagcgtggtggaaactcatggagtcaacagaggagagactccatgagtttccacaacctggcggcagcgcaaaagatg

SEQ ID NO: 84544 - DNA, 103 bp, Artificial Sequence
  Synthetic Polynucleotide
taatacgactcactataggggcctggcggccagcgtggtggaaactcatgaacagaggagacatgagatgccaccacgcaacctggcggcagcgcaaaagatg

SEQ ID NO: 84545 - DNA, 103 bp, Artificial Sequence
  Synthetic Polynucleotide
taatacgactcactatagggtctgtgcctggcggccagcgtggtggaaacaacagaggagagtttccatgacgctggccaacctggcggcagcgcaaaagatg

SEQ ID NO: 84546 - DNA, 103 bp, Artificial Sequence
  Synthetic Polynucleotide
taatacgactcactatagggggcgatctgtgcctggcggccagcgtggtgaacagaggagacaccacatgggccgccagaacctggcggcagcgcaaaagatg

SEQ ID NO: 84547 - DNA, 103 bp, Artificial Sequence
  Synthetic Polynucleotide
taatacgactcactataggggacagtcggtttgtcctgtgccattacggtaacagaggagaaccgtaatggcacaggacaacctggcggcagcgcaaaagatg

SEQ ID NO: 84548 - DNA, 103 bp, Artificial Sequence
  Synthetic Polynucleotide
taatacgactcactatagggtattcggcgatctgtgcctggcggccagcgaacagaggagacgctggatgccaggcacaaacctggcggcagcgcaaaagatg

SEQ ID NO: 84549 - DNA, 103 bp, Artificial Sequence
  Synthetic Polynucleotide
taatacgactcactataggggccgctattcggcgatctgtgcctggcggcaacagaggagagccgccatgcacagatcgaacctggcggcagcgcaaaagatg

SEQ ID NO: 84550 - DNA, 103 bp, Artificial Sequence
  Synthetic Polynucleotide
taatacgactcactatagggcggccgccgctattcggcgatctgtgcctgaacagaggagacaggcaatgatcgccgaaaacctggcggcagcgcaaaagatg

SEQ ID NO: 84551 - DNA, 103 bp, Artificial Sequence
  Synthetic Polynucleotide
taatacgactcactatagggcacaccggccgccgctattcggcgatctgtaacagaggagaacagatatgcgaatagcgaacctggcggcagcgcaaaagatg

SEQ ID NO: 84552 - DNA, 103 bp, Artificial Sequence
  Synthetic Polynucleotide
taatacgactcactatagggttccccacaccggccgccgctattcggcgaaacagaggagatcgccgatgagcggcggcaacctggcggcagcgcaaaagatg

SEQ ID NO: 84553 - DNA, 103 bp, Artificial Sequence
  Synthetic Polynucleotide
taatacgactcactatagggtggatttccccacaccggccgccgctattcaacagaggagagaatagatgcggccggtgaacctggcggcagcgcaaaagatg

SEQ ID NO: 84554 - DNA, 103 bp, Artificial Sequence
  Synthetic Polynucleotide
taatacgactcactatagggacccatggatttccccacaccggccgccgcaacagaggagagcggcgatgggtgtggggaacctggcggcagcgcaaaagatg

SEQ ID NO: 84555 - DNA, 103 bp, Artificial Sequence
  Synthetic Polynucleotide
taatacgactcactatagggatgtcgacagtcggtttgtcctgtgccattaacagaggagaaatggcatgggacaaaccaacctggcggcagcgcaaaagatg

SEQ ID NO: 84556 - DNA, 103 bp, Artificial Sequence
  Synthetic Polynucleotide
taatacgactcactataggggctctatgtcgacagtcggtttgtcctgtgaacagaggagacacaggatgaaccgactgaacctggcggcagcgcaaaagatg

SEQ ID NO: 84557 - DNA, 103 bp, Artificial Sequence
  Synthetic Polynucleotide
taatacgactcactatagggaaccagctctatgtcgacagtcggtttgtcaacagaggagagacaaaatgactgtcgacaacctggcggcagcgcaaaagatg

SEQ ID NO: 84558 - DNA, 103 bp, Artificial Sequence
  Synthetic Polynucleotide
taatacgactcactataggggttgtaaccagctctatgtcgacagtcggtaacagaggagaaccgacatgcgacatagaaacctggcggcagcgcaaaagatg

SEQ ID NO: 84559 - DNA, 103 bp, Artificial Sequence
  Synthetic Polynucleotide
taatacgactcactatagggctccggatttcttttttgggtttttcatgaaacagaggagatcatgaatgacccaaaaaaacctggcggcagcgcaaaagatg

SEQ ID NO: 84560 - DNA, 103 bp, Artificial Sequence
  Synthetic Polynucleotide
taatacgactcactatagggctgttgttgtaaccagctctatgtcgacagaacagaggagactgtcgatgtagagctggaacctggcggcagcgcaaaagatg

SEQ ID NO: 84561 - DNA, 103 bp, Artificial Sequence
  Synthetic Polynucleotide
taatacgactcactataggggctgactgttgttgtaaccagctctatgtcaacagaggagagacataatgctggttacaaacctggcggcagcgcaaaagatg

SEQ ID NO: 84562 - DNA, 103 bp, Artificial Sequence
  Synthetic Polynucleotide
taatacgactcactatagggatgttgctgactgttgttgtaaccagctctaacagaggagaagagctatgtacaacaacaacctggcggcagcgcaaaagatg

SEQ ID NO: 84563 - DNA, 103 bp, Artificial Sequence
  Synthetic Polynucleotide
taatacgactcactatagggccgccatgttgctgactgttgttgtaaccaaacagaggagatggttaatgcaacagtcaaacctggcggcagcgcaaaagatg

SEQ ID NO: 84564 - DNA, 103 bp, Artificial Sequence
  Synthetic Polynucleotide
taatacgactcactatagggtacctccgccatgttgctgactgttgttgtaacagaggagaacaacaatggtcagcaacaacctggcggcagcgcaaaagatg

SEQ ID NO: 84565 - DNA, 103 bp, Artificial Sequence
  Synthetic Polynucleotide
taatacgactcactataggggatcttacctccgccatgttgctgactgttaacagaggagaaacagtatgcaacatggcaacctggcggcagcgcaaaagatg

SEQ ID NO: 84566 - DNA, 103 bp, Artificial Sequence
  Synthetic Polynucleotide
taatacgactcactatagggagtaggatcttacctccgccatgttgctgaaacagaggagatcagcaatgtggcggaggaacctggcggcagcgcaaaagatg

SEQ ID NO: 84567 - DNA, 103 bp, Artificial Sequence
  Synthetic Polynucleotide
taatacgactcactatagggatagcagtaggatcttacctccgccatgttaacagaggagaaacatgatggaggtaagaaacctggcggcagcgcaaaagatg

SEQ ID NO: 84568 - DNA, 103 bp, Artificial Sequence
  Synthetic Polynucleotide
taatacgactcactataggggcctcatagcagtaggatcttacctccgccaacagaggagaggcggaatgaagatcctaaacctggcggcagcgcaaaagatg

SEQ ID NO: 84569 - DNA, 103 bp, Artificial Sequence
  Synthetic Polynucleotide
taatacgactcactatagggttgatgcctcatagcagtaggatcttacctaacagaggagaaggtaaatgcctactgctaacctggcggcagcgcaaaagatg

SEQ ID NO: 84570 - DNA, 103 bp, Artificial Sequence
  Synthetic Polynucleotide
taatacgactcactataggggaatcctccggatttcttttttgggtttttaacagaggagaaaaaacatgaaaaagaaaaacctggcggcagcgcaaaagatg

SEQ ID NO: 84571 - DNA, 103 bp, Artificial Sequence
  Synthetic Polynucleotide
taatacgactcactatagggtgatattgatgcctcatagcagtaggatctaacagaggagaagatccatgtgctatgagaacctggcggcagcgcaaaagatg

SEQ ID NO: 84572 - DNA, 103 bp, Artificial Sequence
  Synthetic Polynucleotide
taatacgactcactatagggatgtctgatattgatgcctcatagcagtagaacagaggagactactgatgtgaggcatcaacctggcggcagcgcaaaagatg

SEQ ID NO: 84573 - DNA, 103 bp, Artificial Sequence
  Synthetic Polynucleotide
taatacgactcactatagggaagccatgtctgatattgatgcctcatagcaacagaggagagctatgatgcatcaatataacctggcggcagcgcaaaagatg

SEQ ID NO: 84574 - DNA, 103 bp, Artificial Sequence
  Synthetic Polynucleotide
taatacgactcactataggggtccgaagccatgtctgatattgatgcctcaacagaggagagaggcaatgatatcagacaacctggcggcagcgcaaaagatg

SEQ ID NO: 84575 - DNA, 103 bp, Artificial Sequence
  Synthetic Polynucleotide
taatacgactcactatagggcggctgtccgaagccatgtctgatattgataacagaggagaatcaatatgagacatggcaacctggcggcagcgcaaaagatg

SEQ ID NO: 84576 - DNA, 103 bp, Artificial Sequence
  Synthetic Polynucleotide
taatacgactcactatagggggcagcggctgtccgaagccatgtctgataaacagaggagatatcagatgtggcttcggaacctggcggcagcgcaaaagatg

SEQ ID NO: 84577 - DNA, 103 bp, Artificial Sequence
  Synthetic Polynucleotide
taatacgactcactatagggtgttgggcagcggctgtccgaagccatgtcaacagaggagagacatgatgtcggacagcaacctggcggcagcgcaaaagatg

SEQ ID NO: 84578 - DNA, 103 bp, Artificial Sequence
  Synthetic Polynucleotide
taatacgactcactatagggccttgtgttgggcagcggctgtccgaagccaacagaggagaggcttcatgcagccgctgaacctggcggcagcgcaaaagatg

SEQ ID NO: 84579 - DNA, 103 bp, Artificial Sequence
  Synthetic Polynucleotide
taatacgactcactatagggcttcaccttgtgttgggcagcggctgtccgaacagaggagacggacaatggctgcccaaaacctggcggcagcgcaaaagatg

SEQ ID NO: 84580 - DNA, 103 bp, Artificial Sequence
  Synthetic Polynucleotide
taatacgactcactataggggtaggcttcaccttgtgttgggcagcggctaacagaggagaagccgcatgccaacacaaaacctggcggcagcgcaaaagatg

SEQ ID NO: 84581 - DNA, 103 bp, Artificial Sequence
  Synthetic Polynucleotide
taatacgactcactatagggatccggaatcctccggatttcttttttgggaacagaggagacccaaaatggaaatccggaacctggcggcagcgcaaaagatg

SEQ ID NO: 84582 - DNA, 103 bp, Artificial Sequence
  Synthetic Polynucleotide
taatacgactcactatagggtcaaggtaggcttcaccttgtgttgggcagaacagaggagactgcccatgacaaggtgaaacctggcggcagcgcaaaagatg

SEQ ID NO: 84583 - DNA, 103 bp, Artificial Sequence
  Synthetic Polynucleotide
taatacgactcactataggggcttgtcaaggtaggcttcaccttgtgttgaacagaggagacaacacatggtgaagcctaacctggcggcagcgcaaaagatg

SEQ ID NO: 84584 - DNA, 103 bp, Artificial Sequence
  Synthetic Polynucleotide
taatacgactcactatagggtgattgcttgtcaaggtaggcttcaccttgaacagaggagacaaggtatggcctaccttaacctggcggcagcgcaaaagatg

SEQ ID NO: 84585 - DNA, 103 bp, Artificial Sequence
  Synthetic Polynucleotide
taatacgactcactataggggtgtctgattgcttgtcaaggtaggcttcaaacagaggagatgaagcatgccttgacaaaacctggcggcagcgcaaaagatg

SEQ ID NO: 84586 - DNA, 103 bp, Artificial Sequence
  Synthetic Polynucleotide
taatacgactcactatagggattgagtgtctgattgcttgtcaaggtaggaacagaggagacctaccatgacaagcaataacctggcggcagcgcaaaagatg

SEQ ID NO: 84587 - DNA, 103 bp, Artificial Sequence
  Synthetic Polynucleotide
taatacgactcactataggggacatattgagtgtctgattgcttgtcaagaacagaggagacttgacatgcaatcagacaacctggcggcagcgcaaaagatg

SEQ ID NO: 84588 - DNA, 103 bp, Artificial Sequence
  Synthetic Polynucleotide
taatacgactcactatagggttgcagacatattgagtgtctgattgcttgaacagaggagacaagcaatgagacactcaaacctggcggcagcgcaaaagatg

SEQ ID NO: 84589 - DNA, 103 bp, Artificial Sequence
  Synthetic Polynucleotide
taatacgactcactatagggttcttttgcagacatattgagtgtctgattaacagaggagaaatcagatgctcaatatgaacctggcggcagcgcaaaagatg

SEQ ID NO: 84590 - DNA, 103 bp, Artificial Sequence
  Synthetic Polynucleotide
taatacgactcactatagggtaacgttcttttgcagacatattgagtgtcaacagaggagagacactatgtatgtctgcaacctggcggcagcgcaaaagatg

SEQ ID NO: 84591 - DNA, 103 bp, Artificial Sequence
  Synthetic Polynucleotide
taatacgactcactatagggtccactaacgttcttttgcagacatattgaaacagaggagatcaataatgctgcaaaagaacctggcggcagcgcaaaagatg

SEQ ID NO: 84592 - DNA, 103 bp, Artificial Sequence
  Synthetic Polynucleotide
taatacgactcactatagggtgacaatccggaatcctccggatttcttttaacagaggagaaaaagaatgccggaggataacctggcggcagcgcaaaagatg

SEQ ID NO: 84593 - DNA, 103 bp, Artificial Sequence
  Synthetic Polynucleotide
taatacgactcactatagggctctgtccactaacgttcttttgcagacataacagaggagaatgtctatgaaagaacgtaacctggcggcagcgcaaaagatg

SEQ ID NO: 84594 - DNA, 103 bp, Artificial Sequence
  Synthetic Polynucleotide
taatacgactcactatagggccagcctctgtccactaacgttcttttgcaaacagaggagatgcaaaatgacgttagtgaacctggcggcagcgcaaaagatg

SEQ ID NO: 84595 - DNA, 103 bp, Artificial Sequence
  Synthetic Polynucleotide
taatacgactcactatagggtttccccagcctctgtccactaacgttcttaacagaggagaaagaacatgagtggacagaacctggcggcagcgcaaaagatg

SEQ ID NO: 84596 - DNA, 103 bp, Artificial Sequence
  Synthetic Polynucleotide
taatacgactcactatagggatccatttccccagcctctgtccactaacgaacagaggagacgttagatgacagaggctaacctggcggcagcgcaaaagatg

SEQ ID NO: 84597 - DNA, 103 bp, Artificial Sequence
  Synthetic Polynucleotide
taatacgactcactatagggtccacatccatttccccagcctctgtccacaacagaggagagtggacatgggctggggaaacctggcggcagcgcaaaagatg

SEQ ID NO: 84598 - DNA, 103 bp, Artificial Sequence
  Synthetic Polynucleotide
taatacgactcactatagggaaaagtccacatccatttccccagcctctgaacagaggagacagaggatggggaaatggaacctggcggcagcgcaaaagatg

SEQ ID NO: 84599 - DNA, 103 bp, Artificial Sequence
  Synthetic Polynucleotide
taatacgactcactatagggtgccaaaaagtccacatccatttccccagcaacagaggagagctgggatgatggatgtgaacctggcggcagcgcaaaagatg

SEQ ID NO: 84600 - DNA, 103 bp, Artificial Sequence
  Synthetic Polynucleotide
taatacgactcactatagggccctttgccaaaaagtccacatccatttccaacagaggagaggaaatatgtgtggacttaacctggcggcagcgcaaaagatg

SEQ ID NO: 84601 - DNA, 103 bp, Artificial Sequence
  Synthetic Polynucleotide
taatacgactcactatagggaggctccctttgccaaaaagtccacatccaaacagaggagatggatgatgactttttggaacctggcggcagcgcaaaagatg

SEQ ID NO: 84602 - DNA, 103 bp, Artificial Sequence
  Synthetic Polynucleotide
taatacgactcactatagggtcaccaggctccctttgccaaaaagtccacaacagaggagagtggacatgttggcaaagaacctggcggcagcgcaaaagatg

SEQ ID NO: 84603 - DNA, 103 bp, Artificial Sequence
  Synthetic Polynucleotide
taatacgactcactatagggcatattgacaatccggaatcctccggatttaacagaggagaaaatccatgggattccggaacctggcggcagcgcaaaagatg

SEQ ID NO: 84604 - DNA, 103 bp, Artificial Sequence
  Synthetic Polynucleotide
taatacgactcactataggggcatgtcaccaggctccctttgccaaaaagaacagaggagactttttatgaaagggagcaacctggcggcagcgcaaaagatg

SEQ ID NO: 84605 - DNA, 103 bp, Artificial Sequence
  Synthetic Polynucleotide
taatacgactcactatagggttagcgcatgtcaccaggctccctttgccaaacagaggagatggcaaatggagcctggtaacctggcggcagcgcaaaagatg

SEQ ID NO: 84606 - DNA, 103 bp, Artificial Sequence
  Synthetic Polynucleotide
taatacgactcactatagggcaaacttagcgcatgtcaccaggctcccttaacagaggagaaagggaatgtggtgacataacctggcggcagcgcaaaagatg

SEQ ID NO: 84607 - DNA, 103 bp, Artificial Sequence
  Synthetic Polynucleotide
taatacgactcactataggggcatgcaaacttagcgcatgtcaccaggctaacagaggagaagcctgatgacatgcgctaacctggcggcagcgcaaaagatg

SEQ ID NO: 84608 - DNA, 103 bp, Artificial Sequence
  Synthetic Polynucleotide
taatacgactcactatagggttggagcatgcaaacttagcgcatgtcaccaacagaggagaggtgacatgcgctaagttaacctggcggcagcgcaaaagatg

SEQ ID NO: 84609 - DNA, 103 bp, Artificial Sequence
  Synthetic Polynucleotide
taatacgactcactatagggttttcttggagcatgcaaacttagcgcatgaacagaggagacatgcgatgagtttgcataacctggcggcagcgcaaaagatg

SEQ ID NO: 84610 - DNA, 103 bp, Artificial Sequence
  Synthetic Polynucleotide
taatacgactcactatagggggtcattttcttggagcatgcaaacttagcaacagaggagagctaagatggcatgctccaacctggcggcagcgcaaaagatg

SEQ ID NO: 84611 - DNA, 103 bp, Artificial Sequence
  Synthetic Polynucleotide
taatacgactcactatagggttcccggtcattttcttggagcatgcaaacaacagaggagagtttgcatgctccaagaaaacctggcggcagcgcaaaagatg

SEQ ID NO: 84612 - DNA, 103 bp, Artificial Sequence
  Synthetic Polynucleotide
taatacgactcactatagggtgctcttcccggtcattttcttggagcatgaacagaggagacatgctatgagaaaatgaaacctggcggcagcgcaaaagatg

SEQ ID NO: 84613 - DNA, 103 bp, Artificial Sequence
  Synthetic Polynucleotide
taatacgactcactatagggctggatgctcttcccggtcattttcttggaaacagaggagatccaagatgatgaccgggaacctggcggcagcgcaaaagatg

SEQ ID NO: 84614 - DNA, 103 bp, Artificial Sequence
  Synthetic Polynucleotide
taatacgactcactatagggtttagcatattgacaatccggaatcctccgaacagaggagacggaggatgccggattgtaacctggcggcagcgcaaaagatg

SEQ ID NO: 84615 - DNA, 103 bp, Artificial Sequence
  Synthetic Polynucleotide
taatacgactcactatagggtctggctggatgctcttcccggtcattttcaacagaggagagaaaatatgcgggaagagaacctggcggcagcgcaaaagatg

SEQ ID NO: 84616 - DNA, 103 bp, Artificial Sequence
  Synthetic Polynucleotide
taatacgactcactataggggattctctggctggatgctcttcccggtcaaacagaggagatgaccgatgagagcatccaacctggcggcagcgcaaaagatg

SEQ ID NO: 84617 - DNA, 103 bp, Artificial Sequence
  Synthetic Polynucleotide
taatacgactcactatagggctccagattctctggctggatgctcttcccaacagaggagagggaagatgatccagccaaacctggcggcagcgcaaaagatg

SEQ ID NO: 84618 - DNA, 103 bp, Artificial Sequence
  Synthetic Polynucleotide
taatacgactcactatagggcggtactccagattctctggctggatgctcaacagaggagagagcatatggccagagaaaacctggcggcagcgcaaaagatg

SEQ ID NO: 84619 - DNA, 103 bp, Artificial Sequence
  Synthetic Polynucleotide
taatacgactcactatagggttatccggtactccagattctctggctggaaacagaggagatccagcatgagaatctggaacctggcggcagcgcaaaagatg

SEQ ID NO: 84620 - DNA, 103 bp, Artificial Sequence
  Synthetic Polynucleotide
taatacgactcactatagggcagcattatccggtactccagattctctggaacagaggagaccagagatgctggagtacaacctggcggcagcgcaaaagatg

SEQ ID NO: 84621 - DNA, 103 bp, Artificial Sequence
  Synthetic Polynucleotide
taatacgactcactatagggactgacagcattatccggtactccagattcaacagaggagagaatctatggtaccggataacctggcggcagcgcaaaagatg

SEQ ID NO: 84622 - DNA, 103 bp, Artificial Sequence
  Synthetic Polynucleotide
taatacgactcactatagggcatgaactgacagcattatccggtactccaaacagaggagatggagtatgggataatgcaacctggcggcagcgcaaaagatg

SEQ ID NO: 84623 - DNA, 103 bp, Artificial Sequence
  Synthetic Polynucleotide
taatacgactcactatagggggagccatgaactgacagcattatccggtaaacagaggagataccggatgatgctgtcaaacctggcggcagcgcaaaagatg

SEQ ID NO: 84624 - DNA, 103 bp, Artificial Sequence
  Synthetic Polynucleotide
taatacgactcactatagggtgctgggagccatgaactgacagcattatcaacagaggagagataatatggtcagttcaaacctggcggcagcgcaaaagatg

SEQ ID NO: 84625 - DNA, 103 bp, Artificial Sequence
  Synthetic Polynucleotide
taatacgactcactatagggcgcgttttagcatattgacaatccggaatcaacagaggagagattccatgttgtcaataaacctggcggcagcgcaaaagatg

SEQ ID NO: 84626 - DNA, 103 bp, Artificial Sequence
  Synthetic Polynucleotide
taatacgactcactatagggcactgtgctgggagccatgaactgacagcaaacagaggagatgctgtatgttcatggctaacctggcggcagcgcaaaagatg

SEQ ID NO: 84627 - DNA, 103 bp, Artificial Sequence
  Synthetic Polynucleotide
taatacgactcactatagggcatcccactgtgctgggagccatgaactgaaacagaggagatcagttatgggctcccagaacctggcggcagcgcaaaagatg

SEQ ID NO: 84628 - DNA, 103 bp, Artificial Sequence
  Synthetic Polynucleotide
taatacgactcactatagggacgatcatcccactgtgctgggagccatgaaacagaggagatcatggatgccagcacagaacctggcggcagcgcaaaagatg

SEQ ID NO: 84629 - DNA, 103 bp, Artificial Sequence
  Synthetic Polynucleotide
taatacgactcactatagggcattaacgatcatcccactgtgctgggagcaacagaggagagctcccatgacagtgggaaacctggcggcagcgcaaaagatg

SEQ ID NO: 84630 - DNA, 103 bp, Artificial Sequence
  Synthetic Polynucleotide
taatacgactcactatagggtgtgtcattaacgatcatcccactgtgctgaacagaggagacagcacatggggatgatcaacctggcggcagcgcaaaagatg

SEQ ID NO: 84631 - DNA, 103 bp, Artificial Sequence
  Synthetic Polynucleotide
taatacgactcactatagggtgtcctgtgtcattaacgatcatcccactgaacagaggagacagtggatggatcgttaaaacctggcggcagcgcaaaagatg

SEQ ID NO: 84632 - DNA, 103 bp, Artificial Sequence
  Synthetic Polynucleotide
taatacgactcactatagggtttcatgtcctgtgtcattaacgatcatccaacagaggagaggatgaatgttaatgacaaacctggcggcagcgcaaaagatg

SEQ ID NO: 84633 - DNA, 103 bp, Artificial Sequence
  Synthetic Polynucleotide
taatacgactcactatagggatcagtttcatgtcctgtgtcattaacgataacagaggagaatcgttatggacacaggaaacctggcggcagcgcaaaagatg

SEQ ID NO: 84634 - DNA, 103 bp, Artificial Sequence
  Synthetic Polynucleotide
taatacgactcactatagggttctcatcagtttcatgtcctgtgtcattaaacagaggagataatgaatgaggacatgaaacctggcggcagcgcaaaagatg

SEQ ID NO: 84635 - DNA, 103 bp, Artificial Sequence
  Synthetic Polynucleotide
taatacgactcactatagggctctattctcatcagtttcatgtcctgtgtaacagaggagaacacagatgatgaaactgaacctggcggcagcgcaaaagatg

SEQ ID NO: 84636 - DNA, 103 bp, Artificial Sequence
  Synthetic Polynucleotide
taatacgactcactatagggtactccgcgttttagcatattgacaatccgaacagaggagacggattatgaatatgctaaacctggcggcagcgcaaaagatg

SEQ ID NO: 84637 - DNA, 103 bp, Artificial Sequence
  Synthetic Polynucleotide
taatacgactcactatagggcttcgctctattctcatcagtttcatgtccaacagaggagaggacatatgactgatgagaacctggcggcagcgcaaaagatg

SEQ ID NO: 84638 - DNA, 103 bp, Artificial Sequence
  Synthetic Polynucleotide
taatacgactcactatagggtcaaccttcgctctattctcatcagtttcaaacagaggagatgaaacatgtgagaatagaacctggcggcagcgcaaaagatg

SEQ ID NO: 84639 - DNA, 103 bp, Artificial Sequence
  Synthetic Polynucleotide
taatacgactcactatagggttatctcaaccttcgctctattctcatcagaacagaggagactgatgatgatagagcgaaacctggcggcagcgcaaaagatg

SEQ ID NO: 84640 - DNA, 103 bp, Artificial Sequence
  Synthetic Polynucleotide
taatacgactcactataggggggcgttatctcaaccttcgctctattctcaacagaggagagagaatatggcgaaggttaacctggcggcagcgcaaaagatg

SEQ ID NO: 84641 - DNA, 103 bp, Artificial Sequence
  Synthetic Polynucleotide
taatacgactcactataggggaattgggcgttatctcaaccttcgctctaaacagaggagatagagcatgggttgagataacctggcggcagcgcaaaagatg

SEQ ID NO: 84642 - DNA, 103 bp, Artificial Sequence
  Synthetic Polynucleotide
taatacgactcactatagggttggtgaattgggcgttatctcaaccttcgaacagaggagacgaaggatgagataacgcaacctggcggcagcgcaaaagatg

SEQ ID NO: 84643 - DNA, 103 bp, Artificial Sequence
  Synthetic Polynucleotide
taatacgactcactatagggggctcttggtgaattgggcgttatctcaacaacagaggagagttgagatgacgcccaataacctggcggcagcgcaaaagatg

SEQ ID NO: 84644 - DNA, 103 bp, Artificial Sequence
  Synthetic Polynucleotide
taatacgactcactataggggcttcggctcttggtgaattgggcgttatcaacagaggagagataacatgcaattcaccaacctggcggcagcgcaaaagatg

SEQ ID NO: 84645 - DNA, 103 bp, Artificial Sequence
  Synthetic Polynucleotide
taatacgactcactataggggggtggcttcggctcttggtgaattgggcgaacagaggagacgcccaatgcaccaagagaacctggcggcagcgcaaaagatg

SEQ ID NO: 84646 - DNA, 103 bp, Artificial Sequence
  Synthetic Polynucleotide
taatacgactcactatagggccccagggtggcttcggctcttggtgaattaacagaggagaaattcaatgagagccgaaaacctggcggcagcgcaaaagatg

SEQ ID NO: 84647 - DNA, 103 bp, Artificial Sequence
  Synthetic Polynucleotide
taatacgactcactatagggactcgaactgtcgcagtctgattcacacagaacagaggagactgtgtatgtcagactgcaacctggcggcagcgcaaaagatg

SEQ ID NO: 84648 - DNA, 103 bp, Artificial Sequence
  Synthetic Polynucleotide
taatacgactcactatagggcgggctactccgcgttttagcatattgacaaacagaggagatgtcaaatggctaaaacgaacctggcggcagcgcaaaagatg

SEQ ID NO: 84649 - DNA, 103 bp, Artificial Sequence
  Synthetic Polynucleotide
taatacgactcactatagggaaaccccccagggtggcttcggctcttggtaacagaggagaaccaagatgcgaagccacaacctggcggcagcgcaaaagatg

SEQ ID NO: 84650 - DNA, 103 bp, Artificial Sequence
  Synthetic Polynucleotide
taatacgactcactatagggttccaaaaccccccagggtggcttcggctcaacagaggagagagccgatgccaccctggaacctggcggcagcgcaaaagatg

SEQ ID NO: 84651 - DNA, 103 bp, Artificial Sequence
  Synthetic Polynucleotide
taatacgactcactatagggtaggcttccaaaaccccccagggtggcttcaacagaggagagaagccatgctggggggtaacctggcggcagcgcaaaagatg

SEQ ID NO: 84652 - DNA, 103 bp, Artificial Sequence
  Synthetic Polynucleotide
taatacgactcactatagggagtcctaggcttccaaaaccccccagggtgaacagaggagacaccctatggggttttggaacctggcggcagcgcaaaagatg

SEQ ID NO: 84653 - DNA, 103 bp, Artificial Sequence
  Synthetic Polynucleotide
taatacgactcactatagggaatcaagtcctaggcttccaaaaccccccaaacagaggagatgggggatgttggaagccaacctggcggcagcgcaaaagatg

SEQ ID NO: 84654 - DNA, 103 bp, Artificial Sequence
  Synthetic Polynucleotide
taatacgactcactatagggttcacaatcaagtcctaggcttccaaaaccaacagaggagaggttttatgagcctaggaaacctggcggcagcgcaaaagatg

SEQ ID NO: 84655 - DNA, 103 bp, Artificial Sequence
  Synthetic Polynucleotide
taatacgactcactatagggctcggttcacaatcaagtcctaggcttccaaacagaggagatggaagatgaggacttgaaacctggcggcagcgcaaaagatg

SEQ ID NO: 84656 - DNA, 103 bp, Artificial Sequence
  Synthetic Polynucleotide
taatacgactcactatagggctgtcctcggttcacaatcaagtcctaggcaacagaggagagcctagatgttgattgtgaacctggcggcagcgcaaaagatg

SEQ ID NO: 84657 - DNA, 103 bp, Artificial Sequence
  Synthetic Polynucleotide
taatacgactcactatagggaaggcctgtcctcggttcacaatcaagtccaacagaggagaggacttatgtgtgaaccgaacctggcggcagcgcaaaagatg

SEQ ID NO: 84658 - DNA, 103 bp, Artificial Sequence
  Synthetic Polynucleotide
taatacgactcactatagggaagtcaaggcctgtcctcggttcacaatcaaacagaggagatgattgatgaccgaggacaacctggcggcagcgcaaaagatg

SEQ ID NO: 84659 - DNA, 103 bp, Artificial Sequence
  Synthetic Polynucleotide
taatacgactcactatagggtcacacgggctactccgcgttttagcatataacagaggagaatatgcatgaacgcggagaacctggcggcagcgcaaaagatg

SEQ ID NO: 84660 - DNA, 103 bp, Artificial Sequence
  Synthetic Polynucleotide
taatacgactcactatagggctgaaaagtcaaggcctgtcctcggttcacaacagaggagagtgaacatgggacaggccaacctggcggcagcgcaaaagatg

SEQ ID NO: 84661 - DNA, 103 bp, Artificial Sequence
  Synthetic Polynucleotide
taatacgactcactatagggcaaatctgaaaagtcaaggcctgtcctcggaacagaggagaccgaggatgggccttgacaacctggcggcagcgcaaaagatg

SEQ ID NO: 84662 - DNA, 103 bp, Artificial Sequence
  Synthetic Polynucleotide
taatacgactcactatagggtaatacaaatctgaaaagtcaaggcctgtcaacagaggagagacaggatgtgacttttcaacctggcggcagcgcaaaagatg

SEQ ID NO: 84663 - DNA, 103 bp, Artificial Sequence
  Synthetic Polynucleotide
taatacgactcactatagggtcaagtaatacaaatctgaaaagtcaaggcaacagaggagagccttgatgtttcagattaacctggcggcagcgcaaaagatg

SEQ ID NO: 84664 - DNA, 103 bp, Artificial Sequence
  Synthetic Polynucleotide
taatacgactcactatagggcatagtcaagtaatacaaatctgaaaagtcaacagaggagagactttatggatttgtataacctggcggcagcgcaaaagatg

SEQ ID NO: 84665 - DNA, 103 bp, Artificial Sequence
  Synthetic Polynucleotide
taatacgactcactatagggttattcatagtcaagtaatacaaatctgaaaacagaggagattcagaatggtattacttaacctggcggcagcgcaaaagatg

SEQ ID NO: 84666 - DNA, 103 bp, Artificial Sequence
  Synthetic Polynucleotide
taatacgactcactataggggcttgttattcatagtcaagtaatacaaataacagaggagaatttgtatgacttgactaaacctggcggcagcgcaaaagatg

SEQ ID NO: 84667 - DNA, 103 bp, Artificial Sequence
  Synthetic Polynucleotide
taatacgactcactatagggccagtgcttgttattcatagtcaagtaataaacagaggagatattacatgactatgaataacctggcggcagcgcaaaagatg

SEQ ID NO: 84668 - DNA, 103 bp, Artificial Sequence
  Synthetic Polynucleotide
taatacgactcactatagggaccaaccagtgcttgttattcatagtcaagaacagaggagacttgacatggaataacaaaacctggcggcagcgcaaaagatg

SEQ ID NO: 84669 - DNA, 103 bp, Artificial Sequence
  Synthetic Polynucleotide
taatacgactcactatagggtgtggaccaaccagtgcttgttattcatagaacagaggagactatgaatgacaagcactaacctggcggcagcgcaaaagatg

SEQ ID NO: 84670 - DNA, 103 bp, Artificial Sequence
  Synthetic Polynucleotide
taatacgactcactatagggggggctcacacgggctactccgcgttttagaacagaggagactaaaaatgggagtagccaacctggcggcagcgcaaaagatg

SEQ ID NO: 84671 - DNA, 103 bp, Artificial Sequence
  Synthetic Polynucleotide
taatacgactcactatagggctccttgtggaccaaccagtgcttgttattaacagaggagaaataacatgcactggttgaacctggcggcagcgcaaaagatg

SEQ ID NO: 84672 - DNA, 103 bp, Artificial Sequence
  Synthetic Polynucleotide
taatacgactcactatagggaaccactccttgtggaccaaccagtgcttgaacagaggagacaagcaatggttggtccaaacctggcggcagcgcaaaagatg

SEQ ID NO: 84673 - DNA, 103 bp, Artificial Sequence
  Synthetic Polynucleotide
taatacgactcactatagggcgtggaaccactccttgtggaccaaccagtaacagaggagaactggtatgtccacaaggaacctggcggcagcgcaaaagatg

SEQ ID NO: 84674 - DNA, 103 bp, Artificial Sequence
  Synthetic Polynucleotide
taatacgactcactatagggaatgtcgtggaaccactccttgtggaccaaaacagaggagattggtcatgaaggagtggaacctggcggcagcgcaaaagatg

SEQ ID NO: 84675 - DNA, 103 bp, Artificial Sequence
  Synthetic Polynucleotide
taatacgactcactatagggaatggaatgtcgtggaaccactccttgtggaacagaggagaccacaaatggtggttccaaacctggcggcagcgcaaaagatg

SEQ ID NO: 84676 - DNA, 103 bp, Artificial Sequence
  Synthetic Polynucleotide
taatacgactcactatagggaaggtaatggaatgtcgtggaaccactcctaacagaggagaaggagtatgtccacgacaaacctggcggcagcgcaaaagatg

SEQ ID NO: 84677 - DNA, 103 bp, Artificial Sequence
  Synthetic Polynucleotide
taatacgactcactataggggtgccaaggtaatggaatgtcgtggaaccaaacagaggagatggttcatggacattccaaacctggcggcagcgcaaaagatg

SEQ ID NO: 84678 - DNA, 103 bp, Artificial Sequence
  Synthetic Polynucleotide
taatacgactcactatagggccagcgtgccaaggtaatggaatgtcgtggaacagaggagaccacgaatgtccattaccaacctggcggcagcgcaaaagatg

SEQ ID NO: 84679 - DNA, 103 bp, Artificial Sequence
  Synthetic Polynucleotide
taatacgactcactatagggctgccccagcgtgccaaggtaatggaatgtaacagaggagaacattcatgtaccttggcaacctggcggcagcgcaaaagatg

SEQ ID NO: 84680 - DNA, 103 bp, Artificial Sequence
  Synthetic Polynucleotide
taatacgactcactatagggggtgtctgccccagcgtgccaaggtaatggaacagaggagaccattaatgtggcacgctaacctggcggcagcgcaaaagatg

SEQ ID NO: 84681 - DNA, 103 bp, Artificial Sequence
  Synthetic Polynucleotide
taatacgactcactatagggccaaaggggctcacacgggctactccgcgtaacagaggagaacgcggatgagcccgtgtaacctggcggcagcgcaaaagatg

SEQ ID NO: 84682 - DNA, 103 bp, Artificial Sequence
  Synthetic Polynucleotide
taatacgactcactataggggttccggtgtctgccccagcgtgccaaggtaacagaggagaaccttgatgcgctggggcaacctggcggcagcgcaaaagatg

SEQ ID NO: 84683 - DNA, 103 bp, Artificial Sequence
  Synthetic Polynucleotide
taatacgactcactataggggtggagttccggtgtctgccccagcgtgccaacagaggagaggcacgatggggcagacaaacctggcggcagcgcaaaagatg

SEQ ID NO: 84684 - DNA, 103 bp, Artificial Sequence
  Synthetic Polynucleotide
taatacgactcactatagggccagtgtggagttccggtgtctgccccagcaacagaggagagctgggatggacaccggaaacctggcggcagcgcaaaagatg

SEQ ID NO: 84685 - DNA, 103 bp, Artificial Sequence
  Synthetic Polynucleotide
taatacgactcactatagggttgttccagtgtggagttccggtgtctgccaacagaggagaggcagaatgcggaactccaacctggcggcagcgcaaaagatg

SEQ ID NO: 84686 - DNA, 103 bp, Artificial Sequence
  Synthetic Polynucleotide
taatacgactcactatagggctttgttgttccagtgtggagttccggtgtaacagaggagaacaccgatgctccacactaacctggcggcagcgcaaaagatg

SEQ ID NO: 84687 - DNA, 103 bp, Artificial Sequence
  Synthetic Polynucleotide
taatacgactcactatagggtgcttctttgttgttccagtgtggagttccaacagaggagaggaactatgcactggaacaacctggcggcagcgcaaaagatg

SEQ ID NO: 84688 - DNA, 103 bp, Artificial Sequence
  Synthetic Polynucleotide
taatacgactcactatagggaccagtgcttctttgttgttccagtgtggaaacagaggagatccacaatggaacaacaaaacctggcggcagcgcaaaagatg

SEQ ID NO: 84689 - DNA, 103 bp, Artificial Sequence
  Synthetic Polynucleotide
taatacgactcactatagggactctaccagtgcttctttgttgttccagtaacagaggagaactggaatgacaaagaagaacctggcggcagcgcaaaagatg

SEQ ID NO: 84690 - DNA, 103 bp, Artificial Sequence
  Synthetic Polynucleotide
taatacgactcactatagggcttgaactctaccagtgcttctttgttgttaacagaggagaaacaacatggaagcactgaacctggcggcagcgcaaaagatg

SEQ ID NO: 84691 - DNA, 103 bp, Artificial Sequence
  Synthetic Polynucleotide
taatacgactcactataggggcgtccttgaactctaccagtgcttctttgaacagaggagacaaagaatgactggtagaaacctggcggcagcgcaaaagatg

SEQ ID NO: 84692 - DNA, 103 bp, Artificial Sequence
  Synthetic Polynucleotide
taatacgactcactatagggagcccccaaaggggctcacacgggctactcaacagaggagagagtagatggtgtgagccaacctggcggcagcgcaaaagatg

SEQ ID NO: 84693 - DNA, 103 bp, Artificial Sequence
  Synthetic Polynucleotide
taatacgactcactatagggcatgtgcgtccttgaactctaccagtgcttaacagaggagaaagcacatgtagagttcaaacctggcggcagcgcaaaagatg

SEQ ID NO: 84694 - DNA, 103 bp, Artificial Sequence
  Synthetic Polynucleotide
taatacgactcactatagggtttggcatgtgcgtccttgaactctaccagaacagaggagactggtaatgttcaaggacaacctggcggcagcgcaaaagatg

SEQ ID NO: 84695 - DNA, 103 bp, Artificial Sequence
  Synthetic Polynucleotide
taatacgactcactatagggtgccttttggcatgtgcgtccttgaactctaacagaggagaagagttatgggacgcacaaacctggcggcagcgcaaaagatg

SEQ ID NO: 84696 - DNA, 103 bp, Artificial Sequence
  Synthetic Polynucleotide
taatacgactcactatagggcagtttgccttttggcatgtgcgtccttgaaacagaggagatcaaggatgcacatgccaaacctggcggcagcgcaaaagatg

SEQ ID NO: 84697 - DNA, 103 bp, Artificial Sequence
  Synthetic Polynucleotide
taatacgactcactatagggcacgacagtttgccttttggcatgtgcgtcaacagaggagagacgcaatggccaaaaggaacctggcggcagcgcaaaagatg

SEQ ID NO: 84698 - DNA, 103 bp, Artificial Sequence
  Synthetic Polynucleotide
taatacgactcactatagggagaaccacgacagtttgccttttggcatgtaacagaggagaacatgcatgaaggcaaacaacctggcggcagcgcaaaagatg

SEQ ID NO: 84699 - DNA, 103 bp, Artificial Sequence
  Synthetic Polynucleotide
taatacgactcactatagggtccctagaaccacgacagtttgccttttggaacagaggagaccaaaaatgaaactgtcgaacctggcggcagcgcaaaagatg

SEQ ID NO: 84700 - DNA, 103 bp, Artificial Sequence
  Synthetic Polynucleotide
taatacgactcactatagggttgactccctagaaccacgacagtttgcctaacagaggagaaggcaaatggtcgtggttaacctggcggcagcgcaaaagatg

SEQ ID NO: 84701 - DNA, 103 bp, Artificial Sequence
  Synthetic Polynucleotide
taatacgactcactatagggccttcttgactccctagaaccacgacagttaacagaggagaaactgtatgggttctaggaacctggcggcagcgcaaaagatg

SEQ ID NO: 84702 - DNA, 103 bp, Artificial Sequence
  Synthetic Polynucleotide
taatacgactcactatagggctgctccttcttgactccctagaaccacgaaacagaggagatcgtggatgtagggagtcaacctggcggcagcgcaaaagatg

SEQ ID NO: 84703 - DNA, 103 bp, Artificial Sequence
  Synthetic Polynucleotide
taatacgactcactatagggcttcaagcccccaaaggggctcacacgggcaacagaggagagcccgtatgagcccctttaacctggcggcagcgcaaaagatg

SEQ ID NO: 84704 - DNA, 103 bp, Artificial Sequence
  Synthetic Polynucleotide
taatacgactcactataggggtgaactgctccttcttgactccctagaacaacagaggagagttctaatgagtcaagaaaacctggcggcagcgcaaaagatg

SEQ ID NO: 84705 - DNA, 103 bp, Artificial Sequence
  Synthetic Polynucleotide
taatacgactcactataggggccgtgtgaactgctccttcttgactccctaacagaggagaagggagatgagaaggagcaacctggcggcagcgcaaaagatg

SEQ ID NO: 84706 - DNA, 103 bp, Artificial Sequence
  Synthetic Polynucleotide
taatacgactcactatagggcaagggccgtgtgaactgctccttcttgacaacagaggagagtcaagatggagcagttcaacctggcggcagcgcaaaagatg

SEQ ID NO: 84707 - DNA, 103 bp, Artificial Sequence
  Synthetic Polynucleotide
taatacgactcactatagggtccagcaagggccgtgtgaactgctccttcaacagaggagagaaggaatggttcacacgaacctggcggcagcgcaaaagatg

SEQ ID NO: 84708 - DNA, 103 bp, Artificial Sequence
  Synthetic Polynucleotide
taatacgactcactatagggagagctccagcaagggccgtgtgaactgctaacagaggagaagcagtatgcacggccctaacctggcggcagcgcaaaagatg

SEQ ID NO: 84709 - DNA, 103 bp, Artificial Sequence
  Synthetic Polynucleotide
taatacgactcactatagggcctccagagctccagcaagggccgtgtgaaaacagaggagattcacaatgcccttgctgaacctggcggcagcgcaaaagatg

SEQ ID NO: 84710 - DNA, 103 bp, Artificial Sequence
  Synthetic Polynucleotide
taatacgactcactatagggctcagcctccagagctccagcaagggccgtaacagaggagaacggccatggctggagctaacctggcggcagcgcaaaagatg

SEQ ID NO: 84711 - DNA, 103 bp, Artificial Sequence
  Synthetic Polynucleotide
taatacgactcactatagggtccatctcagcctccagagctccagcaaggaacagaggagaccttgcatgagctctggaaacctggcggcagcgcaaaagatg

SEQ ID NO: 84712 - DNA, 103 bp, Artificial Sequence
  Synthetic Polynucleotide
taatacgactcactatagggcaccatccatctcagcctccagagctccagaacagaggagactggagatgtggaggctgaacctggcggcagcgcaaaagatg

SEQ ID NO: 84713 - DNA, 103 bp, Artificial Sequence
  Synthetic Polynucleotide
taatacgactcactatagggctttgcaccatccatctcagcctccagagcaacagaggagagctctgatggctgagatgaacctggcggcagcgcaaaagatg

SEQ ID NO: 84714 - DNA, 103 bp, Artificial Sequence
  Synthetic Polynucleotide
taatacgactcactatagggagcctcttcaagcccccaaaggggctcacaaacagaggagatgtgagatgctttgggggaacctggcggcagcgcaaaagatg

SEQ ID NO: 84715 - DNA, 103 bp, Artificial Sequence
  Synthetic Polynucleotide
taatacgactcactatagggcttccctttgcaccatccatctcagcctccaacagaggagaggaggcatggatggatggaacctggcggcagcgcaaaagatg

SEQ ID NO: 84716 - DNA, 103 bp, Artificial Sequence
  Synthetic Polynucleotide
taatacgactcactatagggacagccttccctttgcaccatccatctcagaacagaggagactgagaatgatggtgcaaaacctggcggcagcgcaaaagatg

SEQ ID NO: 84717 - DNA, 103 bp, Artificial Sequence
  Synthetic Polynucleotide
taatacgactcactatagggagaggacagccttccctttgcaccatccataacagaggagaatggatatggcaaagggaaacctggcggcagcgcaaaagatg

SEQ ID NO: 84718 - DNA, 103 bp, Artificial Sequence
  Synthetic Polynucleotide
taatacgactcactatagggtggccagaggacagccttccctttgcaccaaacagaggagatggtgcatggggaaggctaacctggcggcagcgcaaaagatg

SEQ ID NO: 84719 - DNA, 103 bp, Artificial Sequence
  Synthetic Polynucleotide
taatacgactcactatagggtcaagtggccagaggacagccttccctttgaacagaggagacaaaggatgggctgtcctaacctggcggcagcgcaaaagatg

SEQ ID NO: 84720 - DNA, 103 bp, Artificial Sequence
  Synthetic Polynucleotide
taatacgactcactatagggacatttcaagtggccagaggacagccttccaacagaggagaggaaggatgtcctctggcaacctggcggcagcgcaaaagatg

SEQ ID NO: 84721 - DNA, 103 bp, Artificial Sequence
  Synthetic Polynucleotide
taatacgactcactatagggaggcgacatttcaagtggccagaggacagcaacagaggagagctgtcatgtggccacttaacctggcggcagcgcaaaagatg

SEQ ID NO: 84722 - DNA, 103 bp, Artificial Sequence
  Synthetic Polynucleotide
taatacgactcactatagggttttcaggcgacatttcaagtggccagaggaacagaggagacctctgatgacttgaaataacctggcggcagcgcaaaagatg

SEQ ID NO: 84723 - DNA, 103 bp, Artificial Sequence
  Synthetic Polynucleotide
taatacgactcactatagggatccattttcaggcgacatttcaagtggccaacagaggagaggccacatgaaatgtcgcaacctggcggcagcgcaaaagatg

SEQ ID NO: 84724 - DNA, 103 bp, Artificial Sequence
  Synthetic Polynucleotide
taatacgactcactatagggagtttatccattttcaggcgacatttcaagaacagaggagacttgaaatgtcgcctgaaaacctggcggcagcgcaaaagatg

SEQ ID NO: 84725 - DNA, 103 bp, Artificial Sequence
  Synthetic Polynucleotide
taatacgactcactatagggctggcagcctcttcaagcccccaaaggggcaacagaggagagcccctatgggggcttgaaacctggcggcagcgcaaaagatg

SEQ ID NO: 84726 - DNA, 103 bp, Artificial Sequence
  Synthetic Polynucleotide
taatacgactcactatagggatctaagtttatccattttcaggcgacattaacagaggagaaatgtcatgtgaaaatggaacctggcggcagcgcaaaagatg

SEQ ID NO: 84727 - DNA, 103 bp, Artificial Sequence
  Synthetic Polynucleotide
taatacgactcactatagggcttcaatctaagtttatccattttcaggcgaacagaggagacgcctgatgatggataaaaacctggcggcagcgcaaaagatg

SEQ ID NO: 84728 - DNA, 103 bp, Artificial Sequence
  Synthetic Polynucleotide
taatacgactcactatagggacgcccttcaatctaagtttatccattttcaacagaggagagaaaatatgtaaacttagaacctggcggcagcgcaaaagatg

SEQ ID NO: 84729 - DNA, 103 bp, Artificial Sequence
  Synthetic Polynucleotide
taatacgactcactatagggatgacacgcccttcaatctaagtttatccaaacagaggagatggataatgttagattgaaacctggcggcagcgcaaaagatg

SEQ ID NO: 84730 - DNA, 103 bp, Artificial Sequence
  Synthetic Polynucleotide
taatacgactcactatagggggagtatgacacgcccttcaatctaagtttaacagaggagaaaacttatgttgaagggcaacctggcggcagcgcaaaagatg

SEQ ID NO: 84731 - DNA, 103 bp, Artificial Sequence
  Synthetic Polynucleotide
taatacgactcactatagggcacaaggagtatgacacgcccttcaatctaaacagaggagatagattatggggcgtgtcaacctggcggcagcgcaaaagatg

SEQ ID NO: 84732 - DNA, 103 bp, Artificial Sequence
  Synthetic Polynucleotide
taatacgactcactatagggcggtacacaaggagtatgacacgcccttcaaacagaggagatgaaggatgtgtcatactaacctggcggcagcgcaaaagatg

SEQ ID NO: 84733 - DNA, 103 bp, Artificial Sequence
  Synthetic Polynucleotide
taatacgactcactatagggcgctgcggtacacaaggagtatgacacgccaacagaggagaggcgtgatgtactccttgaacctggcggcagcgcaaaagatg

SEQ ID NO: 84734 - DNA, 103 bp, Artificial Sequence
  Synthetic Polynucleotide
taatacgactcactataggggtgaacgctgcggtacacaaggagtatgacaacagaggagagtcataatgcttgtgtacaacctggcggcagcgcaaaagatg

SEQ ID NO: 84735 - DNA, 103 bp, Artificial Sequence
  Synthetic Polynucleotide
taatacgactcactatagggtgaatgtgaacgctgcggtacacaaggagtaacagaggagaactcctatggtaccgcagaacctggcggcagcgcaaaagatg

SEQ ID NO: 84736 - DNA, 103 bp, Artificial Sequence
  Synthetic Polynucleotide
taatacgactcactatagggtccggctggcagcctcttcaagcccccaaaaacagaggagatttgggatgttgaagaggaacctggcggcagcgcaaaagatg

SEQ ID NO: 84737 - DNA, 103 bp, Artificial Sequence
  Synthetic Polynucleotide
taatacgactcactatagggcttggtgaatgtgaacgctgcggtacacaaaacagaggagattgtgtatggcagcgttcaacctggcggcagcgcaaaagatg

SEQ ID NO: 84738 - DNA, 103 bp, Artificial Sequence
  Synthetic Polynucleotide
taatacgactcactataggggggatcttggtgaatgtgaacgctgcggtaaacagaggagataccgcatggttcacattaacctggcggcagcgcaaaagatg

SEQ ID NO: 84739 - DNA, 103 bp, Artificial Sequence
  Synthetic Polynucleotide
taatacgactcactatagggcagccgggatcttggtgaatgtgaacgctgaacagaggagacagcgtatgcattcaccaaacctggcggcagcgcaaaagatg

SEQ ID NO: 84740 - DNA, 103 bp, Artificial Sequence
  Synthetic Polynucleotide
taatacgactcactatagggtgtttcagccgggatcttggtgaatgtgaaaacagaggagattcacaatgaccaagatcaacctggcggcagcgcaaaagatg

SEQ ID NO: 84741 - DNA, 103 bp, Artificial Sequence
  Synthetic Polynucleotide
taatacgactcactatagggtgcagtgtttcagccgggatcttggtgaataacagaggagaattcacatggatcccggcaacctggcggcagcgcaaaagatg

SEQ ID NO: 84742 - DNA, 103 bp, Artificial Sequence
  Synthetic Polynucleotide
taatacgactcactatagggtcccgtgcagtgtttcagccgggatcttggaacagaggagaccaagaatgcggctgaaaaacctggcggcagcgcaaaagatg

SEQ ID NO: 84743 - DNA, 103 bp, Artificial Sequence
  Synthetic Polynucleotide
taatacgactcactataggggactgtcccgtgcagtgtttcagccgggataacagaggagaatcccgatggaaacactgaacctggcggcagcgcaaaagatg

SEQ ID NO: 84744 - DNA, 103 bp, Artificial Sequence
  Synthetic Polynucleotide
taatacgactcactatagggactgtgactgtcccgtgcagtgtttcagccaacagaggagaggctgaatgactgcacggaacctggcggcagcgcaaaagatg

SEQ ID NO: 84745 - DNA, 103 bp, Artificial Sequence
  Synthetic Polynucleotide
taatacgactcactatagggcctccactgtgactgtcccgtgcagtgtttaacagaggagaaaacacatgacgggacagaacctggcggcagcgcaaaagatg

SEQ ID NO: 84746 - DNA, 103 bp, Artificial Sequence
  Synthetic Polynucleotide
taatacgactcactatagggctgtacctccactgtgactgtcccgtgcagaacagaggagactgcacatgacagtcacaaacctggcggcagcgcaaaagatg

SEQ ID NO: 84747 - DNA, 103 bp, Artificial Sequence
  Synthetic Polynucleotide
taatacgactcactatagggagaagtccggctggcagcctcttcaagcccaacagaggagagggcttatggaggctgccaacctggcggcagcgcaaaagatg

SEQ ID NO: 84748 - DNA, 103 bp, Artificial Sequence
  Synthetic Polynucleotide
taatacgactcactataggggcgtactgtacctccactgtgactgtcccgaacagaggagacgggacatgcacagtggaaacctggcggcagcgcaaaagatg

SEQ ID NO: 84749 - DNA, 103 bp, Artificial Sequence
  Synthetic Polynucleotide
taatacgactcactatagggtccctgcgtactgtacctccactgtgactgaacagaggagacagtcaatgtggaggtacaacctggcggcagcgcaaaagatg

SEQ ID NO: 84750 - DNA, 103 bp, Artificial Sequence
  Synthetic Polynucleotide
taatacgactcactatagggatctgtccctgcgtactgtacctccactgtaacagaggagaacagtgatggtacagtacaacctggcggcagcgcaaaagatg

SEQ ID NO: 84751 - DNA, 103 bp, Artificial Sequence
  Synthetic Polynucleotide
taatacgactcactatagggggtccatctgtccctgcgtactgtacctccaacagaggagaggaggtatggtacgcaggaacctggcggcagcgcaaaagatg

SEQ ID NO: 84752 - DNA, 103 bp, Artificial Sequence
  Synthetic Polynucleotide
taatacgactcactatagggtgcaaggtccatctgtccctgcgtactgtaaacagaggagatacagtatgcagggacagaacctggcggcagcgcaaaagatg

SEQ ID NO: 84753 - DNA, 103 bp, Artificial Sequence
  Synthetic Polynucleotide
taatacgactcactatagggaaccttgcaaggtccatctgtccctgcgtaaacagaggagatacgcaatgacagatggaaacctggcggcagcgcaaaagatg

SEQ ID NO: 84754 - DNA, 103 bp, Artificial Sequence
  Synthetic Polynucleotide
taatacgactcactataggggctggaaccttgcaaggtccatctgtccctaacagaggagaagggacatgtggaccttgaacctggcggcagcgcaaaagatg

SEQ ID NO: 84755 - DNA, 103 bp, Artificial Sequence
  Synthetic Polynucleotide
taatacgactcactatagggtctgagctggaaccttgcaaggtccatctgaacagaggagacagatgatgcttgcaaggaacctggcggcagcgcaaaagatg

SEQ ID NO: 84756 - DNA, 103 bp, Artificial Sequence
  Synthetic Polynucleotide
taatacgactcactatagggcgccatctgagctggaaccttgcaaggtccaacagaggagaggacctatgaaggttccaaacctggcggcagcgcaaaagatg

SEQ ID NO: 84757 - DNA, 103 bp, Artificial Sequence
  Synthetic Polynucleotide
taatacgactcactatagggtccaccgccatctgagctggaaccttgcaaaacagaggagattgcaaatgtccagctcaaacctggcggcagcgcaaaagatg

SEQ ID NO: 84758 - DNA, 103 bp, Artificial Sequence
  Synthetic Polynucleotide
taatacgactcactatagggttcaaactcgaactgtcgcagtctgattcaaacagaggagatgaatcatgctgcgacagaacctggcggcagcgcaaaagatg

SEQ ID NO: 84759 - DNA, 103 bp, Artificial Sequence
  Synthetic Polynucleotide
taatacgactcactatagggccagcagaagtccggctggcagcctcttcaaacagaggagatgaagaatgtgccagccgaacctggcggcagcgcaaaagatg

SEQ ID NO: 84760 - DNA, 103 bp, Artificial Sequence
  Synthetic Polynucleotide
taatacgactcactataggggcatgtccaccgccatctgagctggaacctaacagaggagaaggttcatgctcagatggaacctggcggcagcgcaaaagatg

SEQ ID NO: 84761 - DNA, 103 bp, Artificial Sequence
  Synthetic Polynucleotide
taatacgactcactatagggagtttgcatgtccaccgccatctgagctggaacagaggagaccagctatgatggcggtgaacctggcggcagcgcaaaagatg

SEQ ID NO: 84762 - DNA, 103 bp, Artificial Sequence
  Synthetic Polynucleotide
taatacgactcactataggggtcagagtttgcatgtccaccgccatctgaaacagaggagatcagatatgggtggacataacctggcggcagcgcaaaagatg

SEQ ID NO: 84763 - DNA, 103 bp, Artificial Sequence
  Synthetic Polynucleotide
taatacgactcactatagggctggggtcagagtttgcatgtccaccgccaaacagaggagatggcggatgacatgcaaaaacctggcggcagcgcaaaagatg

SEQ ID NO: 84764 - DNA, 103 bp, Artificial Sequence
  Synthetic Polynucleotide
taatacgactcactatagggcccaactggggtcagagtttgcatgtccacaacagaggagagtggacatgcaaactctgaacctggcggcagcgcaaaagatg

SEQ ID NO: 84765 - DNA, 103 bp, Artificial Sequence
  Synthetic Polynucleotide
taatacgactcactatagggaacctcccaactggggtcagagtttgcatgaacagaggagacatgcaatgtctgaccccaacctggcggcagcgcaaaagatg

SEQ ID NO: 84766 - DNA, 103 bp, Artificial Sequence
  Synthetic Polynucleotide
taatacgactcactatagggttatcaacctcccaactggggtcagagtttaacagaggagaaaactcatgccccagttgaacctggcggcagcgcaaaagatg

SEQ ID NO: 84767 - DNA, 103 bp, Artificial Sequence
  Synthetic Polynucleotide
taatacgactcactatagggagcggttatcaacctcccaactggggtcagaacagaggagactgaccatggttgggaggaacctggcggcagcgcaaaagatg

SEQ ID NO: 84768 - DNA, 103 bp, Artificial Sequence
  Synthetic Polynucleotide
taatacgactcactataggggggttagcggttatcaacctcccaactgggaacagaggagacccagtatggaggttgataacctggcggcagcgcaaaagatg

SEQ ID NO: 84769 - DNA, 103 bp, Artificial Sequence
  Synthetic Polynucleotide
taatacgactcactatagggttacggggttagcggttatcaacctcccaaaacagaggagattgggaatgtgataaccgaacctggcggcagcgcaaaagatg

SEQ ID NO: 84770 - DNA, 103 bp, Artificial Sequence
  Synthetic Polynucleotide
taatacgactcactatagggatgacccagcagaagtccggctggcagcctaacagaggagaaggctgatggccggacttaacctggcggcagcgcaaaagatg

SEQ ID NO: 84771 - DNA, 103 bp, Artificial Sequence
  Synthetic Polynucleotide
taatacgactcactatagggagtgattacggggttagcggttatcaacctaacagaggagaaggttgatgaccgctaacaacctggcggcagcgcaaaagatg

SEQ ID NO: 84772 - DNA, 103 bp, Artificial Sequence
  Synthetic Polynucleotide
taatacgactcactatagggctttcagtgattacggggttagcggttatcaacagaggagagataacatgtaaccccgtaacctggcggcagcgcaaaagatg

SEQ ID NO: 84773 - DNA, 103 bp, Artificial Sequence
  Synthetic Polynucleotide
taatacgactcactatagggcagtgctttcagtgattacggggttagcggaacagaggagaccgctaatgccgtaatcaaacctggcggcagcgcaaaagatg

SEQ ID NO: 84774 - DNA, 103 bp, Artificial Sequence
  Synthetic Polynucleotide
taatacgactcactataggggttctcagtgctttcagtgattacggggttaacagaggagaaaccccatgatcactgaaaacctggcggcagcgcaaaagatg

SEQ ID NO: 84775 - DNA, 103 bp, Artificial Sequence
  Synthetic Polynucleotide
taatacgactcactatagggttagagttctcagtgctttcagtgattacgaacagaggagacgtaatatgtgaaagcacaacctggcggcagcgcaaaagatg

SEQ ID NO: 84776 - DNA, 103 bp, Artificial Sequence
  Synthetic Polynucleotide
taatacgactcactatagggtcatcttagagttctcagtgctttcagtgaaacagaggagatcactgatggcactgagaaacctggcggcagcgcaaaagatg

SEQ ID NO: 84777 - DNA, 103 bp, Artificial Sequence
  Synthetic Polynucleotide
taatacgactcactatagggcagcatcatcttagagttctcagtgctttcaacagaggagagaaagcatggagaactctaacctggcggcagcgcaaaagatg

SEQ ID NO: 84778 - DNA, 103 bp, Artificial Sequence
  Synthetic Polynucleotide
taatacgactcactatagggagttccagcatcatcttagagttctcagtgaacagaggagacactgaatgctctaagataacctggcggcagcgcaaaagatg

SEQ ID NO: 84779 - DNA, 103 bp, Artificial Sequence
  Synthetic Polynucleotide
taatacgactcactataggggatcaagttccagcatcatcttagagttctaacagaggagaagaactatgagatgatgcaacctggcggcagcgcaaaagatg

SEQ ID NO: 84780 - DNA, 103 bp, Artificial Sequence
  Synthetic Polynucleotide
taatacgactcactatagggtggtggatcaagttccagcatcatcttagaaacagaggagatctaagatgatgctggaaaacctggcggcagcgcaaaagatg

SEQ ID NO: 84781 - DNA, 103 bp, Artificial Sequence
  Synthetic Polynucleotide
taatacgactcactatagggggcccatgacccagcagaagtccggctggcaacagaggagagccagcatgacttctgctaacctggcggcagcgcaaaagatg

SEQ ID NO: 84782 - DNA, 103 bp, Artificial Sequence
  Synthetic Polynucleotide
taatacgactcactatagggccaaatggtggatcaagttccagcatcatcaacagaggagagatgatatgggaacttgaaacctggcggcagcgcaaaagatg

SEQ ID NO: 84783 - DNA, 103 bp, Artificial Sequence
  Synthetic Polynucleotide
taatacgactcactatagggagtccccaaatggtggatcaagttccagcaaacagaggagatgctggatgttgatccacaacctggcggcagcgcaaaagatg

SEQ ID NO: 84784 - DNA, 103 bp, Artificial Sequence
  Synthetic Polynucleotide
taatacgactcactataggggtaagagtccccaaatggtggatcaagttcaacagaggagagaacttatgccaccatttaacctggcggcagcgcaaaagatg

SEQ ID NO: 84785 - DNA, 103 bp, Artificial Sequence
  Synthetic Polynucleotide
taatacgactcactatagggacaatgtaagagtccccaaatggtggatcaaacagaggagatgatccatgatttggggaaacctggcggcagcgcaaaagatg

SEQ ID NO: 84786 - DNA, 103 bp, Artificial Sequence
  Synthetic Polynucleotide
taatacgactcactatagggctatgacaatgtaagagtccccaaatggtgaacagaggagacaccatatggggactcttaacctggcggcagcgcaaaagatg

SEQ ID NO: 84787 - DNA, 103 bp, Artificial Sequence
  Synthetic Polynucleotide
taatacgactcactataggggactcctatgacaatgtaagagtccccaaaaacagaggagatttgggatgtcttacattaacctggcggcagcgcaaaagatg

SEQ ID NO: 84788 - DNA, 103 bp, Artificial Sequence
  Synthetic Polynucleotide
taatacgactcactatagggtccccgactcctatgacaatgtaagagtccaacagaggagaggactcatgcattgtcataacctggcggcagcgcaaaagatg

SEQ ID NO: 84789 - DNA, 103 bp, Artificial Sequence
  Synthetic Polynucleotide
taatacgactcactatagggtcttctccccgactcctatgacaatgtaagaacagaggagacttacaatgtcataggagaacctggcggcagcgcaaaagatg

SEQ ID NO: 84790 - DNA, 103 bp, Artificial Sequence
  Synthetic Polynucleotide
taatacgactcactataggggatcttcttctccccgactcctatgacaataacagaggagaattgtcatgggagtcgggaacctggcggcagcgcaaaagatg

SEQ ID NO: 84791 - DNA, 103 bp, Artificial Sequence
  Synthetic Polynucleotide
taatacgactcactatagggtgggtgatcttcttctccccgactcctatgaacagaggagacataggatgcggggagaaaacctggcggcagcgcaaaagatg

SEQ ID NO: 84792 - DNA, 103 bp, Artificial Sequence
  Synthetic Polynucleotide
taatacgactcactatagggtgatgggcccatgacccagcagaagtccggaacagaggagaccggacatgtgctgggtcaacctggcggcagcgcaaaagatg

SEQ ID NO: 84793 - DNA, 103 bp, Artificial Sequence
  Synthetic Polynucleotide
taatacgactcactatagggagtggtgggtgatcttcttctccccgactcaacagaggagagagtcgatgagaagaagaaacctggcggcagcgcaaaagatg

SEQ ID NO: 84794 - DNA, 103 bp, Artificial Sequence
  Synthetic Polynucleotide
taatacgactcactataggggtgccagtggtgggtgatcttcttctccccaacagaggagaggggagatgaagatcaccaacctggcggcagcgcaaaagatg

SEQ ID NO: 84795 - DNA, 103 bp, Artificial Sequence
  Synthetic Polynucleotide
taatacgactcactatagggctcctgtgccagtggtgggtgatcttcttcaacagaggagagaagaaatgcacccaccaaacctggcggcagcgcaaaagatg

SEQ ID NO: 84796 - DNA, 103 bp, Artificial Sequence
  Synthetic Polynucleotide
taatacgactcactatagggtgccactcctgtgccagtggtgggtgatctaacagaggagaagatcaatgaccactggcaacctggcggcagcgcaaaagatg

SEQ ID NO: 84797 - DNA, 103 bp, Artificial Sequence
  Synthetic Polynucleotide
taatacgactcactatagggggtgctgccactcctgtgccagtggtgggtaacagaggagaacccacatgtggcacaggaacctggcggcagcgcaaaagatg

SEQ ID NO: 84798 - DNA, 103 bp, Artificial Sequence
  Synthetic Polynucleotide
taatacgactcactatagggccaatggtgctgccactcctgtgccagtggaacagaggagaccactgatgcaggagtggaacctggcggcagcgcaaaagatg

SEQ ID NO: 84799 - DNA, 103 bp, Artificial Sequence
  Synthetic Polynucleotide
taatacgactcactatagggcttttccaatggtgctgccactcctgtgccaacagaggagaggcacaatggtggcagcaaacctggcggcagcgcaaaagatg

SEQ ID NO: 84800 - DNA, 103 bp, Artificial Sequence
  Synthetic Polynucleotide
taatacgactcactatagggaaatgcttttccaatggtgctgccactcctaacagaggagaaggagtatgagcaccattaacctggcggcagcgcaaaagatg

SEQ ID NO: 84801 - DNA, 103 bp, Artificial Sequence
  Synthetic Polynucleotide
taatacgactcactataggggcttcaaatgcttttccaatggtgctgccaaacagaggagatggcagatgcattggaaaaacctggcggcagcgcaaaagatg

SEQ ID NO: 84802 - DNA, 103 bp, Artificial Sequence
  Synthetic Polynucleotide
taatacgactcactatagggcagtggcttcaaatgcttttccaatggtgcaacagaggagagcaccaatggaaaagcataacctggcggcagcgcaaaagatg

SEQ ID NO: 84803 - DNA, 103 bp, Artificial Sequence
  Synthetic Polynucleotide
taatacgactcactatagggcatcctgatgggcccatgacccagcagaagaacagaggagacttctgatgggtcatgggaacctggcggcagcgcaaaagatg

SEQ ID NO: 84804 - DNA, 103 bp, Artificial Sequence
  Synthetic Polynucleotide
taatacgactcactatagggtctcacagtggcttcaaatgcttttccaataacagaggagaattggaatggcatttgaaaacctggcggcagcgcaaaagatg

SEQ ID NO: 84805 - DNA, 103 bp, Artificial Sequence
  Synthetic Polynucleotide
taatacgactcactataggggcacctctcacagtggcttcaaatgcttttaacagaggagaaaaagcatgtgaagccacaacctggcggcagcgcaaaagatg

SEQ ID NO: 84806 - DNA, 103 bp, Artificial Sequence
  Synthetic Polynucleotide
taatacgactcactatagggtcttggcacctctcacagtggcttcaaatgaacagaggagacatttgatgccactgtgaaacctggcggcagcgcaaaagatg

SEQ ID NO: 84807 - DNA, 103 bp, Artificial Sequence
  Synthetic Polynucleotide
taatacgactcactatagggcattctcttggcacctctcacagtggcttcaacagaggagagaagccatggtgagaggtaacctggcggcagcgcaaaagatg

SEQ ID NO: 84808 - DNA, 103 bp, Artificial Sequence
  Synthetic Polynucleotide
taatacgactcactatagggactgccattctcttggcacctctcacagtgaacagaggagacactgtatgaggtgccaaaacctggcggcagcgcaaaagatg

SEQ ID NO: 84809 - DNA, 103 bp, Artificial Sequence
  Synthetic Polynucleotide
taatacgactcactatagggccaagactgccattctcttggcacctctcaaacagaggagatgagagatgccaagagaaaacctggcggcagcgcaaaagatg

SEQ ID NO: 84810 - DNA, 103 bp, Artificial Sequence
  Synthetic Polynucleotide
taatacgactcactataggggtctcccaagactgccattctcttggcaccaacagaggagaggtgccatgagaatggcaaacctggcggcagcgcaaaagatg

SEQ ID NO: 84811 - DNA, 103 bp, Artificial Sequence
  Synthetic Polynucleotide
taatacgactcactataggggctgtgtctcccaagactgccattctcttgaacagaggagacaagagatgggcagtcttaacctggcggcagcgcaaaagatg

SEQ ID NO: 84812 - DNA, 103 bp, Artificial Sequence
  Synthetic Polynucleotide
taatacgactcactatagggcccaggctgtgtctcccaagactgccattcaacagaggagagaatggatgtcttgggagaacctggcggcagcgcaaaagatg

SEQ ID NO: 84813 - DNA, 103 bp, Artificial Sequence
  Synthetic Polynucleotide
taatacgactcactatagggaaagtcccaggctgtgtctcccaagactgcaacagaggagagcagtcatgggagacacaaacctggcggcagcgcaaaagatg

SEQ ID NO: 84814 - DNA, 103 bp, Artificial Sequence
  Synthetic Polynucleotide
taatacgactcactatagggaagaccatcctgatgggcccatgacccagcaacagaggagagctgggatgtgggcccataacctggcggcagcgcaaaagatg

SEQ ID NO: 84815 - DNA, 103 bp, Artificial Sequence
  Synthetic Polynucleotide
taatacgactcactataggggatccaaagtcccaggctgtgtctcccaagaacagaggagacttgggatgcacagcctgaacctggcggcagcgcaaaagatg

SEQ ID NO: 84816 - DNA, 103 bp, Artificial Sequence
  Synthetic Polynucleotide
taatacgactcactatagggcaactgatccaaagtcccaggctgtgtctcaacagaggagagagacaatgcctgggactaacctggcggcagcgcaaaagatg

SEQ ID NO: 84817 - DNA, 103 bp, Artificial Sequence
  Synthetic Polynucleotide
taatacgactcactataggggcctccaactgatccaaagtcccaggctgtaacagaggagaacagccatggactttggaaacctggcggcagcgcaaaagatg

SEQ ID NO: 84818 - DNA, 103 bp, Artificial Sequence
  Synthetic Polynucleotide
taatacgactcactatagggagagcgcctccaactgatccaaagtcccagaacagaggagactgggaatgtggatcagtaacctggcggcagcgcaaaagatg

SEQ ID NO: 84819 - DNA, 103 bp, Artificial Sequence
  Synthetic Polynucleotide
taatacgactcactatagggagttgagagcgcctccaactgatccaaagtaacagaggagaactttgatgcagttggagaacctggcggcagcgcaaaagatg

SEQ ID NO: 84820 - DNA, 103 bp, Artificial Sequence
  Synthetic Polynucleotide
taatacgactcactatagggcaatgagttgagagcgcctccaactgatccaacagaggagaggatcaatgggaggcgctaacctggcggcagcgcaaaagatg

SEQ ID NO: 84821 - DNA, 103 bp, Artificial Sequence
  Synthetic Polynucleotide
taatacgactcactatagggttgcccaatgagttgagagcgcctccaactaacagaggagaagttggatgcgctctcaaaacctggcggcagcgcaaaagatg

SEQ ID NO: 84822 - DNA, 103 bp, Artificial Sequence
  Synthetic Polynucleotide
taatacgactcactatagggtgcccttgcccaatgagttgagagcgcctcaacagaggagagaggcgatgtcaactcataacctggcggcagcgcaaaagatg

SEQ ID NO: 84823 - DNA, 103 bp, Artificial Sequence
  Synthetic Polynucleotide
taatacgactcactatagggatggatgcccttgcccaatgagttgagagcaacagaggagagctctcatgtcattgggcaacctggcggcagcgcaaaagatg

SEQ ID NO: 84824 - DNA, 103 bp, Artificial Sequence
  Synthetic Polynucleotide
taatacgactcactatagggatttgatggatgcccttgcccaatgagttgaacagaggagacaactcatggggcaagggaacctggcggcagcgcaaaagatg

SEQ ID NO: 84825 - DNA, 103 bp, Artificial Sequence
  Synthetic Polynucleotide
taatacgactcactatagggttgccaagaccatcctgatgggcccatgacaacagaggagagtcatgatgccatcaggaaacctggcggcagcgcaaaagatg

SEQ ID NO: 84826 - DNA, 103 bp, Artificial Sequence
  Synthetic Polynucleotide
taatacgactcactatagggcaaaaatttgatggatgcccttgcccaatgaacagaggagacattggatgagggcatccaacctggcggcagcgcaaaagatg

SEQ ID NO: 84827 - DNA, 103 bp, Artificial Sequence
  Synthetic Polynucleotide
taatacgactcactatagggtgctccaaaaatttgatggatgcccttgccaacagaggagaggcaagatgatccatcaaaacctggcggcagcgcaaaagatg

SEQ ID NO: 84828 - DNA, 103 bp, Artificial Sequence
  Synthetic Polynucleotide
taatacgactcactatagggaaagctgctccaaaaatttgatggatgcccaacagaggagagggcatatgtcaaattttaacctggcggcagcgcaaaagatg

SEQ ID NO: 84829 - DNA, 103 bp, Artificial Sequence
  Synthetic Polynucleotide
taatacgactcactatagggatttgaaagctgctccaaaaatttgatggaaacagaggagatccatcatgtttttggagaacctggcggcagcgcaaaagatg

SEQ ID NO: 84830 - DNA, 103 bp, Artificial Sequence
  Synthetic Polynucleotide
taatacgactcactatagggcaatgatttgaaagctgctccaaaaatttgaacagaggagacaaattatgggagcagctaacctggcggcagcgcaaaagatg

SEQ ID NO: 84831 - DNA, 103 bp, Artificial Sequence
  Synthetic Polynucleotide
taatacgactcactatagggccaaacaatgatttgaaagctgctccaaaaaacagaggagattttggatgagctttcaaaacctggcggcagcgcaaaagatg

SEQ ID NO: 84832 - DNA, 103 bp, Artificial Sequence
  Synthetic Polynucleotide
taatacgactcactatagggttcctccaaacaatgatttgaaagctgctcaacagaggagagagcagatgtcaaatcataacctggcggcagcgcaaaagatg

SEQ ID NO: 84833 - DNA, 103 bp, Artificial Sequence
  Synthetic Polynucleotide
taatacgactcactatagggggacattcctccaaacaatgatttgaaagcaacagaggagagctttcatgtcattgtttaacctggcggcagcgcaaaagatg

SEQ ID NO: 84834 - DNA, 103 bp, Artificial Sequence
  Synthetic Polynucleotide
taatacgactcactatagggaaccaggacattcctccaaacaatgatttgaacagaggagacaaatcatggtttggaggaacctggcggcagcgcaaaagatg

SEQ ID NO: 84835 - DNA, 103 bp, Artificial Sequence
  Synthetic Polynucleotide
taatacgactcactataggggtgagaaccaggacattcctccaaacaatgaacagaggagacattgtatggaggaatgtaacctggcggcagcgcaaaagatg

SEQ ID NO: 84836 - DNA, 103 bp, Artificial Sequence
  Synthetic Polynucleotide
taatacgactcactatagggtagaattgccaagaccatcctgatgggcccaacagaggagagggcccatgaggatggtcaacctggcggcagcgcaaaagatg

SEQ ID NO: 84837 - DNA, 103 bp, Artificial Sequence
  Synthetic Polynucleotide
taatacgactcactataggggatttgtgagaaccaggacattcctccaaaaacagaggagatttggaatgatgtcctggaacctggcggcagcgcaaaagatg

SEQ ID NO: 84838 - DNA, 103 bp, Artificial Sequence
  Synthetic Polynucleotide
taatacgactcactatagggatgaggatttgtgagaaccaggacattcctaacagaggagaaggaatatgctggttctcaacctggcggcagcgcaaaagatg

SEQ ID NO: 84839 - DNA, 103 bp, Artificial Sequence
  Synthetic Polynucleotide
taatacgactcactatagggttccaatgaggatttgtgagaaccaggacaaacagaggagatgtcctatgtctcacaaaaacctggcggcagcgcaaaagatg

SEQ ID NO: 84840 - DNA, 103 bp, Artificial Sequence
  Synthetic Polynucleotide
taatacgactcactatagggcaacgttccaatgaggatttgtgagaaccaaacagaggagatggttcatgcaaatcctcaacctggcggcagcgcaaaagatg

SEQ ID NO: 84841 - DNA, 103 bp, Artificial Sequence
  Synthetic Polynucleotide
taatacgactcactatagggatcagcaacgttccaatgaggatttgtgagaacagaggagactcacaatgcctcattggaacctggcggcagcgcaaaagatg

SEQ ID NO: 84842 - DNA, 103 bp, Artificial Sequence
  Synthetic Polynucleotide
taatacgactcactatagggaccacatcagcaacgttccaatgaggatttaacagaggagaaaatccatgttggaacgtaacctggcggcagcgcaaaagatg

SEQ ID NO: 84843 - DNA, 103 bp, Artificial Sequence
  Synthetic Polynucleotide
taatacgactcactatagggacccaaccacatcagcaacgttccaatgagaacagaggagactcattatgacgttgctgaacctggcggcagcgcaaaagatg

SEQ ID NO: 84844 - DNA, 103 bp, Artificial Sequence
  Synthetic Polynucleotide
taatacgactcactatagggttcagacccaaccacatcagcaacgttccaaacagaggagatggaacatggctgatgtgaacctggcggcagcgcaaaagatg

SEQ ID NO: 84845 - DNA, 103 bp, Artificial Sequence
  Synthetic Polynucleotide
taatacgactcactatagggttgtgttcagacccaaccacatcagcaacgaacagaggagacgttgcatgtgtggttggaacctggcggcagcgcaaaagatg

SEQ ID NO: 84846 - DNA, 103 bp, Artificial Sequence
  Synthetic Polynucleotide
taatacgactcactatagggattctttgtgttcagacccaaccacatcagaacagaggagactgatgatgttgggtctgaacctggcggcagcgcaaaagatg

SEQ ID NO: 84847 - DNA, 103 bp, Artificial Sequence
  Synthetic Polynucleotide
taatacgactcactatagggaaggctagaattgccaagaccatcctgatgaacagaggagacatcagatgggtcttggcaacctggcggcagcgcaaaagatg

SEQ ID NO: 84848 - DNA, 103 bp, Artificial Sequence
  Synthetic Polynucleotide
taatacgactcactataggggatccattctttgtgttcagacccaaccacaacagaggagagtggttatgtctgaacacaacctggcggcagcgcaaaagatg

SEQ ID NO: 84849 - DNA, 103 bp, Artificial Sequence
  Synthetic Polynucleotide
taatacgactcactatagggaaatagatccattctttgtgttcagacccaaacagaggagatgggtcatgacacaaagaaacctggcggcagcgcaaaagatg

SEQ ID NO: 84850 - DNA, 103 bp, Artificial Sequence
  Synthetic Polynucleotide
taatacgactcactatagggaagggaaatagatccattctttgtgttcagaacagaggagactgaacatgaagaatggaaacctggcggcagcgcaaaagatg

SEQ ID NO: 84851 - DNA, 103 bp, Artificial Sequence
  Synthetic Polynucleotide
taatacgactcactatagggcacataagggaaatagatccattctttgtgaacagaggagacacaaaatgtggatctataacctggcggcagcgcaaaagatg

SEQ ID NO: 84852 - DNA, 103 bp, Artificial Sequence
  Synthetic Polynucleotide
taatacgactcactatagggccaagcacataagggaaatagatccattctaacagaggagaagaatgatgctatttcccaacctggcggcagcgcaaaagatg

SEQ ID NO: 84853 - DNA, 103 bp, Artificial Sequence
  Synthetic Polynucleotide
taatacgactcactatagggtaaggccaagcacataagggaaatagatccaacagaggagaggatctatgtcccttatgaacctggcggcagcgcaaaagatg

SEQ ID NO: 84854 - DNA, 103 bp, Artificial Sequence
  Synthetic Polynucleotide
taatacgactcactatagggccccctaaggccaagcacataagggaaataaacagaggagatatttcatgtatgtgcttaacctggcggcagcgcaaaagatg

SEQ ID NO: 84855 - DNA, 103 bp, Artificial Sequence
  Synthetic Polynucleotide
taatacgactcactatagggacactccccctaaggccaagcacataagggaacagaggagacccttaatggcttggcctaacctggcggcagcgcaaaagatg

SEQ ID NO: 84856 - DNA, 103 bp, Artificial Sequence
  Synthetic Polynucleotide
taatacgactcactataggggatcaacactccccctaaggccaagcacataacagaggagaatgtgcatggccttagggaacctggcggcagcgcaaaagatg

SEQ ID NO: 84857 - DNA, 103 bp, Artificial Sequence
  Synthetic Polynucleotide
taatacgactcactatagggaagaagatcaacactccccctaaggccaagaacagaggagacttggcatgagggggagtaacctggcggcagcgcaaaagatg

SEQ ID NO: 84858 - DNA, 103 bp, Artificial Sequence
  Synthetic Polynucleotide
taatacgactcactatagggtcaaaaaggctagaattgccaagaccatccaacagaggagaggatggatgtggcaattcaacctggcggcagcgcaaaagatg

SEQ ID NO: 84859 - DNA, 103 bp, Artificial Sequence
  Synthetic Polynucleotide
taatacgactcactatagggtggataagaagatcaacactccccctaaggaacagaggagaccttagatggagtgttgaaacctggcggcagcgcaaaagatg

SEQ ID NO: 84860 - DNA, 103 bp, Artificial Sequence
  Synthetic Polynucleotide
taatacgactcactatagggggctgtggataagaagatcaacactcccccaacagaggagagggggaatgttgatcttcaacctggcggcagcgcaaaagatg

SEQ ID NO: 84861 - DNA, 103 bp, Artificial Sequence
  Synthetic Polynucleotide
taatacgactcactataggggagacggctgtggataagaagatcaacactaacagaggagaagtgttatgcttcttatcaacctggcggcagcgcaaaagatg

SEQ ID NO: 84862 - DNA, 103 bp, Artificial Sequence
  Synthetic Polynucleotide
taatacgactcactatagggcagcagagacggctgtggataagaagatcaaacagaggagatgatctatgtatccacagaacctggcggcagcgcaaaagatg

SEQ ID NO: 84863 - DNA, 103 bp, Artificial Sequence
  Synthetic Polynucleotide
taatacgactcactatagggcacatcagcagagacggctgtggataagaaaacagaggagattcttaatgacagccgtcaacctggcggcagcgcaaaagatg

SEQ ID NO: 84864 - DNA, 103 bp, Artificial Sequence
  Synthetic Polynucleotide
taatacgactcactatagggcaccccacatcagcagagacggctgtggataacagaggagaatccacatgcgtctctgcaacctggcggcagcgcaaaagatg

SEQ ID NO: 84865 - DNA, 103 bp, Artificial Sequence
  Synthetic Polynucleotide
taatacgactcactatagggccgagcaccccacatcagcagagacggctgaacagaggagacagccgatgctgctgatgaacctggcggcagcgcaaaagatg

SEQ ID NO: 84866 - DNA, 103 bp, Artificial Sequence
  Synthetic Polynucleotide
taatacgactcactataggggtccaccgagcaccccacatcagcagagacaacagaggagagtctctatggatgtggggaacctggcggcagcgcaaaagatg

SEQ ID NO: 84867 - DNA, 103 bp, Artificial Sequence
  Synthetic Polynucleotide
taatacgactcactataggggagaagtccaccgagcaccccacatcagcaaacagaggagatgctgaatgggggtgctcaacctggcggcagcgcaaaagatg

SEQ ID NO: 84868 - DNA, 103 bp, Artificial Sequence
  Synthetic Polynucleotide
taatacgactcactatagggtctttgagaagtccaccgagcaccccacataacagaggagaatgtggatggctcggtggaacctggcggcagcgcaaaagatg

SEQ ID NO: 84869 - DNA, 103 bp, Artificial Sequence
  Synthetic Polynucleotide
taatacgactcactatagggttcgcttcaaactcgaactgtcgcagtctgaacagaggagacagactatgacagttcgaaacctggcggcagcgcaaaagatg

SEQ ID NO: 84870 - DNA, 103 bp, Artificial Sequence
  Synthetic Polynucleotide
taatacgactcactataggggaatctcaaaaaggctagaattgccaagacaacagaggagagtcttgatgattctagccaacctggcggcagcgcaaaagatg

SEQ ID NO: 84871 - DNA, 103 bp, Artificial Sequence
  Synthetic Polynucleotide
taatacgactcactatagggctccttctttgagaagtccaccgagcacccaacagaggagagggtgcatggtggacttcaacctggcggcagcgcaaaagatg

SEQ ID NO: 84872 - DNA, 103 bp, Artificial Sequence
  Synthetic Polynucleotide
taatacgactcactatagggctcgtctccttctttgagaagtccaccgagaacagaggagactcggtatgcttctcaaaaacctggcggcagcgcaaaagatg

SEQ ID NO: 84873 - DNA, 103 bp, Artificial Sequence
  Synthetic Polynucleotide
taatacgactcactatagggcgcatctcgtctccttctttgagaagtccaaacagaggagatggactatgcaaagaaggaacctggcggcagcgcaaaagatg

SEQ ID NO: 84874 - DNA, 103 bp, Artificial Sequence
  Synthetic Polynucleotide
taatacgactcactatagggtgtaccgcatctcgtctccttctttgagaaaacagaggagattctcaatgaaggagacgaacctggcggcagcgcaaaagatg

SEQ ID NO: 84875 - DNA, 103 bp, Artificial Sequence
  Synthetic Polynucleotide
taatacgactcactatagggacccctgtaccgcatctcgtctccttctttaacagaggagaaaagaaatggacgagatgaacctggcggcagcgcaaaagatg

SEQ ID NO: 84876 - DNA, 103 bp, Artificial Sequence
  Synthetic Polynucleotide
taatacgactcactatagggcgaacacccctgtaccgcatctcgtctcctaacagaggagaaggagaatggatgcggtaaacctggcggcagcgcaaaagatg

SEQ ID NO: 84877 - DNA, 103 bp, Artificial Sequence
  Synthetic Polynucleotide
taatacgactcactatagggatagacgaacacccctgtaccgcatctcgtaacagaggagaacgagaatgggtacagggaacctggcggcagcgcaaaagatg

SEQ ID NO: 84878 - DNA, 103 bp, Artificial Sequence
  Synthetic Polynucleotide
taatacgactcactatagggtcgttatagacgaacacccctgtaccgcataacagaggagaatgcggatgaggggtgttaacctggcggcagcgcaaaagatg

SEQ ID NO: 84879 - DNA, 103 bp, Artificial Sequence
  Synthetic Polynucleotide
taatacgactcactatagggcaacgtcgttatagacgaacacccctgtacaacagaggagagtacagatgtgttcgtctaacctggcggcagcgcaaaagatg

SEQ ID NO: 84880 - DNA, 103 bp, Artificial Sequence
  Synthetic Polynucleotide
taatacgactcactatagggggcttcaacgtcgttatagacgaacaccccaacagaggagaggggtgatggtctataacaacctggcggcagcgcaaaagatg

SEQ ID NO: 84881 - DNA, 103 bp, Artificial Sequence
  Synthetic Polynucleotide
taatacgactcactataggggccgtgaatctcaaaaaggctagaattgccaacagaggagaggcaatatgagcctttttaacctggcggcagcgcaaaagatg

SEQ ID NO: 84882 - DNA, 103 bp, Artificial Sequence
  Synthetic Polynucleotide
taatacgactcactatagggctccaggcttcaacgtcgttatagacgaacaacagaggagagttcgtatgtaacgacgtaacctggcggcagcgcaaaagatg

SEQ ID NO: 84883 - DNA, 103 bp, Artificial Sequence
  Synthetic Polynucleotide
taatacgactcactatagggtgtccctccaggcttcaacgtcgttatagaaacagaggagatctataatgacgttgaagaacctggcggcagcgcaaaagatg

SEQ ID NO: 84884 - DNA, 103 bp, Artificial Sequence
  Synthetic Polynucleotide
taatacgactcactataggggtacctgtccctccaggcttcaacgtcgttaacagaggagaaacgacatggaagcctggaacctggcggcagcgcaaaagatg

SEQ ID NO: 84885 - DNA, 103 bp, Artificial Sequence
  Synthetic Polynucleotide
taatacgactcactatagggtacttgtacctgtccctccaggcttcaacgaacagaggagacgttgaatgctggagggaaacctggcggcagcgcaaaagatg

SEQ ID NO: 84886 - DNA, 103 bp, Artificial Sequence
  Synthetic Polynucleotide
taatacgactcactataggggatggtacttgtacctgtccctccaggcttaacagaggagaaagcctatggggacaggtaacctggcggcagcgcaaaagatg

SEQ ID NO: 84887 - DNA, 103 bp, Artificial Sequence
  Synthetic Polynucleotide
taatacgactcactataggggtcaggatggtacttgtacctgtccctccaaacagaggagatggaggatgaggtacaagaacctggcggcagcgcaaaagatg

SEQ ID NO: 84888 - DNA, 103 bp, Artificial Sequence
  Synthetic Polynucleotide
taatacgactcactatagggggggagtcaggatggtacttgtacctgtccaacagaggagaggacagatgcaagtaccaaacctggcggcagcgcaaaagatg

SEQ ID NO: 84889 - DNA, 103 bp, Artificial Sequence
  Synthetic Polynucleotide
taatacgactcactatagggtacggggggagtcaggatggtacttgtaccaacagaggagaggtacaatgaccatcctgaacctggcggcagcgcaaaagatg

SEQ ID NO: 84890 - DNA, 103 bp, Artificial Sequence
  Synthetic Polynucleotide
taatacgactcactatagggcaatctacggggggagtcaggatggtacttaacagaggagaaagtacatgcctgactccaacctggcggcagcgcaaaagatg

SEQ ID NO: 84891 - DNA, 103 bp, Artificial Sequence
  Synthetic Polynucleotide
taatacgactcactataggggctgccaatctacggggggagtcaggatggaacagaggagaccatccatgctccccccgaacctggcggcagcgcaaaagatg

SEQ ID NO: 84892 - DNA, 103 bp, Artificial Sequence
  Synthetic Polynucleotide
taatacgactcactatagggtgattgccgtgaatctcaaaaaggctagaaaacagaggagattctagatgttttgagataacctggcggcagcgcaaaagatg

SEQ ID NO: 84893 - DNA, 103 bp, Artificial Sequence
  Synthetic Polynucleotide
taatacgactcactatagggctgctgctgccaatctacggggggagtcagaacagaggagactgactatgcccgtagataacctggcggcagcgcaaaagatg

SEQ ID NO: 84894 - DNA, 103 bp, Artificial Sequence
  Synthetic Polynucleotide
taatacgactcactatagggcttgactgctgctgccaatctacggggggaaacagaggagatcccccatgagattggcaaacctggcggcagcgcaaaagatg

SEQ ID NO: 84895 - DNA, 103 bp, Artificial Sequence
  Synthetic Polynucleotide
taatacgactcactataggggcttgcttgactgctgctgccaatctacggaacagaggagaccgtagatgggcagcagcaacctggcggcagcgcaaaagatg

SEQ ID NO: 84896 - DNA, 103 bp, Artificial Sequence
  Synthetic Polynucleotide
taatacgactcactatagggcccaggcttgcttgactgctgctgccaatcaacagaggagagattggatgcagcagtcaaacctggcggcagcgcaaaagatg

SEQ ID NO: 84897 - DNA, 103 bp, Artificial Sequence
  Synthetic Polynucleotide
taatacgactcactatagggatcttcccaggcttgcttgactgctgctgcaacagaggagagcagcaatggtcaagcaaaacctggcggcagcgcaaaagatg

SEQ ID NO: 84898 - DNA, 103 bp, Artificial Sequence
  Synthetic Polynucleotide
taatacgactcactatagggataccatcttcccaggcttgcttgactgctaacagaggagaagcagtatggcaagcctgaacctggcggcagcgcaaaagatg

SEQ ID NO: 84899 - DNA, 103 bp, Artificial Sequence
  Synthetic Polynucleotide
taatacgactcactatagggcgcagataccatcttcccaggcttgcttgaaacagaggagatcaagcatgcctgggaagaacctggcggcagcgcaaaagatg

SEQ ID NO: 84900 - DNA, 103 bp, Artificial Sequence
  Synthetic Polynucleotide
taatacgactcactataggggatcccgcagataccatcttcccaggcttgaacagaggagacaagccatggaagatggtaacctggcggcagcgcaaaagatg

SEQ ID NO: 84901 - DNA, 103 bp, Artificial Sequence
  Synthetic Polynucleotide
taatacgactcactataggggaggagatcccgcagataccatcttcccagaacagaggagactgggaatgtggtatctgaacctggcggcagcgcaaaagatg

SEQ ID NO: 84902 - DNA, 103 bp, Artificial Sequence
  Synthetic Polynucleotide
taatacgactcactatagggaaacagaggagatcccgcagataccatcttaacagaggagaaagatgatgtctgcgggaaacctggcggcagcgcaaaagatg

SEQ ID NO: 84903 - DNA, 103 bp, Artificial Sequence
  Synthetic Polynucleotide
taatacgactcactatagggtggcttgattgccgtgaatctcaaaaaggcaacagaggagagcctttatgagattcacgaacctggcggcagcgcaaaagatg
